United States Patent 9,061,059 (MODIFIED POLYNUCLEOTIDES FOR TREATING PROTEIN DEFICIENCY) - sequence listing, part 102

SEQ ID NO: 199405 - DNA, 2250 bp, Artificial Sequence
  Description of Artificial Sequence: Synthetic coding sequence
atgacccacgaggagcaccacgccgccaagaccctgggcatcggcaaagcaattgcggtccttacaagcggaggagacgcccaaggaatgaacgcggccgtcagagctgtggtccgggttggaatctttactggggcccgcgtgttctttgtgcatgaaggctaccagggcctcgtcgatggaggggatcacatcaaggaagccacctgggagagtgtgtcaatgatgctgcagctgggggggactgtgatcgggtctgccagatgtaaagatttccgcgagcgagaaggtaggttaagagctgcgtataacctagtcaagcggggtataactaacctctgtgttattgggggggacggttcccttactggggccgatacgttccgctccgagtggagcgacttactgtcagacttacagaaggctggtaagataactgatgaagaagccaccaaaagctcctatctcaacatcgtggggctcgtcggttctattgacaacgatttctgcggaacagacatgaccatcggaaccgactcggccctacatagaattatggagattgttgacgcaataactactaccgcacagtcacaccagcggacattcgttcttgaagtgatgggccgccattgcggatatctggctctggtgacaagtctcagctgcggtgccgactgggtgtttattcctgagtgtccaccggatgacgattgggaagaacatttgtgtcggagattgtccgagacaagaaccagagggtcacgcctgaatatcatcatcgttgctgaaggagcaattgacaagaatggaaaaccaattactagtgaggacatcaaaaacggtagtcggatgggagtggaggcagtaatggccctgctggagggcacccctgatactcctgcctgcgtggtatccctctccgggaaccaggcagtccggcttcccttaatggagtgtgtgcaggtgacaaaggacgttacaaaagcaatggacgaaaagaagtttgacgaagccctgaagctccgcggtcggagttttatgaacaattgggaggtgtacaagctcttagcccacgtcagaccaccagtgtccaagtccggatctcatacagtggctgtaatgaacgtgggcgcccctgctgcgggcatgaatgctgccgtgaggtccacggtgaggattgggctcatacagggtaacagggtattggtggtccatgacggtttcgaggggctggccaagggtcagatagaagaagcaggttggagctacgtgggaggctggacgggccagggcgggagcaaactgggaaccaaaaggacacttcctaagaaatcatttgagcagattagcgccaatatcactaagtttaacatccagggtctcgttatcatcggtgggttcgaggcctacacgggcggattggagctgatggagggcaggaaacagtttgatgaactgtgcatccccttcgtcgtcattcccgcaactgtcagcaacaacgtccccggatcagacttttctgttggggctgatacggccctgaatactatctgcacaacatgcgacaggattaagcagtccgccgcaggcaccaagaggagggtttttataatagaaactatgggcggatattgtgggtacttagcaactatggctggattggctgcaggagctgatgcagcttacattttcgaggaaccgttcacaatccgagatctgcaggctaacgtggaacacctcgtgcagaagatgaaaacaacagtcaaaagagggctagtactgaggaacgagaagtgtaacgaaaactacactacagatttcatttttaatctctattcagaggaggggaagggcattttcgacagtcggaaaaacgttttaggccatatgcagcagggtggaagccctacgcccttcgaccggaactttgctaccaaaatgggcgccaaagccatgaattggatgtccgggaaaatcaaggagtcttatcggaatggacggattttcgcaaacacgcctgactctgggtgcgtcctgggtatgagaaagcgggcactcgttttccagcccgtggccgaactgaaagatcagaccgatttcgagcatagaatcccgaaagagcagtggtggcttaaactgagaccaatcttgaaaattctggcaaaatacgagatcgacttggatacttccgatcacgcccaccttgagcatattacaagaaagagaagtggggaggcagctgtctag

SEQ ID NO: 199406 - DNA, 609 bp, Artificial Sequence
  Description of Artificial Sequence: Synthetic coding sequence
atgggcggctactgcggctacctggccaacatgggcggcctggccgccggcgctgacgcagcatacattttcgaagagccattcgacatccgtgacttgcagtcaaatgttgagcatttgaccgagaagatgaaaacaactattcagcgcggtcttgtgctcaggaatgaatcatgtagtgaaaactacaccactgattttatttatcagttatacagcgaagagggcaagggggtcttcgattgccgcaagaacgttctgggtcacatgcaacaaggaggcgcacccagtccttttgataggaatttcggaactaagatttctgccagggctatggaatggatcactgcgaagctgaaagaagcgagaggcaggggaaagaaatttaccactgacgattctatctgcgtactggggatatccaagcggaatgtcatctttcaacctgtggccgagttgaaaaaacagacagatttcgaacacagaataccaaaagagcaatggtggctgaagcttaggcctctcatgaaaattctcgctaagtataaggccagttacgatgtttcagacagcggacagcttgaacatgtgcagccctggtcggtgtag

SEQ ID NO: 199407 - DNA, 2331 bp, Artificial Sequence
  Description of Artificial Sequence: Synthetic coding sequence
atgtgcggctacgagcggtgccggccctgccggggcgcccacggctatcttcgaggaggccagggagtgctgcacctgcgtggtctccctgggcacgggggaagaagattgaaacaccgcaggggcagactgggggagtgcttgcagcacccagcttcgggcgcggtccggggcgattggagagagaagccaggctgttggtcccatcgctttccctgtccaggacgacacgctctcgtggggggcaccattatcgggtctgctaggtgtcaggcatttcggacccgggaaggccgtctgaaggctgcctgtaatctattacagcggggtatcacgaatttgtgtgtcataggcggcgacggctcactgacaggggccaacttgttccgtaaagagtggtctggtcttctggaagagcttgccaggaacggacagatagacaaagaggccgtacagaaatacgcatacttgaacgtagtaggcatggtggggtccatcgataatgatttctgtggcaccgatatgaccataggaactgacagcgcactacacaggatcattgaggtggtggatgcaatcatgacgacagcccagagccatcagcggacctttgtgctggaggtcatgggtcgccactgcggctatttagcattagtcagtgccctggcttgtggagctgattgggtgttccttccggaatcccctccagaggagggatgggaggagcagatgtgtgtcaagttgtctgaaaaccgagctcggaagaaaagactgaatatcattatcgtcgccgaaggggcaatcgacacccagaacaagcccattacctccgaaaagatcaaagaactcgtggtcacacagctgggctatgacactcgtgtcactattcttggacacgtccagcggggaggcactccttccgccttcgatagaatcctggcctctagaatgggagttgaagccgttatcgccctactagaggcgacacctgataccccagcttgcgtcgtgagtcttaacggcaaccatgccgtgagactaccactaatggagtgcgtgcagatgacccaggatgtccagaaggcaatggacgaacgaagatttcaggatgcggtgcgcctgcgaggtcgcagcttcgcaggaaatctgaatacctataaaagactcgcaatcaaacttcctgacgaccagatcccgaagacaaattgcaatgtagctgtcatcaatgtgggcgcccctgccgctggaatgaatgccgctgtccggtccgccgtgagggtagggattgcagatggccaccgcatgctggccatttacgatggatttgacggctttgcaaaaggtcagattaaagagattgggtggactgacgtcggaggatggaccggccagggcgggtccatcctcggcaccaagcgagttttaccaggaaaatatctggaggagatcgcgactcagatgcgcacccatagcattaatgccctgctaatcatcgggggcttcgaagcctatttgggactgttggagctctccgcagctagagagaagcacgaggagttttgtgtccccatggtaatggtgccggccaccgtatcaaataatgttccaggctcagacttttccattggcgctgataccgcccttaacactattacagacacttgtgaccgcattaaacagtcagcttctggtacaaagagaagggtgttcataatcgagactatgggcgggtactgcggctatcttgcaaatatgggcggcttagcagccggtgccgatgcagcttacatttttgaagaaccattcgacatccgcgatctccagagcaatgtagaacacctgaccgagaagatgaagaccacaattcagcggggactcgtacttcggaacgagtcatgcagtgaaaattacaccaccgactttatctatcagctctatagtgaggaaggcaaaggtgtatttgattgccgaaaaaatgtcctggggcacatgcaacagggtggagcgccatccccttttgatcggaactttggcaccaaaatttcagcgagagcaatggaatggattaccgctaagctaaaggaagcaaggggacgtggcaaaaaatttaccactgatgactctatttgcgtgctgggaatcagcaaacgaaatgtgatcttccagcccgtcgctgaactgaagaagcagacggacttcgaacatagaatcccaaaggagcagtggtggctcaagctgcgccctctcatgaaaatcctggcgaaatacaaagcatcctacgatgtatcagacagtggccagctggagcacgtgcagccatggtccgtgtag

SEQ ID NO: 199408 - DNA, 2355 bp, Artificial Sequence
  Description of Artificial Sequence: Synthetic coding sequence
atggacgccgacgacagccgggcccccaagggcagcctgcggaagttcttagagcatctgagcggagcaggaaaggctattggcgtgctcacttctggaggagatgctcaggggatgaatgccgcagtccgggcggtcgtgcgcatgggcatttacgttggagccaaagtgtacttcatctatgaggggtaccaaggaatggtcgacggaggatccaatattgctgaggcagattgggaaagtgtaagctccatcctccaggtaggcggcacgattattggcagtgcacggtgtcaggcctttcggacccgcgaaggtcgccttaaggcagcctgtaatctactgcagagaggcatcaccaatctgtgtgtcattgggggggacggttccctgacaggggctaacctattccgaaaagagtggtctgggcttctggaggagcttgctcgcaacgggcaaatcgacaaggaagcagtccaaaagtacgcatacctgaacgttgtgggtatggtcggcagcattgataatgatttttgtggcacagacatgactataggcacagactccgccttgcatcgaattatagaggttgtggacgccataatgacaaccgctcagtctcatcagaggacctttgtgctggaagtgatgggccgacactgcggctatcttgccctggtgtccgcactggcctgcggtgctgactgggtgtttctacctgagtctccaccagaggagggatgggaggaacagatgtgcgtaaagttgtccgaaaatcgggcgcgtaagaagcgtctcaatataataatcgtcgcggaaggtgcgatcgacacccagaataagccgattaccagtgagaagattaaggagttggtcgtgacgcagttgggctacgacacacgcgtcaccattctcggacacgtacaaagaggaggtacaccttccgccttcgatcggattttggccagtagaatgggagttgaggccgtgatcgccctgctcgaagcaacacccgatacccccgcatgtgtcgtgtcactcaatggaaatcacgcagtgcgtttgcccttaatggaatgcgtgcagatgacccaagatgtgcagaaagccatggatgaacgtcggtttcaggacgcagtcaggcttcgcggccggagtttcgctggaaacctgaacacttacaagcgcctggccattaagctgcccgacgaccagatcccaaaaacaaactgcaatgtggccgtgataaacgtcggggcccctgcagccggcatgaacgcagcagtgcgaagcgctgtaagggtgggaatcgctgacgggcatcggatgttagctatttacgacggctttgatgggttcgccaagggacagatcaaggagatcggctggaccgacgttggtggctggaccggccaggggggtagtatcctcggaaccaagagggtgctccccgggaagtacctggaggaaatcgccactcaaatgcgaacccactctatcaacgctctgctcattatcggcggattcgaggcatatttgggcttactggaattgtccgctgcacgggagaagcacgaagaattctgtgtccctatggtcatggtgccagccacagtcagcaataacgtcccagggtccgacttttctattggcgcagacacggccttaaacactatcacagatacatgcgatcggattaagcagtctgctagcggaactaagcgccgagtgttcatcatagaaacaatgggtggttactgtggttacctagccaacatgggtgggctggcggcaggcgctgacgccgcctacatcttcgaagagccctttgatatacgggatctccagtcaaacgtcgagcacctcacagagaagatgaaaacgaccattcagaggggccttgtcctccgaaacgaaagttgcagcgaaaactatacaactgattttatataccagttgtacagcgaggaaggcaaaggtgtgttcgactgccgcaagaatgtcctagggcacatgcagcagggaggagctccttcaccattcgaccggaattttgggactaagatctccgctagagcgatggaatggattaccgcaaaattaaaggaggcgaggggaaggggtaaaaaatttactaccgacgactccatctgtgtgctgggaatatcaaagcgcaatgtgatctttcagccggtggcggaacttaagaaacaaaccgatttcgagcatcggatccctaaggaacagtggtggctcaaacttcgcccacttatgaagatactggcaaagtacaaagcatcatatgacgtgtccgactctggccaattggaacacgtgcagccttggtctgtgtag

SEQ ID NO: 199409 - DNA, 2322 bp, Artificial Sequence
  Description of Artificial Sequence: Synthetic coding sequence
tacgagcggtgccggccctgccggggcgcccacggctacctgcggggcggtcaaggtgtcttgcatctcagagggctgcccgggcacgggggacggcgcctgaaacaccgcaggggccgccttggtgaatgtcttcaacatccggccagcggggccgtgcgaggcgattggcgggagaaacccggatgctggtcacatagattcccctgtcctggacgccacgctctggtgggagggacaatcatcggctccgccaggtgtcaggcctttaggaccagagagggacggctgaaagctgcgtgcaatctcctacagaggggcatcacgaatttatgtgtgataggaggggatggttccttgaccggagctaatctatttcggaaggagtggtcaggccttctcgaggaactcgcgcggaacggacagattgataaagaggccgtgcaaaaatacgcctacctaaacgtggtgggaatggtgggcagtatcgataatgatttctgcggtactgatatgacaatagggaccgactccgcacttcacagaataattgaggtggtcgacgctatcatgaccaccgctcagagccatcagcgcacattcgtgctagaagtgatgggcaggcattgtggctacctcgcccttgtgtcagccttggcttgcggagcagactgggtcttcttacccgagagtccccctgaggaggggtgggaagagcagatgtgtgtcaagttatccgagaatcgggctcggaagaagaggctgaacataatcatcgtggcggagggggctatcgatacccagaataagccaatcacctcggaaaaaatcaaagagctggtcgtaacccaactcgggtacgacacacgcgtgaccatcctcgggcatgtgcagagggggggcactccttctgcctttgaccggattttggcctccaggatgggcgttgaggcagttatagccttgctggaggctaccccggacacaccggcctgtgtggtgtctcttaacggtaaccatgctgtgcgcctgcccctgatggagtgcgtccagatgactcaggatgtccaaaaggcgatggatgaaaggcggtttcaggatgctgtgcggctccggggtagatcatttgccggcaatctgaacacgtacaagagactcgcaattaagctgcctgacgaccagattcctaagaccaactgcaatgtggccgtgatcaacgtgggcgccccggccgctggaatgaacgccgcagtgaggagtgcagtcagggtgggcattgcggacggtcacaggatgttagccatctacgatgggttcgacgggttcgctaaaggtcagatcaaagagataggatggacggatgtggggggctggacaggccaagggggttccattttagggaccaagagagtgttaccggggaagtacttggaagaaattgccacccaaatgcgaacccattcaattaacgccttgttaatcataggggggttcgaagcatatctcggcttgctggaattgtcagcggcccgggagaagcatgaggaattctgcgttcccatggtgatggtgccagccactgtctctaacaacgtgcccgggtctgacttttccataggtgccgacacagcactcaatacaatcaccgacacatgcgaccggattaaacagagtgcgtccggtacgaagcgcagggtgttcatcattgagactatggggggctactgcgggtacctcgccaatatgggaggactcgcagcaggggctgacgccgcttatatatttgaggagcccttcgacatcagggatcttcagtccaatgtggagcacctcactgaaaaaatgaaaactactatacaacgagggctggttctaaggaatgagtcgtgttctgagaattacacaacagatttcatttaccaactgtactccgaagaagggaagggcgtcttcgactgcagaaaaaatgtgttgggccacatgcagcagggcggcgctccctccccctttgacagaaactttggaactaagatatctgcccgggctatggagtggatcaccgccaagcttaaagaggctagaggtagaggcaagaaatttactaccgatgattcaatctgcgtactggggatcagcaagcgcaacgttatatttcagcctgttgcagaacttaagaagcagaccgactttgagcaccgaattcccaaagagcagtggtggctcaagttgcggccacttatgaagatcctcgccaaatacaaagccagctatgatgtgtcggacagcgggcagttggaacacgtgcaaccctggtccgtgtag

SEQ ID NO: 199410 - DNA, 633 bp, Artificial Sequence
  Description of Artificial Sequence: Synthetic coding sequence
atgaacgccgccgtgcgggccgtggtgcggatgggcatctacgtgggcgctaaggtctatttcatttacgagggctaccagggtatggttgatggaggatccaatatagccgaggcagactgggaatcagtaagttcgattctgcaggtcggaggcactattattggaagcgctcggtgccaggcgtttcgcacccgcgaaggcagacttaaggcggcttgcaatttgctccaacgaggaattacaaacttatgcgtgatcggaggcgatggatccctaacaggcgcgaatctgttccgtaaagagtggtccggactgctagaagaattagctcggaacgggcagattgacaaggaggcagtgcaaaagtacgcttaccttaacgtggttgggatggtgggctccattgacaatgatttctgtggcactgacatgaccattggcacagatagcgccttacatcggatcattgaggtcgtcgatgcaatcatgactacagcccagagtcatcagagaacattcgtgcttgaagtaatgggtcgccattgcggatatctggccttggtgtcagctctcgcctgtggtgcggactgggtgtttctccccgagtcccctcccgaggaaggttggtag

SEQ ID NO: 199411 - DNA, 501 bp, Artificial Sequence
  Description of Artificial Sequence: Synthetic coding sequence
tgagccgacggccaccggatgctggccatctacgacggcttcgacggttttgctaagggccaaatcaaagagatcggatggacagatgttggtggctggaccggccagggtggtagtatattaggtacaaaaagagtcttgcctggaaagtacctggaggagattgctacacaaatgcgcactcattctattaacgccctgctgatcatcggggggttcgaggcttacaaaagcgcttgtgatatggctgaagctcgcggaaggcaccaagagctgtgcattcccctgtgtgtggtccccgcaaccatctccaataacgttccgggcacagagataagcctgggatctgacacaggtctcaatgccgtagtggagacatgtgacagaatcaaacagagcgcgtcaggaaccaagaggagagtgtttatcattgagactatggggggatactgcgggtacttagctaacatgggagggcttgccgccggcgccgacgcgtag

SEQ ID NO: 199412 - DNA, 723 bp, Artificial Sequence
  Description of Artificial Sequence: Synthetic coding sequence
atgggccggcactgcggctacctggccctggtgagcgccctggcctgcggcgctgattgggttttccttccagaatctccaccagaagagggatgggaagagcagatgtgtgtcaaactatccgagaaccgtgccagaaaaaaaaggctgaatatcatcatagtggcagagggagctatagatacccagaacaagccaatcacttccgagaagattaaggagctggtagtgacccaacttggatatgatacccgggtcacgatcctgggacacgtccagagaggcggcaccccatctgctttcgacagaattcttgcatctcgcatgggtgtcgaggccgttatcgccctccttgaggcaaccccagatactccggcctgtgtggtgtctctgaacggcaaccacgcggtacgactcccacttatggagtgcgtccagatgacgcaagacgtccaaaaagctatggacgagaggagatttcaggacgcggtgaggttacggggacgttcctttgcaggcaatctgaacacctacaagcgactggctatcaaattgcctgacgatcaaatccctaaaactaactgcaatgtcgccgtgattaacgtaggggcccctgccgccggtatgaatgctgccgtgagatccgcagtgcgcgtcggaatcgcagacgggcataggatgttggctatctacgatggctttgacggatttgccaaaggatag

SEQ ID NO: 199413 - DNA, 501 bp, Artificial Sequence
  Description of Artificial Sequence: Synthetic coding sequence
atgaacgccgccgtgcgggccgtggtgcggatgggcatctacgtgggtgctaaggtatatttcatttatgagggctaccaggggatggtggatggcggctctaatatcgcagaagccgattgggaatctgtgtcctcaattcttcaggtgggcggtacgattatcggaagcgcgcggtgccaggcctttcggactcgcgaaggccggctcaaggccgcatgcaaccttctgcaacgtggcataaccaatctttgcgtcatcggtggggacggctcactgacaggtgccaatctttttcggaaggaatggtccggattgctggaagagttggcaaggaatgggcaaatcgataaggaggcagtgcagaagtacgcttatctcaacgtggtgggaatggtgggaagcatcgacaatgatttttgtgggactgacatgacaattgggaccgacagcgccctccacaggattatcgaggtggtcgatgcgatcatgaccacatag

SEQ ID NO: 199414 - DNA, 312 bp, Artificial Sequence
  Description of Artificial Sequence: Synthetic coding sequence
tgattcatctaccagctgtacagcgaggagggcaagggcgtgttcgattgtcgaaagaacgtgctgggccatatgcagcaggggggggctccgagcccattcgaccggaattttggcaccaaaatctccgctcgggctatggaatggatcactgctaaattaaaagaagcaagagggaggggtaaaaaatttactaccgatgactccatctgcgtgcttggaataagcaagcgaaatgttatcttccagccagtggcagagcttaaaaaacagacagatttcgaaaccgttagtatgcaaccaccacgatag

SEQ ID NO: 199415 - DNA, 1743 bp, Artificial Sequence
  Description of Artificial Sequence: Synthetic coding sequence
atgagcgacttcgaggagtggatcagcggcacctaccggaagatggaggaaggtcctttaccactgctgacgttcgccactgccccttaccacgaccagaagcctggcacgtccgggctcagaaaaaaaacctattattttgaagagaaaccgtgttacctggagaattttatccaatctatctttttttccattgatttaaaggacaggcaggggtcgagtctggtggtaggaggagacggtaggtatttcaataagtccgcaatcgagaccatcgttcaaatggctgccgcaaacggtataggccggctggtcattggccagaatggcatcctttcgacccccgctgtgtcatgcatcatacggaaaatcaaggccatcgggggaatcatattgactgcctctcacaatccaggcgggcctaatggagattttggtatcaaattcaatatttctaatggcggcccagctcccgaagctattactgacaagatattccaaattagcaaaacaatcgaagagtacgcggtgtgtcccgatcttaaagtcgacctgggcgtcttggggaagcagcagtttgacctggagaacaaattcaagcccttcaccgtggagatagtggactctgtggaagcgtacgctaccatgctcagatccatttttgacttctctgcactgaaagagctgttaagtggcccaaaccgcctgaaaatccgcattgatgccatgcatggagtcgtcggaccatatgtcaagaaaatactttgtgaagagctgggagctcccgcgaacagtgctgtgaactgcgtcccactcgaagactttggcgggcaccatccagatcctaacctcacgtatgcagccgatctggtcgagaccatgaagagtggggaacatgacttcggcgcagcattcgatggcgatggtgacaggaatatgatcctggggaagcatggattttttgtcaacccatctgacagtgtcgcagtaatcgccgccaatatatttagcatcccctattttcagcaaacaggggtaaggggattcgccaggagtatgccaacatccggcgccctcgatcgcgtcgcctccgcaaccaaaatcgccctgtatgagaccccaaccggctggaaattctttggaaatctgatggacgccagtaagctgagcctttgcggtgaggaaagctttggaaccggcagcgatcatattcgagaaaaagatggactgtgggccgtcctggcatggctttctattctggctaccagaaagcagagcgtcgaagatatccttaaagatcattggcaaaagtatggtaggaatttctttacacgatacgattatgaagaggtggaggccgagggcgcgaataaaatgatgaaggacctggaggccttaatgtttgacagatcctttgtaggaaaacagttctcggccaatgacaaggtgtatacggtcgagaaggcagataactttgaatacagcgatcccgtggatggaagcatctccagaaatcagggattgcggctgatcttcacggatgggtcaaggatagtttttcgtctctcaggcaccggctctgcgggcgccaccatccggctgtatatcgactcatatgaaaaggatgtcgcaaagatcaaccaggatccacaagtcatgctagcacctttaatcagcatcgccttgaaggtcagccagctgcaggaaagaacaggtcgtaccgcaccaactgtaataacttag

SEQ ID NO: 199416 - DNA, 1689 bp, Artificial Sequence
  Description of Artificial Sequence: Synthetic coding sequence
atggtgaagatcgtgaccgtgaagacccaggcctaccaggaccagaagcccggcactagcggtcttaggaaaagagttaaagttttccagagcagcgctaactatgccgagaacttcatccaaagtataatctctaccgtcgagcccgcccagagacaggaagccacattggttgtgggcggtgatggccggttttatatgaaggaggcgatccaactgatagccagaattgccgcagccaacggcataggccgactggtgattggtcagaatggcattctctctacacccgccgtttcatgtattatcaggaaaatcaaggcgattggcggaatcatactgaccgcttctcacaacccaggcggcccaaatggcgatttcggcataaagtttaacatcagtaatggggggcccgcaccagaagcaattacagacaaaatctttcagatcagcaaaaccattgaggaatacgcagtgtgtcccgatcttaaggtggacctcggcgtgctgggcaagcaacagttcgacctagaaaacaaatttaagcccttcacagtcgagatcgtggatagtgtggaagcttacgctaccatgctgcgaagtatttttgatttctcagccctgaaggaactactgtctggccctaatcgcctgaagatacgtatagatgcaatgcacggagtcgtgggcccttatgtaaagaaaatcctatgcgaagaactgggcgccccagccaattcagctgtaaattgcgtgcccctggaggactttggcggccaccatcctgaccccaacctaacttacgccgccgatctcgtggagaccatgaagtccggagaacacgatttcggcgccgcgttcgatggggacggagataggaatatgattctggggaaacacggcttttttgtgaacccgtccgactctgttgctgttattgccgccaatattttctcaattccgtatttccagcaaacaggtgtgcgcggatttgccagaagcatgcccacctccggggcgcttgatagggtcgcctcagccacaaagattgctctgtacgagacaccaactggatggaagttttttggaaatctaatggatgcctccaagctcagcttgtgcggtgaggagagttttgggacaggaagcgaccacatcagggagaaggatggactgtgggccgtgttagcttggctgtctatactggctactagaaagcaaagcgtcgaagacatactgaaggaccattggcagaaatacggccgtaacttcttcacccgttatgattacgaagaggtagaggcagagggcgctaataaaatgatgaaggatctcgaagccttgatgttcgatagatctttcgtggggaaacaattttccgcgaatgacaaggtgtatactgtggagaaagctgacaactttgagtactccgaccctgtggatggctctatctcccggaaccaaggtctcagattaatctttaccgatgggtctcggatcgtctttcgactgagtggcacaggctccgccggagctaccattagactttatatagattcatatgagaaggacgtcgcaaagatcaatcaagatcctcaggtgatgcttgcccctctgatttccatcgcactcaaggtatctcagttgcaagagagaaccggccgcacagcccccactgtgattacatag

SEQ ID NO: 199417 - DNA, 1617 bp, Artificial Sequence
  Description of Artificial Sequence: Synthetic coding sequence
atggtgaaggtgttccagagcagcgccaactacgccgagaacttcatccaaagtatcatctccaccgtggaacccgcccagagacaggaagctacactggtggtaggcggtgacggccgtttctatatgaaagaggccatccagttgattgctcgcattgctgcagccaatggtattggccgacttgtaatcggacagaacggaatactgtctacacctgccgtgagttgtattatcaggaaaatcaaagcgatcggaggcatcatcctgaccgcctcccacaatcccggggggcctaacggggactttgggattaagttcaatatttccaatggcggcccagccccagaagcaataaccgataaaattttccaaatttccaagacaatcgaagagtacgccgtctgtccagatctcaaagttgacctgggcgttctaggaaaacagcagttcgatctagagaacaaattcaaaccatttaccgtggagatcgtggatagtgttgaggcctatgcaacaatgctgaggagcatatttgatttttcagcactgaaagagttgctaagtggccccaacagacttaagatccgcatcgacgcaatgcacggggtcgttggcccctacgtcaagaagatcttgtgcgaggagctgggcgctcctgcgaactcggccgtcaactgtgtccctctcgaggactttgggggccatcaccctgatcccaacctcacttacgctgctgacctagttgagacaatgaagagtggcgagcatgattttggggcggccttcgacggggatggggataggaacatgatcctgggcaagcacggattcttcgtcaacccaagcgactccgttgccgtgattgctgcaaatatcttttccataccgtattttcagcaaacaggcgtcagaggctttgcacggtctatgcccacttctggtgccttagatagggtcgcaagcgccactaaaattgccctttacgagacacccactggctggaaatttttcggcaatctcatggacgccagtaaactgtcactatgtggggaagagtccttcggcacaggatctgatcatatcagggagaaggacgggctctgggcagttctggcctggctatccatacttgccacccgaaagcagtcggtcgaggacatcctcaaggaccattggcagaaatatgggaggaacttcttcaccagatacgactatgaggaagtggaggccgagggagcgaataaaatgatgaaagatctcgaggcccttatgttcgaccgatccttcgtgggcaaacagttctctgctaacgacaaagtttacaccgttgagaaggccgataactttgaatattctgaccctgttgatggctccattagtaggaatcaggggctcagattgatcttcacggacgggtcaagaatagtgttccgactgagcgggacaggatcagccggcgctaccattcgcctctacattgactcctatgagaaagacgtggctaagataaatcaagacccccaggtcatgcttgccccactgatttctattgctctgaaggtcagccagctacaggaacgcacagggaggactgcaccaacagtgatcacatag

SEQ ID NO: 199418 - DNA, 1098 bp, Artificial Sequence
  Description of Artificial Sequence: Synthetic coding sequence
atgctgcggagcatcttcgacttcagcgccctgaaggagctgctgtcaggtcccaatcggctcaagatccgaatcgatgccatgcatggcgtagtcgggccgtacgtgaagaagatcctatgtgaggagctcggcgcccccgcgaatagtgcggtgaactgcgtgcccctggaagatttcgggggccaccatccagaccccaacttaacatatgcggcggatctggtcgagaccatgaagtccggcgaacacgattttggggcggcgtttgatggagacggagatcgcaatatgatcctggggaaacacggctttttcgtcaatccgtccgactctgtggccgtgatcgccgccaatattttcagtatcccatattttcagcagactggcgtgagaggtttcgctcgttcaatgcctacaagtggggccctggacagagtcgccagcgctactaagatcgctctgtatgaaacccccaccggctggaagttctttggaaatttgatggatgcttcaaaactgagtctgtgtggtgaggaatcttttgggaccggctccgaccacatccgtgaaaaagacgggttatgggctgttcttgcctggctatctattctcgctactaggaagcagtcagtagaggacattttaaaggatcactggcagaaatacggcaggaacttcttcaccaggtatgattacgaggaagttgaggccgagggagccaataaaatgatgaaggatctggaggctctgatgttcgatcgctcctttgtgggcaagcagttcagtgctaacgacaaggtttatactgtcgaaaaggcagacaacttcgagtacagtgaccctgtggacgggagcattagcagaaaccagggcctgaggttaattttcacagatggttcacgcatcgtattccgacttagtggaaccggcagtgccggtgccacgataaggctgtatattgacagctacgagaaggacgtagccaagattaatcaggatcctcaggtcatgttggctccgttgatctccattgctttgaaggttagtcagcttcaggagaggactggcagaacggcaccaaccgttattacctag

SEQ ID NO: 199419 - DNA, 1839 bp, Artificial Sequence
  Description of Artificial Sequence: Synthetic coding sequence
atggccgcccccgagggcagcggcctgggcgaggacgcccggctggaccaggagacggcccaatggttgcgctgggataaaaactccctcacccttgaggccgtcaagcgccttatagccgaggggaacaaggaggagttacggaagtgtttcggagcacgtatggagttcgggaccgccggactgagagccgctatgggcccaggaatttcacgcatgaacgacctcacaatcatacaaaccacccagggtttctgtcggtacttggagaagcaattttctgatttgaaacagaaagggattgtgatcagctttgacgcgcgtgcccatccttcatcaggcggttcatcccgacgatttgccaggctcgccgcaacaacctttatcagccagggaatcccggtttacctgttttcggatattacaccgactccttttgtgccttttaccgtgagccacctgaaactgtgtgcgggaatcatgatcacagcctctcacaatcctaaacaggacaatggatataaggtgtattgggacaacggggcacagatcattagccctcatgataagggcatatctcaagctattgaggaaaatctggagccttggccccaggcatgggatgatagtctgattgactcttcacccctgctgcacaacccctcagcctccataaacaacgactacttcgaggacctgaaaaaatattgtttccatcggagtgttaacagagagactaaagtgaaatttgtgcatacgtctgttcatggggtgggccacagcttcgttcagtccgcattcaaggcgtttgatctggtcccccctgaggccgtgcctgaacagaaggacccagacccagagttccctacagtaaaatatccaaatcctgaggagggaaaaggagtgctaaccctttcttttgcactggccgataaaacaaaggctaggattgtgctggccaacgacccagacgcggaccgcctcgctgtggccgaaaagcaggactccggggaatggcgagtgtttagcggcaacgaactgggggcactgctggggtggtggctgttcaccagctggaaggaaaagaatcaggatcggagtgcattgaaagacacctatatgctgtcatccaccgtgagcagcaagatacttcgcgccatcgccctcaaagaaggctttcatttcgaagagacacttacaggattcaaatggatggggaatagagccaaacaactcattgaccaagggaagacagtcctgttcgcttttgaagaggccattgggtatatgtgttgtccttttgtactagacaaggacggagtgtccgccgccgttattagcgctgagctcgcttcctttctcgccacgaaaaacctgtcactgtcacagcagttgaaggctatttacgtggagtacggttaccacatcactaaagcctcttattttatctgtcatgaccaggagacgataaaaaagctcttcgaaaacctccgaaactatgatgggaagaataactaccccaaggcatgcgggaagttcgaaatcagcgctataagggacctaaccaccgggtatgatgactctcagcctgataaaaaggcagtactgcctacgagcaagtctagtcagatgatcactttcacgttcgccaacggcggagtcgccacgatgaggacctccggtacagagccgaagataaagtattatgccgagctttgcgcaccacccggcaattccgaccccgagcaactcaagaaggagctaaatgagctcgtctcagccatcgaagagcactttttccagccccagaagtacaatctgcagcctaaagccgactag

SEQ ID NO: 199420 - DNA, 1359 bp, Artificial Sequence
  Description of Artificial Sequence: Synthetic coding sequence
atgatcaccgccagccacaaccccaagcaggacaacggctacaaggtctattgggataatggcgcacagattatatctccgcacgacaaggggatctctcaggccatcgaagaaaatcttgagccctggcctcaagcttgggacgactctctaatcgatagttcccctctgctgcataatccctcagcttccattaacaatgactattttgaggacctcaaaaaatattgcttccatcgcagtgtgaatagggagacaaaggtgaagtttgtgcacacctcggtgcacggcgtcgggcatagcttcgtgcagtcagcctttaaagccttcgacctggtgccacctgaagccgtcccagaacagaaggaccccgaccctgaatttcctaccgtcaagtatccaaatccagaggaaggaaagggtgtcctcacgcttagttttgcactagccgataaaacaaaagcaaggatcgtgctggccaacgatccagacgccgatcggctggctgtggcggagaaacaggactctggagaatggcgtgtgttttccgggaatgaactgggtgccctccttgggtggtggctgtttaccagttggaaagaaaaaaatcaagacaggtccgctttgaaagacacctatatgctcagctctacagtaagtagcaaaatcctcagggctatcgcactgaaagaagggtttcacttcgaggaaaccctgaccggattcaaatggatgggcaacagagcaaagcagctgatcgaccagggtaaaacagtgttatttgcattcgaggaagccatcggctatatgtgctgcccgtttgtactggacaaagatggggtatcggctgcagtcatctctgccgagctggctagctttctggcaactaaaaatcttagtctctcacagcagctgaaggccatttatgtggagtacggatatcacattactaaagctagctacttcatctgtcacgatcaggagacaataaaaaagcttttcgaaaatctgcgtaactatgatggcaagaataactatccaaaggcatgcggcaaattcgagattagcgccatcagagatttgaccactggctacgacgattcccagcccgacaagaaagctgtcttacccacgtcaaagagttcacaaatgatcacctttaccttcgcaaacggcggggttgctactatgcgtacaagcgggacagaacccaaaatcaaatattacgctgagctgtgcgcaccccccgggaactctgatccagaacagctgaaaaaggagttaaatgagctggtctctgctattgaagaacacttcttccagccccagaaatataatctacagcccaaagcggattag

SEQ ID NO: 199421 - DNA, 876 bp, Artificial Sequence
  Description of Artificial Sequence: Synthetic coding sequence
atgagcagccagctgatcctgcggcccttcaccgtgagccacctgaagttgtgcgcggggatcatgattacagcttcccacaatccgaaacaggataatgggtacaaagtatattgggacaacggggcccagataatctcaccccacgataagggaatttcacaagccatcgaggagaacctagaaccttggcctcaggcctgggacgacagtctaattgactccagccccctcctgcacaacccatccgcaagcattaacaatgattattttgaggatcttaagaaatactgctttcacaggtcagtcaacagggagacaaaggtaaagtttgtgcatacgtctgtgcatggggtcgggcactctttcgtccagtccgccttcaaggcttttgatctggtgccgcctgaggccgttccagaacagaaggaccccgatccagaatttcccactgtgaaataccctaacccggaggaagggaaaggggtcctgacactcagcttcgcgctggccgacaaaactaaagccagaattgttttagcgaatgaccctgatgcagacaggctggccgttgcagaaaagcaggactcaggtgagtggcgggtattcagcggaaatgaactcggcgcgctgctcggttggtggctgtttactagctggaaggaaaaaaaccaagatagatccgccctcaaggatacctacatgctgtcatccacagtcagctcaaaaatcttgagggcaattgccctgaaggaggggttccactttgaggagactctgactggttttaaatggatgggcaatcgggctaaacagttgatcgatcaaggaaaaaccgtgttgtttgccttcgaggaagccatcggcaagaagtag

SEQ ID NO: 199422 - DNA, 1869 bp, Artificial Sequence
  Description of Artificial Sequence: Synthetic coding sequence
atggccgagaacaccgagggcgacctgaacagcaacctgctgcacgctccgtaccacaccggggaccctcagttggacacagcgatcgggcagtggctaagatgggataaaaaccctaaaacaaaggagcagatagaaaatctactgagaaatggaatgaacaaggagctgcgtgacaggctgtgttgtcgcatgaccttcgggacagctggtcttagatccgctatgggcgcgggtttttgttatattaacgaccttaccgtcattcaatctacacaggggatgtataagtatctcgagcggtgcttcagcgatttcaaacagcgtgggtttgttgtgggatacgacacaagaggtcaagtgacatcttcatgctcttctcaacggctcgcgaaactgaccgccgctgtgctgctggccaaagatgtcccagtgtacctgttcagtcgatatgttcctacaccgtttgtaccctacgctgttcagaagttgaaagcggtcgctggcgtgatgattactgcctcccataaccgcaaggaggataatggctataaggtgtattgggaaactggcgcccagataacctcccctcatgataaggaaattctgaagtgcatcgaagaatgcgtcgagccttggaacggttcatggaatgataatctggtggatacctcacctctgaaacgggatccattgcaagacatatgtcgtagatatatggaagacctgaaaaagatctgtttctatcgggaactgaactcaaaaactaccttaaaattcgtgcacacaagtttccacggcgttggccacgattacgtgcagctggctttcaaagttttcgggttcaagccacccatccctgtgccagagcaaaaggaccccgaccctgatttctccacagtcaagtgccctaaccctgaggagggcgagagcgtcctggaactcagtctgagactcgccgagaaggaaaatgctcgcgtcgtcctggccactgatcctgatgcagaccggctggctgcagccgagctgcaggagaacgggtgctggaaggtgttcacaggcaatgagttggccgctttattcggatggtggatgttcgattgttggaagaagaataagtctcgtaatgcagacgttaagaatgtctatatgttagcaacaacagtttcatccaaaatactgaaggccattgctctcaaggaagggtttcactttgaggaaactttgcctgggttcaagtggataggctccaggatcatcgaccttctggaaaacgggaaggaggtcttgttcgcttttgaagaatccattgggttcctgtgtgggacctctgtgctcgacaaagacggagtctcagctgctgtggtggtggcagagatggcctcatacctagaaacaatgaatattacacttaagcaacagttggtaaaagtgtatgagaagtacggctaccacatttccaagactagctactttctctgctacgagccgccaaccattaagtctatattcgaaaggctcaggaatttcgattcccccaaagaatacccgaaattttgtggcacctttgccatcttgcacgtacgcgatgtaaccacaggttatgatagttcccagcccaacaagaaaagcgtactgcctgttagtaagaactctcagatgatcacatttacctttcaaaatgggtgtgttgccacattgagaacaagtggaacagagcccaagataaagtactatgcagaaatgtgtgccagccctgatcagtcggacacggcacttctcgaggaggaactgaaaaagctgatcgatgccttgattgagaattttctgcaaccaagtaagaatggcctcatctggagaagcgtctag

SEQ ID NO: 199423 - DNA, 1713 bp, Artificial Sequence
  Description of Artificial Sequence: Synthetic coding sequence
atgggcggcgagtggggccagagcgccatctgccccgagagcgcccaggaatggacctaccaagtgggccagcatcttgtggatatggatctgggggctatcaccaaatatagtgcacttcacgctaaacctaatggcctaatcttgcagtacgggactgctgggtttcgcacaaaagccgagcaccttgaccacgttatgtttcgcatgggactgctggctgttctgcgcagcaagcaaacaaagtccacaattggcgtcatggttacggcatcgcacaaccctgaggaagataacggcgtgaagctggtggatcctctcggtgaaatgttagcacctagttgggaagagcacgcaacatgcctcgccaatgcggaggaacaggacatgcagcgtgttctgatcgatatttccgagaaggaggctgttaacctgcagcaggatgcctttgtggtgattggtcgggataccaggcctagtagcgagaagctgagtcagtctgttatagatggggtcactgtgctgggtggccagttccacgactatggccttctaaccaccccacagctacactatatggtctactgcagaaacactggaggccgctacggaaaagcaaccatcgaggggtactaccaaaagttgagcaaagcctttgtcgagcttacaaaacaggcctcatgttcaggagacgagtatcggtctcttaaggtcgattgcgccaatggcattggagcactgaaactgagggagatggaacactatttcagtcaggggctttcggtacagctattcaatgacggatcaaaaggcaagttgaaccacctatgtggtgccgattttgtgaaatctcaccagaaaccgcctcagggaatggagatcaagtccaacgaaagatgctgcagctttgacggggacgctgacagaattgtctactactaccacgatgctgatgggcattttcatcttatcgatggggacaaaatcgccacgctgatctcttcttttttaaaggaactgttagtggaaattggagaatctctcaacatcggggtggtccagacagcatatgctaatggaagctcaaccagatatttggaggaggtgatgaaagtccctgtgtattgtaccaagacgggagtgaaacatctgcatcataaggcccaggagtttgacattggggtctattttgaagctaacggccacggaactgccctgtttagcaccgcggttgagatgaaaatcaagcagtccgccgaacaactggaggacaaaaagcggaaggccgcgaagatgctagaaaacataatcgatctgtttaatcaagccgcaggcgatgctatctccgatatgctcgttatagaagcaatactcgcattgaaaggactcacagtgcagcagtgggatgccctgtatacagacctacccaatagacagctgaaggtgcaggtagcagacaggagagttatttcgaccacggacgccgaacggcaggcagtaacgccacccggcttacaggaagcaattaacgatttagtgaagaagtacaaattgtcacgagcgttcgtgagaccatcaggcacagaagacgtcgtgagagtatatgctgaagcagatagccaggagtcggcagatcaccttgcccacgaggtgtctctggctgtgtttcagctcgctggcggaatcggtgaaagacctcagcctggattctag

SEQ ID NO: 199424 - DNA, 444 bp, Artificial Sequence
  Description of Artificial Sequence: Synthetic coding sequence
atggacctgggcgccatcaccaagtacagcgccctgcacgccaagcccaacggtctgattttgcagtacggcaccgctggatttcgaactaaagcagagcacctggatcatgtgatgtttagaatgggcctattggccgttttgcgctccaagcagaccaaatctaccattggcgtaatggttactgctagtcataatccagaagaggacaacggcgtgaaacttgtcgatcccctaggcgaaatgttggctcctagctgggaagagcacgctacctgtctggctaatgcagaggagcaggacatgcagagggtattgatcgatatcagcgaaaaggaagccgtgaatctccagcaagacgcattcgtggtaatcggtcgcgatacacgtccaagctcagaaaagttgtcacagtcagtcattgacggagtcacagtactgtag

SEQ ID NO: 199425 - DNA, 1629 bp, Artificial Sequence
  Description of Artificial Sequence: Synthetic coding sequence
atggacctgggcgccatcaccaagtacagcgccctgcacgccaagccaaacggtctgattctgcagtacgggacggcagggtttcgaaccaaggctgaacatctggaccatgtgatgttccgcatgggattactcgccgttttaaggagcaaacagaccaaatcaactatcggggtaatggtcaccgcctcgcacaatcctgaagaggataacggcgtgaagttggtggatccactgggcgagatgctggctccatcttgggaggagcatgccacttgtcttgcaaacgcagaggagcaggacatgcagcgtgtgctgatcgacatatcggaaaaggaagccgtgaatttgcagcaggacgcctttgtggtgattggccgggatacccgaccctcttccgaaaaactgagccagtctgtgatcgatggggtaacagtcctaggcggccaatttcacgattacggcttgctgacgactccccaactgcattatatggtatactgtcgtaacacaggtggcagatatggcaaagcaaccatagaaggctactaccagaaattgagcaaagcctttgtggagctgactaaacaagcaagttgttcgggtgatgagtaccgtagcctgaaagtggattgtgctaacggaattggggccttgaaactgcgggaaatggagcattattttagtcagggcctgtcagtgcagctttttaacgatgggagtaaggggaagttgaatcacctgtgtggggctgatttcgtgaagtcacatcagaaacccccgcaaggcatggaaataaaatccaatgagaggtgctgttcctttgacggggatgctgataggattgtgtactactaccatgacgccgacggtcacttccacttaatcgacggagataagatcgccacattgatcagctcattcttgaaagagctgctggtagaaattggagaatctctgaatatcggtgttgttcagacagcctacgccaacgggtctagcacccgttaccttgaggaagtaatgaaggtgccggtttattgcaccaagacgggagtgaaacacctgcatcataaagcccaggagtttgatataggcgtgtattttgaagctaatggccacgggactgctttgttcagtactgctgtggagatgaagattaaacagagtgcagaacaactggaagacaaaaagcggaaagctgctaagatgctggagaacattatagacctgttcaaccaagcagccggcgatgccatcagcgatatgctggtgattgaagccattctggctctgaaggggctaaccgtgcaacagtgggatgccttatatactgacctccctaataggcagcttaaggtgcaggtcgccgatcgcagggttattagtacaacagatgcggaacgtcaggcagtgactccccctggcctgcaagaggccatcaatgaccttgttaagaagtacaagttgagcagagcttttgttaggccaagcggcactgaagacgttgtgagagtttacgcggaggcagacagtcaggagagtgctgatcacctcgcccacgaggtatctctagccgtcttccagctggccggggggatcggcgaaagacctcagccaggattttag

SEQ ID NO: 199426 - DNA, 1701 bp, Artificial Sequence
  Description of Artificial Sequence: Synthetic coding sequence
atggacctgggcgccatcaccaagtacagcgccctgcacgccaagcccaatggacttatacttcagtatggcaccgccgggttccggaccaaggccgaacatctcgatcacgtaatgttccgtatggggctcctcgccgttctacggagcaaacagacgaaaagcaccataggggttatggtaaccgcgagccataatcccgaggaggataatggggtcaagctggtcgaccccctcggggagatgctggcccctagctgggaagagcacgccacctgtctggcgaatgctgaggaacaggatatgcaacgtgtgttgatcgacatttctgagaaggaggccgtcaatcttcagcaggacgctttcgttgttattggcagggacaccaggccctccagcgaaaagctctctcagtccgtcattgacggcgtgacagtcctgggcggacagtttcacgactacggcctactgacaaccccacaactgcactatatggtttattgccgcaacacaggcggaaggtatggaaaagccacaatagagggctactaccagaagctgtcaaaggcattcgtcgaattaactaagcaggcaagttgctcgggcgacgagtaccgatcacttaaagtcgactgcgcgaatggaataggcgctctaaaattgcgcgagatggaacactacttttctcaaggcttatcggtgcaattattcaacgatggatccaaaggcaaactgaatcacctgtgtggcgcagactttgtgaagtcccatcagaagccccctcagggcatggaaatcaagtcaaatgaacgatgctgtagtttcgatggcgacgctgaccgcatagtgtattattaccacgacgccgatgggcattttcacctaattgacggtgacaagatcgccactctcattagcagctttttaaaagagctgctggtggagatcggggaatctctgaatatcggagtagtgcaaactgcttacgcaaacgggagttctacacggtatctggaagaagttatgaaggttcctgtctactgtactaaaacaggagtcaagcaccttcaccacaaggcacaggagtttgatatcggagtctacttcgaagcaaacggtcacggcaccgcattgttttctaccgctgttgaaatgaagatcaaacagtccgccgaacagttagaagataaaaaaaggaaggcagccaaaatgttggagaatatcattgacctattcaaccaggcagccggggacgcaatctccgatatgctggttatcgaggcaatcttagctcttaaaggtttaacagtccagcagtgggatgccttgtacaccgatttgccaaataggcagttgaaggtgcaggtcgccgacaggagggttatcagtaccacggacgctgagcgacaggccgtcactccccccgggttgcaagaagctattaatgatctggtgaagaagtacaaattatcccgagcctttgtaaggccatcaggcacagaagacgttgtgagggtatatgcagaagctgactcccaggagtcagcagaccatctcgcacatgaagtttcacttgcagtctttcaactggcaggcggcatcggcgagcgccctcaacccgggtacaaagcggccgaaaccacccacaacataaacaacgcctttggaccagggaccgcaaatgagcataccgtcccttag

SEQ ID NO: 199427 - DNA, 720 bp, Artificial Sequence
  Description of Artificial Sequence: Synthetic coding sequence
atggagggcagccccatccccgtgctgaccgtgcccaccgccccctacgaagaccagcgccccgcaggtggaggcggtctgagaagacctactggattattcgaaggacaacggaattacctccccaacttcatacagtcagtgctgagtagcattgacctgcgggatagacagggatgcactatggtggtagggtcggacggcagatacttcagcagaacagctatcgagatagtggtgcagatggcagcggctaatggcataggccggttgattatcggccaaaatggtatcctatcgactcctgcagtcagctgtatcatccgcaaaattaaggctgcggggggcattatcctaacagcatcccactgccctggtggacctggtggagagttcggtgttaagtttaacgttgcaaacggcgtcgagatcgtcgatcccgtggatatctatctgaacctgctcaggacgattttcgacttccatgccattaagggattgctaaccggtccttcccagctgaaaatccgcattgatgcaatgcatggagtcatgggaccctacgtcaggaaggtcttatgtgatgaattgggcgcaccagcaaattcagcaataaactgtgtgcccctcgaggactttggcggccagcaccctgacccgaacctgacatacgcaacgactctgctggaagctatgaaagggggcgagtatggtttttag

SEQ ID NO: 199428 - DNA, 1704 bp, Artificial Sequence
  Description of Artificial Sequence: Synthetic coding sequence
atggagggcagccccatccccgtgctgaccgtgcccaccgccccctatgaagaccaacgacccgccggaggaggcgggttgaggaggccaacaggattgtttgagggccaacggaattacttacccaacttcatccagtcagttctgtcctctatcgacctaagggatcggcagggttgcaccatggtcgttgggagtgacgggagatacttctctcgaacagcaattgaaatagtagtgcagatggccgccgcgaacggaatcggtcgtctcatcattggccaaaatggtatccttagcacaccagctgttagctgcattatccggaagataaaagctgcaggcggaatcatcctcacggcgtcacattgtcccggcgggccaggaggcgaattcggagtgaaattcaacgttgctaacggtggtcccgcgcccgacgttgtcagtgacaaaatttaccagatctctaagacaatcgaggagtatgccatctgccctgacctgaggattgacctctcccgcctggggagacaggaatttgatctggagaataaattcaaacccttccgcgtggagattgttgatccagtagatatttacctgaatctactgcgtactatcttcgattttcatgcgatcaaagggctccttaccggtccctctcaactgaagatacggatcgacgccatgcacggcgttatgggtccatacgtgaggaaagtattatgcgacgagttgggggcacctgctaactcagcaattaattgtgttccattagaggattttgggggccagcaccctgaccccaaccttacttacgcaactactcttctcgaagcaatgaagggcggcgaatatgggtttggcgcggccttcgacgctgacggtgaccgctatatgattctcggccaaaatggattctttgtgtccccctcagattccctggccatcatcgctgcgaacctttcctgcattccctacttcaggcagatgggggtgagaggctttggtcggtccatgccaacaagcatggccctcgatcgagtcgctaaaagcatgaaagtcccagtctacgagacaccagccggatggaggtttttcagtaatctgatggacagcggccgttgcaatctgtgtggcgaggagagcttcggtacgggcagtgatcacctgagggagaaggatgggttgtgggccgtgctcgtttggttaagcatcattgccgcgcgcaagcaatccgtcgaggaaattgtaagagatcattgggctaagtttgggcgtcactactattgcagattcgactatgagggcctggaccctaaaacgacttactatattatgagagaccttgaggctctggtcaccgacaagtcatttattgggcaacaatttgctgtcggaagtcatgtctactctgtcgctaagaccgacagtttcgaatatgtggaccccgtggatgggaccgtcacgaagaaacaggggctgcgaataattttcagcgacgcatctaggctgatcttcagactgagttccagtagcggtgtgagggcgaccctgcggctatatgccgagtcatatgaacgggatccatccggtcacgatcaggaaccacaggccgtactcagccccctgatcgccatcgcactcaaaatcagccagatccacgaacgtacaggtaggcgtggtcctactgtgatcacctag

SEQ ID NO: 199429 - DNA, 1452 bp, Artificial Sequence
  Description of Artificial Sequence: Synthetic coding sequence
atggcccaggccgacatcgccctgatcggcctggccgtgatgggccagaatttgattttgaatatgaatgaccacggtttcgtagtctgtgccttcaataggacagtgagtaaggttgatgactttctggctaatgaagcaaaaggaacgaaggtggtgggcgcacagagtctaaaagagatggtctccaaattgaagaagcctcgacgaatcattttgttagtgaaggcgggacaggcagtcgacgacttcatcgagaagctcgtgcccttgctggatacgggcgatattattatcgatggtggaaattccgagtatagagatacaactcggagatgccgggatttgaaagctaaaggcatcctttttgtgggttctggagtaagtgggggggaggagggagcgagatatgggcccagcctcatgccggggggtaataaagaggcatggccccacattaagactatctttcagggcattgctgcgaaggtgggcaccggagagccctgttgcgactgggtgggtgacgaaggtgcaggacacttcgttaagatggttcataacggtattgagtatggcgatatgcagctgatttgtgaagcataccacctcatgaaagatgtgctgggtatggcgcaggacgaaatggcccaggccttcgaggattggaacaagactgagctagactctttcctgattgaaataactgctaatattctgaagttccaagacactgacggcaaacacctattgccaaagatcagggactcagctggtcaaaaaggcaccggtaagtggacggcgattagcgctctggagtacggcgtgcccgttacgctaataggggaagctgtgttcgcccgatgtctaagcagcttgaaggacgaacggatccaagcctccaagaagctcaaggggccacagaaattccagtttgatggggacaaaaaatctttcctagaagacataaggaaagccctctacgctagtaagatcatctcctatgcacagggatttatgctgctacgccaagcagcaacagaatttgggtggacgctgaattacggcggaatcgcgctgatgtggcggggcggttgcatcattcggtcggtgttcctgggcaagattaaggatgcgttcgacaggaaccctgaattgcagaatctgctgttggatgatttttttaaatccgccgtggagaattgtcaggattcatggaggagggccgtctccacgggcgtgcaggcggggatccccatgccttgtttcaccacggcattatccttttacgatgggtatagacacgaaatgctccccgcgagtctcatccaggcccaaagggattacttcggagcgcatacttacgaactgctcgcaaaaccaggccagttcatccacacaaattggacaggccacggtgggactgtgtcttcgagctcatataacgcttag

SEQ ID NO: 199430 - DNA, 1413 bp, Artificial Sequence
  Description of Artificial Sequence: Synthetic coding sequence
atgggccagaacctgatcctgaacatgaacgaccacggcttcgtggtgtgtgctttcaacagaactgtcagtaaagttgacgattttctcgcgaatgaggcgaagggcactaaggtcgtgggggcccagtcactgaaagaaatggtgtcgaaactcaagaaaccccgcagaattatattgctggttaaggccggacaagccgtcgatgattttattgaaaagctggtgcctctgctcgacaccggggacatcatcattgatgggggcaatagcgagtatcgtgacactacccgtagatgccgcgacttgaaagctaaggggatactatttgtggggtctggggttagcggcggagaggagggcgctcggtacggtccttccctcatgccaggtgggaacaaagaggcctggccacacatcaaaactattttccagggaatcgctgccaaagtgggcacaggggagccgtgttgcgactgggttggcgacgagggtgccggacattttgtgaagatggtccataatggaatcgagtatggtgatatgcagcttatctgcgaagcatatcatttaatgaaagatgtcctgggcatggctcaggacgaaatggcacaggccttcgaggattggaacaaaaccgaactggattcatttctgatagaaattactgccaacatactgaaattccaggatacggacggtaaacacctcttgcccaagatccgcgacagtgctggacagaaggggactggcaaatggacagccataagcgccctggaatatggagtaccagtgaccctgatcggggaagcagtctttgcgcggtgtctgtcttccctgaaagacgaaagaattcaagctagcaagaagctcaaaggcccacagaagttccagtttgatggcgacaagaagtcatttctggaggatatccgcaaggccctctatgctagtaagataattagctatgcccaggggttcatgctcctacggcaggctgcaaccgaatttggctggacgctcaactacggcggaattgcccttatgtggcgaggtggatgtatcattaggtcagtgtttctgggaaaaataaaggatgcctttgaccgcaaccccgaacttcagaatctccttctggatgacttttttaagtccgctgtggaaaactgccaggattcttggcggcgtgctgtgtctacgggagtccaagcgggaattcccatgccgtgcttcaccactgctctgtcattttatgatggatacaggcatgaaatgttaccagctagtctcattcaagctcagcgtgattactttggggcccacacatacgagttgttagccaaacctggccagttcatccacaccaactggacaggtcacggagggactgtgtcgagctcttcctataacgcctag

SEQ ID NO: 199431 - DNA, 1386 bp, Artificial Sequence
  Description of Artificial Sequence: Synthetic coding sequence
atggcccaggccgacatcgccctgatcggcctggccgtgatgggccagaatctgatcctcaacatgaacgatcacggattcgtggtctgcgctttcaatcgaacagtcagtaaggtggatgattttttagcaaacgaagcaaagggtacaaaggtggtgggtgctcaaagccttaaagaaatggtttcaaaacttaaaaagcctagacgcatcattctattggtgaaggccggacaggccgtggatgattttatcgagaagttgagacgctgtagagacctgaaagccaagggcattctgttcgtgggtagtggggtaagcggcggtgaggagggcgctcggtatggcccctctctgatgcctggtgggaacaaagaggcctggccacacataaaaactatcttccagggtatcgcagcaaaggtagggaccggtgagccttgctgcgactgggtcggcgatgaaggtgctggccacttcgttaagatggtacataatggcattgagtatggtgacatgcaactcatatgcgaggcctaccatctaatgaaagacgtgttaggcatggctcaagacgagatggcccaagccttcgaagattggaataagaccgaactggacagctttctgattgagatcaccgcaaacatacttaaattccaagacactgatgggaaacatcttctccctaagatccgcgatagtgctggccagaaaggcaccggaaaatggaccgcaatctcagccctggagtacggagttccggtgacactgattggggaggcagtgttcgctaggtgcctgtcgtccctcaaggacgaaagaattcaagcctccaaaaagctgaagggccctcagaagtttcagttcgacggcgacaaaaagagcttcctggaggacatcagaaaggctttatatgcatctaaaatcatctcctacgcgcaggggtttatgctgctccgtcaggcggctactgagttcgggtggaccctcaactacggcggtattgctctgatgtggcgtgggggctgcatcatcagaagcgtgttcctcggcaagatcaaagacgccttcgatcggaaccccgaactgcaaaacctgcttttggatgacttttttaaaagcgccgttgagaattgtcaggacagttggcggagagccgtctcaacgggtgtccaagccggaatacccatgccgtgctttacaactgccctatccttctatgacgggtaccggcatgaaatgttacccgcatctctaatccaggcacagcgcgactattttggagcgcacacctatgagcttctcgccaagccaggtcaattcatccatacaaattggaccgggcatggaggcaccgtctcgtcaagcagttacaacgcctag

SEQ ID NO: 199432 - DNA, 1290 bp, Artificial Sequence
  Description of Artificial Sequence: Synthetic coding sequence
atgaccaccgccctgtggagcgtgctgctgatcggcctgagccccaagctgatgatcagctggccgatgcgacaggctgttgatgacttcatcgagaaattagttcctcttttagataccggcgatatcatcattgacggaggcaactcggaataccgggacaccacaagaagatgccgagatctgaaagctaagggcatactgtttgtgggctctggggtgagcggaggggaagagggggcccggtacggcccctcactgatgccaggcggtaataaggaagcttggcctcacattaaaacaatttttcaaggaatcgcagcaaaggttggtacaggtgagccctgttgcgactgggtgggtgacgaaggggctggccacttcgtgaagatggttcacaatggaatcgaatacggtgatatgcaacttatttgtgaggcctaccacctcatgaaagatgtgctgggaatggcccaggacgaaatggctcaggcctttgaggactggaataagactgagctcgatagcttccttattgagataactgccaatattctcaagttccaggacactgatggcaaacacctcctccctaaaatacgggattccgccggccagaagggcactggtaagtggacagccataagtgcccttgaatacggtgtgccagtgaccctgatcggggaggccgtgtttgctcggtgtttgtcctctctcaaagatgaaagaatacaggcatctaagaagttaaaaggcccgcagaaatttcaatttgatggcgacaagaagagcttcctcgaagacattagaaaagctttgtacgctagcaagattatttcctatgcacaggggtttatgttgctgaggcaggcagccactgagttcgggtggacactgaactatggaggcatcgctctcatgtggagaggtggctgcattatcaggtcagtgtttctcgggaagattaaagacgcgttcgaccgcaatccagagctccagaacctgttacttgatgacttctttaaaagcgcagttgagaactgtcaagacagctggcggcgcgcagtgtccaccggcgttcaggctggaatcccaatgccctgtttcaccaccgccctgtctttttatgatgggtaccggcatgagatgctgcctgcatctctgattcaggcccaaagagactattttggcgcccacacttacgagttgttggcaaagcccgggcagtttatccacaccaactggactggacacggtggaacagttagcagtagcagctacaacgcatag

SEQ ID NO: 199433 - DNA, 1500 bp, Artificial Sequence
  Description of Artificial Sequence: Synthetic coding sequence
atgaccttctggacccagatgttcttcctgctgcaggactgcgagggactgatcgtccggtcagccacgaaagtaactgctgacgtcatcaacgcggctgagaagttgcaagtggtgggtcgggccggaacaggagtggataacgtcgacctcgaggctgccactagaaaaggaattttagtcatgaatacacccaacggtaatagtctgtctgctgctgaacttacttgtgggatgatcatgtgtctcgcgagacagatcccccaggccactgcctccatgaaggatggcaagtgggagcgcaaaaagttcatggggacggaattgaatggaaagacactcggcatactaggacttggtagaataggccgggaagtagcaacacgcatgcagtcattcggaatgaagacaatcggctacgatcccattatcagcccagaggtaagcgcttcctttggtgtgcagcaattgcctctcgaagagatctggcctttgtgtgattttatcacagtgcacacccctctgctgccctcaactactggtctgctaaacgataatacctttgctcaatgtaagaagggcgttcgggtcgtcaactgcgcaagagggggaatcgtggacgaaggtgctctgcttcgcgccctgcagagtggccagtgcgccggcgccgctctcgatgtgtttacggaagaacccccccgggaccgtgccctggtggatcacgagaatgtcatttcctgcccccacttgggggcgtcgaccaaggaggcacagtccagatgcggcgaggagatagcagtgcagtttgtggatatggtgaaaggcaagtcgctgacaggagtggtcaatgctcaggccctgaccagcgctttctctccgcacactaaaccctggatcgggttggccgaggcgctagggacactcatgagagcctgggctggatccccgaagggcactatacaagtaatcacccaggggacaagcctcaaaaacgcgggcaactgccttagccccgctgttatcgtgggacttttgaaggaggcctcgaagcaggcagacgttaatttggttaatgcaaagctcttggtaaaggaggcgggactgaatgtcacaaccagccatagcccggcagcacccggcgagcagggctttggcgagtgcctgctcgccgtcgccttagccggagccccctaccaggctgtcggcctcgtgcagggaacaacaccagtgctccagggactgaacggagctgtgtttagacccgaggttcctctgagaagagacttgcccctactgttgttccgtacccagacatcagatcctgcgatgctcccaaccatgataggcctgctggccgaagctggtgtgagactcctctcatatcaaacatctttggtatcggatggggaaacatggcacgtcatgggtatcagttccctgctacccagcctcgaagcatggaagcagcatgtgacagaggcctttcagttccacttctag

SEQ ID NO: 199434 - DNA, 1602 bp, Artificial Sequence
  Description of Artificial Sequence: Synthetic coding sequence
atggccttcgccaacctgcggaaggtgctgatcagcgacagcctggatccgtgttgtcgcaagatcttgcaagacggaggcctccaggtggtggagaagcagaacctgagtaaagaggagctcatcgccgagctccaggactgtgagggacttatcgtcaggagcgcaactaaagtgactgctgacgtcataaatgctgcagaaaagctccaggtggtgggcagagcggggacaggagtagataacgtcgatctcgaggcagccactcgcaagggaatactcgtcatgaatacaccgaacggcaattcattgagtgcagccgagctgacttgtggtatgataatgtgcttagcgagacagatcccgcaagccacagcatccatgaaagacggcaagtgggagcggaagaagttcatgggcacagagctgaacgggaaaactctgggtatattagggctgggccgaattggcagggaggtggccactaggatgcagtccttcggcatgaaaactatcggatacgacccaataatctccccagaggtctccgccagctttggcgtacaacaattgccactagaggaaatttggcccctgtgcgattttatcacggtccacactcccttacttccttcgacaactggactgttaaacgataacacttttgcacagtgcaagaagggcgttcgggtggtcaattgtgctagaggaggcatcgtcgacgaaggggcgttgctgcgcgcgctacagagcggacagtgcgctggagccgccctggacgtctttactgaagaaccaccccgggaccgggcgctggtagatcatgaaaatgtgatctcttgtccccacctgggagcgagcactaaggaagcccagtcacggtgtggcgaggagatagctgtgcagttcgtagatatggtcaaaggaaaatctcttaccggcgtggtcaatgcgcaggccttaaccagcgccttttcaccacacaccaaaccctggattgggctggccgaggctttgggcacactcatgagggcttgggctggcagcccaaaaggcactatccaggtgatcactcagggtacaagcttgaagaacgcggggaattgtttgtcccccgccgttatcgttggacttctgaaagaggcatcaaaacaagctgacgtcaacttagtaaatgctaaactactcgtgaaggaagctggcctgaacgtgacgacaagtcactctcctgcagcccctggagaacaggggtttggcgaatgcctactggccgtggctctcgcgggtgccccataccaggccgtgggactcgtgcaaggcactaccccagtgttgcaggggctcaacggagcggtattcagacccgaagttcccctcaggagagaccttccactcctactttttcgaactcagacaagcgaccctgcaatgttaccgacaatgattgggctgctggcggaggcgggtgtgaggcttctgagttatcagacttccctagtgtccgacggagagacctggcacgtcatgggtatcagttctcttcttccttcgctcgaggcttggaagcagcacgtgactgaggcctttcaattccatttttag

SEQ ID NO: 199435 - DNA, 291 bp, Artificial Sequence
  Description of Artificial Sequence: Synthetic coding sequence
atgaagaccatcggctacgaccccatcatcagccccgaggtgagcgctagctttggagtacagcaactgcctttagaggagatctggcctctgtgtgattttatcaccgtgcacactccactcttgccttccacaacaggcctgttaaacgataacacatttgcacagtgtaagaagggtgtgcgggtggttaattgcgcgaggggggggatcgtggatgagggcgcactcttgagagccctacaatcgggtcagtgcgcgggggccgcccttgacgtgtttacagaatag

SEQ ID NO: 199436 - DNA, 1221 bp, Artificial Sequence
  Description of Artificial Sequence: Synthetic coding sequence
atgaaggacggcaagtgggagcggaagaagttcatgggcaccgagttgaatggaaagactctgggcatcctaggtctgggaaggatcgggagggaggtcgcaactaggatgcaaagcttcggaatgaagaccattggttacgacccaattattagtcctgaggtcagcgcctccttcggggttcaacagctgccactggaagagatctggcccctgtgcgactttattactgtgcacacccccctcctaccaagcacaacaggcttgctgaacgataacaccttcgcccagtgtaagaaaggggtaagggtcgttaattgcgctcggggcggtatcgtggatgagggcgctctccttagggctctccagagcgggcagtgtgccggggctgccttagacgtgtttactgaagagcccccaagagatcgcgcacttgtcgaccatgagaatgttatttcttgtccacacctcggagcttctacaaaggaagcgcagagccgatgcggtgaggagatcgccgtgcaatttgtggatatggtcaaagggaagtctttgaccggagtcgtcaacgctcaggctctgactagcgcatttagtccccacactaagccctggatcggcctagctgaagctctgggcactctgatgagagcctgggccgggtccccaaaaggaacgattcaggtaatcacacaagggaccagcttaaagaatgccggcaactgcctcagcccagcagtcattgtcggcctgctgaaggaagcaagcaagcaggccgacgtgaacctcgtcaatgctaagctcctcgtgaaggaagccggcttgaacgtgaccaccagccactcccctgccgcgccgggtgaacagggctttggcgaatgcctgctggctgtagctctggcaggtgcaccgtatcaggctgtcgggttggtgcaggggactacaccggtgctccagggcctcaacggagctgttttccgaccagaagtccccctgcggagggacctgcccctgctgctctttcggactcaaactagtgaccctgccatgctcccaaccatgattgggctacttgctgaggctggggttcgccttctgtcttaccaaacgtcgctggtaagtgatggcgagacctggcatgtgatggggatatcatctcttcttccctctctagaggcatggaagcagcatgtaactgaagcctttcagttccacttctag

SEQ ID NO: 199437 - DNA, 1254 bp, Artificial Sequence
  Description of Artificial Sequence: Synthetic coding sequence
atgagcctgagcaacaagctgaccctggacaagctggacgtgaaggggaaacgcgtggttatgcgggttgatttcaacgtacccatgaaaaataaccagataacaaacaatcagcggatcaaggcagccgtgccaagtataaaattttgtttagacaatggagccaagtccgttgtactgatgtcacacctgggccgaccagacggcgtacctatgccggacaagtatagtctagagcccgtggctgtggagttgaagtccctattgggaaaagacgttctgttcctgaaagattgtgtgggcccagaagtggagaaagcttgtgctaaccctgcagccggtagcgtgatactgctagagaaccttaggttccacgtcgaggaggagggaaaggggaaagacgccagcggcaacaaagtaaaggccgagccagccaaaatcgaggccttcagggcatcattatccaaacttggcgatgtctacgtcaatgacgcctttgggactgcacaccgcgctcatagcagcatggtgggcgtaaacctgccacaaaaggcaggggggttcttgatgaagaaggagctcaattattttgcgaaggctctcgagtctcctgaacgtcccttcctcgccatcctgggcggtgcaaaagtggcagataagatacagctgatcaacaacatgcttgataaggtgaatgaaatgattattgggggcgggatggcctttacttttctgaaggtgctgaataatatggaaattggtaccagtcttttcgacgaagaaggcgcgaaaatcgtgaaagacctaatgagtaaagcagaaaaaaatggtgtaaagatcacactgcctgtggacttcgtaacagcagacaagtttgatgaaaatgctaaaacaggccaggcgacagttgcctccgggattccagcagggtggatgggtctagattgtggccctgagtccagtaaaaagtacgccgaggcagtcacgcgtgcaaagcagatcgtctggaacggaccagtgggggtgttcgagtgggaagcctttgctcgcggcactaaggctctcatggacgaggtggtgaaagccaccagtcgtggttgcattacaataattggtgggggcgatacagcaacctgctgtgccaagtggaataccgaggataaggtcagccacgtgtcaactggcggcggcgcctcactggaattactagagggcaaggtcctgccgggcgtggatgctctgagcaacatttag

SEQ ID NO: 199438 - DNA, 846 bp, Artificial Sequence
  Description of Artificial Sequence: Synthetic coding sequence
atgagcctgagcaacaagctgaccctggacaagctggacgtgaaggggaagagagtcgtaatgcgggtggacttcaacgtgccaatgaagaacaatcagattacaaataatcagaggataaaagctgcagtcccgagcataaagttctgcttagataacggggcaaagagtgtcgtgctcatgagccacctaggccgccctgacggcagacccttcctcgccatactgggcggggccaaagtcgcagacaagattcaactcattaacaacatgttagataaggttaatgagatgattataggaggaggcatggcattcacctttttgaaggtgctgaataatatggaaattgggacatcccttttcgacgaggagggggccaaaatagtaaaggatctgatgtctaaggccgagaaaaatggcgtcaaaatcactctgccagtggacttcgtgaccgctgacaaattcgatgaaaacgcaaaaactggtcaggcgacagtagccagtgggataccagccggctggatgggcctggactgcgggccagaaagcagcaaaaagtacgctgaggcggtaacacgcgcgaagcaaatcgtgtggaacgggcctgtaggcgttttcgagtgggaggcctttgctcgcgggacaaaggccctgatggacgaggtggtgaaggccacatctcggggttgcatcactatcataggcggtggggacactgccacttgttgcgccaaatggaacacggaggataaagtctcccacgttagtactggcgggggggcttcactggaactgctggaagggaaggttctgccaggtgtggacgcactatccaatatttag

SEQ ID NO: 199439 - DNA, 729 bp, Artificial Sequence
  Description of Artificial Sequence: Synthetic coding sequence
atggtgggcgtgaacctgccccagaaggccggcggcttcctgatgaaaaaagagctgaactatttcgcaaaggccctagagagcccggagagacctttcttggccattctgggaggggccaaggtggctgataaaattcagcttatcaacaacatgttagataaggtaaatgagatgattattggcgggggaatggccttcacctttctgaaggtcctgaataacatggagatcggcacttccctgttcgatgaggaaggtgctaaaatagtgaaagatttaatgtccaaagctgaaaaaaacggggtcaagatcactttgccagttgatttcgtaacggctgacaaatttgatgagaatgccaagaccggccaggccaccgtggcttccggaattcctgccgggtggatgggacttgactgtggacccgagtcttcgaagaagtacgcggaagccgttacgagagccaagcagattgtgtggaacggacctgtgggcgtgttcgaatgggaggctttcgcccgcggcactaaagctctgatggacgaagtcgtgaaagcaacctccagaggctgtatcactatcattggcggaggagacaccgcaacgtgctgcgcgaaatggaacactgaggacaaggtgtcccacgtgagtacaggaggcggagctagtctggagttgctggagggtaaagtgctgcccggggttgatgccttgtcgaacatttag

SEQ ID NO: 199440 - DNA, 1170 bp, Artificial Sequence
  Description of Artificial Sequence: Synthetic coding sequence
atgaagaacaaccagatcaccaacaaccagcggatcaaggccgccgtgccatccattaaattttgtcttgacaacggagcaaagtccgttgtgctgatgtcccacctgggtcgtccagacggcgtacccatgccagacaagtatagcttagagccagttgcagtggagctgaagtctctcctagggaaggatgtactgttcctcaaggattgcgttggtcccgaggtggagaaagcttgtgcgaaccctgctgccggttctgtgatcctattggaaaacctccggttccacgtggaggaggaagggaaaggaaaggacgcctctgggaataaagtcaaggccgagcccgccaagattgaggcgtttcgtgctagtttaagcaaacttggcgatgtgtatgtgaatgacgcctttggaaccgcccaccgcgcgcattcttctatggttggtgtgaacctaccacagaaagccggcggatttttaatgaagaaggaactgaactatttcgcaaaagccctggaaagccctgagcgaccatttctggcgatactgggtggtgctaaggttgccgacaaaattcaactcattaacaacatgttggacaaggtaaatgagatgataattggcggggggatggccttcacttttctcaaagtgctgaacaacatggagattggcacgtctctgttcgacgaggagggcgctaagatcgtgaaagatctgatgagcaaggcggaaaagaatggggtgaagataactctgcctgtcgacttcgtgactgccgacaaatttgacgagaatgcaaagactggacaagctaccgttgccagtgggattccggctggctggatggggcttgactgcggccccgaatcttccaagaagtacgctgaggctgttacgagagccaagcagatagtctggaacggaccagtgggcgtgtttgaatgggaagcctttgcccgagggacaaaagcactaatggacgaagtggtcaaggccacttccaggggatgtataaccatcattggaggcggagacactgctacatgttgcgccaagtggaacacggaagataaagtgtcacacgtctcgaccggtggaggtgcttccctggagctgcttgagggaaaggtgctccccggcgtggacgcactgtcaaacatctag

SEQ ID NO: 199441 - DNA, 1254 bp, Artificial Sequence
  Description of Artificial Sequence: Synthetic coding sequence
atgagcctgagcaagaagctgaccctggacaagctggacgtgcggggcaaacgagtcattatgcgcgtagattttaacgtgcccatgaaaaaaaaccagattaccaataatcagcgtataaaggcctctataccgagcattaaatattgcttggacaatggtgctaaagcagtggtgctaatgtctcatctggggcgccccgacggcgttcccatgccggacaagtactcgctggcacctgtggccgtggagctcaaaagcctgttgggcaaggacgtgttgtttctcaaggattgcgtcggggccgaagtggaaaaagcttgcgccaatcctgccccgggatccgttatcttattggaaaacctgagatttcacgtcgaggaagaaggcaaagggcaggatccctccggaaagaaaataaaggcagaaccggacaaaattgaagcttttcgtgcgagtctcagtaagttaggagatgtgtacgtgaatgacgcatttggcacggcgcatcgcgcgcacagctccatggttggcgttaatcttccacacaaagcatccggcttcttgatgaaaaaagaactcgattacttcgccaaagccttggaaaacccagttcggcccttcctcgccattctgggcggcgccaaggtcgccgacaaaatacaactgatcaagaacatgttggacaaagtcaatgagatgattatcggggggggaatggcttacaccttcttaaaggttctcaataacatggagatcggagcatctctgtttgacgaggagggggcaaagatcgtgaaggatataatggcgaaagcccagaagaatggggttcgtataacttttcctgtggattttgttactggagacaaatttgatgagaatgcccaggtcggaaaagctaccgtcgctagtggaattagccccggctggatggggttggattgtggccccgagtctaacaagaatcacgcccaggtggtcgcccaggcacggctgattgtttggaatggtcccttgggggtttttgaatgggatgcgtttgccaaggggactaaggctttgatggacgaaatagtcaaggctacctcgaaggggtgtatcaccgtgatcggaggcggcgacactgcaacatgctgtgccaagtggaacaccgaggataaagtgtcccatgtgtccaccggtgggggcgcctccctggaacttttggaggggaaaattctaccgggggtggaggctctgtccaatatgtag

SEQ ID NO: 199442 - DNA, 765 bp, Artificial Sequence
  Description of Artificial Sequence: Synthetic coding sequence
atggccgcctacaagctggtgctgatccggcacggcgagagcgcctggaatctcgaaaacaggttctccggctggtacgacgcggatcttagccctgctggccacgaggaggcaaaaagaggtggccaggccctgagagatgccggctacgagtttgatatctgctttacttcggttcagaaaagggcaattaggacactctggaccgtacttgacgctattgaccaaatgtggctcccagtcgtccgaacctggcgacttaacgagcggcactatgggggcctgacaggtcttaataaggcggagacggcggcgaagcatggggaagcccaggtaaaaatttggcgtaggtcctacgatgtgccgccgcctcccatggagccagatcatcctttttattcaaatatctctaaagaccggagatacgcagatcttaccgaggatcagcttccctcctgtgaatcactaaaagacacaatcgctcgtgccctccctttctggaatgaggagatcgttccccagatcaaagagggcaaaagggtcctgatcgccgctcatggtaattccctgagggggatcgtaaaacaccttgaagggctgagtgaagaagctattatggagctgaatctgccaactgggattcctatcgtctacgaattagacaaaaatctgaaacctataaaacctatgcagtttctgggtgatgaggaaacagtgcgcaaggccatggaggcggtcgcagcacaggggaaggcgaaaaagtag

SEQ ID NO: 199443 - DNA, 435 bp, Artificial Sequence
  Description of Artificial Sequence: Synthetic coding sequence
atgcccctgatccggtgcggctgccacgacgtgccccccccccccatggagcccgatcacccattttactcgaacattagtaaggacagaagatatgctgacctgacagaagaccaattgccatcttgtgagagcttgaaagacaccattgcgcgtgctctgcctttctggaatgaggagatcgtgccacaaataaaggaggggaaaagggtgctcattgccgcacacggtaactcccttcgaggcatcgtgaagcatctcgagggactgagcgaagaagcaatcatggagttaaacctgccaacaggcatccccatagtgtatgagctggacaagaaccttaagcctattaagcccatgcagttcctgggagatgaagaaaccgtgaggaaagcaatggaggcggtggcagcacaagggaaggccaagaagtag

SEQ ID NO: 199444 - DNA, 762 bp, Artificial Sequence
  Description of Artificial Sequence: Synthetic coding sequence
atggccacccaccggctggtgatggtgcggcacggcgagagcacctggaatcaggagaacagattctgtggctggttcgacgccgaattatcggagaagggaacagaggaagctaagaggggggccaaagccattaaggacgctaagatggagttcgacatttgttataccagtgtgttaaaacgggctattaggacgctctgggcaatcctggatggcactgaccagatgtggttgcccgtggtgagaacctggagactgaacgaaagacactacggggggctcacaggcctgaacaaggcagaaacagccgctaaacacggcgaggaacaagttaagatatggcggagatcattcgatatcccccccccacctatggacgagaagcacccctactacaacagtatcagtaaagagcggcggtatgcaggactgaaacctggcgagctacccacctgtgagagccttaaggatacaatcgcccgcgccctccccttctggaatgaagaaatagtcccccagataaaagctggaaagagagtcttaatcgcagcccatggtaatagcttgagaggtattgtcaaacacctggagggtatgtccgaccaggccatcatggaattaaaccttcctactggtatcccgatcgtctacgagcttaacaaggagcttaaacctacaaaacccatgcaattcctgggcgacgaggagactgtacgcaaagccatggaagcagtggcagcacaaggaaaggctaaatag

SEQ ID NO: 199445 - DNA, 765 bp, Artificial Sequence
  Description of Artificial Sequence: Synthetic coding sequence
atggccgcctacaagctggtgctgatccggcacggcgagagcacctggaacttggaaaaccgtttttcgtgttggtatgatgccgatctgtcccccgccggacatgaggaagctaaaagggggggtcaagccctccgagatgccggatatgagttcgacatttgtttgacgagcgtccagaaacgggtgatacggacgctgtggaccgtgctggatgctatagatcaaatgtggctcccagtggtgcgcacttggagactcaatgagaggcattatggcggcttaacagggttaaacaaggccgagaccgcagcgaaacatggtgaagcacaggtgaaaatctggaggcgcagctatgacgtgccccctcctcccatggagcctgaccatccattctactccaacatatccaaggacagaaggtacgctgacttaacagaggaccagttgcctagctacgagagtcccaaagatacgatcgctcgggcactgcctttttggaatgaggagattgtgcctcaaataaaagaaggtaagagggtccttatcgctgcacacggaaacagtcttcagggtatcgccaagcacgttgagggactttccgaagaggctattatggaattaaatctacctaccgggatacctatcgtctacgagttagacaagaacctcaaacccatcaagcctatgcagttcctaggagatgaagagactgtctgtaaggcaatagaggcggtggcggcccagggcaaagccaaaaaatag

SEQ ID NO: 199446 - DNA, 966 bp, Artificial Sequence
  Description of Artificial Sequence: Synthetic coding sequence
atggccgccgccgaggccggcggcgacgacgcccggtgcgtgcggctgagtgccgagagagcacaggccctcttagctgacgtggacacattgctcttcgactgtgatggagttctgtggcgtggcgaaactgccgtgccaggcgcccccgaagcactgagagctttgcgcgcacgggggaagagactcggattcataacaaacaactctagcaagacacgcgccgcttatgcagaaaagcttcgcaggctcggatttggtggacccgccgggcccggggcatctttagaggtgtttgggaccgcctattgcactgcactgtaccttcgacaaagactggcaggggcgccagctccgaaagcttatgtgctgggttcccctgcccttgccgccgagttggaggcagtgggtgttgcttctgtgggcgtcggtccagagccgttgcagggagaagggcccggcgattggctgcacgcccctctggagccagatgtgagggccgtcgtcgtcggctttgatcctcatttcagctacatgaaactgaccaaggccctgaggtaccttcagcaaccaggatgtttgctggtgggaacgaacatggacaacagattacctcttgaaaatggccgattcatagccggtactggctgcttggtgagggcggtcgagatggccgcacaacgccaggctgacatcatcggtaagccctctcggtttattttcgactgtgtgtcccaggagtacggaatcaatcctgaacgtaccgtgatggtcggcgatcgcctggatactgacatcctgctaggagccacttgtggcctaaagaccatacttacactgaccggagtgtcgactctgggcgatgttaaaaacaatcaggaatccgactgcgtgagtaagaaaaagatggtgcccgatttttatgtagatagtattgccgacctcctgcctgcactgcagggctag

SEQ ID NO: 199447 - DNA, 378 bp, Artificial Sequence
  Description of Artificial Sequence: Synthetic coding sequence
atggccgtggccgacctggccctgatccccgacgtggacatcgacagtgatggcgtctttaagtacgtgctgatccgggtgcactccgccccaaggagtggagccccagccgccgagagtaaagagatagtgaggggctacaaatgggccgagtatcatgccgacatctatgataaagtcagcggtgatatgcaaaaacagggttgcgactgtgaatgtctgggcggcggccgcatcagccaccagtcccaggataaaaaaatacacgtgtatgggtattctatggcatatggccctgcacaacatgctatatctaccgagaaaataaaggctaagtaccctgactacgaggtcacctgggcaaatgatggttactag

SEQ ID NO: 199448 - DNA, 375 bp, Artificial Sequence
  Description of Artificial Sequence: Synthetic coding sequence
atggccgtggccgacctggccctgatccccgacgtggacatcgactcagacggggtgttcaaatatgtcctgattcgcgtccacagtgcacccaggtctggcgcgcccgccgccgagtcaaaggaaatcgtccgcgggtacaaatgggccgaataccatgccgatatatacgataaggtctccggagacatgcaaaagcaagggtgcgattgcgagtgcctgggtggaggacgaattagccaccaatcacaggataaaaaaattcacgtctacgggtatagtatgatgcgacctacatgcgttccactgggagcgagcggacctcgcatccatcatcagggactttggtcttgccccgcgagacattttaactag

SEQ ID NO: 199449 - DNA, 375 bp, Artificial Sequence
  Description of Artificial Sequence: Synthetic coding sequence
atggccgtggccgacctggccctgatccccgacgtggacatcgacagtgatggggttttcaagtacgtgttaattagggtgcacagcgctcctagatctggggctcctgccgctgaatccaaggagatcgtcaggggatacaagtgggcagagtaccatgccgatatctatgacaaggtgagcggtgatatgcaaaaacagggatgtgattgcgaatgcctcggcggtggtaggatctcccaccaaagccaggacaaaaaaatccacgtctatggctattctatgatgagaccaacatgcgttccactcggtgcctcaggcccccggatccaccaccagggcctctggagttgccctgccaggcattttaactag

SEQ ID NO: 199450 - DNA, 1356 bp, Artificial Sequence
  Description of Artificial Sequence: Synthetic coding sequence
atggccaccgacgacaagaccagccccaccctggacagcgccaacgacttgcctcgcagccccacgtcccccagccacctgacccacttcaagcctctgaccccagaccaggacgagccaccctttaaatccgcatacagcagcttcgtcaatcttttccggttcaacaaggaaagggctgaggggggacagggggaacagcagcccctttcgggttcttggacgagcccgcagctgcctagtcgtacacagagtgtaagatcgcctaccccttataagaagcagctcaacgaggagctacagagaagatcgagcgctctgggcgacctgcgcgcgtgcacttactgccgcaagatagccttgtcatacgctcatagcaccgattcgaactccatcggggaagacttaaacgccttgtccgactctgcgtgttctgttagtgtcctggacccgtcagagcctcggacacccgtcggcagtaggaaggcttctagaaacatattcctcgaagatgacttagcatggcaatccctgatccaccccgatagttcaaatactcccttgagcacccggcttgtgtcagttcaagaagacgccggcaagtcccctgcacgcaatcgcagtgctagtatcaccaatctgtccctggaccgctctggatccccaatggtgcccagttatgagacctcggtatccccacaagccaatcgcacatacgtgagaacagagacaaccgaagatgagagaaaaattctgctggattctgtgcagctaaaggatctgtggaagaaaatatgtcatcattcatccggcatggagtttcaagaccaccgctattggctcaggacacaccccaattgtatcgtgggtaaagaactggtaaactggctgatccggaatggacacattgctacaagggcacaagcaatcgctattggccaggccatggtcgacggacgctggctcgattgtgtgtcacaccacgatcagttgttccgagacgaatatgccctctatcgccccctacaatccacggagttctcagagaccccatcaccagacagtgattcagtcaacagtgttgaaggtcacagcgaaccaagctggtttaaagacatcaagtttgatgactccgataccgagcagattgccgaagagggcgacgataaccttgcaaactctgcatctccatcaaaaagaacctccgtttccagttttcaaagcactgttgattccgacagcgcagcctccatctctctgaatgtggaactggataacgttaatttccacattaaaaagccaagcaagtatccacatgtacctcctcaccccgcagatcaaaagggccgccggtag

SEQ ID NO: 199451 - DNA, 1647 bp, Artificial Sequence
  Description of Artificial Sequence: Synthetic coding sequence
atggccaccgacgacaagaccagccccaccctggacagcgccaacgacctccctcgaagtccaacaagcccttcgcatctgactcacttcaagcctctgacaccagaccaggatgagcctccctttaagtcggcctactcgagcttcgtaaacctgttccggttcaataaagaaagggcagaaggcggacagggggaacagcagcctctctctggttcttggacgtccccacagctgccttctaggactcaaagtgttcgcagtcccacgccttacaagaaacagctcaatgaagaactccagagacggagctccgctctggacacacgacgtaaagctgagccaacgtttgggggtcacgacccgaggaccgccgtacagctgcgcagcctcagtacggtcctcaaaaggcttaaagaaattatggagggaaaaagtcaggacagcgacttgaaacaatactggatgcctgatagccagtgcaaggagtgttacgattgttccgagaaatttactactttcaggagacgccatcactgtcgactttgcggacagatcttttgctctaggtgctgcaaccaggaaattcctggaaaatttatgggctacaccggtgacctgagggcgtgcacctactgccgaaagatcgcactgtcttatgcccactccactgattctaactcgatcggcgaagatctaaacgcactcagcgattctgcctgtagcgtgtcagtattggatccaagcgaaccccgaactcccgtggggtctcgtaaagcatcaagaaatatatttttggaagatgatctggcttggcaaagcctgatccaccccgacagctctaacaccccactgtccacccggctggtcagcgtgcaggaggatgcaggaaagtctcctgcaaggaacagatctgctagcatcactaatctcagccttgaccgatccggatccccgatggtccccagttatgagaccagcgtatccccccaggccaaccggacttatgtgagaacagagaccacggaagacgagagaaagatattgctagactctgtacaactgaaggacctctggaaaaaaatatgccatcactcctcaggcatggagttccaggaccatcgctactggctcagaacccaccctaactgcatagtgggcaaggaactggtgaattggcttatccgtaacggccacattgctactcgggcacaggcaattgcgattgggcaggccatggtcgatggccgatggctggactgcgtcagtcaccatgaccaattgttccgagatgagtatgcactgtatcggcctctacagtctactgagttttctgaaaccccctcacctgattcagacagtgtcaattcagtggaaggacacagcgagccaagttggttcaaagatattaagtttgacgactctgacacagaacagattgcagaagagggagacgacaatcttgccaatagcgccagtccatctaagcggacttcagtctctagcttccagtcaacagtcgatagcgattccgcggcttccatctcactgaatgtagaactagacaatgtgaatttccatattaaaaaaccctccaagtacccccatgtaccacctcacccagctgatcagaaagggagacgatag

SEQ ID NO: 199452 - DNA, 6297 bp, Artificial Sequence
  Description of Artificial Sequence: Synthetic coding sequence
atggccaccgacgacaagaccagccccaccctggacagcgccaacgacctgccgcggtcacctacctctccctcacatctaacacattttaaaccactaacccccgatcaagatgagccgccatttaaaagcgcttactcatcatttgtgaatttattccggttcaataaagagagggccgaagggggtcagggcgagcagcaaccactctctggttcgtggactagcccgcaactccctagccgcacacagtcggtgaggtctccaactccttacaagaaacagctcaacgaggagctgcagcgccgcagctctgcactggatacaaggcgaaaggcagaacctactttcggtgggcacgaccccaggaccgcggtgcagcttaggagcctgtcaactgtgctcaaacggctgaaggagatcatggagggcaagtcgcaggattctgacctcaaacagtactggatgcctgactcacaatgcaaggagtgttatgactgttctgagaagtttacgactttccgccgccgtcaccattgtcgtctttgcggtcagattttttgctctcgctgctgtaatcaggagatcccgggtaaattcatgggttatactggggacctgagagcgtgcacctattgtcggaaaattgcattgtcatacgcccactccacagacagtaacagcataggagaagacctgaacgcgctctcggactcagcgtgttctgtatcggtgttggaccctagtgagccaagaaccccagtaggttccaggaaggctagccggaatatcttcttagaggacgacctggcctggcagagcctcatccaccccgatagcagcaacaccccactttccaccagattggtgagtgttcaggaggatgccggaaagtctccagcacggaacaggagtgcatccattactaacctgtctctggatcggtccggtagcccaatggtcccctcatacgagacaagtgtgtcgcctcaagctaatcggacatacgttcgtaccgaaacaaccgaggatgagcggaagattctgttagactcggtccagctgaaagatttatggaagaaaatatgtcatcactcgagtggaatggaattccaagaccacagatactggcttcggacgcaccccaattgtattgtgggcaaggaactggtgaactggctgataagaaacggccacattgccacaagggcccaggccatagctattgggcaggccatggttgacggtcgctggctggattgtgtgtctcaccacgaccagctgtttagggacgagtacgcgttgtaccgccctttacagagtacagaattctctgaaacccccagtcctgattctgactccgtaaactctgtggaaggtcactcggagcccagttggttcaaagacataaagtttgatgattccgataccgagcagatcgccgaggagggggacgacaacctcgctaactctgcgtcccccagtaagcgcacctctgtgagtagcttccaatccacagtagattccgactctgccgctagtatcagcttgaacgtcgaactggataacgtgaattttcacataaagaagccgtcaaaatatccccacgtgccacctcacccagcggaccagaaggagtatctgatctcagatacaggaggccagcagctgtctattagcgatgccttcattaaagagtccctgttcaataggagggtcgaggagaagtctaaggaactgccattcacccctctcggatggcaccataataacctcgagttgctgagagaagagaacggggaaaagcaggctatggagcgcctccttagcgccaatcacaatcacatgatggctctgcttcagcagctgttgcactccgacagtctgagtagcagctggcgggatatcatagtttctttggtatgccaagtagtacagacagtgcgacccgatgttaaaaatcaagatgacgatatggacatcaggcaattcgtacacatcaaaaagattccaggcggcaagaaattcgattcagtcgtcgttaatggattcgtttgcaccaagaatatcgcgcacaagaagatgtcctcatgtatcaaaaacccaaaaattctactgctgaagtgttctattgagtacctctatagggaggaaaccaaatttacgtgcatagaccctattgtgctgcaggagcgagagttccttaaaaactacgtgcagcgaatcgtggatgtaaggcctaccctcgtgctggtcgagaagaccgtttcacgtattgcccaggacatgctactggaacacggcattacccttgtgatcaacgtgaaaagccaggtgctcgagcggatcagcagaatgacacagggcgacttggtaatgagcatggatcaactgttaactaagccacatcttgggacatgtcataagttttacatgcagatcttccagctccccaatgaacagacaaagaccctgatgttcttcgaaggatgcccacaacacctggggtgcacaataaagctgcgcggtgggtccgactacgagctggctagagtcaaagagatattaattttcatgatttgcgtggcctatcacagccagcttgagatctcctttctaatggacgagtttgcgatgccgccgacccttatgcaaaacccctcttttcactcgttaatcgagggcaggggacatgaaggagcagtacaggagcagtatggcggagggagcattccgtgggatcccgacataccgccagagagcctcccatgcgacgactccagcctgctcgaactacgcatcgtgtttgaaaaaggggagcaggaaaacaagaatctgccacaggcagtggcgagcgttaagcatcaagagcattcaaccactgcttgtcctgccggactaccctgcgccttctttgcgcccgtccccgagagcctgcttccacttccagtggatgatcaacaggacgcactgggatcagaacaaccagagactcttcagcagacagtagtgctgcaggatcccaaatcacagattagggccttccgtgacccattgcaagacgataccggcctatacgtaacggaggaggttaccagtagcgaagacaaacgtaagacgtacagcctagccttcaagcaggagctaaaagatgttattctctgcatttctccagtgatcacattcagggaaccattcctgctgaccgagaaaggcatgaggtgcagtacccgagactacttcgcagaacaggtatactggtctcccttgctgaataaggaatttaaagagatggagaatagacgaaaaaagcagctgctgagggatctctcaggcttgcagggaatgaatggctccattcaggctaagagcatacaggtgcttccaagccacgaactggtttccaccaggatcgctgagcatctcggagatagccagagcctcggaaggatgctggccgactatcgggcaaggggtggccgaatccaaccaaaaaattccgatccctttgcgcactccaaggacgcttcctcgacttccagcggtcagagcgggtccaagaatgaaggagatgaagagcggggtctgattctgtcagatgccgtgtggtcaacaaaagtggattgtcttaatccaatcaatcatcagcgcttgtgcgtgcttttttctagctccagcgcccagtcttccaatgcaccttccgcttgtgtcagcccttggattgtcactatggagttttacgggaagaatgatttaaccctcggaatatttctcgaacggtactgtttcaggccgtcgtatcagtgcccttctatgttttgtgacacccccatggtccaccatatccgcagatttgttcatgggcagggatgcgtgcagattatcctgaaagagctggattcacccgtgcccggttaccagcatactatcttgacatatagttggtgtcgcatctgcaagcaagtcactccagttgtggccctttctaacgaatcttggtccatgtcctttgctaagtaccttgagctccggttttacgggcaccagtacacaaggcgcgctaacgcagaaccatgcggccacagtattcatcacgactatcaccagtacttctcttacaatcagatggtcgctagcttctcctattcccctattcggctgctggaagtgtgcgttcccctccccaagatcttcattaaaaggcaggcacctctcaaagtatctctgctgcaggatcttaaagatttttttcagaaggtctcgcaggtgtacgtggcgattgacgagagacttgcctctctaaaaaccgacacattcagtaaaacccgggaagaaaagatggaagatatatttgcacagaaggagatggaggaaggggagtttaagaactggatcgagaaaatgcaggctcgtctcatgagttcaagcgtggacactccccagcagctgcagtcagtgtttgagtctctcatcgccaagaagcagtccttgtgcgaggtgctacaggcctggaataatcggttgcaggatttattccagcaagagaaaggacggaagcgcccctcagtgccaccaagtcctggtagactcaggcagggggaggagagtaagatcagtgccatggatgcgtcacccaggaacattagtcccggcctgcagaacggagagaaagaggacagatttctgactacactatccagtcagtctagcaccagtagcacacacctgcaactgcctacacctcctgaagtcatgtcagagcagtctgtgggcgggccccccgaactggataccgctagcagcagtgaagatgtgtttgatggccacctgctgggatctacagactcacaggtcaaagaaaagagcactatgaaggcaattttcgccaatctcctcccaggtaatagttataacccgatcccgtttcccttcgatcccgataaacattacctgatgtatgagcatgagcgagtgccaatagcagtatgcgagaaggagccgagctcaataatagcctttgcattgtcttgcaaggaataccgaaacgcattggaggagctcagcaaagccacccagtggaactctgctgaggagggactgcctacgaactcgacatccgacagtagacccaagtctagcagtcccattaggttgcccgaaatgtcagggggacagacaaatagaaccactgagaccgagccccagccaaccaaaaaagcttctgggatgttatctttcttcaggggcaccgcggggaaaagccccgacctgagctcacagaagcgcgagaccctgaggggcgcagattcagcctactatcaagtgggccagactggtaaggagggcacagagaaccagggcgtagagccccaggatgaagttgatggaggtgacacacagaaaaagcagcttattaatccacacgttgagctgcagttctctgacgctaacgcgaagttttattgtagactgtattacgctggggaatttcataaaatgagggaggtcattctcgatagcagcgaggaggacttcatacggtccctgtcacacagctccccatggcaggcacgaggtggaaagtcaggggccgctttctatgcgacagaggacgatcgctttattcttaaacaaatgccacgccttgaagtacagtctttccttgacttcgctccccattactttaactacatcaccaacgccgtgcagcagaaaagacctactgccttggccaagattctgggcgtctaccgcatcggctataagaactcgcaaaataacacggaaaaaaaattagacctgctggtgatggagaaccttttttatggccggaaaatggctcaggtgtttgatctgaagggctcactgcggaaccgcaatgtgaaaacagataccggaaaggaatcctgcgatgtagttctgctggatgagaatctcttgaaaatggtgcgcgataacccgctgtatattcggtcccactcgaaggctgttctacggacgagcattcactctgacagtcattttctctcttcccacctgattattgactacagcctgctagtgggaagagacgatacctcgaatgaactagtggtgggaataatcgattacatccggacctttacatgggacaagaagctggagatggtggtgaaatccacagggatacttgggggacaggggaagatgccaaccgtggtgagccctgagctgtatcgaacccgcttttgcgaagccatggataaatacttcttgatggttccagatcactggaccggcttaggactcaactgctag

SEQ ID NO: 199453 - DNA, 3051 bp, Artificial Sequence
  Description of Artificial Sequence: Synthetic coding sequence
atggagttccaggaccaccggtactggctgcggacccaccccaactgtatcgtgggaaaagagctcgtgaactggcttatccgcaacggacacatcgcaactagagcccaggcgatagccattgggcaggcaatggtggacgggcgctggttggactgtgtcagccaccacgaccagttgttcagggatgagtatgcactgtacaggccactgcaaagcacagagttctcagagactccatctcccgattccgattctgtgaacagtgtggagggccactccgagccctcatggtttaaagacattaagtttgacgactctgacacagagcaaatagctgaggagggggacgataatttggccaaatacctcatctccgataccggggggcagcagctgtctatctccgacgctttcatcaaggaatctctttttaatcgacgtgtggaagagaaatctaaggaactcccattcacacctctggggtggcatcacaacaatcttgagctgttaagagaagagaacggggaaaagcaggccatggagcgtctgttaagcgctaatcacaaccatatgatggccctgctgcagcagcttctacatagtgattccctctctagtagctggagagacattatcgtatctttagtgtgtcaggttgtgcagaccgtgagacccgacgtgaaaaatcaggatgacgatatggacataaggcagttcgtccatattaagaaaatcccaggaggcaagaaattcgactcagtggtggtgaacgggttcgtttgcacaaagaatatcgcccacaagaagatgtcctcatgcataaagaaccctaagatccttctcctcaagtgttcaatcgaatacctctatcgcgaagaaaccaaatttacatgcattgacccaattgttctgcaggagcgcgaatttctgaagaattacgttcaaagaatcgttgatgtacgcccgacgcttgtgctggttgaaaagacagttagtaggatcgctcaagatatgcttctcgaacatgggatcacactggtaattaacgtgaagtcacaggtgctggagcggatctctaggatgacgcagggtgaccttgttatgtccatggatcagcttcttaccaaacctcatctgggcacatgccacaaattttacatgcagattttccagttgccgaatgagcagacaaagacattgatgttttttgaaggatgccctcagcacctggggtgcaccatcaagctaaggggaggcagcgattacgagttggcacgtgtgaaggagattcttatcttcatgatctgtgttgcctatcactctcagttggagatctccttcctgatggatgaattcgctatgccccccacactgatgcagaacccaagctttcattctctaatagaggggcgcggacatgagggagcggttcaggaacagtacggcggtggctccataccttgggatccagatattcctcccgagagtctgccttgtgatgacagctctctactggagctgcgaatcgtgtttgaaaaaggagaacaggagaacaagaacttgcctcaagccgtggcctctgttaaacatcaggagcattccacgaccgcgtgtcccgctggcctgccgtgtgccttctttgctcccgtcccagagagcttactgcccctacctgtcgacgaccagcaggatgccttgggatccgaacagccggagacgctgcagcagaccgtggtgctgcaggatcccaaatcacaaatccgagcattccgggaccccctgcaggatgacactggactctatgtgaccgaagaagtgacatcctctgaagataagagaaaaacctattctctcgccttcaagcaggaactcaaagacgtgattctgtgcatctccccggtgatcacgttccgcgaacctttcttgttaactgaaaaggggatgagatgcagtacgagggactattttgccgaacaagtctattggagcccactcctgaataaagaatttaaagagatggagaatcgacgaaaaaaacaactcctgcgcgacttgtcgggtcttcaggggatgaatggttccatacaggcgaaatcgattcaggtgttaccttcacatgagctagtgtcaacaagaatcgcagagcatttaggcgatagccagagcctggggcgcatgctagcagattatagagcccgtgggggccggatccagcctaagaattctgacccattcgcccatagtaaagatgcctcatccacaagctcaggccagagcgggtctaaaaatgaaggcgacgaggagagaggcctgatcctctcagatgctgtctggagcaccaaagtggattgcctgaacccaatcaatcaccaaaggctctgcgtattattttctagtagctccgctcagagctccaacgcaccaagcgcttgcgtctccccttggattgtgaccatggagttttacgggaagaatgacctcacccttggaatcttcttggaaaggtactgcttccggcctagctaccaatgtcccagcatgttttgtgatacgccaatggtgcatcacatccggagattcgtgcatgggcagggctgcgtgcagatcatcttgaaggaactggactctcctgtgcccggctatcagcatactatcctgacatattcttggtgtagaatctgcaaacaagtcacgccagtggtcgctttgtccaacgagtcgtggtcgatgtctttcgctaagtacctagagctgagattctacggccatcagtatactcggagggcgaacgccgaaccttgcgggcattcgatccaccacgactaccaccagtatttctcatataatcagatggtggcctccttctcatattctcccatcagactcttggaagtttgcgtacccttgccgaagatatttataaaaaggcaggcccccttgaaggtcagcctgttgcaggacttgaaggactttttccagaaagtgtctcaggtgtatgtcgcaatcgacgaacggctggcctcactcaagactgacactttttcctag

SEQ ID NO: 199454 - DNA, 522 bp, Artificial Sequence
  Description of Artificial Sequence: Synthetic coding sequence
atgcggccctggagcagccccgcccagctggtggccggcgcccagcctgccggacggggtgatccactcgggcctcggcctattcctccaccgaggttccgccgagcctcaagtcagcgtgaacctccatacccgcggccagccgaacccgcccttgagctggccggttctaaatgtcaacccgatacacctgctgcctctctatgtccagccgactcacccagccagcaccgcgtaatgcccccaggcccagcatcttgggcaaacgttggttctcgcccgcataccgttgccaatgggcacgagctgttcgaggtgtctgaagaaagggatgaagaagttgcagccttttgccatatgctggatatcttgcgcagtggctccgatatacaagactatttcctcaccggctacgtgtggtccgctgtcaccccatccccggaacacttaggcgacgaggtcaacctcaaggtgacagtcctgtgcgataggttgcaggaagcattaactttcacatgctag

SEQ ID NO: 199455 - DNA, 4905 bp, Artificial Sequence
  Description of Artificial Sequence: Synthetic coding sequence
atgagcagcacccagggcaacggcgagcactggaagagcctggagtccgttggcatctcccggaaagagcttgcaatggccgaagccttacagatggagtatgatgcattgagccgcctacgtcacgacaaggaggaaaatcgggctaaacagaacgccgacccctctctgatcagctgggatgagccaggcgtggatttctactccaagccagccggcaggcgcaccgatctgaaactgctgcgggggctgagcggctccgaccccacgctcaattacaactccctctccccgcaggaggggccaccaaaccattctacctcacaggggcctcagcccggcagcgacccatggcccaagggctcgctctcaggggattacctgtatatattcgacggctccgacggaggcgtctcaagcagtcctggtcccggcgacatcgagggctcatgcaaaaagctgtcaccacctcccctcccaccaagagcgtctatttgggatacaccccctctgccgccacggaaaggctccccctccagttcaaagatctcacagccatccgatattaacacatttagcctcgtagagcagctgcccggaaaattgttagagcatcgcatccttgaagaggaagaggttctgggaggaggaggacagggacgattgctggggtccgtggattatgatggaatcaatgatgctatcaccaggttgaacctgaagtccacatatgatgctgaaatgctcagggacgccactcggggctggaaagagggaagaggtcctctggattttagtaaagacacatccggcaagcccgtggctaggagtaagacaatgcctccgcaggtgcccccccgcacctacgccagccgctacggcaaccgaaaaaacgcaactccaggaaagaacaggcggatcagtgcagctccggttggctcacggccacatacagtggcaaatggacatgagctgttcgaagttagcgaagaacgcgatgaggaagtggctgctttttgtcacatgctcgacatcctgcgcagtggcagcgacatacaggactattttctgacaggctacgtctggtcagccgtaaccccaagccccgagcacctcggggatgaagtgaatctgaaagttacagtgctctgtgaccgacttcaggaggccctcacttttacctgcaactgctccagcactgtggatctcctgatttaccagacactgtgctatacacacgacgacctgcggaacgtggatgtgggcgactttgtcttgaagccatgtggcctggaagagttcctgcagaacaaacatgcgctcggctctcatgaatatatccaatattgccggaagtttgacatcgacattaggcttcagttgatggaacagaaggtggtgagatctgacttggccagaaccgtgaatgacgaccagtctccaagcactctgaattatctcgtgcatctccaggagcggcccgtgaaacagacaatatcccgccaagcactgtccctgctgttcgatacgtaccataatgaggtcgatgcatttctgttagcagacggcgactttccactgaaggcagacagagtggtccagagcgtaaaagccatctgcaacgctctggctgcagtcgagacccccgaaataacttctgccctgaaccagcttcctccgtgccctagcaggatgcaacctaagatccagaaggaccctagcgtcttggctgtgagggaaaatcgggagaaagtagtcgaggccttaaccgccgctatcctggatcttgtggagctgtactgtaacacattcaacgctgatttccagacagcagtgcctggaagtcgtaagcacgacctggtgcaggaggcatgccattttgccaggagcctggcttttaccgtttacgcaacccaccgtatcccaatcatctgggctactagctacgaagacttctatctctcttgttctctttcccacggaggaaaagaactgtgctcccccctgcagacccgcagagcgcatttctcaaagtacctgttccatctgatcgtgtgggatcagcagatctgtttccccgtccaggtgaacaggctacctagagaaacgttactgtgcgccaccctgtatgctctaccaattcctcctccaggctcaagtagcgaagccaacaagcaaagacgcgtgccggaggcactcggatgggttacaacaccgttatttaactttcggcaggttttgacatgcggtcgcaaattacttgggttatggccagccacccaggaaaatcctagtgcccgatggtccgcacccaatttccatcagcctgacagcgtcatcctgcagattgacttcccaacgtccgcttttgatatcaaatttacgtctccacccggcgacaaattcagtccgcggtacgaattcggctctctgcgcgaagaagatcagcgtaagctcaaggacatcatgcaaaaggagtccctttattggcttaccgacgcagacaaaaagcggctgtgggaaaaaagatattattgccattccgaggtgagcagcctgccgctcgttctggcaagcgcgccatcttgggaatgggcctgtttaccagatatttatgttcttctgaaacagtggacccacatgaatcatcaggatgcccttggcctgctacatgccacattccccgatcaggaggtgcggcgtatggccgtccaatggataggaagcctgtcagatgctgagctcctcgactatctgccccagctcgtccaagccctgaagtatgaatgttacctggactcccccctggtacggtttttacttaagcgagctgtgtccgatctgcgtgtgacccactactttttctggctgctgaaggatggattaaaagactcccagttttctatccgataccagtaccttctggcagccctcctttgctgttgcggcaagggcctgcgtgaggagtttaacaggcagtgctggcttgtcaatgccttggccaagctcgcccagcaagtgagagaggccgcgccaagtgcccgccaaggaatcctccgcactggcctagaggaggtaaagcagttctttgcactgaacggatcctgtcggcttcctctgtcaccttcgctgctggtgaaggggatcgtcccgcgggattgcagctacttcaattcaaacgctgtccctctgaagctttcttttcagaacgtggacccactgggcgaaaacatacgcgtcatttttaagtgtggcgacgatctgagacaggatatgttgaccttgcaaatgataaggatcatgagtaaaatctgggtacaggagggattagatatgcgcatggtgatattccgctgcttttccaccgggcggggacgcggcatggtggagatgattccaaacgctgaaactttacgcaaaatacaggttgagcacggagtgactggcagtttcaaggataggccacttgcagactggcttcagaaacacaatccaggcgaagacgaatacgagaaggctgtcgagaacttcatttattcttgtgcaggatgttgcgtggccacctatgtcttaggtatctgtgacagacacaatgacaatattatgttgaagaccactggtcacatgttccacattgatttcggcaggttcctgggccacgcacagatgtttgggaatatcaagagagatcgggccccatttgtgtttacgtcagatatggcctacgtaattaacggcggcgataaacccagctccaggtttcatgattttgtggacttgtgctgtcaagcctacaatctcattaggaaacacactcatctgtttctcaacctcctcgggcttatgctgtcttgtggtataccagaactctcggatctggaggatttaaagtatgtctatgacgctctgagacctcaggatactgaagccaacgcaactacctactttacacggttgatcgagtccagcctgggctccgtggctacaaagttaaatttcttcatacacaacttagctcagatgaaatttacaggtagcgacgacaggctgactcttagtttcgcctccagaactcacacccttaagagcagtgggcgtatttcagacgtgttcctgtgccgacacgaaaaaattttccatccgaataagggctacatatacgtggtgaaggtgatgcgtgaaaacacccacgaagccacgtatatccagcgcaccttcgaggaattccaggaactccacaacaagttgaggctgctctttccttcttcccacctgccctcattcccctccaggtttgtgatcggcaggagtcgcggggaagccgtcgccgagagacggcgtgaggagctgaatggatacatctggcatttgatccacgcccctcccgaggtcgccgaatgcgacctcgtgtacaccttcttccatcctctgcccagagacgaaaaggccatggggacgagtcccgctcctaagagcagcgatggaacctgggctaggcccgtggggaaagtcggcggagaggtgaagttgagcattagctataagaacaacaagcttttcatcatggtgatgcacatccggggtctccagttactacaggatggcaatgaccctgatccatatgtgaagatttacctgctgcccgacccccaaaaaacaaccaagcggaagaccaaggtcgccagaaagacatgcaacccgacgtataatgaaatgctcgtgtatgacggtatcccaaaaggggacttacagcagcgagaactgcagctgagtgtgctgtccgaacaaggcttttgggagaacgttctcttaggtgaggtcaacattcggctgcgtgagctagatttggctcaggaaaaaacaggctggtttgccttagggtcgagatcccacggcaccctgtag

SEQ ID NO: 199456 - DNA, 360 bp, Artificial Sequence
  Description of Artificial Sequence: Synthetic coding sequence
atgttcggcaacatcaagcgggaccgggcccccttcgtgttcacctctgacatggcctatgtgatcaatggaggtgataaaccgtcatccaggtttcatgactttgtggacttgtgctgtcaggcttacaatctcattcgcaaacacacgcatctgtttttgaacctgttgggactgatgttgtcttgtggaattcctgagcttagtgatttggaagatctgaaatacgtctacgacgccttgcgcccgcaggatacagaggctaatgcaaccacctattttaccagggtgattctggcgtctgtggtgggcggacgggagagcaaaacctgctccgccgtgtcgtcttcaggagactag

SEQ ID NO: 199457 - DNA, 396 bp, Artificial Sequence
  Description of Artificial Sequence: Synthetic coding sequence
atgagcagcacccagggcaacggcgagcactggaagagcctggagagtgttggtattagtcggaaagaactcgccatggccgaggctcttcagatggaatacgatgccttgtccagattaagacacgacaaagaggagaacagggctaagcagaacgctgacccttcattgatcagttgggatgagcccggcgtggacttctattccaaacccgccggaaggagaacagatctgaaactcctccgcggactctccggcagcgatccgacactgaattataatagcttgagcccccaggaagggccacccaaccattcgacatcccagggccctcagccggggagcgatccctggccaaaggggagcctatcaggtgactatttgtatatattttag

SEQ ID NO: 199458 - DNA, 4821 bp, Artificial Sequence
  Description of Artificial Sequence: Synthetic coding sequence
atgagcagcacccagggcaacggcgagcactggaagagcctggagagtgtaggcatcagccggaaggaactcgcgatggccgaggctctccaaatggaatatgacgcattgtcccgacttagacatgacaaggaagagaatagagccaagcaaaatgccgatccatccctgatttcttgggacgagccaggggtggacttctactccaagccagcaggccgccgtacagacttgaaactcctgaggggcttaagcggaagtgacccaaccctcaattacaattccctctctcctcaggagggaccaccgaatcacagcacttctcaggggccgcagcccggaagtgacccatggccaaaagggtccttaagtggggattacctctacatatttgatggctccgacggtggcgtctcaagctcgcctggacccggagatattgaaggtagttgcaagaagttatcaccccccccattaccgccaagagcttccatctgggacacacctccattgcctccccgaaagggcagtccctcgtcctctaaaatctctcagccctcagatataaacaccttctccctggttgagcaactccctgggaagcttctcgaacacagaatcctcgaagaggaagaagtgttgggagggggcggacagggccggctcctgggaagcgtcgactacgacgggatcaacgacgcgatcacaagactgaatctcaaatcaacttatgatgccgagatgcttcgggacgcaacccgtggatggaaagagggacgcggcccacttgactttagtaaggacacctcgggaaagcccgtggcacgctccaaaaccatgcctccccaggttccccctcggacttatgcaagccggtatgggaaccggaagaacgccacccctggcaaaaaccgccgcatatcagccgcgcccgtcgggtcgagaccccataccgtggctaatggccacgagctgtttgaggtgagcgaggaacgtgacgaagaggtggctgccttctgtcatatgctggatatcttaaggtccggtagcgatatccaggattactttctgaccggatatgtgtggtccgccgtaacaccctcacctgagcacctgggagatgaagtcaaccttaaggtgaccgtgctctgcgatcgtctccaagaggctctgacctttacatgcaattgcagcagcaccgtagatctgctcatttatcagactttatgttacacccatgacgatctgaggaacgttgacgttggggatttcgtgttaaagccttgtggtctcgaagagttcctgcagaataaacacgctttagggtcccatgaatacatccagtattgcaggaaatttgatatcgacatacggctgcagctgatggaacagaaggtggtgcgctcagacctggccaggacagtaaatgacgaccaatctccgtctacactaaactaccttgtgcacttgcaggagagaccggtcaaacagactattagtcgacaggctttgagcttactgttcgacacctaccacaatgaggttgacgcctttctcctcgccgacggggactttcctttgaaggccgatagagtggtgcagtcagtgaaagctatctgcaacgcactggcagctgttgagacgcctgagattacctcagctctgaaccaactgcccccctgcccatctcgaatgcagcccaaaattcagaaggacccaagtgtgctggcagttcgagagaaccgcgagaaggtggtcgaggcgctgaccgctgctatcctggatttggtcgaactctactgcaatacctttaatgctgactttcagaccgctgtgcccggatcacgaaagcacgatttagtgcaggaggcttgtcacttcgcccggtcattggcctttacagtgtatgccacccatagaattcccataatttgggccaccagctacgaagacttttacttgagctgcagtttatctcacggcggaaaggagctgtgttctccattgcaaactcggcgagcccacttttccaaatacctgttccacctcatcgtttgggaccagcaaatttgtttccctgtgcaggtaaacagactgccacgggaaacacttctctgcgcgacgctatatgcactccccatccctcctcccggcagctcctccgaagcaaacaaacagagaagggttcccgaagctctagggtgggtgacaacacctctgttcaatttccggcaggtcttaacatgcggcaggaagctgttggggctctggcccgccacccaggagaacccgtcagcacgctggagtgcccccaattttcatcagccagacagcgtcattctccagattgatttccccactagtgccttcgatatcaagtttacctcacccccaggcgacaagttttctcctcgttacgaatttggtagtctacgcgaagaagaccagcgcaagctgaaggacatcatgcagaaagaaagcctttattggcttacggacgcagataagaaaagactgtgggaaaagaggtactactgccacagcgagtggactcacatgaaccaccaagacgcactgggcctgttgcatgcaactttccctgatcaggaagtccggaggatggcagtccagtggattggctccctgtcagatgcagagctgttggactatttaccccagctggtacaggcacttaaatacgaatgttaccttgactctcccctggtccgctttttgctcaaacgcgctgtctccgatctccgggtgacccactacttcttctggctcctgaaggatggcctgaaggactcacagttctctattagataccaataccttctagcggccctcctctgttgttgcggcaaaggactaagggaagagtttaatcggcagtgctggttagtgaatgccctcgccaaactggcccagcaagtgcgggaggctgcgccctctgctcggcagggcatcctgcgcactggcctcgaagaagtcaaacagttcttcgctctgaacgggtcatgccggctccccctctcacccagtctcctggtgaaaggaattgtgccccgcgattgttcgtatttcaatagcaatgccgtgcctctgaagcttagcttccaaaatgtagatcctttgggcgagaacatcagagtgatatttaagtgtggagacgatctcagacaggatatgttgacactgcaaatgattcggattatgagcaagatctgggtacaggagggactcgatatgcgtatggtcatcttccgctgtttcagtacaggccgaggccgaggaatggttgaaatgattcctaacgcagaaaccttacgcaagatccaggtagaacacggcgtgaccgggtccttcaaggacagacccctcgcagactggcttcaaaaacacaatcccggcgaggatgagtacgaaaaagcagtggagaattttatctacagttgcgccggctgctgcgtggccacttatgtcttgggtatctgcgatcggcacaatgacaatattatgttaaagacaaccggtcacatgtttcatatagacttcgggaggtttctcggacacgcccagatgtttggaaacatcaagagggaccgggccccctttgtgtttacttccgacatggcttacgtgataaacggtggagataagcccagcagccgattccatgacttcgtggatctgtgctgccaagcttataatctcatcagaaagcatacccacctcttcctgaatcttttgggactcatgctgagttgcgggatccctgaattgagcgacctggaggacctaaagtacgtctatgacgctctgagaccacaggatacagaggcaaatgctacaacttactttacccgactgatagaatcctctctgggctccgtggccaccaagctaaactttttcatccacaacttagctcagatgaaattcacaggaagtgacgacagacttaccctatcgttcgcaagtcggacacacaccttaaaatcctccgggaggatctcagacgtgttcctgtgccggcatgagaagatcttccatccaaacaagggatacatctacgtcgtgaaggtaatgagagagaatacccacgaagccacatatatccagcgcaccttcgaagagttccaggagctgcataacaagctgagactgctgttcccgtcctctcacttgccttcttttcctagcaggtttgttattggacggagccggggtgaagccgtcgctgagagaaggcgcgaggaactgaacggctacatttggcacctcatacacgccccgcccgaggtggctgagtgtgatctcgtctatactttttttcaccctttaccacgcgatgagaaagctatgggcactagccctgctccgaaaagctctgatggcacttgggcacgcccagtaggcaaagtgggcggtgaggtgaaattgagcattagctacaagaacaacaagttattcatcatggtcatgcatattcgcgggctccagttgctgcaagacggaaatgatcctgatccctacgtcaagatctatcttctccctgacccccagaaaacaaccaagcgaaagaccaaggtggccagaaaaacgtgtaaccctacgtataacgaaatgcttgtgtacgatggaatccccaagggtgacctccagcaacgagagctgcaattgagcgttctgtcggagcagggattctgggagaacgtgttgctgggagaagtgaatatccggcttcgcgagctcgacctggcccaggagaaaaccggttggtttgccctagggagtaggtcacatgggactctgtag

SEQ ID NO: 199459 - DNA, 183 bp, Artificial Sequence
  Description of Artificial Sequence: Synthetic coding sequence
atgagcagcacccagggcaacggcgagcactggaagagcctggagtcagtgggtatttctcggaaggagttggccatggccgaggctcttcaaatggagtacgatgctctgtctcggcttcgccacgataaggaagaaaaccgcgccaaacagaacgccgatccaagcctcatcagctggtag

SEQ ID NO: 199460 - DNA, 522 bp, Artificial Sequence
  Description of Artificial Sequence: Synthetic coding sequence
atgcggccctggagcagccccgcccagctggtggccggcgcccagcccgccggacgcggcgatccactaggaccacggccaatcccaccaccgcgatttcgacgggccagtagccagagagagcctccataccctcggcccgccgagccagccttagagcttgcaggatccaaatgccagccagacacacctgctgcaagcctgtgccctgcagattctccttcacagcatagggtcatgccccccgggcccgcctcatgggccaacgttggctcacgcccacacactgtagccaatggccatgaactgtttgaagtatccgaggagcgcgatgaggaagtggccgccttctgtcatatgttggacattctgagatcaggaagcgacattcaggactacttcttgacaggatacgtgtggagtgccgtgaccccatcccccgagcacctaggggacgaagtcaaccttaaagtgacagtgttgtgtgatcgattgcaggaggccttgacgtttacctgttag

SEQ ID NO: 199461 - DNA, 4338 bp, Artificial Sequence
  Description of Artificial Sequence: Synthetic coding sequence
atggcctacagctggcagaccgaccccaaccccaacgagagccacgagaaacagtatgagcaccaggaatttctatttgtgaatcagccacattcttcgtcacaagtcagtctcgggtttgatcagatcgtggacgaaatctcgggcaagatccctcactacgaaagcgaaattgacgaaaatacctttttcgtgcccacggctcccaagtgggatagcactggccattccctcaatgaggctcaccagatctctctgaatgaattcacatcaaagagcagggagctaagctggcatcaggtatccaaggcccccgctataggtttttctccatccgtgctgcctaagcctcagaacactaacaaagaatgctcctggggttcgcctatcggaaaacaccacggagccgatgacagccggttctctatccttgccccaagcttcacatctctagataagatcaaccttgagaaggagctggagaatgagaatcacaactatcatatcggatttgaatcctccatccccccaaccaactcatctttttcatcagattttatgcccaaagaggagaacaaaaggagcgggcatgtgaacatcgtggaaccgagcctcatgttgcttaagggcagtttgcagccagggatgtgggagagtacttggcaaaagaatatcgagtccataggctgcagtatccagctcgtggaggtcccccagagctcgaatacatccttagcttctttctgcaataaggtgaagaagattcgggaaagataccacgcggccgacgtgaatttcaactccggcaagatttggtctacaaccaccgctttcccctaccaacttttcagcaagacaaagtttaatatccacatttttatcgataattcaacccagccactgcatttcatgccatgtgcaaattacctggttaaggacctcatcgccgaaatcttgcacttctgtaccaatgaccagctattgccaaaggaccacatactgtccgtgtgtggctctgaggaatttctgcagaatgaccattgccttggatctcataagatgttccagaaggataaatccgtgatccagctgcatttgcagaaatcgagggaggccccagggaagctgtctaggaagcacgaagaagatcactcccagttttacctgaatcagctgttggagttcatgcatatctggaaggtgtcccgccagtgtctgctcacactaatccgtaagtacgactttcatctgaagtaccttctgaagacacaggagaacgtatacaatataattgaagaggtcaaaaagatttgctcagtcctgggttgcgtcgagaccaaacagatcacagatgctgtgaacgagttatccttgattctccagcgtaagggcgagaacttttaccagtcaagcgagacttctgccaaggggttgatagagaaggtcaccaccgaactttccacatcgatttatcaactcattaacgtgtattgtaactccttttatgccgacttccaacccgtcaacgtgccacggtgtactagttacttgaacccgggactaccttcacatctgagctttacggtatacgctgcccacaatatccctgagacatgggtacaccgaattaacttccccctggagatcaagagcctgccccgcgaatctatgttgacagttaagctattcgggatcgcatgtgcaactaacaatgctaacttgttagcatggacctgtcttcctctctttcccaaagaaaaatcgattctgggttccatgctcttctccatgactttgcagtccgagccaccagtggagatgattactcccggcgtctgggatgtgtcacaaccctcaccagtgaccctgcagatcgactttcctgcaaccggctgggagtacatgaagccagattccgaggagaatcgctcgaatctggaagaaccgttgaaagaatgtataaaacatattgcacggctaagccagaagcaaacccctttactgcttagtgaagaaaaaaagcgatacctgtggttttatcgtttttactgcaataacgagaactgctccctgcctctggtcctgggttcggcacctggttgggacgaaagaacggtgtcagaaatgcatacaattctgcgccgctggacattctctcagcccctagaggctctggggttactgacttcgagtttccccgaccaagaaatccggaaggtggccgtgcagcagctggataacctgttgaacgatgaactgctggagtacctcccccagctcgtgcaagccgtaaaattcgaatggaatttagagagccccctcgtgcagttattactgcaccggtctttacagagcatccaggtggctcaccgcctctattggctcctgaagaacgccgagaacgaggcgtacttcaaaagctggtatcagaagctcttagccgccctccagttttgcgccggaaaggccctcaacgatgaattcagtaaggagcaaaaactgatcaaaattcttggcgatattggagaacgagtaaaaagcgcttctgaccaccagaggcaggaggtgctcaagaaggagattggtagactggaggagttctttcaagatgttaatacatgccacttaccacttaacccagctctgtgtatcaaagggatagatcacgatgcctgttcctactttacctccaatgctctgccgctgaagatcacgtttatcaatgcaaaccctatgggcaaaaatatcagtattattttcaaagcgggagatgatctgcggcaggacatgttggtcctgcaactgatacaggtcatggacaacatctggcttcaggaaggtctggacatgcagatgataatctaccggtgtttgtcgaccggcaaagaccagggtctcgtgcaaatggtacccgacgcggtgacgctcgctaaaattcaccggcactcagggctgatcggccccctaaaagaaaataccattaaaaagtggttctcccaacataaccacctgaaggctgactatgaaaaggccctccggaacttcttttactcctgtgctggctggtgcgtcgtgacttttatactaggcgtttgtgacagacataacgacaacatcatgctgacaaaatctggccacatgttccacatagattttggaaagtttctgggtcatgcccagaccttcgggggcatcaagagagacagggcgccatttatctttactagtgaaatggagtattttataactgagggggggaagaaccctcagcattttcaggatttcgtggaactctgttgccgcgcttataacattatcagaaagcactcccaactgcttctcaatctgctggagatgatgctgtacgcgggactgcccgaactgtctggtatccaggatcttaaatatgtttacaacaatctgcgaccacaggatacagaccttgaggccacttcacactttactaaaaagatcaaggagtcactggagtgcttcccggttaaactgaacaaccttattcacactctggcccagatgagcgccatctccccagccaaatcaaccagccagaccttccctcaagagagttgtttattatcaaccaccagaagcattgagagagcgaccatcctgggcttttccaaaaaaagctctaacctgtatctgatccaggtaacgcattctaacaatgagactagcttgacagaaaagagcttcgaacaattttctaagctccatagccagctccagaaacagtttgcgtctctcacacttcccgagttcccgcactggtggcacctgccctttacgaactccgatcacagacgcttccgggacctgaatcattatatggagcagatcttgaatgtgagccacgaagtgactaattccgactgcgtcctttccttctttctctccgaggcagtgcagcagacagtggaggaatcctcacctgtgtatctgggagagaaattccctgacaaaaagcctaaagtccagctggtcatttcttatgaggacgtgaagctgaccatactagtgaaacatatgaaaaatatccaccttccggatggtagtgccccgtcagcccacgtggagttttacctgctcccttacccatctgaggtgagacgcaggaagaccaaatcagtccccaagtgcaccgatcctacttataatgagattgtggtgtatgatgaagtgactgaactccaggggcatgtcctgatgttgattgttaaatccaagactgtatttgtgggcgcgatcaatattcgtttatgtagtgttccacttgataaggagaaatggtatcccctagggaacagcataatctag

SEQ ID NO: 199462 - DNA, 4338 bp, Artificial Sequence
  Description of Artificial Sequence: Synthetic coding sequence
atggcctacagctggcagaccgaccccaaccccaacgagagccacgagaagcagtacgaacaccaggagtttctatttgtgaaccagccacacagtagctcccaggtttcactcggcttcgaccagatcgttgatgagatatcaggtaagatcccacactacgagtcagaaatcgacgaaaacaccttcttcgtgcccacagcccctaaatgggacagtaccgggcatagccttaatgaggcacatcagattagccttaatgagtttaccagtaaatctagagaactgtcctggcatcaggtgagtaaagctccggctattggcttttcgccatccgtgctcccgaaacctcaaaacacaaataaagaatgtagttgggggagtcccatcggcaaacaccacggagccgatgattccaggttctcaatcctggcccctagtttcaccagcctagacaagataaatctggagaaggagctggagaacgagaaccacaattaccacattggcttcgagagctccatccctcctaccaatagttcgttcagcagtgacttcatgccaaaggaagaaaacaagagatccggtcatgtgaacattgttgaacctagcctgatgctcctaaaaggatccctacagcccggcatgtgggaatcaacatggcagaaaaacatcgagtctattggctgctcaatccaactggtggaggtgcctcagtcaagcaatacgtctctcgcaagcttttgcaacaaagtgaaaaagattagagaacgctaccacgccgcggatgtgaattttaattcaggaaagatatggtctaccacaaccgccttcccttaccaacttttttctaagaccaagtttaacattcatatttttatcgacaattctacccagccactgcactttatgccctgtgccaattacctggtcaaggacctgatcgctgagatcctccacttttgtactaacgatcagctcctgcctaaagaccacatcctgagcgtttgtgggtcagaagagtttctacaaaatgatcactgcttgggatcccataaaatgttccagaaagacaaaagcgtcatccaactccaccttcaaaaatcccgggaggcacccggaaaactgagtaggaagcatgaagaagatcatagtcagttttacctgaatcagctgcttgagtttatgcacatctggaaggtatcaaggcagtgcctcctgaccctgattcgcaagtatgacttccacctaaaatacctcctgaaaactcaggaaaatgtgtacaacattatagaagaggttaagaagatctgctcagttttgggttgtgtggagacgaagcagatcaccgatgccgtgaatgagcttagcttgattttgcagcgcaagggcgagaatttttaccaatcatcagaaactagtgccaaagggctgattgaaaaggtgactactgagctgagtacaagcatctatcagctgattaacgtgtactgcaattctttctacgctgactttcagcccgtgaatgtgcctaggtgcacttcctatctgaatccaggcttgccttctcacctcagcttcacagtctatgccgcgcacaacatccccgaaacgtgggtgcaccggattaatttccccttggaaataaagtcacttcctagggaaagcatgctcacagtcaaactctttggcattgcctgcgcaacaaataacgctaacctgctcgcctggacctgcctgccactgtttcccaaggaaaagtcaatcctcggcagcatgctatttagtatgacactccagtcagaaccccctgtcgagatgattactccaggcgtgtgggatgtgagccagccttccccagtcaccctgcagattgacttccccgcaaccgggtgggaatacatgaagcccgactctgaagaaaatcgcagtaatctggaggagcctcttaaggaatgcataaagcatattgcgcgactttcgcagaagcagacgcctttactgctgagcgaagagaaaaagcggtatctgtggttctataggttctactgcaataacgagaactgtagcctgcccctcgtgctaggttctgcccccgggtgggacgagcggacagtatcagagatgcatacaatcctccgaaggtggacattctctcagccattggaagcgcttggactgttaacaagttcgttcccagaccaggagatacgtaaagtcgctgtgcagcaactcgataaccttctgaacgacgaactgctggaatacctgccccagcttgtgcaggccgtcaagtttgagtggaatctggaatcacccctggtccagttgttgctccatcgcagtctccagagcatacaggtggcccacagactatactggctcctaaaaaacgccgaaaatgaggcatatttcaagtcttggtatcagaaattactggccgcattgcagttctgtgcggggaaagctctgaatgatgagttttcaaaggagcaaaaactcattaagatcctaggggacatcggggagcgcgtgaagagtgcctccgaccaccaacgccaggaggtactgaagaaagagatcgggcgactggaggaattcttccaggacgtcaatacttgccacctgcctctcaatccggcattgtgtattaagggcattgatcatgacgcatgctcttatttcacatccaacgcactccccctcaaaatcactttcatcaatgctaatccaatggggaaaaacatatccataattttcaaggcaggggacgatctgaggcaggacatgctggtactgcaactcatacaggttatggataatatctggctacaagaagggctggatatgcagatgatcatttaccggtgcctttccactggaaaggaccagggcctcgtgcagatggtccctgatgctgtcacacttgcaaaaatccacaggcactctggcctcatcgggcccctcaaagaaaacactattaaaaagtggttctcccaacacaaccatcttaaagcagactacgaaaaggcactgcgaaacttcttttactcctgtgccgggtggtgcgtagttacgtttatccttggcgtctgtgatagacacaatgataacattatgctgaccaagagtggacatatgtttcacatcgattttggcaagttccttggacatgcccagacgttcggtggaataaaacgagatcgggcgcctttcatcttcacctctgaaatggagtatttcataactgagggtggaaagaatcctcagcacttccaagattttgtcgagctgtgctgcagagcctataacatcatcagaaaacacagtcagctgttgcttaacctcttggaaatgatgctgtacgccggcttaccggaactaagcggaatccaggatttaaagtatgtttacaataaccttagacctcaggacactgatctggaggccactagccatttcacaaaaaaaattaaagagtctctcgagtgcttccctgtgaagttgaacaatctaatacacacactcgctcagatgtctgcaattagtcccgcgaagagtacttcacaaaccttccctcaggaaagctgcttactgtccaccacccggtctatcgagagagcaactattctgggattcagtaaaaagtcatctaatttatacctcatccaggtgactcatagcaacaatgagacaagcctgactgaaaaaagcttcgaacagttttcaaaactacattctcagttgcagaagcagttcgccagtcttaccctgccagaattcccccattggtggcatctcccttttacaaactctgaccaccggcgattccgagacctgaatcactatatggaacagattcttaatgtaagtcatgaagtaaccaatagcgactgcgttctgtccttttttctgtctgaggctgtgcagcagacagtagaggagtccagcccagtttatctcggagaaaagtttcctgataagaagcccaaggtccagttggtgatcagctatgaggacgtgaagctgaccattctcgtgaagcacatgaagaacatccatctgccggatggaagcgcaccaagcgcccacgtcgagttctacctgttaccctacccatctgaagtgcgccgccggaagactaagagcgttcccaaatgtacggaccctacatacaacgaaatcgtggtgtacgacgaggtgacggagctgcaagggcacgtgttaatgttaattgtgaagtcaaaaaccgtctttgtcggcgcaattaatatccgcctgtgctccgtgcccctcgacaaagaaaaatggtaccccctaggcaactcaattatttag

SEQ ID NO: 199463 - DNA, 4461 bp, Artificial Sequence
  Description of Artificial Sequence: Synthetic coding sequence
atggcctacagctggcagaccgaccccaaccccaacgagagccacgagaagcagtatgagcatcaagagttcctgtttgtgaaccagccccattcatctagtcaggtttcccttggctttgaccagatcgtggatgaaatttccgggaagataccacactatgagtctgaaatcgatgagaataccttcttcgtcccgacagcacccaaatgggatagtactgggcatagcctgaacgaggcccaccaaatctccctcaacgaatttaccagtaagtcccgggaactatcttggcatcaggtgtcaaaagcacctgctattggtttttctcctagtgtcctgcctaaaccccagaatacgaacaaggagtgttcttgggggagcccaatcggaaagcatcacggggccgacgatagtcggttctcaatcttagcaccttcatttacttctcttgataaaatcaacctagaaaaagagttagagaatgaaaaccacaattaccatataggcttcgaaagttcaataccgcccaccaactcttccttcagtagcgacttcatgcccaaggaagagaacaaaagatctggacatgtcaatatcgtggagcctagtctgatgctgttaaaagggtcactgcagccaggcatgtgggagtcaacctggcagaagaatattgaaagcatagggtgttctatccagctggtcgaggttcctcaaagttcaaatacctcactcgctagcttctgtaacaaggtcaaaaagatacgggagaggtaccacgccgcagatgtcaacttcaattccggcaaaatttggtctactacgacagcgtttccctaccaacttttctctaagacaaaattcaacattcatattttcattgacaatagcacccagcctttacacttcatgccctgcgctaactacctggtaaaggaccttatagccgagattctgcatttctgtactaacgaccagctcctcccaaaggaccacattctctctgtgtgtggatctgaggagttcctgcagaacgaccactgcctggggtcacataaaatgttccaaaaagacaagagcgtaatccaactccatctacaaaagagcagagaggcgccaggcaagctctccaggaaacatgaggaggaccactcacagttttatcttaaccagttgttagagttcatgcacatttggaaagtgtcacgccaatgtcttcttaccctgatcaggaaatatgacttccatcttaaatatctgctcaagacacaggagaacgtgtataatatcattgaggaagtgaaaaagatctgctccgttttgggatgcgttgagactaagcaaataacagatgccgtgaatgagctgagtctgatcctccaaaggaaaggcgaaaacttctatcagtcctcggagacctccgcaaagggcctgatagagaaggtcacaaccgaactgtctacctctatctaccagctgattaacgtgtactgtaactccttttacgccgattttcagcctgtcaatgtgccaaggtgtacatcatacttgaacccgggcttaccatcacatttgtccttcactgtctatgctgcccacaacatcccagagacctgggtgcattcttacaaggcattcagcttcacatgttggctcacctatgctggtaagaaactttgccaggtacgaaactaccggaatataccggataagaagttgttctttttcttggtgaattggaacgaaaccattaacttccccctagaaatcaagtctttacccagagagagcatgttgacagttaagctttttgggatcgcttgcgcgacgaacaatgcgaatctattggcctggacttgtctacctctgtttccgaaggaaaagtctattctgggtagtatgctgtttagtatgaccttacagtccgagcctccagtcgaaatgattacgccaggcgtatgggatgtttcacaaccaagcccagtgaccctgcagatcgactttcctgcaactgggtgggagtatatgaagcccgactccgaagagaatcggtcaaatctcgaggagcccctcaaggagtgtatcaaacacatagctagactatcacagaaacagactcctctgctgctcagcgaggagaaaaagagatacctgtggttttacaggttttactgtaacaatgagaattgttcgcttcctctggttcttgggtctgcacccggctgggacgagagaactgtaagcgagatgcacaccatcctgcggcgctggacatttagtcagccacttgaagcgctcggactgcttacaagttcctttcccgatcaggagatcagaaaggtcgctgttcaacagctcgacaatttactgaatgatgagttgctcgagtatctgcctcagctggttcaagcagtcaagttcgaatggaatcttgaatccccgctggtccagctgctcctgcatagatctctgcaatccattcaagtagcacaccgactctattggctgctcaagaacgccgaaaacgaagcttattttaaaagctggtaccagaagcttctggcagccctgcaattttgcgccggtaaagctctgaacgacgagttttccaaagaacagaaattgatcaaaatcttgggggacataggcgaacgcgtaaaatcggcctcggatcaccaaaggcaggaggtgctgaaaaaagaaattggacgcctcgaggagttttttcaggatgtgaacacttgtcatttacctctgaatcccgcgttgtgtataaaaggtatcgatcatgacgcatgctcctacttcacatctaatgccttacccctgaagataaccttcatcaatgctaatcctatgggcaaaaatatatctattatcttcaaggcaggcgacgatctcaggcaagacatgctggtgttgcaactcatccaggtgatggacaatatttggctacaagaaggcttggatatgcaaatgatcatttaccggtgcctgtctacagggaaagatcaggggctggttcagatggtccccgatgctgtgaccctcgcaaagattcacaggcactctgggctgattggtcctttgaaggagaacacaattaaaaagtggttcagtcagcacaaccatctaaaggctgattacgagaaagcacttagaaatttcttttactcttgcgccgggtggtgtgtggtgacatttatactgggcgtctgcgatcgccataatgataatataatgcttacaaagagtggtcacatgttccatatcgattttggtaaattcctcgggcacgctcagacatttggaggcatcaagcgtgacagagctccctttatttttacaagcgagatggagtacttcatcactgagggaggaaaaaatcctcaacactttcaggatttcgttgagctatgctgtcgcgcttataatattatccggaagcacagccagctgctattaaatctactggaaatgatgctgtacgcgggacttccagaactttctggcatccaagatctgaaatacgtttataataacctgaggcctcaggacacggacctggaggcaacaagccacttcactaagaagattaaagagagtttagagtgttttcctgtgaagctgaataatttgattcatacactcgctcagatgagtgccattagtcccgctaagagtacaagtcagacattcccccaggaatcttgcttgctaagtacaaccaggtctattgaaagagccacaatattgggatttagcaaaaaaagcagcaatctttacctgatccaggttacccatagcaataacgagactagcctgacagagaagagttttgagcagttttctaaactgcattctcagcttcaaaagcagttcgcgagtctgactctgcctgagtttcctcattggtggcatctgcccttcacaaactcagatcatagaagatttagagatttaaaccactatatggaacagatactcaacgtatcccacgaggttaccaactccgattgtgtgctttcctttttcttgtcggaggccgttcagcagacagtggaagagtcctcccctgtgtatttaggcgaaaagtttccagacaagaaacctaaggttcagctggtgatctcttacgaagatgtcaagctgaccatccttgtgaaacacatgaaaaacattcatttgcccgacgggtctgccccctcagcccacgtggaattttacctgctcccgtacccctcagaagtgagaagaagaaaaacaaaaagtgtgcccaaatgtacagacccgacatataacgaaattgtggtgtacgacgaggtcactgagctgcaggggcacgtcctgatgctgatcgtgaagtcaaagacagtgtttgtgggtgctatcaacattaggctgtgctccgttcccctggataaagagaagtggtatcccctcggtaacagcatcatatag

SEQ ID NO: 199464 - DNA, 414 bp, Artificial Sequence
  Description of Artificial Sequence: Synthetic coding sequence
atgaccatggagaccctgcccaaggtgctggaggtggacgagaagagcccagaagccaaggatctcttgcccagccagacggcctcttccctgtgtattagctcccgcagcgagtcagtctggacaacaaccccaagatccaactgggagatctatcgcaagccaatcgtgattatgagtgtcgggggagccatcttactgtttggggtggttattacatgtctggcatatacactcaagcttagtgacaagtctctaagtatactgaagatggttgggcctggctttctgtcccttggactgatgatgcttgtctgcggtctcgtgtgggtgcccataatcaagaagaagcagaagcatcggcagaagtcaaactttctacggagtctgaagtctttttttcttacacggtag

SEQ ID NO: 199465 - DNA, 414 bp, Artificial Sequence
  Description of Artificial Sequence: Synthetic coding sequence
atgaccatggagaccctgcccaaggtgctggaggtggacgagaagtcacctgaagcgaaggaccttcttccctcccaaacagcctcctctctgtgcatcagctctcgttcagaatctgtgtggactacaaccccgcgttccaactgggagatctaccgaaagccgatcgtgattatgagtgtgggcggcgcaattctgctgttcggcgtcgtcatcacatgcctcgcctacactctcaagctatcagacaaatcgctgagtatccttaagatggtcgggcctggattcctgagcctggggttgatgatgctggtttgcggactcgtatgggttccgattataaagaaaaaacagaagcaccgccagaagtccaacttcctgcgttcactcaaatccttcttcttaacccgctag

SEQ ID NO: 199466 - DNA, 159 bp, Artificial Sequence
  Description of Artificial Sequence: Synthetic coding sequence
atggagaaggtgcagtacctgacccggagcgccatccggcgggccagtactattgagatgccacaacaggctcgccaaaagctacaaaacctcttcatcaacttttgtctgatactcatatgcctcttgctgatttgcattatcgtcatgctgctctag

SEQ ID NO: 199467 - DNA, 1371 bp, Artificial Sequence
  Description of Artificial Sequence: Synthetic coding sequence
atgccccccggcccctgggagagctgcttctgggtgggcggcctgatcttatggctgtccgtggggagttcaggagacgctccacctactcctcaaccaaagtgcgcagatttccaaagtgctaacttgttcgaaggaacagacctgaaagtccagttccttctgttcgtgccttctaatccatcgtgcggtcagctcgtagagggcagttcagacttgcagaacagcggcttcaatgctaccttggggacaaaactaataattcatggctttcgagtgctggggaccaagccttcttggattgacacatttatcaggactctgctgagagcaacaaacgccaacgtcattgccgttgattggatctatggttccacgggcgtctatttttctgccgtaaagaatgttattaaactttctctggaaataagcctcttcctgaataagcttctcgttctcggggtgtcagagtccagcatccacataattggcgtgtcactgggggctcacgtgggagggatggtgggccagttgttcggcggccagctgggacagattaccgggcttgaccccgcggggccagagtacacaagggcctctgtggaggagcggcttgacgcgggggacgctcttttcgtcgaggcaatccataccgatacagataacttggggatacggatccctgtcggccacgtcgattatttcgtgaatggcggtcaggatcaacccggttgcccgactttcttttacgcaggttattcatacctcatctgtgatcacatgcgcgcagtccacttgtacatttcagctctggagaacagctgtcctctaatggctttcccttgtgcatcgtacaaagcctttcttgccgggcgctgtcttgattgctttaaccctttcctgctgtcgtgtcctcggataggactggtggagcaggggggagtgaagattgaaccactaccaaaagaggtgaaggtgtacttgctcactacatcttctgcgccatactgtatgcaccattcattggtcgagtttcacctgaaagagctgcggaataaagatacgaacatagaggtaacctttctctccagcaatatcacgtcttcctctaagataactatcccaaaacagcagcggtatggcaagggaatcatcgcccacgcaactccccagtgccagatcaaccaggtgaagttcaagttccaatcctccaatcgggtgtggaaaaaggaccgtaccacgatcattgggaagttctgtaccgcccttttgcccgtgaatgatcgggagaagatggtctgcctgccagagccagtgaatctccaggccagcgtcaccgtcagctgcgatctaaagattgcctgcgtgtag

SEQ ID NO: 199468 - DNA, 1323 bp, Artificial Sequence
  Description of Artificial Sequence: Synthetic coding sequence
atgccccccggcccctgggagagctgcttctgggtgggcggcctgattttatggctcagcgtgggttccagcggagacgccccacccacgccgcagccaaagtgcgccgattttcagtccgccaatttgtttgaaggaacagatctcaaggtgcagtttttgctgtttgtgccaagcaacccttcttgtggacaactcgtggagggctcaagtgacctacagaattccggcttcaacgctaccttaggtactaaactcataattcatgggtttcgggtgttgggtaccaagccttcttggatcgataccttcattaggaccctgctgcgcgccactaacgctaatgtgattgccgtggattggatttatgggagtacgggtgtgtacttctctgcagttaaaaatgtgcttggggtctcagagtcatccatccatatcattggcgtttccctgggagcgcacgtgggggggatggtgggccagttgttcggtggccagctgggacagatcaccggcctggaccctgcaggccctgagtatacccgagcgtctgttgaagagaggttggatgcaggcgatgcactgtttgttgaggccatccataccgatacagataatctcggcatcagaataccagtcggccacgtagactactttgtcaacggaggacaagaccaacctggctgtccaactttcttctacgccggctactcctatctgatttgtgaccacatgagagcagtgcacttgtatatcagtgccctggaaaattcctgcccactaatggcttttccatgtgcaagttacaaagcatttttggccggccgttgtctggattgttttaatccctttttactgtcgtgcccaagaatcgggctggtggaacagggaggcgtcaaaatcgaacccttgcccaaggaggtaaaggtgtatttactgacaacatcatccgctccttactgcatgcaccacagtctggttgagtttcacctcaaggaactgcgaaacaaggataccaatattgaagtgacgtttctgtccagtaatatcactagctccagcaaaattacaatccctaaacaacagcgatacgggaaaggcatcattgcacatgctaccccccagtgccagataaaccaggtgaagttcaagttccaaagttccaaccgggtatggaaaaaagaccggaccacgattatcggcaagttctgcaccgcattactccccgtgaatgacagggaaaaaatggtctgcctgcctgaacccgtgaatttacaggcctctgtgaccgtgagttgcgatttaaaaatcgcatgcgtatag

SEQ ID NO: 199469 - DNA, 852 bp, Artificial Sequence
  Description of Artificial Sequence: Synthetic coding sequence
atggtgggccagctgttcggcggccagctgggccagatcaccggcctggacccagccgggcccgaatacaccagagcatcagttgaggagcgactagacgcaggcgatgcgctgttcgtggaagcgatccataccgatacagacaacctagggattcgtattcctgttggccacgtagattattttgttaacggggggcaggaccagccaggctgtccgaccttcttctatgctggctacagctacctgatctgcgaccacatgcgcgcagtacatttatacatttccgccttagagaactcgtgccccctgatggcctttccttgtgcttcctacaaagccttcctggccgggcggtgcctggactgttttaatccattcttgctctcttgtccgcggatcggcttagtggaacagggtggcgtgaagattgagcctctcccgaaggaagtcaaggtatacttgctgacgacgtcctcagctccatattgtatgcaccactccttagtcgaatttcatctgaaagagctgagaaataaggacacaaacatagaggttacattcctctcctctaatatcacaagttcctccaaaatcacgatcccaaagcagcagcgctatggcaagggaatcatcgcccatgccactccacagtgccaaatcaatcaggttaaatttaaattccaatcatctaatagggtatggaaaaaggaccgaacaactattatcggcaaattttgtacggccttactacctgtaaacgacagggaaaagatggtctgtctcccagagcccgtcaatctacaagcaagcgtgactgtatcatgcgacctcaaaatagcctgcgtctag

SEQ ID NO: 199470 - DNA, 1656 bp, Artificial Sequence
  Description of Artificial Sequence: Synthetic coding sequence
atgcggacccggccccggccccggctgcggcggaccgagaacttcctgactgctgtgcatcacgggaagaaggaggagaaggccgcagtggagcggcggcgtctccacgtccttaaagccctcaagaagctgcggatcgaagcagacgaagcgcccgtcgtggcagtgctcggatcaggcggtgggttgagagctcacattgcttgcctgggagtgctgtcagaaatgaaggagcagggccttctcgacgctgttacctatctagctggggtttctgggagtacatgggccatctcaagcctgtacacaaacgatggtgacatggaagcgctggaggccgacttgaagcatcgcttcacgagacaggagtgggacctggccaagtctttgcagaagaccatccaggcagctcggagcgaaaactatagcctgacggacttttgggcttatatggtgattagcaagcagacccgggagctcccagagagccatctctcaaacatgaaaaagccagtggaagagggcactcttccgtaccccatttttgcggcaatagataacgatctccaaccttcctggcaagaagcgcgcgctcccgagacttggttcgagtttactccacatcatgcgggcttttccgccctaggagcattcgtgtctataacacactttgggagcaaatttaaaaaaggcagactagtgcgcacgcatccagaacgtgatttgacatttctgcgcggcctctggggtagtgccctgggtaacactgaggttattagggaatatattttcgatcagttgcgcaatctaacgctgaaaggtctatggaggcgcgctgtcgccaacgcaaagagcatcggccaccttatttttgctcgtcttctccggctgcaggaaagctcccagggagaacatccacccccagaggatgaggggggggaacctgagcacacatggctgaccgagatgctggagaactggactcgcaccagccttgagaagcaggagcagcctcatgaggaccccgagaggaaaggatccctgtcaaacttgatggatttcgtcaaaaaaaccggaatctgcgcttctaagtgggagtggggtaccacccataatttcttatacaagcacggtggtatacgagataagattatgtctagcaggaagcaccttcatctcgtagatgctggactcgcaatcaacaccccgtttccgctagtattgccaccaacaagggaagtacatctgattctgagcttcgacttttccgcaggagatcccttcgagaccatcagagcaaccaccgactattgtcgccggcataaaatcccttttccccaggtggaagaagcagaacttgacctgtggtcaaaggctccggccagttgttacattctaaaaggcgaaacgggaccagtggttatgcatttccctctcttcaatatcgacgcttgtggaggagatattgaagcttggtctgacacctatgacactttcaagttagccgacacatacacactggacgtggtggtgctcctgctcgcacttgccaagaaaaacgtcagggaaaataaaaaaaagatcctgcgagagttgatgaacgtcgctggactgtactaccccaaggactccgcccggtcatgttgcctggcatag

SEQ ID NO: 199471 - DNA, 4392 bp, Artificial Sequence
  Description of Artificial Sequence: Synthetic coding sequence
atgctgctgagccccagcctgctgctgctgctgctgctgggcgcccccagaggatgcgcagagggagtggcggccgctttaacacctgaaaggctgttagagtggcaggacaaagggatcttcgtgatacagagtgaatcactgaagaagtgcattcaggcggggaaaagcgtattgactttggaaaactgtaagcaagccaataaacacatgctgtggaaatgggtgagtaaccatggattgttcaacattggaggttctggctgcctcggactgaatttttctgcccctgaacagccgctgtcactgtacgagtgtgatagcactctggtgtccctgagatggcggtgtaataggaagatgatcaccggacccctgcagtatagtgttcaggtggcccacgacaataccgtggtcgcaagccgaaagtatattcataagtggatttcatacggctcaggcggaggcgacatttgcgaatacctgcataaggatctgcataccatcaaggggaatacacacggaatgccttgcatgttcccatttcagtataatcatcagtggcaccacgagtgcacaagagagggtcgtgaagacgacctcctttggtgtgcgacgaccagtaggtatgaaagagacgagaagtgggggttctgtcccgatcccacctcagccgaggtaggatgcgacacaatctgggaaaaagacttgaactcccacatctgttaccagtttaacttactctcatcactttcttggtctgaagcccacagtagctgtcagatgcaaggcgggaccctgctcagcatcacagatgaaactgaagagaacttcatccgagagcatatgagcagcaaaaccgttgaagtatggatgggtctaaaccagttggatgaacatgccggctggcagtggtcggacggtacaccgctgaactatctgaactggtcacctgaagtgaactttgagccattcgtcgaggaccactgtgggaccttctccagctttatgccctcagcgtggcgaagccgtgattgcgaatccactctcccatatatatgtaaaaagtatttaaatcatattgaccacgaaatcgtagagaaagatgcctggaagtactacgctacgcattgcgagccaggctggaatccttacaacaggaactgttacaagctgcaaaaggaagaaaaaacctggcacgaagctctgcggtcgtgccaggctgacaactctgcccttattgatatcactagccttgccgaggtcgagttcctggtcacactgcttggagatgagaatgcttcagaaacctggattggactgtcatctaataaaattcctgtaagcttcgagtggtctaacgatagttcagttatcttcaccaactggcataccctggagccacatatattccctaatcgcagccaactgtgcgtcagtgctgagcagagcgagggacattggaaagtgaagaactgtgaagagagattgttttacatttgtaaaaaagcgggtcacgttctctcagacgctgagtcagggtgtcaggaagggtgggaacggcacgggggcttttgttacaagatcgacacagtgctcagatctttcgatcaagcatccagcggatattattgtcctccggctctggtaacgataacgaatagattcgagcaagcgtttattaccagcctgatctcgtccgttgtgaaaatgaaggactcctacttctggatcgcactacaagatcagaacgacaccggggagtatacatggaaaccagtcggacagaagcccgagccagtccagtacacccattggaatactcatcagccgagatatagtggaggctgtgtggcaatgcggggaagacatcctttgggccgatgggaggtcaagcactgccggcactttaaggccatgagcctgtgtaaacagccagtggagaaccaagagaaagccgagtacgaggaaagatggccttttcacccctgttacttggactgggaatctgagcctggcctggcctcctgttttaaggtcttccactccgaaaaggtgctgatgaaacggacttggcgggaagccgaagcgttctgcgaggaattcggtgcccatctcgccagctttgcacatattgaagaggaaaacttcgttaatgagttactccacagtaagttcaattggacagaggaacgacaattctggatcggattcaacaaacgtaacccgctaaatgccggatcctgggagtggagtgaccgaacacccgtcgtcagttccttcctggataacacctatttcggtgaggacgcccgcaattgtgccgtatataaagcaaacaagacactgctgcccctacactgtggctctaagagggagtggatctgcaaaataccccgggacgtgaaaccaaagattccattctggtatcagtatgatgtaccctggctgttttatcaggatgcggaatatttgtttcacaccttcgcctctgagtggctcaactttgaattcgtttgctcttggctccacagtgacctcctaacaatccacagtgcccacgagcaggaatttatccattcaaaaataaaggcccttagtaaatacggggcctcctggtggatcggactacaggaagagagagccaacgacgaattccgctggcgcgatggtacaccagtgatttatcaaaattgggacactggacgggagcgaacagtgaataaccagagtcaaagatgtggcttcataagctcgatcacagggctgtggggctcagaggaatgctccgtgagcatgcctagcatctgcaaacggaagaaagtatggctgatcgagaagaagaaggacaccccaaagcagcacggaacttgccccaagggatggctatacttcaattataaatgccttcttcttaacattccaaaagaccccagttcctggaaaaattggactcatgctcagcacttctgcgctgaggagggcggtacattagttgccatcgagtccgaagtggagcaggccttcattactatgaatctcttcggacagaccacaagcgtttggattgggctgcaaaacgatgactacgaaacttggttgaatggtaagcctgtggtgtattcgaactggtctccattcgatataatcaacatccctagtcacaatacaactgaggtgcagaaacacatcccactgtgcgctcttctgagcagtaatcctaactttcatttcaccggaaaatggtatttcgaggactgcgggaaagaaggctatggattcgtttgcgagaagatgcaggacacgtcaggccacggggttaacacctctgacatgtatcccatgcccaacaccctggagtacgggaatcgcacttataagataatcaacgcgaacatgacttggtatgcggccattaagacttgtcttatgcacaaagcccagttggttagcattacagatcaataccaccaaagcttccttacagtggtgctgaaccggctgggatatgctcactggatcggcctgtttacaaccgacaacggccttaattttgactggtcggacggaaccaagagctcttttaccttctggaaggacgaagagtcctcactgctgggagattgcgtttttgccgattccaacggccgttggcactctacagcctgcgagtctttcctacagggggcaatttgccacgtgcccccagaaacccggcagtcagaacaccctgagctgtgcagtgagacgtccatcccatggattaagttcaaatctaattgctactctttctcaacagtgctggattcaatgtcctttgaagctgcccacgaattctgtaagaaagaggggagcaatctgcttaccattaaggatgaggccgagaatgccttcctcttagaagagttgtttgcctttggtagttccgttcaaatggtttggctgaacgcccaattcgacggcaacaatgaaaccattaagtggtttgatggtaccccaaccgatcaatcaaactggggcatccggaaaccagacaccgattacttcaagccccaccattgcgtggcgctgcgcatacccgagggactctggcagctctctccctgccaagagaagaaaggctttatctgtaaaatggaagccgacattcataccgctgaagcgttacctgagaaaggccctagccattccattatccccctcgccgtagtcctcaccttgatagtcatagtcgctatttgtactttaagcttttgtatttacaaacataacggtgggtttttcagaaggctcgcagggtttaggaacccatactatcccgcaactaacttctcgaccgtgtaccttgaagagaacattctaatcagtgatcttgagaaatccgaccagtag

SEQ ID NO: 199472 - DNA, 3975 bp, Artificial Sequence
  Description of Artificial Sequence: Synthetic coding sequence
atgctgctgagccccagcctgctgctgctgctgctgctgggcgcccccaggggctgcgccgagggagtcgccgctgccctgaccccggaacgactgctagagtggcaggataagggcatctttgttattcagtctgaaagcctaaaaaaatgtattcaggccgggaaatccgtgcttacactcgaaaattgcaagcaagccaacaaacatatgctctggaaatgggtaagcaaccatggtctgttcaatattggagggtctggctgtttaggcctcaacttttcggctcctgaacagccgctgagcctctacgaatgtgacagcaccctggtgtctctgaggtggcgctgtaataggaaaatgattactggaccactgcagtattccgtgcaggtcgcccatgacaacacagttgtcgcaagccggaagtacatccataaatggatttcctacggaagcggcggaggcgacatatgtgaatatctgcataaagaccttcacactattaagggaaatacacacggcatgccttgtatgttcccattccaatacaatcaccagtggcaccacgagtgcacacgggaggggcgtgaggacgatctcttatggtgcgccacaacctcgcggtatgaacgtgatgaaaaatgggggttttgtcctgatcccacctcggcggaagtgggatgtgacaccatctgggagaaagatctaaacagccacatatgctaccagtttaatctcctgagctcactcagctggagcgaagcccacagcagttgtcaaatgcagggaggtaccctcttgtcaattaccgacgaaaccgaagagaactttatccgcgagcacatgagttcaaagactgtggaagtgtggatgggcctcaaccaactggacgagcatgccggttggcagtggtcagacggaacgcctctgaattatttaaactggtctccggaagttaatttcgagccgttcgtggaagaccattgcgggacctttagtagcttcatgccctcggcctggagatcaagagactgtgagagtaccctgccctacatttgtaagaaatacctgaaccacattgaccacgagatcgtagagaaagacgcttggaagtattacgctactcattgtgagcctggatggaatccatataatcgcaattgctacaaactgcagaaggaagaaaagacgtggcacgaggcactaaggtcatgccaggcagataactccgctctgatcgacataaccagcctggctgaggtggagtttcttgttactctgttgggcgatgagaatgcttcagagacttggattggcctatcatccaataaaatacccgtgtcgtttgagtggtccaatgattccagtgtgatctttacaaattggcatactctggaaccccatatcttccccaatcggagccaactatgtgtgtctgccgaacaatcggaaggccactggaaggtaaaaaattgcgaggagaggctgttttatatctgtaagaaggcagggcacgtactgtcagatgccgagtctggatgtcaggaaggatgggagcggcatggcggattctgctacaaaattgacaccgtcctgaggtcctttgatcaagcgtcctctggatactattgcccgcctgctctggtcacaattaccaaccgattcgagcaggcctttatcaccagccttatcagcagcgtcgtcaagatgaaagactcatacttttggatcgccctccaagatcaaaatgacacaggagagtacacttggaagcccgtgggccagaaacccgaacccgtgcagtatacacactggaacactcatcagcctcgatatagcggaggctgtgtcgctatgcgcggccgacaccctctcgggcgctgggaggtcaagcactgtcggcactttaaggccatgtctctgtgtaagcagcccgtggaaaaccaggagaaagcagaatacgaagaaagatggccctttcacccatgctacctagactgggagtctgaacctggcctggcatcttgcttcaaggtttttcatagtgagaaggtgctaatgaaacggacttggagggaagcggaagccttttgcgaagaattcggagcacaccttgcttcatttgcgcacatcgaggaggaaaatttcgtgaacgagcttttgcattcaaagttcaattggacagaagagaggcagttttggattggctttaataaacgcaatccccttaacgctggaagctgggaatggtccgacaggactcctgttgtctcatcctttctggacaatacttattttggtgaagacgcaagaaattgtgccgtgtacaaggccaacaagacattgctgcccttgcactgtggtagcaaacgcgagtggatatgcaagattccccgcgacgtgaaacccaagatccccttttggtaccagtacgatgtcccttggctgttctaccaagatgcggaatacctctttcatactttcgccagcgaatggttaaattttgagttcgtgtgctcgtggctgcactccgatctgcttacaatccacagcgcacatgagcaagaattcattcacagcaaaatcaaagccctttccaaatatggggcaagttggtggatcggcctgcaggaagaaagagccaatgacgagtttcgctggcgcgatggcacacctgtgatctatcagaactgggacaccggccgggaacggacggttaataatcagtcacagcggtgtggcttcatatcgagtatcactgggctgtggggtagcgaggagtgttcggtctccatgccatctatttgtaagcggaagaaggtgtggttgattgagaagaagaaggacacgcctaagcagcacgggacctgtcctaaaggatggctttactttaattacaagtgtcttcttttaaatatccccaaagacccctcttcctggaagaactggactcatgcccagcatttttgcgccgaagaggggggcacactggtggccattgagagtgaagtcgagcaggcctttataacaatgaacctgttcggccagaccacctctgtttggatcggcctccagaatgacgactatgaaacctggctaaacgggaaaccggtcgtctactcaaattggagccctttcgatatcattaatattccatcccacaataccacagaggtccaaaaacacatacctttatgcgccctgctgagttccaaccccaattttcactttactggcaaatggtacttcgaagattgtgggaaagagggatacggctttgtgtgcgaaaaaatgcaagacacgagcggccacggcgtcaatacatccgatatgtatcctatgccaaataccttggagtacggcaatcgaacctacaagattatcaatgctaatatgacatggtatgcggcaatcaagacttgcctgatgcataaggctcaacttgtctccattaccgaccaataccatcaaagcttcctgacagttgtgctcaatagactcgggtacgcccactggatcggactttttacaacggacaacggtctgaacttcgattggtccgatggcaccaagagctccttcaccttttggaaggacgaagagagcagtcttctgggggattgtgtgttcgctgacagtaacggccgatggcatagcaccgcctgtgaatcctttctccagggagctatttgtcacgtccccccggagactcgccagtccgaacatcctgagctttgctcagaaacaagcattccttggatcaaattcaagtccaattgctacagtttctcaaccgtactcgattccatgtccttcgaagctgcgcatgagttttgcaaaaaagagggctcaaacctgctgacaatcaaagatgaggccgaaaacgccttcttgcttgaagagttatttgctttcggatcctccgtgcaaatggtgtggctgaacgcccaatttgatggaaatagtaaatag

SEQ ID NO: 199473 - DNA, 1584 bp, Artificial Sequence
  Description of Artificial Sequence: Synthetic coding sequence
atgggcagcagcgaggtgagcatcatccccggcctgcagaaggaggaaaaagctgccgttgagcgacgtcggctacatgtgttaaaggctctgaaaaaactgaggattgaagccgatgaagcaccagttgtcgctgttttgggttcaggtggagggctgagagcacatattgcctgtctgggcgttctttccgagatgaaggaacagggcctgctagatgcggtcacatacctcgctggcgtgagtggctcaacatgggcaattagcagcttgtatacaaacgacggtgacatggaagcgcttgaggctgatctgaaacacagattcacaagacaggagtgggacctggcaaagtctctccagaaaaccatccaagccgcaagatctgagaactactcgctgaccgatttttgggcatatatggtcatatctaaacagaccagggagctgcccgagtcccatctctcaaacatgaaaaagcccgtcgaggagggcacactcccctacccgatttttgcagcaattgataacgatttacaaccatcttggcaggaggcccgcgcccccgagacttggtttgagtttaccccacaccacgcagggttttccgccctgggagccttcgtatccataacccactttgggtccaaatttaaaaaaggaaggctcgttagaactcacccagagcgggatttgacattcctgagagggctttggggctctgcacttgggaatacagaggtaattagggagtacatcttcgatcagctgagaaatctgactcttaaggggctttggcgaagggcagtcgccaatgctaagtccattgggcacctgatctttgcccgtcttctgcgtctgcaggagagctcgcagggtgagcaccccccacctgaggacgagggcggcgaacccgagcacacctggctgacagagatgctggagaactggacccggacatctctggagaagcaggagcagccgcatgaggacccggagagaaaaggaagtctgtccaatctgatggactttgtcaaaaaaaccggaatttgcgcaagcaagtgggaatggggcacaactcataatttcctttataagcatggaggaatccgtgataaaatcatgtcatcccgcaagcaccttcacttagtggatgccgggcttgctatcaacaccccctttccactagtgcttcctcctacacgtgaggttcatcttattctcagtttcgacttctctgcaggggacccgtttgagactattagagctaccacggactactgtaggaggcacaaaatccctttccctcaggtagaggaagctgaactagacttgtggagcaaggcccccgcaagctgttacatcctcaagggcgagaccggccccgtcgtcatgcattttcctctttttaacatcgatgcctgtggtggggacatcgaggcttggagcgatacttacgatacatttaagctcgcagacacctatacactcgatgtcgtcgtcttgctgctggcgcttgccaagaaaaacgtacgcgagaataaaaagaaaattcttcgcgagcttatgaacgtggccggatag

SEQ ID NO: 199474 - DNA, 1626 bp, Artificial Sequence
  Description of Artificial Sequence: Synthetic coding sequence
atgggcagcagcgaggtgagcatcatccccggcctgcagaaggaggagaaagctgcagtggaaagacgcagattgcatgtgttgaaagctctgaaaaagctgcgaatcgaggccgacgaggctcctgtggtcgcagtgctcggatccggcggcggactgagggcacatattgcctgcctgggagtgctgtcagaaatgaaggaacaggggctgctagacgctgtgacctatctggcaggcgtgtccggctccacctgggccatttcgtccctgtataccaacgatggagacatggaagccttggaggccgacttgaagcatcgattcacacgtcaagaatgggacctggccaagtccctgcagaagaccattcaggcagctcggagcgagaactatagcctcactgatttctgggcgtacatggtgatatcaaaacagacccgagagcttccagaatctcacctgagcaatatgaagaagcccgtcgaggagggcactttgccttaccccatctttgctgctatcgataatgatctgcaacctagctggcaggaggcccgggcgcctgagacctggttcgagtttacgccccaccacgcagggttctccgccctcggagctttcgtgtctataactcacttcggctcgaagttcaagaagggcaggctggttaggacacacccagaaagggatctgacattccttaggggcctttggggtagcgccttaggaaacaccgaggtcatccgcgaatatatattcgaccagctgcggaaccttaccctcaagggactctggcgccgggcggtagccaatgctaaaagcatcggccatctcatctttgcacgccttctgcggctccaggagtccagtcagggggagcatccacccccggaggacgagggcggagagcctgagcatacatggcttacagaaatgctagaaaactggacaaggacctcactcgagaagcaggagcagccacatgaggaccctgaacggaagggctcccttagcaacctgatggattttgtgaagaagaccggcatctgtgcaagcaaatgggaatgggggactacccataactttctttataaacatggagggattagagacaaaatcatgagttcacgcaagcacttgcacctggtagacgccgggctggcaatcaatacacctttccccctggtgctgccacctacccgggaggtgcacctgattttaagctttgacttctcagcaggagacccatttgagactattcgggcgacaactgattactgcagacgtcacaagatcccctttccgcaggttgaagaggcagagctggatctgtggtctaaggcaccagcttcatgctatatcctcaaaggcgagaccgggcctgtcgtcatgcatttccctctgttcaatatagatgcatgcgggggggacatcgaggcgtggtctgatacgtacgacactttcaagctggctgacacatacaccctggacgtggtcgtgcttctcctggccctcgctaaaaaaaatgtacgcgaaaataagaaaaaaattttacgagaactgatgaatgtggctggcctctattaccctaaagattcagcgcggtcatgctgccttgcatag

SEQ ID NO: 199475 - DNA, 2457 bp, Artificial Sequence
  Description of Artificial Sequence: Synthetic coding sequence
atggagagcctgagccccggcggcccccccggccacccctaccagggcgaggccagcacttgctggcagttaacggtccgggtgctggaagctcgcaatctgcgatgggcagacctgctttcggaggccgatccgtacgtcatccttcagttgtccaccgcgcccggaatgaagttcaaaactaaaacactgactgatacatcccatccagtgtggaacgaagctttccgcttccttatccaaagtcaagtgaaaaacgtgttggagctcagtatctatgacgaggacagcgtcacagaggacgacatttgcttcaaggtcctgtatgacatctctgaggtgctgcctggaaagctcctgcggaagacctttagtcagagtccccaaggcgaggaagaactggacgttgagttccttatggaagagaccagcgaccgaccggaaaacctgataaccaataaagtgatcgtcgccagagagctctcttgcctcgatgtccatctggattccactggtagcacggccgtggtggctgatcaggacaaactggagttagaactggtgctcaagggtagctatgaggacacccagactagtttcctgggcactgcctctgccttccgtttccactacatggctgctctggagacggagctttcagggaggttgcgtagctctcgcagcaacggatggaacggcgacaatagcgccgggtaccttactgtccctttacgcccactgacaatcggaaaagaggtaactatggatgtgcctgcaccgaatgcacccggggtgcgcttacagctgaaggctgaggggtgcccagaggaattggcggtccatctggggttcaatctctgcgctgaggaacaagcattcttaagtcgtcggaaacaggtggtggccaaggccctgaagcaggcactgcaactcgaccgcgatctccaggaggatgaagtgccagtcgtgggtattatggccaccggcggcggcgcccgggccatgacctctctttatggccatttgctggctttgcagaaattggggctcttggactgtgtcacttattttagtgggattagtgggagcacctggaccatggcccatttgtacggggatcccgaatggtcccagagagacctggagggccctatcagatacgcccgtgagcacctcgcaaagtctaaactcgaggtcttctctcccgaaagactagccagctaccggcgagaactggaactgagagctgagcagggacatccaacaacatttgtggatctgtgggctcttgttttagagtctatgctgcatggccaggtgatggaccaaaagctgtctggccagcgagctgctcttgagagaggccagaatccgctaccattatatctgtccctgaacgttaaggaaaacaatctcgaaacccttgatttcaaagagtgggttgagttctccccctatgaggttggatttcttaagtacggggctttcgtacctccagaactcttcggctccgagtttttcatggggaggcttatgcggcgcatccccgaacctagaatctgcttcctggaagctatctggagcaacattttctccctgaacctcctggacgcatggtatgatctgacctccagcggtgaatcttggaaacagcatataaaggacaaaacccggagcctcgaaaaagagcctctgacaacttctggaacttcttcaaggctcgaggcctcctggctgcaaccaggcacagccttggcacaggcctttaagggctttctaacgggccgccccctccaccaacgtagccccaactttttgcaaggtctgcagcttcaccaggattactgctcccacaaagacttctcaacctgggctgactatcagctggattccatgccatctcaattgacccctaaggagccccgcctatgtctggtggatgctgcatatttcatcaacacatccagcccgtcaatgtttcgccctggtcgccggctagacctgattctgtccttcgactactctctttcagctccttttgaagcactgcagcaaaccgaactgtattgtagagcacgcggccttccattccccagagttgagccttctccacaagaccagcatcaacctcgcgagtgccacctcttctctgaccccgcttgccctgaggccccaatcctgctgcactttccactggttaacgcatctttcaaggaccatagcgctccaggtgtgcagcgtagccccgctgagttacagggcggccaggtcgacctgaccggcgctacctgcccttataccttatctaatatgacatacaaggaagaagattttgaacgtctattgaggctctcagattacaacgtccaaacgtcccagggtgccatcctgcaggcattgcgaaccgctctcaaacaccgcacattggaggcacggcctccccgtgcacagacttag

SEQ ID NO: 199476 - DNA, 1326 bp, Artificial Sequence
  Description of Artificial Sequence: Synthetic coding sequence
atggtgccccccaagctgcacgtgctgttctgcctgtgcggctgcctggcggtcgtctatccttttgactggcagtacatcaacccagtcgcccatatgaagagcagcgcatgggtgaacaagatccaagtactcatggcggcggcatcattcggccagaccaagattcctcggggaaacggaccgtattctgttgggtgcacagatttgatgtttgatcacactaacaagggcactttcctcagactgtactacccgtcccaggataacgacagactcgatacgttgtggatccccaacaaggagtacttttggggcctctcaaaattcttgggtacgcattggctgatgggaaatatactgagattgctgttcggtagtatgacaacacccgcaaactggaattccccgcttcggccaggcgagaaatatcccctggtcgtgttttcacacggcctgggcgctttccgcactctgtacagcgccataggcatcgatctcgcctcccacggattcatagtggccgcggtagagcaccgggacaggtccgcctctgcaacctactattttaaggatcagagcgcagcagagattggcgacaaatcatggttgtacttgcggacattgaagcaggaagaggagacgcacatccggaatgaacaggtgcggcagcgggccaaagagtgttcccaagccctctctctgattttggacatcgaccatgggaagcccgtcaaaaatgccctcgacttgaagtttgatatggagcagttgaaggacagcattgaccgggaaaagatcgccgtgatcgggcattcctttggtggggccacagtcattcagactctgtcagaagaccagagattccgctgcgggatagctttggacgcgtggatgtttccactgggagacgaggtgtatagtaggatcccccagcccctcttcttcatcaattctgagtattttcagtaccccgctaatatcattaagatgaagaaatgttactcccctgacaaagaaaggaagatgatcaccatacgaggcagtgtgcaccagaactttgctgattttacctttgcaactgggaagatcataggccacatgctcaagttaaagggcgatatcgacagcaatgtggcaatcgatctcagcaacaaagccagcctagcatttttgcagaagcatttggggctccataaggacttcgaccagtgggactgcctgattgaaggcgacgacgagaatctgatcccaggaactaatatcaatacaacaaatcagcatataatgctccagaactcctccgggatcgagaaatacaactag

SEQ ID NO: 199477 - DNA, 1326 bp, Artificial Sequence
  Description of Artificial Sequence: Synthetic coding sequence
atggtgccccccaagctgcacgtgctgttctgcctgtgcggctgcttggcagtagtttatccttttgactggcaatacatcaaccctgtagcccacatgaagtcatcagcttgggtgaacaagatccaggtgttgatggctgctgcaagcttcggccagacaaagattccgagaggaaacggcccttactccgtgggctgcacagatcttatgttcgatcacaccaacaaagggaccttcctgaggttgtactacccttcccaggacaacgacaggctcgataccctgtggatccccaacaaagagtatttctggggtctcagcaagttcttaggtacccattggctgatggggaacattctgcggctgctgttcggatcaatgacaactcccgctaactggaactcgcctctacgacccggtgagaagtacccactggtcgtattcagccatgggctgggagcgtttcgtaccctatactcagcaataggcatcgatctggcttctcatggcttcatcgtagccgcggtcgagcaccgagaccggagtgcttccgccacctattacttcaaggaccaaagcgcagccgaaattggagacaagagctggctgtaccttcggacgctcaaacaagaagaggaaactcacatccgcaatgaacaggtcagacagagggcgaaagaatgctcccaggcactgtcgcttattctggacattgaccatggaaaacccgtgaagaacgccttagatctcaagttcgatatggaacagctgaaagattccatcgacagagaaaaaattgccgtgattggccactcgtttggtggcgccacagttattcagactctgtcagaggaccaacgctttcgatgcggcattgcactggacgcctggatgtttccgctgggcgatgaggtttacagcagaatcccacagcctctgtttttcattaattccgagtatttccaataccctgccaatataatcaaaatgaagaaatgctactcacctgacaaagagcgcaagatgatcacaattcgcggttcagtgcaccagaattttgcagactttacctttgcaacgggcaaaataataggacacatgttgaagttaaaaggcgatatcgactctaatgtcgccatcgatctgtccaacaaagcctctttggcctttttgcaaaagcaccttgggcttcataaagatttcgatcaatgggattgccttattgagggtgacgacgagaacttgatccctggcacaaatattaacactacaaatcagcatatcatgctgcaaaactcatccggtatcgagaagtataactag

SEQ ID NO: 199478 - DNA, 660 bp, Artificial Sequence
  Description of Artificial Sequence: Synthetic coding sequence
atggccgccgccagcttcggccagaccaagatcccccggggcaacggtccatactctgtcggttgtactgacctgatgttcgatcatactaacaaaggaaccttcctgcgactctactatccttcacaagataatgatcggctggacacactctggataccgaataaagagtacttttggggactttcgaaatttctgggaactcactggttgatgggcaatatcctgagactactgtttgggagcatgactacgccagcaaactggaactcgcctcttaggcctggtgaaaagtatcctctggtagtattttcccacgggctcggcgcctttagaacattgtactccgccattggcatagacctcgccagccacggttttattgtggctgccgtcgaacatcgagatcggagcgcctcggcgacctattacttcaaagatcaatccgctgccgaaatcggcgacaagtcgtggctctacttaagaaccctgaaacaagaagaagagacacatattcgtaatgagcaggtgcgacagcgggccaaagagtgttcccaggcgctgtccctaattctcgacattgatcacggcaagcccgtgaaaaacgcgctggacttaaagttcgatatggagcagctcaaagtgagctacaagaagtag

SEQ ID NO: 199479 - DNA, 414 bp, Artificial Sequence
  Description of Artificial Sequence: Synthetic coding sequence
atgaccacccccgccaactggaacagccccctgcggcccggcgagaagtatccactggtggtgttctcacacgggctcggagcctttagaaccctttactcagctatcgggatcgacctggcatcacacggattcatcgtggctgcggttgaacatagggatcgctccgccagcgcaacttattattttaaggatcaaagcgcagccgaaatcggagacaagagctggctctacctgaggactttgaaacaagaggaggaaacgcatattcgcaatgagcaggtgcgccagcgagccaaggagtgtagccaggcactgtcactgattttggatatagaccacggtaaacccgtgaagaatgctttggatctgaagttcgatatggagcaacttaaggtgtcttataagaagtag

SEQ ID NO: 199480 - DNA, 489 bp, Artificial Sequence
  Description of Artificial Sequence: Synthetic coding sequence
atgcgggcccccatccccgagcccaagcccggcgacctgatcgagatatttcgtccattttatcgccactgggcgatctacgttggcgatggctatgttgtacatctagcccccccatccgaggtcgccggagctggggccgcctccgttatgagtgccctgaccgacaaagccatagtgaagaaggagctgctgtatgatgtggcgggaagcgataagtaccaggtgaataataaacacgatgataagtattcccccctgccttgtagcaagatcattcaacgggccgaggagcttgtgggtcaggaagtcctctataaattaacaagcgagaattgtgaacatttcgtcaacgaacttcgttacggagtcgcaaggtctgaccaagtgagagatgttatcatagccgcctcagtcgctggaatgggacttgcagccatgagcttgatcggcgtcatgttctcccgaaataaaaggcaaaagcagtag

SEQ ID NO: 199481 - DNA, 489 bp, Artificial Sequence
  Description of Artificial Sequence: Synthetic coding sequence
atgcgggcccccatccccgagcccaagcccggcgacctgatcgagatcttcagacctttctatcgacactgggctatctatgtgggtgatgggtatgtcgtgcacctggctcctccctcagaggttgcaggggcgggagccgcctccgtgatgagcgcgttgacggacaaggccatagtgaagaaggagttactgtatgatgtggccggtagcgacaaataccaggtgaataacaagcacgatgataaatactcacctctgccttgttccaaaatcatccagagggccgaggagctagttggtcaggaggtgttgtacaagctgacgagcgagaactgtgaacactttgttaatgagctgcgttacggagtggcccgcagtgaccaggtgcgagatgtcattatcgccgctagcgtcgccgggatgggtctcgcggccatgtcactgatcggcgtgatgtttagtcgaaataagagacagaagcaatag

SEQ ID NO: 199482 - DNA, 4377 bp, Artificial Sequence
  Description of Artificial Sequence: Synthetic coding sequence
atgggcctgcggcccggcatcttcctgctggagctgctgctgctgctgggacaggggaccccccagatccacaccagccctaggaaaagcaccctggagggacagttgtggcctgaaactctgaaaaactcaccatttccctgcaacccaaataaacttggcgtgaacatgcccagtaaaagcgtacacagcctgaaaccctccgatatcaaatttgtagccgccattggaaatctcgaaatccctcccgaccctggtactggcgacctggaaaagcaggattggactgaacggcctcagcaggtctgtatgggagttatgaccgtgctgtccgacatcatccgctacttttctcctagtgttcccatgccagtttgtcacactgggaagagagtcattcctcacgacggggcagaggatttgtggattcaggcacaggaactggtgcgcaatatgaaggagaacttacagcttgactttcaattcgattggaaacttatcaatgtgtttttcagtaacgcatcgcagtgttatctgtgcccgagcgcccagcaaaacggactggccgcaggaggtgtagacgagctcatgggggtgttggattacctgcagcaggaggtccccagagcgttcgttaaccttgtggatttgtccgaggtcgccgaggtttcccgtcagtatcatgggacttggctgtcgcccgctcctgagccatgcaattgcagcgaggagacaacgcgcttagctaaggtggtgatgcagtggtcttaccaggaagcgtggaatagtctccttgctagcagccggtattccgagcaggaatcctttactgtggtgtttcagccctttttctatgaaaccacacctagcctccattctgaggacccgagattacaggatagcaccaccttagcctggcacctgtggaacaggatgatggaaccagcgggggaaaaagacgagcccctgtctgtcaagcacggcagaccgatgaaatgtccttcacaggagtctccttacctcttcagctatagaaacagcaattatctgacccgtttgcaaaagccacaagataaactggaggttagggaaggtgccgagattagatgtccggacaaagatccgagcgatacagtgcctaccagtgtccacaggctgaaaccagcagatatcaatgtgataggggcactgggtgatagcctaaccgccgggaatggcgctggatctaccccagggaatgtcctggatgtgctgacacaatacagaggacttagttggagcgtgggtggcgatgaaaatatcggcaccgtgaccacactcgctaacatcttgcgcgaatttaaccccagcctgaaggggttctctgtggggaccgggaaggaaacatcccccaatgcctttctaaaccaggctgttgctggcggacgggctgaagacctacctgttcaggctaggaggctggtagatcttatgaagaatgacacacgcatacacttccaggaggattggaagatcattacattgttcattggcggaaacgacctgtgcgacttctgtaatgacctggtgcactatagtccgcagaatttcacggataacataggaaaagccttagacatcttgcacgcggaggttccacgggcatttgtgaacctggtcactgtgctagagatcgtgaacctccgggaactttaccaggaaaagaaggtttactgccccaggatgatacttaggtctctgtgtccatgcgtcttaaagttcgacgacaattcaactgagcttgccacactcattgaattcaacaagaaattccaggaaaagacacaccagctgatcgaatccggaagatatgatacacgagaagactttacggtggtcgttcagccctttttcgaaaacgtggatatgcccaagacatcagaaggactgcctgataattcattttttgctccagactgcttccacttcagcagtaaatcccactcacgtgcagccagtgccctgtggaacaacatgctagagccagtcggccagaaaacaacccgtcacaagttcgagaacaaaatcaacatcacatgccccaatcaggtgcagccattcctgaggacttataaaaacagcatgcaggggcacgggacctggcttccctgccgcgatcgggcccctagcgctctgcaccctacgagtgtgcacgccttgcgccctgccgatattcaggtggtggcggccctgggggactccttgacagccggcaatggcatcgggtccaaacccgacgacctgcccgacgtgaccacacaatacaggggcctgagttacagcgccggtggggatgggtctctcgaaaacgtgaccacactgccgaatatcttacgtgaatttaataggaatttgaccggctacgcagtcggcactggggatgccaacgacactaatgcgttcttgaatcaggccgtgccaggggctaaggcagaagatctgatgtcccaagtccagaccttaatgcaaaaaatgaaggatgaccatcgcgttaattttcacgaggactggaaagtgatcacagttttgataggggggtccgacttgtgcgactactgtacagactcgaatctgtactctgcagccaactttgtccaccacctgagaaacgctttagacgtccttcatcgtgaggttccccgggtactcgttaatctcgtcgattttctcaatcctacaatcatgcggcaggtttttctggggaatcccgacaagtgccctgtgcaacaggcaagtgttttgtgcaactgtgttcttactctccgggagaactcacaggagcttgctcggctcgaggccttcagccgcgcctatcggtctagcatgagagagttggtaggcagcggcagatacgatacacaggaggatttcagtgtcgtgctgcagccgttcttccagaacatccagctacccgtgctggctgacggtctccctgacacatcctttttcgcgcccgactgtattcatcctaaccaaaagtttcattctcagcttgctcgcgccctgtggaccaatatgcttgaacctctcggtagcaaaaccgagaccctcgacctacgcgccgaaatgccaattacctgtccgacccagaacgaaccgtttctgagaaccccgagaaacagtaactatacttaccctattaagcccgcaatcgagaattggggaagtgacttcctatgtacagaatggaaagccagcaactccgtgcccacgtctgtgcaccagttacggccagcagacatcaaagttgtggccgctttaggggactccttaaccactgctgttggcgcccgaccgaacaacagttcagaccttccaactagctggcgcggtctctcctggtccatcggtggagatggaaatctggaaacccacacaactctgccaaatatcctgaagaaatttaacccctaccttttgggattctccacctccacttgggagggcaccgctggcttgaacgttgccgctgaaggggcacgagcccgcgacatgcctgcacaggcttgggatttggttgagaggatgaaaaactcacctgacatcaatttagagaaagattggaaattggttacactgttcatcggagtcaatgatttgtgtcattattgtgaaaacccagaggcacacttagctacagagtacgtgcagcatattcagcaggcactggatatcctgtccgaagagctgccacgtgcctttgtcaatgtggtggaggtaatggaactggccagcttgtatcagggacaggggggcaagtgcgctatgttggctgctcaaaataattgtacctgtctgagacacagccagtcgtcactcgagaaacaggagttaaagaaggtaaactggaatctccagcacgggatatcctccttttcctactggcaccaatatactcagcgtgaggattttgcagtagttgtacagcctttttttcagaatacattaacacctttgaacgaacgcggggatacggacctcactttttttagcgaggactgcttccatttctccgacagagggcacgccgagatggcaatcgccttgtggaataatatgctagagccggtgggtagaaagactactagcaataattttacccactcccgggctaagctcaaatgcccatctccggagagcccctatctgtatacgctaagaaacagcagactgctgcccgaccaggcagaggaagcccccgaggtgctctactgggcggtgcctgtcgctgcaggtgttggacttgtcgttggtataataggaacagtggtttggagatgcagaaggggtgggcggcgggaggacccacctatgtcacttcggacagtcgccctatag

SEQ ID NO: 199483 - DNA, 1467 bp, Artificial Sequence
  Description of Artificial Sequence: Synthetic coding sequence
atggagcccgccggcgagaaggacgagcccctgagcgtgaagcacggtagacccatgaagtgtccctcacaagaaagcccttatctgtttagttatagaaacagtaattatctgactaggctccagaagccgcaggacaaattggaagtcagggaaggcgcagagatcagatgtcctgacaaggacccctctgacacagtgcctacttctgtccacaggttgaagcccgccgatattaacgtgatcggcgctcttggtgacagcttgacggcaggtaacggagctggaagcaccccgggaaatgtgctggatgtactgacccagtaccgggggctaagctggagcgttgggggggacgaaaatatcggtacagttacaaccctcgccaatatcctcagagagtttaatccctccttaaagggatttagtgtgggaaccggaaaggagaccagcccgaatgcattcctgaaccaggccgtagctggtggcagagccgaggatctgcctgttcaagcgaggcggctggtggatctcatgaagaatgatacgaggattcacttccaggaggactggaaaatcatcactctcttcataggcgggaatgacctgtgtgacttctgtaacgacctcgtgcattattcaccccagaacttcaccgataatatcgggaaggccctcgacattttgcacgctgaagtgccgagggcctttgtcaaccttgtgacagtcctggagatagtgaacctgagggagctgtaccaagagaaaaaggtatactgtcctaggatgattcttagatccctgtgtccctgtgtgctcaagtttgacgataactcaaccgagctggcaaccctgattgaatttaacaagaaattccaggagaagacgcatcaactgatcgagagcggcaggtacgatacccgcgaggatttcaccgttgtagtacagcccttttttgaaaacgttgatatgccgaagacaagcgagggtctgccggacaattcattttttgcgcctgattgcttccatttcagcagcaagtcccacagcagggccgcatcagccttgtggaacaatatgctcgagcccgtagggcaaaagaccactcggcataagtttgaaaacaagatcaatatcacatgtcccaatcaggttcagccatttctcaggacctacaagaatagtatgcagggacacggcacctggttgccatgcagagatagagcaccaagcgcacttcatcccacctcagttcatgccttgcggccagctgatatccaggtcgtggccgcgctgggagattcccttaccgctggtaacggaattggtagtaagcccgacgacctcccagacgtgaccacacagtaccgtggactttcttatagggagagcaaaccaggtttcctcagcgactcctgggtcagcaagagcaatcgcaagtgcactcggaaggccccaaacccatag

SEQ ID NO: 199484 - DNA, 4344 bp, Artificial Sequence
  Description of Artificial Sequence: Synthetic coding sequence
atgggcctgcggcccggcatcttcctgctggagctgctgctgctgcttggtcagggcacgccacagatccacacgagtccgaggaaaagcacactcgagggtcagttgtggccagagacccttaaaaacagtccatttccatgtaatcccaataaactgggggttaatatgccgtcaaagagcgtgcactctctgaagccttccgacatcaaatttgtagccgctattggcaacttagagatcccacctgaccctgggaccggtgacctggaaaaacaagattggacagagaggcctcagcaggtgtgcatgggcgttatgaccgtgctgagcgatattattcgatacttcagcccaagcgtgcctatgcccgtgtgccatactggcaaacgtgttattccacacgatggggccgaggacctgtggattcaggcccaggaactggtaagaaatatgaaggagaacttacagctagattttcagtttgactggaagctgatcaatgtgttttttagtaatgcctcacaatgttatctttgtccttcggctcagcaggctccatccctgtctactgtgctcctctcacaaaacgggttggccgctggcggagttgacgagttgatgggcgtcctagactacctgcagcaggaggtgcctagagctttcgtcaacctggtcgacctaagcgaagtcgcagaggtgtcgcgccagtatcacggtacatggctgtcaccagctcccgagccttgtaactgtagcgaggaaactacacgactggcaaaggttgttatgcagtggtcctatcaggaggcatggaacagtttacttgcctccagccgttattccgagcaggagtcattcacagtagttttccagcctttcttttacgaaaccacaccgtcattacactccgaagatcctagattacaggattccacaaccctcgcttggcacttatggaaccgcatgatggagccagctggagagaaggacgagccattatctgtgaagcatggccgtcccatgaaatgtcctagccaggaaagcccctatttgtttagctataggaattcaaactacctcaccagattgcagaagccccaggataaactcgaagttagggaaggcgcagaaattcgctgtccagacaaggacccatctgatacagttcctacaagtgttcaccgcctgaaacccgctgatattaacgtcatcggggccttgggtgactccctcactgcagggaacggcgcaggatctaccccggggaatgttttggacgtgctcacccagtaccgaggcctgagctggagtgtgggcggagatgagaacattggcaccgtgaccacgttggccaatattctgcgcgagtttaatccttcccttaaaggttttagtgtaggtaccggaaaagaaacatctcctaacgctttcttgaatcaggccgtcgccgggggtagagccgaggatctgcctgtgcaggcacgacggctcgtggatctcatgaagaatgatactcgcatacactttcaggaggattggaagataattaccttattcatcggaggaaacgacctctgcgacttctgcaacgacctggtgccccgcgcgtttgtgaacctggtgaccgtgctggagatcgttaatctgcgcgaactttatcaagagaagaaagtctattgccctcggatgatactgcgcagcctatgcccctgcgtgctcaagttcgacgacaactctaccgagctggctaccttgatcgaatttaacaaaaaattccaggaaaagactcaccagctgatcgagtctggccggtatgatacaagagaagacttcacggtggtcgtgcagcccttcttcgaaaatgtggacatgcctaagacatctgaagggttgccggacaactcattcttcgcaccagactgctttcacttttcttccaagtctcacagccgagctgcgagcgcgctctggaacaacatgttggaacctgtgggccagaaaacaactcgccataagtttgagaacaagatcaacattacctgtccaaatcaagtacaacccttccttcgaacctacaagaacagcatgcaaggccatggtacctggcttccatgtcgggatcgcgctccttcagccttacacccaacctctgtccacgccttaaggccggcagacattcaagtggtcgccgctctcggagattccctgaccgctgggaacgggataggttcaaagccagacgatttaccagatgtgactactcagtacaggggactgtcgtactcagccgggggagatggttccctggaaaacgtgaccacactccctaatattctgcgggaattcaatcgcaacttgaccggatacgctgtcggaacaggggatgctaatgatacgaatgcttttttgaaccaggctgtacctggtgcgaaggccgaagatctgatgtcacaggtccagacgctcatgcaaaagatgaaggacgaccaccgcgtgaatttccacgaagactggaaagtgatcactgtcctgatcgggggatctgacctttgcgattattgcaccgattcaaacctgtactctgctgcgaattttgtccaccacctgcgcaatgcccttgatgtcctgcatagagaggtcccccgcgttctggtgaacctcgtcgattttcttaatccaacaataatgagacaggtgttcctggggaacccagacaagtgccctgtgcagcaagccagtgtcttgtgcaactgcgtcctgaccttaagagagaactcgcaagaactcgccagactggaagcctttagcagggcgtacagatcaagcatgagagaactggttggcagtggccgatacgatactcaggaagatttctccgtagtcctacagccgttcttccagaatatccaactacctgttctggctgacgggctgccagatacctctttctttgctcccgattgcatccaccccaatcagaagtttcactcacaacttgcgagggccctttggacaaacatgctcgagccactgggctctaagactgaaacgcttgatctcagagccgaaatgcctatcacctgtccaacccagaacgagccctttctgcgcacccccaggaattctaattacacctatcctatcaaacccgcgatcgaaaactggggcagtgactttctgtgtaccgagtggaaggcgagtaattctgtgccaacctccgtgcaccagcttcgacctgcagatattaaggtagtcgcggctctgggagatagcttgaccacagctgtgggagcccggcccaacaactcgagcgatctgccaacatcctggcggggactttcctggtctatcggtggcgatgggaacctggagacgcatactaccttgcctaacatactgaagaagtttaacccatacctgcttggctttagcaccagcacctgggaagggactgctggcctgaacgttgcagccgaaggagcccgagccagggacatgcctgctcaggcgtgggacttagtggagcgcatgaagaactcaccagacataaacctggaaaaggactggaagctggttactctgttcatcggtgtcaatgacctgtgtcactactgtgaaaaccctgaggctcacctggcaaccgaatacgtgcaacatatccagcaggctctcgatattcttagtgaagaacttccacgagctttcgtcaatgtggtggaggtgatggagttggctagcctgtatcaaggccagggcgggaagtgcgctatgctcgccgcgcagaacaactgtacctgtctgcggcatagtcagtccagcctggagaagcaggagctgaaaaaagtaaactggaatctccagcatgggatctcaagtttttcctactggcatcagtacactcagagagaggactttgctgtggtggtacagccattcttccaaaacactctcacacctctgaacgagagaggtgacacagacctaactttcttttctgaagactgtttccacttctctgatagagggcacgctgagatggctatcgctctgtggaacaatatgcttgagcccgttgggcgcaaaacgacatcgaacaatttcactcactccagggccaaactgaagtgtccctctccagaatcaccatatctctatacgctcaggaactctagactcctacccgaccaggcagaagaggcccctgaagtgctttactgggctgtacccgtcgctgccggcgtcggcctggtcgtgggcattatcggtactgtggtgtggcgatgcaggcggggagggagacgtgaagatcctcctatgtcgcttagaactgtggcgctctag

SEQ ID NO: 199485 - DNA, 1272 bp, Artificial Sequence
  Description of Artificial Sequence: Synthetic coding sequence
atgcccatcacctgccccacccagaacgagcccttcctgcggaccccgaggaatagcaattacacttatcctatcaagccagccattgagaactggggctctgattttttgtgtacagagtggaaagccagtaactccgttccaacatcagtgcaccaactgcgtcccgctgatatcaaagttgtcgcggcgctaggcgacagcttgacaaccgccgtcggagccaggcctaataactccagtgatcttcctacgagctggagagggttgagctggagcatcggaggcgacggcaacttagaaactcacactaccctgcccaacattctgaagaagtttaatccatatctgctgggattttcaacttccacctgggaaggaacagccgggttgaatgtcgcagcagagggtgcccgggcgcgcgatatgccggcccaggcttgggatctggtagagaggatgaagaattcccctgacattaatctcgagaaagattggaagctggtgacactgtttataggagtcaatgacctgtgccactattgtgagaatcctgaggcacatctcgccaccgagtacgtgcagcatattcagcaggcacttgacatactttccgaagagctgccacgagctttcgtgaatgtggtcgaagttatggagctggcaagtctgtatcaaggtcagggaggaaagtgtgccatgctcgccgctcaaaacaactgtacttgcttacgacactcccagtcttctctggaaaagcaagaactgaagaaagtcaactggaatttgcagcacgggattagctcgttctcctactggcaccaatacacgcaacgggaggattttgctgtggtcgtccagcctttcttccagaacaccctgacaccactgaatgaaaggggagatacagacctaacattcttttcagaggactgttttcatttcagtgatagaggacacgccgaaatggccatagctctctggaataacatgctggagcccgtgggcaggaagactacaagtaacaactttactcacagccgcgcgaaattgaagtgtccatcccctgaaagcccctatctgtacaccctcagaaattctagactgctgccagatcaggcagaagaggccccggaggtgctctattgggccgtacccgtggctgccggggtaggcctcgtggtaggcattatcggcacagtggtctggaggtgccgcagggggggacgtcgtgaggatccccctatgtcactgaggaccgttgcactatag

SEQ ID NO: 199486 - DNA, 3504 bp, Artificial Sequence
  Description of Artificial Sequence: Synthetic coding sequence
atggccggcgcccagcccggcgtgcacgccctgcagctggagcccccgacagttgtcgagactctgaggcggggatcaaaatttattaagtgggacgaagaaaaactgatgactgtggtcagcgggcctgacccagtgaataccgtattcctgaatttcatggctgtgcaggacgataccgctaaagtgtggtctgaggaattgttcaagctcgccatgaatatcctggcccagaatgcgagtcggaacactttcctaagaaaggcttacactaagctgaagttacaagtgaatcaggatgggcgcatccctgttaagaatatcctgaaaatgttctcagctgataagaaacgagtcgagactgccttggagagctgcggcttgaagttcaaccgaagtgaaagcatcaggcccgatgagtttagcctggagatctttgagcggttcttaaacaagttgtgcctccgacccgacatcgataaaatactgttggagatcggggcaaagggtaaaccctatttaaccttagagcagcttatggactttataaaccagaaacagcgcgaccctcgcctcaatgaagttctataccctccgttacggccaagtcaggcacggctcctaattgagaaatacgagcctaatcaacagtttctagagagggaccagatgtccatggaaggattttccagatacctcggcggagaggagaacgggatcctgcctcttgaagcgctggatctctccaccgacatgactcagcccctctctgcctacttcataaattcctcacacaacacttatctgacagctgggcagttagctggcacatcatccgtggaaatgtatcggcaagccctattatgggggtgccgatgcgtcgaattagacgtgtggaagggacgacctccagaggaggagccattcatcactcacggctttaccatgaccaccgaagtcccactgagggatgtcctggaagcgatcgccgaaaccgcattcaaaacctcaccataccccgtgatcctctccttcgaaaaccatgtggacagcgcgaagcagcaggctaagatggccgagtactgtcggagcattttcggcgacgctctgcttatcgaacccctagacaaatacccgttagctcccggcgtgcccctccctagtccccaagatcttatgggacggattctggtcaagaataagaagagacatcgaccttccgctggaggccctgactccgcaggtcggaagaggccgctcgaacagtcaaatagcgccctctcggagagttccgccgccaccgaacccagctcccctcagctgggtagtccaagttccgattcctgccctggactgtctaatggggaggaagttggcctggaaaaaccaagtctggagcctcagaagtcattaggcgacgaaggtcttaaccgcggaccttatgttctgggcccagctgatcgggaggacgaggaagaggacgaggaggaggaggagcagaccgatcccaaaaaacctactactgacgagggcacagcgtcatccgaagtgaacgccacggaagaaatgagcaccctggtaaattacattgaacctgtgaaattcaagagcttcgaagcagcaaggaagcgcaataaatgttttgaaatgagcagtttcgtagaaactaaggccatggaacagctgacaaagtcccccatggagttcgtcgagtataacaagcagcaacttagccggatataccccaagggcactagggtcgactcgtccaattacatgcctcagctcttttggaacgtcgggtgccagctggtagccctgaacttccagactctcgatgtggcaatgcaattgaacgccggtgtattcgagtacaacggcaggtctggctatctgctgaaacccgagttcatgcgccgtccggataagtcatttgacccgtttaccgaagtaatcgtcgatggcatagtggccaatgcactcagagttaaagtgatttctgggcagttcctcagcgatagaaaggtcggcatctacgtggaggtggacatgtttggcctgcccgtggacacaaggaggaaataccgtactaggaccagccagggaaactcctttaaccccgtatgggacgaagagccctttgatttccctaaggttgtcctacccactcttgcaagcttgcgcatagccgccttcgaagaggggggtaagtttgtaggccatcgcatactgcctgtttccgccattagatctggctatcactacgtctgtctccgaaacgaagccaaccaaccactgtgtctgccagctctgcttatctacaccgaagccagcgactatatcccggacgaccatcaggattacgcggaggcattaattaatcccattaagcacgtgagtttgatggatcagcgcgcaagacaacttgcagcccttattggagaatctgaagcccaagccggccaagaaacctgtcaggacacccagtcccaacagctcggatcgcagccttcctctaatcctacacccagtcccctagacgccagccccagacgtccaccgggaccaacaaccagccccgccagcacttctctgagctcccccggccaaagggatgatttgatcgcatcaatactcagcgaagttgcccctaccccacttgatgagttgcgtggccacaaggcgctagtaaaactcagaagcagacaggagcgtgaccttcgagagctgagaaaaaagcaccagcggaaggcagtcacattgacgaggaggctgctcgatggcctcgcccaggcgcaagcagagggccgctgtcgcctacgcccgggagcactcgggggagccgctgacgttgaggataccaaggaaggagaggatgaagctaagaggtatcaagaattccagaaccgtcaagtgcagtctctactggaactccgagaggcccaggttgatgctgaggctcaacgaaggcttgagcatctcagacaggccctgcagagacttcgcgaggtggtcctggacgcaaacacaacccagttcaaaagactgaaggaaatgaacgaaagggaaaaaaaggagctacagaaaatcctcgaccggaaacggcacaatagcatttccgaagccaagatgagggacaagcacaagaaagaagccgaattgacggagatcaacagaagacatattaccgagagtgttaatagcattagacgtctcgaagaagcgcagaagcagaggcacgatcgcctggtcgccgggcaacagcaggtgcttcagcagcttgccgaggaggagccaaagctactggcccaactggctcaggaatgccaggaacaacgcgcgcgtctgcctcaagagatcagaaggtctctcttaggcgagatgcctgaaggcttgggagatggcccccttgtcgcttgcgccagtaatggacatgcccccggatcaagtggccatctgtcaggcgctgacagcgagagccaggaggagaatacccagctgtag

SEQ ID NO: 199487 - DNA, 3651 bp, Artificial Sequence
  Description of Artificial Sequence: Synthetic coding sequence
atggccggcgcccagcccggcgtgcacgccctgcagctgaagcccgtatgcgtgtccgacagtctgaagaaggggactaaattcgttaagtgggatgatgattcaaccatcgttaccccgattatcttaagaactgaccctcaggggttcttcttttactggacagatcagaataaggagaccgaattgttggatttatcgctggtcaaagacgcccgctgtgggcggcacgccaaggccccaaaggatcctaagttaagagaactgttggatgtcggcaatattggcagactcgaacagagaatgattacagtcgtgtatggacctgatttagttaacattagccatctcaatctggtggcctttcaggaggaggtggctaaagaatggaccaatgaggttttcagcttagccacaaatctactagctcagaatatgtcaagagatgcattcctcgaaaaggcctacactaagctaaaactccaggtaacacctgagggtagaataccgcttaagaatatttatagactgtttagcgcagaccgcaaaagggtggaaacagccctggaggcctgcagcttaccgagtagcagaaatgactctataccccaggaagatttcaccccagaagtgtatagggtgttcctaaacaatctttgcccgagaccggaaattgacaacatcttctccgagttcggagctaagtcaaaaccctatttgaccgtggatcagatgatggattttatcaatctgaagcagagagaccctcggctgaacgagattctttatcctccgctgaagcaggagcaggtgcaggtcctgatcgaaaaatatgaacccaataactctctggctagaaaaggacaaatttccgtggatggttttatgcgatacttgagcggtgaagagaatggtgtggtgtccccagaaaaactggatctcaacgaggacatgtcgcagcctctcagccactactttattaatagttcccacaatacctacctgactgctgggcagctggccgggaattctagcgttgaaatgtatcggcaagtgctgctgtcaggttgtcggtgtgttgagctggactgttggaaaggacggactgcggaagaagaacctgtgatcacacacgggttcacgatgacgacagagatctcatttaaagaagtgatcgaggcaatcgccgagtgcgcctttaaaacaagccctttccccatcttgctctctttcgagaaccatgtggattcccctaaacagcaggctaagatggccgagtattgtcgtctaattttcggcgatgctttgctcatggagccactggagaagtatcccctggaatccggtgtgccgcttccttcccccatggacctgatgtacaaaatcctcgtgaaaaacaagaagaagtcccataaatcctccgaaggatcaggtaaaaaaaagctgtcagagcaggctagcaacacttatagtgactccagcagcatgttcgaaccgagtagccccggcgcaggggaggccgacactgagtcagacgacgacgacgatgatgacgattgtaaaaagagtagcatggacgaaggtactgccggatctgaagcgatggcaactgaagagatgtccaatctggtgaactacatccaacctgtgaaattcgaatctttcgaaataagcaagaagcggaataaaagctttgaaatgtctagttttgtcgagaccaaaggcctcgaacagttgactaagtcccctgtggagttcgtcgagtacaacaagatgcagctgtctcgaatataccctaaaggcacccgcgtggatagctcgaattacatgccccagctgttctggaatgctggatgtcagatggtggctctaaactttcagactatggatctcgccatgcaaatcaatatgggtatgtatgaatataacgggaaatcaggctacaggctgaagcctgagtttatgcgccgtcctgataagcatttcgacccctttacagaggggatcgttgacggcattgtcgccaacactttgagtgtaaagattatttcgggccagtttctatcagataagaaggtgggcacctatgtggaggtagacatgttcgggttgccagtcgatacccgtaggaaggcatttaaaaccaaaacctcccagggcaatgcagtcaacccggtttgggaggaagagccaatcgtattcaagaaggtggtcctgcctaccctggcgtgtctgaggattgcagtgtacgaagagggtggcaagtttatcggtcatcggattttaccagtgcaagctattcgccctggctatcactacatatgtttgaggaatgagcggaaccaacctttaacactgcccgcggtgtttgtttacatcgaagtgaaagactacgtccctgacacctacgccgacgttattgaggccctgtctaatccaattaggtacgtcaatttaatggagcaaagagctaagcaactggcagcattaacattggaagacgaggaggaggtgaagaaggaagccgaccccggagagacaccctctgaggcaccatcagaggcacgtaccacacccgctgaaaatggtgttaatcacactacaacactgacccccaagcccccctcccaggccctacattctcagcctgcccccgggtccgttaaggcccccgcaaagaccgaagatctgattcagagcgtgctgacggaggttgaggcccaaactattgaggagctgaaacagcagaaaagttttgtgaaactccaaaagaagcactacaaggagatgaaagacctggtgaagaggcaccataaaaagaccactgatctgatcaaggaacacactacaaaatacaacgagatccagaacgattatcttaggagacgcgccgcattagaaaagtccgcaaaaaaggattccaagaaaaagagcgaaccttcctctccagaccatggctcttcaaccatcgagcaagacttggctgccctcgatgcggaaatgactcagaagctgatcgatctgaaagataaacagcagcagcaactgctcaatcttcggcaagagcagtattatagcgagaaatatcaaaagagagagcatatcaaattgcttattcaaaagctgaccgatgttgctgaggaatgtcagaataaccaactgaagaaactgaaggaaatctgcgaaaaagaaaaaaaggaactaaaaaagaagatggataagaaacggcaagagaagataactgaagcgaaatccaaggacaaatcccagatggaagaggagaaaaccgagatgatccggtcttacattcaagaggtggtgcaatacatcaagaggctggaagaggcccaaagcaaacggcaagaaaaattagtcgagaaacataaagagattcggcagcaaattctcgacgaaaaaccaaaactgcaggttgaactggaacaggagtaccaagacaaatttaagaggttgcccctggaaatactggaatttgtgcaggaggccatgaaaggaaaaatctctgaagactctaatcatggctctgcccctctctccctgtccagcgatccaggaaaggttaatcataagacacccagttctgaggagctcgggggagatataccaggcaaggaatttgacacacccctttag

SEQ ID NO: 199488 - DNA, 672 bp, Artificial Sequence
  Description of Artificial Sequence: Synthetic coding sequence
atgcggcggcccgacaagcacttcgaccccttcaccgagggcatcgtcgacgggatcgtggccaatactctgtcagtgaagatcatctccgggcagtttctcagcgacaaaaaggtcggcacatacgtcgaggtggacatgtttggattgcccgtggacacaaggagaaaagcctttaaaaccaagaccagccagggcaatgccgtaaaccccgtatgggaggaagagccaatcgtctttaagaaagtggtattgcccactttggcctgcctcagaattgcagtgtatgaggagggaggaaaatttatcggccatcgcatactgcccgttcaggcaattcggccagggtatcattatatttgtttgagaaatgagagaaaccagccgctcacacttcctgcagtgtttgtgtacatcgaagtcaaagactacgtcccagacacttacgcagacgtgatcgaagcactgtctaatccaatccgctacgtgaacctgatggaacaacgagccaagcagctcgcagccttaacattggaagatgaagaggaggtcaagaaggaagggggcttcctgcatgacgagatcatgcgccttacacgcaacacactcgaaaagttaatggctctcccccttacacacgtcgttccgattcagtctaaaatgctgtcctag

SEQ ID NO: 199489 - DNA, 3522 bp, Artificial Sequence
  Description of Artificial Sequence: Synthetic coding sequence
atggccggcgcccagcccggcgtgcacgccctgcagctgaagcccgtgtgtgtttccgactcacttaaaaaagggaccaaattcgttaagtgggacgacgactctacgatcgtcacacctataatcctccgcaccgaccctcagggattctttttctactggacagaccaaaacaaagagaccgagctgttagatttgtcactcgtcaaggatgctaggtgtggcaggcacgccaaggcacccaaagacccaaagctcagagagctcctggatgtcggaaatataggcagactggagcaacggatgattactgtggtgtacgggccagacttggttaacatttcccacctaaatctggttgccttccaggaagaagtagcaaaagagtggacaaatgaagtgttttctctcgccacgaacctgttagcccagaacatgagccgagatgcatttctcgagaaggcgtacacaaaactgaagctgcaggtgacaccagagggccggattcctttgaaaaacatataccgtttgttttcggctgatcgcaagcgtgttgagaccgcattagaggcctgttcacttcctagtagtcggaatgactcaataccgcaggaagatttcaccccagaagtgtatagagtatttcttaacaatctttgtcccaggcccgaaatagataatatcttttctgagttcggcgctaagagcaaaccttacctaaccgttgaccaaatgatggattttatcaatctaaagcagagggacccacgactcaatgagatcctctaccctcccctcaagcaggaacaggtgcaggtcctgatagagaagtatgagcccaacaactcactcgccaggaaagggcagatctccgtcgatggcttcatgcggtatcttagcggagaggaaaacggagtcgtgtcaccagagaaactcgaccttaacgaagatatgtctcagccgcttagccattatttcattaatagctcacataatacctacttaactgccggccagttagctggtaactcgagcgtggagatgtatcgccaagttctcttatccggatgtcgctgtgtggagctggactgctggaaaggacggaccgccgaagaagaaccagtcataacacatgggttcacgatgactaccgagatctctttcaaagaagtcatcgaggccattgccgagtgtgctttcaagactagcccttttccaattttgctgagttttgaaaaccacgtggattcacccaagcagcaggctaagatggccgaatactgcaggctgatcttcggcgacgctctcctgatggaaccactcgagaagtacccacttgaatctggtgtacccctccccagcccaatggacctgatgtacaagatcctggtgaaaaataagaaaaaaagccacaaaagcagcgaggggagtgggaaaaagaagttatcggagcaggcttctaatacttattccgacagctcctctatgtttgaaccaagtagccccggtgccggagaggccgataccgagtctgatgatgacgacgatgatgatgattgtaaaaagtcttccatggacgagggtactgcaggatctgaagctatggccaccgaagaaatgtccaaccttgtgaactatatccagcctgtgaaatttgagagctttgagatcagcaaaaaacggaacaagtcatttgaaatgagttcttttgtggaaactaagggactagagcagctcaccaagtctcctgtggagttcgttgaatacaataagatgcagttatcccgcatctacccgaagggtacaagggtagacagttccaactatatgccacagcttttctggaatgctggctgtcagatggtggcactgaacttccagacgatggacctggccatgcagattaacatggggatgtatgagtacaatggtaagagcggataccgactgaaacctgagtttatgcgcagacctgataagcattttgacccatttactgaaggtattgtggacggtattgtggcgaataccttatcagtcaagatcatttctggccaattcctgagcgacaagaaagtaggaacatatgttgaggttgacatgttcggtctgcctgtggatactagaaggaaggctttcaagacaaaaacatcccagggaaatgccgtgaatcctgtgtgggaagaggagcccatcgtgttcaagaaagttgttctgcccactctggcgtgcctacgtatcgcagtctatgaggaggggggtaagttcatcggccaccgaattttgccagtgcaggccatccgtcctgggtaccactacatttgtttgagaaatgaaagaaatcagccactcactctgccggcagtgttcgtctatatcgaggtcaaggattacgtgccagatacttatgcagacgtgattgaggccctgagcaaccccattagatatgtgaacctgatggagcagcgagccaagcaactcgcggctctaacactcgaggacgaagaggaggtaaaaaaggaggccgatcctggcgagactccctcggaagctccatccgaggcaagaacaactcctgccgagaacggcgttaaccacaccaccactctgactcccaagcccccgagccaagccctgcattctcagcctgctcccggcagcgttaaggcccctgctaaaacagaagacttgattcagagtgtgctaaccgaagttgaggcgcaaaccatcgaggagctgaagcaacaaaaatcatttgtcaaactccagaagaagcactataaagagatgaaagacctggttaaacggcaccacaagaagactacggacttaatcaaggaacacacaactaagtacaacgagatccaaaatgattacctgcgccggcgggctgcactcgagaagagtgctaaaaaggacagcaagaaaaagtccgaaccttcaagcccggaccacggatcctctaccatagaacaagatttggcagccctcgatgcggagatgacacagaagcttattgatttaaaggacaagcaacagcaacaactcctgaatctgaggcaggagcaatattactctgagaagtaccagaaaagggaacatattaaactactcattcagaagcttacagatgtggctgaagagtgccagaacaaccagcttaaaaagctgaaagaaatctgtgaaaaagaaaagaaggagcttaagaaaaagatggataagaagcgtcaggagaagataaccgaggctaagtccaaagataaatcccagatggaggaggaaaaaaccgagatgattcgcagttacatccaggaagtggtacaatatattaaaaggctggaggaggcccagtccaaacggcaggagaaactggtcgagaaacataaggagatcagacagcagatcttagacgagaaacccaaaggcgagggctcctcatctttcttaagcgagacctgccacgaggatccgagcgtgtctcctaacttcacgcctcccaatccacaggccctgaaatggtag

SEQ ID NO: 199490 - DNA, 3522 bp, Artificial Sequence
  Description of Artificial Sequence: Synthetic coding sequence
atggccggcgcccagcccggcgtgcacgccctgcagctgaagcccgtgtgtgtttcagattcactgaagaaaggcaccaagttcgtcaagtgggatgacgacagtactattgtcacccccattattctgcgaacagatccgcaaggatttttcttctattggactgaccagaataaggagaccgaactgctggatctctctttagtgaaggatgcccgatgtgggaggcacgccaaggcccccaaagatccaaagctgcgtgaacttctcgatgttggtaacattgggaggctggaacagcgcatgattacagtcgtatacggtcccgatctcgtcaatatctcccacttaaacctggtggcctttcaagaagaagtcgctaaagagtggaccaacgaagtgttttctttagcaacgaatctgctcgctcagaacatgtctcgcgatgccttcctcgaaaaagcgtatactaaacttaagctgcaggttacccccgagggacgtattcctctgaaaaacatttacaggctgttcagtgccgatcgaaagcgagtggagaccgccctggaagcgtgctcactgccttcttcacgcaacgacagtattcctcaagaggacttcacacccgaggtttaccgggtttttctgaacaacctgtgccctcgcccggagattgacaatatttttagtgagtttggggccaaaagtaagccctatctgaccgtggaccaaatgatggatttcatcaatctcaaacaaagagaccccaggctcaatgagatcctctacccgccacttaagcaggaacaggtacaagtactcattgagaagtatgagcctaataattccctcgcccgtaagggtcagatctcggttgacgggttcatgaggtatctgtcaggagaggagaatggagtcgtgtcccccgagaagctggatctgaatgaagatatgagccaaccactatcacattattttataaatagctctcacaacacttatctgactgcaggtcagctcgctggcaactccagcgtggaaatgtatcggcaggttctacttagcgggtgccgctgcgtggagctggattgctggaaggggcgaactgccgaggaagagccagtcattacccatggatttacaatgacaaccgagataagttttaaagaagtaatcgaggccatcgcagaatgcgcctttaaaactagcccctttcctatcctgctatcattcgaaaatcatgtcgattcccccaaacagcaggccaagatggccgaatactgtaggctgatcttcggagacgccctgctgatggaaccattggaaaagtaccctctggaaagtggagtcccattaccatcaccaatggatctaatgtacaaaatactggtcaaaaacaagaaaaagagtcataagagtagtgagggtagtggtaaaaagaaactctcagagcaagcaagtaacacttacagtgactcctcttcgatgtttgaaccctcatctcccggggcgggggaagccgacaccgagtcggatgacgatgatgacgatgacgactgtaaaaagtcatctatggacgaaggtactgccggctccgaggcgatggccacggaggagatgagcaatctcgtgaactacattcagccagtaaagtttgaaagcttcgaaattagcaagaagagaaacaagtccttcgagatgagttcctttgtagaaactaaagggctagagcagctgacaaagtcccctgttgagttcgtagaatacaataaaatgcagcttagccgcatttatcctaaggggacccgagtggacagcagtaattatatgccacaactgttctggaacgctgggtgccagatggtggcactgaactttcagactatggacctggctatgcagatcaacatggggatgtacgaatacaatggcaaaagtgggtaccgattgaaacctgaatttatgaggcgacctgacaagcactttgacccatttaccgaggggatcgtcgacggcatcgttgcgaataccctgagcgtgaagatcattagtggccaattcctctccgacaagaaggtgggtacttacgtcgaagtggacatgttcggcctcccagtggatacccgccgcaaggcattcaagaccaagacgagccaagggaatgccgtgaaccccgtttgggaggaagaacctattgtgttcaagaaggtcgtactacccacgcttgcctgtctccgaatcgctgtctatgaggaaggagggaagttcatcgggcataggattctgccggttcaggctatcagaccaggctaccactatatatgtctccgcaatgagcggaaccaaccactgaccctgcccgccgtctttgtctacatagaggtgaaagattatgtgccagatacatatgccgacgtcatagaggcactgagcaatccgatacgctatgtgaacctaatggagcagagagcgaaacaactggcggccttaactcttgaggacgaggaagaagtgaagaaagaggccgatccaggagaaaccccgagcgaagccccgtctgaagccagaaccacgccagcggaaaacggagtgaaccataccaccacccttacacccaagcccccgagccaggcactccacagtcagccagctcccggaagcgtgaaagctcctgccaagactgaggaccttatacaaagtgtgctcactgaagtcgaggctcagactattgaggagctcaagcagcagaagagctttgtcaaactgcagaagaaacactataaggagatgaaagacctggtgaaacgccatcacaaaaagaccacggatttgattaaggagcacaccacaaaatataacgagatccagaacgactatcttaggaggagagcagctttagaaaagagcgctaagaaggactcaaagaagaaatcggagccatcatccccagaccatgggagttctacaattgaacaggacctggctgctctggatgccgagatgactcaaaagctcatcgatctaaaagataagcaacagcaacagctgcttaacttgagacaggaacagtattactccgagaagtatcagaagcgggaacatattaagctgctcattcaaaagttaacagatgtggccgaggagtgtcagaacaaccagctgaagaagctgaaagagatatgtgaaaaagaaaaaaaagaactcaaaaaaaaaatggacaagaagagacaagagaaaatcacagaagcaaaaagcaaagataaatcgcaaatggaagaggaaaaaactgaaatgattcggtcatatattcaggaggtggttcagtacatcaaaaggctggaggaagcgcaaagtaagcgccaggaaaagctcgtggagaagcataaagaaatccggcaacagattctggatgagaaaccaaagggagaggggtcctcatcgttcctgtcagagacatgccacgaagatcctagtgtatctcccaacttcacgcctccgaatccacaagccttgaagtggtag

SEQ ID NO: 199491 - DNA, 699 bp, Artificial Sequence
  Description of Artificial Sequence: Synthetic coding sequence
gccggcgcccagcccggcgtgcacgccctgcagctgaagcccgtgtgtgtctcagatagcctcaaaaagggaacaaagtttgtgaagtgggatgatgactctactatagtgacccctataatcctgcgtactgacccacagggttttttcttctattggactgatcagaacaaagagacggagctgcttgacctgagtctggttaaggacgctcgatgtgggcgccacgctaaagcacctaaagacccgaaactcagagaattactagacgtaggcaatatcggccgcctggagcagcgtatgatcactgtggtctacggtcctgacttggttaacatttcccatctgaacctggtggcttttcaagaggaggttgctaaggaatggacaaatgaggtgttttcgttggcaacaaatcttttagcgcagaatatgagccgcgatgcattcctagagaaggcttatactaaactgaagttgcaagtcactccggaaggcaggattcccttaaagaatatataccggttgttttctgccgataggaaacgcgtcgaaaccgccctagaagcctgttctcttccctcttccagggttgaaaaggctaatgaggcagctaagagcgaacagtcatgcggcaaggctccccccaagcactttcatctgcacttcatcaaacaaaacaagatgcttgaaccatag

SEQ ID NO: 199492 - DNA, 93 bp, Artificial Sequence
  Description of Artificial Sequence: Synthetic coding sequence
gaggaggcccagagcaagcggcaggagaagctggtggagaagcacaaggagattcgacagcaaattttagacgagaaaccgaaagtcccttag

SEQ ID NO: 199493 - DNA, 591 bp, Artificial Sequence
  Description of Artificial Sequence: Synthetic coding sequence
atcatcagcggccagttcctgagcgacaagaaggtgggcacctacgtcgaagtggacatgtttgggctccccgtggacacccgtaggaaggcgtttaagacgaaaacctcacagggcaatgcagttaatcccgtgtgggaggaggagccgattgtctttaagaaggtggtactccccaccctcgcatgtctgagaatcgcggtgtacgaggaagggggtaagttcataggacaccgcatccttcccgtacaagctattcgaccagggtaccactatatttgtcttcgcaacgaacgcaaccagccgctgacactccctgctgtgttcgtctacatcgaggtgaaagactatgtaccagatacttatgctgacgtcatcgaggccctgtccaatccaattagatacgttaatttgatggaacagagggcaaagcagttagcggcactcacgcttgaggatgaggaagaggtgaagaaggagggcggttttctgcatgatgaaattatgcggctgacccggaacaccttggagaagctgatggctctgcctctcacacacgtggtgccaatccagagtaagatgctgtcttag

SEQ ID NO: 199494 - DNA, 3411 bp, Artificial Sequence
  Description of Artificial Sequence: Synthetic coding sequence
acccaggaccccaagctgcgggagctgctggacgtgggcaacatcggcaggctagagcaaaggatgattacagtcgtttatgggcctgacctagtcaacatctcacaccttaacctcgtggccttccaggaggaggtggcgaaagaatggactaacgaggtcttctccttggccactaatttgctggcccagaatatgagtcgcgatgctttcttggagaaggcatataccaagcttaaactgcaggttactccagaaggaaggatacccctgaagaacatctatcggctcttcagcgctgaccgcaaaagagtcgaaacggcactggaggcttgctctttaccctctagccggaacgatagcattccacaggaggactttactccagaagtatatcgggtttttctgaataatttgtgtcctagacccgagatcgataacattttctcagaatttggcgccaagagcaaaccttacctcactgtggatcaaatgatggactttattaatctaaagcagcgggacccccggctcaatgaaatcctttacccccctctgaagcaggagcaggttcaggtattgatcgaaaagtacgagccaaataactctctcgcacgaaaaggacagatctcggtcgatggtttcatgaggtacctaagcggcgaagagaatggcgtggtgagccccgaaaaactggatctgaacgaggatatgtcacaacccctgagccattactttatcaactctagccataatacctatctaactgctggccagctggcgggaaattctagtgtcgagatgtacagacaagttctgctgtcaggctgccgttgtgtcgagctagactgttggaaggggaggacagcagaagaggaacctgtgataactcacggcttcaccatgacaactgaaattagtttcaaagaagtgatcgaagccattgccgaatgcgctttcaagacttctcccttccctattttgttgtcctttgagaaccacgtagattctccgaaacaacaggccaagatggcagaatattgtagactgatctttggagatgcccttctgatggagccactggagaagtatcccctggagtctggagtccctttgccatcccccatggatctcatgtataaaattttggtcaaaaacaagaaaaaaagtcacaagagctccgaaggaagcgggaaaaaaaagttgtctgagcaagcatccaatacttactctgatagcagctctatgtttgagcccagtagcccaggagcaggcgaggctgatacagaaagcgacgatgacgacgacgacgatgactgtaagaagagctctatggacgagggtaccgcgggatcagaggccatggctacagaagagatgtcaaatctagtgaactacatacagcctgtcaaatttgagtctttcgaaatttcaaaaaagagaaataagtctttcgagatgtcaagcttcgtcgagaccaaaggcttggagcagctgaccaaaagcccagtcgagttcgtcgaatacaacaagatgcagttaagtcgcatttaccccaagggcacacgggtggacagttccaattatatgccacagctgttttggaacgccggatgccagatggtagccctcaattttcagaccatggacctggccatgcagattaatatggggatgtacgagtacaacggaaagtctggctaccggctgaagccggagttcatgaggcggcctgataaacactttgacccttttaccgaggggatcgtggacggaattgttgcaaataccctgagcgtgaagattatatctggccaattcctgagtgacaagaaggtgggaacttacgtggaagtggatatgtttggcctgccagtggacacaaggaggaaggcatttaaaacaaaaacaagtcagggcaatgctgtcaacccagtctgggaggaggaaccaattgtgtttaaaaaggtagtgcttcctactcttgcctgtctccggattgctgtctatgaggagggggggaaattcatcgggcatcggattttgcctgtgcaggcaataagaccagggtaccactatatctgtctacggaatgagcgaaatcaaccccttactctgccagctgtattcgtgtacattgaggttaaggactacgtacccgacacatatgctgacgttatcgaagccctttccaaccccattcgttacgtaaacctgatggagcagagggccaaacagcttgccgcgctgactctggaggacgaggaggaagtaaagaaggaagccgaccctggtgaaaccccttcagaagcaccctcagaggcccggaccacccctgcagaaaacggagtgaaccacacgaccacactgacgcccaaaccaccttcacaagcgttacattcacagcctgcgcctggctcagtgaaagctccagcaaagaccgaagatctgattcagtctgtgctgacagaagtcgaggcgcagaccattgaagaattaaagcaacagaaatcttttgtgaaactccagaagaagcactacaaagagatgaaagacctggtcaagcgacatcataaaaagactacagacctgattaaggaacacacaactaaatacaatgagattcaaaacgactaccttaggcggagggcagccttagagaaaagcgcgaagaaggactcaaaaaagaagtcggagccatcgagccccgaccacgggagctcaactattgaacaggacctagcggcactggatgccgagatgactcagaagctcatcgatcttaaggacaagcagcaacagcagctgcttaatctcaggcaggaacagtactacagcgagaaataccagaaacgtgaacacatcaagcttctcattcagaagcttaccgatgttgctgaagagtgccagaacaatcagttgaagaagctgaaggagatctgtgagaaagagaaaaaggaactgaaaaagaagatggacaagaaacgacaggagaagatcactgaggcgaagtcaaaagacaaaagccaaatggaagaggagaaaaccgagatgatccgctcatacattcaggaagtcgtgcaatatattaagaggctcgaggaagctcagtcaaagagacaggaaaaacttgttgagaaacacaaggagatacgccagcagattctggatgagaagccaaaattacaagtggagttagagcaggagtaccaggacaagtttaagagactcccactggagattctggagtttgtgcaggaagccatgaagggaaaaatatcggaagatagtaatcacggttccgctcctctgagcctgagcagcgaccccggaaaagtgaaccataaaacgccgtcctctgaggagctggggggcgatattcccggcaaagagttcgataccccgctgtag

SEQ ID NO: 199495 - DNA, 3282 bp, Artificial Sequence
  Description of Artificial Sequence: Synthetic coding sequence
acccaggaccccaagctgcgggagctgctggacgtgggcaacatcgggaggctggagcaacgcatgatcacggtggtctatggaccagacttagtaaatattagtcacctgaaccttgtagcttttcaggaggaggtcgccaaggagtggaccaacgaggttttttcccttgccacaaacttactggcccagaatatgagccgggacgccttccttgaaaaggcctacactaagcttaaactgcaggttacccctgaaggtcgcatccccctgaaaaatatttaccggctattttccgcagaccgaaagcgagtcgagaccgcccttgaggcgtgtagcctgccttccagtagaaatgattccattccgcaggaggactttactcctgaggtgtaccgggtctttctgaataacctgtgcccacgccccgagattgacaatattttttcagaatttggtgctaaaagtaaaccctacttgactgtggaccagatgatggactttattaatctaaagcaacgggatccgcggttaaatgagatcctttatccaccactgaagcaagagcaggtccaggttttgatcgagaagtatgagcctaataattctttggcacggaaaggacagattagcgttgatggcttcatgcgttatctgagcggggaggaaaacggagtcgtcagcccagaaaagctggatttaaacgaggacatgtcccagccgctctcacactatttcatcaactcttcgcacaacacataccttaccgcaggtcagctggcaggcaacagcagcgtggagatgtacaggcaagtgcttcttagtggctgcagatgtgtcgagctggactgttggaagggtagaacagcggaagaggagcccgtaatcacgcacggatttacaatgacgactgaaatcagctttaaggaagtgatcgaggcaattgcagaatgtgcttttaagacctctccattccccattcttctatccttcgagaatcatgtggattctccaaagcagcaggcgaaaatggcggagtattgtcgtctgattttcggggatgctctgctgatggagcccctggagaagtacccacttgaatctggggtccccctgccgagcccaatggatcttatgtataagattcttgtcaagaataaaaagaagtctcataaaagtagcgagggaagtgggaagaagaaactctcggagcaggcgtccaacacctactcagattcgtcctcgatgtttgaaccttcctctcctggcgctggcgaggcagatacggaatccgatgatgacgatgacgacgatgattgtaaaaagagctcaatggacgagggaaccgctggaagcgaggctatggccaccgaagaaatgagtaatttagtgaattacatacaacctgtgaagtttgagagcttcgaaattagtaagaaacgcaataagagttttgagatgtcaagcttcgttgaaactaaagggctggagcagttgactaaatctcctgtagagttcgtggaatataataagatgcaactctctcggatttatcctaaggggacaagggtggactcctcaaattatatgcctcagttgttctggaacgccggatgccagatggttgctttgaatttccagacaatggacctcgcgatgcaaatcaatatgggaatgtacgagtacaacggcaaaagtggctatcgcctgaagcccgagtttatgaggcgacccgataaacatttcgacccgtttactgaaggaatagttgacgggatcgtcgctaacacgttgagcgttaagatcatcagtggacagtttctgtctgataaaaaggtgggaacttacgtcgaagtagatatgttcggtctgcccgtggacacgcgccgcaaggcgtttaagaccaaaacctctcagggcaacgccgtgaatcctgtctgggaagaggagcctattgtgtttaaaaaagttgtactgccaaccctcgcctgtctgagaattgccgtctacgaggagggaggaaaattcatcggccatagaatcctgcccgtacaggccatccgccccgggtaccactacatctgtcttagaaacgagcggaaccaacccctgacgctcccggccgttttcgtgtacatagaagtcaaggactacgttccagatacatacgccgatgttattgaagctctgtctaatccaatccgctacgtcaacctcatggagcagcgcgccaagcaacttgctgcactgaccctggaagacgaagaagaggtgaaaaaggaggccgaccctggtgagactccatccgaagctccttctgaggcccggacgacacccgccgagaatggtgttaaccacacaaccaccctgacccctaagccaccttcacaggctttacactctcaacctgccccaggatctgttaaggcgccggctaagaccgaagacctaattcaatctgtattgactgaagtggaggcccagacaatcgaggagctcaagcagcagaagtctttcgtgaaattacagaagaagcattacaaagaaatgaaagatttggttaagagacatcataaaaagaccactgatttgattaaggaacacacaaccaagtacaacgaaatccagaatgattatctgcggaggagagctgccctcgagaaatccgctaaaaaggattctaagaagaagtccgagcctagttcaccagatcatgggagctcgacaatcgaacaagatctggctgcactggacgcagagatgacccagaagctgatagacctgaaggataaacagcagcagcagctgcttaatctacgccaggaacaatactattcagagaagtaccaaaagcgggagcacatcaagctgcttatccagaaacttacagacgtagccgaggagtgtcagaacaaccagcttaagaaacttaaagaaatctgcgagaaggaaaagaaggagttgaagaaaaagatggataagaaaaggcaagagaagatcacggaagccaaatccaaggataaaagccagatggaggaggagaagactgagatgattcgttcttatatccaggaagtcgtacagtacataaagcgtctggaggaggctcagagtaaacggcaggaaaaactcgttgaaaaacacaaagagatcaggcagcagattctggacgagaagcctaagggcgaggggagctcatcattcctgagcgaaacctgccacgaagatccctccgtaagcccaaatttcactccgcccaacccgcaggccctgaagtggtag

SEQ ID NO: 199496 - DNA, 3558 bp, Artificial Sequence
  Description of Artificial Sequence: Synthetic coding sequence
atgagcctgctgaaccccgtgctgctgccccccaaggtgaaggcctatctctcgcagggggagagattcattaagtgggacgatgaaactacggtggccagtcccgtcatcctcagagttgacccaaagggttattatctgtactggacgtaccagagtaaagaaatggaatttctcgatattacttcaatccgggatacaagatttggcaagtttgctaagatgccaaaaagccagaagctgagagacgtgttcaacatggatttccccgataactctttcctgcttaagaccctgacggtggttagcggtcccgacatggtggacctgacatttcataattttgtatcttacaaagagaatgtgggcaaggcttgggccgaggatgtgctggcacttgttaaacatcccctcaccgccaacgcctcgaggtccacttttttagacaaaatcttggtaaaactcaagatgcagcttaactctgagggcaagattcccgttaagaacttcttccagatgttccctgccgaccgtaagagagtggaggctgctttatctgcctgccacttaccaaaaggcaaaaacgatgcaatcaaccctgaggatttccccgagcctgtatacaagagtttcctcatgtcactctgccctcgccccgagatcgacgaaatctttactagttaccacgccaaggctaaaccttatatgaccaaggagcatctcactaagttcatcaatcagaagcagcgggatagcagattaaattccctcctgtttcctccagcgcgccccgaccaagtgcagggtctgattgataaatatgagcccagcggaattaacgcccagagggggcagctctcacctgagggcatggtgtggtttttgtgcggtcccgagaattccgttcttgctcaggacaaactcctactccaccacgatatgactcagccccttaaccattattttattaattcgtcacataatacttacttgacagccgggcaatttagtggcctgtcctccgcagaaatgtatagacaagtgttgctgtctgggtgccgttgcgtggaactggattgctggaagggaaaacccccagatgaggagccaattatcactcatggctttactatgaccaccgacatcttttttaaagaggcaatagaagccatcgcggaaagcgcgtttaaaacgagcccatatcccatcattctgagcttcgagaaccacgtggacagcccgcggcaacaggccaaaatggcagaatattgccgcacaattttcggcgacatgctgctgacggagcccctggagaaattccccctgaaacctggcgtgcctctgccgagtccagaagacctccgcggaaaaatacttattaagaacaaaaagaatcaattttctgggcctacatcctcctccaaagacacggggggggaggcggagggctcatcccccccttctgccccggcgggcgagggaaccgtctgggcaggggaggagggcacagagctagaggaagaagaggtggaagaagaggaagaggaagaatctggcaacctcgatgaggaagaaatcaaaaagatgcagtccgatgagggaacagccggtctcgaggtcacagcctacgaagagatgagctccctggtgaactacattcagcctaccaagttcgtgtctttcgagttttccgctcagaaaaatcggagctatgtgatcagcagttttaccgagctgaaagcatatgacttactgagcaaggcctcagtccagtttgtcgattataacaaaaggcagatgtcgaggatctatccaaaaggcacacggatggactcttctaattacatgcctcaaatgttttggaatgcgggatgccagatggtggcgctgaatttccagacaatggatctccccatgcagcaaaatatggccgtatttgagtttaacggacagtccgggtacctgctaaagcatgaatttatgagaagacctgataaacagttcaacccattctccgtggatcggatcgacgtcgtcgttgcaaccactctgagtattaccgtcattagcggccagttcttgagtgagaggtccgtgcgcacatacgtggaggtggagctgtttgggttgcctggtgaccctaagagacggtatagaactaagttgtctccttcgacaaacagtatcaatcctgtatggaaagaggaaccttttgtctttgagaaaatcctgatgcccgagttggcatctctccgggtggccgtgatggaggaggggaacaagtttctgggtcacaggattatccccatcaacgccttaaacagcggctaccatcacctgtgtttgcacagcgaatcaaatatgcctttgacaatgccagcactcttcattttccttgaaatgaaggactacatccctggcgcttgggccgacttaactgtggccctggccaatccaataaagtttttttctgcacatgacacgaaaagtgtgaagctgaaagaggcgatgggggggcttccagaaaaaccttttcccctggctagcccagtcgcctcgcaagtgaatggggctcttgcaccgacttcgaacgggagccctgccgccagagctggcgcccgtgaggaggcgatgaaggaggctgctgagcctcggacggcgtccctggaggaactgcgtgagctcaaaggagtcgtgaagctgcaaaggcgtcatgagaaagaactgagggagctcgaaagaaggggggcccgtaggtgggaggaactcttgcaacggggcgccgcccagcttgccgaactgggccctcccggggtagggggggtaggagcatgtaaattgggtccagggaagggtagcagaaaaaaaaggtccctccccagagaggagtccgccggagccgccccaggggagggccctgaaggagtcgacgggcgggtgagggagcttaaggatcggctggaactggaactgctgcggcagggcgaggagcagtacgagtgcgtcctgaaaaggaaggagcagcacgtggccgagcaaatttccaaaatgatggaactcgcccgggaaaaacaagcggcagaactgaaggctttgaaggaaacctcagagaacgatacaaaagaaatgaagaaaaaattggagaccaagcgccttgagaggatccagggcatgacaaaggttaccactgacaaaatggcgcaggagagacttaagcgggagattaataactcacacatccaagaagtcgttcaagtgataaaacaaatgaccgaaaacctggaaaggcatcaggagaagttggaggaaaagcaggctgcgtgtctagagcagatacgcgagatggagaagcagttccagaaggaggcgctggcggagtacgaggcgagaatgaagggcttggaagctgaggtgaaggaatcagtacgggcatgcctgaggacctgcttcccatcggaagcgaaggataaaccagaaagggcatgtgagtgtccacccgagctttgtgagcaggaccccctgatagctaaggccgatgcccaggagagccgactgtag

SEQ ID NO: 199497 - DNA, 3546 bp, Artificial Sequence
  Description of Artificial Sequence: Synthetic coding sequence
atgagcctgctgaaccccgtgctgctgccccccaaggtgaaggcctatctgtcccagggggagaggttcataaaatgggacgatgaaacaactgtcgcatcccctgtcattttgcgcgttgacccaaagggttactatctgtactggacatatcagagtaaggagatggagttcttagatattacctccattagggatacacggttcggaaagtttgccaagatgcctaagtcccagaagttgagggatgtatttaacatggacttccctgataactccttcttacttaagactttaacagtagtgagcggtcctgacatggtggacctgacctttcataacttcgtgagctacaaggagaacgtgggtaaggcatgggcggaggacgtgctggccttggtgaaacatcccctgacagccaatgcttccagatccacctttttggacaaaatcctcgtgaagctgaagatgcaactgaactctgaaggaaagatccctgtaaagaacttctttcaaatgttcccagcagatcggaagcgcgtggaggcggctctgtccgcctgccacctacccaagggcaagaacgacgctatcaaccccgaggatttcccggagcctgtgtataagtccttcctcatgtcactttgtccacgcccagagatcgacgaaatcttcacgagttaccatgcaaaagcaaaaccctacatgaccaaagagcatctgaccaagttcattaatcagaagcagcgcgatagcaggcttaattcactgctttttccgccagcgcgacccgatcaggtgcagggccttatcgacaaatacgagccatccggcattaacgcccagaggggacaactgagcccagaaggcatggtatggttcctttgcggccctgagaatagcgtgctcgcccaagataagttgttgttgcaccacgacatgacgcagcctctcaaccactattttattaatagttcccacaacacataccttaccgccggacaattcagcgggctcagcagcgccgagatgtataggcaggtgcttctgtccgggtgtagatgtgtggaactggactgttggaagggcaaacctcccgatgaggaacccatcattacacatggctttactatgacaacagatatattctttaaagaggccattgaggccatagccgaatctgccttcaagacctccccctaccccatcatcctgagctttgaaaatcacgtggattcccccaggcagcaggccaagatggccgagtactgccggacaatatttggggacatgctccttaccgagccactggagaagttccccctcaaacccggcgtgccccttccgagcccagaagatctccgagggaaaatcctaatcaagaataagaagaaccagttctcaggaccaacttcgagttccaaggatacagggggcgaggccgaaggcagctcccctccttccgccccagccgtgtgggcaggggaggagggcaccgagttggaagaagaagaagtagaggaagaagaagaagaggaaagtggaaatttagacgaagaggagatcaaaaagatgcagtctgatgaggggactgccggcttggaagttacagcctatgaagagatgagctcgctggtgaattacatacagccaactaagttcgtgagttttgaatttagcgcgcagaagaacaggtcatatgtgatcagttcctttacggagctgaaagcttatgacctactttccaaggccagcgtgcagttcgtcgattataataagagacagatgtccagaatatacccaaagggtactagaatggattctagtaattacatgccacagatgttctggaacgcgggctgtcagatggtggccctgaatttccaaacaatggaccttcctatgcaacagaacatggcagtgtttgagtttaacggccagagcggctatttgctcaagcatgaatttatgcgccgccccgataagcaatttaaccccttttccgtggacagaatagatgtggtggttgccaccaccctatcaatcactgtgatcagcggacagttcctcagtgaacgttccgtgagaacttacgttgaggttgagctttttggcctgccaggcgatccaaagcggagatatagaaccaaattgtccccctcgaccaactctatcaatccagtgtggaaagaagaacccttcgtctttgaaaaaatattgatgcccgaactggcaagcttacgggttgccgtgatggaggagggcaacaagttcctaggacatcgcataatcccaatcaacgctctcaattctgggtatcatcacttatgtctgcactctgagtcgaatatgcctctgaccatgcctgcgctctttatttttttggagatgaaggattatataccgggcgcgtgggccgatctgaccgttgccctggcaaacccgatcaagttcttttcagcccatgataccaaatctgtgaagttgaaagaagctatggggggccttcccgagaagccattccccctcgccagtcccgtagcatcccaggttaacggggccttggccccgacctccaatggtagcccggccgctcgggcaggagcacgagaggaggcgatgaaagaagctgccgaacctcggaccgcgtccctggaggaactgagagagctgaaaggggtcgtcaaactccagcgtcgccacgagaaagaattgagagaactggagcgtcggggcgcaagacgctgggaggagttgctccagagaggtgctgctcagctcgccgagctgggccccccgggtgtcgggggagttggcgcgtgcaagctgggccctggaaaagggagtaggaagaaaaggagccttccacgagaggagtcagcaggcgcggcaccaggagagggcccagagggcgtggatgggagagttcgggaactcaaggatcggctggagcttgagcttctgagacagggcgaagaacagtacgagtgcgtcctgaaacggaaggaacaacacgtagctgaacagatctccaagatgatggagctggcccgcgagaagcaggcagcagaattaaaggccctgaaagaaacttccgagaacgacaccaaggagatgaagaagaaactcgaaactaagagacttgagcgaatccaggggatgaccaaggtgacaacggataaaatggcacaggagaggctaaaacgcgagatcaataatagtcatatccaggaagttgtccaagttatcaagcaaatgactgaaaatctcgagcgacaccaggagaagcttgaagagaaacaggccgcttgcctcgagcagattagagagatggaaaagcaattccagaaggaggctctggccgagtacgaagcccgaatgaagggactggaggctgaggtgaaggaatccgtgagggcctgtttgaggacctgttttcccagcgaggctaaggataaaccagagcgcgcgtgcgaatgccctcccgagctgtgcgaacaggacccattgatagctaaagcagacgcgcaagagtcccgcttgtag

SEQ ID NO: 199498 - DNA, 3705 bp, Artificial Sequence
  Description of Artificial Sequence: Synthetic coding sequence
atggccggcgcccagcccggcgtgcacgccctgcagctggagcccccaacagtcgtggagaccctaagacgcggatcaaagtttattaagtgggatgaggagacttccagccgcaacttagtcacccttcgcgtcgaccccaatggcttcttcttatactggaccggccctaacatggaagtcgacacgctggacataagcagcatacgagacacccgcactggaagatacgccagactacccaaggaccccaagatcagagaggtgctggggtttggcgggcctgacgcaaggcttgaggagaagctgatgaccgtcgtctctggtccggaccctgtcaatactgttttcctaaattttatggcagtccaggacgacaccgcaaaagtatggtcggaagagttgttcaagcttgcgatgaacatccttgctcagaacgcaagccggaataccttcctgcgaaaagcgtacactaagctgaaactccaagtcaaccaggacggtcgcattcccgtgaagaatattctgaagatgtttagtgccgataaaaagcgtgtggagaccgcactcgagagctgcggcctgaagtttaacagaagtgaatctatccgaccagacgagttcagccttgagatctttgaaaggtttctgaacaagctgtgtctgaggcctgacatcgacaaaatcctattggagataggggctaagggtaagccgtaccttaccctggaacagttgatggacttcataaaccagaaacagcgagacccacgtttgaatgaggttctgtatccgcccctgcgccccagccaggccagactcctcattgaaaagtatgaacccaatcagcagttcctcgaacgtgaccaaatgagcatggaaggtttcagcagatatctggggggggaggagaatgggatcttacccctggaagctttagaccttagcacagacatgacgcagccactttccgcatatttcatcaattcgtctcacaacacctacctgactgcaggacagctagccggaacatcctcagtggagatgtacaggcaggctctgctttggggctgtagatgtgtggaactcgacgtgtggaaagggagaccgcctgaagaagaaccctttattacccatgggttcacaatgactactgaagtgccacttcgggatgtgttagaagccatcgctgagaccgccttcaagacatcgccgtaccctgtgattctctcttttgaaaatcatgtagactccgccaaacagcaggctaaaatggcagaatactgtaggagcatcttcggcgatgccttgctcatcgaacccttggacaagtacccgctggcacccggcgttcctctgcctagtccccaggatctgatgggacgcatcctagtgaagaataaaaagaggcacagaccatctgccggaggaccagattctgcaggccgtaaacggcctctcgagcagtccaatagcgccttgagcgaatcttcagccgctacggaaccatccagccctcagctgggcagcccgtcttcagactcatgccccggcctctcaaacggcgaagaggtggggctggagaaaccaagcctggaaccacaaaagtcccttggcgacgagggattgaacagagggccctacgtgttgggcccagccgacagagaagacgaggaggaagatgaagaggaggaggaacagacggaccccaagaagccaactaccgacgagggcacagctagttctgaagtcaacgctaccgaagagatgtctactttggtgaattacatagagccagtgaagttcaagtcattcgaagctgcccgaaagagaaacaagtgtttcgagatgagtagtttcgtggaaacaaaggccatggaacagctgaccaagtcaccgatggagttcgtggaatacaataagcagcagttgtctcggatctatcccaaaggcacacgggtcgactcaagtaactatatgccccagctcttttggaacgtcggatgccagctcgtagcactgaacttccagaccttagacgtggccatgcaattaaacgccggtgtcttcgagtataacggacgcagtgggtacctcctgaagcctgaattcatgcgacgccctgacaaaagtttcgacccgtttaccgaagttatcgtggacgggattgtcgccaacgcactgcgagttaaggtgatctcaggtcaattcttgtccgacaggaaagttggcatttacgtggaggttgacatgttcgggcttccagtggacacaaggcggaagtaccgaacccggacaagccagggcaattcatttaaccccgtgtgggatgaagaacctttcgactttcccaaggtagttctacccacccttgcgagtcttaggatcgccgcattcgaggagggcggaaaatttgtcgggcaccgtatactgcccgtctccgctattcgatcgggctaccactacgtgtgcctgcggaatgaagcgaaccagccgttatgcctgcctgcgttgcttatctacaccgaggcctcagactacatacccgacgaccatcaggactacgcagaggcactgatcaatccgattaagcatgtgagccttatggatcagcgcgccagacagctggcagctctgatcggggagtcagaagcgcaagccggtcaggagacttgccaggatacacaaagtcagcagctgggttcgcaaccatcatcaaaccctaccccttcccccctggatgcatctccaagaagacccccaggaccaactacgtctcccgcatctacatccctgagctcacctggtcagcgtgatgatctaattgcctccatcctgagcgaagtggcccccacgcccctcgacgagctccgggggcacaaggctttggttaaactgcgcagcaggcaggagcgtgatctcagagagctgcgcaagaagcatcagcgcaaggccgtgacgctgactcgccggcttctggacggactcgcccaggcgcaggctgagggaaggtgtcgcttgcggcccggggcactgggcggcgctgcagatgtagaggacactaaagagggcgaagacgaggccaaaagataccaggaattccagaaccggcaagtccagtctctgctcgagttaagagaggctcaagtggatgctgaggctcagcgaaggctggagcatttacgtcaagcactgcagcgccttagagaagtggttctggatgccaacactacgcagtttaaaagacttaaggagatgaatgagcgagaaaaaaaggaactgcagaaaatattggatagaaagcgacataactcaatttcagaagcgaaaatgagggacaagcataagaaagaggctgaactcactgagattaatagaagacacatcactgagtctgtgaacagtatacggcgactggaagaagcccaaaagcagagacatgacaggttggtcgccggacagcaacaggtgctgcagcagcttgctgaggaggaacctaagcttctggcccagttagcccaggagtgccaggaacagcgcgcacgtctgccccaggagatccggaggtccctgctaggcgagatgcctgagggcttaggcgacggacccctggtggcttgcgcaagcaacgggcatgcacctgggagcagcggccacctcagtggggccgacagtgagtctcaggaggaaaacacccaactgtag

SEQ ID NO: 199499 - DNA, 3705 bp, Artificial Sequence
  Description of Artificial Sequence: Synthetic coding sequence
atggccggcgcccagcccggcgtgcacgccctgcagctggagcccccaaccgtggtggagaccttaaggcgaggctctaagtttatcaaatgggatgaggaaacatcctcccgcaatctggttactctgagggtggatcctaacgggttttttctctattggacaggcccaaacatggaggtggatactcttgacatctccagcataagggataccagaactggaagatacgcacgactaccaaaggaccctaaaatccgggaggtcctggggttcggcggtcccgacgctcggctggaggagaaactgatgaccgtcgtgtctggccctgatcccgtcaacacagtcttcttaaacttcatggcggtccaggatgacaccgctaaggtctggtccgaagagcttttcaaactggctatgaacatcttagctcagaacgctagccggaacacatttctgagaaaggcctatactaagctgaagctgcaggtcaatcaagacggccgcatccccgtcaagaacatcctgaaaatgttctctgcggataagaaaagggtcgaaaccgcactcgagagttgcggactaaaatttaatagatcagagagcattcggcccgacgaattttcactcgaaatttttgagcgcttcctcaacaaactgtgtctgaggcccgacatcgataagatcttgcttgagatcggcgctaagggcaagccttatctgactctggagcagttgatggattttataaatcaaaaacagagagaccctaggcttaacgaggtgctgtacccgcctctccgtccctcacaagcgaggttgctgatcgaaaagtacgagccaaatcagcaatttttggagcgcgatcagatgtctatggagggcttctctcgttatcttggtggtgaagaaaacggcattctacctctggaagctctcgatctgagcaccgacatgacccaacccctatctgcctactttatcaactcttcgcacaatacatatcttaccgccgggcagctagccggcacctcttccgtggagatgtatcgacaggctctgctctggggttgtcgttgtgtagaactggacgtgtggaaaggaagaccccctgaggaggagcctttcatcacacacggctttaccatgaccacagaggtccccctgcgtgacgttctcgaagccattgccgaaaccgccttcaagaccagcccatacccagttatcctgtcctttgaaaatcacgtcgattctgcgaagcagcaggcaaagatggccgaatactgccgttctatttttggggacgccttactgatagagcccctggacaagtacccgcttgctcctggcgtcccgctgccctccccccaggacctcatgggacgcatcctggtgaagaacaaaaagagacaccggccgtctgccggcgggcccgacagcgcgggaaggaaacgacctctggagcagagcaacagcgccctgagtgagtcatcagcagccacggagccctcgtccccccagttgggatcaccttcgtccgattcgtgtccggggctgtccaatggggaggaagttggactggaaaaaccatctctcgaaccccaaaagagcctgggcgacgaaggcttaaacagaggcccctatgtcctggggccagccgaccgcgaagatgaggaggaggatgaggaagaagaagagcagacagatccgaagaagcctaccacagatgaggggaccgcatccagcgaggtaaatgccactgaagaaatgtctactctcgtgaattacattgagcccgtgaagttcaaatcctttgaggcagcccggaaacgcaataaatgtttcgagatgtctagctttgtagagaccaaagcgatggagcagctgactaaaagccccatggagttcgtggaatataataagcagcagctctctcggatataccctaaggggactcgggtggacagtagcaattacatgcctcaattattctggaatgttggatgccagctcgtcgctctcaactttcagaccctcgacgttgctatgcagcttaacgcaggcgtgtttgaatataacggtaggtctggctatctgctgaaacctgaattcatgcgcaggcccgataaaagcttcgatccattcacagaggtgatcgtggacggtatagtggcgaacgctctacgcgtaaaagtgatatcaggccaatttctctccgacagaaaggttggcatttacgtggaagtcgacatgtttgggctccctgttgacaccaggagaaaataccggactcggacgtctcaagggaactcattcaacccagtctgggatgaagagccctttgatttccccaaagtggttctgcctacactggcctccctgcgaatagccgccttcgaggaaggcgggaaatttgtaggacataggatccttcctgtgagcgccattcggagcggctatcattatgtatgtctgcgcaatgaggctaatcagcccctctgtttgcctgcactcttgatttacaccgaggctagcgattacatccccgacgatcaccaggattacgccgaggcgctcattaatcccataaagcacgttagcttgatggaccagcgggcccgacaactggccgccctgattggcgaatccgaggcgcaagccggccaggaaacttgccaggacacccagagccaacaattagggtctcagccaagctccaatccaacaccatcaccactggatgcctctcccaggcggccccccggcccaacaacatctcccgcttcgacctccctaagctcacctggtcaaagagatgaccttatagccagcatactgtcagaggttgcccctacacccctggatgagctgcgtggacataaagcattggttaagctgaggtctcggcaggaacgtgacttgagagaactccggaaaaagcaccagagaaaagcggttactcttacacggcggctgttggacggtctggcacaggctcaggcggagggaaggtgtcgcttacgccctggcgctctgggcggtgccgcagatgttgaagatactaaggagggggaagatgaggcaaaacgttatcaagagttccagaatcgccaggtccagtctttgttggagctcagagaggcccaggtcgatgctgaggctcaacggcgcctggaacatctccgccaggctctgcaacgcctgcgggaagtggtgctggatgctaataccacacagtttaagaggctgaaggagatgaatgagagggaaaagaaggaactccagaaaatcctggataggaagaggcacaattccattagcgaagccaaaatgcgcgacaagcacaagaaggaagccgaattaacagaaataaaccgacgccacatcactgagagtgttaatagtattcgacgattggaggaggcacagaaacaaaggcacgatagactggtagctggccagcaacaggttctccagcagctcgcagaagaggaacccaaacttcttgcccaacttgcacaggagtgtcaagagcagcgtgccaggttaccccaggaaatccggcgtagcctgctaggtgaaatgcccgaaggcctaggggacggaccgctagtcgcctgcgcttcaaatggccatgcccccggtagcagcggtcatctgtcgggggccgattctgagagccaggaagagaacactcagctctag

SEQ ID NO: 199500 - DNA, 3528 bp, Artificial Sequence
  Description of Artificial Sequence: Synthetic coding sequence
atggccaagccctacgagttcaactggcagaaggaggtgcccagcttcctgcaagaaggagccgtgttcgacagatatgaagaggaatctttcgtttttgagcccaattgtttgttcaaggtggatgagttcggcttttttctcacctggcgctcagaagggaaagagggccaggtgctcgaatgttcgctcatcaactccataaggtccggagccatcccaaaggaccccaagattctggccgctctcgaagcggttggaaaatcggaaaatgaccttgagggtcggatcgtgtgtgtgtgcagtggaaccgaccttgtgaatatcagctttacatatatggtagccgaaaatccggaggtgaccaaacagtgggtggaaggcctcagaagcataatacataacttccgcgcgaacaacgtcagcccaatgacgtgcctgaagaagcattggatgaaactggcgtttatgaccaatactaacggaaaaatccctgtcagaagcatcaccaggacatttgcctctggaaaaactgagaaggtgattttccaggctctgaaagagttgggattaccttctgggaaaaacgatgagatagagcccacagcttttagttatgagaaattttatgagttgacccagaaaatttgtccaagaacagacattgaagatttgtttaagaagattaatggcgataaaaccgattacctgaccgtggaccagctcgtctcatttctcaatgaacaccagagagatccccggctcaatgaaattctgttccctttctacgatgcgaagcgtgccatgcaaatcattgagatgtatgagcccgacgaagacctgaagaaaaagggcctcatttctagcgacggtttttgccgctatttgatgagtgacgagaacgcccctgtgtttctggaccgcctcgaactttatcaggaaatggaccacccattagctcattattttatctctagttcacataacacctatctcacagggaggcagttcgggggcaagagttccgtcgaaatgtacagacaggtgctgctcgcgggctgcaggtgcgtagagttagattgttgggacggtaagggtgaggatcaagagcccatcattacccacggcaaggcgatgtgcaccgacatccttttcaaggacgtgatccaggctattaaggagactgcattcgttacatccgagtatcccgtgatactctctttcgaaaatcattgcagcaagtatcagcaatacaagatgtcaaagtactgtgaagatttgtttggagatctcttgctgaagcaggcacttgagtcacaccccctcgagccgggacgcgccttgcccagtccaaatgatctcaagcggaaaattttgatcaaaaataagcggctgaaaccggaagtagagaagaagcagctggaggcactgagaagcatgatggaagctggtgagtctgcaagccccgcaaacatcctggaagatgataacgaggaagaaatagagtcggccgatcaggaggaggaggcgcacccggaatttaagtttggcaacgagctgtcagccgatgatctgggacataaggaggcagttgcaaatagcgtgaagaaaggtctagtcactgtagaggacgagcaggcgtggatggcttcctataaatacgtcggcgcaacaacaaacatacatccatacctgagcaccatgatcaattacgctcagcccgtcaagtttcaggggtttcatgtggccgaagagcgcaacatacattacaacatgtcgtcatttaatgagagtgtgggattgggttacctgaagacccatgcgatcgagtttgtcaattataataaacggcagatgtccaggatatacccaaaaggaggcagggtagactcaagtaattacatgcctcagatcttttggaacgcaggatgtcagatggttagcctgaactatcaaacaccggatctggcgatgcagttgaatcagggtaagtttgagtacaacggatcttgcgggtacctgcttaaacccgactttatgcggcggcccgatcgcaccttcgacccttttagcgagacgcctgtggacggcgtgatagcggcgacctgcagtgtacaggtaatatcgggacagttcctatctgataagaaaataggcacttacgtcgaagtggatatgtacggactgcctacggatacgatccggaaggagtttcgcactcgcatggtaatgaataatgggctcaaccccgtgtacaatgaagaatccttcgtgttcaggaaggtcatcctgccagacctggctgtgctgcggatcgccgtgtacgacgataacaacaaactgataggacagcgtattcttcctctggacggactgcaagccggctacagacatatcagtttgaggaacgaaggaaataagccacttagcctccccacaatattttgtaacatagtcttgaagacctatgtaccagatggcttcggggatattgtagacgctctgtccgatcccaaaaagttcctttcaattactgagaagcgcgctgaccaaatgagagctatgggaatcgagacttccgatattgccgacgtgcccagcgacaccagcaaaaacgataagaagggcaaagcaaacactgccaaagccaatgtgaccccccaatcgagctccgaactgcgtcctacaaccacagctgctctggcgtccggggtggaggccaagaaaggcatagagcttataccccaggtgagaatagaagacctgaagcagatgaaggcatacctgaagcacctgaagaaacaacagaaggagctcaattccctcaaaaagaaacacgcgaaagagcacagtaccatgcagaagctgcactgcacccaagtggataaaatcgtagcacagtacgacaaggaaaagtcaacacacgagaaaatcctggagaaagccatgaagaagaagggcggaagcaattgtctggaaatgaaaaaagagaccgagataaagattcaaacactaacatcagatcacaaatccaaggtgaaagaaatcgtcgctcagcacaccaaagagtggtcagagatgatcaatacacactccgctgaggagcaagagatcagggatctacatctatcccagcagtgcgagctgcttaagaaacttttgattaatgcccatgagcagcagacccagcagctgaagctcagccatgacagggagagtaaggaaatgagggcacatcaggccaaaattagtatggaaaattcaaaagcgatcagccaggataagagcatcaagaataaggctgaacgagaacgacgcgttcgggaacttaatagctccaacacaaaaaaattcttggaagagagaaagcgactggcaatgaaacagagcaaggaaatggatcagttgaaaaaagttcagctcgaacacctcgaattccttgagaaacagaacgagcaggcgaaagaaatgcagcagatggtcaagctggaagccgaaatggataggagacctgccacagtagtatag

SEQ ID NO: 199501 - DNA, 3585 bp, Artificial Sequence
  Description of Artificial Sequence: Synthetic coding sequence
atggccaagccctacgagttcaactggcagaaggaggtgcccagctttctccaagaaggagcagttttcgaccgatacgaggaagaatctttcgtctttgaaccaaactgcctgttcaaggttgacgaattcggcttttttctgacctggcgctctgaaggtaaagagggacaggtactggagtgctccctgatcaattctattcggagcggagctattcctaaggatccaaaaatcttggctgcattggaagctgtaggaaagagcgagaacgatcttgaaggaagaattgtgtgtgtgtgttctggcaccgatttggtgaacatatccttcacttacatggttgccgagaaccctgaagtgacgaagcagtgggtggagggtctccgatcgattatccacaactttcgggccaacaacgtgagccccatgacctgccttaagaagcactggatgaaactggcgtttatgacgaacactaatggcaaaattcccgtgagaagtatcaccaggacatttgcgagtggcaaaacggaaaaagtcatttttcaggccttaaaggaactggggctgccgtcaggcaagaatgatgaaatagagcccacggcattcagctacgaaaagttctatgagttgacgcagaagatttgtccccgaaccgacatagaggacctgttcaagaagataaatggggacaaaaccgattatctgactgtggaccaactggtgagttttcttaacgaacatcaaagagaccctcgacttaacgagatccttttcccattttacgatgcaaaaagagccatgcagatcatcgagatgtatgagcccgacgaggacctcaagaaaaaaggtctgataagttctgacggattttgtcggtaccttatgtcggacgagaacgcccctgtttttctggacaggctggaactttaccaggaaatggatcaccctctggcacactacttcatttcatccagccacaatacctatttaactggtaggcagtttgggggaaagtcatctgttgaaatgtatcgccaggtgctcttagccggatgcaggtgtgtggagctggattgctgggacggcaaaggagaagatcaggagcctattatcacccatggtaaagccatgtgcacagacattctgtttaaggatgtgattcaggctataaaggagacggcctttgttactagcgaatatcctgtgattctgtcctttgaaaatcattgtagtaagtaccaacagtacaaaatgtcgaagtactgcgaggacctgttcggagacctcttgctgaagcaggcgctcgagtcccatcccctggagccaggccgcgccctccccagcccgaatgacctcaaacggaagatcctcataaaaaacaaacgcctgaagcctgaagtcgagaaaaagcagctcgaggctctcagatctatgatggaagccggggagtctgccagcccagccaacatcttggaggacgacaacgaggaagaaattgagtcagctgaccaagaggaagaagcccatccagaattcaaattcggaaacgagctctcagctgacgatttgggacacaaggaggccgtcgctaactctgtcaagaagggcctcgttactgtggaagatgagcaggcttggatggcgtcctacaaatacgttggagcaacaacgaacatccatccctatctgtcaacaatgatcaactatgcgcagcccgtaaaatttcagggatttcacgtagcagaggaaaggaatatacactacaatatgtcttcattcaatgagtctgtgggtctcggctatctcaagacacacgccatagagttcgtgaattacaacaagcggcagatgagccggatctaccctaaaggtggccgggtggactcctccaactacatgccacagattttctggaacgccggctgccagatggtaagcctgaactaccagaccccagatttggctatgcagttaaatcaggggaagtttgagtacaatggctcctgcggatacctgcttaagcccgattttatgagacggcccgatagaacctttgaccctttcagtgaaacaccagtagacggcgtgattgcagcaacatgttccgtccaggtaatcagtggtcaatttctgtccgacaagaagataggcacctacgtagaggtggatatgtatgggctacctacggatacaatcaggaaggagttccgcacacgaatggtgatgaacaatgggctgaacccagtatacaatgaagagagctttgtctttcgcaaagtcatcctccccgatctcgccgtccttagaattgctgtgtacgatgataataataagctgatcggccagaggatactacctctcgacgggctacaggctgggtatcgacatatcagcttgcgtaatgagggaaataagccattgagcctgccaactatcttctgtaatatcgtgttaaagacatacgtgccagacggattcggagacatcgtcgatgcactttcagatcctaagaaattcctgtctatcacagaaaagagagcagaccagatgagagcgatgggaatcgaaacatctgatatcgctgacgtgccaagcgacacctcgaaaaatgacaaaaagggaaaggccaatactgcgaaggccaatgttacgcctcaaagcagctccgagctgcgcccaacaaccacagccgcactggcaagtggggtggaagctaaaaaaggaatcgaactgattccacaggtgcggattgaggatttaaagcagatgaaagcctacctgaaacatctcaaaaagcagcagaaagagctaaactccctgaaaaagaagcatgctaaagaacatagtaccatgcagaaacttcactgcactcaagtagacaaaattgtcgcccagtacgacaaagagaaaagcactcacgaaaagatcctggagaaggctatgaaaaaaaaagggggaagcaattgtctcgagatgaagaaggaaactgaaattaagatccagactttgacctctgaccataaaagtaaggttaaggagattgtggcgcagcacactaaggaatggagtgagatgatcaacacacattccgccgaagagcaagagattagggatttgcatctgagccaacagtgcgagctcctaaagaaactgttgattaacgcccacgaacagcagacccagcagttgaagctctctcacgatcgagaatctaaggagatgcgggctcatcaggccaagatttcaatggagaacagcaaagcgattagccaggataagagcattaagaacaaggcggaacgcgagcgcagagtaagggaactgaatagttctaacaccaagaagtttcttgaagagaggaaaagactggccatgaaacagtctaaagagatggatcagctgaagaaagtccagctagaacacttagagtttttggagaagcagaatgagcagctactcaaatcttgtcatgccgtttcacagacacagggggagggagatgctgcagatggtgagattggatcacgcgacggtcctcaaacttcaaacagctccatgaagctccagaatgcaaactag

SEQ ID NO: 199502 - DNA, 3564 bp, Artificial Sequence
  Description of Artificial Sequence: Synthetic coding sequence
atggccaagccctacgagttcaactggcagaaggaggtgcccagctttttgcaggagggggccgtcttcgacagatacgaagaagagtctttcgtattcgagcctaattgcctgtttaaagttgatgaatttggatttttcctcacttggagatccgagggcaaggaggggcaggtgctagagtgttctctgataaatagtattcggtccggagccattccgaaggacccaaaaattctagcagcgctggaagcagtgggcaaatccgagaacgatctggaggggaggatagtatgcgtgtgtagcgggacggacttggtgaatatttcatttacatatatggtagctgagaaccctgaggttacaaaacagtgggtcgagggccttcgatcgattatccacaattttcgggccaataacgttagccctatgacctgcctgaaaaagcactggatgaagcttgcctttatgacaaacactaacggcaaaattccagtccgcagcatcacccgaactttcgccagcggcaagactgaaaaagttatcttccaggccctaaaggagttaggactgccttctggcaaaaacgatgaaatcgaaccaaccgcttttagctacgagaagttctacgagctcacacagaagatatgcccaaggaccgatatcgaggacctgttcaaaaagattaatggcgacaagactgattacttgaccgtggaccagctcgtgagttttcttaatgagcatcaacgcgaccctaggcttaacgaaatcttgttcccattctacgacgcgaagagggcgatgcagatcatagagatgtatgagcccgacgaagacctgaagaaaaaggggttaatttcgagtgacggtttctgtaggtacctcatgagcgacgagaacgcacccgtctttctggatcggctggagctgtatcaggagatggaccaccctttggcccactactttatctccagtagtcacaatacatacctcaccggcaggcagtttggaggaaaaagttctgttgaaatgtatcgtcaggtgctcttggccgggtgtagatgtgtggagcttgattgttgggatgggaaaggggaggatcaggaacccatcataacccacgggaaagctatgtgtactgacatacttttcaaggatgtgatccaggcgattaaggaaacggccttcgtaacctcagagtatcctgtgattctgtcctttgagaatcattgtagcaagtatcagcagtacaaaatgagcaaatattgcgaggacttgttcggagacctgttacttaagcaagccttggaatcccaccccttggagcctggcagggcactgccgtctccgaacgatctaaagagaaagattctcataaagaataaaagattaaagcccgaagtggaaaagaaacagttagaggctctccgctctatgatggaggcaggagaatccgcctctcctgctaacatcctagaagatgacaatgaggaagaaattgagagcgccgaccaggaggaggaggcccaccccgagtttaaatttggcaacgagctttccgccgatgatcttggtcataaggaggccgtggctaattcagtcaagaaggctagcgacgatttggaacacgagaacaataagaagggtctggttaccgttgaggatgagcaggcttggatggcctcttacaagtatgtcggggccaccactaatatacacccctacctgagcactatgattaattacgcccagcccgtcaaattccagggctttcatgtggctgaagagaggaatattcattacaatatgagttctttcaatgagtctgtgggattgggttacttaaaaacccacgctattgaattcgtgaactataacaagcgccagatgtctaggatctacccaaaaggcggtcgcgtcgatagtagcaattacatgccccaaattttttggaacgccggttgccagatggtgtcactgaattatcagacgcccgatctggctatgcagttgaaccagggcaaattcgagtacaatgggagttgtgggtacttgttgaagccagatttcatgcggcgccccgacaggacctttgatccgtttagtgagacacccgtggacggcgtaatcgcagccacatgctcggtgcaggtgattagtgggcagtttctgtcagacaaaaagattgggacatatgtggaggtggatatgtacggtttaccaaccgatacgatacgcaaggagttccggaccagaatggtgatgaataacggattaaaccctgtgtacaacgaggaatctttcgtgtttcggaaggttatcctgcccgatcttgcagtgctgcggattgctgtgtatgacgataataacaagttaataggacagagaattcttccgttggatggcctacaggcagggtatcggcacattagcctgcgaaacgagggaaacaagcctctgagtctgcccaccattttctgtaacattgtcctcaagacatatgtacctgacggattcggagatattgtcgatgccctgagcgacccaaagaagttcctgtctattactgaaaagcgggccgaccagatgagggccatggggatcgagacaagcgacatagctgatgtgcctagcgatacaagtaagaatgacaaaaaagggaaagctaacaccgccaaagccaacgtgacccctcagtcaagctcagagctccggccgactacaacagccgcattggcaagcggcgtggaagctaagaaaggcattgagctaattccgcaggttaggatcgaggacttgaaacaaatgaaagcctatctcaagcatctcaaaaagcagcagaaagaactcaactccctgaagaagaaacatgccaaggaacactccaccatgcaaaaacttcattgtactcaggtggacaagattgtggcccagtatgataaagagaagagcacacacgaaaaaatcttagagaaagctatgaagaaaaagggcgggagcaattgcctggagatgaagaaggagactgagatcaagatacagaccttgacctccgaccacaaaagcaaggttaaagagattgtcgcccagcacaccaaggaatggagtgagatgattaacacgcattcagccgaagagcaagaaatccgggacctgcacctgtcccagcagtgcgagctgctgaagaaactgctaatcaacgctcacgagcaacagacacagcaattaaagctctcccacgacagggaatctaaggaaatgcgcgcacaccaagccaagatctctatggaaaattcgaaggccatttcccaggataagagcattaagaacaaggcagagagggaacgtcgggtgagagagttgaatagcagcaacactaaaaaatttctggaagagcgcaaacgtcttgcaatgaagcagtccaaagagatggaccagctgaagaaggttcagctggagcacttagagttcctagagaaacagaatgagcaggccaaagaaatgcagcaaatggtgaaactcgaggccgaaatggatcgccgcccggccactgtggtttag

SEQ ID NO: 199503 - DNA, 3528 bp, Artificial Sequence
  Description of Artificial Sequence: Synthetic coding sequence
atggccaagccctacgagttcaactggcagaaggaggtgcccagctttctgcaagagggagctgtctttgacaggtatgaagaggagagtttcgtcttcgaaccaaactgtctttttaaggtggatgagtttggattttttctcacatggaggtccgagggcaaggagggtcaggtgttggagtgtagccttattaattccattcgcagcggcgccatccccaaagatccaaagatcctcgcagcactggaggccgtgggcaagtcagaaaatgatcttgaaggcagaattgtgtgtgtttgctctggaaccgacctcgtaaacatctcttttacatacatggtagcggaaaaccctgaggtaaccaaacagtgggttgagggcctgagatctataatacataacttccgcgctaataacgtgagcccaatgacatgcttgaaaaagcattggatgaagcttgcctttatgacgaacacaaacgggaaaataccagtgagatccattactcgcacatttgcttccggtaaaaccgagaaggtgatctttcaggctcttaaagagttggggctcccatctggtaaaaacgatgagatcgagccaaccgccttctcctacgagaagttttacgagctcacacaaaaaatttgtccaaggacagacatcgaggaccttttcaaaaagattaatggagacaagacagattacctgacagtcgaccagttagtgagtttcctgaacgaacaccaacgggacccgcgtcttaatgaaattctattccctttttatgatgcaaagagggctatgcagatcatcgagatgtacgaaccagacgaggatctaaaaaaaaaggggctcatttccagcgacggcttctgccggtaccttatgagtgacgagaacgcgccggtgttcctggaccggctggaactgtatcaggaaatggaccaccctctcgcacattacttcataagctcctcacacaacacgtacctgacaggaagacagttcggaggaaaatcttctgttgagatgtatcgccaggtcttgctggcagggtgcaggtgtgtcgaattggactgctgggacggcaagggggaggatcaggagccaattattacacacggaaaagccatgtgcaccgacatcctgtttaaggacgttattcaagcaattaaagagactgcattcgtcactagcgagtatccagtgatcctcagtttcgagaaccactgttccaagtaccagcagtacaagatgtccaagtattgtgaggacttatttggggacctcctactgaagcaagcactggagagccatccgctggagccggggcgagccttgccgagtccgaatgacctgaagagaaaaatattaattaagaataaacggctgaaacctgaggtggagaaaaaacagttagaggccctccgaagcatgatggaagctggcgagagtgccagtcctgccaacatcctggaggacgacaatgaagaggagattgagtcagctgaccaggaggaagaagcccaccctgagtttaagtttgggaacgaactgtctgccgacgacttggggcataaggaagccgtcgccaattcagtgaaaaaagggttggtgactgtcgaggacgaacaggcctggatggcctcttacaagtatgttggtgctactaccaacatccatccctatttatctacaatgattaactacgcccagcctgttaagttccaggggttccacgtcgcggaggaacggaacattcactataacatgtcatcatttaatgaatccgtgggcctcggatatctgaaaacccatgcaatagagttcgtcaattataacaaacgtcagatgagtcgcatatacccaaaaggcggtagagtggattcctctaattatatgccacagattttctggaatgccggctgccagatggtaagtctgaactaccagactccagatctggccatgcaactgaaccagggtaagtttgagtacaacggctcctgtggttacctcctcaagccagacttcatgcgtagacccgatagaacctttgaccctttttcagagacaccggtggatggtgtcatcgcggccacatgcagtgtacaggtgatttcaggacagttcctctccgataagaagatcggcacatatgttgaggtagacatgtatgggctgccaaccgacactattcgaaaggagtttaggacccgaatggttatgaacaacgggctcaatcccgtctataacgaggagtcattcgttttcaggaaagtgatcttacccgatctcgccgtcctccgaatcgctgtttacgacgataacaacaagctcatcggacagaggatactaccactcgatggactccaggcagggtatcggcacatcagtctgcgaaatgagggcaataaacccctcagtttaccaacgattttttgcaacatagtgctgaagacttacgtccctgacgggttcggtgacattgtagatgcgctatctgaccctaagaaattcttgtctataacagagaagagagccgatcagatgagagcgatgggcattgaaactagcgacatcgccgatgttccttcagatacgagtaagaacgacaagaaaggaaaagcaaacactgccaaagctaacgtaactcctcagagttcctccgaattgagacctaccaccaccgccgcccttgcttcgggcgtcgaggctaagaagggcatagaactgatcccccaggtcaggattgaagacctcaagcagatgaaggcctacctcaagcatctgaagaaacagcagaaagagctcaattctttgaaaaagaaacatgcaaaagaacacagcactatgcaaaaactgcactgcactcaggttgacaaaattgtcgctcagtacgataaggagaagtccacacatgaaaaaatcttggaaaaggcaatgaagaagaagggtggctctaattgcctggagatgaagaaagaaactgagattaaaatccagactctgaccagtgaccacaagtctaaggtgaaggagatagtcgctcagcacaccaaggagtggtccgagatgatcaatacacatagcgcagaagagcaagagattcgggatcttcacctttctcagcagtgcgaactgctgaaaaagctgctgattaatgcacatgaacagcagacccagcagctgaagctgtctcacgatagagaatccaaggagatgagagctcatcaagcgaagatcagtatggaaaactcaaaggcaatctcacaggataaaagcatcaaaaacaaggctgaacgtgagcgaagagtgagagagctgaacagcagtaatacgaagaagtttctggaagaacgcaagagactggccatgaaacagtcaaaggaaatggatcaactgaagaaagttcaactcgaacatttggagttcctcgagaagcagaacgaacaggcaaaggaaatgcagcagatggtgaagctagaggctgaaatggaccggaggcccgctaccgtggtttag

SEQ ID NO: 199504 - DNA, 3585 bp, Artificial Sequence
  Description of Artificial Sequence: Synthetic coding sequence
atggccaagccctacgagttcaactggcagaaggaggtgcccagctttctgcaggagggcgccgtttttgaccggtacgaagaagaatcattcgtatttgagccgaattgcctgttcaaggttgacgaatttgggtttttcctaacctggaggtctgaagggaaagaaggtcaggtgctggagtgctcactgattaacagtatcagatccggagctattcccaaagaccccaagattctggccgctctcgaagcagtcggtaagtctgagaacgacttagagggcaggatcgtatgtgtgtgttcgggaaccgatcttgtcaatatttctttcacatacatggttgccgagaatccagaagttacaaaacagtgggtcgagggtctgagatcaatcatccacaacttcagagctaacaacgttagtcccatgacctgtctgaaaaaacattggatgaagctggcttttatgactaatacaaacggcaaaatcccagtacgtagcatcaccagaacctttgctagcggcaagactgaaaaagtgatcttccaggctctgaaggaactcggcctgcccagcggcaaaaacgacgaaatcgagcccaccgccttttcctatgagaagttctatgaactgactcagaagatttgcccccggaccgatattgaggatttattcaagaaaattaacggggacaagactgattacctgaccgtggatcagctggtcagctttctgaatgagcaccagagggaccctagactgaacgaaatcctgttccccttttatgacgccaaacgggccatgcaaatcatcgagatgtacgagcccgacgaggaccttaagaagaaaggtttaataagcagcgacggtttctgtcggtatctgatgtctgacgaaaatgccccagtctttttagaccgattagagctgtatcaggagatggatcatccactggcgcactacttcattagctcgagccacaacacataccttactggacggcagttcggtggcaagtcttcagtcgagatgtaccgacaagtgttgttggccgggtgccgttgcgtggagcttgactgttgggatggcaaaggggaagatcaggaaccgataatcacacacggtaaggcgatgtgcacggatatactgtttaaagacgtgattcaggctattaaagagaccgcattcgttacctccgaatacccggtgattctgtccttcgagaatcactgctcgaaataccagcaatataagatgtcaaaatactgtgaagacctctttggagatctcctgctgaagcaggctctggaatcgcatcccctcgagcctggccgtgcgctgccttcgcctaacgatctgaaaagaaagatccttatcaagaataagcgactaaagcccgaagtggaaaagaaacagttggaagccctcaggagtatgatggaagcaggcgagtccgctagccctgctaacattctggaagacgataacgaggaggagattgaaagcgccgatcaggaggaggaagcccacccggagttcaagtttgggaacgaactgtccgctgatgatctggggcacaaggaggcggtagccaacagtgtcaagaagggcctggtgactgtggaagatgagcaggcatggatggcaagctacaaatacgttggggccacaacaaatatccacccctacctgagcaccatgattaactacgcacagccggtgaaattccaggggttccacgtcgccgaagagaggaatatccactataacatgagcagcttcaatgagagcgtggggctcggctacttgaagacccatgcaatcgaatttgttaactataacaagcgacagatgtcacggatctatccaaaagggggtcgcgtcgatagtagtaattatatgcctcagatattttggaatgccggctgccagatggtgagcctgaattatcagacaccagacctggcaatgcagttaaatcaggggaagttcgagtataacggcagctgcggatatctcctcaagcctgactttatgaggagacctgaccgaacttttgacccctttagtgaaacgccagtggacggagtcatcgcagcaacttgcagtgtgcaagtgattagtgggcaatttttgagcgataaaaaaattggcacttacgtcgaagtggatatgtatggcctacctaccgacaccattcgcaaggagtttcgaactcggatggtaatgaataacggactgaatcctgtatacaatgaagaatcatttgtttttcgtaaagtgattctcccagatctggccgtactgcgcatcgccgtgtacgatgacaacaataagctaataggccaacgcattctacctttggatggacttcaggccggataccggcacatatccctaagaaatgagggtaacaaaccccttagcttgccaactatcttttgtaatatcgttctaaaaacttacgttccagatggctttggcgacattgttgacgcactttccgatccaaagaagtttttaagtattacagaaaaaagagcggatcagatgagggcaatgggcatagaaacatctgatatcgctgatgttccctctgatacatcgaaaaacgacaaaaagggaaaggccaatactgccaaggccaatgttacgccccagtcatcctccgaactaaggccaacaacaaccgccgcccttgcatctggtgtggaggcaaagaagggtattgagctcataccccaggttagaatcgaggacttgaagcagatgaaagcttaccttaagcatttgaagaaacagcagaaggaacttaacagtcttaaaaaaaaacacgcaaaagagcactctacaatgcagaagctgcactgtacacaggtggacaagattgttgcccagtatgacaaggagaaatccacccacgaaaagatcctggagaaggcaatgaaaaaaaaaggtggctcaaactgtctcgaaatgaagaaggaaactgagattaaaatacaaactctcacctcagaccacaagtccaaggttaaagagattgtggcccagcatactaaggaatggagcgaaatgattaatacgcactccgcagaagagcaggagattcgggaccttcacctgtcccagcagtgtgaactgctgaaaaaactcctgattaacgctcacgagcagcaaactcagcagctaaaactgagccacgaccgggagagcaaagaaatgagggcgcaccaggctaagatttccatggagaattcaaaggccatctcccaggacaagtccattaagaataaagccgagcgagaacgacgcgtacgagagctcaactcgtcgaacaccaaaaagttcctcgaggagcgcaagcgactggcgatgaaacaaagtaaggagatggaccagctgaaaaaagttcagctagaacacttagagtttttagaaaagcagaacgaacagctgcttaaatcatgtcacgccgtgagccagacccagggggagggcgacgcggctgatggagagatcggctcgcgagatggacctcaaacctccaactcatcaatgaaacttcagaatgccaattag

SEQ ID NO: 199505 - DNA, 342 bp, Artificial Sequence
  Description of Artificial Sequence: Synthetic coding sequence
atggccaagccctacgagttcaactggcagaaggaggtgcccagctttcttcaagaaggggcagtctttgatcgctatgaagaggaatcctttgtgtttgagcctaactgcctctttaaagtagacgaatttggtttcttcctgacatggcgctcagagggaaaggagggccaggtgttggaatgtagtctcattaatagcatcaggtcaggtgctatacccaaagatcctaaaatcctggctgccctggaggccgtcggaaaatccgagaacgatctggagggtagaattgtgtgcgtgtgctcaggcactgacctggtcaacattagctttacttattag

SEQ ID NO: 199506 - DNA, 3072 bp, Artificial Sequence
  Description of Artificial Sequence: Synthetic coding sequence
cccgtgcggagcatcacccggaccttcgccagcggcaagaccgagaaggtaatcttccaggccctgaaagagctgggccttccgtctggaaagaacgatgagatcgagccgacagccttcagttatgagaagttttacgaactcacacagaagatctgtccccgaaccgatattgaagacctattcaagaagattaacggggacaagacagactatctgacggtagatcagctcgtctcattcctgaatgaacaccaacgggatccccggctgaatgagatcctcttcccattctacgatgctaaacgtgctatgcagatcatagagatgtacgagccagatgaggatttaaagaaaaaagggttgatatcctctgacggtttctgcagatatctaatgagtgatgagaatgcaccagtgtttctcgatagactggagttgtaccaggagatggaccatccactggctcactactttatcagttctagccacaatacctatctcaccggccggcagtttggagggaagtcaagtgtcgagatgtatcgccaggtactattagccgggtgccgatgcgttgaacttgactgttgggacggaaagggcgaagaccaggaacccattatcacccacggcaaggcaatgtgcacagatatcttatttaaggacgtgatccaggcgatcaaggagactgccttcgtgacttctgaatacccagtgattctgagtttcgagaaccactgcagcaaataccagcagtacaagatgtcaaagtattgcgaggatctctttggcgacctactcttaaagcaagcattagaaagccacccactggagcccggaagagccctccccagtcctaacgacctgaaacgcaagatccttatcaagaataaacggttgaaacctgaggtagaaaagaaacaattggaagctctgaggtctatgatggaggctggagagtccgccagtccagctaatatactggaggacgacaatgaggaagagattgaatcagccgatcaggaagaggaggcccacccagagtttaagtttggaaatgaactgtctgcggatgacctgggacacaaagaggctgtggccaactctgtcaagaaggcctcagacgatctggagcatgagaacaacaaaaaagggctagtgaccgtggaggacgagcaggcgtggatggcctcttataaatacgtgggcgccacgaccaatatacacccttatctgagcacaatgattaattacgctcagcctgtgaaatttcagggcttccacgtggctgaggagagaaatattcattacaacatgtcctcttttaatgaatccgttggcctaggttatctgaagacccacgccattgaattcgtgaattacaacaaacgacagatgtctcgcatttacccaaagggggggcgagtcgactcatcaaattatatgccccaaattttctggaacgccggctgtcaaatggttagtctcaattaccaaacacccgacctagctatgcagctcaatcagggaaaattcgaatataacggctcgtgcggctatctcctcaagccagatttcatgcggcgacctgaccgcacctttgatccctttagcgaaacccctgttgatggagtgatcgctgctacatgcagcgttcaggtgatttccgggcagtttctatctgacaagaagataggtacctatgtcgaagtggacatgtatggtctgcccacagacacaataagaaaagagtttcgtacccggatggttatgaataacgggctcaatcccgtttacaatgaggaaagttttgtgttccgcaaggtaattctgccagatctcgccgtcctgcgaattgccgtatatgacgacaataataaacttatcggccagagaattctgccgctggacggcctgcaggctgggtatcggcacatctccctgaggaacgaaggcaacaagccactgtctctgcctactattttctgtaatatcgttctgaaaacctatgtccctgatggatttggggacatcgtggacgctctcagtgatcccaaaaagttcttgagtatcactgagaagagggcggaccagatgagggccatgggcatcgagaccagtgatatcgcagatgtgccttccgataccagcaaaaatgacaaaaaggggaaggctaatactgccaaggccaatgtgaccccacaatcttcttccgaactgcgtccaacaacgaccgcagccctcgcttcgggcgtggaagccaaaaaagggatcgagttgataccccaggtgcgaattgaagacctgaaacagatgaaggcatacctcaagcatttgaagaagcagcagaaagaactcaactcgttgaaaaaaaagcacgccaaagagcactccaccatgcaaaaactgcactgcacccaagtggacaagattgtcgcacagtacgataaagagaaaagcacccacgaaaagatcctggagaaagccatgaaaaagaagggcgggtcaaactgcttagaaatgaagaaagagacagagattaaaattcagaccctgaccagcgatcataagtcgaaagtcaaggagatcgtggcccagcatacgaaggagtggtctgaaatgatcaacacgcactccgcagaggaacaggaaattagggatctacatctgtcacagcagtgcgagttgctaaagaagttgctgattaatgcccacgaacagcagacccagcagttgaagctgagccatgatagggagtctaaagagatgagggcacaccaggccaagatttccatggagaacagcaaagcgattagccaggacaaatcaattaagaataaagcggaaagggaaagaagggtgcgcgaactgaactcctcaaacacaaaaaaatttcttgaggagcgcaagcggctcgctatgaaacagtctaaagagatggaccaactgaagaaggttcaactggagcacctggagtttctcgaaaaacaaaacgaacaagccaaagagatgcagcagatggtcaaattggaagccgagatggataggagaccagctacagtggtctag

SEQ ID NO: 199507 - DNA, 183 bp, Artificial Sequence
  Description of Artificial Sequence: Synthetic coding sequence
atggccaagccctacgagttcaactggcagaaggaggtgcccagcttcctccaggaaggtgccgtgttcgacaggtacgaagaagagtcattcgtgtttgaaccgaactgtctatttaaagttgatgagtttggtttttttctgacttggaggtccgagggcaaggagggtcaggtcttgtag

SEQ ID NO: 199508 - DNA, 246 bp, Artificial Sequence
  Description of Artificial Sequence: Synthetic coding sequence
atggccaagccctacgagttcaactggcagaaggaggtgcccagcttcctgcaggagggggcagtatttgaccggtatgaggaggagagtttcgtgttcgaacccaattgcttgtttaaggtcgacgagttcgggtttttcctgacgtggaggtccgaaggcaaagagggccaggttttggaatgcagcctcatcaatagtatacgctcgggagccatacccaaagaccctaagattctcgcttag

SEQ ID NO: 199509 - DNA, 333 bp, Artificial Sequence
  Description of Artificial Sequence: Synthetic coding sequence
atggccaagccctacgagttcaactggcagaaggaggtgcccagcttcctccaggaaggggctgtatttgaccggtacgaggaagagagcttcgtgttcgaaccaaactgcttattcaaagtcgacgagtttggattcttcctcacttggcgcagcgagggaaaagaaggccaggtgttggaatgttcgctgattaactctatcaggtcaggtgccattccaaaggaccctaagatcctggcagctctagaagctgtgggcaaatccgagaacgacctggagggcaggatcgtctgtgtgtgttcaggtactgaccttgttaacatctcctag

SEQ ID NO: 199510 - DNA, 2271 bp, Artificial Sequence
  Description of Artificial Sequence: Synthetic coding sequence
atggacagcggccgggacttcctgaccctgcacggcctgcaggacgacgaagatctgcaggccctgcttaaagggtcccagctcctcaaggtgaagagctccagctggagaagggaaagattttataagctccaggaggattgtaaaacaatttggcaggaatcgcgaaaagtgatgcgcacaccagaatctcagctgttttccatagaagatatacaagaagtgcgaatgggccaccgaaccgaggggttagagaagttcgctcgtgacgtgccagaagacagatgtttttccatagtctttaaggatcagagaaacaccctggatctcatcgccccttcaccagccgatgcccaacattgggtacttgggctgcacaagatcattcatcactccggctctatggaccagcgccagaagctgcagcactggatccactcttgccttcgaaaggccgacaaaaacaaggacaacaaaatgagcttcaaagagctgcagaacttcttgaaagagctcaatatccaggtggacgattcttacgcacggaagatttttagagaatgcgatcattctcagaccgacagtctcgaggatgaagaaatagaagccttctacaagatgctgacacagcgggtcgagatcgatcggaccttcgccgaggccgcaggctctggcgagactttatcagtggatcagttggtgacattcttacagcaccagcagcgagaggaagccgcgggcccagctcttgcgctgtcgctgattgaacgatacgaacccagcgagacagcaaaggctcaaagacagatgactaaggatggattcctcatgtacctgctcagcgcggatgggtcggcgttcagcctggcacacaggcgggtctaccaagatatggggcagccactgagtcattacctggtttcatcctcccacaatacatacttgctggaagatcaacttgccggaccctctagtacagaagcctatatccgggcgctctgtaaaggatgtaggtgcctggagttagactgctgggacggccctaatcaggagccgattatttaccatggctatacatttacatcaaagattctcttttgcgacgtgctgagagcaatcagagattatgccttcaaagcttcaccctacccggtgattttgtcattggagaaccactgcaccctcgagcagcagcgcgttatggccaggcatcttcacgctatcctcggtccgatgctacttaaccggcctcttgacggggtgacgaactccctgccgagcccagagcagctgaagggtaaaatcctgttgaaaggtaagaagctgggcggacttctcccaccggggggcgagggcggccccgaggctactgtcgtgagcgacgaagacgaagctgccgaaatggaggacgaagccgtgcgcagccgggtccagcacaaacctaaggaagacaaattgaggctggcccaggagctttctgatatggtgatatattgcaagtcagttcactttggcggcttttcctcaccgggcactcctggacaggccttctacgagatggcatctttcagcgagaacagagctttacggctgcttcaggaatccggaaatgggttcgtacgccataacgttggtcatctctcaagaatctaccctgcaggctggcggaccgatagcagtaattatagccccgttgagatgtggaatggcggctgccagatcgtagcactgaatttccagacccctggaccggagatggatgtttatcaaggacggtttcaggataatggcgcctgtggttatgtcctcaagcccgcatttcttcgcgatccgaatggcacctttaacccccgcgctctggcccagggcccctggtgggccaggaaacgcctgaacatcagagtgatcagtggccagcaacttcccaaggtgaacaaaaataagaattccatcgtggacccgaaggtcactgtagagatacacggcgtgagtagggacgttgccagcaggcagaccgcagttatcacgaacaacggattcaacccatggtgggataccgagtttgctttcgaggtagtcgttcccgatctagcactcattaggttcctggtcgaggattacgacgcgtctagcaaaaacgacttcattggccagagcaccattccgctaaacagcctcaaacaggggtataggcacgtgcatctcatgtccaaaaatggcgatcaacacccatcagctacacttttcgttaagatctccctccaggattag

SEQ ID NO: 199511 - DNA, 2334 bp, Artificial Sequence
  Description of Artificial Sequence: Synthetic coding sequence
atgcagtgcctgggcatccggagccggagccggagccgggagctgtacttacaagaaagatctctgaaagtcgcagcactgaacggaagaaggctagggctacaggatgatgaggatctccaggcgctgttaaagggctctcagctcctcaaagttaagtcttccagctggaggagagagcggttctataagctacaggaagattgcaagacaatatggcaggaaagccggaaggtaatgcggacacccgagagccagctgttctctatcgaggacatccaagaagttagaatgggccaccgtacggaaggccttgaaaaattcgccagagatgtgcctgaggaccgctgcttttcaattgtcttcaaagatcaacgcaatacgctggaccttattgctccatcccccgctgacgcccaacactgggttctgggacttcataaaatcatccaccactcggggagcatggaccagaggcagaagcttcaacactggatccacagctgcctgaggaaagctgacaaaaataaggataataagatgtcctttaaggagcttcagaactttcttaaggagctgaacattcaggtagatgacagttacgcgcgcaagatcttcagagagtgtgatcactcacagactgatagtctggaggacgaggaaatagaggcgttctataaaatgctcactcagcgcgtggagattgacagaacgttcgctgaggctgccggcagtggggaaaccttatctgttgaccagctggtcacgttcttgcagcatcaacagcgggaagaagcagctggccccgctcttgctttatcactcattgaaaggtacgagcccagcgaaactgccaaggctcagcgtcagatgacaaaggatggtttcctaatgtacctgctctctgccgacggaagcgctttttctctcgcccacaggcgcgtctatcaagacatgggccagcccctctctcattatctggtgtctagcagtcacaacacctatctcctcgaggaccagttggccggcccaagttccaccgaggcttatattcgggcactttgtaaaggctgtcgctgcctcgagctagactgctgggatggccccaaccaagagccaattatctatcatggctacacctttacctccaaaattctgttctgtgacgtattgagggccatcagggactatgcttttaaggcaagtccctaccctgttatcctgtccctggaaaaccactgcaccctcgagcagcagcgcgtaatggcaagacacctgcatgcgatcttgggccccatgctcctgaacagaccacttgatggagtgaccaattctctcccaagtcccgagcagctgaaaggcaagatactacttaagggaaaaaagttaggcgggctgctgcctcctggaggagagggtgggcccgaagccaccgtagtaagcgacgaggatgaggcagctgaaatggaagacgaggccgtcagatctagggttcagcacaagcccaaagaagacaagttgagactcgcccaggagttgtccgatatggtgatctattgcaagtcagtgcacttcgggggtttttcaagtccagggacccctggtcaggctttttacgaaatggccagtttttcagagaaccgagctttacgcctattacaggaatctggtaatgggtttgtgcggcacaacgtgggccatttgtcacgcatatacccggctggatggaggactgactcatctaattattctcctgtcgaaatgtggaatggcgggtgccagatcgtggctctgaatttccagacccccggcccggaaatggacgtttatcagggacgttttcaggacaacggagcctgcggctatgtgctcaagcccgccttcttgagagatcctaatggcacgttcaaccctcgggcccttgctcaggggccttggtgggccaggaaacgcctaaacattcgggttatctctggtcagcagctgccaaaggttaacaaaaacaagaacagcatagtggatccaaaagtgacggtcgagatacacggtgtatctcgggacgtcgccagccgacagacggccgttatcacaaacaatggctttaacccttggtgggataccgagttcgcttttgaagtggtggttcccgacctcgctttaatcaggttcctcgtggaggattacgatgcatcttccaaaaacgatttcatcggccagtctacgattcccttaaactctttgaagcaggggtatcggcatgtgcatctcatgtctaagaatggagaccagcatccctctgccactctcttcgttaaaattagccttcaggactag

SEQ ID NO: 199512 - DNA, 6909 bp, Artificial Sequence
  Description of Artificial Sequence: Synthetic coding sequence
atgaccagcgaggagatgaccgccagcgtgctgatccccgtgacccagaggaaagtggttagcgcccagagcgcagcagacgaaagttccgagaaggtaagcgacattaatatatccaaagctcatacagtgcgtcgttctggggaaacctcccacaccatcagtcagctgaataaactgaaggaggaaccgagcgggtcgaaccttcctaaaatcctaagcattgctagggaaaagattgtcagcgatgaaaactcaaatgagaagtgctgggaaaagataatgcccgactctgcgaagaacctcaatattaattgtaacaacatcctaaggaatcaccagcatgggctgccacagcgacagttctacgagatgtataacagtgtggccgaggaagacctttgtcttgagaccggaatccccagtccacttgaaagaaaggtgttcccaggcatccaactggagctggacaggccttctatgggaatttcccctttaggcaaccagtctgttatcattgagaccgggcgtgcacaccccgactctagacgggccgtttttcatttccattacgaggttgataggcggatgtctgataccttctgcaccttgagcgaaaatctgatcctggacgactgtggcaactgtgtccccttgcctggaggggaggagaagcagaaaaagaattacgtggcgtatacgtgtaagctcatggaattagccaagaattgcgataataaaaacgagcagctgcagtgcgatcattgcgacactttaaacgataagtatttctgtttcgagggatcatgtgaaaaggtagacatggtttactctggggacagtttttgtcgcaaagattttactgacagccaggctgcgaaaacttttctgtcccatttcgaggacttccccgacaattgcgacgatgtcgaggaagatgctttcaagagcaagaaagagagaagcacactgctcgtgagaaggttctgcaagaatgatagggaggtcaaaaagtccgtgtacactggaacccgcgccatcgtgcggactctgccttctggccatataggtcttaccgcctggagctacatcgaccagaagaggaacggaccactcctgccttgcggtcgggtgatggagcctccttcaactgtggagattaggcaggatggaagtcagaggctgagtgaggcccagtggtaccctatctacaacgcagtgcggagggaggagaccgaaaataccgtcgggtcactcctgcatttcctgaccaaacttccagcttcagagaccgcccacggccggatctcggtcggaccatgtctcaaacagtgtgtcagagacaccgtatgtgagtatcgggccacactgcaacggacttcgatatctcagtacataacgggcagcctgctcgaggccactacatctctgggagctcggagcggcctgttgtcaaccttcggaggcagcaccggacgtatgatgctcaaggagcgccagcccggcccatcggtcgctaattccaatgcactgccgagttcttctgctggcatttccaaggaactgatcgatctccagcctctgatccagtttccagaagaggttgctagcattctcatggagcaggagcagacaatatacaggagagtcttgccagtggactatctgtgctttctgactagggacctggggactcccgaatgtcagagctcactgccttgtctcaaggcctctattagcgcttcaatcttgaccactcagaatggagagcacaacgcccttgaagatctcgtaatgcgcttcaatgaagtgagttcgtgggtgacatggctgatcctgactgcaggctcaatggaggagaagagagaggtgttcagttacctggtccatgtggccaaatgctgttggaacatgggaaattacaatgcagtcatggaatttctggcgggccttagatcacgcaaagtattgaaaatgtggcagtttatggaccagtcggacatagaaactatgagaagcctcaaagatgccatggcccagcatgagagttcctgcgagtatcgaaaggtagtcacaagagccctacacatacctggttgcaaggtagtccccttctgtggggttttcctcaaagaactttgcgaggttttggatggcgcctcaggattaatgaagctgtgcccacgttacaattcccaagaggaaaccttagaattcgtggctgattactcagggcaggacaacttcctccagcgcgtgggacagaatggactcaaaaatagcgagaaagagtcgacagtcaactccatcttccaagtgatccgcagctgtaaccgaagtctggagacagatgaggaagacagtccttccgagggtaacagttcccgtaagtcctctctcaaggacaagtccaggtggcaattcatcatcggtgacctcctggattctgataatgatatctttgagcagtcgaaggaatacgactcccatgggagtgaggatagtcagaaagcattcgatcatgggaccgagctgatcccttggtatgtgcttagcatccaggctgacgtgcatcagtttctgctccagggtgcgacagtgattcactacgaccaggatacgcatctgtcagcacgctgctttttacagctccagccagataactcaacgttgacctgggttaagccgacgacggcgagccccgcatcctccaaagctaaattgggcgttctgaataataccgccgagcctggtaagttccccttacttgggaacgctggactgagctccctcaccgagggcgtgctcgatctgtttgccgtgaaggcggtctacatgggccatcctggcatcgatattcatacggtgtgtgtgcaaaacaaactggggagtatgttcctctctgagactggtgtcactctactgtatggcctgcaaacaacggataaccgcctcctgcattttgtggcacccaaacacacggctaaaatgctgttttcagggcttctcgagcttacccgggccgtgaggaagatgaggaagtttccagaccagcgccagcagtggcttcgaaaacagtacgtttcattgtatcaggaggacggccgatacgagggccccacacttgcccacgccgtcgagctatttggggggcggaggtggtcagcgaggaatccaagccccggtaccagcgccaagaacgcagagaagcctaatatgcagcggaataacacccttggcatatcaactaccaagaagaaaaaaaaaatcctcatgagaggtgaatccggagaggtgactgacgatgagatggcaaccagaaaagcaaaaatgcacaaagagtgtcgatcgcgttcaggcagcgatccccaggatatcaacgaacaagaggagtcagaggtcaacgccatcgctaacccccccaaccctctgcccagtcgccgagcccactctttaactaccgctggctctccgaatctggccgccggaactagtagtcccatcagaccggtatcctcccctgtgctgtcaagctccaacaagtccccctcttctgcttggagctcatcttcttggcacggtaggattaagggcgggatgaaaggatttcaaagttttatggtgagtgactctaacatgtcctttgttgaatttgtggagctttttaagtctttcagcgttcgatctcgcaaagatcttaaggatctgtttgacgtgtacgcagtcccatgcaacagaagcggctccgaaagtgctcccctgtataccaatctaaccattgacgaaaatacctcggacctgcagcccgatctggatcttttaacgaggaatgtcagtgatttgggtttgtttatcaagtctaaacaacagctgtcagacaatcagagacagattagcgatgctattgcggcagcttcaatcgtcacaaacggtacaggcatcgaaagcacttctttgggcatctttggcgtcggcattctgcagttaaacgactttcttgtgaactgccaaggagagcactgcacatacgacgaaatcctcagtatcatccagaaattcgaaccaagcatctccatgtgccaccagggtttaatgtctttcgagggctttgcacggttcctgatggacaaagaaaattttgctagcaagaacgatgagtcccaagaaaacatcaaggagttacaactgcctctctcttattattacatcgagtcttctcataacacttatctcactggtcatcagcttaaaggcgaatcctccgttgaactgtacagccaggtacttctgcaaggctgccggtcggtggagctcgattgctgggacggcgacgatggtatgcctatcatatatcacgggcataccttaactaccaaaatcccatttaaagaggtagtcgaggccatcgaccggtcagcatttatcaatagtgatctgcccatcattattagtatcgagaatcattgttctctgccccagcagaggaaaatggctgagatatttaagacggtgttcggcgagaaattggtcaccaagttcttgtttgaaactgatttctcagatgatcctatgctgccttccccagaccaattaagaaaaaaggtgctgctgaagaataagaaattgaaggctcaccaaacaccagtggatatcctcaaacagaaggctcaccaattagcttcaatgcaggtgcaggcctacaatggaggcaacgcgaaccctcgccccgcgaataatgaggaggaagaagacgaggaggatgaatacgactacgactatgagagccttagcgatgacaacattctcgaggaccgccccgagaacaaaagctgtaacgacaagctccagtttgagtacaatgaggagatacccaaaaggataaaaaaagccgataattccgcatgtaacaaaggaaaagtctacgatatggaattaggcgaggaattctatctggatcaaaataaaaaggagagccggcagatcgcaccagaactatccgatttggtgatttactgccaggccgtgaaatttcccgggctatccactttgaacgctagcggatcttctcgggggaaggagcgaaaatcaagaaagagtatttttgggaacaatccaggaagaatgtcaccgggggagacagcgagtttcaataaaacatccggaaaaagtagctgcgaagggatacgacagacttgggaagagagctccagccccctgaaccctacaacctctttgtctgccataataaggacccctaagtgctaccacatatcaagcctgaacgagaacgccgcaaaacgcctgtgtcgcaggtattcccagaagttgactcagcacacggcatgccaactgctcagaacttaccctgctgccacacgtattgactccagcaatccgaacccccttatgttctggctgcacggtattcaattggttgctctaaactatcagaccgatgacctgcccctccatctgaatgctgctatgttcgaggccaacggcggttgcggttacgtgctcaagccacctgtgctttgggacaagaactgccctatgtatcagaaattctccccactggagcgcgaccttgattccatggaccctgcagtctattctctaaccatagtcagtgggcagaacgtctgtccatccaatagcatgggatctccatgcattgaagtcgatgtgttgggaatgccattggacagttgtcacttccgcaccaagcctatccaccgcaatacacttaacccaatgtggaatgaacagttcctgttccatgtgcacttcgaggacttggtgttccttcgtttcgctgtagttgaaaataacagcagcgcagtgaccgctcagaggataatccctctgaaagctcttaagagggggtaccgtcacctccagctccggaaccttcacaacgaagtgctggagatctcctctctgttcatcaatagtaggcggatggaagagaattcgagcggaaacacaatgtcagctagctctatgtttaatactgaagagagaaagtgtctgcagacccaccgcgttactgttcatggcgttcccggtcccgaacctttcacagtgtttactataaatggcggtaccaaagccaagcaacttctgcagcaaatcctgaccaatgaacaggacatcaagccggtgaccactgattacttcctcatggaggaaaagtactttatctctaaggaaaaaaatgaatgtcggaagcagccattccagcgggccattggacctgaagaagaaatcatgcagattctctccagctggtttcctgaggaaggctatatggggcgtatcgttctgaaaacacaacaggagaatttagaggagaagaacatcgtgcaagatgacaaagaggtgatcctttcatccgaagaggagtcgttttttgtccaggtgcacgatgtttccccagaacagccaaggacggtgatcaaagcgccgagagtgagcaccgctcaagacgtgatccaacaaacattgtgcaaagcgaagtactcctactctattttgtctaaccccaacccctctgattacgtattgttggaggaagtggtgaaggacactacaaacaaaaaaacaactaccccaaagagttctcaacgggtgttattggatcaggagtgtgtgttccaagcgcagagtaagtggaagggagcaggcaagttcatcctcaagttaaaggaacaggtgcaggcctcgagagaagataagaagaaggggatctcatttgcttcggagttgaagaagctgaccaagagcacaaaacaacccagagggttaacttctccaagtcagttactgacctcagagagtatacagacgaaggaggagaagcccgtggggggactgtcgagcagcgacaccatggactatagacagtag

SEQ ID NO: 199513 - DNA, 5985 bp, Artificial Sequence
  Description of Artificial Sequence: Synthetic coding sequence
atggtgagcgagggcagcgccgccggccgggacttcgccggcatggaggaggttcgccagttacacgttaggttttgcaaggggattaaaatctggcaccaggcttggttcctttgcagtctgctcgggagagagccacaggaaagagaggctggatgccaactgtggctgtgcacactgagtgcagttctgaaagttgggtggctgttcccgctctccgaggtccccaattttaccctgctgaaggatggctgcggatgctggaggctcaaagaagaccagatctacaatgcagtccgcagagaggagaccgagaatacggtggggtctcttttgcatttcttaaccaagttgcccgcctcggaaactgcccacggtcgcatttctgttggtccctgtctgaaacagtgtgtgcgggatacagtgtgtgagtacagggccactcttcagagaactagtatatcacagtacatcaccgggtctttactggaagccactacatccctgggggcccgcagcggcttactaagcacgtttggaggttccacggggcgcatgatgctcaaggagcgacagcccggaccctctgtggctaacagtaatgccttgccctcctcttcagccggaatcagcaaagaactgatcgacttgcagccattgatccagtttccagaagaggtggcctctatccttatggaacaggagcaaacaatttaccggagagtgctgccggtggactacctgtgcttcttaacacgagatttaggcacaccagaatgccagtctagtttgccctgtctcaaagcttctattagcgcaagtatcttaacaactcagaacggggaacacaatgccttggaggacttagtgatgagattcaatgaagtgtccagttgggtcacctggctcatcctgacggcaggtagtatggaggagaagcgggaagtcttctcttatctcgtgcacgtggctaaatgctgctggaacatggggaattacaacgctgttatggaattcttagccggactgagatcacgaaaggtcctgaagatgtggcagtttatggaccagtctgacatcgagacaatgcggtcgctgaaggatgccatggcccaacatgaaagtagttgcgagtatagaaaggtcgtaacacgggccttgcacatcccaggttgtaaagtggtgcctttttgtggcgtgttcctgaaagaattatgtgaggtgcttgatggtgcatcgggcctgatgaaactgtgcccgaggtacaactcgcaggaggagactctcgagtttgtggctgattactctgggcaggacaactttttgcagagggtcgggcagaacggcctgaaaaacagcgagaaagaaagtaccgtgaactctatcttccaggtaattcggagctgtaaccggtctcttgaaactgatgaagaagatagtcccagcgaggggaactccagccgcaagagttccttaaaggacaagagccgatggcagttcatcattggcgacctgctcgactctgacaacgacatcttcgagcaaagtaaagagtacgatagtcacggttcagaggactcacaaaaggccttcgaccatggcacagagctgattccttggtacgtgctttcaatccaggccgacgtgcatcagttccttcttcagggcgctaccgtgattcactacgaccaagatacacacctatcagccagatgtttcctgcagcttcagcccgacaattcgacactgacttgggtgaagcccaccaccgcttccccagccagcagcaaggccaaactcggggtattaaataacacagcagaaccaggcaagtttccgctgctgggaaacgctggcctgtcctctctcacagagggcgttcttgatctgttcgctgtaaaagccgtttatatgggccaccccggtattgatatccacactgtctgcgtgcagaacaagcttggctcaatgttcctaagcgagaccggggtcaccctactttacggcctgcagactactgataatagactgctccatttcgtcgctccaaaacacaccgctaagatgctgttctccgggttactggaactgacccgcgctgttagaaagatgcgaaagtttcctgaccagcgccagcaatggctgaggaagcaatacgtgagcctgtaccaagaagacggccgatatgagggccctacccttgcacacgccgtggagctgtttggaggcagaagatggagtgctcggaacccttcccccggaacctctgcgaagaatgccgagaagcctaacatgcagcgcaataatacactgggaatctcaaccactaaaaaaaaaaagaagattcttatgagaggtgagagcggtgaggtcaccgacgacgagatggccaccaggaaagctaagatgcacaaagagtgccgctctcgttctggatcggatcctcaggacatcaacgagcaggaagaatctgaggtcaatgccatagctaatcccccgaatcctctcccatcccggagagcgcactctctgacaactgcaggttcacccaaccttgcggccggcactagctcgcctattcgacccgtttcttctccggtattatctagcagcaataaatctccatctagcgcctggagcagctcgagttggcatggcaggattaagggcggtatgaagggcttccagtcgttcatggtttctgacagcaatatgtcctttgtggagttcgtggaactgtttaagtccttctcggtacgtagtagaaaggacttaaaagatctctttgatgtgtacgccgtcccatgtaacaggtccggatcagagagcgcacctctgtacaccaacctgaccatcgatgagaatacaagcgacctgcagcctgatctggacctactgactaggaacgtgtctgatctgggattatttatcaaaagcaagcagcaacttagcgacaatcagcgccaaatctccgatgctatcgcagctgccagtattgttactaacgggacaggaatcgaatccacgtctctgggaatctttggggttgggattctccagctgaacgacttcctggtgaattgccaaggggagcattgcacttacgatgagatactctccattatccagaagttcgaaccttcaattagcatgtgccatcagggactgatgtcttttgaggggtttgcaagattcctgatggacaaggaaaattttgcttctaagaacgacgagtctcaagaaaatatcaaggaactgcagcttcctctgtcttattattacattgagtcctcccacaatacttacctgaccgggcaccaactgaaaggtgaatcttccgtcgagctatattcgcaggtcctcctgcaaggttgcagatccgtggagctggactgctgggacggtgatgatggaatgcccattatctaccacggtcacacactgactaccaagattccatttaaggaagtggtggaagcgatcgaccggagcgcctttattaactcagacctccccatcatcataagtatagagaaccattgtagtctccctcaacaaaggaaaatggccgaaattttcaaaaccgtgtttggcgagaaactcgtaacaaagtttttgttcgagaccgacttcagtgacgacccgatgctgccttccccggatcagctgcggaaaaaagtactgttgaagaacaaaaaactcaaagctcatcagacacctgttgacatcctgaagcagaaagctcatcagcttgcatccatgcaggtacaggcctacaatggcgggaacgctaaccctcggccggcgaacaacgaggaggaggaggatgaggaggatgagtatgactacgattacgaatcactcagtgatgacaacattctggaggaccgccctgagaacaagtcctgtaacgataagctgcagtttgagtacaatgaagaaatacctaagcggatcaagaaagccgataacagcgcctgcaataaaggaaaagtgtatgatatggaactgggggaagagttttatctagatcagaacaagaaggagtcccgacagatcgccccagaactgagcgaccttgtgatttattgtcaggctgtgaaattccctggattgtctaccttgaatgcatccgggagttccagaggtaaggagagaaaaagtcggaagagcatcttcggaaacaaccccggccgcatgtcccccggagagacagcatcgtttaataagacgtcaggcaagtcttcctgtgaagggattcggcagacctgggaggaaagctcctctccacttaatcctaccacctccttatcagcgatcattcggacccccaaatgctaccacatttcaagccttaatgaaaacgccgctaagcgcctgtgtcggaggtatagtcaaaagttgactcagcacaccgcatgccagctacttcgtacgtacccagccgccaccagaattgacagctcgaacccaaatccccttatgttttggctacacggcattcagcttgtcgcactaaactaccagactgacgacttacctctgcatctgaacgctgccatgttcgaagccaacggcgggtgcgggtatgttctgaaaccgcctgttctctgggacaagaattgccccatgtatcaaaagttctccccactagagagggacctggacagtatggatcccgccgtgtattcgttgacaatcgtaagtggccagaatgtgtgtccctcaaactcaatgggaagcccttgcatcgaagttgatgtgctcgggatgcccctggactcttgccacttccgaaccaagccaatccatcgaaatactctgaaccctatgtggaacgagcagttcctctttcatgtccactttgaagaccttgtgtttctccgattcgctgtggtggaaaataattcttcagcagtcactgcccagagaattatacctcttaaagcactgaagagagggtacagacatttgcagttgcgcaatcttcacaatgaagtgttggagatatccagcctcttcatcaacagtagacgtatggaagagaactctagcggcaataccatgtctgcttcctcaatgtttaacactgaggagcgcaaatgtctgcaaacacatcgtgtcactgtgcacggtgtgccggggcccgaaccatttactgtctttactatcaatggaggcaccaaggccaagcagcttctccagcaaatcttaacgaatgaacaggatattaaacccgtgacaactgattatttcctgatggaagaaaagtatttcatatctaaggaaaagaacgagtgcagaaaacaacctttccagagggccataggtcccgaggaggagataatgcaaattttgtctagctggttcccagaagagggctacatgggcaggattgtgctgaaaacacaacaggagaatcttgaagagaagaacattgttcaggacgataaggaggtcatcctgtcctctgaagaagaaagcttcttcgtgcaggtacacgacgtttccccagagcagccccgaacagtgattaaagccccgcgagtatccaccgcccaagacgtaatccaacagacactctgtaaagcaaagtacagttattccatcctgagcaatcccaatccgtccgactatgtcctgctagaagaagtcgtaaaggacactactaacaaaaagactactacgcccaagtcatcacaaagggtcctgctggaccaggagtgcgtcttccaggcgcagtcaaagtggaagggcgctgggaaattcattctcaaactcaaggagcaggtacaggcaagcagagaagataagaagaaaggtatttcctttgcctccgaactgaagaagctgaccaaatcaactaaacaacctagagggctcacgagcccaagccaactgctgactagcgagtccatccaaacaaaagaggagaaacccgttggcggattgtcatccagcgacactatggattatcgccagtag

SEQ ID NO: 199514 - DNA, 6939 bp, Artificial Sequence
  Description of Artificial Sequence: Synthetic coding sequence
atgaccagcgaggagatgaccgccagcgtgctgatccccgtgacccagcgcaaagttgtttccgctcagtccgccgctgatgaatcctccgaaaaagtgtctgacatcaatatatccaaagcccacacagtgcgcaggagtggcgaaacatcccacaccatctctcagctgaacaaacttaaagaagagccaagcggttccaatctgcccaaaattctgtcaattgccagagagaagatcgtgagtgacgagaatagcaatgaaaagtgctgggagaagatcatgcctgattccgccaagaatcttaacatcaattgcaataacattctgaggaaccatcagcatggattgccacagcgccagttctatgaaatgtacaatagcgtcgcagaagaggacttatgcctcgaaacgggtattccctctcctctggagagaaaggtcttcccgggaatccagctggagcttgatcgccctagcatggggatatcaccacttggaaatcagtccgtaatcatagagacggggcgggcgcacccggatagcaggcgtgcagtgtttcacttccactacgaagtcgacaggaggatgagcgacactttttgtaccctgagcgaaaacctcatcctggatgactgtgggaactgcgtgcctctgccagggggagaggaaaaacaaaagaaaaattatgtggcttatacgtgcaagctcatggaactcgctaagaattgtgataataaaaatgaacaactgcaatgtgaccattgcgataccctaaatgataagtacttctgttttgaaggctcgtgcgagaaagtggacatggtctatagcggcgacagcttctgtaggaaagatttcactgattcccaggcggcaaaaacttttctaagtcattttgaggatttccctgacaactgtgacgatgttgaagaggacgcgtttaagtccaagaaggagcggagcaccctgctagtacgtcggttttgcaagaacgacagagaagtaaagaaatccgtttatactgggactagagcaattgtccggacactcccaagcggccatattgggctgactgcttggtcctatatcgaccagaagcggaatggacccctgttaccatgtgggagagtgatggagcctccgagcacagtcgaaatcaggcaggacggatcacagagactctcagaagcccaatggtaccctatttataatgctgtgcggcgggaggaaactgagaacacggtgggcagtctactgcactttctcaccaagttgccagcctccgagaccgcacacggacggatcagcgtcggaccttgcctgaaacagtgtgtccgggacactgtgtgcgagtatcgggccacccttcagagaacatccatcagccagtacatcacaggatccctcctcgaggccactacctcactgggtgccagatcaggcttgctcagtacattcggggggtcaactgggcgcatgatgctgaaggaacgccagcccggtccctctgtcgccaacagcaatgccttgccaagctctagcgctggcatctccaaggaacttatcgacctgcaacccctgatccaattcccagaggaagtagccagtatcctgatggaacaggagcaaaccatataccggagggtgcttcctgtggactacctttgcttcctgacccgtgacctgggcacaccagaatgccagagcagtctgccctgtctgaaggcatccatttccgctagcatactcacaacgcagaacggtgaacacaacgccctggaagatcttgtaatgaggtttaacgaagtgagtagttgggtgacttggttgattctcacggccggatcaatggaagagaaacgggaggtattcagctacctggtccacgtggctaaatgctgttggaacatgggaaactacaacgccgtgatggaattcctggctggtctacgcagccggaaggtgcttaagatgtggcagtttatggatcagtccgacatcgagacaatgcgctcacttaaagatgctatggctcaacatgagagcagctgcgaatatcgtaaagtagtgacccgggcactccatatccctgggtgtaaagtagtccctttttgtggtgttttcttgaaagagctgtgtgaggtgctggatggagccagcggcctgatgaagttgtgcccccgatataatagccaggaggaaactcttgagttcgtcgccgactacagcggacaagacaattttcttcagcgggtcgggcaaaacggccttaagaactctgagaaggagagtacagtgaactccatcttccaggtgatcagaagttgcaaccgctcgctcgagacagacgaagaagattctcccagtgagggcaattctagccgcaaatctagcttgaaagacaaaagtaggtggcagtttatcatcggcgatttgttggactctgacaatgatatctttgagcagagtaaggagtatgacagtcacggctcagaggacagccagaaagcctttgaccatgggacagagctaattccttggtacgtcctgtccattcaggctgacgtgcaccaatttctattgcaaggagcaaccgttattcactacgatcaagacactcacctctcagctcgatgcttcttgcagctgcaaccggataattccactcttacttgggtcaagcccacaaccgccagtcccgctagctctaaggcgaagctgggcgttctgaataatactgccgaaccagggaagttcccattgttgggcaatgcaggtctttcgtcgttaacagagggggtgctggacctgttcgccgtgaaagctgtatacatggggcacccaggtatcgatatacataccgtttgtgtgcagaataagctagggtccatgtttctcagcgaaaccggggtcaccctgttatacggtcttcagactacggacaatcgtctcctgcactttgttgcgccaaaacatacagcaaagatgctgttttcaggcctcctcgaactgacaagggctgtgcggaagatgcgtaagtttcccgaccagcggcagcaatggctgcgaaaacagtacgtgagcctgtaccaagaagatggcaggtacgaaggacctaccctggcacacgccgttgaactgttcggcgggcgcaggtggagtgcccgtaatccaagccctggcacaagcgcaaagaacgccgagaaacccaatatgcaaagaaacaatactctcggtattagcacgactaaaaagaagaaaaaaatcctgatgcggggagaatctggggaggtgacagatgacgagatggctactcgtaaggccaaaatgcataaagaatgtaggagcaggtccggctccgacccgcaggatattaacgagcaggaggagagcgaggtgaacgcaattgccaatccacccaaccccctgccatcaagaagggcccactctctaactacggccggctccccgaacctcgccgccgggacatcctctcctattaggccagtaagctcaccagtgttatcttccagtaataagtccccttcatcagcatggtcaagttccagttggcacggtcggattaagggggggatgaagggctttcagtcgttcatggtgtccgactcaaatatgtcgttcgtcgagttcgttgagctgttcaagtccttttccgtgaggtctcgtaaagaccttaaggacctttttgacgtctacgccgttccttgcaacagaagtggctcggagagtgctcctctttataccaatctaaccatagacgagaacacctccgacctccaacctgacctggaccttttgactcgaaatgtgtccgatctgggcctctttataaagtcgaaacaacagttgtccgacaatcaaagacagattagtgacgcaatagcggctgctagcattgtcactaacggcacaggtatcgagtcaacttctctcggcatcttcggggtgggaattctgcaactgaatgacttcctggtcaactgtcaaggagagcattgtacctacgacgagattctttcgatcatacagaaattcgagccaagcattagtatgtgccaccagggacttatgagcttcgaaggattcgcccggttcttgatggacaaggagaacttcgccagtaaaaacgacgaaagtcaagagaatatcaaggaactgcagctgcccttaagctactactacattgagtccagccacaacacttacctgaccggccaccagctgaagggggaatcaagcgtggaactgtattctcaggttctgctgcaggggtgtcgttccgtggagctcgattgttgggatggagacgatggcatgcctataatttaccacggccacacactcacaacaaaaatcccgtttaaagaggttgtggaagcaattgacagatcagcattcatcaacagcgatctgcccattattatttccattgagaaccattgctccctgccacagcagcggaaaatggccgagattttcaagactgtatttggggagaagctagtgactaaattcttgttcgaaacagatttcagtgacgaccctatgttaccatctcctgatcagttgcgtaagaaagtacttctaaaaaataagaagttaaaggcccaccagacccccgtagacatactcaagcaaaaagcccaccagctggcatccatgcaggtacaggcctataatggtggcaacgccaacccccggccagctaacaatgaagaggaggaggacgaggaggacgagtacgattatgattacgaatccttatccgacgacaacatcctggaagataggcccgaaaataagagctgtaatgacaagctccagttcgaatacaatgaggagattcctaagcggattaaaaaggctgacaattccgcatgtaacaaaggcaaagtgtacgatatggagctgggagaagagttctatctagaccagaacaaaaaagaatcccgtcagatcgcacccgaactgagcgaccttgtgatctattgccaagccgtcaagtttccgggactgtctactctcaacgcaagtgggagctccaggggaaaggagcgcaagtctcgtaaaagtattttcgggaataatccaggccgcatgagtccgggagaaacagcaagctttaacaaaacctctggcaagtccagctgtgagggaataaggcagacatgggaggaaagttccagtccactcaacccaaccacctccttgtcagctatcatccgcacccctaagtgctaccatatcagcagccttaatgaaaatgctgccaagcggctatgtagacgatacagtcagaaactgactcagcacactgcatgtcagttgctgcggacttaccccgcggctactagaatcgacagcagcaacccaaacccgcttatgttttggctacacggaattcagctcgtcgcccttaactaccagaccgacgatttgcccctacatcttaacgctgcaatgtttgaggccaatggggggtgcggatacgtgctgaagcccccagtgctctgggacaagaattgtcctatgtaccagaagttctcacctctggagcgggacttggacagcatggaccccgccgtgtactcactaacaatcgtgtctggccagaatgtctgtccatcaaattccatgggatcgccttgcattgaagtggatgttcttgggatgcctctggattcttgtcacttccggactaagccgatccaccgcaatacgctgaaccctatgtggaacgagcagttcctgtttcatgtccacttcgaagacctggtgtttctgagatttgctgtggttgaaaataattcttctgccgtcactgcacaaagaatcattcccttgaaggccctcaagagaggttatcgacacctgcaactgagaaatcttcacaatgaggtgctggagatttcctcgttgttcattaacagtagaaggatggaggaaaattcaagcgggaacactatgtccgccagttctatgtttaacacagaggagcggaagtgtctgcaaacgcacagagttacagttcacggcgtcccaggtccggaacctttcaccgtgtttacgattaacggagggacaaaggccaagcagctgttgcagcagatactaacgaatgagcaagacatcaagccagtgaccacagattacttcctgatggaggaaaagtactttattagcaaggaaaaaaacgagtgccgaaagcagcctttccagagagctattggaccagaagaggagattatgcagatcctatcctcctggtttccagaagaaggatacatgggtagaatcgtgctcaagacgcagcaagagaatctggaagagaagaacatagtgcaagatgacaaagaggtaattctttcttctgaggaagaatcttttttcgtgcaggtacatgacgtgagccccgagcaaccacgcacagttatcaaggctcccagagtgtccacagctcaagatgtgatacagcagaccctctgtaaggccaaatactcttactcaatcctgagtaacccaaatccgagcgactatgttctactggaggaggtggttaaggatacaaccaacaagaagacgactactcctaaaagctctcagagagtcctgctcgaccaagaatgcgtctttcaggcacaaagtaagtggaaaggggctgggaaatttatactgaaactcaaagagcaggtgcaagccagcagggaggacaaaaaaaaaggaatctccttcgccagcgagctgaaaaaactgacgaagtctaccaagcagccgagaggacttaccagcccttcccaattgctgactagcgaatcaattcaaacaaaggaagaaaaaccggtcggagggctttcctcctcagacaccatggactatagacaggtgaagatattcaagcaggaagtgaaggagtag

SEQ ID NO: 199515 - DNA, 5985 bp, Artificial Sequence
  Description of Artificial Sequence: Synthetic coding sequence
atggtgagcgagggcagcgccgccggccgggacttcgccggcatggaagaagttaggcaactgcacgttcggttctgtaagggaatcaagatttggcaccaggcatggttcctctgctccctcctcgggcgtgagccccaagagcgggaggccggttgccaactgtggctgtgcacactgtccgccgtgctgaaagtgggatggttgtttcctctttccgaggtgcctaatttcaccctcctcaaggacggctgcggctgttggcgcttaaaggaagaccagatctacaacgccgtccggagggaagagaccgagaacaccgtaggcagcttgctgcactttcttacaaagctgcccgcttctgagacagcacacgggaggattagtgtaggcccctgtctcaagcagtgcgttagagataccgtgtgcgaatatagggccactctgcagaggacgtccatttcacagtacataaccggtagcctgctggaagctaccacatccctgggtgctagaagtgggctactcagcaccttcggcggatcaaccgggagaatgatgctgaaggaacgacaaccagggccatctgtcgccaactctaacgccctccctagttcgtcagctggaatctccaaggagttgatcgatcttcagccgctcattcagtttcccgaagaagtcgctagtatactgatggagcaggagcaaaccatttatcggcgggtgctgccggtggattatctgtgctttctcactcgggatctgggcacgccagagtgtcagtcgtctcttccctgtcttaaagcaagcatctctgctagcatcttaaccactcaaaatggggaacataatgcccttgaagacctggtgatgcgctttaacgaggtctcttcctgggtgacgtggttaatcctgacagccggtagtatggaagaaaagcgagaggtcttcagctatctcgtgcacgtggccaagtgctgctggaacatggggaactataacgcagtaatggaattcctggccggacttcgatccagaaaggtgttgaagatgtggcagtttatggaccagtccgacattgagactatgcggtctttgaaggatgctatggcacagcatgaaagctcatgtgagtataggaaagttgttactagagcactccacattcccggctgcaaggtggtgcccttctgtggtgtgttcctgaaagagctgtgtgaagttctagatggtgcatcaggccttatgaaactgtgcccacgctataactcacaggaggagaccttggagttcgtggcggattactcaggccaggacaacttcctgcaacgagtgggacagaacggactgaagaattctgagaaggagtccacagtgaactctatatttcaggtgataagaagctgcaatcgctctctcgagactgatgaggaggactctccctcagagggcaatagctctcgtaaatcgagcctgaaggataaatcccgatggcaattcatcataggagatctactagactctgacaacgatatttttgagcagtccaaggagtatgacagtcatggaagcgaggactctcaaaaagcctttgaccatggcaccgagctaattccctggtatgtcctgagcatccaagctgacgtgcatcaatttctgctgcagggagctaccgttatccattatgatcaggacacccatttgtccgcaaggtgcttcctacagcttcagcccgataattcaaccctgacctgggttaaacctaccacagccagcccagccagttccaaggctaaacttggagtcctgaacaacactgcagagccaggtaagtttcctctgttgggaaatgctggacttagcagcctgactgaaggtgtgctggacttgttcgcagtcaaagctgtttacatgggtcatccgggcattgacatccacaccgtgtgtgtccagaataaacttggctctatgttcttgtcagaaacaggagttactctcctatacggcctgcagacaacagacaacaggctgttgcacttcgtcgcccccaagcataccgctaaaatgctgtttagtggactgttagagctcactagagctgtgcgtaagatgcgcaagtttcccgatcagagacaacagtggcttaggaaacaatacgtcagtctgtatcaggaggatggacggtatgagggtccaacactggcccatgccgtagagctgttcggcggcagacgttggtcagctaggaacccatccccagggacttcagccaagaatgccgaaaagcccaacatgcaaagaaacaacacgctcggcatttcaaccactaagaagaaaaaaaaaattctgatgagaggggagagtggagaggtgacagacgacgaaatggccacccggaaggctaaaatgcacaaggagtgcagatcccggtcaggaagcgacccgcaagacataaatgaacaagaagaaagtgaagtcaacgccattgcgaatcctcctaatccgttaccctcacggcgcgcgcatagtctgactaccgccggcagccctaatctggctgccggtacgagttctcctatccggcctgtgagctcccctgtgctgagcagttccaacaagtcaccatcatcagcatggagcagttccagctggcacgggcggatcaagggtgggatgaaggggttccagtctttcatggtaagcgactcaaacatgtcgttcgtggaatttgtggagctgttcaaaagctttagcgtgagaagcagaaaagacttaaaagatttgtttgatgtgtacgccgttccctgcaatcgttctgggtctgaatctgcacccctctacacgaatttaactatcgacgagaacacctctgacttacagccggacctcgacttacttacccgtaatgtttctgacctcgggcttttcatcaagagtaaacagcagctgagtgataatcagcgacagatatcagatgctattgctgcagccagcattgtgacaaatgggacgggtatcgagagtacatccttgggtatcttcggcgtgggaatacttcaactgaatgattttcttgttaactgtcaaggggagcattgcacatatgacgagattctctctataatccaaaaatttgaaccgtctatttcaatgtgccatcaaggcctgatgtccttcgaaggcttcgctagatttctcatggataaagagaacttcgcctcgaaaaatgacgaatctcaggaaaacatcaaggaacttcaactgccattgtcatactattatatagagtcaagccacaacacctatctgactggccaccagctgaagggtgaatcatcggtggaactgtacagccaggtactccttcagggatgccgctcagtagagctggattgttgggacggtgatgacgggatgcctataatttaccacggtcataccctgactaccaaaataccattcaaggaagtggtagaggccatagaccgctctgcttttattaatagcgatctgcccatcattatatctattgagaaccactgctcattaccacaacagaggaaaatggccgagattttcaaaacggtttttggcgagaagttggttacaaaattcttattcgaaacagatttcagtgatgaccctatgttgccaagcccagaccaactgagaaaaaaagtcctgctgaagaataaaaagctgaaagcacatcagactcctgtcgatatcctgaagcagaaggcacaccagctggctagcatgcaggtgcaagcatataatgggggcaatgctaacccaagacccgcaaacaacgaggaggaggaggatgaagaggatgaatatgactatgactatgagtccctctctgatgacaatatcctggaggatcggcctgaaaataagagctgtaacgataagctgcagttcgagtataacgaggaaataccaaaacggatcaagaaagcggataattccgcgtgtaataagggcaaagtgtatgacatggaacttggtgaggagttttaccttgaccaaaataaaaaagaaagcagacaaattgctcccgaactcagtgacttggtcatctactgccaggccgtgaaatttcctgggctgtccacgctgaacgcttcaggctcttctcgcggcaaggaacgcaagtcaagaaaatccattttcggaaataatccaggtcgcatgagcccgggcgagaccgcctcatttaataaaacctccgggaaatcttcatgcgaaggcataagacaaacttgggaggaaagcagctcccctctgaaccctaccacatcactgtctgccattatccgcaccccaaagtgttaccacatttccagtctgaatgaaaatgcggccaagcgactgtgtagacgctactcccagaaactcacacagcacaccgcttgccaactgcttcgtacttaccctgccgccaccagaattgactcttctaaccccaatcccctcatgttttggctccatggaatccagttagtggcactcaactaccagacagacgaccttcctcttcaccttaacgccgctatgtttgaggcgaacggcggttgtgggtatgtgctgaaaccaccagtgctttgggacaaaaactgtcctatgtaccaaaaatttagtcccctagaaagggacttagacagcatggacccagctgtctacagtttgacaatcgtgtctgggcagaatgtctgtccatctaattctatgggctctccatgcatagaagtggacgtcctgggcatgcctctcgattcctgccacttccgcacaaagcccattcatcggaacaccctgaaccccatgtggaacgagcaatttctcttccatgtccacttcgaggatcttgtgttcctgagatttgccgtggtagagaataactctagcgcagtgacggcccagaggattattcctctcaaagccctgaaaagaggctatagacatcttcagctcaggaaccttcacaacgaagtgctggaaatctcatcacttttcatcaacagccggcgtatggaggagaactcctccggaaatacgatgtcagcctcctccatgttcaacactgaagagaggaagtgcctacaaacccaccgtgtaacagtgcacggggtaccggggccagagccatttaccgtgttcacaataaatggaggaacgaaagcaaagcaactgctccagcaaattctaacgaacgagcaggatatcaagcccgtgactaccgattactttctcatggaggagaagtatttcatttcaaaggaaaaaaacgaatgtagaaaacagcccttccagagagcaattgggcctgaagaggagataatgcagattctcagctcatggttccccgaggaagggtacatgggccgaattgtcctaaagacccaacaggagaatcttgaagagaagaacattgtgcaagatgataaggaggtcatcctctctagtgaagaggaaagttttttcgtacaggttcacgacgtgtctcctgagcagcctaggacagtcatcaaagcaccgagagtgagtacagctcaggatgtgattcagcagacgctttgcaaagctaagtactcatactctatcctaagtaatccaaacccttcagactacgttctcctggaagaagtcgtgaaagataccacaaacaaaaagaccacaacccccaagtcctctcagagggtcctgttggatcaagaatgcgtcttccaagcccagtccaaatggaagggagccgggaagtttattctgaagctgaaagaacaagtccaggcctcacgtgaggacaagaaaaaaggtatcagttttgctagcgaactcaagaagttgaccaagtccaccaagcagccacgtgggctgacctccccgagccagctgttaacttctgaaagtattcagacgaaagaagagaaacctgttggaggtctatcgagtagcgacacaatggactataggcagtag

SEQ ID NO: 199516 - DNA, 4968 bp, Artificial Sequence
  Description of Artificial Sequence: Synthetic coding sequence
atgagcgtgatgcagagcggcacccagatgatcaagctgaagcggggcactaaggggctggtcaggctgttttacttagatgaacaccgaacccgactcaggtggcgcccaagccgtaagtcagagaaggcaaaaattttaatcgactccatctataaggtgactgagggccgccaaagtgaaatcttccatcgacaggccgaaggcaactttgatccttcctgctgctttactatatatcacggcaaccacatggagagtttggatctgattacgtctaaccctgaggaagcccgcacctggatcaccggtcttaagtaccttatggccgggatcagtgacgaggactcacttgcaaaacgtcagcgcactcacgatcagtgggtgaagcagacattcgaagaggcagacaagaatggggacggtttgctgaatattgaggagattcaccagctgatgcacaaactaaatgttaatttgccaaggaggaaagtgcgccaaatgtttcaggaagctgacactgatgagaatcagggcacccttacattcgaagaattttgtgtgttttacaaaatgatgtcccttcggcgtgatttatacctgctgctactgtcctactctgacaaaaaagaccatctgaccgttgaggaactcgctcagtttttaaaggtcgagcaaaaaatgaataatgtcacgaccgattactgtctggacattatcaagaaattcgaggtcagcgaggagaacaaagtgaaaaacgtgctgggcattgagggcttcactaactttatgagatcaccagcatgtgatatctttaacccgctacaccacgaagtctaccaggacatggatcagccactgtgtaactactacattgccagttctcataatacttatctgaccggtgatcaactattgagccaatctaaggtggacatgtatgcccgcgtcctgcaggaaggatgtcgatgtgtcgaagtggactgctgggatggccccgatggcgaacctgtggtgcaccatggctacaccctcacctctaaaatcctctttcgcgacgtcgtagaaactatcaataaacacgcctttgtgaagaatgaatttcccgtcattttgtctatcgaaaaccactgctccattcaacagcagaggaaaatcgcacaatacctgaaagggatctttggagacaagttggacctgtcttccgtggatacgggtgaatgtaaacaactgcccagcccacaaagcttgaaaggcaagatcctggtgaagggaaagaaactgccctatcatctgggagatgatgccgaggaaggtgaagtatccgatgaggactccgctgatgagatcgaggacgagtgcaaattcaagttacattactcgaacggcactactgagcatcaagtcgagagtttcattagaaaaaaacttgagagcttgctgaaagagagtcagattcgggataaagaagatccagactcgttcacagtgagagccctgctgaaggctacacacgaaggtttgaatgcgcatttgaagcagagccctgacgtgaaggaatccgggaaaaaatctcacgggcggagccttatgacaaatttcggcaaacataagaagacgaccaagagtcgaagtaagagttattctacggatgatgaagaagatacacagcagtctactggcaaggaaggtggacagctctaccgtctcggtcggagacggaaaacaatgaagctttgtagagagctgtctgatctggtggtgtatacaaactccgttgcagcccaggatattgtagatgacggcacaaccggcaatgttctctccttctctgaaaccagagcccatcaggtggtgcaacagaagtctgaacaattcatgatatataatcagaaacagctgacaagaatctatccaagcgcatatcggatcgactcttctaacttcaatcctctgccatattggaatgctggctgccagttagttgccctcaactatcaaagcgagggaaggatgatgcagcttaaccgggctaaattcaaggccaatgggaattgtggctatgtactgaaacctcaacagatgtgtaagggaactttcaatccattttccggagatcctctccctgctaatcctaagaagcagttgattctgaaggttatttccggacagcagttgcccaaaccgcctgatagtatgtttggcgaccgcggggagatcattgatcccttcgtcgaggttgagatcattggcttacccgtggactgttgcaaagatcaaacacgtgtagtggacgataatgggtttaatcccgtgtgggaggaaacactgacatttaccgtccatatgccggagattgccctcgttagattcctggtttgggatcatgaccctataggaagagatttcgtggggcagaggaccgtcacattttcctcattggttccaggttaccgtcacgtgtatctggagggactgacagaggcgagcatcttcgtccacattacgattaatgagatttacgggaagaataggcagctgcaggggttgaagggcctcttcaataagaaccctcgtcactccagcagcgaaaacaactcacactacgtccgcaagaggagtattggcgacagaatacttcggcggacagcaagcgctcccgcaaaggggaggaagaagtcaaaaatggggttccaagagatggtggagatcaaagacagtgtctcggaggcaacccgtgatcaagacggcgtcctacggcggacgaccaggtccctccaagcaagacccgtatccatgcccgttgatagaaatctgctaggagcccttagcctaccagttagcgaaacagccaaggacatcgaaggaaaggagaacagtctcgccgaagacaaagacggtcgcaggaaaggcaaggcctccatcaaagaccctcatttcctgaactttaataagaagctgtcaagctcctcgtcagcccttcttcataaagatacctctcagggagacacaatagtgtcaacggctcacatgagtgtaaccggtgagcagctcgggatgtcgtcacccagaggcgggcggaccacttccaacgccacctcaaactgccaagagaatccctgtccctccaaatctctttctccgaagcagcatctcgcacctgaccccgtggttaatcctacacaagatctgcacggagttaagatcaaagagaagggaaaccctgaggatttcgtggagggcaagagcatcctgtcaggcagcgtgctgtcccactctaatctcgagattaagaatctagaaggaaaccgcggaaagggtcgcgctgctacatccttttctctgtctgacgtttctatgctctgctcagacattcctgatctacattcaacagctatactccaagaaagtgtcatatcccacttaattgataacgtaactctgactaacgagaatgagccgggatccagcattagcgctctaattggacaatttgacgaaactaataaccaggccttgaccgtggttagtcacctccacaatacgagcgtaatgagcgggcactgtcctctgccttcactcggcttaaagatgcccattaaacacggtttctgcaagggtaagagcaagtcttccttcctgtgtagctcaccagagttaattgcgctgagcagtagtgagaccactaaacacgccactaataccgtctacgagaccacgtgcacaccaatatcaaaaaccaagcccgatgacgacctctcatcaaaagcaaagaccgccgctctggagtccaacctgcccggatccccaaacacgtcacgcgggtggcttccaaagagtccaacgaagggagaggattgggagactctgaagagttgctcacctgcatctagcccagatctgaccctggaggacgttatcgccgaccccacactttgctttaacagcggcgagagtagcctagtcgaaattgatggcgagagtgagaacctcagcctgacaacatgcgaataccgcagggagggcacttcccaactcgcttcccctctcaagctgaaatataatcaaggtgtggtggaacacttccagcgcggcctgcgaaatgggtattgcaaggaaactttacggccctccgtgcctgagatctttaataatatccaggacgttaaaactcagtccatctcatacttagcttaccagggcgccggcttcgtacacaatcacttctccgattccgacgccaaaatgttccagacatgtgtgccacagcagtcaagcgcgcaggatatgcatgttcctgtgccaaaacaactagcccatctgcccctgcctgctcttaagcttccatctccttgtaagtcaaagtccctgggcgaccttaccagcgaggacatcgcatgcaacttcgagtctaaataccagtgtatatctaagagcttcgttaccaccggaatcagggacaaaaaaggcgtgactgtgaaaaccaagtcattagagccaatcgacgctctcacagaacagctccgcaagctggtcagctttgatcaggaggataattgccaggtcctttacagtaagcaagacgctaaccagcttcctagggcactggtgcggaaactctcatccagaagtcagtcacgtgtccggaacatcgcatcacgggcaaaggaaaaacaagaagcgaacaaacagaaagttcccaacccctccaatggtgctggcgtcgtcctacggaacaaaccaagcgcccctacacctgccgtgaatcggcatagcacgggatcgtacattgccggctacctcaagaatactaaaggagggggtctcgaggggagaggcatccctgaaggtgcctgcaccgcactacattacgggcacgtggatcagttttgctcagataattcggttctccagacagaaccatccagcgatgataaacccgagatttacttcttgctgagattgtag

SEQ ID NO: 199517 - DNA, 5082 bp, Artificial Sequence
  Description of Artificial Sequence: Synthetic coding sequence
atggccgacctggaggtgtacaagaacctgagccccgagaaggtggagaggtgtatgagtgtaatgcagtctggcacgcaaatgatcaagctgaaaaggggtaccaaagggctcgttaggctattctatctcgacgagcatcggacccggttaaggtggaggccaagccgcaagtccgagaaggcaaagatccttatcgactccatttataaggttaccgagggaaggcagtcagagatcttccacaggcaggccgaggggaacttcgatcccagctgttgcttcacaatatatcatggaaaccatatggagtcactggacctgatcacaagcaatcctgaagaggctcgcacgtggattacagggctgaagtatctcatggccgggataagtgacgaggatagcctagcaaagcggcaaagaactcacgaccaatgggtaaaacagacattcgaggaagctgacaaaaacggggacgggctgctcaacatcgaagaaatccaccaactgatgcataagttgaatgtgaaccttccgagaagaaaagtgaggcagatgttccaggaagccgataccgatgaaaatcagggcaccctaacctttgaggaattttgcgtcttttacaaaatgatgagcctgcgccgagatctctacctgctgctgctctcctactcagacaagaaggaccaccttaccgtcgaagagctggcccagtttctaaaagtcgaacagaagatgaacaatgttactacggattactgcctggacatcatcaaaaagttcgaggtgtcagaagaaaataaagtgaaaaatgtcctcgggatcgagggctttaccaacttcatgagatcgcccgcttgtgatatttttaatcccctgcatcacgaggtgtatcaggacatggatcagccactgtgcaactactatatcgcgtcgtcccataatacctacctaaccggcgatcaactgctgtcccaatcaaaggtggacatgtatgctagggtgctccaggaagggtgccgctgtgttgaggtagattgttgggatggccctgacggcgaaccagtggtgcaccacggatacacactgacttccaaaatactgttccgcgacgtagtggagaccataaacaaacatgccttcgtaaaaaatgagttccctgtcatcttgtccattgagaatcactgcagcatacagcagcaaaggaaaattgcgcagtatttgaaggggatctttggcgacaagctcgacctgtctagtgtggataccggggagtgtaaacagctcccctctcctcaaagtcttaagggcaagatcttagttaagggaaagaaactgccataccatctgggggacgatgcagaggaaggagaggtcagcgacgaggactcagccgatgaaatcgaggatgaatgcaagttcaagctccattacagcaacggcacaacagaacatcaggtggaatctttcatcagaaagaagcttgaatctctcttaaaagagtcccagattcgggataaggaagacccagactcattcacagttcgagcgctcctcaaagctacacacgaagggttgaatgcccatcttaaacagtcccccgatgttaaggagagtgggaagaaatcccacggtcggagcctgatgactaactttggcaaacacaaaaagaccacaaagtctaggtcgaaatcatactccaccgatgatgaggaggacacgcagcagagtactggcaaggagggtggtcagctttacagattggggcgccgcaggaaaaccatgaagctttgcagagaactgtcagacctggtggtgtatacaaactccgtggccgctcaagacatcgtcgatgacggaacaactggaaacgtgctgtccttctccgaaacccgagcacaccaggtggtccagcaaaagtccgagcaatttatgatatataatcagaagcagctcacgaggatttatccttccgcatatagaatagattctagtaattttaatccccttccatactggaatgcagggtgtcagttagtcgccttgaattaccaatcagaaggtcgtatgatgcagctgaacagagcaaaatttaaggcaaatggcaactgcggctatgtactgaaacctcagcagatgtgcaagggcaccttcaatcctttctccggtgacccacttccagcaaatccaaagaaacagcttattctcaaggtgataagcggccagcaactgccaaaacccccggattctatgttcggcgaccgcggggaaattattgacccctttgtcgaggtggaaatcattggcctgcctgttgactgctgcaaggatcaaacccgcgtcgtcgacgacaatggcttcaatccagtgtgggaagagactctgacctttacagtccatatgccagagattgcccttgtgcgatttcttgtgtgggaccatgacccaattgggagggatttcgtgggacaacgcacggtgacctttagcagtctggtgcccgggtatagacacgtgtacctggaagggttgacggaagcatccatctttgtgcatattaccatcaatgagatttacggcaagtggagccccctgatcctgaatcccagctataccatcctgcattttctcggcgcgaccaaaaatcgccaattgcagggcctcaaaggtctgtttaacaaaaatccccgccacagcagttcagagaacaactctcactatgtccgtaaaaggagtatcggcgatcgcatcctgcgccggactgcctccgcaccagccaagggaaggaaaaagtctaaaatgggcttccaggaaatggtcgagattaaagatagtgtgagcgaggcaacacgggaccaagacggggtgctgagacggaccactagatcgctgcaggcccgtcctgtcagtatgcctgtggacaggaacctgctgggggcacttagcctccccgtttcagagaccgctaaagatatcgagggtaaggagaattccctcgccgaagacaaggacggcagacgcaagggaaaggcaagcattaaggacccgcactttctcaacttcaacaagaagctcagcagcagctcaagcgccctgcttcacaaggacacctctcagggagatacaatagtgtccacagcccatatgtctgtgacaggggagcaactgggcatgagctccccgaggggaggaaggaccaccagtaatgccacctcaaactgtcaggagaacccatgtccttccaaatccctcagcccaaagcagcacctggctcctgacccggtagtgaaccctacccaggacctccatggagtcaagatcaaggagaaagggaacccggaggatttcgtggagggcaaatcaatactgagcggatctgtgttgtcccacagtaacttggagattaagaatctcgagggcaaccgaggtaaggggcgcgccgccacctctttttccctttccgacgtctctatgctatgtagcgatatccccgacttgcactccactgctatcctccaggagtccgtgatcagtcatctgattgataacgttactttgaccaatgagaatgaacccggcagcagtatcagcgcattaatcggacagtttgatgagaccaataatcaggccctgacggtggtgtcgcacctacataacaccagcgtgatgagcggacactgtccgttgcctagcctcggcctcaaaatgcccattaagcatgggttctgtaaaggaaaatcgaagtcttctttcctgtgttcgtctcccgaattgatcgccctatcctcctccgagacaacaaaacacgccacaaataccgtgtacgaaactacatgtaccccaatttccaagacaaagcccgacgatgacctgtcttctaaggccaagaccgccgccctcgagtccaatctccccgggtcccccaacacatcccgcgggtggctgccgaagagtccaactaagggagaggactgggagaccctgaaaagttgttctcccgcttcaagccccgatctaactcttgaagatgttatcgctgatcctacgctttgcttcaacagcggagagtcatctctcgtggagatcgacggcgagtctgagaatctgtctctcaccacctgtgaatatcgccgagaagggacaagtcaactggcttccccgctcaaacttaagtataaccaaggagtcgtcgaacattttcagagaggcctgagaaacggatactgtaaagagacactcagaccatccgtcccagagattttcaataatattcaagacgtgaagacacagtctatctcatatctcgcctaccagggcgccgggtttgtccacaaccacttttcagacagcgacgccaagatgttccagacttgtgtcccacagcagagctctgctcaagatatgcatgtgcctgtccccaaacagctggctcacctgcccctgccggccttaaagctcccatcaccctgtaagtctaagtccctcggtgaccttacgtcagaggacattgcatgcaattttgagtccaaataccagtgcatttccaagtctttcgtgaccaccggcattagggacaaaaaaggggtcactgtcaaaacgaaatctctcgaaccaattgatgccctaactgagcagctccggaagctcgtgtcttttgaccaggaagacaattgtcaggtgctttacagtaaacaggatgcaaaccaactgcctcgcgcattggtccggaagttgagctctcgctcccaatcacgtgtgcgaaacatcgcctctcgagctaaagaaaagcaagaggcaaacaaacagaaagtgcctaacccctcaaacggagcaggcgtcgtcctgaggaacaaaccctccgcccctaccccagccgtcaatcgacactctactggaagttacatagcaggttacctcaaaaacaccaagggaggaggcctcgagggcagaggcataccagaaggtgcgtgcacagctttgcactacggacacgtggaccagttttgttccgacaactctgtactccagacggagcccagcagtgatgataagccggagatttatttcctcctgaggctgtag

SEQ ID NO: 199518 - DNA, 4968 bp, Artificial Sequence
  Description of Artificial Sequence: Synthetic coding sequence
atgagcgtgatgcagagcggcacccagatgatcaagctgaagcggggaaccaaaggtctggtccggctcttctacctcgacgagcatagaacacggctgagatggcgaccgagtcgtaagtctgaaaaggctaaaatcctgattgactcaatctacaaggtcactgagggcaggcagtctgagatcttccataggcaagccgagggaaactttgaccccagttgctgcttcactatttatcacgggaatcatatggagagccttgatctgattactagtaacccggaagaggcaagaacctggatcactggcctgaaatatctaatggccggcattagcgacgaagactcacttgcaaaacggcagaggacccacgaccagtgggtaaaacaaacattcgaagaggccgataagaacggcgacggactgctcaatatagaggaaattcatcagctgatgcataagctcaacgtgaacctgccaagacggaaggtcagacagatgttccaggaagcagacaccgatgaaaaccagggaacactgacattcgaggaattctgcgtgttctacaaaatgatgagcctgagacgcgacttgtacctgctactcctgtcttattcagacaaaaaagatcacttaaccgtggaagaactggcccagtttctgaaggtggaacagaaaatgaacaatgtgacaactgattactgtttggacattatcaagaagttcgaagtgtcagaagaaaataaagtgaagaatgtcctgggtatcgagggctttactaactttatgagatcacccgcctgtgatatattcaacccgctacatcacgaggtgtatcaggatatggaccagcctctctgcaactactacatcgctagcagccataacacttatctgacaggggaccagcttctgagtcagagcaaggtcgatatgtatgctagggtattgcaagaaggttgccggtgtgtggaagtcgactgctgggacggacctgatggcgaacccgtggtgcaccacggttatactctcacttccaagattctgttccgcgatgtagtagagaccatcaataagcacgctttcgtgaaaaatgagttccccgtgatcctgagcatcgagaaccattgttctatccagcagcagcggaagatagctcagtatttgaagggcatcttcggggataagctcgatctgagttctgtggacaccggggagtgcaaacagcttccatcgcctcagagcctcaagggcaaaatccttgttaaggggaagaaattaccatatcatctgggcgacgacgctgaggaaggagaagtgagtgacgaagattccgctgatgaaatcgaggacgagtgcaagtttaagttgcactacagcaatggcacaacagagcaccaagttgagtcgttcattcgaaagaagctagagtcactgctgaaagagtcacagattagggataaagaggacccagattctttcaccgtgagagccctgttgaaagctactcacgagggcttaaacgcacacctgaaacagtctcccgatgtgaaggaatccgggaaaaaatcccacggtcgcagtctgatgaccaatttcggtaagcacaagaagactactaagtcccgcagcaagagctatagcactgacgacgaagaagacacgcagcagtctacaggaaaggaaggaggccaactgtataggctgggccgccgacgaaagaccatgaaattatgtcgtgaactcagcgatctagtggtctacacaaactctgtcgcagcacaggacattgtggacgatgggactacgggaaacgtgctatccttctcggaaactcgcgctcatcaggtcgtgcagcagaagagcgagcagtttatgatatataatcagaaacagttgacacgcatctaccctagcgcatatagaattgactcatccaatttcaaccctctcccctattggaacgccgggtgtcagctggtcgcactaaattaccagtccgaggggcggatgatgcagctgaatcgcgctaagtttaaggccaacgggaactgcggatacgtgctcaagccacagcagatgtgcaaaggcaccttcaatccgttcagcggagatcctctcccggctaacccgaagaaacagctgattttgaaggttatttccggacagcaactaccgaagccacctgatagtatgttcggtgatagaggagagattatagatccatttgtagaggtggaaatcatcggactccctgtcgactgctgtaaggatcagacgcgggtggtggacgataatggttttaatcccgtttgggaggagactctcactttcactgtgcatatgcccgagattgcactggtccgttttctggtgtgggaccatgatccaatcgggagggactttgttggacagcgcacagtcactttcagttcactcgttcccgggtatagacatgtctatctggagggtctgactgaagcctccatattcgtccacattacaatcaacgaaatttacggaaaaaaccgccagttgcagggactgaaaggcctgtttaataaaaatccaaggcattcatcctcagagaataattctcattacgttcgcaagcgatcaataggcgatagaattctccgtaggacagcctctgctccggctaagggtcggaaaaaaagcaaaatgggattccaagagatggtggagataaaagatagtgtatccgaagccacccgcgaccaagatggggtgctgcggcgcaccacccgaagccttcaggctcgtccggtgagcatgcccgttgatcggaacttactgggggcactaagcctgcctgtatccgaaacagcaaaagatattgagggaaaggagaactccctggccgaggacaaagacggccggaggaagggaaaagcgagcatcaaagacccccattttctcaatttcaacaagaaactgagctcatcatcatccgccctgctccataaagataccagtcagggggacactatcgtgtccacggcccatatgtccgtcaccggagagcaactggggatgagctctcccaggggtggaaggactaccagcaatgccacaagtaactgccaagaaaatccatgcccgtccaagagcttgagcccaaaacagcatctagcccccgacccagtcgttaatcctacacaggaccttcacggagtcaagatcaaagagaagggcaatccagaggattttgtggagggaaagtccatcctgtctgggtccgtactgtcccactctaaccttgagattaagaacctggaggggaatcgcggcaaaggaagggcggcaacgagttttagtttgtctgatgtttctatgctgtgctccgacatcccggacctccactccaccgctattctccaagaaagtgtaatcagccatttgattgataacgtgacactgactaacgaaaacgaaccaggtagctcaatcagtgctctaattgggcagttcgatgagactaataaccaggctttaaccgtagtgagccacctacataatacatccgtgatgtctggacactgccccctcccatctctaggtttaaaaatgcccataaagcacggtttctgcaaagggaaatcaaagtcttcgttcctatgttcttcccctgagctgattgctctgagttccagtgagactaccaagcacgccacaaatactgtctatgagacgacgtgtacacctatcagtaagacaaagccagacgacgacttaagttcgaaggccaagaccgctgctctggagtctaacctacccgggagtcccaacacctctcgcgggtggttgcccaaatccccgacaaaaggcgaggactgggagacgctgaagtcctgctcgccagcttcatctcccgacctgacactggaggatgtgatcgcggaccccactctttgtttcaattcaggcgaatcgtcactggtggaaattgacggggagtccgagaatctgtcgctgacaacatgtgagtataggcgagaaggaacgtcccagttggcaagtccgttgaaattaaagtacaaccagggggtggttgagcacttccagcggggactccgcaacggttattgcaaagaaacacttcgaccgtcggtgcccgagatatttaataacatccaagacgttaaaacacagagtatatcctatttggcataccagggcgccggttttgttcataaccactttagcgactccgatgctaagatgttccagacttgcgtgccacagcagagttctgcgcaggacatgcacgtgcctgtgccaaagcagctggcacatctgcccttacccgccttaaaactacccagcccgtgcaagtctaaatctctaggagatctgacatcagaggacattgcctgcaattttgagtccaagtatcagtgtatcagcaagagcttcgtcaccactgggatccgcgacaagaaaggggttactgtaaagacgaaatccctcgagccgatcgatgcgctgaccgagcagctgcggaaactagtgtcgttcgatcaggaggacaattgccaggtcctctactccaaacaggacgccaatcaacttccgcgtgctctcgtccggaagttgtcatcgaggtcacagtcacgggtgcggaatatcgccagccgggccaaggagaaacaggaagccaacaagcagaaagtacccaatccctctaacggcgcaggcgtggtactacggaataaaccaagcgcccctactccagctgtgaatagacactccacgggaagctacatagctggctacctgaaaaataccaaggggggcggtctggaagggcgaggcatacccgaaggtgcgtgtactgcattgcactacggtcatgtggaccagttttgcagcgataactccgtgttgcagaccgagccttcttctgacgacaaacccgaaatctattttttgctcaggttgtag

SEQ ID NO: 199519 - DNA, 3009 bp, Artificial Sequence
  Description of Artificial Sequence: Synthetic coding sequence
atggccgacctggaggtgtacaagaacctgagccccgagaaggtggagcggtgcatgagtgttatgcaatcaggcacccagatgattaagcttaagagggggacaaaaggactagttcgacttttttacctggacgagcatcgcacccggttgcggtggagaccatcccgcaaaagcgaaaaggcaaaaatcctgattgattccatttataaagtaactgagggcaggcagtccgagatcttccaccggcaagctgagggaaactttgatccaagttgctgcttcactatataccacgggaatcacatggagagtctagatcttattacttccaatccggaggaggcccggacgtggatcaccgggctcaagtacctgatggctggcatttcagacgaagattccctcgccaagcggcagaggacgcacgatcagtgggttaaacagacgtttgaggaagccgataagaatggcgacgggctactgaacatcgaggaaatccatcagctgatgcacaaactgaacgtcaacctccctaggcgcaaagtgcgacagatgtttcaggaggcggacaccgatgaaaatcaaggtacccttacctttgaggagttctgtgtgttctacaaaatgatgtccctccgaagagacttgtatttgctacttctgagctactccgataaaaaggatcacctgactgtggaggaactggcccagtttttgaaagtcgagcaaaaaatgaataacgtgaccacagactattgtctggacattattaagaaattcgaggtctcagaagaaaacaaggtaaagaacgttctgggcatcgaaggttttaccaacttcatgagatctcccgcttgtgatatttttaatccactgcaccacgaggtgtatcaggatatggaccagccactgtgtaattattacatcgccagttctcacaatacgtatcttaccggggatcagttgctgtctcagtcgaaggtggatatgtacgcccgcgtgctccaggaagggtgcaggtgtgtggaagtggactgttgggatgggcccgatggcgagccagtggtccatcacggctataccctgactagtaagatcctgtttagggatgttgtggagacaatcaacaagcacgcctttgtgaaaaatgaattccccgtcattctgtctatagagaaccattgttccatccagcagcagagaaagatcgcccaatatcttaaagggatattcggcgacaaactggatctctcctctgtcgacacaggggagtgcaagcagctgccaagccctcagtcactcaaaggcaagatactcgtgaaagggaaaaaattgccctatcatctgggggatgacgccgaagagggcgaggtgtccgatgaggactcagccgacgaaatcgaagatgaatgtaaattcaagctgcattattctaacggtacaacagaacaccaggtggagagcttcattcgaaagaagcttgaaagtttactaaaggaatcccagatcagggacaaggaggacccagatagttttactgtgcgagcgctccttaaagcgacacatgagggccttaacgctcaccttaaacagagcccagacgtgaaagaatcgggaaagaagagtcacggccgatcactgatgactaattttggaaaacataagaaaactacgaaatctcgatctaagagctactctactgatgatgaggaggacacgcaacagagcaccggcaaggagggaggccaactttatcggttaggtcgacggcggaaaaccatgaagttatgcagggagttaagtgacctagtggtgtacacaaacagtgtagccgcccaggacattgtcgatgatggcacaacaggaaacgtgttgagtttcagtgaaaccagagcccatcaagtggttcaacaaaagtccgagcagtttatgatttataaccagaaacagctcacaaggatctacccttcagcctatagaattgactctagcaatttcaatcctctgccctattggaacgcaggatgtcaactagtggccctcaactaccagtcagaggggaggatgatgcagcttaatcgggccaagttcaaggcaaacggcaattgcggctacgtgctgaagccacagcaaatgtgtaaggggacattcaatccctttagtggcgatcctctcccagccaatcctaagaagcagctgatcttaaaagtgatctccggccagcaattgccaaagccccctgactctatgttcggcgacagaggagagatcattgatccctttgtggaggtcgaaataatcggtctacctgtggattgctgcaaggatcagaccagagtcgttgatgataatggcttcaaccccgtgtgggaggaaaccctgacctttaccgtccacatgccagaaattgccctggtgagattcctggtgtgggatcacgatcccatcggccgcgattttgtgggccagcgcacagtgacattcagttctttagtccccggatatcgccacgtgtacctcgaggggcttaccgaggcctccatcttcgtgcacattacgattaacgaaatttacgggaagtggtcacccctaatcctgaatccttcctataccatattgcatttcttgggagctacaaagaaccggcagctgcagggcctgaagggactgtttaacaagaaccctagacatagttcttcagaaaacaacagccactacgtacggaaacgatcaattggggacagaattttgcgccgcacagctagtgcaccagcgaagggacggaagaaaagtaagatgggtttccaggaaatggttgaaatcaaagatagtgtgtccgaagctacccgggatcaggacggggtcctgcggaggactaccaggtccttgcaggcgcgacctgtgtcaatgcccgttgaccgaaacctgttaggcgcgctgtcattgccagtctctgagaccgccaaagatatagaggggaaagaaaatagtctggtccagatatag

SEQ ID NO: 199520 - DNA, 4968 bp, Artificial Sequence
  Description of Artificial Sequence: Synthetic coding sequence
atgagcgtgatgcagagcggcacccagatgatcaagctgaagcggggcactaagggtttagtcaggcttttttacctggatgaacataggacacgactgagatggaggccaagcagaaaaagtgaaaaagcgaaaattctgatcgactccatttacaaggtcacagagggccggcaatccgagattttccaccgacaggctgaagggaactttgatcccagctgctgtttcactatttaccatgggaaccatatggaatctctcgacctcataacatctaaccccgaagaagcccggacatggatcacaggcttgaaatacttgatggctgggatttcggacgaagactctttggccaagaggcagcgtacccatgaccaatgggttaagcaaaccttcgaagaggccgataagaacggagatggcctgctgaacatcgaggaaattcaccagttaatgcacaaattaaatgtgaatctcccacggcggaaagtgcgccaaatgtttcaggaggccgataccgatgagaatcaaggcaccctgaccttcgaagaattctgcgtgttttacaagatgatgtctctgcggagggacctatacctactcctgctgtcctactcagataaaaaggatcacctcactgttgaagaactggcccaattcttgaaagtggagcagaaaatgaacaatgtgactacggactattgtcttgatattatcaaaaaatttgaggtgtcagaagaaaataaagtcaaaaatgtactcggaatcgaagggttcactaattttatgcggagccctgcttgcgatattttcaatcctctgcatcacgaagtgtaccaggatatggaccagcccctgtgcaattactatatcgcgtcatcacataacacgtacctgaccggcgatcagctgctctcccagagtaaggttgatatgtacgcccgcgtcctccaagagggatgcagatgtgtggaggtagattgttgggacggcccagatggggaaccggttgttcaccatggatacaccttaacttccaaaatcttgtttagagacgtggtggagaccatcaataaacatgcctttgtaaagaatgaatttccagttatcctcagcattgaaaatcattgtagcattcaacaacagaggaaaattgctcagtacttgaagggaatttttggagataaactggacctctccagtgttgacaccggagagtgtaaacagctcccaagcccccagtcactgaaggggaagatcctagtgaaggggaaaaagctgccctaccacctgggagatgatgcagaggagggagaggtgagcgatgaagacagcgctgatgaaatcgaggatgaatgcaagttcaaactccactacagcaatggcaccacagaacaccaggtggagagttttattcggaaaaaactggagtcactcctcaaggaatcccagatacgggataaggaagatccagattctttcaccgtgcgcgccctcttgaaagccacacacgagggcttgaatgcacatttgaagcagagccccgacgtcaaggaatccggaaagaaatcccacgggcgcagcctcatgaccaattttgggaagcataaaaaaaccacaaaatccagaagcaagtcctactcaaccgacgatgaggaggatacacaacagtccacaggtaaagagggcggccagttgtacagactcggacggagacggaagacaatgaaattatgtcgagagctgtcagacctggttgtttacacaaactccgtggccgcccaggacatcgtcgacgatggaacaacaggcaatgttctttctttctcagaaactcgagctcaccaagtggttcagcaaaagtcagagcagttcatgatatataatcagaagcagctcactcgaatctatccgtctgcttatcgaatcgatagctcaaatttcaatcctctcccttattggaatgctgggtgtcagctggtggcactcaattaccagtcagaaggtaggatgatgcagctaaaccgcgcaaagttcaaggccaatggtaattgcggctacgtgcttaaaccccaacagatgtgtaaaggtaccttcaatcccttcagcggagacccgctgcccgcaaacccaaagaagcaactgattcttaaggtgatttcaggtcagcagttacctaaaccccctgatagtatgtttggcgacagaggggaaataattgacccctttgttgaggtggagattatagggcttcctgtggattgttgtaaggaccaaacgagagtagtcgatgataatggatttaacccagtatgggaagagactttgaccttcaccgtccacatgcccgagatcgccttggtgcgcttcctcgtctgggaccacgacccaattggtagggattttgtcggtcagagaactgtcactttctcatcactggtgccaggataccggcatgtgtacctggagggcctcacagaggcttccatctttgttcatatcacaataaatgagatctacggcaaaaatcgacaactccaaggactgaagggtttgttcaataaaaaccctcgccacagttcctcagaaaacaatagccactatgtgcgcaaaagatctattggggacaggattcttaggaggacagctagcgccccagctaaagggagaaaaaaaagcaaaatgggatttcaggagatggtcgaaataaaggattccgtgagtgaagccacgagagaccaagacggagttctgcggcgaacgacgaggtcccttcaggcccgacctgtgagcatgccagtcgatcggaatctactcggagccctttccctgcccgtctcggagaccgccaaggacatagaggggaaggagaactcactggcagaagacaaagacggccgtagaaaggggaaggcaagcatcaaagatccccatttccttaactttaacaagaagctgagttcgagctcaagcgctctgcttcacaaagacacttctcagggagacacaatcgtcagtacagcccacatgagcgtgaccggtgagcagctgggaatgtctagcccacgtggaggccgtacaacgtcaaacgctacatctaattgtcaggagaacccttgtccaagcaagagtttatcccccaagcaacatcttgcccctgatcctgtggtgaaccccacccaggatttgcatggagtcaaaattaaagaaaaaggcaaccccgaggacttcgtggaggggaagagcattctgtccggttcagtgttgagtcactcaaatctcgaaataaagaaccttgaaggaaaccggggtaaaggtcgggcggcaacgagtttctcactgagtgacgtgagcatgctatgtagtgatatcccagatctgcactctacagccatactgcaagaaagcgttattagtcatctcatcgataatgtgacactaacaaacgagaacgaacctgggagcagcatttctgctttgataggacagtttgatgagacgaacaatcaggctttgacagtggtgtcacacttacataatacttccgtgatgagtgggcattgtcctctcccctcacttggtctcaaaatgccaataaaacatggcttctgtaagggcaagtccaagtcttcctttctgtgcagtagccccgaactgatcgctctctctagctctgaaacaaccaagcacgccacaaacaccgtctacgagacaacctgtactcctatctcaaaaactaaacctgatgacgatctgtccagtaaggctaaaaccgccgccctggagtctaatctcccaggctcacctaacacgtctaggggctggctgcctaaaagccccactaagggtgaagattgggaaaccctgaagagttgtagccctgcaagctcaccggatcttaccctggaagatgtcattgccgatccaacattgtgctttaattcaggggagtcaagtctcgttgaaatagacggcgaatctgagaatctgtccctgactacttgcgagtaccgcagggaaggcacgtcacagttggccagtccactaaagctgaaatacaaccaaggcgtggtcgaacacttccagagaggattgcgtaacggctattgcaaggagaccctcagacccagcgtcccggagatatttaacaacattcaagatgtaaaaacccagtctatatcttacctggcatatcagggcgcaggatttgtccataaccacttctccgactccgatgcaaaaatgttccagacatgtgtaccccagcagtcatctgctcaggatatgcatgtgcctgtgcctaaacaactggcacacctccctcttcctgcattgaagctgccatcaccatgcaaaagtaagtctctaggagatcttacctcagaagatattgcctgcaactttgagtcgaaataccagtgcatctcgaagtcgttcgtgacaacaggcattcgggacaaaaagggggtgactgtgaagaccaagtccctggaacctatagatgccctgacagagcagttgagaaagctggtgtcattcgaccaagaagacaattgccaagtgttgtatagcaagcaggacgccaaccaacttcctagggcactggtaagaaagctgtcctcacggagtcagtctcgagttcggaatattgcatcacgtgccaaggaaaaacaagaggccaataaacagaaagtccccaacccgtcaaacggagccggggttgtgctgcgaaacaaaccctccgctcctactcctgccgtcaaccgtcacagcaccggaagttatatcgcggggtatctcaaaaacaccaagggcggcggcctggaaggaagaggcattcccgaaggagcatgtacggccctgcactacggccacgtggaccagttctgttcagacaattcagttctacagaccgagccttcctctgacgacaagcctgagatttatttcctgctcaggctttag

SEQ ID NO: 199521 - DNA, 3045 bp, Artificial Sequence
  Description of Artificial Sequence: Synthetic coding sequence
atggccgacctggaggtgtacaagaacctgagccccgagaaggtggagcgctgcatgtccgtgatgcagtctggcactcagatgatcaagctgaagagaggaaccaagggcttggtgcggcttttttatcttgacgaacatcgaacaagattgagatggcgtccttctaggaaaagcgagaaggcaaagattctgatcgatagcatttataaggttactgagggcaggcaaagcgagatcttccatcgacaagctgaaggcaatttcgatcccagttgctgcttcactatctatcacggtaaccacatggaatctttagatctcatcacatcaaatcctgaagaagctaggacctggattaccggcctgaagtaccttatggccggcatcagcgacgaggactctttggccaagagacagaggactcacgatcagtgggtcaagcagacattcgaagaagccgataagaatggagacgggctgctgaatattgaagagattcatcaactgatgcataaactgaacgtgaatttgcctcgaagaaaagtcagacaaatgtttcaggaggctgacacagatgagaaccagggcacgttgacatttgaagagttctgcgtcttttacaagatgatgtcactgcggcgagacctgtatcttttactcctatcctattccgataagaaggatcatcttactgtagaggaattggctcagttcctgaaagtagagcagaagatgaacaacgttaccacagattattgcctcgacattattaagaaattcgaggtcagcgaggaaaataaagtgaagaacgtgctcggaatcgaagggtttacaaatttcatgcggtcacccgcctgtgatatatttaatcccctccaccatgaggtctaccaggatatggatcagcctctttgtaactattatatcgcaagctcacataatacctatttaaccggggaccagttgctctctcaaagcaaggttgatatgtacgctcgggtgttgcaggagggctgccggtgcgtggaggtcgattgttgggacggaccagacggtgagcccgtggtgcaccatggctacaccctgaccagtaagattctctttcgagatgtagtagaaactatcaataagcacgcctttgtgaaaaatgagtttcccgttatcctaagtatcgagaatcactgttctatccagcagcaacgaaagattgcacagtaccttaaaggaatctttggggacaaactggaccttagctccgtggataccggcgaatgcaagcagctgccaagcccccagtctctgaaggggaaaatcctcgtgaaggggaagaaactgccatatcacctcggagacgacgctgaggagggcgaagttagcgatgaagactctgctgatgagattgaagacgaatgcaaattcaaactgcactactccaacgggactaccgaacaccaggtagagagctttatcagaaaaaaattagagagcctgctgaaggagtctcaaatcagggataaggaggatcccgacagctttaccgtcagagctctgttgaaggctactcatgaggggttgaatgcgcaccttaagcaaagcccggacgttaaagaaagcggcaagaagagccacggacgctctctgatgaccaacttcggtaaacataagaagacaacgaaaagccgaagcaaaagctattcaacagatgatgaagaagacacccagcaatccaccgggaaggaggggggccagctgtatcggcttgggaggcggcggaaaacgatgaagctttgtagggagcttagtgatctggtggtgtacaccaacagcgtggccgcacaggatattgtcgatgacggtactaccgggaacgtcttgtcattcagcgagactagagcgcaccaggttgtgcagcaaaaaagcgagcaatttatgatctataatcagaagcagctgactaggatttacccgtcagcctatcggattgacagttccaactttaatcccctcccgtattggaatgccggctgccagttggtggccctgaactaccagtccgagggtcgcatgatgcagctgaacagggcgaagttcaaagcaaacggtaactgtggttatgtgctcaaaccacagcagatgtgtaagggtacctttaatccattttcgggcgaccctctgccagccaatcctaagaagcagctgattctgaaagtgatctcaggacagcagttgccgaaacccccagactccatgtttggggatagaggggagattatcgatccctttgtggaggtggagataattggacttcccgtggattgctgcaaagatcagactcgagtcgttgacgacaatggattcaaccccgtttgggaggaaactctcacttttactgtccacatgcctgagattgctctggtgaggtttctggtgtgggatcacgaccctatagggagggacttcgttgggcagaggaccgttacattctccagtcttgtgcctggctaccgccatgtgtacctggagggcctcactgaggccagcattttcgtgcacatcactattaacgaaatttatggcaagaatcgacagctgcagggcctgaagggcctgttcaataagaatccccgacactccagctcagagaacaattctcactacgtgcgtaagcgttctataggggaccggatcctcaggcgtacagcttcagctcccgccaagggccgaaagaagtccaaaatgggatttcaggaaatggtagaaatcaaggattctgtgagcgaagcaacaagagatcaggatggggtgctccgacgcaccaccaggtcccttcaggctcgtcccgtgagcatgcccgtggacagaaacctgctcggagccttgtcgctcccagtgtctgagacagcaaaagacatcgagggtaaggagaactcactggacagcagcttctgccgccccacagaacaggctaaggccgagatgtgcaaagtcccattcccccggcagctggaatgtgtgatgaagatggaaattagtgagacctag

SEQ ID NO: 199522 - DNA, 3507 bp, Artificial Sequence
  Description of Artificial Sequence: Synthetic coding sequence
atgttccgggaggccgacaccgacgaccaccagggcaccctgggcttcgaggagttctgtgctttttacaaaatgatgtcaacccggagagacctctacctgctgatgctgacatactcgaaccataaagaccatttggatgcagcatctctgcaaaggttcttgcaagtcgagcagaaaatggccggcgtaacccttgaatcatgccaagatattatagaacagtttgagccttgcccagaaaacaagagcaaaggactcctgggaattgatggttttaccaattacactcgctctcccgccggcgatatattcaatcctgagcatcaccacgtgcaccaggacatgactcaacccctgtcccactacttcattacgtcatcgcataacacttacctagttggagatcaactgatgtctcagtcacgtgtcgacatgtatgcatgggtcctgcaggctgggtgtaggtgcgtggaggttgattgctgggacggacccgatggagagcctatcgtgcaccatgggtatactttgacttcgaaaattctctttaaagatgtcatcgagacgattaacaagtacgctttcatcaaaaacgaataccccgtcatcctttcaattgagaatcactgctcggtcattcagcaaaagaaaatggcccaatatctgaccgatattctgggcgacaagctggacctgagctctgtgtctagcgaggatgcaactaccctcccttcccctcagatgctgaagggaaaaattttggtcaagggcaagaagctgcctgcaaacatctcggaggatgcagaggagggcgaagtgagcgatgaggactctgccgacgaaatagatgatgactgcaagctgttaaacggtgacgccagcaccaatcggaaacgggtcgagaacaccgcaaaacggaaactcgacagtctgatcaaggagtcaaagataagggactgcgaagacccaaataactttagtgttagcacactctccccgtctggaaagctggggagaaagtcaaaggccgaggaggatgtggagtctggtgaagacgccggcgccagtcgaaggaatggtcggctcgtggtgggttctttttccagacgcaaaaagaagggcagcaagcttaagaaagccgcttcagtggaggagggcgacgaaggacaagattcaccagggggccagtcccggggggcgacaagacaaaagaagaccatgaaactgtctagggcgctgagcgacttagttaagtatacaaagtctgtggccacacacgacattgagatggaggccgctagtagttggcaggtgagcagtttcagcgaaactaaggctcaccagatcctccagcagaagccggctcaatatttgagattcaatcagcagcagctgtcacgcatttacccaagttcttaccgcgtggacagctctaactacaatccacagccattctggaacgcaggatgtcaaatgggagtgttcaatcctaacagcgaggacccactgccaggacaattgaagaaacagcttgtgctgaggatcatttcagggcagcaattacctaagcccagggatagcatgctgggggacaggggcgaaataattgacccattcgtcgaggtcgaaatcatcggtttgcctgtggattgtagcagggaacagacccgtgtggtggacgacaacggttttaaccccacatgggaagagacgctcgtgtttatggttcacatgcctgagatagcgctggtgcgcttccttgtgtgggaccacgacccaattggacgagacttcatcgggcagaggaccctcgcctttagttctatgatgcccggttaccggcacgtctacctggagggaatggaggaagcaagcattttcgtgcacgtggctgttagtgacattagcggcaaggtgaagcaggccttaggtcttaagggactgttcctcagaggtcctaaacctggaagccttgactcacatgccgccggccgtcctcccgcacgccccagcgtgtcccaacgaatcctacggagaactgcgagcgccccgactaaatcacaaaagccaggacgcagaggctttcccgagctggtgctgggaacacgagatacgggtagcaaaggggtggccgacgatgttgttccaccagggcccggaccagcgcctgaggcaccagctcaggaaggacctgggtcaggtagtccgagggatactcggccccttagcacccagcggcccttgccacccctgtgtagcctggagacaatcgctgaagagccggctccaggaccagggccaccccccccagcagccgtgcctacaagctctagtcagggacgaccgccatatccaaccggtcccggcgctaacgttgcatctccactggaagatacggaagaaccacgtgactcccggccccgcccatgcaatggcgaaggtgcgggcggcgcctatgagcgcgctcccggatcgcagaccgatgggaggtctcaaccacgaacgctcggccacctaccagtcatccgtagagtcaaatctgaaggtcaggtgccaacagaacccctgggtggctggcgccccctggccgccccattccctgctccagcggtttattcagatgctaccgggagcgatccactgtggcagcgcctggaaccctgcgggcacagggactcagtgagcagcagctcttcaatgtcctcaagcgacacagttattgatttgtcgttgccgagcctcgggttgggccgctccagagagaatctggccggagcccacatggggagactcccaccccggccgcactccgcttccgccgccagacctgatcttcctcctgttaccaagtctaagagtaaccccaacctgagagctactggacagcgcccccctattcctgacgaactacagcctcgatccttagccccacggatggctggcctgcctttccgtcccccttggggttgtctttcgctggtcggagtccaggactgccctgttgccgccaagtcaaagagcttgggagacttgaccgcagacgattttgccccatcatttgaaggtggcagcagaagactgtcacatagccttggcctaccaggcggcactcggcgagtgtcgggacctggcgtgagaagggacacgttgaccgagcaactccgttggctcacagtcttccagcaggccggcgacataacgtcacctaccagcctgggtcccgccggcgagggcgtcgctgggggcccagggttcgttcggaggtccagcagtcggagtcatagccgcgtgagagccattgcatcccgggccaggcaggcccaggaacgccagcagcgtttgcaaggcctgggacgccagggcccgccagaggaggagagggggacgcccgaaggagcttgctctgtagggcatgaaggaagtgtggacgcccccgcaccaagtaaaggggctctcggtcccgccagcgctgctgccgagaatctggtgctactacgtctgtag

SEQ ID NO: 199523 - DNA, 1500 bp, Artificial Sequence
  Description of Artificial Sequence: Synthetic coding sequence
atgggcgccatgcaggagggcatgcagatggtgaagctgcggggcggatcaaaaggcctggtgagattctactacctggacgaacacaggtcctgcatcaggtggcgccccagcaggaagaacgaaaaggcaaaaatttcaatagatagcatccaagaggtaagtgagggccgacaatcagaagtctttcagcgctatcctgacggatccttcatcatcgatccgtttgtcgaggttgagatcatagggctaccagtagactgcagtcgggagcagacaagagtggtggatgataacggcttcaaccctacgtgggaggagacactggttttcatggtacacatgcccgagattgccctcgtgaggttcttggtgtgggaccacgaccccataggcagagatttcattggacagcggactttagcgttctcttccatgatgccaggctaccgccacgtctacctcgagggaatggaggaggctagcatattcgtacacgtggccgtttctgacatctccgggaaggtgaagcaggcactaggtctcaagggcttgtttcttagaggcccaaagcccggaagccttgacagtcacgccgctggcaggccgccagcaagaccatccgtttcccaacgcatcctcaggaggacggcctctgctccgaccaaatctcaaaagcctggcaggagggggttccctgaactggttttaggtactagagatactggaagtaaaggcgtcgctgacgatgtagtgcccccaggcccgggccccgcacctgaggcgccagcacaggagggcccgggatctgggtccccgcgcggaaaggctcccgccgctgtggcagagaaatctccggtacgcgtgagaccacctagagtgcttgacggtcccggacccgcaggcatggccgccacatgtatgaaatgcgtcgtcggcagctgtgccggagtgaacacaggggggctccagagggagaggcccccttcccctggacctgcatctcgccaagcagcgatccggcagcagccgagagctagggctgattccttgggggcaccctgctgcggcctagatccgcatgcaatccctggaaggagcagagaggcccctaaagggccaggagcgtggcggcaggggcccggcggttctggtagcatgagctccgacagttccagtcccgattctcccggtatccccgaacggtcacctaggtggccagagggtgcctgccgtcagcccggcgctctgcagggagagatgtccgctctgttcgctcaaaagttggaagaaatacggtccaagtcacctatgttttctgctgggaagccactgctgccttgcgtggtgctgccccacgctccaggaatggctggcccgggatcccccgccgccgcatccgcctggacagtatcacctagggtcctggtcctggtagctctatacccgtggcattgcctgcgcggcacccttctgccctggctggcgtgtggcccatag

SEQ ID NO: 199524 - DNA, 3177 bp, Artificial Sequence
  Description of Artificial Sequence: Synthetic coding sequence
atggccggcatcagcgacgaggacagcctggcccggcggcagcggacaagagatcagtggttgaaacaaacattcgatgaagccgataagaacggcgacgggagcttgagcattggcgaggtgctccagcttttgcacaagttaaacgtgaacctgcctcgacaacgtgtgaaacagatgtttcgcgaagccgataccgacgaccaccaggggaccctggggtttgaggaattttgtgccttttacaagatgatgtccaccagacgcgacctgtatctgttaatgctgacgtactcaaaccacaaagaccacctggacgccgcaagcctgcagcgctttttgcaggtcgagcagaaaatggcgggagtaactcttgagagttgtcaagatattattgagcagttcgaaccgtgcccagagaataaatccaaggggttacttggtatcgatgggttcactaactatacgagatctcccgccggagacatcttcaacccagagcatcaccacgttcaccaagatatgacacagccactaagccattactttatcactagctctcacaacacctacctcgtaggcgatcagctgatgtcacaaagtcgagtagacatgtacgcctgggtgctgcaagctggctgcaggtgcgtggaagttgattgctgggatggcccagacggtgagcccatcgttcaccacggctatactttgacatccaagatcttgttcaaggacgttatcgagaccattaacaaatatgcattcatcaaaaatgaatatccagtcatcttgtcaattgaaaatcattgctcagtcattcagcagaaaaaaatggcccaatacctgactgacattctcggagacaaactagatttgagcagcgtgtcttcagaggacgcaacaacccttccgtcaccacagatgttaaagggcaaaattctggtgaagggcaagaagctgcctgccaacatatcagaggacgctgaagagggcgaggtgtctgacgaagacagtgccgatgagatagatgacgactgtaagctcctcaacggtgatgcctcaaccaaccgcaagcgggttgagaatactgcaaagcgaaaactcgactctctgattaaagagtcaaagatccgcgactgcgaagatcccaataactttagtgtgtccacactttccccaagtggaaaactgggtaggaaatctaaagctgaggaagacgtcgagagtggagaggacgccggtgcatccagacgtaatggcaggcttgtagtgggctcatttagtagaaggaaaaagaaaggttcaaagctgaaaaaggccgcctcagtggaggagggcgatgagggccaggattcaccagggggtcagagccgcggtgccacacgccaaaagaaaacgatgaagctttctagagccctgtccgatctcgtgaagtacactaagtcagtcgccacccacgacatcgaaatggaggctgcgtcctcctggcaagtcagcagctttagtgaaaccaaggctcatcagattctgcagcagaagccagcccagtatctgagattcaatcaacagcagctgagccgcatttaccccagcagctaccgggtcgattcaagcaattataatccacaacctttttggaacgctggttgtcagatggtcgcgttaaattaccagtccgagggccggatgctgcagttgaaccgtgccaaattttccgccaatgggggttgtggttacgttctgaagccaggatgtatgtgtcaaggcgttttcaatcccaactctgaagaccctctgcccggtcagctcaaaaagcagctggtgcttcggattatatccggacaacaattgcccaaaccccgagatagtatgttaggcgatagaggagaaattatagatccatttgttgaggtggaaatcatcggactcccggtcgattgctctcgcgaacagacacgggtcgtggatgataacgggtttaatcctacttgggaagagaccctcgtgtttatggtccatatgcccgagatagccctggtgagattcctggtatgggatcacgacccgatcggtcgggactttattggccagcgaactttagccttttcatctatgatgcctggatacaggcacgtataccttgaaggcatggaagaagccagtatcttcgtgcatgtggccgtctcagatatttcaggtaaagtgaagcaggctttgggactgaagggcctgtttttgcgcggcccaaagcctggtagtctggacagccacgcagcaggtcggcctcccgctaggccttcagtgtctcaaaggattctgcggcgaacagcctccgccccaacaaaaagccagaaacccggtcgccgcggctttcccgagctcgtcctcggaacccgggataccggttcaaaaggggtcgccgacgatgtggtgccgccaggacccggacctgccccagaggcacccgcacaagagggcccaggcagtggatctccgcgagggaaagcacccgctgccgtggcagagaaaagcccagtgcgggtcagaccacctcgggtcttggacggtcccgggcccgctggcatggcagccacctgtatgaagtgcgttgtcgggtcctgtgccggcgtcaacacaggcggcctgcaacgcgagagacctccctcacccgggcccgctagtcgccaggccgcaattcggcagcagccgagggccagggctgactcccttggcgcaccttgctgcgggcttgacccccatgcaatccctggacggtcacgcgaagcccccaagggaccaggggcttggaggcagggacctggtgggagtgggtctatgtctagcgactcatccagcccagatagccccggaattccagaacgttcccctcgctggcccgaaggggcttgcagacagcctggcgcccttcagggggagatgtctgccctttttgcacagaaactggaggaaattagaagcaaatcacctatgttcagcgctgggaaacccctgctgccatgcgtcgtcctgccgcacgctccaggaatggctggccccggaagccctgcagccgcaagcgcctggactgtgtccccgcgcgtgctggtgcttgtggctctttatccctggcattgtttgcgaggaaccctgctgccttggctcgcttgtgggccatag

SEQ ID NO: 199525 - DNA, 1494 bp, Artificial Sequence
  Description of Artificial Sequence: Synthetic coding sequence
atgggcgccatgcaggagggcatgcagatggtgaagctgcggggcggcagtaaaggattggtgcgattttattacctcgacgagcaccgttcctgtatacgctggaggccctctagaaagaatgagaaggcgaaaatcagcattgatagcatccaggaggtgtctgaaggacgacagagcgaagtcttccagagatacccggatggatcttttgacccatttgtggaggttgaaattattggactgcctgtagactgttccagggagcagacacgggttgtggatgacaacggcttcaatcctacatgggaggagaccttggtttttatggtgcacatgcccgagatcgcccttgtgcggttcttggtgtgggaccatgatcccatcggaagagattttatcggccagaggaccctagcattctccagtatgatgccgggttatcgccatgtatacttggagggcatggaggaagctagtatttttgttcacgtggctgtcagtgacatcagtgggaaggtcaaacaagcgctcgggttgaagggtcttttcctccgcggccctaaaccaggtagtctggattcgcacgccgccggtcgtccccccgctcgaccttctgtgtcccagagaattctgcgacggacggcctccgcccctaccaagagccaaaagcccggccgacgaggatttccggaactggtgctgggaaccagggatacgggaagcaaaggcgttgcagacgatgtggtgcccccaggcccaggccccgcacccgaagcaccagcacaggagggacccggctcgggatcacctagggggaaagccccagcagccgtcgccgagaaatctccagtcagggtgcgaccccctagagtcctggacggaccgggccccgcaggcatggccgccacctgcatgaaatgtgtagtcgggtcctgcgctggtgtgaacacgggaggcttacagcgagaacgtcccccctctcccggtccagcctctcggcaagccgccatcaggcagcagccccgggcacgagccgatagcctaggagcaccctgttgtggactggatccacatgctataccgggccgctcccgcgaagcacccaaaggccccggagcctggcggcagggccccggaggttcaggcagtatgtcttccgactccagtagtcccgactccccaggcatacccgagagatcccctcgctggccagagggcgcctgcagacaacccggtgctctgcagggggaaatgtcagccttgttcgctcagaaactcgaagagattaggtctaagagtcctatgttttccgctggcaaaccactccttccttgcgtcgtcctgccccacgcaccaggcatggcggggccaggttctccagctgctgcgtccgcctggacggtctccccaagggtgcttgtccttgtggccctttacccgtggcactgtttaagagggacactcctaccatggctagcttgtggtccctag

SEQ ID NO: 199526 - DNA, 4251 bp, Artificial Sequence
  Description of Artificial Sequence: Synthetic coding sequence
atgagcggcccctggcccagccccgacagccggaccaagggcaccgtggcctggctggccgaagtgttgctgtgggtgggtggctctgttgtgctctcgtctgagtggcaactggggcccttggtggagcgctgcatgggcgccatgcaggaggggatgcagatggttaagcttcgggggggttctaaggggctcgtacgcttctactatttagacgagcatcggtcctgtattagatggagaccctctcgcaaaaacgagaaggctaaaatatcaattgattcaatccaggaggtgtctgaaggccgtcagagcgaggtatttcagaggtaccccgatggaagcttcgacccaaactgttgtttttctatctaccatggctcacacagagaatcccttgatctcgtcagtacgagttctgaggtggcacgcacctgggtgacagggctcaggtacttgatggcaggcatctctgatgaggactccctggcaagaagacaaaggactagagatcagtggttaaaacaaacatttgacgaggcagataaaaatggggacggatccttaagcatcggagaggttctgcagctcctacacaagctgaacgtgaatctcccccgacagcgggtgaagcaaatgttcagagaggcggacacagatgaccaccaggggaccctgggcttcgaggagttttgcgccttctacaagatgatgtccactcgacgcgatctgtatctgctgatgctaacctattcaaaccataaggaccatttagatgctgcttcgctgcagcgcttcctccaggtagagcaaaaaatggctggagtcaccctggaatcatgtcaggatattatagaacagttcgaaccttgtccggagaataaatctaaggggcttcttggtattgatggttttacgaactacacaagatccccagcgggggacatatttaatccagaacaccatcacgtccaccaggatatgactcagccgctcagccactattttatcacgtctagccacaacacctacttggtcggagatcaactgatgtctcagtcgagagttgacatgtatgcctgggtgcttcaggccggctgcagatgcgtggaagtcgactgctgggatggccccgacggggaacctattgtccaccatggttataccttaacatccaaaattctgtttaaggatgtcatagagacgatcaataagtatgcgttcattaaaaatgaatacccggtgattctgtctatcgagaatcactgcagtgtgattcagcagaaaaaaatggcccagtatttaaccgacattctcggagataaattggatctgtctagcgttagctccgaggacgctactaccctgccatctccccagatgctcaaaggaaagatcttagtgaaaggcaagaaattgcctgcaaacatctccgaggacgccgaagagggggaggtttcggatgaagatagcgccgacgaaatcgacgacgactgcaagcttctcaacggggatgcctccactaaccgtaaaagggtggagaacacagccaagagaaagttggactccttgatcaaggaatctaaaatacgggactgcgaagacccgaacaactttagcgtgtcaacgctaagtccctcaggcaaactggggagaaaaagcaaagccgaggaggacgtcgagtccggggaagacgccggtgcaagtcggcgtaacgggcggttagtggttggctcattctctaggagaaaaaagaaaggcagtaaattgaagaaggcagccagcgtggaggagggagacgagggtcaagactcacccgggggtcaaagccgaggtgctacaagacagaaaaagacaatgaaattatctcgggctctgtctgacttagtcaagtacactaaatctgtcgccacacacgacattgagatggaggctgcctccagttggcaggtgtccagctttagtgagactaaagcacaccagatactgcagcaaaaacctgcacagtacctcaggtttaatcagcagcagctctcccgaatctaccccagcagctaccgtgttgattcctctaactataatccccagccattctggaacgctggctgccaaatggtggctcttaattaccaaagtgagggtaggatgctccagcttaacagggcaaagttttccgcaaacggaggctgcggctacgtgctcaaaccagggtgcatgtgccagggtgtatttaatccgaatagcgaagatccattacctggacagcttaagaagcagcttgtccttaggattatctccgggcagcagttgcctaagccacgcgacagtatgttgggtgaccggggcgagataattgaccccttcgtcgaggtcgagattataggactacccgtggactgctccagagaacagacccgagtggtcgacgacaatggcttcaatcccacctgggaggagactctagttttcatggtgcacatgcccgagattgctttagtaagattcttggtgtgggaccacgacccaattggaagagactttattggacagaggaccctggccttcagctccatgatgcctggctaccggcacgtctacctcgaaggcatggaggaggccagtatttttgttcacgtcgctgtctcagatatcagcgggaaggtgaagcaggccctcggcctcaagggcctttttctgagagggccgaaacccggctctttggactcccacgctgccgggcgccctcccgcaaggccctctgtatctcaacgaattctgaggcgtactgcaagcgcacctaccaagagccaaaagcccgggagacgggggttcccagaacttgttctggggacccgcgacaccggctccaagggcgttgctgatgatgttgtaccccccggtcccgggccagctcccgaggccccagctcaggagggcccaggtagcgggagcccccgcgacacgcgccccctgtctacgcagcggcctctgccaccactctgctcccttgaaaccatcgctgaggagcctgctccaggccccggtccgccaccacctgccgctgtcccaacaagtagcagccagggccgcccaccgtaccctaccgggcctggtgcgaacgtggcgtcaccactcgaagatactgaagagcccagggatagccggcctagaccgtgcaacggcgagggcgccggcggcgcgtacgaacgagctccgggttctcagaccgacggtcggagtcaaccacgcactctggggcacctccccgtcatccggcgtgttaaatccgaaggtcaggtacctactgagccgctggggggatggaggccactcgccgcgccctttccggccccagcagtgtactcagacgccacaggaagcgaccctctctggcagcgtttggagccatgtgggcacagggacagcgtatcatcatctagctccatgagttcttccgataccgtcatcgacctaagtcttccatccctgggcctgggccggtctcgagagaacttggccggtgcccacatgggcagactcccacctcggccccacagcgcaagtgccgcacgcccagatttacccccagtaactaagagtaagagtaaccccaatctgagagctacaggccagcggccacctatccctgacgaactgcagccccgctcactggctccacggatggcaggcctgccattcaggcccccctggggctgcctctctttggtaggagtgcaggactgtccggtagctgctaagtccaagagtctcggcgacttaaccgccgacgactttgcgccctcattcgagggcggaagcaggcggctttcccatagccttggcctgccgggaggcaccaggcgcgtcagcggacccggtgtccggcgcgacactctcactgaacagctgagatggctgacggtcttccagcaagcgggggacattacttcacctacttcactggggccagctggagagggcgtggcgggagggccagggtttgtgaggagatcatcctcaagaagtcacagccgggtacgcgccattgcttctagggccagacaggctcaggagagacagcagaggttgcagggactggggcgccaagggccccccgaggaagagaggggaacgccggaaggggcatgctccgtaggccacgaggggtccgttgacgcaccagcgccctccaaaggcgccttgggcccagcttctgctgccgccgagaacctggtgctgctgaggctctag

SEQ ID NO: 199527 - DNA, 4143 bp, Artificial Sequence
  Description of Artificial Sequence: Synthetic coding sequence
atgagcggcccctggcccagccccgacagccggaccaagggcaccgtagcatggttagcagaggtattgctgtgggttggcggatcagtcgtactgtcatctgagtggcagctcgggccactggtcgagcggtgcatgggggccatgcaggagggaatgcagatggttaaactcaggggtggatcgaagggactcgtcaggttctactacctcgatgagcacaggagctgcatccggtggaggccctcccgaaagaatgaaaaagcaaagatttctatagactccatccaggaggtgtctgaggggcggcagagtgaggtcttccagaggtacccggacggctctttcgaccctaattgctgttttagtatttaccacggttcccatcgcgaatcactggatctggtgtcaactagttctgaagtagcacgcacgtgggtcacggggttgaggtacctcatggcaggaattagcgacgaggattccctcgctagaagacagcggacgagggatcagtggctgaagcagacttttgacgaagcggacaagaacggggacggctcactgtccattggagaggtgctgcaattgctgcataagttgaacgtcaacctgcctaggcagcgagttaagcaaatgtttagggaggcagatacggacgaccaccaaggaactttaggattcgaggaattctgcgctttttataaaatgatgagcactcgtcgagatctgtatctgcttatgctgacatactcaaaccataaagaccacttggacgccgcctctctccagcgctttctgcaggtggagcaaaaaatggctggagtaacgctcgagagctgtcaggatatcatcgagcagttcgagccctgccccgaaaacaagagcaaaggactcctgggaatagatggcttcaccaactacacacgcagcccagccggggatatctttaatccagagcaccatcacgtgcaccaagacatgacccagccgttgtcacattatttcatcacgtctagtcataacacatatttagtcggggaccagctgatgagccagagcagggtcgacatgtatgcatgggtgctacaagccggctgtcgttgtgtagaggttgattgttgggacggaccagacggggagcctatcgtccaccacggctacaccctcactagcaaaatcctctttaaagatgtaatcgaaacaatcaataaatatgcgttcattaagaatgaatatcctgtgatcctgagcatagaaaaccactgctcagtcatccagcagaagaaaatggcccagtacctgactgacatactgggggataagctggatctgtcctcagtttccagtgaggatgctaccaccctgccatcaccacaaatgctgaagggcaagattctcgtaaagggcaagaaactcccagcaaatatttctgaagatgctgaagaaggggaggtgtctgacgaagacagtgctgacgagatcgacgatgattgtaagttactgaacggagacgcctcaaccaataggaaacgcgtggagaacactgccaagagaaaattagattctctgattaaagaatccaagatacgcgattgcgaagacccgaataatttcagcgtgagtactctctctccttccgggaaactgggacgcaaatcaaaggccgaggaggacgtcgaatcaggcgaagatgctggcgccagtaggaggaacggtcgcctggtggtgggctccttctcacgccgaaagaagaaaggctccaaactcaaaaaagccgcctcagtggaggagggagatgaaggccaggacagccccggggggcagagccggggagccactcgtcaaaagaaaactatgaaactcagccgggccttgtccgatctggttaaatatacaaaaagcgtggctacccacgatatcgaaatggaagcagcctcttcatggcaagtctcaagcttcagtgagacaaaagcccatcagatcttgcagcaaaagcctgcccaatatctcaggttcaaccagcagcagttgagccgaatttacccctcgtcctatcgcgtggactcgagtaactataacccccaacccttctggaacgcaggctgccagatgggcgtttttaatccaaactcggaagaccctttgcctggccagttaaagaaacagcttgtcctgcggattattagtggacagcaactgccaaagccccgtgactcaatgctgggagacagaggagaaattattgacccattcgtggaggtcgaaatcataggcctgcctgtggactgctcacgagaacagactagagtggtggacgataatgggttcaaccctacttgggaagaaacactcgtgttcatggtccatatgcctgaaatcgcgctggtccggtttctagtgtgggatcatgatcccatcggaagagatttcatcggacagaggacattagcattttctagtatgatgccaggttacagacatgtgtatcttgaaggtatggaagaagcgtctatttttgtgcatgtggccgtcagcgacatctcagggaaggtcaaacaagcattggggttaaaaggactgttcctacgcggccccaagccggggtcacttgatagtcacgccgccggcaggccgcccgcccgcccgtctgtgagtcagagaatcctgcggcgaaccgcctcagcgccaaccaaatcacaaaagccagggcgccggggcttccccgaactcgtgctggggacccgggataccggcagtaaaggggttgccgacgacgtcgtgcccccagggcctgggcctgccccagaggccccggctcaggagggccctggctctgggtctccacgtgacacaagaccgctttctacacagaggcccctccctcccctgtgtagcctcgagaccatcgccgaagaaccagctcccggacctggaccacccccccctgccgctgtacccacctcaagctcccaggggagacccccataccctacagggccaggcgcaaacgtcgcttctcccctggaagacactgaagaaccccgggatagccgtccaaggccgtgcaatggcgaaggggcgggcggagcatacgagcgagccccggggagccaaaccgacgggaggagtcagcccagaaccttgggtcatctaccagtaattaggcgcgttaagtctgaggggcaggtccccaccgagccgctgggtggatggcgtcccctggccgcacccttccctgcccccgctgtctattccgacgcaaccggcagcgatcccctttggcagcgactggagccctgtggtcacagagactccgtctcttcttcaagctccatgtcatctagcgacaccgtgatcgatctgagcctgcctagtcttggcttgggaaggtcccgggaaaacctggccggcgcccacatgggcagactgccccctagaccacactctgcttccgccgcccgaccagatctccctcccgtcaccaagagtaagagtaatcccaatctgagagcaaccgggcagcggccccctattccggacgagttacagccgaggtccctggctcccaggatggccggcctaccatttaggccaccatggggatgcctgagtctggtgggcgttcaggactgtccagtggccgccaagagcaagtccctcggcgatctgacagctgacgactttgccccttctttcgagggcgggtctaggcgattgtctcatagcttaggtctgcccggaggtaccagaagggttagcggtcccggcgtgcggagagataccctcaccgagcagctgagatggcttactgtgttccagcaggctggggacattacgagtccaacgtccctgggcccagccggcgaaggcgtagcaggcggacccggattcgtaagaaggtcgtcttcacgatctcattcacgagtgcgagccattgctagtagagcaaggcaagctcaggagcgccagcagcggctccaagggttgggaaggcaaggccctcctgaggaagaacgcgggaccccagagggagcttgttcagtgggccacgaaggcagcgtggacgctccggctccctccaagggggcactgggacccgcctcagcagccgctgagaaccttgttttactgcggctatag

SEQ ID NO: 199528 - DNA, 2136 bp, Artificial Sequence
  Description of Artificial Sequence: Synthetic coding sequence
tgagccctgaactaccagagcgagggccggatgctgcagctgaacagggcaaagttttctgcgaatggcggatgtgggtacgtcctaaagccaggatgcatgtgccagggagtcttcaatccgaactcagaagatccccttcccggacagttaaaaaagcaactcgtgttaaggataatatccggtcagcagctccctaagccccgagattcgatgcttggggatagaggcgaaatcattgaccccttcgtggaagtcgaaatcatcggactgcccgtggattgctcaagagagcaaactagagtggtggacgataatggctttaacccaacctgggaagaaaccctggtctttatggtgcacatgcctgagatcgcgttagtcaggttccttgtgtgggaccacgatcccattggcagggattttatcggccaaagaaccttagctttcagttctatgatgcctggatatcggcacgtttacctcgagggtatggaggaggccagcatcttcgtacatgtggctgtcagcgatattagtgggaaagtcaagcaggccctgggtcttaaaggactgttcctgcggggaccgaaacctggcagtctggattcacatgcggccggacgcccccccgccaggccttccgtgagtcagcggatactgcggcggacagcctctgccccgaccaagtcacaaaaacctggacgtaggggttttccagaattggtccttggcacacgcgacaccggcagtaaaggcgttgccgacgatgtggtgccacctggacctggaccagcccccgaagccccagcccaggagggaccaggttcgggctcacctcgtgacacgcggcctttgagcacccaaaggccactcccacccctgtgttccttggagacgatcgcagaagagcccgctcctggccccgggccacccccccccgccgccgtccctacttctagctcacagggccgtccaccctaccccaccgggcccggtgctaacgttgccagtccgctggaggacacagaagaaccccgcgacagcagaccccgaccttgcaacggagagggtgctgggggggcctatgagcgggcccctggcagccagactgatggtagaagtcaaccacggacacttgggcacctgcctgtgatccgaagagttaagagtgagggccaggtccccactgagccacttgggggctggcgaccactcgccgctccatttcctgcaccagcagtttacagcgacgctaccggctccgatccactctggcagcgtctagaaccgtgcgggcacagggactcagtgagttcctctagcagcatgtcttcatctgatacagtgattgatctgtcactaccaagcctcggcctcggacggagcagagagaaccttgcaggggcccacatgggcaggttgcctccacgcccgcacagtgctagtgccgcacgtcctgatctgccaccagttacaaaaagcaagagcaaccccaatcttcgcgccaccggacagcgtccccctatccctgatgaactgcagcctcgtagtcttgcccctagaatggccggcctccctttccgtccaccgtggggatgtctatctctggtcggcgtccaagactgccctgtagcagcaaaaagcaagtcactcggagatttgacagcagatgattttgccccatcctttgaggggggctccaggcggctgtctcattctctgggactgcctggtgggacaagacgggtaagcggccccggcgtaagaagagataccctgacagagcagttgcgttggctaaccgtgtttcagcaggcaggagatatcacttcacccacgtccctcggccctgctggcgagggagtggctggtggccccggtttcgtcagaaggagctctagcaggagccattctcgggttcgggctattgcatcccgtgctagacaagctcaagaaagacagcagagattgcagggtttggggagacaggggccacccgaagaggagagaggaactccggagggggcatgttcggtgggacacgagggttctgtggacgcccctgcgccatcgaaaggggctctcggccctgcctctgcagccgccgaaaacctagtgctgctgcgactgtag

SEQ ID NO: 199529 - DNA, 3390 bp, Artificial Sequence
  Description of Artificial Sequence: Synthetic coding sequence
atggaggagcccggcccccccggcggcctgagccaggaccaggtggaacgatgcatgggagcgatgcaagagggtatgcagatggtgaaactcagagggggcagtaagggactagtgcgcttttactatttggacgagcaccggagttgtatacgatggagaccctcccgcaagaacgaaaaggctaagatctcaattgactctattcaagaggtttccgaggggcggcagtccgaggtgttccagcggtacccagacgggagcttcgatcctaactgctgtttctctatctaccatggcagccaccgagagagtctggacctggtgtctacaagttcagaagtggcaagaacttgggtgacaggcttaagatatcttatggccgggatctctgatgaagacagccttgcgagacgacaaaggacacgggaccaatggctgaaacaaacatttgacgaggcggacaaaaacggcgacggttctttgagcataggtgaagtgctgcagctcctccacaagttgaacgtcaacctgcctagacagcgagttaagcagatgttcagggaggctgatacagacgatcaccaggggaccttgggctttgaagagttttgtgccttctataagatgatgtccacccggagagacttatatctactgatgctcacctattctaaccacaaggaccatttggacgctgcctccctgcagcgatttcttcaggtcgagcaaaaaatggcaggagttactctggaatcctgtcaggacataattgagcagtttgagccatgtcctgagaacaagtctaagggtctgctcggcatcgacgggtttaccaattatacaaggagtcccgccggggacatcttcaacccagagcaccaccatgtacaccaagatatgacgcagcctctgtcccattactttattaccagcagtcacaacacatacctcgttggcgaccagcttatgtcgcagtctagggtggatatgtacgcatgggtgctgcaggccggctgcagatgtgtggaggtggattgttgggatggcccagacggagagccaattgtgcatcatggatacacactgacatcaaaaattttattcaaagacgtgatcgagaccattaacaaatacgcctttattaagaatgaatatcctgtgattctgagcatagagaatcattgctcagtgatccagcaaaagaagatggctcagtacctcactgatatcttgggcgataaactcgacctatcttctgtatcaagcgaggatgcgacaactcttccaagcccccagatgttgaagggcaagatacttgtcaaaggcaagaagctgccagccaatatcagtgaggacgctgaggaaggtgaggttagcgatgaggatagcgcggatgaaattgacgatgactgtaagctgctgaacggcgacgcaagtaccaaccggaaaagagtcgaaaacaccgcgaagcgcaagctggactcgctgattaaggagagcaaaatccgtgactgtgaagaccccaataatttttccgtttctactttgtccccatcggggaagctcggccggaaaagtaaagccgaggaggacgtcgaaagtggagaagacgcaggggctagtaggaggaacgggagattggttgtcggttcctttagccgcaggaaaaagaagggctccaagcttaaaaaggcagcaagcgttgaagagggcgatgagggccaggactctccgggcgggcaatccagaggagctacgagacaaaagaaaacgatgaaactctccagggctctgtctgacctggttaaatacaccaaatccgtcgccacgcacgatatcgagatggaggccgcatcttcatggcaggtgtcttctttcagtgaaacaaaagcccaccagattctccagcagaagcctgctcaatacctccgcttcaaccagcagcagctctctagaatctacccctcaagttacagagtcgattcttcaaattataatcctcagccattctggaacgccggatgtcaaatggtcgccctgaattatcaatccgagggccggatgctgcagctgaaccgggctaaatttagcgctaatgggggctgtggttacgtgctgaaacccgggtgtatgtgccaaggcgttttcaatcccaactctgaagatcctctgcccggacaactcaagaagcaactcgttctgcgcatcataagcggtcagcaattacctaagccaagagactcaatgctaggcgaccgcggagagattatagacccctttgtcgaggtggaaataatcggcctgcccgtggactgctcccgtgaacagactcgggtggtggacgataacggattcaaccctacatgggaggagacccttgtgttcatggttcatatgcctgagatagccctggtaaggttcctggtctgggaccacgacccgattggtcgggatttcataggacagaggacactcgccttttctagtatgatgcctgggtatcgccatgtctacttggagggtatggaggaagctagtatatttgtgcatgttgcggtgagtgatatctctggcaaggtgaagcaggccctggggttgaaggggttattcctacgtggtccgaaacctggcagccttgatagccacgcggctggacgaccgcccgcacgcccaagcgttagtcaaagaatcctacgacggacagcctctgctcctaccaaatctcaaaaacccgggagacgaggatttcccgagctcgtactggggactcgggatacagggtccaaaggggtggccgacgacgtggtaccaccagggccaggaccagcaccagaggctcctgcgcaggagggccctggatccggctcgccccgtgggaaagctccagccgccgtggccgaaaaatctcccgtaagagtgaggcctcctagggtgttagacggccccgggcctgccggcatggccgctacctgtatgaagtgcgtcgttggctcatgcgctggggtcaacacagggggtttgcagcgagaacggcccccatcccccggacctgcttctcggcaggctgctatcagacagcagcctcgggctagggccgatagccttggcgctccctgctgcggactcgacccgcacgccattcctgggcgcagcagagaggcgcccaaaggcccaggagcatggcgtcagggtcccggcggatcaggtagtatgtcgtctgactctagcagcccagacagcccaggtattcctgaacggtctccacggtggccagagggagcatgccgccagcctggcgccctccagggcgaaatgtccgccttattcgctcagaagctcgaagaaattagaagcaaatcacctatgttttccgctgtgcggaactag

SEQ ID NO: 199530 - DNA, 1827 bp, Artificial Sequence
  Description of Artificial Sequence: Synthetic coding sequence
atggagatgcggtggttcctgagcaagatccaggacgacttccgggggggaaagataaacctcgagaagacccagagactgctggagaaacttgacatccggtgctcctatatccacgtaaaacagatttttaaagacaacgataggcttaagcaaggaaggatcacaatcgaggaatttcgagctatatatcggataattacccatcgagaggagataatcgaaatattcaatacctactccgagaaccggaagatattattggcttccaatttagcgcagtttcttacccaagagcagtatgcagcagaaatgtccaaagcaatcgccttcgaaattatccagaagtacgaacccatagaggaagttagaaaagcgcaccagatgtccctggaggggtttacgaggtatatggactctcgggaatgcttactctttaagaacgaatgtaggaaggtgtatcaggacatgacccacccattgaatgactacttcatcagttcctcacataatacttatctagtgagcgaccaactccttggtccctctgacctgtggggatacgtgagcgccctggtcaaaggctgtaggtgtttggagattgactgctgggatggcgctcagaatgagcccgtcgtgtatcacggatacacactgacatcaaagctcttgtttaagacagtgatccaggcgatccacaaatacgcttttatgacttcggattatccagtggttctcagccttgaaaaccactgttcgacggcgcagcaggaggtgatggcagacaacctgcaggccacgttcggagaatctttgctctcagatatgctggatgatttcccagatacccttccatctcccgaagcgctgaaattcaagatcttagtgaagaacaagaagataggaactcttaaggagacccatgagcggaagggttcggataaacgcggagacaatcaggacaaagagactggggtgaagaaactgccgggcgtcatgctcttcaagaaaaagaagactagaaaactaaaaatcgccctagctctttcagacttggttatctatacaaaggcagagaaatttaagtcttttcaacacagcagactgtaccaacagttcaacgagaacaattccatcggcgagacacaagctagaaagctctccaagctccgagtgcatgagttcatttttcacactcgaaagttcattactcgcatatatcccaaggcaacacgtgcagatagcagcaactttaacccccaggaattctggaacattgggtgtcagatggtggccttgaactttcaaactccaggactgcctatggacttgcaaaatggaaaatttctcgacaacggagggagcggctatatcctaaagccgcactttcttagggaaagcaagtcttatttcaatcctagcaatatcaaagaaggcatgccaatcacattgacgatccgcttgatatcggggatccagctccccctgactcactcatcatccaacaagggcgactccttggtgattattgaagttttcggcgtgccgaacgatcagatgaaacagcaaacaagagtcataaagaagaatgcattctccccacgatggaatgagacttttacattcattatccatgtacccgagctagcactgatcagattcgttgtggaaggccaaggcctgatagcaggcaatgagttcctgggtcagtataccctccccctgctttgcatgaacaagggatatcgaaggatcccacttttcagcagaatgggggagtctctcgagcccgccagtctgtttgtgtatgtgtggtacgttagatag

SEQ ID NO: 199531 - DNA, 1242 bp, Artificial Sequence
  Description of Artificial Sequence: Synthetic coding sequence
atgcggtggttcctgagcaagatccaggacgacttccggggcggcaaaataaacctcgaaaaaacacagcgtctcctggagaaattggatattcgatgcagttatattcatgtgaaacaaatctttaagaccagtgattaccccgtggttctgagcttggaaaatcactgctccaccgcgcagcaggaagtgatggccgacaacttgcaggcaacattcggagagagtctgctcagcgatatgctggacgattttcctgacacactgccgagtcctgaggctctgaaattcaaaattctggttaagaacaagaaaattggtaccttgaaagagacacacgagcggaaaggatctgacaaaagaggcgataatcaggataaggaaacgggggtgaaaaagctgcccggggtaatgcttttcaagaagaagaagactcgaaagttgaagatagcgctcgctctgagcgaccttgtgatttacacaaaagccgagaagttcaaaagcttccagcatagcaggttataccagcaattcaatgaaaacaactccataggcgagacccaggcgcgcaaactgtccaaactacgggtgcacgagttcatctttcacacccgaaagtttataacacgtatctatccgaaagccactagggcagattccagcaattttaatccccaagaattttggaatattgggtgccaaatggtggcgctgaacttccaaacgccaggattgccaatggacctgcaaaatggcaagtttcttgacaatggcggtagcggatacattctgaagcctcactttttgcgagagagcaagagctacttcaaccctagcaatataaaggagggcatgccaattacgcttaccattagactcatttcagggatccagctccctctgacccattcatccagcaacaaaggtgactccttggtgataatcgaggtcttcggcgttcctaatgaccagatgaaacaacaaactcgtgtcattaagaagaacgccttttctccaaggtggaatgagacctttacattcatcatccatgtgcctgaacttgcattaattaggtttgtggtagaaggacagggcctgatagcagggaatgagtttctcggccagtatacccttcctctgttatgtatgaacaaagggtaccgcaggatcccactgttctctagaatgggtgagtcactggagccagcctccctttttgtctacgtgtggtatgtccgatag

SEQ ID NO: 199532 - DNA, 1821 bp, Artificial Sequence
  Description of Artificial Sequence: Synthetic coding sequence
atgcggtggttcctgagcaagatccaggacgacttccggggcggcaagattaacctcgaaaaaacccagcggcttctcgaaaaactcgacatcaggtgctcctacatccatgttaagcagatttttaaagataatgatcggctgaaacaggggagaatcacaatcgaggagtttagggcaatctacaggattattacgcaccgggaagagatcatcgagatctttaacacatactcagaaaatcgaaagatcctgctggcttcaaatttagcacaattcctcacacaagagcaatatgcagctgaaatgagtaaggcaatcgcattcgagattatccagaaatatgagccaattgaggaagtaagaaaggctcatcagatgagcctggagggcttcacccgctatatggattcaagagagtgtcttttatttaaaaacgagtgtcggaaggtgtaccaggacatgacccatccactgaatgactattttatctcttcatctcacaatacatacctggtgtctgatcaactgctgggcccctccgatctgtgggggtacgtcagtgcactggttaaaggctgccggtgtctggagattgactgctgggacggagctcaaaatgaaccagtggtgtatcacggctataccttaacatccaagctcctgtttaaaaccgtgattcaggccattcataaatatgcatttatgacgtccgattacccggtggtcctttccctggagaaccattgttcaacggcacagcaggaagtgatggccgataatcttcaggctaccttcggagagagtctcttgagtgacatgttggacgacttccctgacacactcccatctcccgaggctttaaagttcaaaattttagttaagaataagaagatcggcaccctgaaagagacccatgagcgtaaagggtccgacaagcggggtgataatcaggacaaggaaacaggtgtgaaaaaattacctggggtgatgctgttcaagaaaaaaaaaaccaggaagttaaaaatcgccttagctttgtctgatttggtgatctacacaaaggctgaaaagtttaagagctttcagcacagcaggttgtatcagcaatttaatgagaataattcaatcggggagacacaggccagaaagttgtctaaacttcgggttcatgagtttatctttcacacccgtaagtttataacgaggatctaccctaaggccacgagggccgattcgtccaatttcaacccccaagaattctggaatatcgggtgccagatggtcgctctgaacttccagaccccaggcctgcccatggatctccagaatgggaagttcctggataacggcggctctggatatatccttaagcctcatttcctgcgggagtcaaagagctacttcaatcctagtaacattaaggaagggatgcctattactctgactattagactcatctctgggatccaacttcctctgacacattctagcagcaataagggggacagtcttgtgattatagaggtcttcggcgtcccaaacgatcaaatgaagcagcagacccgcgtgatcaaaaagaatgccttctctccaagatggaacgagaccttcacatttatcatccatgttcccgaattggctctgattcggtttgtggtcgaaggccaaggcctgattgccgggaatgagtttctgggtcagtatactctccctcttctttgtatgaacaaaggataccgtaggataccattgtttagtcgcatgggggaaagccttgagccggccagtcttttcgtgtatgtttggtacgtcagatag

SEQ ID NO: 199533 - DNA, 1248 bp, Artificial Sequence
  Description of Artificial Sequence: Synthetic coding sequence
atggagatgcggtggttcctgagcaagatccaggacgacttccggggtggaaaaataaatcttgagaagacacagcggctgctcgagaagctggatatcagatgctcatacatacatgtgaaacagatcttcaaaaccagcgattaccccgtagtgctgagccttgaaaaccattgtagcaccgcgcaacaggaggtgatggccgacaacctgcaagccaccttcggggagtccctgctgtcagatatgttagatgattttcccgacacactccctagtccagaagccctgaaattcaagatcctggtgaaaaacaaaaaaatcgggactctgaaggaaacccatgagcgcaagggaagtgataaaagaggggataatcaggacaaagaaactggcgtgaagaaactgccaggggtgatgttgttcaagaagaaaaagacccgcaagctgaagatcgcgctggccctcagtgatctcgtaatctacaccaaggccgaaaagtttaaatcttttcagcatagcagactgtaccagcaatttaacgagaataatagcatcggggaaacccaggctcggaaactttccaagctaagagtgcatgaattcatctttcacacccggaaattcataacccgcatttaccctaaagcaacaagagcagactcctccaacttcaatccccaagagttctggaacatcggttgtcagatggtagccctaaactttcagaccccagggttgccaatggacctgcaaaacggaaaattcctggataatggtggatcaggatatattctgaagccccactttctacgagagtctaaaagttacttcaatccatcgaacataaaagagggcatgccgattacattgaccatcaggctgatctccggcatccagctgccactgacacactctagttctaacaagggcgatagtctggtaattatcgaagtgttcggcgttcctaatgaccagatgaagcagcagacacgcgtgatcaagaaaaatgcattcagccccagatggaacgaaaccttcacgtttattattcacgtacctgaactcgccctcattcgttttgtggtggagggacagggacttatcgctggcaatgaattcctggggcaatatactttaccgctcctctgcatgaataaaggctatcgacgcataccgcttttttctagaatgggggagtctctggagcccgcctcacttttcgtatacgtatggtacgtgcgatag

SEQ ID NO: 199534 - DNA, 1212 bp, Artificial Sequence
  Description of Artificial Sequence: Synthetic coding sequence
atggacagccgggagtgcctgctgttcaagaacgagtgccggaaggtgtaccaagacatgacacaccctctcaatgactatttcataagtagctcacataatacatatctcgtaagcgaccagcttctcgggcccagtgatttgtggggctacgtgagcgcactcgtgaagggttgtaggtgcctcgagattgactgttgggacggagctcagaatgagcctgtcgtgtaccatggttatacactcactagtaaactgctgttcaagaccgtgattcaggccattcataaatacgcctttatgacgagtgattacccagtggttctgtcacttgagaaccattgctccactgcccagcaggaggttatggccgataatcttcaagccaccttcggggagagccttcttagcgatatgctggacgacttcccagacactctacccagccctgaagctcttaaatttaagatcctggtgaagaacaaaaaaattgggaccctcaaggagacacatgaaagaaaagggagcgataaacggggcgacaatcaggacaaggagacaggcgtcaagaagctgccaggtgttatgctcttcaagaagaaaaaaactcggaaattgaaaattgccttggcactgtctgatttagtgatttacaccaaggccgagaagtttaagtccttccagcactcaagattgtatcaacaattcaacgagaataattctatcggggagacccaagctaggaaactcagtaagctgcgggtccacgaattcatattccatacacgcaaatttattacgcgcatataccccaaagccacgagagctgactcatcgaacttcaacccccaggagttctggaatattgggtgccagatggttgcactgaatttccagaccccaggcctacccatggatttgcagaatggcaagtttctcgacaacggcggaagcggctatatcctaaaaccccactttcttagggagagcaaatcttatttcaacccttccaatataaaggagggaatgcccattacactgacgatacgcctgatctccggtatccaattgccactcacccactcatcttccaataagggcgacagtctcgtgatcattgaggtgttcggcgttcctaatgatcagatgaaacagcagacacgggtgatcaaaaagaacggccagggaaatatggtcattatccctgcatag

SEQ ID NO: 199535 - DNA, 3387 bp, Artificial Sequence
  Description of Artificial Sequence: Synthetic coding sequence
atggccgactgcgtgcggggctgggccgccgtgggcggcgccctgccaaccagtccagggccttctctgggagccaaaggggctctgaaggccggcgttggagaggacggagttggcggcggacgtctggtgcatgggcgagccaggtatgactctggcggcgtgagcaacggagattgtagcctaggcgtttccggtgacgaagcccgcgcgagcccaactagaggaccaagaggagtggccctagcacctacccccagtgccgtcgtttgtaccctacctcgagagagtaaacctggtgggcttccaagacgctcaagcatcatcaaggacggaaccaaacaaaagagagaaaggaagaagaccgttagcttctccagcatgccaacagaaaagaagatctcgagcgccagcgattgtattaacagcatggtggaggggtcagagctcaagaaagttagatccaatagtcggatctaccataggtacttcctgttggacgcagacatgcagtctctgaggtgggaaccatcaaagaaggactctgagaaagcgaagatagatatcaagagcattaaggaggtgcgaaccgggaagaacaccgatatttttagatccaacggcatctctgaccagatctccgaggattgtgcgttctcagtgatttatggcgagaactacgagtctttggacctggtagcaaacagcgccgatgtggccaatatttgggtgaccggactgaggtatcttatcagctatggcaaacacacactggacatgcttgaatcctcacaagacaatatgaggacaagttgggtgtctcagatgttcagtgagatagacgtcgacaatctgggccacatcactctttgtaatgccgtgcagtgcatccgcaaccttaacccaggattaaagacctcgaaaatagagctgaaatttaaagaactgcacaagtccaaagacaaggccgggactgaggtcacaaaggaagagttcattgaggtatttcacgaactttgcacccggcccgaaatctacttcctgcttgtccagttttcctcgaacaaagagtttctagatacaaaagacctcatgatgttcctcgaggcagagcagggggttgctcatattaatgaggaaatttcactggagattattcataagtacgagcctagcaaagagggccaagaaaagggatggctttctattgatggatttacaaactacctaatgtcacctgactgttatattttcgatcccgagcataaaaaggtgtgccaagacatgaaacagcccctttcgcactactttattaattcttcccataacacctatcttattgaggaccagttcagaggacctagcgatattacagggtacattcgggccctgaagatgggttgcaggagcgttgaactggatgtgtgggacggaccagacaatgagcccgtcatatatacgggacacacaatgacgtcccagatcgtatttcgatcggtgatcgatattatcaacaagtacgcctttttcgcaagcgaataccccctgattctgtgcctggagaaccactgcagcatcaagcaacagaaggtgatggtccaacatatgaaaaagctcttgggcgacaaactgtataccacctcccccaacgttgaagagagctatctgcccagcccagatgtactgaaagggaagattttgattaaggccaagaagctgagtagtaactgctcaggggtggagggcgacgtcaccgacgaggacgaaggagcggagatgagccaacgcatgggtaaagaaaatatggaacagcccaacaacgtgcccgtcaaacgtttccagctgtgcaaggaactaagtgagctggtcagcatttgtaagtctgtccagttcaaggagttccaggtgtctttccaggtgcagaaatattgggaagtatgctcctttaatgaagtgctcgcatctaagtatgctaacgagaaccctggagacttcgttaactacaataagaggttccttgcccgggtcttcccatccccgatgcgaattgattcttccaatatgaatcctcaggatttttggaaatgtggatgccagatcgtggccatgaacttccaaactcctgggttgatgatggacctgaacattggatggttcagacaaaacggtaactgtggatacgttctgcgacccgccatcatgagagaggaggtgtcgttcttctctgcgaacactaaggactcagtgcccggggtgagccctcaactgctacacatcaaaattatctccgggcagaacttcccaaaacctaagggatccggggccaagggcgacgtagtggatccttatgtgtacgtcgaaattcacgggatccctgctgattgcgccgagcagcgcactaaaactgtccaccaaaacggggatgcgccaatttttgatgagtcttttgagttccagatcaatttaccggagctcgcaatggtgagatttgtggtgttggatgatgactacatcggtgatgagtttatcgggcagtacactatcccttttgaatgcctgcagacaggctatcggcacgttccacttcaaagtctgaccggtgaggttttggcacacgccagcttattcgtgcacgttgccatcactaatcgaagggggggcggaaaaccacataaacgcggcttgagtgtccgaaaaggtaagaagtctcgagagtacgcaagcctcaggactctatggattaaaaccgtggacgaggtgttcaaaaacgctcagccccctattcgagacgcaaccgacctgcgtgaaaacatgcaaaatgcagtagtgagcttcaaggagctatgtggcctgtcctcagttgccaacctaatgcaatgtatgcttgctgtctcccccagatttcttggacccgacaacacaccactggttgtgctaaacctgtccgagcagtatccaactatggaactgcagggcatcgtgcctgaagtactgaaaaaaatagttacaacctacgacatgatgattcaaagcctcaaagctctcattgaaaatgcagatgctgtctacgagaagattgtgcattgtcagaaagctgcaatggagttccacgagcaccttcattctataggcaccaaagaaggtttaaaggagaggaaactgcagaaagctgtggaaagcttcacttggaatattaccatcttgaaggggcaagcagatctactaaaatatgctaagaacgagacgctggagaatctcaaacagattcacttcgcagctgtaagctgtggactgaacaagcccggcacagagaacgcggacgtgcagaagcctagacgcagtctagaagtgattcccgagaaagccaatgacgaaacaggtgaatag

SEQ ID NO: 199536 - DNA, 2883 bp, Artificial Sequence
  Description of Artificial Sequence: Synthetic coding sequence
atgcccaccgagaagaagatcagcagcgccagcgactgcatcaacagtatggtggaggggtccgagctgaagaaagtacgatccaacagtaggatttaccaccgctacttcttactggacgcagatatgcaaagtctcagatgggaaccgagtaaaaaggatagtgaaaaggcaaagatcgacattaaaagcatcaaggaggtgcgaacgggaaagaatacagatatcttcaggtccaacggaattagtgaccagatcagtgaagattgcgcgtttagcgtgatttacggcgaaaattatgaaagcctagacttagttgcaaactcagccgacgtggccaatatatgggtaaccggcctgcgatatctgattagctacggcaagcatactctggatatgttggagtcatcacaggataacatgcggaccagctgggtgtcccagatgttctcagagatagacgtggacaacctgggtcacatcaccttgtgcaatgctgttcagtgcatccgtaacctgaatcctggtctaaaaaccagcaaaatcgagctaaagttcaaagagttgcacaaatctaaggataaggcaggcacagaagttacaaaggaagaatttatcgaggtctttcatgaactgtgcaccagacctgagatttactttctcctcgtgcagttttcatcaaataaagagtttcttgatactaaggatctgatgatgtttctcgaggcggagcagggtgtggcccacattaacgaagagatctccctcgaaataattcacaagtacgagccgtcgaaagagggacaagagaaaggctggctgtctatcgatgggttcaccaactatctgatgtccccggattgctatatttttgatcctgagcataagaaagtgtgccaggacatgaaacagccactgtcccattactttattaacagttcccataacacatacctcatagaagaccagtttaggggaccgtcagatattactggctacattagggccctgaagatgggctgccgttctgtcgagttggacgtgtgggatggccccgacaatgaacctgtaatttataccggacatactatgacctctcagattgtttttcggagtgttatcgatatcattaacaagtatgcattttttgcctccgagtacccactgattctgtgtctcgaaaaccactgctccattaaacagcagaaagtgatggtacagcacatgaaaaaacttctaggggataaactttacaccaccagccccaatgtggaggaatcttacctgccctcccctgatgtcctgaaaggaaaaattctgataaaagccaagaagctcagctctaattgttcgggcgtggagggtgatgtgaccgatgaggatgagggggccgaaatgagtcaacgaatgggcaaggagaatatggagcaacccaacaacgtaccagtgaagaggttccagttatgcaaggagctgtctgagctcgtcagcatttgtaagtctgttcaatttaaagaattccaggtgagcttccaggtacaaaagtactgggaggtgtgctccttcaatgaggtgcttgcctcaaagtatgccaatgagaatcctggggattttgtaaattacaataagaggtttctcgcaagagtgttcccgtctcccatgaggattgactctagcaacatgaatccacaagatttttggaagtgtggatgccagatcgtggctatgaatttccaaacccctggtcttatgatggatctgaacatcgggtggtttagacagaacggtaattgtggatatgtgctgcggcctgctataatgcgagaggaggtgagtttcttttccgccaataccaaggactcagtcccgggcgtaagtccccagcttttgcacatcaagatcatcagcggccaaaacttcccaaaacctaaaggatctggagctaaaggcgatgtggtggacccttatgtgtatgtagagattcatggcattcctgcagattgtgccgagcagcgcaccaagaccgtacaccagaacggcgatgccccaattttcgacgagtctttcgaattccagatcaaccttccggagttagccatggtgcggttcgtggtcttagatgacgactacatcggcgacgagttcatcggacagtacaccatcccatttgagtgtctgcagaccggttataggcatgtccctctccaatccctcaccggagaagtcctagctcatgcttccctctttgtgcatgtggccataaccaatcgcagaggaggcggcaaaccccacaagcgcgggctcagcgttcggaaaggcaagaagtcgcgggagtacgccagtctgagaacactctggatcaagacagtggatgaagtattcaagaatgcccagccaccgattcgggacgccactgatctccgggagaatatgcagaacgctgtcgtttcgttcaaggaactctgcggactgagcagcgttgctaaccttatgcagtgtatgctggccgtgtctccacgtttcctgggccctgataatacaccactggttgtgctgaatttgagcgaacagtatcctaccatggaattgcagggcatcgtgccagaggtgttaaagaagattgtgacaacctacgacatgatgatccagagcctgaaggcgttaattgagaacgctgacgccgtctacgaaaagattgtacactgccagaaggcagccatggaatttcacgaacacttgcactccatcgggacaaaggagggtctcaaagagcgaaaattacaaaaagccgttgaaagcttcacatggaacattactatcctcaaaatcaggaagaccggaaggaggtccattttcgtgccgcagacgccaatcatggtttag

SEQ ID NO: 199537 - DNA, 3006 bp, Artificial Sequence
  Description of Artificial Sequence: Synthetic coding sequence
atgcccaccgagaagaagatcagcagcgccagcgactgcatcaactctatggtagagggatccgagttgaaaaaagttcgatccaacagccgtatctaccataggtacttcttactcgacgctgacatgcagtccctgagatgggagccttccaagaaagattctgagaaagctaaaatagacatcaagtcgataaaggaagttcggaccggcaagaacacagatattttccgatccaatggaatatctgaccagatctctgaggactgcgcgttttccgtgatctacggggaaaactatgaaagcctggacctagtagccaatagtgcagatgtggccaatatttgggtgactggacttcggtatttgataagctatggtaagcacacccttgacatgctcgaaagcagccaggacaatatgcggacatcctgggtgagccagatgttttccgagatcgacgtggataacctagggcatatcacgctctgtaatgccgttcagtgcatcagaaaccttaatccaggcctaaagacctccaagattgaactgaagttcaaagagctgcataaatccaaggacaaggcaggcactgaagtgactaaagaggaattcattgaggtctttcacgaactctgtactcgacccgaaatatatttcctcctcgtgcagtttagcagtaacaaggagttcctggacacaaaggacttgatgatgttccttgaggcagagcagggggtggcacatattaacgaggagattagccttgagataattcacaaatatgagccaagcaaggagggacaggagaaagggtggctctctatcgacgggttcaccaactacttgatgtctccagactgttacattttcgaccctgaacataagaaagtgtgccaggacatgaagcagccattatcacactacttcattaactctagccacaatacctatctgatcgaagaccagttccgtggaccaagcgacattacggggtacatccgcgctctgaagatgggctgtaggtctgtggagctggacgtgtgggatggccctgacaacgaacctgttatttacactgggcatactatgacttctcagattgtcttcagatccgtgattgacataattaataaatacgcgttttttgcaagtgaataccctttgatcttgtgtttggaaaaccactgttccattaagcaacagaaggtgatggtgcagcatatgaagaaactgctcggagacaaactgtacaccacttcgccaaacgtggaggagtcgtacctgcccagtcctgatgtgctgaagggcaagattcttatcaaggccaagaagctctctagcaattgctctggggtggaaggtgatgtgaccgacgaggacgagggagctgagatgagccagaggatggggaaggagaatatggaacagccaaacaacgtcccggtgaagcggttccagctgtgcaaagagcttagcgaattagtttcaatttgcaaaagcgtgcaattcaaagagttccaggtgagctttcaagtccaaaagtattgggaagtgtgctcattcaacgaagtactggcgtccaaatatgccaatgagaaccccggtgatttcgtcaattataacaagcggttcctagcccgggtctttccttccccaatgcggatcgactcttccaacatgaatcctcaggatttctggaaatgcggctgccagatcgtcgcaatgaacttccagacccctggattgatgatggatctgaacattggttggttcagacagaatggcaactgtggctacgtactgcgacccgccataatgcgcgaggaagtgtccttctttagtgctaatacaaaggacagtgttcccggagtttcccctcaactcttgcatattaagatcatctccggacagaatttcccaaagcctaaaggcagcggtgcgaaaggggacgtcgtcgatccatacgtttatgtcgagattcatggaattcccgccgattgtgctgaacaaaggacaaagacagtgcaccagaacggcgatgctccaatttttgatgagagcttcgaatttcagattaacctcccagagctggcaatggtccgctttgtggtgcttgacgatgattacatcggcgatgaattcatcgggcaatacactattccctttgaatgtctccagactggatatcgacacgtccccttgcaatcgttgaccggagaagttctggcccacgcatccctctttgtacacgtggcaattacaaatcgccggggcggaggcaaacctcataaaagaggcctgagtgtgaggaaaggcaagaagtctagagaatatgccagtctccgcaccctctggattaagacagtggatgaagtgtttaaaaacgcccagcctcctattagggatgcaactgatctgcgtgaaaatatgcagaatgccgtggttagctttaaggagctttgtggtctgagcagcgtcgcgaatctaatgcaatgcatgttagccgtttctcctcgctttctgggacccgacaatactccgcttgttgtcctgaatttgtctgagcagtatcccactatggaactgcagggaatcgtgcccgaggtgctgaaaaaaattgttacaacctatgatatgatgatccagagtttgaaagcactgatcgaaaatgccgatgccgtatatgagaaaattgttcattgccagaaagctgcaatggaatttcatgaacacctgcactccattggtactaaggagggactgaaagagaggaagttgcagaaggccgtggagagcttcacctggaacataaccattctgaagggccaagccgatttgctgaaatatgcaaagaacgagacgctcgaaaatctgaaacagattcacttcgccgcagtctcctgcgggctcaataagccaggaacggagaatgccgacgtacagaaacctcgccgctcgctggaagtgattcccgagaaagccaacgacgagacaggggagtag

SEQ ID NO: 199538 - DNA, 3006 bp, Artificial Sequence
  Description of Artificial Sequence: Synthetic coding sequence
atgcccaccgagaagaagatcagcagcgccagcgactgcatcaactctatggtagaagggagcgaactcaagaaggtaagaagtaattccaggatttaccatagatatttcttactggatgcagatatgcagtccctgcggtgggagccatctaagaaggatagcgaaaaagctaaaatcgatattaagagtatcaaggaggttcgcacgggtaagaataccgacatattccggtccaatggaatctccgatcagataagtgaagactgtgctttcagtgtgatatatggggagaactatgaaagtctggatctcgttgccaacagtgccgacgtggcaaatatctgggtcacgggcctgaggtacctgataagttacggtaagcacaccctcgatatgcttgagagcagtcaggacaacatgcgcacttcgtgggtctcccagatgttctccgaaattgatgtcgacaatctcggacatatcacactgtgtaatgctgtgcaatgtatacgcaacttgaaccccggattaaagacctccaaaattgagctgaagttcaaagagcttcacaagagtaaggataaggcagggaccgaggtcactaaggaggagttcatcgaggtcttccatgagctgtgcaccagaccagaaatttactttctgttagtgcagttctccagtaataaggaatttctggacacaaaagatttgatgatgtttcttgaagctgaacaaggcgtggcacatatcaacgaggaaatttcgcttgagataatccacaaatatgagcctagcaaggagggtcaggagaagggctggctgtccattgacggattcacgaactatttgatgagtcctgattgctatatcttcgatcccgagcataaaaaggtctgccaggacatgaaacagcccctgagccactactttattaactcctcacacaacacttatctgatcgaagatcaattcaggggtccctctgacattactggttatatccgcgcactgaaaatggggtgcagaagcgtcgaactggatgtttgggatggccccgataatgaaccagtcatttataccggacatacaatgacctcccagattgtatttcgtagtgttatcgacataatcaataagtacgcttttttcgcaagtgagtatccactcattctctgtctggaaaaccattgttccattaaacaacagaaggtcatggtgcaacatatgaaaaagctcctgggtgacaaactgtatacaacctcccctaacgtcgaggagtcatacctgccctctcctgacgtgctaaaaggcaaaatcttgataaaggcaaaaaagctgtcttctaactgttcgggcgtggaaggcgacgtcactgatgaggacgagggcgcagagatgtcccaaaggatgggcaaggaaaacatggagcaacctaacaacgttccagtcaaaaggttccagctctgcaaagagctgtccgagcttgtgtcaatttgcaagtcagttcagttcaaggaattccaggtgtcatttcaagtccagaaatattgggaagtgtgcagcttcaacgaagtcctagcatccaagtacgctaatgaaaaccccggggatttcgtgaattacaacaaacggttcctagcccgtgtgtttccctcccccatgcgtatagattcctctaacatgaaccctcaagacttctggaaatgcggttgccagatcgtggccatgaacttccagacacctgggctgatgatggacttgaatattggttggttccgtcaaaacggcaattgcggctatgttctgagacccgccatcatgagagaggaggtgtctttcttttctgccaacactaaggactctgttcccggcgtgagcccacagctactgcacatcaaaatcattagtggtcaaaactttcctaagcctaaaggatctggtgctaagggtgatgtggtagacccatacgtgtatgtggaaatccatggaatcccggcagattgcgcagagcagaggacgaaaacagtgcaccagaatggcgatgcccctatttttgacgagtctttcgaattccagataaaccttcctgaactggcaatggttaggttcgtggtgttagacgacgactacattggggatgaattcattggtcagtataccatccccttcgagtgcctgcagacaggatacagacacgttcctctgcagagtcttaccggtgaagtgttggcacatgcctccctgttcgtgcacgtggccatcacaaatcgccgaggcgggggaaagccccacaaacgaggattgtccgtccggaaaggcaaaaagtccagggagtacgcttctcttcgcactctttggatcaagaccgtggacgaagtgttcaagaacgcacagccccctatccgtgatgccaccgacctgagagagaacatgcagaatgcagtcgtgagcttcaaggagctgtgcggtctgagtagtgtggctaatctcatgcagtgtatgctggccgtgtctccacgctttttgggaccagataatactcctttggtcgtcttgaacctttctgagcaatatcccaccatggaactccagggtattgtccctgaggtgctgaagaagatagttacaacttacgacatgatgatccagagcctgaaggctctcatcgagaacgcagacgccgtttacgagaagatcgttcactgccagaaagccgcaatggaatttcacgagcacctgcattctatcggcacaaaagaagggctaaaagagcgcaagcttcaaaaggccgtagagagctttacgtggaatatcacgattctgaaggggcaagccgacctcctgaagtatgctaaaaacgagacactggagaacctgaagcagatccactttgctgcagtgtcctgtgggttgaataagcctggcactgaaaatgcagacgtccagaagcctcggcggtcactcgaggtgattcccgagaaagccaatgatgagacaggggagtag

SEQ ID NO: 199539 - DNA, 2802 bp, Artificial Sequence
  Description of Artificial Sequence: Synthetic coding sequence
atgaccgccacccccgagagcctgttccccaccggcgacgagctggattcctcccaattgcagatggaatcggacgaagtcgacaccctcaaagagggcgaggaccccgctgatagaatgcacccttttcttgcaatatatgagctgcagtcgcttaaggtgcacccactggtctttgcccccggtgttcctgtgaccgcacaagtggtcggcacagagcggtacacctccggcagcaaggtagggacatgtactctgtactctgtgcgcctgactcatggcgatttttcttggactacgaagaagaaatacagacacttccaagagctgcaccgagacctacttaggcacaaggtgctaatgtccctcctccccctcgcccgttttgccgtcgcatactctcctgcgcgcgacgccggaaatagggagatgcccagccttccacgtgccggacctgaagggtctacaagacacgctgccagcaagcaaaagtatctggagaattatctgaacagacttctgacaatgtcattctataggaactaccacgcaatgacagagttcttagaggtcagtcaactctcattcatacctgatctcggtaggaaaggtctcgagggcatgatcagaaagcgatcaggaggccacagagtgcctggcctcacatgttgtgggcgggaccaggtgtgttaccgctggagtaagaggtggctggtggtgaaggattctttcctcctatatatgtgcctggagaccggggccatcagttttgtacaactcttcgacccaggatttgaggtccaagtcgggaaaaggtcaactgaggcacggcacggcgtgcgcattgatacttcccacagatcgctgatccttaagtgcagttcttaccggcaggcccgatggtgggcccaagagattactgaattggcacaaggacccggtcgggattttcttcaacttcataggcatgacagttacgctccgcctcggccaggaactctggcccggtggttcgtgaatggggctggatactttgctgccgtggctgacgcaatcctgcgagcccaggaagagatattcatcacagactggtggctgtctccagaggtgtatttgaagcggcctgctcatagtgatgactggcggctcgacattatgctcaaaaggaaagcagaagagggagtgagggtgagcatactgctgtttaaggaggtggagttggctcttgggatcaacagcggatatagcaagagagctttaatgctgctccacccgaacatcaaagtgatgaggcatccagaccaggtgacattgtgggctcatcacgaaaagttgctagtggtcgaccaggtcgttgcattcctgggcggtctggaccttgcctatggcaggtgggatgacctccattaccgcctcaccgacctgggcgactcctcagaaagcgcagcctcgcagccaccaacacctaggcccgattcgcccgctacccctgatttaagccataatcagttcttctggctggggaaagattactcaaacttgatcaccaaagactgggtgcagctcgacaggccctttgaggacttcattgaccgtgagaccacaccaaggatgccttggcgcgatgtaggcgttgtggtgcacggcctgcctgcgagggacttggctagacactttatccaaaggtggaatttcacaaaaactaccaaggccaaatacaaaactcccacatacccctatctgctgcctaagtctacatcaaccgctaatcagctgcctttcacactgcccggtgggcagtgcacaacagttcaggtgttgcgatctgtggaccgctggagcgcaggtacgctagaaaactcaattctaaacgcttatctacatactatacgcgaaagtcagcacttcctgtacattgagaatcagttcttcattagctgttctgatgggagaacagtcctgaacaaagtgggcgacgagatcgtagataggatcctgaaggcccataaacaaggatggtgctatcgggtatacgtcctcttgcccttactaccaggattcgaaggcgatatctccacgggcgggggaaacagcatccaggccatcttgcactttacataccgcacgctgtgtcgcggtgaatattcaattttgcacagactgaaggccgccatgggcaccgcctggcgtgactacatctcaatatgcggacttcgcacccacggagagctcggaggccatcccgtgtccgagttaatttacatccactcaaaagtactcattgctgatgacagaactgtaatcatcggtagtgccaacattaatgatcgatccttactgggcaagcgtgatagcgaactggctgtgctgattgaggatacagaaaccgagcccagcctgatgaacggtgccgagtatcaggcaggacggtttgccctgtcactgaggaagcactgtttcggtgtaatactgggggccaatacgagaccggatctggacctcagggatcccatctgtgatgacttttttcaattgtggcaggacatggccgagtctaacgcaaacatctatgaacagatatttagatgccttccatccaacgctactcgatccttacgtactttgagggagtacgtcgccgtggaaccacttgcaaccgtcagtccccctctcgctagaagcgaattgacacaggtgcaaggtcatctggtgcatttcccgctcaaatttctagaggatgagtcgttactgccaccgctgggaagtaaagagggtatgataccactggaagtgtggacttag

SEQ ID NO: 199540 - DNA, 2769 bp, Artificial Sequence
  Description of Artificial Sequence: Synthetic coding sequence
atgaccgccacccccgagagcctgttccccaccggcgacgagctggattcctctcagctgcaaatggagtctgacgaagtggataccctcaaagaaggggaagatcccgccgatcgcatgcacccgttcctcgcaatctatgagttgcagagcctgaaggtacatcccttagtattcgcgcccggcgtgccagtgacggctcaagtggttgggactgaacggtacacttctggctctaaggttggaacgtgtactctgtacagcgttcggcttacgcacggcgacttcagctggactaccaaaaagaagtaccgacattttcaggagctgcaccgggatctactgagacacaaggtgttaatgtcactcttgcctttggctaggttcgctgtcgcctatagcccagcacgggacgccgggaacagagagatgccctccctgccaagagctggaccagaaggcagtacgaggcacgctgccagcaaacaaaagtatctcgaaaattacctaaatcggctgctcacaatgtccttctatcgaaactaccacgctatgaccgaatttcttgaggtgagccagcttagcttcataccggacttgggtaggaagggcctggagggtatgattcggaagcggagtgggggacatcgcgtacccggcctaacctgttgtggcagggatcaggtctgctatcgctggtcaaagcgttggctggtggtgaaggattcatttttgctctacatgtgtcttgaaacaggagccatttcgtttgtgcagctgttcgatcccgggttcgaagtccaggtcggaaaacgatctactgaggctagacatggagtgcggattgatacttctcacaggagcctcatcctgaaatgctcttcctacagacaggcccggtggtgggctcaagagatcacggagctagctcagggcccgggaagggactttttgcagctgcatcgtcatgattcctatgcgcctccacgccccggtacactggctaggtggttcgtaaacggcgccggttattttgctgccgtcgctgatgccatactgagggctcaggaagagatttttattaccgactggtggctgagtcccgaggtatatctaaagcgaccagcccactcggatgattggcgcctggatattatgttaaagaggaaggcagaagaaggtgtgagggtgagcatactcttgtttaaagaagtggagctggccctgggtattaattcaggctattccaagcgggctctgatgctcttacaccctaatattaaagtgatgcgacaccctgaccaggtcactctttgggcgcaccatgaaaaattactcgttgtagaccaagttgttgctttcctgggaggtctggatctggcttacgggcgctgggatgatcttcactataggcttacagacctgggagattcttcggagtccgctgcgagccaacctcccacccctcgaccagattctccggctactccagatcttagtcacaatcagttcttttggctgggtaaagactacagcaatctgattacaaaagattgggtgcaactggacaggccttttgaagatttcatagacagggaaacaacccctcgcatgccatggcgcgatgtgggagttgtggtccacggactgccagctcgggacctagcccgccacttcattcagaggtggaacttcaccaagacaactaaggccaagtacaagactcccacgtatccatacctgctgcccaaaagcacgtccactgccaaccagctgccgtttaccttacctggcggccagtgtacaactgtccaggttctaaggtccgtcgatcgctggtccgccggcactctcgagaactctatcctcaacgcctacctgcatactatccgcgagagccagcactttctgtacattgaaaatcagttttttatctcatgctcagatggtaggaccgtgttgaacaaggtgggagacgagatcgtcgataggattctgaaagcccacaagcaggggtggtgctacagagtatatgtgctgctacctctgcttcccggatttgaaggcgatatcagtacgggggggggtaacagcattcaggctatcctccacttcacttacagaactctgtgtaggggagaatatagtattcttcacagactgaaggccgcaatgggtactgcatggcgcgactacattagcatctgtggtttacgaactcatggagagttgggaggacaccctgtcagcgaactgatctacattcacagcaaagtgttaatcgcagacgatcgaacagtcattataggcagcgccaacatcaacgatcggtccttgcttggcaaaagagattctgagttagcggtgttgatagaagacacagaaactgagcctagtctgatgaacggcgccgagtaccaggcggggtccgtcatccttggagccaacacacgccccgatctggacctccgggaccctatttgcgacgattttttccagctttggcaagatatggccgaaagtaacgccaatatttacgagcaaatcttccgctgtcttcctagtaacgccacccgatccctgaggaccctccgcgagtacgtagcagtcgagcccctcgccacagtgagccccccattagccaggtcggagcttacccaggtccaaggccaccttgtgcattttcctctgaagtttctggaggatgaatccctactgcctcccctgggtagcaaggaaggcatgatcccactcgaagtctggacatag

SEQ ID NO: 199541 - DNA, 957 bp, Artificial Sequence
  Description of Artificial Sequence: Synthetic coding sequence
atggacaagcagaacagccagatgaacgccagccaccccgagaccaatctccctgttggctacccaccccaataccctccaaccgcgttccagggccctccgggatactccgggtatcccgggccccaggttagttatccccctcccccagccggccactctggtcctggccctgcaggattcccagttcccaaccagccagtatataaccagcccgtatataatcagcctgtcggagctgccggagtcccttggatgcccgcaccgcagccccctttgaattgtccccctgggctggagtacctctcgcagattgatcagatcttgattcaccaacagatcgaattgctcgaagtgctcacaggatttgaaactaacaacaaatatgaaatcaaaaattcttttggtcagcgggtctattttgcagcagaggatacggactgttgcacgagaaactgttgtgggcctagtcgcccctttaccttacggattatcgataatatgggacaagaagttatcactttagaaagacctcttcgctgctcttcctgctgttgtccatgttgtctccaggagatcgaaatccaggcgccccctggagtgcctatcggctatgttatccagacgtggcatccgtgtctgccaaaattcactatacagaacgagaagagggaagacgtgttaaaaatctccgggccatgtgtggtgtgttcctgctgtggcgacgtagatttcgagataaagagtctggacgaacaatgcgtcgtggggaaaatttcgaaacactggaccgggattctcagagaggcctttaccgacgcggataattttggaatacagttccctctggacctggatgtgaagatgaaagccgtgatgatcggggcctgcttcttgattgatttcatgttcttcgagtccaccggtagccaggaacaaaaatctggagtgtggtag

SEQ ID NO: 199542 - DNA, 93 bp, Artificial Sequence
  Description of Artificial Sequence: Synthetic coding sequence
atgaaggccgtgatgatcggcgcctgcttcctgatcgacttcatgttctttgaaagtacaggatctcaagagcagaaaagcggcgtctggtag

SEQ ID NO: 199543 - DNA, 750 bp, Artificial Sequence
  Description of Artificial Sequence: Synthetic coding sequence
atggacaagcagaacagccagatgaacgccagccaccccgagaccaatctgccggtgggctatcccccccagtacccacctactgcctttcaggggccacccgggtactcgggctaccctggcccccaggtcagctacccccctccgcccgctggccacagcggaccagggcctgccggctttccggtcccgaatcagccagtgtataaccagcccgtctacaaccagcctgtcggggctgccggcgtgccttggatgccagcacctcagccacccctgaactgcccacctggcttggagtacctctcacagattgaccagattctcatccatcaacagattgagctgctcgaggtgttaactgggttcgaaactaataacaaatacgagatcaagaactcatttggtcagcgggtctatttcgcagctgaagatacagattgttgtactagaaattgttgtgggccgtcaagaccttttacattgagaattatagataatatgggccaggaagttatcaccctggaacggcctcttcgatgcagcagctgttgctgtccttgttgtcttcaggagatcgagatccaagcaccacctggtgttcccattggatatgtcattcagacgtggcacccttgcttgcccaaatttaccatccagaatgagaagagagaggatgtgttgaagataagcggcccatgcgtggtctgctcttgttgcggcgacgtggatttcgagatcaagtcatag

SEQ ID NO: 199544 - DNA, 675 bp, Artificial Sequence
  Description of Artificial Sequence: Synthetic coding sequence
atgcccgccccccccccccccctgaactgcccccccggcctggagtatctctcacagattgacatgatactcatccaccaacagatcgagctgttggaggttctgttttctttcgaatccagcaacatgtacgagatcaaaaactcctttggtcagcggatatactttgccgccgaggacacgaatttttgtatacgaaactgctgtggccgctcacggccgttcaccctgaggataacggacaatgtcggcagagaggtgattaccctggagaggcctctaaggtgtaactgttgctgttgcccgtgttgtctgcaggagattgagattcaggcacctccaggcgttcccgtggggtacgtcacccaaacgtggcacccctgtctcactaaatttactataaaaaaccaaaagagagaggatgtgctgaaaataagtgggccttgtatcgtctgctcctgtatagctggagtggacttcgagatcacgagcttggatgaacagatcgtggtgggacgtatttccaaacattggtccggtttcctgcgcgaggcttttacagatgctgacaatttcggcatacagtttccacgcgacttagatgtcaagatgaaggccgtaatgatcggggcatgtttcttgattgactacatgttcttcgaaagaactcgatag

SEQ ID NO: 199545 - DNA, 486 bp, Artificial Sequence
  Description of Artificial Sequence: Synthetic coding sequence
atgcccgccccccccccccccctgaactgcccccccggcctggagtacctcagccagatcgacatgatcttgattcatcagcagattgagctgctggaggtgctgttttcatttgagtccagcaacatgtatgaaataaagaactcattcgggcagcggatatacttcgctgccgaagacactaacttctgcatccgaaattgctgcggccgttcccgccctttcacactaagaatcactgataatgtcggacgcgaggtgattacattggaacgcccccttcggtgcaactgttgttgttgcccttgctgcttacaggagatcgagattcaggcaccgcccggggtgcctgtgggatacgtgactcagacctggcacccgtgtctgacgaagtttaccattaagaaccagaaacgtgaggacgtgctgaaaattagtgggccatgcatcgtttgctcttgcatagcaggcgtggatttcgaatag

SEQ ID NO: 199546 - DNA, 894 bp, Artificial Sequence
  Description of Artificial Sequence: Synthetic coding sequence
atgcggagctggaacagcctgttctgcctgaacagcagccggcccccagggcatatcgtgtaccctaaacaccaagccggacataccggtaagcaggccgatcatctgggctctcaagccttttaccccgggagacagcatgactatttggttcccccagccggcaccgctggcattccggtgcagaatcagcccggacgccctgagggcgtgccgtggatgcccgctcctccgcctccactaaattgcccgccaggacttgagtatctgtcgcaaatcgacatgatcttgatccaccagcaaattgagcttttagaggtactcttctcctttgaaagcagtaacatgtacgaaataaaaaactctttcggccagagaatttattttgccgctgaagacacaaatttttgcatacggaattgttgcggaaggagtcgccctttcaccctccgaattacagacaatgtgggccgggaggtgataacgctggaacggccattgaggtgcaattgctgttgctgcccctgctgtctgcaggaaattgagatccaggctcctcccggagtacccgttggctatgtgacccagacctggcacccctgtttgactaagttcactattaaaaaccagaagcgcgaggatgtcttgaagatttctggtccgtgcatagtatgcagctgtatcgccggagtggactttgaaatcacatccttagacgaacagatcgtcgtgggcagaatatcaaagcactggtccggctttttgagggaagcctttaccgacgccgataactttggtatccaatttccccgcgatctggatgtgaagatgaaggcagtgatgattggagcatgcttcctaattgattatatgtttttcgaaaggaccagatag

SEQ ID NO: 199547 - DNA, 951 bp, Artificial Sequence
  Description of Artificial Sequence: Synthetic coding sequence
gtgagcgcccacctgcggttcttcctggccatcatcctgcgggactccgggctgtgggcagagtggcgaatgaaacctttccagatccacctcccggggccaccgggccatatcgtatatcccaagcaccaggccggtcatactggaaaacaggcagatcatttagggagccaggcattctaccccggacgtcagcatgattaccttgtcccacctgccgggactgcaggcatccccgttcagaatcagcctgggcgcccagagggcgtcccctggatgcccgcccctccgccgccattaaattgccctccagggttggaatatcttagccaaatcgacatgatcctgatccatcagcagattgagctcctggaggtcttgttcagctttgagtctagcaacatgtatgaaatcaagaactcatttggacaacgcatatatttcgctgcagaagataccaatttttgtattcgcaactgttgtggacggagcagaccctttacactccgcattacggacaatgtggggcgagaggtgattaccctcgaaagaccactccgatgcaactgctgctgttgcccatgctgtctgcaggaaattgagatccaagctccgccaggagttcctgttggctatgttacacagacctggcacccttgtctcactaagtttaccattaagaatcagaaaagggaggacgttctgaagatatccggcccttgcatagtctgtagttgcatcgcaggggttgattttgaaattaccagcctggatgagcagatcgtagtggggaggattagcaaacattggtctggttttttaagagaagcatttactgacgcggataatttcggaatccaattccccagggacttggacgtcaaaatgaaagctgtgatgatcggcgcatgcttcctgatcgactatatgtttttcgaacgtacccgatag

SEQ ID NO: 199548 - DNA, 888 bp, Artificial Sequence
  Description of Artificial Sequence: Synthetic coding sequence
atggccggctacctgccccccaagggctacgcccccagcccccccccaccatacccagttactccagggtaccctgaacccgctctgcacccaggacccgggcaggccccagtgccagcccaagtgcctgctcccgcaccaggattcgctttgtttccctccccgggaccggtagccctgggttctgctgcaccgtttctacctcttccgggggttccatctgggctagagttcttagtgcaaattgatcagatactgatacaccagaaggctgaaagggtggagacgtttctaggctgggagacctgtaatcgctatgagctcagaagtggggctggtcagcctttggggcaggcagccgaggaatccaattgctgtgctagactctgttgtggcgccagaaggcccctgagagtccgtttggcagatccaggagaccgcgaagtgttgcgactgttgcggcctctacattgtggctgctcttgctgcccttgcggtttacaggaaatggaagtccaagcgcctcccggcaccaccataggacatgtcctccagacctggcaccccttcctacccaaatttagtatccaagacgcggaccgacaaaccgttcttagagtggtgggcccctgctggacatgtggctgcggaaccgataccaactttgaggtcaaaacccgggatgagagcagaagtgtcggcagaatctcaaagcagtggggcgggttggtgcgggaagccctaacagacgccgacgactttgggctgcagttcccacttgatttggatgtccgggtgaaggccgtgctgctgggagctacctttctcattgactacatgttttttgagaagaggggcggcgctggaccctctgccgtgacgagctag

SEQ ID NO: 199549 - DNA, 672 bp, Artificial Sequence
  Description of Artificial Sequence: Synthetic coding sequence
atggccggctacctgccccccaagggctacgcccccagccccccccccccctatcccgttacaccggggtatccagaaccagcactgcatccaggccccggccaggccccggtgccagctcaggtccccgcacccgcaccgggatttgcactcttcccgtctcctggacccgtcgcactgggctcagcagctccgtttctgcctctccccggagtgccttccggcctcgaatttctggtccagatcgatcaaatcctgatccaccagaaagcggaaagggtggagaccttcctagggtggagacccgtcatcgggatgaattgtgccctcggccctgggagcccttgggttaggagaccccgtcgggcaacagctgcccctgtctgtgccgtggcacccgcaggtcgttgtgtgtcagcctggccaactcctggaactgtgagatgttgcgtctgcagcgctcggtgtactgtagccgcagcggcagcccccgttgcttcaaggcggtggaagtatcgcttacaccaggcaccccctctggctacctgctatcggccggggatccctagcagccctagcagcccttccaggatgcctattgcgcgccagtcctgtgagtggtggggccccgccggccccgtggctgtcgcccaaacacccaccctgcgatag

SEQ ID NO: 199550 - DNA, 888 bp, Artificial Sequence
  Description of Artificial Sequence: Synthetic coding sequence
atggccggctacctgccccccaagggctacgcccccagccccccccccccttatccagtcactcctggctaccccgagccagctctgcatcccgggcccggccaggcgccggtgcccgcccaagtaccggctccggcgccaggtttcgccctgttcccgtccccgggtcccgtggctttgggatctgccgctcccttcctgcctttgcccggggtgccctcaggcctggagtttctggtgcagatagatcaaattctgatccatcagaaggccgagagggtcgagactttcctggggtgggagacttgtaatcgttatgaattgagaagtggagcaggccaaccattggggcaggcggcggaggagagtaattgctgtgcgcgactttgttgtggtgctaggaggccgttgagggtgcgactcgctgatccaggagatagagaggtgcttagactcctgcgtccgctccattgtggatgttcatgctgcccttgcggcctacaggaaatggaagtccaggcccctcccggcaccacaattgggcacgtcttacagacctggcatccgttcctacccaaattctctatccaagacgctgaccgccagactgtattgagggtggtcggcccatgttggacctgcggctgtggcactgatacaaattttgaggttaagacgagggacgaatcgagatcagtgggtagaatcagcaaacagtggggcggtctagtcagagaagccttgacggatgctgacgatttcgggctgcagtttcctctggacctggatgtgcgggtaaaagcagttctactgggcgctaccttcttgattgattacatgtttttcgaaaagagaggcggagcagggccaagcgcggtaacctcatag

SEQ ID NO: 199551 - DNA, 888 bp, Artificial Sequence
  Description of Artificial Sequence: Synthetic coding sequence
atggccggctacctgccccccaagggctacgcccccagccccccccctccatatcccgtgaccccaggttaccctgagcccgccctgcaccctggtcctgggcaggctcctgtacctgcccaagtgccagcgccagcaccagggtttgcacttttccctagccccggcccagtcgccctgggatcagcagcccccttcctgccgctgcccggcgtgccctccggtttagaattccttgtccagattgaccagatcctcatccaccagaaggccgagagagttgaaactttcctgggatgggaaacctgcaataggtatgaactcagaagcggcgctgggcaacctttaggccaagcagccgaagagtccaactgctgcgcaagactttgttgtggagcgcgacgccccctcagggtacggctcgccgatcccggcgaccgggaagtgcttcggctcctcagaccccttcactgtggatgcagctgctgcccctgcggactgcaggagatggaggtgcaggctccaccaggcacgacgattggccatgtgctgcagacctggcacccgtttctccccaaattttccattcaggatgccgatagacagactgtgctgcgggtggtgggcccttgttggacatgtggatgcggcacagacacgaatttcgaggtgaagacaagggatgagtcacgaagcgtcggacgaatctcaaagcaatgggggggcctcgttagggaagctttgaccgatgcagatgattttgggttgcagtttccattggatttggacgtgcgggtgaaggccgtactactcggggctacattcctcatcgattacatgtttttcgaaaaaagaggcggagctggccccagcgccgtaactagttag

SEQ ID NO: 199552 - DNA, 990 bp, Artificial Sequence
  Description of Artificial Sequence: Synthetic coding sequence
atgagcggcgtggtgcccaccgcccccgagcagcccgccggcgagatggagaaccagactaaaccgcccgaccctaggccagacgcacctcctgaatataattcccacttccttcccgggccccccggcacagccgtgcctccgcctaccggttatcccggcggtctcccaatgggatactactctccacagcaaccctctaccttccccctgtaccagcctgtcggtgggattcatcccgtgcgatatcagccaggaaaatacccaatgcccaaccagtccgtccccataacatggatgccgggtcccacacctatggcaaactgcccaccaggcttagaatatctagtgcagttagacaatatccacgttctccagcattttgaaccactggagatgatgacctgttttgagacaaacaaccgttacgacattaagaacaactccgatcagatggtctatatagtgaccgaggacaccgatgactttacccggaatgcctacaggactctccggccttttgtgctgagagtgactgactgcatgggtagagaaataatgactatgcagaggcctttcagatgtacctgttgctgtttctgctgcccttccgcccgacaagagctggaggttcagtgcccgcctggagtcactattgggttcgttgcagagcactggaatttatgcagggctgtgtactccatacagaacgagaagaaggagaatgtcatgcgcgtgcgaggcccatgctccacttacggttgtggcagcgatagcgtatttgaggttaagagtctggacggaatctcaaacatcggcagtatcatccggaagtggaatgggttattaagcgctatggccgatgccgatcactttgacatccactttccactggacctcgacgtgaagatgaaggccatgatttttggcgcctgttttcttatcgactttatgtactttgagcgtagtccacctcagcgaagcaggtag

SEQ ID NO: 199553 - DNA, 720 bp, Artificial Sequence
  Description of Artificial Sequence: Synthetic coding sequence
atgagcggcgtggtgcccaccgcccccgagcagcccgccggcgagatggagaatcagactaaaccacctgatccccggcccgatgcgcctcctgaatataatagtcacttcctccccggccctcctgggacagccgtacctcctcctacaggataccctggtgggctgcctatgggctattactcccctcagcagccatcgacatttcctctttaccaacccgttggagggatccatccggttcggtaccagccaggcaaataccctatgcctaaccagtctgttccaatcacgtggatgcccgggccgacccctatggccaattgccccccgggtcttgaatatctcgtacagctggaagttcagtgccccccaggcgtcacaatagggtttgtcgccgagcactggaatctgtgccgggctgtttattcaattcagaatgagaagaaggaaaatgtgatgagggtcaggggcccctgcagcacctacggttgtggttctgacagtgtgtttgaagttaaaagtctggatggaatctctaacattggcagtattatccgcaagtggaacgggctgctctcggcaatggctgatgctgatcactttgacattcatttccccctagacctggatgtgaaaatgaaggccatgatattcggcgcctgctttctgatcgactttatgtactttgaacgaagcccacctcagcgctcccgatag

SEQ ID NO: 199554 - DNA, 990 bp, Artificial Sequence
  Description of Artificial Sequence: Synthetic coding sequence
atgagcggcgtggtgcccaccgcccccgagcagcccgccggcgagatggagaatcaaactaagcctccagaccctagacctgatgccccacctgaatacaactcccattttctcccgggacccccggggaccgcagtgcccccccccactgggtatcccgggggcttaccaatggggtactatagcccacagcagcccagcaccttccccttatatcagcccgtggggggaattcatccggtccggtatcagcctgggaaatacccaatgccaaatcagagcgtcccaatcacgtggatgcccggccccacaccgatggccaattgcccacccgggctcgagtacctggtgcagttggataatatccatgttctacagcattttgaacctctggagatgatgacttgtttcgagacaaataaccgctacgatatcaaaaacaacagtgaccaaatggtttatatcgtgaccgaggatactgacgatttcacacgcaatgcttatagaactttgagacctttcgtcttgagggtgacagactgtatggggcgggagatcatgaccatgcaacggcccttccgctgtacctgctgttgtttttgctgtcctagcgcccggcaggagctggaggtgcagtgccctcctggggtgacgattgggttcgttgccgagcactggaatctgtgcagggcagtatactctattcagaacgagaaaaaggaaaacgtgatgcgcgtccggggcccttgttcaacatacggctgcggctcagactcagtgttcgaagtgaagtctctcgacggaatttcaaatatcggaagtattatccgcaaatggaacggtttattaagcgctatggccgacgctgaccacttcgacatccatttccccttggatctggacgtcaagatgaaggctatgatcttcggcgcatgtttcctgatcgacttcatgtacttcgaacgaagtccaccacaaaggagccggtag

SEQ ID NO: 199555 - DNA, 789 bp, Artificial Sequence
  Description of Artificial Sequence: Synthetic coding sequence
atgagcggcgtggtgcccaccgcccccgagcagcccgccggcgagatggagaaccagacgaagccccctgatccacggcccgacgcaccacccgaatacaacagccacttcctgcccgggcctcctgggacggcagtgcccccacctacaggctacccaggaggactaccaatggggtactattccccccagcagccctctacctttcctctgtatcagcccgtgggcggcatacaccccgtgaggtatcagccaggtaaatatcccatgcccaatcagagcgttccaattacatggatgccagggcccaccccgatggccaactgcccccctggtctagagtatttggtgcaactggacaacatccacgtactgcagcatttcgaacctctggagatgatgacgtgtttcgagacgaacaaccgctacgatatcaaaaacaattccgaccagatggtgtacattgtcacggaggataccgacgattttacaagaaacgcctatcggaccctgagaccatttgtgctccgggttactgattgtatgggcagggagataatgaccatgcagcgcccatttcgatgcacttgttgctgcttctgttgcccctctgcacgtcaggagctggaggtgcaatgcccccccggcgtcactattggattcgttgccgaacactggaacctctgtcgcgctgtgtatagtatacagaacgagaaaaaagagaacgtaatgcgcgtgagaggcccttgctcaacttacgggtgcgggagcgacagtgtattcgaatag

SEQ ID NO: 199556 - DNA, 627 bp, Artificial Sequence
  Description of Artificial Sequence: Synthetic coding sequence
atgagcggcgtggtgcccaccgcccccgagcagcccgccggcgagatggaaaatcagaccaagccgcctgatcccagacccgacgccccccccgagtacaactctcattttttgcctggaccgcccgggacggctgtgcccccccccactggataccccggtggtctgcctatggggtactattctccccagcagccgagcacttttcccctataccagcccgtagggggcatacatcccgttcgttaccagcctggcaagtaccccatgcctaaccaatctgttccaataacctggatgcctggaccgacaccaatggcaaactgcccccctggactggagtatctggtgcagctagataacatccacgtgctgcagcatttcgaaccactggagatgatgacatgcttcgaaactaacaacagatacgacattaaaaacaattctgatcagatggtgtatatcgtaacagaagacacagacgacttcacccgtaatgcttaccgcacactacggccatttgttctccgggtcaccgactgcatgggtagggagattatgacaatgcagcggccgtttcgctgcacctgctgctgtttttgctgcccatctgcaagacaggaatag

SEQ ID NO: 199557 - DNA, 429 bp, Artificial Sequence
  Description of Artificial Sequence: Synthetic coding sequence
atgagcggcgtggtgcccaccgcccccgagcagcccgccggcgagatggaaaatcagaccaagccgccagacccacgaccagatgcaccacccgagtacaactcacacttcctgcctggtccacccgggacagccgtccccccacccactggttaccctggcgggctgccaatgggatattatagcccccaacaaccttctacatttcctctgtaccagccagttggcgggatccatcccgtgcgctaccagcccgggaaataccccatgcctaaccagtccgtgcccatcacatggatgccgggacctacacccatggccaattgtccacccgggttggagtatttggtgcaactggacaatattcatgtcctgcaacatttcgaacctcttgagatgatgacctgcttcgaaactaacaatcgttag

SEQ ID NO: 199558 - DNA, 990 bp, Artificial Sequence
  Description of Artificial Sequence: Synthetic coding sequence
atgagcggcgtggtgcccaccgcccccgagcagcccgccggcgagatggaaaatcagaccaagccaccagaccccaggcctgacgcccccccagaatacaacagccactttctaccaggtccgcccgggacagcagtcccaccccccaccggctacccaggcggtctgcctatgggatattactctccacaacagccctctacattccccctgtatcagcccgtcggcggtatccaccccgttcgctaccagcccggtaaataccccatgccaaaccagagcgttcctatcacgtggatgcccggacctacccccatggcaaactgcccccctggactggaatacctggtccagctggacaacattcacgtcttgcaacattttgaaccactggagatgatgacatgctttgagacaaacaaccgatatgacatcaaaaacaatagtgatcaaatggtgtacattgtgaccgaagatactgacgatttcacaaggaacgcgtacagaactctgaggcccttcgttctgagagtgactgactgcatgggcagagagataatgacaatgcagcgtcccttccgttgtacatgctgctgcttttgttgcccctccgctcgtcaggagctggaggtccaatgtcctccaggtgtgacaattggattcgtcgcggagcattggaacctgtgccgtgccgtatatagtatacagaacgaaaagaaagaaaacgttatgagagttcgaggtccttgcagcacatatggctgcgggtcagacagcgttttcgaagtaaagagcctagacggcatcagcaatatcggtagcataatcagaaaatggaatggcctgctgagtgctatggccgatgcagaccatttcgatatccacttcccccttgacctggacgtcaaaatgaaggccatgatcttcggtgcgtgttttcttattgattttatgtatttcgagcgctctcctccacaacgttccaggtag

SEQ ID NO: 199559 - DNA, 297 bp, Artificial Sequence
  Description of Artificial Sequence: Synthetic coding sequence
atgagcggcgtggtgcccaccgcccccgagcagcccgccggcgagatggagaatcaaacaaaacctccagatccacgcccagatgcgccgccagagtataactcgcacttcctcccgggaccgcccggaactgcagtgcctcctccgaccggatacccgggcggacttcccatggggtactactcaccgcagcagccaagcacgttccctctttaccaacctgtgggtgggatccatcccgtgcgataccagccaggtaagtacccaatgccaaaccagtctgtcccgatcacatag

SEQ ID NO: 199560 - DNA, 675 bp, Artificial Sequence
  Description of Artificial Sequence: Synthetic coding sequence
atggagaaccagaccaagccccccgacccccggcccgacgccccccctgagtacaacagccattttcttcctggccctcccgggactgcggtgccccctcccaccggctaccctggaggtctgcccatgggatattattcgcctcagcaaccatctactttccctctgtaccaaccagtgggaggtatccaccccgttagataccagcccggaaaataccccatgcccaaccagtcagtcccgatcacttggatgccggggcctacccccatggctaactgtccacccggcctggaatacctcgtgcagctggaggttcaatgtccacccggcgtgacaatcggattcgtcgccgagcactggaatttgtgcagagctgtgtatagcatccaaaatgagaaaaaggagaatgttatgcgggtgcggggtccttgctctacgtacggttgtggctctgactctgtgttcgaggtaaaatcactggatggaatcagcaacatcggctccatcatcagaaaatggaacggcttgctgtcggccatggcagatgccgaccatttcgatatacacttccccctggacctggacgtcaagatgaaggctatgatcttcggtgcttgttttttgattgacttcatgtactttgaaaggagtcccccacagaggtcccggtag

SEQ ID NO: 199561 - DNA, 1326 bp, Artificial Sequence
  Description of Artificial Sequence: Synthetic coding sequence
atggccctgttcggcgccctgttcctggccctgctggccggcgcccatgccgaattccccgggtgtaagatcagagtgacctccaaggcgctggagctggttaagcaggaaggcctaagatttctggagcaggagcttgaaacaatcacaatcccggatctgaggggaaaggaagggcatttctactacaacatttccgaagtgaaagtcacagagctgcagctcaccagcagcgagcttgactttcagcctcaacaggaactcatgctgcaaataactaatgccagtttgggcctccgttttcggagacagttactgtactggtttcttaaagtgtacgactttctctctactttcatcacgagcggcatgaggtttttgctgaatcagcaaatatgcccagtcctttatcacgctggtacagtgctgctgaatagtctgcttgacacagttcctgtccgatctagtgtggacgaactagtcggcatcgattattctctgatgaaggaccccgtggcctctacgtctaatctcgacatggattttcgtggcgccttcttccccttaacagaaaggaactggagcctgcctaaccgggccgtcgagcctcaactccaagaggaggagcggatggtatatgtcgccttcagtgagtttttcttcgactctgcgatggagagttacttccgtgctggcgcactacagctacttctggtcggagataaggtaccacacgatctggatatgctgctgagagctacttacttcggcagtattgtgttgctctccccagctgttattgatagcccactgaaactggaactgagagtccttgcacctccacgttgcacgattaagccgtccggtacaaccatcagtgtgactgctagtgtcacaatcgctttggtgccccctgaccagccagaagttcaactgtcttcaatgacgatggacgctaggttaagcgcaaaaatggcattgcggggcaaggctcttcggacacaactggatctgcggcgcttcaggatatattccaatcacagtgcactagagtcgttggcccttatccctctccaggccccactaaagaccatgctgcaaatcggagtaatgcccatgttaaacgaacgaacttggcgaggagttcagattccattacctgagggtattaacttcgttcacgaagtggtgactaatcatgccggttttctcacaattggtgccgatctgcatttcgccaagggtctgcgtgaagtgattgagaaaaacagaccagcagatgttagagcaagcactgccccgactccaagcactgccgccgtctag

SEQ ID NO: 199562 - DNA, 1482 bp, Artificial Sequence
  Description of Artificial Sequence: Synthetic coding sequence
atggccctgttcggcgccctgttcctggccctgctggccggcgcccatgccgagtttccaggatgcaagattcgagttaccagcaaggctctcgagcttgttaaacaagaggggctcagattcttggagcaggaactcgaaaccatcaccatcccggatctgagagggaaggaaggtcacttctattataacatcagcgaggtgaaggtaacagagctacagctcacctcttccgaattggacttccaacctcaacaggaactcatgctccaaattacaaacgcaagtttaggacttcggtttaggcgtcagctattgtactggttcttttatgatggcggctacattaacgccagcgccgagggggtgagcatcaggactggactggagctgtctcgtgaccctgcggggaggatgaaagtgagcaacgtgtcgtgtcaggctagtgtgtcccgtatgcacgcggctttcggcgggaccttcaagaaggtgtacgactttctgtcaacatttattaccagtggaatgcggttcctgctgaaccaacaaatttgtcccgtcttgtaccatgccggcactgttctgctaaattcactgctggacacggtgcccgttcggtcgtctgtggacgagttagtggggattgattacagcctgatgaaagaccctgtagcttctacctctaatttggatatggacttccgaggcgccttcttccctctgacagaaagaaattggtccctgccgaatcgtgccgtcgagccacagctacaggaggaagaaaggatggtgtatgtggctttttccgaatttttcttcgacagcgctatggagtcctattttagggcgggagccctccaacttttgctcgtcggagataaagtcccacatgacctggatatgttactgagggccacctattttggtagtatcgttctcctgtcccctgccgtcatcgatagtccgctcaagctggaacttcgggtgctggcgcccccccgatgcacaattaaaccgagcggcacgacgatatcagtgacggcaagcgtgactattgccctcgtgcctcctgaccagcccgaggttcagctctcctctatgacaatggacgcacggttaagtgccaagatggccttgcgcggcaaggcccttcgcacccagttggaccttaggcgattcagaatctattcaaaccactctgccctggagagcttagccctaattcctctccaggcgcccctgaagactatgctgcaaattggagtgatgcctatgttaaacgagcgtacctggcgtggagttcagataccactacctgagggaattaatttcgttcacgaagtggtgacaaaccacgctggttttctcaccatcggtgctgatttacacttcgctaaggggcttagagaggttatcgaaaagaaccgacctgccgacgtgcgggcctcaacggcgcccaccccgtcaacagccgccgtgtag

SEQ ID NO: 199563 - DNA, 1482 bp, Artificial Sequence
  Description of Artificial Sequence: Synthetic coding sequence
atggccctgttcggcgccctgttcctggccctgctggccggcgcccacgccgaattccccggctgtaaaattagagtcacctcaaaagctcttgaacttgtgaaacaggaaggtctgcgcttcctagaacaagaactggagaccataaccatcccagacttgagggggaaggagggacatttctactataacatctccgaagttaaagtgacagaattacagctgacctcttccgaattggatttccaaccacaacaggaactcatgttacaaatcaccaacgcttctctgggactgagatttcgaaggcagttgctctactggttcttttacgacggaggttacatcaacgctagtgccgaaggggtgagtattcgtactggactggagctctctcgggaccctgcagggcgcatgaaggtgtcaaatgtttcgtgccaggcatcagtcagccgcatgcatgctgctttcggtgggacattcaagaaggtgtatgatttcttgtccactttcataacctccggcatgaggtttctactcaatcagcaaatttgccccgtactgtaccacgccggaaccgttctcctgaattctctacttgacacagtgcctgtccgcagtagcgttgatgaactggtgggcatcgattactccctcatgaaggacccagtagcatctaccagcaatctggacatggatttcaggggcgctttctttccactgacggaacgaaattggtccttgcccaatagggctgttgaacctcagctgcaggaagaagagcgaatggtctacgttgctttcagtgaattcttcttcgattctgccatggagtcttatttcagagccggtgctctgcagctgcttctcgtgggagataaggtgcctcacgatctggacatgttactgcgcgcgacctactttggaagtatcgtgctgctgtcccccgccgtcattgactctccgctcaaactagagctcagggtcttagcccccccccgttgcactattaaaccctcgggtactactatctcagttaccgcgtccgttaccatcgcccttgtgccaccggatcagccagaagtccagctctccagtatgactatggacgcaagactatctgctaaaatggcccttaggggcaaggcgctccgcacgcaactggatttgcggcggtttagaatctatagcaatcattccgctctggagagcctggcactgataccactccaagctcccttgaaaaccatgcttcaaatcggcgtcatgcctatgctgaatgagcggacgtggaggggcgttcagattccccttcctgaagggataaactttgttcacgaggtggtgactaatcacgccggattccttactatcggagccgacttgcactttgccaaggggcttagggaagttatagagaaaaaccgccccgctgacgtgcgagcttctacagctccaacaccaagcacagctgccgtatag

SEQ ID NO: 199564 - DNA, 1542 bp, Artificial Sequence
  Description of Artificial Sequence: Synthetic coding sequence
atgggcctgagcggcagcgacaacagctgcgaccccacccccccccctggtcccttggcgatggccctgtttggcgcgttgtttctggccctgttggccggcgcccatgctgaattccccggttgcaagatcagagtaactagtaaggcccttgaactcgtgaagcaggaaggactgaggtttctggaacaagaactggagaccatcacaattccagacctgaggggcaaggagggtcacttctattataacatatccgaggtcaaagtgactgagctgcaactgacatcttccgaactggactttcagcctcagcaagagctcatgctgcagataacgaacgcctcattgggtctacgcttcagacgccagctgctgtattggttcttttatgatggcggatacataaacgcttctgccgaaggcgtatctatccgtacagggttagagctttctcgggacccagcagggcgcatgaaagtatcaaatgtttcgtgtcaggcttcagtgtctcgtatgcacgcggcctttggaggcaccttcaagaaggtctacgattttctgtctacttttattacctccggcatgagattcctgctgaatcaacagatctgtccagtactatatcacgccggcactgtcctgcttaactctcttctggacacagtgcctgtacgctcatccgtcgatgagcttgtgggcattgattattctctgatgaaggatcccgttgcttcaaccagcaaccttgacatggattttcgaggagcattctttcccttgacagaaagaaattggtctctccctaatcgggccgtcgagccccagcttcaagaagaggaacggatggtctacgtggctttctctgagtttttttttgactctgcaatggagtcgtattttcgcgctggagccctgcagctgttgcttgtgggcgataaggtcccacacgaccttgacatgctgctccgggcgacttatttcgggtccattgtactgctgtctccagcggtgatcgactcacctctgaagttagaactacgcgtgctggctcccccaagatgcacaattaagccttcaggcactactatctctgtgactgccagcgtgaccatcgccctcgttccccccgaccagcctgaggtccagctatcaagtatgaccatggatgcaaggctgagtgcaaaaatggcgctgcggggaaaagctctgaggactcaactcgacctgcgccggttcaggatttattccaatcactccgccctggagtctctggctttaatacctctgcaggccccgctcaaaacgatgctgcaaattggggtcatgccaatgctcaatgagcgaacatggcgcggggtgcagatccctctgccagagggaataaacttcgtccacgaggtggttactaaccacgccggcttcctaactataggtgcagatctgcatttcgccaagggactgagagaggtgattgagaagaataggcccgcagacgtgcgcgcgtccacagcacctaccccttctactgccgcagtgtag

SEQ ID NO: 199565 - DNA, 1218 bp, Artificial Sequence
  Description of Artificial Sequence: Synthetic coding sequence
atgctgcagatcaccaacgccagcctgggcctgcggttccggcggcagctgctgtactggtttttctacgacggcggctacatcaatgcaagcgccgagggcgtgagcattcggacggggctggaactttcaagggatcccgctggaaggatgaaagtgtctaatgtgagttgtcaagcttctgtgagtcggatgcacgccgcatttggcggcacctttaaaaaagtctacgatttcttaagcacgttcattacctctggcatgcgattccttctgaatcagcagatctgtcctgtgttgtatcatgccgggacagtgctactgaatagcttgctggatacagtgcctgtccgcagctcagtggacgaactggtgggtattgactacagcctcatgaaggatccagtggcttccacttccaacctggatatggactttcgcggtgcctttttccctttgaccgagagaaattggtccctccctaatcgcgcggttgagccgcagttacaagaggaggaaaggatggtttatgtagcgttctcagagttcttttttgatagtgccatggagtcgtatttcagggctggagccctccagctgctgctggtgggggataaggtgccccatgatctcgacatgctgctgagagccacatatttcgggagtattgtgctgctctctcccgcggtcatagacagccctctgaaactcgagttgcgagtgctggccccacctcgctgcactattaagccaagtggtacaaccatcagtgtgacagccagcgttaccattgccctggtgcctcctgaccaacccgaggtccaactcagcagtatgacaatggatgctcggctaagtgccaagatggccctccgtggaaaggccctcaggacacagctggatctgcgacggttccgcatctatagcaatcatagtgcgcttgagagcttggccctgattccgttgcaggcacccctgaagacaatgctgcagataggggttatgcctatgcttaacgagcgcacatggaggggcgtgcagatacccctgccagaaggtattaacttcgtccatgaagtggtgaccaatcacgctgggtttctgaccataggcgctgatcttcattttgctaagggcttacgcgaggtcattgaaaagaataggcccgctgacgtgagggcctcaactgctccaaccccaagcacagccgctgtctag

SEQ ID NO: 199566 - DNA, 1197 bp, Artificial Sequence
  Description of Artificial Sequence: Synthetic coding sequence
atggccctgttcggcgccctgttcctggccctgctggccggcgcccacgcagaattcccaggttgtaaaattcgagtgacctctaaggctctggaactggtcaagcaggagggactcagattcttggagcaggaactcgagactatcacaatcccggacctacgtggcaaagagggccatttctattacaacattagcgagaaggtctatgacttcctctccacttttatcacaagcggtatgcggttccttctaaaccagcagatttgtccagtactgtaccacgccggcactgtgctgctcaattccctcttagataccgtgccagtgaggtcgtcagtcgacgagctggtggggattgattatagcctgatgaaagaccccgtcgcgtccacctctaaccttgatatggacttccggggagcctttttccccttgacagagcggaactggtccctaccgaatagggcggtcgaacctcagctgcaggaggaggagcgcatggtgtacgtagcattctctgaatttttctttgactccgccatggaatcttattttagggccggtgccctacagcttttgttggtcggggacaaggtgccccacgatctcgatatgcttctgcgggctacgtacttcggttccattgtgttactaagccctgctgtgattgactctccgctgaagcttgaactacgcgttttggctccgccccgttgtaccatcaaaccttcaggtacgacaattagtgttactgccagcgtcacgatcgcactggttcccccggatcagccggaagtccagctttcctctatgaccatggatgcgcgcctgtccgccaagatggctctcaggggcaaggcgttaagaacacagctggacctcaggcgcttcaggatttattccaaccattctgcccttgaatcattggccctgattcccctccaggcgcctctcaagacgatgctacaaatcggcgtaatgccaatgctgaacgaacggacatggcgcggggtgcagatccctctgccggaaggaataaatttcgtccacgaggtggtgacaaaccacgccggctttctcacgatcggtgcagacctacatttcgcaaagggtctgcgggaggtaattgagaagaataggcctgctgatgtcagagcgagtaccgctccaactccttctacggcagcagtgtag

SEQ ID NO: 199567 - DNA, 2343 bp, Artificial Sequence
  Description of Artificial Sequence: Synthetic coding sequence
atggccccctacagcctgctggtgacccggctgcagaaggccctgggagttcgccagtatcacgtggcttcagtgctgtgtcagcgcgcaaaagtcgccatgtcacacttcgagccaaacgagtacattcactatgatctcctggaaaaaaatataaacatcgtgcggaagcggttgaatcgccccctgactctgagtgagaaaatcgtttacggacatttggatgatcccgcctcccaggaaatagagagagggaaaagctatctccgactgcgccctgatagagtggccatgcaggatgccacggctcaaatggcaatgttacagtttatttcgtcaggtctttctaaggttgccgtgccaagtaccatccattgtgatcacctgatcgaagcccaagtgggaggggagaaagacctcaggagggcgaaagacattaatcaagaagtttacaactttctcgcaacagctggcgctaaatatggtgtggggttttggaagcctggctcaggaatcatccaccagatcattctggagaactatgcgtaccctggcgtgctgcttattggaacggatagccacaccccgaacggtgggggcttaggcggaatttgcatcggtgtgggtggcgccgacgccgtggatgtaatggcaggcataccgtgggagctcaagtgccctaaggttattggagtaaaactcaccgggtcactgtctggttggtcatcaccaaaagacgtcatcctgaaggtggctggaatactgaccgttaaggggggaacaggggcaatagtagaataccatggtcccggggttgactccatttcctgtactggtatggctacaatatgcaacatgggagccgaaatcggtgcgacaacttctgtgtttccttataaccacagaatgaagaaatacctgagcaaaacaggacgcgaggatatcgccaatctcgccgatgagtttaaggaccacctggtgcccgaccctggctgtcactacgatcaactgatagaaatcaacctctccgaactgaaaccccatatcaatggtccatttactcccgacctggcccaccccgtggcagaggtcggcaaagtcgcagagaaagagggatggcccttggacatacgcgtggggctgatcggttcttgcaccaatagctcttacgaggacatgggaagatctgctgccgtcgcaaagcaggcactggctcatggccttaagtgtaaaagccaatttacaataacgcctggaagcgaacaaatcagagccacaattgaaagggatggctatgcccagatcctgagagatcttggcggcatcgtgcttgcaaacgcatgcgggccatgcataggccaatgggatcggaaagatattaaaaagggggaaaaaaacacgatagttactagctacaaccgcaatttcaccggacgcaacgatgctaacccagaaacccatgccttcgtcacctctcctgaaattgtgacggccctggcgattgccggcacactgaagtttaaccctgagacagactatctaacgggcacagacgggaagaagtttagactcgaggcccctgatgctgatgagctgcccaagggggagttcgaccctggccaagacacataccagcatcctcctaaggattcctctgggcaacacgtggatgtttcccctacttcacagagattgcaattgttggagccgttcgataagtgggatgggaaggatctggaagatctacagatactgatcaaagtgaaagggaagtgcacgactgaccatatatctgctgccggaccctggctgaaatttagggggcatctggataacatcagtaacaatttattgattggtgccataaacatcgaaaacgggaaagccaattctgtgagaaacgccgtaacgcaggagttcggccctgttcccgataccgctcggtactacaagaagcacggaattcgatgggtggtcattggggatgaaaactatggcgagggctcgtcccgcgaacacgccgcattggagcccaggcacctggggggaagagccataatcaccaagtcatttgcacgaatccacgagactaacctgaagaagcaaggactgttgccactgacatttgccgatccagctgactacaataaaattcaccctgtcgacaagctgaccatccagggtctcaaggattttaccccaggcaagcccctcaagtgcattattaaacaccccaacggtacccaagaaactatcctcctgaatcatactttcaatgagacacagattgagtggtttcgagcgggctcagctctcaacaggatgaaggaactacagcagtag

SEQ ID NO: 199568 - DNA, 741 bp, Artificial Sequence
  Description of Artificial Sequence: Synthetic coding sequence
atggccgcccccggccccgccctgtgcctgttcgacgtggacggcactctcaccgccccacgccaaaaaatcactaaggagatggatgatttcctgcagaagctgaggcagaaaatcaaaattggcgtcgttggaggctccgatttcgagaaggtgcaagagcaattgggcaatgacgtggtagaaaagtatgactacgtgtttccagaaaacggcctggtagcatacaaagatgggaagctcctgtgcagacagaacattcagagccatcttggagaagccttaattcaggatctgattaattattgtttaagctacatcgccaaaattaagttaccaaaaaagcggggcaccttcatcgaattccgcaacgggatgctgaacgtgagccccattggccgtagctgttcacaagaggaacggatcgagttctatgaactggacaaaaaagaaaacatccgccagaaattcgtcgccgatctcagaaaggagttcgccggaaagggcctgacattttcaatcggtggccaaattagcttcgacgtgttccccgacggttgggataagagatactgcctgagacacgtggagaacgatgggtataagactatctacttcttcggggacaagaccatgccaggagggaatgatcacgagatttttactgaccctcgcacaatggggtatagtgtgaccgcacccgaagacacccgtcggatttgcgagttgttattctcctag

SEQ ID NO: 199569 - DNA, 366 bp, Artificial Sequence
  Description of Artificial Sequence: Synthetic coding sequence
atgctgaacgtgagccccatcggccggagctgcagccaggaggagaggatcgagttctacgagctcgacaagaaggagaatatcaggcagaaatttgtggcggatctacggaaggaattcgccggcaagggactcacattcagcatcgggggacagatctcttttgatgtgtttcccgatggatgggataagcgctattgtctgaggcacgtcgaaaacgacgggtataagactatctatttttttggcgataaaactatgccaggcgggaacgaccatgagatcttcacagaccccagaactatgggatatagcgtgacagcaccagaagataccagaaggatatgcgaattgttgttctcatag

SEQ ID NO: 199570 - DNA, 492 bp, Artificial Sequence
  Description of Artificial Sequence: Synthetic coding sequence
atgatgaacatccagagccacctgggcgaggccctgatccaggacttgatcaattattgtctgtcttatatcgccaagatcaagttaccaaaaaaaagggggaccttcatcgagttccgaaatggcatgctgaacgtatcacctattggacggagctgctcgcaggaggagagaatcgaattctacgagttagacaagaaggagaacatccggcagaagtttgtcgccgacttacggaaggagtttgcagggaaggggttgaccttcagcattggtggacagatttcctttgacgtgttccccgacggctgggataagcggtattgccttcgccatgttgaaaatgatgggtacaaaactatctatttctttggtgacaagacgatgcccgggggtaatgatcatgagatcttcactgatcctcgcacaatgggatattccgttaccgcaccagaagacacaaggaggatttgcgaacttttattctcatag

SEQ ID NO: 199571 - DNA, 579 bp, Artificial Sequence
  Description of Artificial Sequence: Synthetic coding sequence
atggcccccctgggcggcgccccccggctggtgctgctgttcagcggaaaacgcaagagcggcaaggattttgtcacagaggcattgcagagtcggctcggtgcggatgtctgcgctgtgctgcggctgtctgggccacttaaggaacagtatgctcaagagcacggcctcaatttccagaggctgctcgacacttccacgtacaaggaggcttttcgaaaggacatgataagatggggagaagaaaagcgacaggcagaccccggcttcttttgccggaagatcgtcgaggggattagccagcccatttggctagtgtccgatactcgcagagtgagcgacatccagtggtttagggaagcatatggggcagtgacccagaccgtgcgcgtggttgctctcgagcagtctagacaacagcgaggctgggtttttacccctggggtggacgacgctgagagcgagtgtggccttgataacttcggggatttcgactgggtcatcgagaatcacggtgtggagcagcggctcgaagaacagctggaaaacctgattgagtttatcaggagccgcctttag

SEQ ID NO: 199572 - DNA, 615 bp, Artificial Sequence
  Description of Artificial Sequence: Synthetic coding sequence
atggagcccaaggccagctgccccgccgccgcccccctgatggagcgtaaatttcatgtacttgttggcgtcactggatccgtggccgcgctgaagctgccattgttggtgtccaagctgctggatatccccggcctggaggtggcagtggttacgactgagcgggcgaagcacttttattcaccacaagacatccctgttaccttgtactcagacgccgacgaatgggagatttggaagtcgcgtagtgatcccgttctgcatatcgacctccggcggtgggcagatcttcttctcgtggcaccccttgacgccaacacccttggtaaagtcgcttcgggaatttgcgacaaccttctgacatgcgtaatgagagcatgggaccgttccaaaccgcttctgttttgccctgcaatgaatacagccatgtgggagcacccaattacagcgcagcaggtcgatcagctgaaggcattcggctatgtagagattccatgtgtagccaagaaacttgtctgtggtgacgaaggactaggcgcgatggcagaagtgggcacgatagtggacaaggtgaaggaggttctgttccagcactctggtttccaacagagctag

SEQ ID NO: 199573 - DNA, 171 bp, Artificial Sequence
  Description of Artificial Sequence: Synthetic coding sequence
atggccgagatggaccccgtggccgagttcccccagccccccggcgcggccagatgggccgaagccctgttacgctgtttcacctggctgcgcttgtgccagatctcaatgttcttgtccctcaagtgcctgaacacccgtagctcccacctcggtgcgcactgccgatag

SEQ ID NO: 199574 - DNA, 642 bp, Artificial Sequence
  Description of Artificial Sequence: Synthetic coding sequence
atggccgagatggaccccgtggccgagttcccccagccccccggcgccgcgcgatgggccgaggtaatggccagatttgccgccaggttgggagcacaaggcagaagggtggtcttggtcaccagcggaggtacaaaagtgccactggaagcacgccctgtgcgttttctggataacttttccagcggtcgccgcggtgccacaagcgcagaggcattcttggcagccgggtatggggtattgttcctttatagggctcgctccgcattcccctatgcccacaggtttcccccccagacatggctatccgcgctacggccttcgggccccgctctcagcggtcttctgagtctggaagccgaagagaacgccctaccaggctttgctgaggcgttacgaagctatcaggaagctgccgcggctggcacttttctcgccgttgagttcaccacgttggcggactacctccacttacttcaggctgccgcacaggcattaaatcctctcggaccatcggcaatgttttacctcgccgctgctgtatcagatttttacgtccccgtttctgagatgcccgaacataagatacaaagcagcgggggcccactccaggtcatgggtgcaagcctgccggaaatctag

SEQ ID NO: 199575 - DNA, 936 bp, Artificial Sequence
  Description of Artificial Sequence: Synthetic coding sequence
atggccgagatggaccccgtggccgagttcccccagccccccggcgcagctagatgggccgaagtcatggcccggttcgcggctcgtttaggcgctcagggccgccgagtcgtcctcgtcactagcggcggcaccaaagtacctctcgaggccaggccagtacggtttctggataacttctcaagtggcagacgtggggccacgtcagccgaggctttccttgcagcaggttacggggtcctgtttctgtatcgggctaggagtgcatttccttacgcccacaggtttcctccgcaaacttggctctccgcgctgcgcccgtcagggcctgcccttagcggactgctgtccctcgaagcggaggagaacgcactgccaggcttcgccgaggcgctgaggtcatatcaggaggccgcagctgctgggacattcctggctgtggaatttacaaccctggcagattacttgcacctgttgcaggccgcagcacaagctctgaatcctcttggacctagtgccatgttctacctggccgccgcagtgagcgacttctacgttccagtttctgagatgccagaacataagatccaatcttctggggggcccctccagataactatgaaaatggtgccaaagctgttgagcccacttgtgaaagactgggccccgaaagcgtttattatatcctttaaactcgaaactgaccccgctatagtgatcaaccgcgcgcgtaaggcacttgagatctaccagcatcaggtagtggtggccaatatcttggagtcacgccagagcttcgtcttcattgtcactaaagatagtgaaactaaactgctcctcagcgaagaggaaattgagaagggcgtcgaaatagaagagaagattgtagataacctgcagtcccgccacactgctttcattggggaccgtaattag

SEQ ID NO: 199576 - DNA, 417 bp, Artificial Sequence
  Description of Artificial Sequence: Synthetic coding sequence
atgttctacctggccgccgccgtgagcgacttctacgtgcccgtgtcagagatgcccgaacataagatccaatcgtctggagggcctttgcagatcaccatgaaaatggtgccaaaactcctgagcccactggtcaaagattgggcccctaaggcattcatcatatccttcaagctggaaacggatccagcaattgttataaaccgggcacggaaggctctagaaatctaccagcaccaggtcgtggtagcgaacatcctggagtcccggcagtcctttgtgttcattgtgacaaaggacagtgagaccaagcttctgctgtctgaagaggaaattgagaagggggtcgagatcgaggagaaaatcgtcgataatctgcagagcaggcacaccgcgtttatcggcgatcggaattag

SEQ ID NO: 199577 - DNA, 417 bp, Artificial Sequence
  Description of Artificial Sequence: Synthetic coding sequence
atgttctacctggccgccgccgtgagcgacttctacgtgcccgtgagcgagatgcccgagcacaagattcaatcttccggtggcccactgcagataaccatgaaaatggtccctaagctgctgagtccactcgtcaaggattgggcgccaaaagcgtttatcatatccttcaaactggagaccgatcctgccatagtgatcaacagggccaggaaggccctcgagatctaccagcatcaggtagttgtcgccaacatccttgaatctcgccagagtttcgtgttcattgtgaccaaggattctgagaccaagctcctgctcagcgaggaagagatcgaaaagggggtcgaaatcgaagaaaagatagtggataacctacaaagtcggcacactgccttcataggtgacaggaactag

SEQ ID NO: 199578 - DNA, 393 bp, Artificial Sequence
  Description of Artificial Sequence: Synthetic coding sequence
atggccgagtacggcaccctgctgcaggacctgaccaacaacatcacacttgaggatctggagcagctcaaatccgcctgcaaagaggacataccctccgagaagtctgaagagattactactggttcagcatggttctccttcttggagagccacaacaagctcgataaggataacctttcttatatagagcacatctttgaaatctcacgaaggccagacttgttaacaatggtggtggattatcggacgcgcgtgcttaaaatatccgaggaggacgagctggacactaagcttacacggataccatctgcgaaaaaatataaggacattatccggcaaccatctgaagaggagattattaagctggccccacccccaaagaaggcttag

SEQ ID NO: 199579 - DNA, 456 bp, Artificial Sequence
  Description of Artificial Sequence: Synthetic coding sequence
atggaggacgagggcaacaagctgtgccaggcccccccctggcccggtcaaactagtccagtgatggcagaatacgggaccctgctgcaggacctgactaacaatatcaccctggaagacctggagcaactgaaatcagcatgtaaggaggatatcccgtcagagaagtccgaggagatcaccactgggagcgcctggttttctttcctcgaatcacataataaattggataaagataatctgtcctacatagaacatatcttcgagatctcacgccgcccagatttgcttaccatggtggttgactatagaacccgggtcctgaagatctctgaggaagatgagctggacacgaaactgacaagaattcccagtgctaagaaatacaaagatattatcaggcagcccagcgaggaggagatcatcaagctggcccctcctcctaagaaagcctag

SEQ ID NO: 199580 - DNA, 327 bp, Artificial Sequence
  Description of Artificial Sequence: Synthetic coding sequence
atggccgagtacggcaccctgctgcaggacctgaccaacaacatcacactggaagatctggagcaacttaagtccgcctgtaaggaagacatcccctccgagaagaataatttaagttatatcgagcatatctttgaaatttccaggaggccggatttgcttactatggtggtcgactacaggaccagggtgctcaagatctctgaagaggacgaattagacacgaagctcaccagaatcccttcagcgaagaagtataaggatatcatccggcagccctccgaggaagaaatcatcaagttggcgccgccccctaagaaggcatag

SEQ ID NO: 199581 - DNA, 1554 bp, Artificial Sequence
  Description of Artificial Sequence: Synthetic coding sequence
atggagctggaggagctgggcatccgggaggagtgcggcgtgttcggatgcatcgcctctggcgagtggccgactcagctggacgtcccacacgtcattactttagggttggtgggactccagcaccgaggtcaggaatcagcagggatcgtaacgagcgacggaagcagcgtgccaacctttaagtcacacaagggcatgggccttgtgaatcacgtgtttacagaggataatttaaagaagctgtacgtcagtaatctcggtatcggccacacccggtacgccactacaggaaagtgcgagctggagaattgtcagccgtttgtcgtggagacattgcacggtaagattgcagttgcacataacggggagctggtaaatgcggcccgtctgcggaagaagctcttacggcatggaatcggtttgtcgacctcctccgattctgaaatgatcactcagctgctggcgtacacccctccacaggagcaggatgacacacctgattgggtggcgcggattaagaacctgatgaaggaagcccccactgcatactccctgcttattatgcatcgtgacgtgatttatgccgtccgggacccttatggcaatcggcccctttgtattggccggcttatcccagttagtgatatcaatgataaggaaaagaaaacgtcggaaacagaggggtgggtggttagttccgagagctgctcattcctctctatcggcgctcgatactaccgagaggtcctgccaggcgaaatcgttgaaatcagcagacacaatgtgcaaactctagacatcatatcgcggagtgaggggaatcccgtcgccttctgtatattcgagtacgtttacttcgcccgccctgactcgatgtttgaggaccagatggtctacacggttaggtaccggtgcgggcaacagcttgccatcgaagctcccgtggatgccgaccttgtgagtacggttcctgaaagcgcgactccagccgcacttgcttacgccggcaaatgcgggttaccctatgtggaggtgctctgtaagaacagatacgttggaagaacctttattcaacccaatatgcgccttagacagctgggtgtggccaaaaaatttggggtactctccgacaacttcaaagggaagaggatcgtgctggtcgacgactcaatagttcgtggcaatacaattagccctatcattaagttgctgaaggagagcggcgcgaaagaggtgcacattagggttgcctccccccccatcaagtatccctgttttatgggaatcaatattccaacaaaggaagaacttattgctaataaacctgaattcgaccacttggcagagtacctcggtgccaattcagtggtctatttgtctgtggagggactggtgtcttccgtgcaggagggaataaaatttaaaaaacagaaggagaagaaacatgatatcatgatccaggaaaacggaaacggcctggaatgctttgagaaaagtggacactgtactgcctgtctaaccgggaaataccctgtggagcttgaatggtag

SEQ ID NO: 199582 - DNA, 657 bp, Artificial Sequence
  Description of Artificial Sequence: Synthetic coding sequence
atggagctgctgatcatgatcaacgcctgcaagatcgccagcgccagccgggtgacagccgtcataccttgcttcccatacgcccgccaggacaagaaggacaaaggctttttcgatatcccagttgacaacctgtacgctgaacccgcagttctgaagtggatccgtgaaaacatttctgaatggcgcaactgcacgatagtgtctcccgatgcaggaggcgccaaacgggtgacatccattgccgataggctgaacgtggactttgccctgatccataaggagcgaaagaaagcgaatgaggtggatagaatggtcctcgtcggcgatgtgaaggatagggtagctatcctggttgacgacatggctgacacctgcggaaccatttgccacgccgcagataagctgctgagcgcaggcgcaaccagagtctacgccattctgactcatggtatattttcaggccctgcgattagccgcataaataatgcatgcttcgaggcagtcgtggtcacaaatactatccctcaggaagataagatgaaacattgttctaaaattcaggtgattgatattagtatgatactggccgaagcaataaggcgcacccacaatggggaatccgtcagttacctttttagtcatgttccgttgtag

SEQ ID NO: 199583 - DNA, 507 bp, Artificial Sequence
  Description of Artificial Sequence: Synthetic coding sequence
atgcccaacatcaagatcttcagcggcagcagccaccaggacctgtcgcagaagatagctgaccgcttaggactcgaattgggaaaggtggtaacaaagaaattctcgaaccaagaaacctgcgtcgaaattggtgagtctgtgcggggggaggacgtctatatcgtgcaaagcgggtgtggggaaatcaatgacaacctaatggagctgctgatcatgattaatgcatgtaaaattgcatcagcctctagggtcaccgcggtgattccatgcttcccttacgccagacaggacaaaaaggataagagccgcgcccctataagcgccaagctggtcgccaacatgctctctgtggccggcgccgaccatatcatcaccatggacttgcacgcctcgcaaattcaggtgtctgtagaagccaagtactggtgtctgaaaggggggcgcaagggcttaatgatgcttaagactgctgagaaacctaagatcatgccaaaatacatttag

SEQ ID NO: 199584 - DNA, 756 bp, Artificial Sequence
  Description of Artificial Sequence: Synthetic coding sequence
atggagctgctgatcatgatcaacgcctgcaagatcgccagcgcctcacgggtcaccgcagtcatcccatgcttcccgtatgctaggcaagataaaaaggacaaatccagggctcccatttcagccaaactcgtggctaatatgctgtccgtggcgggagccgaccacatcattaccatggatctgcatgcttcgcagattcagggattcttcgatatccccgtcgataatctctatgctgaaccagctgttctaaagtggattagagagaatataagtgagtggagaaattgtactattgtgagtcccgatgcaggaggggccaagagggttacttctattgcagacagactcaacgtggattttgccctgattcacaaagaaaggaagaaagcaaacgaagtagatcgcatggtgctggtgggggatgtcaaagaccgtgtggctatactcgtagacgacatggccgatacttgcgggacaatttgccatgcagccgacaagctgctgtccgcaggcgctacaagagtgtacgctatcctaacacatggaatcttcagcggcccagccatctcccgcattaacaatgcttgttttgaagccgtcgtcgtgactaataccattccacaagaggacaagatgaagcattgctctaaaattcaggtgatagatatctctatgatcctggccgaggctatacggaggactcataacggggaatccgtgtcttacctgttttcacatgtaccgctttag

SEQ ID NO: 199585 - DNA, 957 bp, Artificial Sequence
  Description of Artificial Sequence: Synthetic coding sequence
atgcccaacatcaagatcttcagcggcagcagccaccaggacctgtcacagaaaatcgccgataggttaggcctggaactgggcaaggtcgttaccaaaaagttttcaaaccaagagacatgtgttgagattggggagtcagttcgcggagaagatgtgtatatagttcagtccgggtgcggggagattaatgacaacctgatggagctgttgattatgatcaacgcttgtaaaattgcttctgcaagcagagttactgctgtcatcccatgctttccttatgcacgccaggacaagaaggataagagcagggcacctatctccgcgaagctggttgcaaatatgctgagtgtggccggggccgaccatattattaccatggacctgcatgcatcccagatccaggggttcttcgacatccccgttgacaatctgtacgccgaacccgccgtgctgaaatggatccgcgagaacatctcagagtggagaaattgtacgatcgtgagcccagacgctggcggggctaaaagggttacgtcaatcgccgaccggcttaatgttgatttcgcacttatccataaggagcgaaaaaaagccaatgaggtagaccgcatggtactcgtgggtgatgtaaaagatcgagtggccattcttgtggacgacatggctgatacgtgcgggaccatatgccacgccgcagataagctcctgagcgcaggtgccacaagggtctatgcaattctcacccacggcatcttctctggcccggctatctcacgcattaacaacgcttgctttgaggccgtcgtggtgacaaacacgatccctcaagaggataaaatgaaacattgttccaagatccaggtaatagacatcagtatgatccttgcagaggccatcagaagaacccacaatggcgagtctgtgagctacctgttttctcacgtccctttatag

SEQ ID NO: 199586 - DNA, 957 bp, Artificial Sequence
  Description of Artificial Sequence: Synthetic coding sequence
atgcccaacatcaagatcttcagcggcagcagccaccaggacctgtcccagaagattgccgacaggctcggtttggagctgggtaaagtcgttaccaagaaattttcaaaccaggagacatgcgtcgaaattggagaaagcgtgcggggagaggatgtatatatagtgcaatcaggatgcggggaaattaatgacaacctgatggaactgttaatcatgatcaatgcgtgcaagatcgcttccgctagccgagtgacggcagtgataccatgtttcccatacgcccgacaagacaagaaagataagagccgcgctccaatttccgcaaaactggtcgcaaatatgctgtcagtcgccggagcagaccatataattactatggatttacacgcgagccagatccaaggtttcttcgacattccagtcgataacctgtacgccgaacccgccgttctgaaatggatccgggagaacatctcagaatggagaaactgcaccatagtgtccccggatgctggcggggcgaaaagggtgacaagtatcgcagatcggctgaacgttgacttcgcactgattcacaaagagcgcaagaaggcaaacgaggtcgaccgcatggtgttggtcggagatgttaaagacagggttgccatccttgtggacgacatggctgacacgtgtgggacgatctgtcacgccgctgacaaactgctgagtgcaggggccacccgcgtgtatgcaatacttactcacggaatcttttcaggtcctgccattagtagaataaacaacgcctgctttgaagcagtggtggtgaccaatacaattccacaggaagataaaatgaaacattgtagcaagatacaggttattgacatttcgatgattctggctgaggctatccgcaggacacataatggtgagagcgtctcatacctgtttagccacgtaccgctgtag

SEQ ID NO: 199587 - DNA, 957 bp, Artificial Sequence
  Description of Artificial Sequence: Synthetic coding sequence
acccccaacatcaagatcttcagcggcagcagccaccaggacctgagccagaaaatcgcagataggcttgggctcgagctagggaaggtcgtgacaaagaaatttagcaaccaagagacctgtgtggaaatcgacgaatccgtgcgcggtgaggacgtgtatatcgtgcagtccggctgtggcgagatcaatgacagtctgatggagctcctgatcatgatcaacgcctgtaagatcgcaagtgcctcgcgcgtaaccgccgttattccttgcttcccatacgccaggcaggataaaaaagataagagtcggtctcctatttccgctaagctagtcgccaacatgttatccattgctggtgccgatcatatcattaccatggatctacacgctagccagatacaagggttttttgacatccctgtggacaacctgtatgcagaacctacagtgttgaaatggatacgcgagaacatacctgagtggaaaaactgcataattgttagcccagacgcaggcggtgccaagcgtgttacttctatcgccgatcagctcaacgttgacttcgctctcatacataaggaaaggaaaaaggcgaatgaggtcgactgtattgtcctggtgggtgacgtgaacgatagggtggcaatcctggttgacgacatggccgacacctgcgttactatttgtctcgcagccgataagttgttaagcgccggcgccactagggtatatgctatcctcacgcacggcatcttctcgggacccgcaattagccgcattaacaccgcctgttttgaagccgtcgtggtgactaataccatcccccaggatgagaagatgaagcactgctccaagatacgcgttatcgacatcagcatgatccttgctgaagctattcgccggactcacaatggagagagcgtgagctatcttttctcccatgtgccactgtag

SEQ ID NO: 199588 - DNA, 957 bp, Artificial Sequence
  Description of Artificial Sequence: Synthetic coding sequence
atgcccaacatcgtgctgttcagcggcagcagccaccaggacctgagtcaacgcgttgcggaccgtctgggtctggagctaggcaaggtggtgactaaaaagttctccaaccaggagacctctgtagaaattggggaatccgttagaggagaggacgtttacatcatccagtccggatgcggagagataaacgacaatttgatggaattgcttattatgattaacgcctgcaaaatcgctagtagcagccgcgtgacggcagtgatcccgtgttttccttatgcacggcaagataagaaagataaatcacgagccccaatctccgccaaattggtagccaacatgctatcggtggccggtgcggaccatattatcaccatggacttacacgcgtcacaaattcagggctttttcgatattccggtcgataatttgtacgccgaacccgcagtgctacagtggatccgggagaatattgccgaatggaaaaactgtatcatcgtgtcacctgacgcaggaggagctaagagggtcacttcaattgcggaccgcttgaatgtagagttcgccctgatccacaaggaacgcaaaaaagcaaacgaggtagataggatggtactggttggcgacgtaaaagaccgtgtggccatcctcgtcgacgacatggccgacacttgcggcaccatctgccacgccgcggataaactccttagcgctggtgcaacaaaggtgtacgccatcctgacgcatggaatcttttctggacctgcgatttcccgtatcaacaatgctgccttcgaagctgtcgtggtcacgaacactatccctcaggaagataagatgaagcactgtacgaaaatacaagttatcgacatctctatgatcttagccgaggctattcgtcgcacacataacggggagtccgtgtcgtatctgtttagtcatgtgcctttatag

SEQ ID NO: 199589 - DNA, 966 bp, Artificial Sequence
  Description of Artificial Sequence: Synthetic coding sequence
atgcccaacatcgtgctgttcagcggcagcagccaccaggacctgagccagagggtcgcagacagacttggcctcgaactcggcaaggtcgtgacgaaaaagttttctaatcaggaaacttctgtagagatcggggagagcgttcggggcgaagacgtgtacataatacaatctggatgcggcgagataaacgataacctgatggaactactcatcatgattaacgcttgcaaaatcgcttcctcatctagagtgacagccgtgatcccctgttttccttacgcgagacaggacaaaaaggataaggtgggagaatcaagagcaccaataagcgcaaaactcgttgcgaatatgttgagcgtggccggggctgatcatataatcaccatggatctgcatgcttcacagatccaaggattctttgacatacccgtggataacctgtatgccgagccggctgtcctccagtggatccgcgaaaatatcgcagagtggaaaaactgtatcatcgtgagccctgatgcagggggtgcaaagagggtcaccagcattgccgataggctgaatgttgagttcgcactgatccataaggaacggaagaaggccaatgaggtggacagaatggtgttggttggagacgtgaaggacagggtggccatcttagtggacgacatggctgatacatgtggcaccatatgtcacgccgctgacaagctcctatctgcaggggccactaaggtttatgctatcctgactcacggcatctttagcggcccagccatctctaggatcaacaatgccgcatttgaagccgtggtcgtgaccaatacgattccgcaggaagacaaaatgaagcactgtaccaagattcaagtgatagatatctctatgattcttgccgaggctatcagacgaacccataacggcgaatctgtgtcgtatctgttctcccacgtacccctgtag

SEQ ID NO: 199590 - DNA, 849 bp, Artificial Sequence
  Description of Artificial Sequence: Synthetic coding sequence
atggagctgctgatcatggcctacgccctgaagaccgcctgcgcccgaaatataattggagtaattccttattttccttattccaagcaaagtaagatgcgcaagcgggggtccatcgtgtgcaagcttcttgcctctatgctggctaaggctggtttaactcatattattaccatggaccttcaccagaaagaaattcaaggtttcttttccttcccggtagataatttgcgtgcctcaccattcctgctccagtatattcaggaggagatccctaactatagaaatgccgtcatcgtggccaagtcaccagatgccgcgaaaagggcacaatcatacgcagagcggctgcggctgggactagccgttattcatggcgaggcgcagtgcactgaactggatatggatgatggcaggcattctccacccatggtgaaaaacgctactgtgcatccggggctggagctgccgttgatgatggctaaggagaagccaccgattactgtagttggcgatgttggcgggcgcatcgccattatcgtggatgacattatcgacgacgtggagtcctttgtggctgctgcagagatactgaaggagcgcggggcctacaaaatatacgtcatggctacccacggtattctgtctgccgaggcccccaggctcattgaagaaagtagcgtcgatgaggtcgtcgtgactaacacggtgccccacgaggtgcaaaagctgcagtgccctaaaatcaaaacagtggacatctctctgatactgtccgaggctattaggcgcattcacaacggtgaatcgatggcctatctgtttagaaatattacagtggatgactag

SEQ ID NO: 199591 - DNA, 1158 bp, Artificial Sequence
  Description of Artificial Sequence: Synthetic coding sequence
atgcccaagaagctgctgctgctgcccccccccagcgccagcagcgctttccgtgtgccacgggctcgtccagtcccaccacccgcgatgaatgctgctaggacagggtatcgagtcttctcagccaatagtactgccgcatgtacggaactggctaagaggattacagagcggctgggggccgaactggggaagtctgtcgtgtatcaagagaccaacggcgagacccgcgtcgagatcaaggaatctgtgcgaggacaagacattttcataatccagacaatcccacgcgatgtgaacactgcagtgatggagctgctgattatggcttatgctctgaagacagcctgtgccagaaatatcattggagtgatcccatactttccatactccaaacagtctaaaatgcggaaaaggggatcaatcgtgtgtaaattactggcctctatgctggccaaagcgggattgacacatatcataactatggatttacatcagaaagaaattcaaggttttttcagtttccctgtggacaacctcagagcatcgccgtttttgttacagtacatacaggaggaaatccccaactaccggaacgccgtaatcgttgcgaaaagtcctgacgcagccaagagagcccagtcatacgccgagcgcctccgactgggactggccgtgattcatggagaagcacaatgcactgagctggacatggatgatgggcgccattcccctcctatggttaagaatgctacagtccaccctgggctggaactacccctcatgatggcgaaggagaagcctccaatcacggttgttggagatgtgggagggcgtattgctattatagttgacgacatcattgacgatgtggaaagctttgtggcagctgccgagattctaaaggaacgcggagcttataaaatttacgtgatggccacccacggcatcttgagcgccgaggcaccccgtctgatagaagagtctagcgtggacgaagtagtcgtgactaatacagtgccccacgaagtgcagaaactgcaatgccccaagatcaaaacagtggatattagtctgattctatcggaagctattcggagaattcacaatggcgaaagcatggcatatttgtttaggaatatcactgtcgatgattag

SEQ ID NO: 199592 - DNA, 1110 bp, Artificial Sequence
  Description of Artificial Sequence: Synthetic coding sequence
atgttctgcgtgaccccccccgagctggagaccaagatgaacatcaccaaaggcggattggtgctgttcagtgctaatagtaattcatcctgtatggaactgtccaaaaaaattgcggagcgtttaggggtcgagatggggaaagtgcaggtctaccaagagccaaaccgagaaacgcgtgtgcagatccaggaaagcgtgcggggtaaagatgtattcataatccaaaccgtctccaaagacgtaaatacgaccattatggaacttctgatcatggtctacgcatgcaaaactagctgcgctaaaagtattattggagtgatcccctacttcccctacagtaagcagtgcaaaatgcgcaaacgcggttccatcgttagcaagttgttagcgagcatgatgtgcaaggctggtttaacccaccttattacgatggacctgcatcaaaaggagattcagggcttttttaatatcccagttgacaatctcagggccagccccttcttgcttcagtatatccaggaagagattccggactatcgtaatgcggtaatcgtggccaagtctcctgcaagtgcgaagcgcgctcagtcctttgcagagcggctgagactggggatcgccgtgatccacggagaggctcaagacgccgaatcagatctggtcgacgggcggcactcccccccaatggtccgtagtgtagctgccattcacccttctttagagataccaatgctgattcccaaggagaaaccacctatcacggtggtgggagacgtcggaggtcgtattgcaatcatagtcgacgatatcattgatgacgtcgactcgttcttagcagcagccgaaacactcaaggagagaggtgcttacaagatcttcgtcatggcgactcatggtctgctgagctccgacgctcctagaagaatcgaggaaagcgccatcgatgaagtagtggtgaccaatacaattcctcacgaggtccaaaagctgcagtgccccaagatcaagactgtggatatctctatgattttgagcgaggcaatcagacgcatccataacggggagagtatgagttacctcttcagaaacatcggactggacgattag

SEQ ID NO: 199593 - DNA, 1110 bp, Artificial Sequence
  Description of Artificial Sequence: Synthetic coding sequence
atgttctgcgtgaccccccccgagctggagaccaagatgaacatcacaaaaggtggcttggtactcttcagtgccaacagcaattcatcatgcatggagctctccaagaagatcgccgaacgccttggagtcgagatgggaaaggtgcaggtctatcaggagcccaatcgggagacgcgcgtgcaaatccaagagagcgtaaggggaaaggatgtctttatcatacaaaccgtgagcaaagatgtgaacacaaccatcatggagctgctgattatggtgtatgcatgcaagacctcatgtgccaaatcaatcatcggggttattccctatttcccatacagtaagcagtgcaagatgaggaagcgtggctcgatcgtgtctaagctcctggcctcgatgatgtgtaaggcaggattgacgcacttgataaccatggacctacatcaaaaagagattcaaggatttttcaatattccggtggataacctcagggcttccccattcttgctccagtatatccaagaagaaatccctgattatcggaatgctgtgatcgttgctaagtctcctgcttcggctaagcgcgcccagtcctttgccgagagactccgtctcggaatcgcagtcattcacggagaggctcaggacgccgagtccgacctagtagacggccgccattccccaccgatggtcagatcagttgccgctatccatcccagtctcgagatccccatgctgatccccaaagagaaaccccccattaccgttgtcggtgacgtcggtgggaggattgccattatagtagatgacatcattgatgatgttgattcattccttgcagccgcagaaactctgaaggagaggggggcctataaaatcttcgtcatggctacccacgggctactttcatcagacgccccccgccggatcgaggaaagtgcaattgacgaagtggtggtgaccaataccatcccacacgaggtgcaaaagctacaatgcccaaagatcaaaactgtggacatttcgatgatcctaagtgaagctatccgcagaattcataatggagagagtatgagttacctgtttagaaatatcggacttgacgattag

SEQ ID NO: 199594 - DNA, 807 bp, Artificial Sequence
  Description of Artificial Sequence: Synthetic coding sequence
atgttctgcgtgaccccccccgagctggagaccaagatgaacatcacaaagggcggattagtgttgttctccgccaacagcaactcctcttgtatggaacttagcaaaaagatcgcagagcggctgggtgtcgagatgggcaaggtgcaggtttatcaggaacctaatcgggagacacgcgtgcaaattcaagaaagtgtgcgaggaaaagatgtattcattatccagaccgtgagcaaggacgtgaatactacaatcatggaactcctcattatggtgtatgcatgcaaaacttcttgcgccaagtcgattatcggtgtgataccctactttccatatagtaagcagtgcaaaatgcgcaaaaggggcagtatagtgtctaagctgctcgcctcaatgatgtgcaaggctggtctgacacatctgattactatggaccttcaccaaaaggagattcagggattctttaacattccagtggacaaccttcgggcctcaccattcctgctgcagtacatccaggaggaaattccggattacagaaatgccgtcattgtagctaagtcaccagctagcgccaaacgagcacaatcattcgccgaacgacttcgcctgggaattgccgtcatacacggtgaagcgcaagacgccgagtccgacctagtagacggcagacacagccctcctatggtgagatcagttgccgcaatccatcccagtctggaaattccaatgctcatacccaaagagaagcctccaattaccgtcgttggcgatgttggtggaagaatagcgattattgtgtag

SEQ ID NO: 199595 - DNA, 585 bp, Artificial Sequence
  Description of Artificial Sequence: Synthetic coding sequence
atgttctgcgtgaccccccccgagctggagaccaagatgaacatcacaaaagggggattagttctgttttcagccaattctaattccagctgcatggagctttctaagaaaattgccgaaaggctgggggtggaaatgggcaaagtgcaggtgtatcaagaacctaaccgtgaaacccgcgtgcaaatccaggaatctgtacgggggaaagatgtgttcattattcagaccgtgagcaaggatgtcaacacaacgattatggaactgctgatcatggtgtacgcctgcaagaccagctgtgcgaagagtattatcggcgtgatcccttatttcccatacagtaaacaatgcaagatgagaaaaagaggtagcattgtaagcaaactgttggcttccatgatgtgtaaggccggcttaactcatctcataaccatggacctgcatcagaaggaaattcaagggttttttaatattcctgtggataaccttagagcgtcaccctttctgctccagtatatccaggaggagattcctgactacagaaacgccgttatcgtggccaagtcacctgccagtgcaaaatag

SEQ ID NO: 199596 - DNA, 990 bp, Artificial Sequence
  Description of Artificial Sequence: Synthetic coding sequence
atgttctgcgtgaccccccccgagctggagaccaagatgaacatcaccaaaggcggtctcgtgctgttttctgctaattctaatagttcttgcatggagctgtctaaaaaaatcgccgaagacgtcaatactaccatcatggagctgctgataatggtctacgcatgcaaaacatcctgtgcaaagagcattatcggtgtgattccatactttccgtacagcaaacagtgtaagatgagaaagagggggagcattgtgtccaagctgttggctagtatgatgtgtaaagcaggtcttacccacctcatcaccatggatttgcaccagaaagaaatccaggggttcttcaacatccctgtggataatctgcgggcgagtcctttccttctccagtacatccaagaggaaatacctgactatcgtaatgccgtgatcgtggccaagtctcccgcgagcgcaaagcgggctcagagtttcgccgagcggctgaggttggggattgctgtcattcacggagaggctcaagacgctgaatccgatctcgtcgacgggagacattctcccccaatggtgagatcagtggctgctatccacccatcactggaaatccccatgctgatccccaaggagaagccgccaatcacagtagttggggacgtcggaggccggatcgccatcatcgttgatgatatcatagacgacgtcgacagcttccttgccgccgcggaaactctgaaagaacgcggcgcttataagatatttgtgatggctacccatgggttgctgagctcagacgctcctaggagaatcgaggaatccgcgatcgatgaagtggtcgtgaccaatactatcccccatgaagtgcagaaactccaatgccccaagatcaaaaccgtggacatctccatgatcctctccgaggcgatccggagaattcacaacggggaatctatgagctacctctttagaaacatcggcctggatgattag

SEQ ID NO: 199597 - DNA, 531 bp, Artificial Sequence
  Description of Artificial Sequence: Synthetic coding sequence
atgttctgcgtgaccccccccgagctggagaccaagatgaacatcaccaaaggaggtctggtgctgttctccgctaactcaaactcctcgtgcatggagttgtctaagaagattgccgaaaggcttggcgtggaaatgggtaaggtccaggtatatcaggaaccgaatcgagagaccagagttcagattcaggaatctgtgaggggaaaagatgtcttcatcatacaaaccgtgagcaaggatgttaatacaacgattatggaactgctcataatggtgtatgcctgtaaaacaagttgtgcaaagtccatcattggtgttatcccctacttcccgtactccaagcaatgcaaaatgagaaaaaggggctccatcgtgtccaagttgctggcctccatgatgtgtaaggccgggttgacccatctgattactatggatctgcatcagaaggaaatccaaggcttttttaacattcccgttgacaaccttagggcaagtccattcctgctgcagtatatccaggaagagtag

SEQ ID NO: 199598 - DNA, 735 bp, Artificial Sequence
  Description of Artificial Sequence: Synthetic coding sequence
atgttctgcgtgaccccccccgagctggagaccaagatgaacatcaccaaaggtggtcttgtgttgtttagtgcaaatagcaactcgtcctgtatggagttatctaagaagattgccgaacgactgggtgttgaaatgggaaaagtgcaggtgtaccaagaacccaacagagagacccgtgtgcaaattcaggaaagcgtgcggggcaaggacgtcttcattattcagacagtcagcaaggatgtgaatactacaataatggagctgctcatcatggtgtatgcgtgcaagacgtcttgtgccaagagcatcataggcgttattccttacttcccgtactccaaacagtgtaagatgagaaaacggggatctattgtttcgaagttactggcgtcaatgatgtgcaaggctggtctgacacacctaatcacaatggacttacaccagaaggagatccagggcttctttaatataccagtagataacttgagagcctcaccttttctgcttcagtacattcaggaagagatccccgactataggaacgcagtgattgtggctaagagtcccgcgtctgccaaacgcgcacaatcctttgctgagcgactacgtctgggcatagcggtgattcatggcgaggcccaggatgctgaaagcgatttggtagatgggaggcactccccgccaatggtaagaagcgtcgctgcaatccatccgtccctcgagattccctag

SEQ ID NO: 199599 - DNA, 135 bp, Artificial Sequence
  Description of Artificial Sequence: Synthetic coding sequence
atgttctgcgtgaccccccccgagctggagaccaagatgaacatcactaagggggggctcgtactcttcagcgccaatagcaacagcagctgcatggagctttccaagaagatcgcagagcggctgggcgtatag

SEQ ID NO: 199600 - DNA, 807 bp, Artificial Sequence
  Description of Artificial Sequence: Synthetic coding sequence
atgttctgcgtgaccccccccgagctggagaccaagatgaacatcacgaaagggggtttagtactatttagcgcaaatagcaatagtagctgcatggagctctcaaagaaaatagcagaaaggctgggagtggaaatgggaaaagtgcaggtgtaccaagagccgaacagagagacccgggtgcagatccaagagtcagtgaggggcaaggatgtgttcatcatacagacggttagtaaggatgtcaatacaaccatcatggaactgctaatcatggtgtatgcctgcaagacaagctgcgcaaagtctatcattggggttattccctatttcccctactcgaagcagtgtaagatgcgaaagcgcggctctattgtgtccaaactccttgcttccatgatgtgcaaggccgggcttacgcatctgattacgatggacctccaccagaaagaaatccaggggttctttaatatccccgtcgacaacctccgagcctcacccttcttgttacagtatattcaagaggaaatcccagattatcgaaatgccgtcatcgtagccaaatcaccagcatcggccaagagagctcagagcttcgctgagagactgaggctggggatcgcagtcatccatggagaagcgcaggatgccgagagcgatctggtggatggcaggcattcaccacccatggtcaggagtgttgcagctatccaccccagtctcgagatccccatgttgattcccaaggagaaaccccctattacagtggtcggcgatgtcggaggacgaattgctatcattgtgtag

SEQ ID NO: 199601 - DNA, 423 bp, Artificial Sequence
  Description of Artificial Sequence: Synthetic coding sequence
atgttctgcgtgaccccccccgagctggagaccaagatgaacatcacaaaaggtggcctggtgctgtttagcgctaattctaatagctcatgtatggaattgtccaaaaagattgccgagaggctgggggtagaaatgggaaaagtgcaggtatatcaagaaccaaacagggaaactagggtccagatccaggagtctgtccgaggcaaggatgtcttcattattcaaactgtgagcaaggacgttaataccaccatcatggaactgctgatcatggtatatgcatgtaaaacaagctgcgccaaatccatcattggggttattccatacttcccctactccaagcagtgtaaaatgaggaagcggggaagcatagtgtctaaactacttgccagcatgatgtgcaaggccggcctgacttag

SEQ ID NO: 199602 - DNA, 807 bp, Artificial Sequence
  Description of Artificial Sequence: Synthetic coding sequence
atgttctgcgtgaccccccccgagctggagaccaagatgaacatcaccaaaggaggactcgtgctgttttcagcgaactcgaactcgtcctgcatggagttgagcaaaaagattgcggaacgcctaggggtggagatgggcaaagtgcaggtgtatcaggaacctaatcgcgagaccagagtgcagatacaagagagcgtacgagggaaggacgtatttatcatccagactgtgagcaaagacgttaacaccaccatcatggaactgcttatcatggtctacgcctgcaaaactagctgcgcgaagtccatcatcggagtgatcccgtactttccgtactctaaacaatgtaagatgcggaagagagggtccatcgtgagcaaactccttgcctccatgatgtgtaaggctggcctcacccatctcatcacaatggatctacatcagaaagagatccaggggttttttaacatccccgtggataatctgagggcctctccctttctactgcagtatatacaggaagagataccggactatcgaaacgccgtaatagtcgccaaaagccccgcctcagccaagagagcacaatcctttgcggagaggctaagattgggaatagccgtgatccatggggaagcacaagacgccgagtctgatttggtggacggccgtcacagccctcccatggtcagatccgttgctgcgatccatccctcacttgagattccaatgctgatccctaaggagaagccccccattaccgttgtgggggacgtcggtggaagaatagccatcatcgtatag

SEQ ID NO: 199603 - DNA, 852 bp, Artificial Sequence
  Description of Artificial Sequence: Synthetic coding sequence
atggagctgctgatcatggtgtacgcctgcaagaccagctgcgccaagagtattatcggtgtgatcccttacttcccttacagtaaacagtgcaaaatgcgaaaacgggggagtatcgtgtcaaaacttttggcctccatgatgtgcaaggcaggcttaacacatctgatcacgatggacctgcaccagaaggagatccaaggcttttttaacatacccgtagacaatctgagggcttctccgttcttactgcagtacattcaggaagaaatccccgactatcgtaatgctgttatcgtggcaaagtctcctgccagtgctaagagagcacagtcatttgctgagaggctgagacttgggatagctgtgatacatggagaggcgcaggacgccgaatcagacctggtcgatgggcggcacagcccccctatggtgaggagcgtggcggctattcatccatctttagaaataccaatgttgatccccaaggagaaaccaccgatcacagtagtaggagatgtgggaggccgcatcgctataatcgtggatgatattatcgatgacgtagactcattcctggccgccgctgaaacgttgaaagaacgaggcgcatacaaaattttcgtgatggccacccatggactactcagctcagatgccccacgccgtatcgaggagtctgccatagacgaggtagtcgtaacaaatacgatcccccatgaggttcagaagctgcaatgtcctaagattaagacagtggacatctcgatgattctctcagaagctatccgtagaatccataatggtgaatcaatgtcatatctgttccgtaacatcggacttgacgattag

SEQ ID NO: 199604 - DNA, 963 bp, Artificial Sequence
  Description of Artificial Sequence: Synthetic coding sequence
atgttctgcgtgaccccccccgagctggagaccaagatgaacatcaccaaaggtggattggtgctgtttagcgccaattctaatagctcatgtatggagcttagtaagaaaatcgccgaacgattaggagtggaaatgggaaaagtccaggtgtaccaagagcccaacagggaaaccagagtgcaaatacaagagtccgtgcgcgggaaggacgtatttattatccagaccgtctctaaagatgtgaacaccaccataatggagcttctgatcatggtttatgcatgcaagaccagctgcgccaaaagtattatcggtgtgattccatattttccttatagcaagcaatgtaagatgcgaaagcggggctccatagtcagtaaactcctagcctccatgatgtgcaaggccgggctgacccatttgatcaccatggatttgcatcagaaagaaattcaaggctttttcaacatcccagtagacaacctgcgtgctagcccttttcttctgcagtatattcaggaggaaatccctgattatcggaatgccgtgatcgtcgccaagagcccagcctcggccaagcgcgcccaaagcttcgcagagcggcttcgtctagggattgctgtcatacatggggaggcccaggatgcagaatccgacctggtggacgggcgtcattctcctcccatggttcggagtgttgctgctattcacccctccctagagatccctatgcttatacccaaggagaagccgcccatcacagtagtgggcgacgtggggggcagaattgcgatcattgtggtggtcgtgaccaatacgataccccatgaggttcagaagcttcagtgccccaaaatcaaaaccgtcgatatctcaatgatcctgtctgaagctattagaaggatccacaatggggaaagtatgagctacttgttcagaaatatcggactggatgactag

SEQ ID NO: 199605 - DNA, 237 bp, Artificial Sequence
  Description of Artificial Sequence: Synthetic coding sequence
atgttctgcgtgaccccccccgagctggagaccaagatgaacatcactaaaggtggtctagtcctgttcagcgctaactctaatagtagctgcatggagctgagcaagaagattgccgaaaacaaaagtactaatagcagggtgtgtgaaggaaagcgatgctttcaccatcccaattgctttgagggcagggagcaccatcaccacggagccccagatcatggtgtgtgcatgtag

SEQ ID NO: 199606 - DNA, 678 bp, Artificial Sequence
  Description of Artificial Sequence: Synthetic coding sequence
atggccggcagcagcgaggaggcccccgactacggccggggcgtggtaattatggatgactggcccggctacgatctaaatttgtttacctatcctcagcattactacggcgatctcgaatacgtgttaatacctcacggaatcatcgtggataggattgagcgcttggcgaaagacatcatgaaagatataggctatagcgatataatggttctttgcgttctgaaaggcggttataaattttgtgctgaccttgtggaacatctgaagaacattagccgaaatagcgaccgtttcgtcagtatgaaggttgattttatcagactgaagtcctacaggaatgaccagtctatgggcgagatgcagattattggcggggacgacctgtctacacttgccgggaagaatgtcctgatcgtggaggacgtcgtcggcacgggccggactatgaaggcgttgttatctaacattgagaagtataagccaaacatgatcaaagtggcgtctctccttgtgaaaagaacgtcccgatcggacggctttagaccagactatgccggatttgaaatcccaaatttattcgtggtcggctatgctctggactataacgagtacttcagggatctgaaccatatctgcgtaatcaatgaacacgggaaggaaaagtaccgggtgtag

SEQ ID NO: 199607 - DNA, 573 bp, Artificial Sequence
  Description of Artificial Sequence: Synthetic coding sequence
atggccggcagcagcgaggaggcccccgactacggccggggcgtggtaattatggatgattggccagggtacgacctgaatctgtttacatacccacaacactattatggcgatctggagtacgtcctgattccacacgggattatcgtggaccggattgagcgtctggctaaggacattatgaaagacattgggtacagcgacattatggtgctgtgtgtgcttaagggtgggtacaaattttgcgctgacctggtggagcacctcaagaatatatccaggaactccgaccgcttcgtgagcatgaaagttgacttcataaggcttaaatcttaccgaaacgaccaaagtatgggggagatgcaaatcatcggcggtgatgacctgagcacattggcgggcaagagcgttctctttgcaaaagacgtggttggaacaggtcgaacgatgaaggctcttttaagtaacatcgagaaatataaacctaacatgatcaaggtagcaagcttacttgtgaagcggactagccgttcggacggattccgcccagatagccacatgagacaccagtag

SEQ ID NO: 199608 - DNA, 522 bp, Artificial Sequence
  Description of Artificial Sequence: Synthetic coding sequence
atggccggcagcagcgaggaggcccccgactacggccggggcgtggtgattatggatgactggcccggctacgatcttaacctttttacataccctcagcattactatggggacctcgagtatgtcttgatcccacacggtattattgttgacaggattgagaggttggctaaggacataatgaaggacatcggctatagcgatatcatggtgctgtgcgtgctgaaggggggctataaattttgcgctgacctcgtagagcaccttaagaacatttcaaggaatagtgaccggttcgtctcaatgaaggtggatttcatcagactgaaatcatatagattgcgcgcacggctcaagcggaccaccatatgtgataggggcgggctggcgtttagtcagggatacatgagcagttgcgccccgctgcaggaatcccccaacacgctctggcgcggatacctgcaagtacttatcccctgcttccatatacggtttcagcttcctcgatctgaacagaattag

SEQ ID NO: 199609 - DNA, 573 bp, Artificial Sequence
  Description of Artificial Sequence: Synthetic coding sequence
atggccggcagcagcgaggaggcccccgactacggccggggcgtggtgattatggatgactggcctggttatgatctgaatctgttcacctacccacagcattactatggcgatctggaatacgtccttatcccacatggtatcatcgtagataggatcgagagattggctaaagatattatgaaagacatcggttattccgatataatggttctgtgtgtgcttaaaggtggatataagttttgcgccgacctcgtggaacatctaaagaacatttcccgcaattccgacagatttgtcagtatgaaagttgactttatccgcctgaagagttataggaacgatcagtccatgggtgaaatgcagatcatcgggggcgacgacctgagtactttagccggtaagaatgttttgattgtggaggatgtggtggggacaggcaggacaatgaaggctctgttgtcaaatattgagaaatataagcccaacatgatcaaggtggctagcttgctggtgaagcggacaagtcggtccgacgggttccgcccagatagtcatatgaggcatcagtag

SEQ ID NO: 199610 - DNA, 1299 bp, Artificial Sequence
  Description of Artificial Sequence: Synthetic coding sequence
atggccaccgccgaggtgctgaacatcggcaagaagctgtacgaggggaagaccaaggaagtgtacgagcttcttgatagtcctggaaaggtgctcctgcagagtaaagatcaaattacagctggtaacgctgctcgtaagaatcacctggaaggcaaggccgcaataagcaataaaattaccagttgtatcttccagctcctgcaggaagcagttaccagttacaagtccaacaggattaaaacagcctttacccgaaaatgcggcgagaccgcattcatcgcaccgcagtgtgaaatgattcctatcgaatgggtctgccgccggatcgcaacagggtctttcttgaagcggaatccaggagtgaaggaaggttacaaattctatccaccaaaagtggagttgttcttcaaggacgacgcaaataacgacccccagtggtcagaggaacagttgatagcggccaagttctgttttgccgggctgctgatcggacagaccgaggtggacatcatgtctcacgccacccaggccattttcgaaatcctggaaaaaagctggctaccccagaactgcaccctcgttgacatgaaaatcgaattcggcgtggacgtcacaactaaagagattgttctggccgatgtgatcgacaacgattcatggagactgtggccatccggtgaccgcagccagcagaaggataaacagtcatacagagacctgaaagaagtaacccctgaaggactgcagatggtcaagaaaaattttgagtgggtggcagaacgagtggaactcttacttaagtccgaaagccagtgccgggtggtggtcctgatggggagtacaagtgatctggggcattgcgagaaaataaagaaagcgtgtgggaactttggcattccttgcgagctgagagtgacctctgcgcataaggggcccgacgagacactcaggatcaaagctgagtacgagggtgatggcattcccacagtgtttgttgccgtcgcgggacgcagcaacggcctcgggcccgtgatgagcggcaatactgcctatccagtgattagctgcccgcccctgacgcctgactggggcgtgcaggatgtctggtcgtctctcagattacccagcgggctgggatgtagtaccgtcctttcacctgagggctctgcccagttcgcagcccagattttcggcctgtcaaatcacctggtgtggtcaaagctcagagcttcaattctgaacacctggatcagcctaaagcaggcagataaaaagattcgggagtgcaacctctag

SEQ ID NO: 199611 - DNA, 1278 bp, Artificial Sequence
  Description of Artificial Sequence: Synthetic coding sequence
atggccaccgccgaggtgctgaacatcggcaagaagctgtacgagggaaagactaaggaggtttacgaactactggactctccgggtaaagtgctgctgcagtctaaagaccagatcaccgccggaaacgcggcccgaaaaaatcatctggaaggaaaagccgctatcagtaataaaatcacaagctgtatattccaactgcttcaggaagcggggatcaaaacagcattcacgagaaagtgtggcgaaacagcattcattgccccgcagtgcgaaatgattcccatcgagtgggtatgtcggaggattgcgaccggctccttcctgaagcgtaacccgggcgtaaaagagggatacaagttctaccctcccaaagtcgagttattctttaaggacgatgctaataatgaccctcagtggtctgaggaacagctgatagcagcaaagttctgcttcgcgggtctgcttatcggccagacagaggtggatatcatgtcccatgccacccaggctatttttgaaatcctcgaaaaatcctggctcccacagaactgcaccctggtggatatgaaaattgaatttggggtcgatgtgacgactaaagagattgtgctggctgatgtcatcgataatgactcctggcggttgtggcctagtggagaccggagccagcaaaaggataagcagtcttacagggacttgaaggaggttaccccagagggtctgcagatggtcaagaagaacttcgaatgggtggcggagagggtagagctgctcctcaaatccgaaagtcaatgtagagtggtcgttttgatggggagtacgtccgaccttgggcattgcgaaaaaattaaaaaggcttgcgggaatttcggaatcccttgcgagttgcgggtgacatctgctcacaagggacccgacgaaacacttcgaataaaggcagaatacgagggagacgggatccctactgtgttcgtggccgtggccgggcgctctaatggcttaggcccagtcatgagcgggaacactgcctatcccgtgatctcatgcccccccctgacccccgactggggcgtgcaggatgtatggtcaagcctgcggttaccctccgggctaggctgctccactgtgctatccccagagggctccgctcagttcgcggctcagatctttggtttatccaatcacctcgtatggtctaaattacgggcgtctattctaaacacctggatttcacttaaacaagctgacaagaaaatccgggagtgcaacctttag

SEQ ID NO: 199612 - DNA, 1278 bp, Artificial Sequence
  Description of Artificial Sequence: Synthetic coding sequence
atggccaccgccgaggtgctgaacatcggcaagaagctgtacgaggggaagacaaaagaagtgtacgagctattagactcgcctggcaaggtcttactgcaaagtaaggatcaaatcacagcaggcaacgccgcgcggaaaaaccacttggaaggcaaggctgccatttctaataagatcacgtcctgcatcttccagcttttacaggaggcaggaataaaaaccgctttcactcggaaatgtggcgaaactgctttcatcgccccacagtgcgaaatgatcccaattgagtgggtttgtcggcgcatcgccactggaagctttcttaagcggaacccaggtgtgaaggaaggatacaaattttatcctccgaaggttgagctgttttttaaggatgacgctaataatgacccccaatggagcgaagagcaactgatcgctgccaagttttgctttgcgggattactgataggccagaccgaagttgacattatgtcccacgcaacccaggccatctttgagattcttgagaaatcttggctcccacagaattgcacgctggtcgatatgaaaatagaattcggagtggacgtcactaccaaagagattgtgttggctgatgtgatcgataatgattcgtggcgactgtggcccagcggcgatagatcacagcagaaggataagcagagttatagagatctaaaggaggttacccctgaggggttacagatggtcaaaaaaaattttgagtgggtggcggaacgggtcgagctgctcctcaagtcagaatctcagtgtcgagtagtggtgctaatgggctcaacttcggatttaggacactgcgaaaaaattaagaaggcatgtggcaactttggcattccctgtgagctcagagtgacgtcggctcataagggccccgacgagaccttgcggataaaggccgaatacgaaggcgatggaatcccaactgtgtttgtcgccgtggccgggcgaagcaacggactggggccagtgatgtcagggaacacagcatatccagtgatttcctgcccacccctgacacccgattggggggttcaggacgtgtggtcttccctgcggctccctagcggactgggttgcagtacagtactcagcccggagggatctgctcaatttgccgcacaaattttcggccttagtaatcacctcgtgtggtcaaaactccgggcatctatcctgaatacctggattagcttgaaacaagctgataaaaagataagggaatgtaatctctag

SEQ ID NO: 199613 - DNA, 4017 bp, Artificial Sequence
  Description of Artificial Sequence: Synthetic coding sequence
atgagccccgtgctgcacttctacgtgcggcccagcggccacgagggtgccgcacctgggcacactcggcggaagttgcagggtaagttaccagagcttcagggcgtggaaacggaactctgctataacgttaattggaccgctgaggccctaccatctgcagaggagaccaaaaagctgatgtggctatttggttgcccactactgctggacgacgtcgctcgggaaagttggctcttgcctgggagcaacgatctccttctcgaagtaggcccacggctgaatttctccacccctaccagcaccaatattgtctccgtctgtagggccaccggcttaggaccagtggatagagtcgaaacaaccaggcggtacagactgtcttttgcacaccctcccagcgctgaggtagaggctattgcccttgccactctgcatgaccgaatgacagagcagcactttccacacccaatccaatctttctctccggagagcatgcctgagcccctgaatgggcctatcaacatattgggcgaaggtagactcgcccttgaaaaagcaaaccaggagttgggtctcgctctggactcctgggacctggacttttacactaagcgcttccaagagctgcaacgtaacccaagcacagtggaggcctttgacctggcacagagtaattctgaacacagcaggcactggttctttaaaggacagttgcacgtagacggccagaaattggtgcatagcctctttgaatctatcatgagcacccaggagtcctccaaccccaataatgtgcttaaattctgtgataatagctccgcaatacagggtaaagaagtacggtttcttagaccagaagatccgaccagacccagtagatttcagcagcagcagggcctgaggcacgttgtgtttaccgcggagacccacaactttcccaccggagtgtgcccattcagtggcgcaactacggggactgggggcagaattcgggatgtgcagtgcacaggccggggagctcacgtcgtggcagggacggccggctattgtttcggaaatcttcacattccaggttataacctgccctgggaggatccatcttttcagtaccccgggaacttcgcaaggccactggaagtcgccattgaagcctccaatggcgcgagtgattacgggaataagttcggagagccggtattggccggcttcgccagaagcttgggccttcagctccccgatggccagcgccgggagtggatcaaacctatcatgttctctggtgggatcggatctatggaagctgatcatatttctaaagaagcacccgagccaggaatggaagtagtcaaagtgggcggacctgtgtacagaattggggtgggaggaggcgccgcttcatccgtgcaagtgcagggcgataacaccagcgacctggatttcggagccgtccagcgaggcgaccctgagatggagcagaagatgaaccgggtgatccgcgcatgcgttgaggcccccaaggggaatcccatctgcagcctgcacgaccagggtgcaggcggcaatggcaatgtgttgaaagagctgtctgatcctgctggcgccataatctacacaagccgctttcagctgggcgacccaacgttaaacgcgctggagatctggggagccgaataccaagagagtaacgcgcttcttctacgctcacctaacagggactttttaacccacgtcagtgccagggaaaggtgcccggcttgctttgtcggtacgattacaggggacaggaggattgttctagtggatgacagagagtgcccggtgagacgcaacgggcagggtgacgcccccccaacccctttgccgactccagtggatcttgagctggaatgggtcctggggaagatgccaagaaaagagttctttttacagaggaagccccccatgctccagccgctcgctctaccaccaggactgtccgtgcaccaagctttggaacgtgttctgagattacccgctgttgcttccaagcggtatcttacaaacaaggtcgaccgaagtgtgggaggattggtcgctcagcagcagtgtgtaggccctctgcagaccccactggcggatgttgcagtggttgcactgtctcacgaagaacttattggcgcagccaccgcccttggtgagcagccagttaaatcacttttggaccctaaggtggctgcccggctggcggtcgcggaagccctgaccaatctggtgtttgccctggtgacggatcttagagatgttaaatgcagcggcaactggatgtgggctgccaaactgccgggcgagggggcggcgctagccgatgcgtgcgaggccatggtggcagtcatggcagccctgggggttgccgtggatggtggaaaggactcgctcagcatggctgcgagggtgggaacagagacggtgagagctccagggagcctggtgatttctgcctatgctgtttgccccgatattacggcaactgtgactcccgatcttaagcacccggaagggagaggtcacctcttgtatgtggccttgagtccaggacaacaccggttgggcggtaccgctctggctcagtgtttttcccaacttggagagcatccgcccgacctggatttacccgagaacttggtgagggcattttcaatcactcaaggcctgctgaaggatcgactcctgtgctctgggcacgacgtgtcagacggaggacttgtgacatgcctcctcgagatggctttcgctggaaactgtggactacaggtggacgtcccggtgcctagggtggatgtgctctcggtactattcgctgaagagcccggcttggttctagaagttcaggaacccgatcttgcacaggtactgaaacggtatagagacgccgggttgcactgcctggaactgggacacaccggcgaggcaggaccccatgccatggtgcgcgtgtctgttaacggggctgttgtcctggaggagccagtgggcgagctgcgagcactctgggaggaaactagctttcagttggacagactgcaggccgagccgcgctgcgtagccgaagaggaaaggggcctgagagagaggatgggtcctagttattgcctgccacccacattccccaaggcgagcgtgccccgagagcccgggggcccatcccccagagtggcaattctgcgagaggaaggtagtaacggtgatcgagaaatggcagacgcttttcacctcgccggctttgaggtgtgggacgtgaccatgcaggacctgtgcagtggcgccattggcctggataccttcaggggagtggccttcgtaggaggcttctcctatgccgatgtgctgggatcagccaaggggtgggccgccgcggtcacattccatcctagggccggagctgagttgcggcggttcagaaagcggccagataccttctcactgggggtgtgtaatggttgtcagttactcgccttgctgggctgggtgggcggcgacccaaatgaagacgctgcagagatgggaccagactcacagcccgcccgtccaggactcctgctgcgccacaatcttagtggcagatacgaaagtaggtgggcctccgtgcgggttggccctggaccagcactgatgttgaggggcatggagggggcagtattgcctgtatggagtgcacatggtgagggatatgtggctttctcctctcccgagctgcaagctcaaatcgaagcaaggggtctcgcccccctccattgggctgacgacgatggaaaccccactgagcaatatcccctcaaccctaatggctcgcctggtggtgtcgccggcatatgttcctgtgacgggcgacacctcgcggtgatgccgcatcctgagcgggctgtgagaccttggcaatgggcgtggcggcccccacccttcgacaccctcactactagcccctggctgcagttgtttatcaatgccagaaactggacgctggagggctcatgttag

SEQ ID NO: 199614 - DNA, 2745 bp, Artificial Sequence
  Description of Artificial Sequence: Synthetic coding sequence
atgttcagcggcggcatcggcagcatggaggccgaccacatcagcaaggaggcacccgagcctgggatggaagtagtgaaggtcggaggtccagtttatagaatcggagtgggggggggggcggctagttccgtccaagttcagggggacaatacttcggacctcgactttggggcagtgcagcgaggggaccccgagatggaacagaaaatgaaccgcgtcatcagggcttgcgtggaggcacccaaaggcaatcccatctgttcactacatgatcagggcgcggggggaaacggtaatgtgttgaaggaattgtcagaccctgctggtgcaattatttacacctccagattccagctgggagaccccacactgaatgctctggagatctggggggctgaataccaggagagcaacgccctgttactccggagccccaatcgcgacttcctgactcacgtgtcagcccgagaaagatgccctgcttgctttgtgggtaccattaccggtgatcgccgcattgttttggtggacgatcgggagtgccccgtgaggcggaacggccagggggatgcgcctcccacccccttacctacccccgttgatctggagttggagtgggtgctaggcaaaatgcctcggaaggaattttttctgcagagaaagcctcctatgctgcagcctttggctctcccgccaggcctgtccgtgcaccaggccttggaacgtgtgttaagactcccggctgttgcgtcaaagagatatttgactaataaggtggatcgctcagtgggcggactagtggcacagcagcagtgcgtgggtcctctgcagacaccgctcgccgacgtggccgttgtcgccctgtcacacgaagaacttatcggagcggccactgcattgggcgagcagcccgttaagagtctcttggacccaaaggtagctgcacgtctggccgtggccgaggcgctgaccaacttggtgttcgcgctcgttacagacctgagagatgtgaagtgttctgggaactggatgtgggccgctaaacttcctggtgagggggccgccttggctgacgcgtgcgaggcgatggttgcggtcatggcggcacttggggtggctgtagatgggggcaaagacagtctgtctatggcggctagagtgggcactgagacagtgagggcccctggctctctcgtcattagcgcatatgcagtctgtccagatattacggctaccgttacaccagaccttaaacaccccgaaggtagggggcatctgctgtacgttgctctgagcccaggccagcaccgactgggcggcacagccctggcccagtgcttctcacagctgggagagcaccctcccgacctggatctcccagaaaatctcgtaagagccttctctatcacgcaggggctcctgaaagaccggctgctgtgctcgggacatgacgttagcgatggaggattggtgacctgcctgttggagatggccttcgccggcaattgcggccttcaagtggacgtacctgtccctcgcgtggatgtgttgtctgtgctgtttgctgaggagcctggactcgtgctggaggtgcaagagccagacttagctcaggtgctgaaacggtatagggacgcagggttacattgcctcgagcttggtcacactggcgaggcaggaccacacgccatggtgcgagttagcgtgaacggggccgtggtgttggaagaacctgtgggagagctccgcgccctctgggaggagacttcatttcagctcgatagactgcaagcggagcccaggtgtgtggccgaggaggaaagaggcctgcgcgagcggatgggccctagctactgcttgccacctacttttccaaaggctagcgtaccaagagaacccggcgggcctagccccagagttgccattctgagggaagagggcagtaatggcgatagagagatggctgatgctttccacctcgctggcttcgaggtctgggacgtgacgatgcaagatttgtgctccggtgctatcggcctagacacgttcagaggcgttgcttttgtcggcggattcagctatgcggacgtcctgggatcggcaaaggggtgggctgcagccgtcactttccacccccgtgctggcgcagagctcagacgtttcagaaagcgcccagatacttttagccttggagtctgcaacggatgccagctgctcgcccttttgggttgggtggggggcgatccaaatgaggatgcggcagaaatgggccccgactcacagccggccaggcctgggttgttgctccggcataacctgagtggtcgttatgaatcacgttgggccagcgtgcgagtgggtccaggccccgcactgatgctccgggggatggagggcgctgtgctcccagtgtggtccgcacatggcgagggatatgtggcatttagcagtccggaactccaggcccagatcgaggcaagagggctcgccccactgcactgggcagacgacgatgggaacccaaccgaacaataccccttgaaccctaatggttccccaggaggggtggccggaatctgcagctgtgacgggagacatcttgccgtcatgccacaccccgagagggctgtgcggccatggcagtgggcgtggcgaccgccgcccttcgatacattgacaacatctccatggctgcagctttttattaatgcaaggaactggaccttggaaggttcctgctag

SEQ ID NO: 199615 - DNA, 2244 bp, Artificial Sequence
  Description of Artificial Sequence: Synthetic coding sequence
gtgaagggcgagcggcggatcgtgctggtggacgaccgggagtgccctgtgagaagaaacggccagggtgatgccccaccgaccccccttcctacaccagtcgaccttgagctcgagtgggtactgggcaaaatgcctagaaaggaattctttctccagagaaagcctcctatgttgcagcccctggctcttcccccaggtctgtccgtgcaccaggcgctagaaagggtgcttcgtctgcctgccgtggcctctaagcgatatttaaccaacaaagtcgaccgatcagtaggcggcctggtggctcagcaacaatgcgtcggccccttgcagacaccattggctgatgttgcagttgtggcccttagccacgaagagctgatcggtgctgccaccgcactgggcgaacagcctgtgaagagcctgctcgacccaaaggttgccgcgcgactggccgtagctgaagctctcaccaacctcgtgttcgccctggtgacagatctgcgcgatgtcaaatgttccggaaactggatgtgggccgccaaactccccggcgagggcgccgcgttggccgatgcctgtgaggctatggtcgctgtgatggctgcactaggggtggctgtagacgggggtaaggactcgctttccatggccgcccgggtagggacagagacagtgcgcgctccaggctccctggtcatcagtgcatacgcagtctgcccggatattaccgctacagtgacgccagatttgaaacatccagaaggacgtgggcatctcctgtatgtggctttatctcctggccaacaccgacttggcggtacagcactggctcagtgtttctcccagctgggggagcatccaccagatctggatctgcccgagaacctggtgcgcgcattctccattacacagggcctactgaaggatcgcttgctctgcagcggacatgatgtctcagacggcggcctcgtgacttgtttgctggaaatggccttcgctggcaactgtggccttcaggtagatgtgcccgtgccaagggtggatgttctatctgtgttgttcgctgaggagcctggtctcgttctggaggtacaagagcccgacctcgctcaggtgctgaaaagatatcgtgatgccgggctgcactgtctagagctcggccatactggcgaagcagggccccacgcaatggtgcgagtctccgtaaatggagctgtggtgctggaggagccagtcggagagcttagggctctgtgggaggaaactagcttccaactcgaccgccttcaagctgagccaaggtgcgtggccgaagaagagcgcggtctgagggaaagaatggggccttcatactgtctgccacctacattccctaaagctagcgtccctcgggaacctggcgggccatctcctcgggtggctattcttcgggaggagggtagcaacggagacagggagatggctgacgcctttcacctggccggattcgaggtgtgggatgttactatgcaggatctgtgtagcggggccattggcctggatacattcagaggggtcgccttcgtcgggggcttctcttatgccgatgtgctgggcagcgcaaaaggctgggcagcggctgtaacattccaccctcgggcgggagccgagttgcgacgatttcggaagagaccagacaccttctctttgggtgtatgcaacggctgccaactcctggccttgctgggatgggttggtggcgacccaaacgaagatgcagccgagatgggccctgactcccagcccgcacggccgggcttactgctgagacacaatttgagcgggcggtacgaaagcagatgggcctcagtgcgggtggggccaggccctgccttgatgctgcgcggaatggaaggtgccgttcttcctgtctggtcggcccatggggaaggatatgtagcgttcagcagcccagagctccaggctcagatcgaagctagagggctggcgcccctgcactgggctgacgatgacggcaatccgactgaacagtatcccctgaacccaaatgggagccctggaggtgtggccggaatttgtagctgtgacgggcgccatctggccgtgatgccccatcctgagagagccgtccgaccctggcaatgggcctggcgtcccccaccgttcgacacgcttaccacctcaccatggctccaattatttatcaacgctcgaaattggacactggaaggaagttgctag

SEQ ID NO: 199616 - DNA, 1302 bp, Artificial Sequence
  Description of Artificial Sequence: Synthetic coding sequence
atggccgcccgggtgctgatcatcggcagcggcggccgggagcacaccctggcttggaagctcgcccagagccatcacgtgaagcaggtgctcgtagcccccggaaacgccggcacagcctgctccgagaagatcagcaataccgccatctccatcagcgaccacactgcgttagcccagttctgtaaggaaaagaagatcgaattcgttgtcgtgggccccgaggcgcccttggccgctggtattgtcgggaatctgaggagtgcgggggttcagtgttttggacccaccgccgaggccgcgcagctggaatcgtccaagcgcttcgccaaggagtttatggatcgacacggtatccccactgcccagtggaaggcctttactaagcctgaggaggcctgtagtttcatattatccgcagatttcccagccctcgtcgttaaagcctcaggtttagcagccggtaaaggagtcatagtggctaagtcaaaggaagaggcctgcaaagctgtgcaggagattatgcaggaaaaggctttcggagctgcgggcgaaacaatcgtcattgaggaactgctggacggcgaggaggtcagctgtctctgcttcacagacgggaagacagtagcaccgatgcccccagcccaggatcacaaacgcctcctggagggcgacggcgggcctaataccgggggaatgggcgcttactgtccagctcctcaagtcagtaacgatttactcttaaaaatcaaagatactgtgcttcagcgtacagtggacggcatgcagcaggagggaactccttacaccggaatcctgtatgccggtattatgctcaccaagaacggtccaaaagttctggagttcaattgtaggttcggcgacccagagtgtcaggtgatactgccattgctcaagtccgatctctatgaagttatccagtccactctggacggcttgttatgcaccagcttacccgtatggctggagaaccacacagcgctcacggtggtcatggcatctaaggggtatcctggagattatacaaagggggttgaaataactggatttcccgaagcgcaagccttaggcctggaagtctttcatgccggaaccgccctgaaaaacgggaaagtggtgacccacggaggccgggtgctcgctgtcacagccatccgagaaaatctcatcagcgcactagaagaggccaagaaaggccttgctgcgattaagtttgaaggagccatctacaggaaagatgtgggattccgcgcgatcgcattcctacagcagccccgttag

SEQ ID NO: 199617 - DNA, 3033 bp, Artificial Sequence
  Description of Artificial Sequence: Synthetic coding sequence
atggccgcccgggtgctgatcatcggcagcggcggccgggagcacacactcgcctggaagcttgctcagtctcaccatgtcaaacaagtacttgtcgcccctgggaatgccggcactgcttgttccgagaagataagcaacaccgccatctcaatttccgatcacaccgccctagctcagttttgcaaggagaaaaagatcgaattcgtggtggtgggacctgaagccccccttgcggctgggatcgtaggaaaccttaggtctgctggagtacagtgttttggccccaccgcggaggcggcacaattggaatcttccaagagatttgccaaagaattcatggaccgccacggaattcctactgctcagtggaaggcattcacgaaacctgaagaggcctgttcctttatcctgtccgccgactttccagctttagtggtgaaagctagtggactggccgctgggaaaggagtgattgtggccaaatcgaaagaagaagcctgcaaggccgtgcaggagattatgcaggagaaagctttcggcgcagcaggagagacaatcgtgatcgaggagctcctggatggagaggaagtcagttgtctgtgttttaccgacggcaagacggtggcaccaatgccccctgctcaggatcacaagcgccttcttgagggagatggcggcccaaataccggggggatgggtgcctactgccctgctcctcaggtaagcaacgacctcctgctgaagataaaagacaccgtcctgcaaagaacagtggatgggatgcaacaggagggcactccatacactggcatcctgtatgcaggaatcatgcttacaaaaaatgggccgaaggttctggagtttaactgtaggttcggcgatcccgagtgtcaggtgatcttgccactcctgaaaagtgacttatatgaggttatccagagcaccctggacggcttgctgtgtacgagcttgcctgtgtggctcgagaatcatactgccttgacggtcgtcatggcttccaaaggctatcccggagattacaccaagggcgtcgagattaccgggttccctgaagcccaggcactaggattagaggtgtttcatgccgggactgcgctaaaaaacgggaaagttgtaactcatggcggacgggtgcttgcagtcacggcgataagggagaacctcattagcgccctggaagaggccaaaaagggactggcagctattaaatttgagggcgccatttatcggaaagacgtcggcttccgcgccatcgcgttcctgcagcagccacgctctctgacctacaaagaatccggcgtagacattgccgcaggaaatatgttggttaaaaaaatacagccactggcaaaagcaacttctcgcagtggctgtaaggtggatttgggggggtttgcagggctatttgatttgaaagccgcaggattcaaggatccacttctagcaagtggaacggatggcgtgggtaccaaactcaaaatcgcccagctgtgtaacaagcacgatactatcggacaggacttagtcgccatgtgtgtcaatgatatcctggcccagggcgccgagccgctgtttttcttggattacttctcatgtgggaaactggacctcagcgttaccgaagcagtcgtcgcagggatcgccaaggcgtgcgggaaggcagggtgtgctcttctcggaggggagactgctgagatgcctgatatgtaccctccaggcgaatacgacttggcagggttcgcggtgggggccatggaaagggaccagaagttacctcacctcgagcggatcacagagggtgatgtcgtggtaggcatcgccagtagcggcttgcacagcaacggcttctccttggtgcgaaaaattgttgctaagagctcactacaatacagcagcccagcacccgacggttgtggggaccagaccctgggggaccttctcctgacacctacgagaatctactcacacagcctcctccccgtgctgcgaagtggtcatgtgaaggcctttgcgcacatcaccggcggcggtctgctggaaaatatcccacgagtgctaccagaaaagcttggggttgacctcgatgctcagacctggcggataccaagggtgtttagctggctccagcaggagggacacctctcagaagaagagatggcgcgaacgttcaactgcggagtgggagcagtgctggttgtcagtaaggagcagaccgaacagatcttgagagatatccagcagcacaaggaggaagcctgggtgatcggatctgtggtcgcacgggccgagggctcacctagggtgaaagtgaagaaccttattgaatcaatgcaaattaacggttctgtcttaaagaatggcagtctcactaaccacttctcgtttgagaagaaaaaggcacgagttgcagtactgatcagcggcactggatctaacctccaggcactgatcgacagtacacgcgaacccaattcttcagcccaaattgacatagtgatttccaacaaagccgcagtggccggcctggacaaggccgaaagagctggcattccaacacgtgtcataaatcacaagttatacaaaaacagagtggagttcgacagtgccatcgatctggtcctagaggaattcagcattgacattgtgtgtctggccgggttcatgcgcatcctttctggccctttcgtgcagaagtggaacggcaaaatgctgaacatacacccctctttactcccgagcttcaagggttccaacgctcacgaacaggctctggagaccggggtgactgtgacgggctgtaccgtacattttgtggccgaagatgtcgacgcaggacagatcatactgcaggaggctgtccccgttaaacgcggggacactgttgccaccctgtcagagagagtaaaacttgcagagcataaaatatttcccgcagcactgcagctggttgcatctgggacggtgcaactcggtgagaatggcaagatttgttgggtcaaagaagaatag

SEQ ID NO: 199618 - DNA, 3033 bp, Artificial Sequence
  Description of Artificial Sequence: Synthetic coding sequence
atggccgcccgggtgctgatcatcggcagcggcggccgggagcacacgctggcatggaaactggcacaaagccaccacgttaagcaggtcctggttgcccctggcaacgctggaactgcttgctcagaaaaaatttctaataccgccataagcatcagcgaccatactgcactggcgcaattctgtaaggaaaaaaagatcgaatttgtggtggtcggccctgaagccccgcttgccgccggcatcgtggggaatttgcggtccgcaggcgttcaatgcttcggccctaccgcagaggcagctcagcttgaaagttctaaaagattcgccaaggaattcatggaccgacatggcatccccaccgcacagtggaaggccttcacgaaacctgaggaagcatgcagcttcatcctctctgccgattttcctgccctagtggtaaaagcgtccggcctcgccgcaggcaagggggtcattgtcgccaaaagcaaggaggaagcctgtaaggcggtgcaggaaattatgcaggagaaagcattcggggctgccggggaaacgattgtgatcgaagagcttttagatggagaagaagtatcctgtctgtgctttacagatgggaaaactgtcgccccgatgccgccggcccaggatcataagcgactcctggagggagatggaggaccaaacactgggggaatgggagcctattgtccagccccgcaagtgtctaatgatctgctactcaagatcaaagacaccgtcctccagagaactgtggacggtatgcaacaagaaggcaccccatatactggtattctttacgccgggatcatgctgaccaagaacggccctaaagtcctggagttcaattgcagatttggagatcccgagtgccaggtcatcctacctctgctcaagagcgacctgtacgaagtcatccagtcaaccctcgatgggctcttatgcacttctctgcccgtgtggctggagaaccataccgcgcttacagtcgtgatggccagcaaaggctatcccggagattacacaaaaggagttgagatcacagggttccctgaagcccaggccttgggcctggaggttttccacgctggcactgcgctcaaaaatggtaaggtggtgacccacggcggcagagtgctcgcagtcaccgccattagggaaaacctgatctccgctctggaggaggcaaagaaggggctcgctgcaatcaagttcgaaggcgctatctaccgaaaggacgtaggcttcagagccatcgctttccttcaacagccaaggagtctcacttataaggagtccggggtcgacatcgccgcagggaatatgcttgttaaaaagatccagcctttagctaaggccaccagtagatccggatgtaaagtcgacctggggggtttcgccggcctgttcgatctcaaggctgcaggctttaaggacccactgctagcctctggcacagatggggtgggtactaagctgaaaatagcccagctgtgcaacaaacatgatacaattgggcaggacctcgtcgcaatgtgcgtgaatgatatccttgcccagggcgctgaaccactgttcttccttgattattttagctgcggcaaattggacctgtccgttacagaagccgtggttgccggcatcgccaaagcctgtggcaaggccggctgcgcactgctgggaggggagactgccgagatgcccgatatgtatcctcctggggaatatgacctggccgggttcgctgtgggtgctatggaaagggaccagaaacttccacacctggagcgcattacagaaggagatgtggtggtgggtatcgccagcagtggcctacactccaacggattttctctggttcgaaagattgttgctaaaagctcgctgcagtattcatcacctgcccctgacggctgtggagaccagaccctgggcgacctcctgctcacgccgacacgaatttactcccactcgctcctgcccgtactcaggagcgggcacgtgaaagcttttgcccatataactggagggggtctcctcgagaacatacccagagttcttccggagaagcttggggtggatctcgacgctcagacctggagaatcccccgtgtgttctcatggttgcagcaggaaggacatctatctgaggaggagatggcccgcactttcaattgcggagtgggtgccgtgctcgtggtaagcaaagaacagactgaacaaatcctacgggacatacagcagcataaggaggaggcctgggtgatcggtagcgtggttgcccgagccgaagggagtccccgggtgaaggtcaagaaccttatcgaatcaatgcagatcaacggctctgtcctgaaaaacggcagtctcacaaaccacttttccttcgagaaaaaaaaagcgagggtggctgttctgattagcggcacaggatccaacctgcaagcgctgatcgattccaccagggagccaaatagctccgcccagattgacatcgtaatcagcaataaagcagccgtagctgggcttgacaaagcagaaagggctgggatccccacacgcgtgatcaaccacaaactgtataaaaacagagtggaatttgatagtgccatcgatcttgtgctcgaggagttctctattgacatagtgtgtctggccggatttatgcgcatcctctctggcccttttgtgcagaagtggaatggaaagatgttgaatattcatccatctctgcttccctccttcaagggaagcaacgcacacgagcaggctctggaaacaggggtgactgtcacaggatgcacggtgcattttgtggccgaagatgtcgacgcaggccagatcatcctccaagaggctgtgccggtgaaacgaggcgataccgtggctaccctaagcgagcgggtcaaactggccgaacacaaaatctttccggccgccctgcagctggtcgctagcggtactgtccagcttggagagaatggcaagatctgctgggttaaggaggagtag

SEQ ID NO: 199619 - DNA, 3033 bp, Artificial Sequence
  Description of Artificial Sequence: Synthetic coding sequence
atggccgcccgggtgctgatcatcggcagcggcggccgggagcacacactcgcctggaaactggcccaaagccatcacgtgaagcaggtgctggtggcgcccggtaacgcgggcacggcctgcagtgagaagatatcgaacactgccatttctatttccgatcatacggccttggctcagttttgcaaagaaaaaaaaatcgagttcgttgtagtcggacccgaagctccactggcagctggaattgtcggaaacctgcgctctgctggagttcagtgttttggacccaccgcagaggccgctcaactggagagctcaaaaagatttgccaaagagttcatggatcgccatggaatccctaccgcacaatggaaggcattcactaagcccgaagaggcatgctcatttattcttagcgctgattttccggcactggtggtcaaagcgtccgggcttgccgcaggtaagggcgtcattgtggccaagtctaaagaagaggcttgcaaagccgttcaggaaataatgcaggagaaagcgtttggtgccgctggagaaaccatcgtaatcgaagagctcctagacggagaagaagtgtcctgcttgtgcttcacagatgggaaaacagtggccccaatgcctcccgcgcaggatcacaagagactgctcgagggcgatggcggacccaatacaggaggcatgggcgcgtactgtcccgcaccccaggtttctaatgacctgcttctcaaaatcaaagataccgtgctacagcgaaccgtggatggaatgcagcaggaaggaaccccctacaccgggatcttatacgcgggaatcatgttgaccaagaacggaccaaaggtcttagagtttaactgcagatttggggatccagagtgtcaggtaattttgcctttactgaagtccgacctatatgaagtgatccagagtactctggatgggctgctgtgcactagcctgcccgtctggctggaaaaccacactgctctgactgtggtgatggcctccaagggatacccgggagactatacaaagggggttgagataacggggttccccgaagcccaagccctcgggttggaagtcttccacgcggggacggctctgaagaacggcaaggtggtaactcacgggggaagagtcctcgctgtaactgccatccgtgagaatctgatcagtgcactcgaggaagcaaagaaggggttggcagctatcaagttcgaaggcgcaatctatagaaaggatgttgggttcagagctatcgcattcctgcaacagccaagatccctcacgtacaaagagtccggtgtggacatcgcggctggaaatatgctggtgaaaaagattcagccgctcgcaaaggccaccagccgatcaggctgtaaggtggatctgggcggcttcgctgggctctttgacctcaaagctgcagggtttaaagaccccctcctggcatctggcactgacggcgtggggacaaaattgaagatcgcgcagctgtgcaataagcatgatactataggccaggaccttgtagccatgtgcgtcaatgacattctggctcaaggagctgaacctctctttttcctggactacttctcttgtggaaaactggatctcagcgttaccgaggccgtcgtggctggtatcgctaaagcctgtggtaaagcaggctgcgccctgctcggcggtgaaaccgccgaaatgcctgacatgtaccctcctggagagtatgacctcgcaggattcgctgtgggggccatggagagggatcagaagttgccacatctagaaaggattacagagggcgacgtcgttgtgggaatcgccagtagcggcttgcattctaacgggttctcactggtccgtaagatcgtcgccaagtcctccctgcaatattccagccccgcgcctgacgggtgcggagatcagacgctcggggatctgctcctcacccctacccgtatttattcccatagtctcctgcctgtcctgcgttccgggcacgtaaaggcgtttgcacacatcacagggggcgggttattagaaaatatccctcgggtgttaccggagaaactgggggtggacctcgacgcacagacttggcgaattcccagagtctttagctggcttcagcaggagggccatcttagtgaagaggaaatggctaggacatttaattgtggcgttggcgcagtcctggttgtctctaaagaacagactgagcagatcctccgcgatatccagcagcacaaagaggaagcctgggtcatcggtagtgtcgtggcccgcgccgaaggtagcccacgagtcaaagttaaaaatctaattgagagcatgcagataaacgggagcgtgctgaagaacggaagcctgacaaaccacttctctttcgaaaagaaaaaagcccgggtggcagtgctgatatctggaacaggaagcaaccttcaggccctgattgatagcactcgagaacccaatagctccgcacagatagacatcgtgatctcaaataaggccgccgttgccggtctggataaagccgaaagggccgggattccgacccgggttataaaccataagctttacaaaaaccgggttgaattcgattccgcaatcgaccttgtactggaggagttttctatagacattgtatgcctggctggtttcatgaggattctctccggaccattcgtgcagaagtggaatgggaaaatgctgaatatccacccctctcttctgccatctttcaaaggcagcaacgctcacgagcaggcgctggagactggagtgactgtgaccggatgcacagtccactttgttgcagaagatgtcgatgcgggccagattatactgcaagaagcggtgcctgtgaaacgcggagacactgtggcaactttaagcgagcgcgtaaaattggccgaacacaaaatctttcctgccgccctgcaactggtggcttctggtaccgtccagctgggtgagaacggaaagatttgttgggtgaaggaggaatag

SEQ ID NO: 199620 - DNA, 699 bp, Artificial Sequence
  Description of Artificial Sequence: Synthetic coding sequence
atggccgcccgggtgctgatcatcggcagcggcggccgggagcacacactggcatggaagttggcgcagtctcatcacgtcaaacaggtgttggtggccccgggtaacgctggcacagcctgctctgaaaagatatcgaacacagcaatttccatcagtgatcatacagccttagcacagttctgcaaagagaaaaagatcgagtttgttgtagtcggccctgaagcccctctggccgccggaatagtggggaatctgcgatcagcaggcgtgcaatgcttcgggcccaccgccgaggccgctcagctggaatcttccaaaaggttcgccaaggagttcatggatcgacacggcattccaaccgcccagtggaaagcgttcaccaagcctgaagaagcttgctcattcatactgtctgcggactttcctgctctggtggtaaaagctagtgggctggccgcaggcaagggggtgattgtagcgaaatccaaggaagaggcatgcaaggcagtgcaagaaattatgcaggagaaggccttcggcgccgctggcgagacaattgtgattgaagaattgttggacggcgaagaagtgagctgcctgtgttttaccgacgggaagactgtggcacccatgccccccgcccaagaccataagcggctgctcgaaggagacggcggacccaatactggtggatag

SEQ ID NO: 199621 - DNA, 726 bp, Artificial Sequence
  Description of Artificial Sequence: Synthetic coding sequence
atggccgcccgggtgctgatcatcggcagcggcggccgggagcacactcttgcatggaaactcgcgcagtctcatcatgtgaagcaagtcttggtggctccaggcaacgctggaaccgcgtgctcggagaaaataagcaacacagcaatctcaatcagcgaccacactgcacttgcccagttttgcaaagagaagaaaatcgaattcgttgttgtaggccccgaagcccctctcgctgctggcattgtgggcaacctgcgttcggcaggagtgcagtgttttgggcctactgcggaagctgcccagctcgagagtagtaaacgatttgcaaaggagttcatggacaggcatggcataccgactgcacagtggaaagcattcactaagcccgaggaggcctgcagctttattttgtccgccgacttccccgctcttgtggtgaaggcctctggcctggcggccggaaaaggggtaatcgtcgcaaaatcaaaggaggaagcttgtaaggctgttcaggaaattatgcaggaaaaggccttcggcgccgccggggaaacaattgtgatcgaagaacttctcgatggagaggaggtgagttgcctgtgcttcacagatgggaagaccgtggcccccatgccaccagcccaggaccacaagcgactgttagagggagatggtggacccaacacaggcggcatgggagcctattgtcctgctccgcagtag

SEQ ID NO: 199622 - DNA, 417 bp, Artificial Sequence
  Description of Artificial Sequence: Synthetic coding sequence
atggccgcccgggtgctgatcatcggcagcggcggccgggagcacaccctggcctggaaactggcacagtctcatcacgttaaacaggtgctagttgctccaggcaatgcaggaaccgcatgcagtgagaaaatttcaaacactgcaatttctatcagtgatcacacagcgctggctcagttctgcaaagaaaagaaaatcgagttcgttgttgtcggtcctgaggccccactggccgccggtattgtcggaaatctgagatccgctggggtacagtgctttggcccaaccgccgaggccgcccagcttgagtcttccaagagatttgccaaggagtttatggaccggcacggaatcccaaccgctcagtggaaggcattcaccaagcccgaggaggcatgctccttcatcctctag

SEQ ID NO: 199623 - DNA, 411 bp, Artificial Sequence
  Description of Artificial Sequence: Synthetic coding sequence
atggccgcccgggtgctgatcatcggcagcggcggccgggagcacacactagcctggaaactcgcccagagccaccacgtgaagcaggtactggtcgctcccgggaatgcaggcacagcctgcagcgaaaagatcagcaacactgccatcagtatctccgaccacactgcgctggcccagttctgtaaagaaaaaaagatcgagttcgtagtggtgggccccgaggcgcctctggcagcaggaatcgtcgggaacctccgatcagcaggagtccagtgcttcggtcctactgccgaagcggcacaactggagagtagtaagaggttcgccaaggaatttatggaccgtcacgggatcccaactgcccagtggaaggcctttacaaaacctgaggaagcttgtagcttttag

SEQ ID NO: 199624 - DNA, 1689 bp, Artificial Sequence
  Description of Artificial Sequence: Synthetic coding sequence
atgctggtgaagaagatccagcccctggccaaggccaccagccggtctgggtgtaaggtggaccttggaggatttgctggcctgtttgatttaaaggctgccgggttcaaggacccactcctcgcctcaggcaccgatggcgttggcactaagctcaagattgcccaactgtgcaacaaacacgatactataggacaagatttagtggcaatgtgtgtaaacgatatcttagcccaaggggcggagcctttgttctttctggactacttctcctgtgggaaactggatctctcagtaacagaggccgtggtggccggaattgctaaggcctgtggtaaagcaggttgtgccctgttgggcggtgagacggccgagatgccggacatgtaccctcccggcgagtatgacctcgcagggtttgcagtcggagccatggagagagatcagaagttaccccacctggaacgcatcaccgaaggggacgtcgtggtgggcattgccagctctggcctccacagtaatggattttctctggttcgcaagattgtggccaagtctagtctgcaatattccagcccagctcccgatggctgtggcgatcaaaccctgggggacctgctgctgacgccaacgagaatttacagtcactctctgctacccgtgctcaggagtggtcacgtcaaagcttttgctcacattaccggcggtggcttgctggaaaatatcccacgcgtattgccagagaagttgggcgtggaccttgatgcacaaacctggcgtataccaagagtgttctcttggctccagcaagagggccatctatcagaagaagagatggcccggacattcaactgcggagttggcgctgtgctcgtggtgtccaaagagcagacagaacaaatcttgcgcgatatccagcagcacaaggaagaggcctgggtgatcggcagcgtggttgcgagggccgagggaagtcccagagtgaaggtgaaaaatctcatcgagtccatgcagatcaacggaagcgttctgaaaaacggatcactgaccaatcattttagctttgagaaaaagaaggctcgcgtggcagtacttatcagtggcacagggagtaaccttcaggcgcttatagatagtactagagaaccaaattcttctgctcagatagatatagtgataagtaataaagccgccgtggccggattggataaagctgagcgtgccgggatccctacacgcgtgatcaaccataagctctataaaaatagggtggagttcgactctgccatcgacctggtactcgaagagttctcaatcgatatagtttgcttagccggctttatgagaattctgtcagggccatttgtgcagaaatggaacggcaagatgctcaacatccaccctagtttactgccctcttttaaggggtcaaatgcccacgagcaagctttggagactggcgtcaccgttacgggctgcaccgttcacttcgtggctgaggatgtggacgccggccaaatcatcctgcaagaggcagtcccggtgaaaaggggtgatactgtcgctacgctgtcggaaagagtgaagctcgccgagcacaagatcttcccagcagcgttacagttggtggcaagcggcaccgttcagctcggtgagaatgggaaaatatgttgggtgaaggaggagtag

SEQ ID NO: 199625 - DNA, 2265 bp, Artificial Sequence
  Description of Artificial Sequence: Synthetic coding sequence
atgagccggcccctgagcgaccaggagaagcggaagcagatcagcgtgagaggcctggccggtgtcgagaacgtcacagagttaaaaaaaaattttaaccggcatctgcactttaccctggttaaggaccgtaatgtcgccacacctcgtgactattatttcgctctggctcacacagttagagaccatctggtgggacgctggattagaacccagcagcattactatgaaaaggatcccaaaaaaatctcaggcgggtggcaaatggaggaggccgacgattggctccgctatggcaacccctgggagaaggcccgcccggaattcaccctgcctgtgcatttttacgggcatgtcgaacatacaagccaaggagcgaagtgggttgacactcaagtagtgctcgccatgccatatgatacaccggtccccggctaccggaacaatgtagtcaataccatgcggctctggtccgccaaagcaccgaacgatttcaacctaaaggattttaatgtcggaggctatattcaggctgtcttggacaggaatctcgctgaaaacatctcaagggttctttaccccaacgacaatttcttcgagggtaaggaacttcgcctgaaacaagaatatttcgtggtagcagctacacttcaggatattattaggcgattcaaatcgtcaaagtttggctgccgcgacccggtccgcactaattttgacgcattcccagacaaagtggctattcaactcaacgatacccacccatccttagctataccagagcttatgcggattctggtggatctggagaggatggattgggacaaggcttgggatgtgaccgtgcgaacttgcgcctacactaatcacaccgttctgcctgaggcactggaaaggtggcccgtgcacctgctcgagacattgcttccacggcatctgcagataatatatgagatcaaccagcgcttcctaaaccgggtggcggccgcctttccaggagacgttgatcgcttgagaagaatgtccttagtggaggagggagccgtgaagaggatcaatatggcacatctatgcattgccggctcacacgccgtcaacggagtggcacgaatccactccgagattctgaaaaagaccatattcaaagacttctacgagctggagccccataaatttcagaacaaaactaacggtatcactccccggcgttggctcgtcctttgcaaccctggtctggccgaggtgattgctgaacggatcggcgaagattttatttcagacctcgatcaattaagaaaattgctctcatttgtggacgatgaggccttcatccgcgacgtagcgaaggttaagcaagagaacaagctgaaatttgccgcctacctggaaagggaatacaaggtgcacattaaccctaactctctctttgacattcaggtcaagcggatccatgagtataaacggcagcttctgaactgtctccatgtaatcacactctacaacaggatcaagcgcgaacccaacaagttcttcgtgccccgaaccgttatgatagggggtaaggccgctcccgggtaccacatggcaaaaatgatcataaggctggtgaccgctatcggtgatgtggtcaatcatgacccagccgtgggcgatcggctgagggtcatttttttagagaattaccgggtgtccctggctgagaaggtgatccccgcggccgacttaagtgagcagatttcaacagcagggacagaggcctcaggcaccggtaacatgaagttcatgctcaatggggccttaactattggtacgatggatggtgctaacgtggagatggccgaggaggcaggagaggagaactttttcatcttcggcatgcgggtcgaggacgtggataagctggatcaacgtgggtataacgctcaggaatactacgatcgcatacccgaactccgccaggtgatcgagcagctcagctctgggttcttcagtcctaagcagcctgacttgtttaaagatattgtcaatatgctcatgcatcacgatagatttaaggtcttcgctgattacgaagattacatcaagtgccaagaaaaagtttctgcattatacaagaaccctcgagaatggactcgcatggtgatcaggaacattgctacctccggcaaatttagcagtgaccgaaccatcgcacagtacgctcgagaaatttggggcgtcgagccttctcgacagagacttcccgctcccgacgaggcaatctag

SEQ ID NO: 199626 - DNA, 3633 bp, Artificial Sequence
  Description of Artificial Sequence: Synthetic coding sequence
atgcggagccggagcaacagcggcgtgcggctggacggctacgccaggctcgtacagcagactatattgtgtcaccaaaatccggtaaccggtctcctccccgccagctatgatcagaaagacgcctgggtgcgggataatgtgtattcaattctggctgtgtggggactggggctggcttaccggaagaatgcagacagagatgaagataaagctaaggcatacgaacttgaacagtccgtggtgaagctcatgcgtggcctcctccattgtatgataagacaagtagacaaagtcgaatctttcaagtacagtcagtcgaccaaagactctcttcacgcaaagtataacaccaagacctgcgctaccgtggtgggcgacgaccagtgggggcacttacagctcgatgcaacaagtgtgtacctgttgtttcttgctcagatgacggcctctggattgcatatcatacatagtctggatgaagtgaacttcatccagaacctggtgttctacatcgaggcagcctataagaccgctgattttggcatttgggagaggggggacaagacaaaccagggcatttccgagttaaatgccagttccgtggggatggctaaagcggcactggaagcccttgacgagctagatctctttggagtcaagggaggaccccaatccgttattcatgtactagccgatgaagtccagcactgtcagtcaatcttaaactccctgctccccagagcctccacatctaaggaggttgacgcttccctgctgtctgttgtctctttccctgcatttgccgtggaagacagccagctggttgagttaactaaacaggagataattacaaagttgcagggccgttacgggtgctgtagatttctccgcgatggatacaagacccccaaggaggaccctaaccgtctatattatgaacccgccgaactgaaactgtttgaaaatattgagtgcgaatggcctctcttctggacttacttcattctggacggtgtgttcagcggcaatgccgaacaggtccaggaatacaaggaagctctggaggccgtactgataaagggaaaaaatggggtgccactgttacccgaactgtacagcgtccctccggatcgtgtcgacgaggaataccagaacccacacaccgtcgatcgagtgcctatgggcaaattgcctcacatgtggggccagagtttgtatatccttggctctcttatggctgaaggattcttggcgcccggagaaattgaccctttaaatcgacgtttcagtacagttcctaagccagacgtggtggttcaggtcagcatactagccgaaacagaagaaatcaagaccatcctgaaagacaaaggcatatacgtggaaaccatcgccgaggtctacccaatacgcgtgcagccggctaggatactctcccacatctacagttctttaggatgcaacaatcgcatgaaactttcagggcgaccctacagacacatgggtgtactgggcaccagcaagctatacgacatccggaaaacaattttcacattcaccccccagttcattgatcaacagcaattctatttggcactggataacaaaatgatcgtcgagatgctcaggactgacctgtcctacttgtgcagccgttggagaatgacgggacaacccaccatcacattccccatcagccactcaatgcttgatgaagacggaacttctttgaattctagcatcttggcggctctccgtaagatgcaggacggctattttggcggcgcaagggtacagaccgggaagctgtctgagtttctgaccaccagttgctgcacacatctgtccttcatggacccaggtcctgaaggaaagctctactccgaggattatgatgacaattacgattatcttgagagtgggaactggatgaatgactacgactcaacttctcatgccaggtgtggagacgaggtggccagatatttagaccatctcttggcccatactgcccctcaccccaagctggcccctacaagtcagaaaggggggctggaccgatttcaagcagccgtgcagaccacctgcgacctgatgtcactcgtgactaaagccaaggaactgcacgtgcagaatgtccacatgtatttgcccaccaagttgttccaggcatctcgaccaagtttcaatctcttagatagcccgcaccccaggcaggaaaatcaagtgccctccgttagagtggagatacatcttcctcgagaccaaagtggggaggtggattttaaagcgcttgttctgcagttaaaggagacctccagtttacaggaacaagccgacattctatacatgttatacactatgaaggggccagactggaatacagagctctacaacgaacggtccgcgacggtgcgggaattgcttactgaactttacgggaaagtaggcgaaatccgtcactggggcctgatacgatacataagcggcatattgcggaaaaaagttgaagcactggacgaagcatgtacagatcttctgagccaccagaaacacctgaccgtcggtctgcctcctgagccccgggaaaaaactatctcggcaccacttccctacgaggcacttacccaactgatcgatgaggctagcgaaggcgatatgtctatcagtatcctgacccaagagatcatggtttacctcgctatgtatatgcggacacagcccggactcttcgcggagatgtttagattacgcatagggctgatcattcaagtcatggcgacagaactcgcacattcgctccgctgtagcgccgaggaggccacagaaggccttatgaatctgtctccgtctgccatgaagaacctcctgcaccacatcctgagtggaaaagagttcggagttgaaagatctgtaagaccgacagactctaacgtttcacctgcgatcagcatccacgagattggagcagtgggtgccacaaagacagagcggactggtatcatgcagctcaagagcgagattaaacagtcccccgggacatcgatgaccccatcttcaggaagcttccccagcgcatacgaccagcaatcatcaaaggattctcggcagggacaatggcagcgccgacggagactagacggagctttaaatcgagtgccagtaggattctaccagaaagtttggaaagtgctacagaagtgccacggacttagcgtcgagggctttgtcctccccagctcaaccactagggagatgacaccgggtgagattaaattttccgtgcacgtggaatccgtgctgaatagagtgcctcaacctgagtatagacagctgctcgtggaggcgatcttggtcttaacaatgcttgccgacatcgagatccactccatcggctctataattgccgtggagaaaatcgtccatattgctaacgatttgttcctgcaggagcagaaaacactgggggctgacgataccatgcttgctaaagaccctgctagcggaatttgcaccctactgtacgactctgccccctctggccggtttgggacgatgacctatctgtctaaggcagccgccacttacgtgcaagagttcctgccacattcaatatgcgccatgcaatag

SEQ ID NO: 199627 - DNA, 3723 bp, Artificial Sequence
  Description of Artificial Sequence: Synthetic coding sequence
atgcggagccggagcaacagcggcgtgcggctggacggctacgccagactcgtgcagcaaacgattctgtgtcaccagaacccggtcacagggcttctgcccgccagttatgaccagaaggatgcttgggtgagagataatgtgtacagcatactggccgtctggggattggggctggcctaccgcaagaatgccgatagggatgaggataaggccaaagcatatgagctcgagcaatcagtggtcaagttgatgcgtgggctgctgcactgtatgatccgccaggtggacaaggtcgagtcatttaagtacagtcagtcaaccaaggactctcttcacgcaaaatacaatactaagacatgtgcaacggtggtgggagatgaccagtggggacatttacagcttgacgccacgtccgtatatctactgttcctggcccaaatgacggcttcagggctgcatattatccacagcctcgatgaggttaacttcatccagaaccttgtgttctatatcgaggctgcatacaagactgccgactttggcatttgggagcgaggggacaagaccaaccagggtatctctgagctgaacgcaagttcagtgggcatggccaaggcagccctggaagctctggacgagctggatctgttcggggtgaagggcggtccccaatccgtgatccacgtcctcgcagatgaagtccaacattgccagtccatcctgaacagtctgctgcctcgtgcctcaacttctaaggaagttgatgcaagtcttcttagtgtggtgagcttccccgccttcgcggtagaagacagtcaactagtggagctgactaagcaggagattatcactaaactgcagggacgctacggctgttgcaggtttttgcgagacggctataagacccctaaggaagacccaaacaggctgtactatgaacctgccgaactcaaactattcgaaaatatcgagtgcgagtggccactcttttggacttacttcattctcgacggggtctttagcggcaatgctgagcaggtgcaggagtataaagaggcacttgaagctgtgctaatcaagggaaagaatggagtaccactcctacccgaactctacagcgttccccccgatagggtcgatgaggagtaccagaacccccacaccgtggatagggtgccaatgggaaagctgccacacatgtggggacaaagtctttatatcttgggctcactgatggctgaggggtttctggcaccaggcgagatcgaccccctgaaccggcggttcagcactgtccctaagcccgacgtcgtggtgcaggtgtcaatcctagccgaaaccgaagaaataaaaaccattttgaaggacaaggggatctatgtggagacaatcgcagaagtgtatcccatccgcgtgcagcctgccaggatattaagtcatatttacagctccctcggctgcaataacaggatgaaactgagtgggcgaccctaccgccacatgggcgtgttagggactagcaagctgtatgacatccgaaagaccattttcacattcacccctcagtttatagatcagcaacagttctacttagcattagataataagatgattgtggaaatgcttcgaaccgatttaagttacctgtgtagccgatggagaatgacaggccagcccacgattacgttcccaattagccattctatgctggatgaggatggcaccagcttgaactcctccattctggcagccttacgcaagatgcaagatgggtacttcgggggcgctcgcgtgcaaactggcaagctaagcgagttccttacaacatcttgttgtacacacctctctttcatggatcccggtcctgaggggaagctttactccgaagattacgatgataattatgactacctggagagcggcaactggatgaatgactacgatagcactagccatgctaggtgtggagatgaggtggctcgttacctggatcatttgctggcccacaccgcccctcaccccaagctggctcccaccagtcagaaaggcggcttagaccgatttcaggctgcagtgcaaacaacttgcgaccttatgagcttggtgaccaaggctaaggaactgcacgttcagaacgttcatatgtatctgccaacaaaactctttcaggcttcccgtccatcatttaatctgctcgactcaccgcatccacggcaggagaaccaggtccctagtgtgcgggtagaaatccatcttccaagagatcagagcggggaggttgattttaaggccctggtgctccagctgaaagaaacctcttcccttcaagaacaggctgatattctctacatgttgtatacgatgaagggccctgattggaacacggagctttacaatgaacgcagcgcgaccgttagagaactgctgacggaattgtatggcaaagtgggggaaatccggcattgggggttgatccgatacatctcaggtatcctcaggaaaaaggtcgaggcgctggatgaggcttgtacagatcttttgagccaccagaagcacctaaccgtggggttgccccctgaacctagagaaaaaacaattagcgcaccattaccctacgaggccttaactcaactcattgatgaagcatctgaaggagatatgtcaatttccatattgacacaggagatcatggtttacctagccatgtatatgcggacgcagccgggactgttcgccgagatgttccgcttgcggattggtctgattatccaggttatggcgaccgagttagcccatagtttgcggtgcagcgcagaagaagccaccgaaggactcatgaacctctccccctcggcgatgaaaaatcttctccaccacattctgtccggaaaggagtttggcgtggagaggtctgtaaggcctacggactctaacgtatcacctgccataagtatccacgagatcggggctgtgggcgctactaaaaccgagcggacaggcattatgcagctaaaatctgaaatcaagcaggtggaatttaggcggcttagcatttccgccgagagccagagtaatggaggacaccccctggggattgatctcatgtctcctagctttatgagccccggaacttcaatgacccctagctctggtagcttcccttcagcctacgaccagcaatcctctaaagatagtcggcagggacagtggcagcgcagacgaagattggacggagccttaaatcgggtgcctgttggcttctaccaaaaggtttggaaggtgctgcaaaagtgccacggtctgagcgtggaagggttcgtgctcccttccagtactacccgcgaaatgactccaggtgagatcaaattctcagttcatgttgagagcgtcctcaacagggtgccacaacccgaataccgacagctactggttgaggccattttagtgcttacgatgttggcagacatcgaaatccactccatcgggtctattatcgctgtggagaagatcgtccacatcgccaatgacctgtttctgcaggaacagaaaacgctgggggcagacgacacgatgttagctaaagatcctgcttcaggtatatgcaccttgctgtatgacagcgcccctagcggccggttcggtaccatgacatatctaagtaaggccgccgcaacgtacgttcaggagttcctcccccactcaatctgcgcaatgcagtag

SEQ ID NO: 199628 - DNA, 3672 bp, Artificial Sequence
  Description of Artificial Sequence: Synthetic coding sequence
atgcggagccggagcaacagcggcgtgcggctggacggctacgcccgcttagtccagcagacaatactttgtcaccagaacccagtcaccggccttctgcccgcatcttatgatcagaaggacgcttgggttcgtgataatgtgtactctatactggcagtctggggactgggcctggcctacaggaagaacgctgacagggacgaggataaggccaaagcctacgagttggagcaatcagtggtgaagcttatgcggggactccttcactgcatgatccgtcaggtcgacaaagtcgaatcatttaaatatagtcaatctacaaaagactctctgcacgccaaatacaacacaaaaacgtgcgcgactgtggtcggcgacgatcagtggggccacctacagctcgacgccacaagcgtgtacctgctttttctggctcaaatgaccgccagtggactacacattatccatagtctggatgaggtgaattttatccagaaccttgtgttctacatcgaggccgcttataagacagcggatttcggtatctgggagcggggcgataaaacaaaccaggggatttcggagctgaatgcttcctccgtcgggatggctaaagccgcacttgaagcattggatgaactggacctatttggcgtaaagggcggaccacagtctgtcattcatgtcctggctgatgaggtgcagcactgtcagtctattctgaatagcctactccccagagctagtactagcaaggaggtcgacgcctcccttctatccgtcgtatcatttcccgcgttcgccgtcgaggactcacagctggtagaattgacaaagcaagagatcattacaaaactgcagggcagatacggctgctgcaggtttctgagagatggatataagaccccaaaggaagatccaaatcgcctgtattacgagccggcagaactgaagttatttgaaaatatagaatgtgagtggccacttttctggacctacttcatcctggatggcgtatttagtggcaatgccgaacaagtacaggagtacaaagaggccctagaagccgtactgattaaaggaaagaacggtgtgccgctgcttcctgaattatattcagtgcctccggatcgcgtggatgaagaataccagaacccccacaccgttgacagggtaccgatgggaaagctgcctcacatgtggggtcaatcattatacatacttggctccctgatggctgaaggtttcctggctccaggcgaaatcgaccccctaaataggaggttctctactgtgccaaagcctgacgttgtggttcaggtctcaatccttgccgaaacagaggaaattaagacgatcctgaaggataaggggatctatgtggagaccatcgccgaggtgtatcccattagagtccaaccagcccgcattctgtcgcatatatactctagtctgggctgtaacaacagaatgaagctcagcggtagaccctacaggcacatgggcgtcctcggcacaagtaaactgtatgacattaggaagacaatctttacctttaccccccagttcattgatcaacagcagttctacctcgcgctggataataagatgattgtggagatgctcagaactgacctctcgtatctgtgtagtaggtggaggatgacaggacagcccaccatcacctttcctatctcccattctatgctcgatgaggacgggacttccttaaactcaagtattcttgcagccctgagaaagatgcaggatgggtactttggaggcgcccgggtgcagactgggaagctgtcagagttcctgactacaagttgctgtacccatctgtcttttatggaccccggacctgaggggaagttgtatagcgaggattacgacgataactacgattacctagagtccggtaactggatgaacgactatgattctacatcacatgctcgctgtggcgacgaggtagccaggtacttagaccacctgctggcgcataccgccccacaccctaagttagcacccacctctcagaaagggggattggatcgctttcaggctgccgtccagacaacgtgcgatctgatgagccttgtcacaaaagcgaaggagctccacgtgcagaacgtgcacatgtacctacccacgaagctctttcaggcatcgcgacctagctttaacttactcgatagtccccatcctaggcaggaaaatcaagtgcccagtgtcagggtcgagattcacctcccaagagatcaaagcggagaagtggattttaaggctctggtgttgcagttgaaggagacctcttcattgcaggagcaagccgatatactgtacatgctctatacaatgaaaggcccagattggaatactgagctgtacaatgagcgctctgctacagtccgggagcttttaaccgagctgtatggtaaggttggagaaattcgacactggggactgattagatatatctccgggattcttagaaagaaagttgaggctctggatgaggcctgtacagatcttctgagccaccagaagcacttaacagttggattgccaccggagcctagggagaaaacaatctctgcgccactgccatacgaggcattaacccaacttatcgatgaggcatccgaaggagacatgagtatctcgattctgacacaggaaatcatggtgtacctagccatgtatatgcgcacccagcctgggctgtttgccgaaatgtttagactgaggattggtctcattatccaggtcatggccaccgagctggcgcactccttacgatgtagtgccgaggaggctacagaaggacttatgaatctctcaccttccgctatgaaaaatctgttgcaccacatcctctcaggtaaggaattcggggtggagagatcggttcggcccaccgactcgaacgtgtcccccgctattagcatccacgagattggcgctgtaggcgctaccaagacagagcgcaccggcatcatgcagctcaagagtgagattaagcaggtagagttccgaaggctgtccatatctgccgaaagccaaagccctggtacatctatgacaccatcttccggctcattcccatcagcgtacgatcagcagagcagcaaagactcaagacaggggcagtggcaaaggaggcgccggttggatggagccttgaaccgggtcccagtgggtttttaccagaaggtatggaaagtgttgcagaagtgccatgggctctccgtagaaggctttgtgctgccaagctcaactactcgcgaaatgacccctggtgagattaaatttagtgttcacgtggaatccgttctgaatagggttccacagcccgagtaccggcaactgttggtggaggccatcctagttctgactatgctggccgatatcgagatccactcaatcggatcaataattgccgttgaaaagatcgtacatattgccaatgacctcttcctgcaggagcaaaaaactttgggcgccgacgataccatgctagctaaagaccccgcctccgggatttgtactttactctacgattctgcaccgtcaggtcgtttcggtacaatgacttacctcagcaaagctgccgccacctacgtccaagaattcctgcctcattcgatctgtgctatgcaatag

SEQ ID NO: 199629 - DNA, 3546 bp, Artificial Sequence
  Description of Artificial Sequence: Synthetic coding sequence
atgcggagccggagcaacagcggcgtgcggctggacggctacgccaggctagtacaacagacaatactctgccaccagaaccctgtcacaggattactacctgccagctatgaccagaaggatgcctgggtccgagacaacgtgtacagcattttagcagtctggggtctgggtttagcttatcggaagaatgccgatagggatgaggacaaggctaaagcttatgaactcgagcaatctgtggtgaagttgatgcggggtttgctccactgtatgatcaggcaggtggacaaggtggagagctttaagtatagtcagagcactaaagattctctgcatgcaaaatataacaccaagacgtgcgctactgtagtcggagacgatcaatggggacacctccagctggacgccacgtctgtgtatctccttttcctcgcacaaatgacagcatctggcctccacataattcactctctggacgaagtgaattttatacaaaatctcgtcttttacatcgaggctgcctacaagacggcagactttggcatatgggagagaggcgacaagaccaaccaaggaataagtgagctcaacgcttcttccgtgggaatggctaaagctgcactcgaggccttggacgaactcgacctttttggcgtcaaaggggggcctcaaagcgttatccacgtcttagcggacgaggtccagcactgccagtcaatattgaattccttgttaccgcgggcctcaacctctaaagaagtagacgcatcacttctgtcagtcgtcagcttccccgccttcgctgtcgaggacagtcagctggtggaactgactaaacaggagataattacaaagctgcagggccgctacggctgttgtcgctttcttagagacggttataaaacacctaaagaagacccgaatcgcctctattacgagcccgcagagctgaagttgttcgagaacatcgaatgcgaatggccattgttctggacatatttcattttggatggagtgttttcagggaatgcagagcaggttcaggagtataaggaggccctggaagcagtgctgattaaggggaagaacggagtgcctctgctccctgaactatattccgttcctcctgaccgggtggacgaggagtaccagaatccccacactgtagacagggtgcctatgggtaagttgccgcacatgtgggggcagtccctgtacatactcgggtctctgatggccgagggctttttagccccaggggagatagatcccctgaaccgccgattttccaccgtaccgaaacccgatgtcgtggtgcaggtctctatcctcgccgagacggaggagatcaaaaccattctgaaagacaaaggaatttatgttgaaactatcgcggaagtataccctataagagtgcagcccgctcgaatactgagccacatatactcctctttaggctgcaacaaccggatgaagcttagcggcagaccgtacagacacatgggagtgcttggaactagtaagctgtacgacatcagaaagacgatcttcactttcacacctcaatttatcgatcagcagcagttctacttggcactggacaacaaaatgatcgtcgagatgttacggactgatctgagctatctgtgcagtcgctggaggatgactggacaacccaccattacgttccctatcagtcattccatgcttgatgaagacggtacctccctgaacagttcaattttggctgccttgcgtaaaatgcaggatggctactttggcggcgcccgtgttcagacaggcaagctgagtgagtttttgaccacatcctgctgcacgcatctttcattcatggaccctggaccagaaggtaagctatactctgaggactacgatgataattacgattacttagagtctgggaattggatgaatgattacgacagcactagccacgatgtccatatgtacctccccaccaagctcttccaagctagtcgaccctcctttaaccttctggatagcccacaccctcggcaagaaaaccaagtcccctctgtgagggtggagatccatctgcctcgagaccagtcaggcgaggttgacttcaaggccctggtgttacagctcaaggaaacatcgagtctacaggaacaggccgatattctctatatgctgtatacaatgaagggtccggattggaatacagagttatacaatgagcgctccgccacagttagggagctcttaacagagctctacgggaaggtgggcgagattaggcactggggtttgatccggtacatttcgggcattctcaggaaaaaggtggaagcactcgacgaggcttgcactgaccttctgtcccaccagaagcacttgacagttggactgcctccggagcctcgcgagaaaacgatctcagcgcccctcccgtacgaggctctaacacagctaattgatgaggcctcagaaggcgatatgagtatctccatccttactcaggaaattatggtctacttggctatgtatatgcgcactcagcctggactgttcgccgaaatgtttaggttgcgaatcggccttatcattcaggtcatggccacggaactcgctcattctctgcggtgcagcgctgaggaggccaccgagggcttaatgaaccttagtccatctgctatgaaaaacctgttacatcatatcctgagcgggaaggagttcggggttgagcgctccgtgcgacctactgactccaacgtgagtccagcaatttccattcacgagataggagccgtcggcgctactaaaacagagagaaccgggatcatgcagctgaagtcagaaataaagcaagtcgagttccggaggctgtcaatcagcgccgaaagccagtcgaacggaggtcacccactgggcatcgacctaatgtcaccctcattcatgagcccgggaacttccatgaccccaagttcaggaagcttcccatccgcatacgatcaacagagttcgaaagactcacggcagggacagtggcaaaggcggagacgtctggatggagccctgaaccgggtgcctgtcggcttctaccagaaggtgtggaaggttctccagaagtgccatggccttagcgtggaggggtttgtcctcccttcgtctactactagggagatgacgcctggtgaaataaaattttctgttcacgttgagagcgttctgaatcgagtgccccagccggagtaccgccaactgctggtggaagcgattttggtattaacaatgttagccgacattgagattcacagcataggcagtatcatcgcagtcgaaaaaattgtgcatatcgcaaacgacctgttcctgcaggagcagaaaacactgggcgctgatgacaccatgctcgcaaaggacccggcttctggaatctgcactctcctgtacgactcagcaccctcagggaggttcggtaccatgacgtatttgtccaaggccgcagccacctatgtccaggaatttctgccgcattctatctgcgctatgcaatag

SEQ ID NO: 199630 - DNA, 3456 bp, Artificial Sequence
  Description of Artificial Sequence: Synthetic coding sequence
atgcggagccggagcaacagcggcgtgcggctggacggctacgcccgactcgtgcagcaaactattctgtgtcatcagaacccggtcacaggattactgcccgccagctatgatcagaaagacgcttgggtgcgggataatgtgtactcgattctagcagtgtggggcctaggcctggcttaccggaagaatgccgaccgcgacgaggataaggctaaagcatacgaactcgagcagagcgtagtgaagctgatgaggggcctattgcactgcatgatccgccaggtggacaaggtggagtctttcaaatattctcagagcaccaaggatagcctccacgcaaagtacaataccaaaacatgtgctactgtggttggtgatgatcagtggggccacctgcagcttgacgccacgtctgtgtatctccttttcctagcacaaatgaccgcctccggtctgcatattatccattctctggatgaagtcaatttcattcagaaccttgtcttctatatagaggcagcctacaaaaccgctgattttggaatttgggaacggggagacaagacaaaccagggcatctccgagctgaacgcctcaagcgtgggtatggccaaagccgccctcgaagcactggatgagctggatttattcggggtgaaaggaggccctcaaagcgtgatccacgtgctggctgacgaagtccagcattgtcagagtatactgaattctctcctcccgagggccagcacctctaaggaagtcgacgcctcactgctgagcgtggttagcttcccagccttcgccgtcgaagacagccagttggtagagctgactaagcaagaaatcattactaaactgcagggccgctatggatgttgtagattcctccgcgatggatataagacacctaaggaagatcctaatagactatattatgagcctgccgagctcaaacttttcgagaatatagagtgcgagtggcctctattttggacttacttcattcttgatggagtttttagcggcaacgcagaacaagtccaggagtataaggaggccctagaagcagtcctgattaagggcaagaatggggtgccccttttgccagagttgtacagcgtgccgcccgaccgtgttgatgaggaatatcagaacccccacacagtggaccgcgtacccatgggtaaactcccccatatgtgggggcagtctctttatatactgggttctctgatggcggagggttttcttgcccccggggaaattgatcctctcaacaggaggttcagcaccgtaccaaagcctgacgtagtcgtgcaagtgagcatcctggccgaaaccgaggagattaaaacaatcctgaaggacaagggcatctatgttgaaacgattgcggaagtctatccaatcagggtacagcctgctaggattctgagtcacatttactcctctctaggttgcaataaccgaatgaagctaagcgggcggccttataggcatatgggggtcctgggaacaagcaagctgtacgacataaggaaaactatctttacattcactcctcagttcatagaccaacagcagttctacctggcactggacaataaaatgatagtagaaatgcttaggacagacctatcctacctctgcagcaggtggcgcatgacaggtcagccaactataactttccctatctctcacagcatgttggatgaggacggcacctccctgaattccagtatcctcgccgcactacgtaaaatgcaagatggatacttcggaggcgcccgggtccaaaccggcaagttgtccgagtttcttactacatcctgttgtacgcatctgtccttcatggaccccggacctgagggtaagctatactctgaggattacgacgacaattacgattacctggagtcaggcaattggatgaatgattacgattccacaagccacgacgtccatatgtacctgcccactaaattgtttcaagcttcaaggccgtctttcaatctcctggacagtccgcaccctcgacaggaaaaccaagttccatcggttcgagtggagattcatttaccaagagaccaaagcggtgaagttgattttaaagctttagtactccagttaaaggagacaagctctctccaggaacaggctgacatcctctacatgctctatacaatgaagggaccggactggaacactgaactctacaatgaacggtcagctactgtacgggagctcctgaccgagctttatgggaaagtgggggaaatccggcattggggacttatccggtatatctctggtattctgaggaaaaaggtggaggccctggacgaagcatgcaccgatctactctcacatcagaagcacctcaccgtgggattgccccctgagccacgtgaaaagacaatctctgctccgctcccgtatgaagccttgacccagttgatcgatgaagcaagcgaaggggacatgagtattagtattctgacccaggagatcatggtctaccttgcaatgtacatgaggactcagcccggcctgtttgccgagatgttccggcttcgaatcggcttgattatccaggtaatggctacggagctcgcacactcactacgttgctcggccgaagaggcaactgagggcctgatgaatctgtccccaagcgcgatgaagaacctgttgcaccatattctgtccggcaaggagtttggagtggagcgcagcgttagaccaaccgattccaacgtgagtcccgccatctctattcacgaaataggcgcggtgggggctacgaagaccgagagaacgggaatcatgcagctcaaatccgaaatcaagcagtcccctgggacctcgatgactccctctagcggctctttcccttctgcttacgatcagcaatccagcaaggatagtagacaaggccagtggcaaagacgccgccggctagatggggcattgaaccgggtgccagtggggttttaccagaaggtgtggaaagtattgcagaaatgtcacggactgtcagtggaagggtttgtcctgccttcatccactacacgcgagatgacccctggggaaatcaaattcagtgtgcatgtagagagcgttcttaaccgcgtgccacagccggagtacagacagcttctcgtggaagctattctggtgctgacgatgctcgctgatattgaaattcacagcatcgggtctattattgcagtggagaagattgtacacattgcaaacgacctgtttctccaggaacagaaaaccctgggagccgatgacaccatgctggccaaagatcctgcttccggcatctgcactctcttatatgattccgccccatctgggcgtttcggcacgatgacttatttaagcaaggccgccgccacttacgtacaagaatttttacctcacagtatatgtgccatgcagtag

SEQ ID NO: 199631 - DNA, 1164 bp, Artificial Sequence
  Description of Artificial Sequence: Synthetic coding sequence
atgacccgggacgaggccctgcccgacagccacagcgcccaggacttctatgaaaactacgagcccaaagaaatactcggaagaggcgtatctagtgtggtacgacgctgtatacacaaaccaactagccaggagtacgcagttaaggtaatcgatgtgacaggcggcggcagcttctcacctgaagaggtgagggaactccgggaagccaccctaaaagaagtggatatcctccgcaaggtatccgggcatcccaacatcatacagctcaaagatacgtatgaaaccaacaccttctttttcctcgtgtttgaccttatgaagcgaggagaactgttcgattacctgacagaaaaggtcacattgtccgagaaggagaccaggaaaatcatgcgcgcgcttttggaagtcatctgcacactgcacaaattgaacatagtgcaccgcgaccttaagccagagaacattctgcttgacgacaacatgaatatcaaactcacagactttgggtttagttgtcagctggaacctggcgagagacttagggaggtgtgtggaacaccgagttatcttgcacccgaaattatcgaatgctctatgaacgaagatcaccccgggtatggtaaagaggtagacatgtggtctacgggagtgatcatgtatacccttctggcaggctccccccctttctggcacagaaagcagatgctgatgttgagaatgatcatgtctggcaactatcagtttggctcaccagagtgggatgactactcagacaccgtcaaagatctcgtgtcaaggtttctggtcgtgcagccccagaaccggtacactgcagaggaggcgctggctcacccatttttccaacaatatctggttgaagaagtgagacatttctcacctcgcggcaagtttaaggtgattgcgttgacagtactggcaagcgtgaggatttactatcagtaccgaagggtcaagcctgtcactagggagatagttatcagggatccctatgctttgcggcccctccggcgcctcatcgatgcatacgcatttaggatctatggacattgggttaaaaaaggccagcaacagaaccgcgccgccctgtttgaaaatactcctaaagcggtgcttctgagcttagcggaagaggattactag

SEQ ID NO: 199632 - DNA, 1260 bp, Artificial Sequence
  Description of Artificial Sequence: Synthetic coding sequence
atgacccgggacgaggccctgcccgacagccacagcgcccaggacttctacgagaattacgagccgaaggaaattctcggaaggggcgtctcttctgttgttagaagatgtatccataaacctacatcccaagaatatgctgtgaaggtaatcgatgtgactggcggagggtctttctctcctgaagaagtgcgcgaattgagggaagcgactctgaaggaagtggatatcctgcgcaaagtatctgggcatcccaatattatccagctcaaggacacttatgaaacaaatacattttttttcctggtcttcgacctgtgggaggataccgacactatggaaatggaacaaaagtggtgcctcgggtgggattctcccaagtcaacaaatttccgcgcgcagggccgggcaaggatgaagcgcggagaattgttcgattacctaaccgagaaagtgaccctatctgagaaggagacaaggaagatcatgcgggctctgttggaggtgatctgtactctgcataaactcaacatcgtgcacagagatctgaagcccgaaaatattctcctggacgataatatgaacattaaacttaccgatttcgggttctcttgccaactcgaacccggtgagcggctgagggaggtgtgcggtaccccctcctaccttgctccggagatcatcgagtgttccatgaatgaagaccacccgggctacggtaaggaagtcgatatgtggagcaccggagtcatcatgtatactctcctcgctggcagtcctcccttctggcaccgcaaacagatgcttatgttacgtatgattatgtctgggaattatcagttcgggtccccagagtgggacgattattcagataccgtgaaagatttagtgtcccggtttttggtcgtgcagcctcaaaacaggtatactgccgaagaggccttagcgcaccctttcttccaacagtatctggtggaggaagttcgacacttctcgccgcgaggcaagtttaaggtgattgcattaactgtgctggcatctgtacggatctactatcagtaccgtagagtgaaacccgtcacccgggaaatcgtaatccgagacccgtatgcactgcgccccttacggcgtcttatcgacgcttacgcttttcgaatctacggccattgggttaaaaagggacaacagcagaatcgggccgcactgtttgagaatacccccaaggccgtcctactatccctagcggaagaggactattag

SEQ ID NO: 199633 - DNA, 1002 bp, Artificial Sequence
  Description of Artificial Sequence: Synthetic coding sequence
atgcacccccaggcccacgagcccggcgtgcggcgggagggccaccgaaggcacaggtggcggcagctccagccgggcgggggcgctggagcggcgcggtctcacgccgaggggggcgggcaccccgctcaaggcttgcgggcccctcagcaccagatgaagcggggagagctgtttgattacttgaccgagaaggtcacacttagtgaaaaggagacaaggaagattatgagggccctgcttgaagtgatttgcactctccacaagcttaatattgtgcacagagacttgaaacccgagaatattctgttggacgacaatatgaacattaaacttacagacttcggattttcatgccagctcgagccaggtgaacgattgcgtgaagtttgtggcacaccatcctaccttgccccggagataatagaatgcagcatgaacgaagaccaccctggatatggaaaagaggttgacatgtggagcaccggcgtgatcatgtacactctcttagccgggtctcccccattctggcacaggaagcaaatgcttatgctgagaatgattatgtcgggcaattaccagttcggcagccctgaatgggatgattactccgatactgtgaaggaccttgtgagtcgctttctggtggtccagccacagaatcggtataccgctgaagaggctctggcgcacccgttcttccaacagtacttggttgaagaggttcggcatttcagtcccaggggtaagtttaaggtgattgcgttgaccgtgttagcttccgtgcggatatattaccagtatagacgggtaaaaccagtgactagggaaatcgtcattcgcgacccatatgcgctaagacccctacgaagactgatcgatgcttacgctttcagaatctatggccattgggtcaaaaagggccagcagcagaacagggccgccctcttcgagaatactcctaaagcagtgctcctatcgctggccgaagaggattactag

SEQ ID NO: 199634 - DNA, 2529 bp, Artificial Sequence
  Description of Artificial Sequence: Synthetic coding sequence
atgagccggcccctgagcgaccaggagaagcggaagcagatcagcgtccggggactcgctggcgtggagaatgtgaccgaactaaagaaaaacttcaatcgccacctgcacttcactctggttaaagatcggaacgtggctacacctcgcgattactacttcgctctcgcgcacacagtgcgggaccatcttgttggcagatggatccggactcaacagcactactacgaaaaagaccccaaacggatctactatctgagtctcgagttttatatgggccggacattgcagaacactatggttaatctggcactagaaaatgcctgcgatgaggctacataccaactgggactggacatggaggaacttgaagagattgaggaggacgcggggctgggtaatggtggcctcgggagactggcagcatgtttcctggactcaatggccacactaggtctagctgcttacgggtatggcatacgctacgaatttggaatttttaatcagaaaatcagtggtggctggcagatggaagaagccgacgactggctgaggtatggaaatccgtgggaaaaggctcggcccgagtttacccttcccgtgcatttttacggacacgtggagcacacaagtcagggcgcgaagtgggtggatactcaggtggtgctggctatgccctacgacacgcctgttccaggatatagaaacaatgttgtgaacactatgagattgtggtccgcaaaggcccccaacgatttcaacctgaaagactttaatgtgggaggctatattcaggcagttctcgatcggaacctggcggaaaacatcagtcgagttttgtacccaaatgataatttcttcgaaggaaaggagctgcggttgaaacaggaatatttcgtcgtggccgctacattacaggatataatccgcaggttcaagtctagcaagttcgggtgccgcgaccctgttagaactaacttcgacgccttccccgacaaagtggcaatccagcttaacgacactcatccctccctggccatccctgaattgatgcggattctggtagacctggagcgcatggactgggacaaagcttgggacgtgacagtgcggacttgcgcctacacaaaccacacagtgttgcctgaagctcttgagcggtggcccgtgcacctgctggagaccctgctgccacgacacctgcagattatatatgagataaatcaacgattcctaaacagggtggccgctgcattccccggagatgtggacagacttcgtaggatgtccctagtggaagaaggcgcggttaagaggattaacatggcccatttatgcattgcgggttcccacgcagttaacggtgtggcccggattcactcagagattctgaagaaaaccatcttcaaggatttctatgagctggagccacacaaattccagaacaagaccaacgggatcactccaaggaggtggctggtgctgtgtaaccccggactggcggaagtgattgcagagaggatcggcgaagactttatttctgatctggatcaactaaggaagctgttgtcatttgtcgacgatgaagccttcatccgggacgtcgctaaagtgaagcaggaaaataaacttaagtttgccgcttatttggagcgggagtacaaagtgcatatcaaccccaacagcctcttcgatatccaagttaaaaggatccacgaatacaagaggcaattgctcaattgtttgcacgtgatcacactgtataataggataaagcgcgaacctaacaagttttttgtcccaagaacagtgatgatcggggggaaagctgcacctggataccacatggcaaagatgatcattagactggtgactgcaattggtgacgtggtaaaccatgatccggcagtgggcgataggctgagagttatttttctggagaactatcgggttagtttggctgagaaagtgatccctgcagcagacctgtctgaacagatttccaccgctgggaccgaggcctcaggcaccggcaatatgaagtttatgctaaatggggcccttactatagggactatggatggcgccaacgttgagatggccgaggaggctggagaggaaaactttttcatctttggcatgcgcgttgaagacgtggacaaactcgaccagagaggctacaatgcacaggaatactatgacagaatacccgaactgaggcaggtgattgagcagctgagcagcggttttttcagcccaaagcaaccagacctgttcaaagacattgtcaacatgctcatgcaccatgaccggttcaaagtgttcgctgactacgaggattatattaaatgccaggagaaagtaagcgctctctataaaaaccccagggaatggacccgaatggttattaggaatatcgcgacgagcgggaagtttagttctgacagaacaattgcccagtatgcacgcgagatctggggggtcgaaccgtcaaggcagcgcctgcctgctccggacgaggcaatctag

SEQ ID NO: 199635 - DNA, 2499 bp, Artificial Sequence
  Description of Artificial Sequence: Synthetic coding sequence
atgagccggcccctgagcgaccaggagaagcggaagcagatcagcgtaagaggcctagccggggttgagaacgtgactgaacttaaaaaaaattttaatagacacttacactttactctcgtgaaggaccggaacgtcgccacccctcgtgactattacttcgccctggcccataccgtgagggaccacttggtagggcggtggatccgtacccagcagcattactatgagaaggatcccaaaagaatttactatttatctctggagttttatatgggaaggacactgcagaacactatggtcaatttagcactggaaaatgcatgcgatgaggccacttaccaggtcgggcttggtcgcctggcagcctgtttcttggactcgatggccaccctaggactggccgcctacgggtatggcatccggtacgaattcggcatcttcaaccagaagatcagcgggggctggcagatggaagaggccgacgattggctgcgctatggaaacccctgggagaaggccaggcctgaattcacgctcccagtacatttttatggacatgtcgaacacactagccagggggcgaagtgggttgatacacaggtggttctcgcaatgccctatgatacccccgtgcccggctatcgaaataatgtggtgaacactatgcggctctggtcagccaaagcccctaatgatttcaatcttaaggattttaatgtgggagggtacatccaggcagttctcgacagaaacctcgccgaaaacatcagtagagtgttgtaccccaacgataacttcttcgagggcaaagagctccgattgaaacaggaatattttgtggtggccgcaacactgcaggacattatccgtagattcaaaagctcgaaattcggctgtcgcgatcccgttcgtactaactttgatgcattccccgataaagttgcgattcagctgaacgacacccatcctagcctcgccatccctgagctgatgcgaattctcgtagacctcgagcggatggactgggataaggcatgggacgtgacagttcggacgtgcgcttacaccaatcacaccgtgctcccggaggcattagagagatggcccgtacatctgctggaaacactgttacctaggcacctgcagatcatatatgagatcaaccagagattcctgaatagggtcgccgctgccttcccgggagacgttgataggttaaggaggatgagtctggtggaggaaggtgccgtgaagcgaatcaacatggcccacctctgtattgcaggttcgcacgctgtgaatggcgtcgcaaggatccatagcgaaatcctcaagaaaactatatttaaggatttctacgaactggagccacataaatttcagaataagactaatggaatcacgccgaggagatggctggtgctttgtaaccctggcttggcggaagttattgccgaacgcatcggcgaggactttataagtgatttagatcaactcagaaaattgttatcattcgtggacgatgaagcctttatccgagatgtggccaaagtgaaacaggaaaacaaactcaaatttgccgcctatttggaacgcgagtacaaggtccacatcaaccctaatagtctgtttgatatccaggtgaaacgcatccacgaatacaagcggcaactccttaattgcctccacgtgatcacactatacaatagaatcaaacgcgaacccaacaaatttttcgtcccccggacagtcatgattgggggtaaggcagcccccggctatcatatggctaagatgatcatccgcctggtgactgctatcggtgatgtggtgaaccacgatcctgccgtcggagaccgcttacgcgtgatctttctggagaattacagagttagcttagccgagaaggtcatcccagctgccgatttgagtgaacagatctccacagccggaactgaggcaagtgggacaggaaacatgaagtttatgctcaatggagcattgacgatcgggaccatggatggtgcaaatgtggaaatggccgaggaagcaggagaagagaattttttcattttcggaatgcgagttgaggatgtcgataaattggatcagcgcggatacaacgcacaagaatactacgaccgaatcccagagctcagacaagttatagaacagctttcctctggattctttagcccaaaacagcctgaccttttcaaagacatcgtgaatatgctgatgcatcatgaccgtttcaaggtgttcgctgactacgaggactatatcaagtgccaggagaaagtatcagcactctacaagaacccgagagagtggacccgaatggtgataagaaatatcgcaactagcggtaagttttcatccgatcgcaccatcgctcagtacgcccgggagatctggggggtggagccgtcacgccagcggctccctgctcctgcgccccacgctgagggaggtgttctggagctagacttgtag

SEQ ID NO: 199636 - DNA, 1425 bp, Artificial Sequence
  Description of Artificial Sequence: Synthetic coding sequence
atggccaccaactggggcagcctgctgcaggacaagcagcagctggaagaactggcgcggcaggcagtggacagagcgttggctgagggtgtcctcctcagaacgtctcaggagcccacttcctcggaagtggtcagctacgctcccttcacactcttcccaagcctggtgcctagcgctttactggagcaggcctacgccgtgcagatggacttcaatctgctggtcgatgcagtctcacaaaatgcagcctttctggagcagactctgagcagtacgatcaagcaggacgacttcaccgcgcggctgttcgacattcacaagcaggtactcaaagaaggcatcgctcagaccgtttttctaggtctaaataggtcagactatatgttccaacgcagcgccgacggatctcccgcactaaaacagatagaaattaatactattagcgccagttttggaggcctggcttcaagaacaccagccgttcacaggcacgttttgtccgtactctctaaaacgaaggaggccgggaaaatactgtctaataacccctccaaaggcctcgccctcggtattgcaaaggcatgggagctgtacggctctcccaacgcactcgtgctgttaatagcccaggagaaagaaagaaatatattcgatcaaagagccattgagaacgaattgcttgcgcgtaatatccacgttattcgcaggacctttgaggatattagtgagaagggcagccttgaccaagatcgacgactgtttgtcgacggccaagagattgcagtcgtgtactttcgcgatgggtatatgccaagacaatattcactacaaaattgggaggcacgtctgctgttagagaggtcacacgctgccaagtgccccgacattgccacgcagttggcaggcacaaagaaggtgcagcaggaactgagtagacccggaatgcttgaaatgcttcttcccgggcagcccgaagctgtcgccaggctccgggcgacgttcgccggactgtactccttagacgtcggggaagaaggcgaccaagctattgctgaagcgcttgccgccccttcccgattcgttctcaagcctcagcgggagggcggaggaaacaatctgtacggcgaagaaatggttcaggccttaaaacaactcaaagactcagaggagcgtgccagctatatactgatggaaaaaattgagcccgagccctttgaaaactgtctgctacgacccgggtcccctgcacgggtcgtgcagtgtataagcgagttgggaattttcggggtgtacgtcagacaggagaaaacgctcgtgatgaataaacacgtgggccatttattgcggaccaaggccattgagcacgcggatggaggtgtcgcagccggggtcgccgttctggataacccttaccccgtttag

SEQ ID NO: 199637 - DNA, 738 bp, Artificial Sequence
  Description of Artificial Sequence: Synthetic coding sequence
tgaaagcaccaccacaccgtgccccccagcgtgacccccaaggccctggacaggtccccaccatgtccagagatgtttaccagggccgctccaggatatcacatggctaaattgataatcaagctggtgacctccatcggcgacgtcgtgaaccacgatccagtggtgggtgaccggctaaaggttatcttcctggagaattaccgcgtgtcgctggcggaaaaagtgatcccagcagccgacctctcccaacagataagcacagcggggacagaggccagtgggactggcaacatgaagttcatgctgaatggagccctcacgatcggtacaatggatggggccaatgtcgagatggccgaggaagccggcgccgagaatttattcatcttcgggctgcgcgtggaggatgtggaagcattagaccgtaaaggctataatgcccgggagtattacgatcatctgccggaactcaagcaggctgtggaccagatctccagtggcttcttctcaccaaaagagcccgattgctttaaagacatcgtcaatatgttaatgcaccacgataggttcaaggttttcgcggactacgaagcttatatgcagtgtcaggcgcaggtggatcagctctaccgcaatccaaaagaatggaccaagaaggtcattagaaatattgcatgctccggaaagttctctagcgataggactatcacggagtacgcacgggaaatttggtag

SEQ ID NO: 199638 - DNA, 975 bp, Artificial Sequence
  Description of Artificial Sequence: Synthetic coding sequence
atggacgccccccggcaggtggtgaacttcggccccggccccgccaagctgccccactccgtcttgctggagatccagaaggaattgctcgattacaaaggcgttggaatcagtgttctcgagatgtctcataggtcctctgacttcgctaagatcattaacaacaccgaaaacctggtgcgggagctcctggcggtgccagacaattacaaagtcatttttctacagggcggtggatgtgggcaattttcagccgttcctctaaatctgattgggctgaaggctgggcggtgtgctgactacgtggtgacaggtgcctggtccgccaaagccgcagaagaggctaaaaagttcgggactataaacatcgtgcatccaaaactcggaagttacacgaaaatccccgacccctctacctggaatcttaacccagatgccagctatgtgtactactgtgctaatgaaaccgttcatggcgtagaattcgacttcattcctgacgtcaaaggggctgttctcgtgtgcgacatgtccagcaactttctgtccaagcctgtggacgtatccaagttcggtgtcattttcgcaggtgcccaaaaaaacgtgggatctgcaggggtgacagtggtgatcgtgagggatgatctgctcggttttgcactgcgtgagtgccccagtgtgctcgaatataaggtccaggccggcaattctagtctatataatacaccaccttgtttcagtatctacgtcatgggactggtgctggagtggattaaaaacaacggtggtgccgctgccatggagaaactgtccagtatcaaatcacagacaatttacgagatcatcgataacagccaaggattttatgtctcggtgggcgggatccgcgcatccctgtataacgctgtcacaattgaggatgtccagaaactagcagcctttatgaaaaagtttttggagatgcatcagctttag

SEQ ID NO: 199639 - DNA, 1113 bp, Artificial Sequence
  Description of Artificial Sequence: Synthetic coding sequence
atggacgccccccggcaggtggtgaacttcggccccggccccgccaagctgccacattcagtactgctagagatccagaaggaactgctggattataagggtgtgggaatctccgtgctggagatgtcgcacaggagctcagactttgccaagatcatcaataataccgaaaatctcgtgagagaactactggccgtccctgataattacaaggtgatttttctgcagggtggtgggtgcggtcagttctccgcagtgccccttaatctgattggccttaaagccggtcgctgtgctgactacgtggtaacaggagcatggtctgccaaggcggccgaggaagccaaaaaattcggcacgatcaatatcgtgcatcctaagctcggctcttataccaaaattcctgatccttctacctggaatctaaaccctgacgcttcatatgtttactattgcgctaatgaaaccgttcacggtgtggaatttgattttattcccgatgtgaagggcgccgtgttggtttgcgatatgtccagtaatttcttgagcaaacccgtggacgtgtcaaaattcggggtgatttttgctggcgcccagaagaacgtcgggagtgcaggcgtgactgtcgtcattgtcagggacgacctcctcggtttcgccctcagggaatgccccagtgttcttgagtacaaagtgcaggcaggcaattcctcactatataacacacccccttgcttcagtatttatgtcatgggcctcgtgctggaatggattaagaataacggcggcgcagccgcgatggagaagctgtcgtctattaagtcacagactatctatgaaattattgacaacagccagggcttctacgtatgtcctgtcgagccccagaaccgtagcaagatgaacattccttttcgcatcggcaatgccaaaggtgacgatgcgctggaaaagcggtttctggataaggccctggagttgaacatgctctcgctgaaagggcatcggagtgtcgggggaattagggcctcgctgtacaatgctgtgacaatcgaggatgtgcagaaacttgccgccttcatgaaaaaatttctcgaaatgcatcaactctag

SEQ ID NO: 199640 - DNA, 585 bp, Artificial Sequence
  Description of Artificial Sequence: Synthetic coding sequence
atgagcagcaacttcctgagcaagcccgtggacgtgagcaagttcggtgtgatcttcgctggtgcccagaagaatgtcggttctgccggggtcaccgttgtcatagtgagagatgacttgttgggcttcgcattaagagaatgtccctccgttctggagtacaaagtgcaggccgggaacagttctctttacaacactccaccctgcttctctatctatgtcatgggcctcgttctggagtggattaaaaacaatggaggagccgcggctatggagaagctttcgagcatcaagagccagacgatatatgaaatcatcgacaactctcagggtttttacgtatgcccggttgagccgcagaacaggtctaagatgaacatcccttttcgaatcgggaatgcaaaaggcgatgacgcgctggagaagcgcttcctagacaaagctttggaactgaacatgctgtcactgaaaggccatcgttccgtcggcggtatccgagcttcactctataatgccgtcacaatcgaggacgtgcagaagcttgccgcattcatgaagaagtttctcgaaatgcaccagctgtag

SEQ ID NO: 199641 - DNA, 1050 bp, Artificial Sequence
  Description of Artificial Sequence: Synthetic coding sequence
atgagcagcctgagcggcaaggtgcagaccgtgctgggcctggtggagccttcaaaactggggcgcaccttaacccacgagcacctagccatgactttcgattgttgctactgtcctcctccgccttgccaagaggcaatcagcaaagagcccatcgtcatgaagaacttgtattggatacaaaaaaatgcctactcccacaaggaaaatcttcagttgaatcaggagacagaggcaataaaagaagagctcctgtatttcaaggccaacggaggaggcgcattggtcgagaataccacgacgggcatctcccgcgacactcagactctaaagagactcgctgaggaaaccggtgtgcacatcatttctggcgccggcttttatgtagatgcaacacactcgtccgaaacccgcgccatgagtgtagagcagcttactgacgtgctaatgaacgagatcctccatggagcagacgggacttctattaaatgtggcatcatcggcgaaattgggtgctcctggccacttacagagagtgagagaaaagtcttgcaggccacagctcatgcccaggcccagcttggatgccccgtgattattcaccctggaagatcaagccgggccccgttccaaataatcaggatactacaggaagcaggcgccgacatttccaagactgtgatgtctcacctagatcggaccattttggataagaaggagctgctggaatttgctcagttaggatgttatctggaatatgacctatttggaactgagcttctacattatcagctggggcctgacatcgatatgccggatgacaacaagaggatccggcgcgtacggttattagtcgaggaaggatgtgaggatcgcatattggtggcccacgacattcacacaaaaactcgtctgatgaaatatgggggccacgggtacagccacatactgacaaacgtcgtgcccaaaatgctgcttagagggatcacagagaatgtcctggataagattctaatagaaaacccgaaacagtggctcaccttcaagtag

SEQ ID NO: 199642 - DNA, 1050 bp, Artificial Sequence
  Description of Artificial Sequence: Synthetic coding sequence
atgagcagcctgagcggcaaggtgcagaccgtgctgggcctggtggagccctccaagctgggccgcaccctgacccacgaacatctggctatgaccttcgactgctgttactgtccccctcctccctgtcaggaggccattagcaaagaacccattgtgatgaaaaatctgtattggatccagaagaacgcatatagtcataaggaaaacctgcaactcaatcaggaaactgaagccataaaagaggaactgctgtatttcaaggcgaacggaggcggcgccctggtggagaacacaaccacaggaatcagccgggatacacaaaccctgaagcggctcgccgaggaaacgggggtacacatcatctctggagccgggttttacgttgacgctacccactcttctgagacaagggccatgtctgtggaacaactcactgacgtgctgatgaatgagatccttcacggcgccgatgggacatctattaagtgtggaatcatcggcgagatcggttgtagttggccactcacagagtcggagagaaaagtcctgcaggctacagcccatgctcaggcccaattggggtgccctgtcattattcaccctggcagatccagcagagcacctttccagataatccgtatactgcaggaggctggcgccgacatatctaagaccgtgatgtcacatctggaccgtacgattcttgacaagaaggagctgctggaattcgcccagctgggttgttatcttgaatacgatctctttggcaccgaactgctgcactaccagctggggcccgacattgacatgccagatgataacaagagaattcggcgtgtgcggctgctggtggaggaaggctgcgaggatcgcatactcgtggctcatgatatccatactaaaactcgcctaatgaagtatggaggccatggatatagccacatcctgaccaacgtggtgcctaagatgcttctgaggggtatcaccgagaatgttcttgacaagattcttatcgagaatcccaaacagtggcttacttttaagtag

SEQ ID NO: 199643 - DNA, 1050 bp, Artificial Sequence
  Description of Artificial Sequence: Synthetic coding sequence
atgagcagcctgagcggcaaggtgcagaccgtgctgggcctggtggaaccctccaagctcgggcgcaccctcacccacgagcacttagctatgacctttgattgttgctactgcccgccccccccttgccaagaagctatcagcaaggaaccaatcgtgatgaagaatttgtactggatccagaagaacgcctattctcataaggagaatctccagctgaaccaggaaaccgaggccattaaagaggagctgctgtattttaaggcaaatggcggtggagcactcgtagagaatacaaccactgggatctctagggatacccaaaccctgaaaagactcgcagaagaaacgggcgttcatattatttctggggccggattctacgtcgacgccacgcatagttcggagacacgggcgatgtccgtggagcagctgactgacgtcctgatgaatgaaatattgcacggtgctgacggcacatctatcaaatgcggcattataggtgagatcggttgctcatggccactgaccgagtctgagcgtaaggtgctgcaggccactgcccacgcgcaggcccagcttggctgtcccgtgattatccatcccggcaggtccagcagggccccttttcagatcatccgcatcctccaggaagctggggctgacatcagcaagacagttatgagtcaccttgatcggacaattttggacaagaaagagctgcttgagtttgcccaactagggtgctatctggaatacgacctgttcggaactgaactcctgcactatcagctgggtccagacatagacatgcccgacgacaacaagcgtattcgccgcgtgcgactgctggttgaagaaggctgcgaagaccggattttggtcgcacacgatatccacacaaaaactaggcttatgaaatatggcggacacggatatagccacatcttgacgaacgtggtcccaaagatgctgctacgaggaattactgaaaatgttctggataaaatccttatcgagaatcctaagcagtggttgaccttcaaatag

SEQ ID NO: 199644 - DNA, 909 bp, Artificial Sequence
  Description of Artificial Sequence: Synthetic coding sequence
atgagcagcctgagcggcaaggtgcagaccgtgctgggcctggtggaaccatctaagctaggacgcacattaacgcacgagcacctggcgatgacctttgattgttgttactgccctccccctccatgccaggaggcaatcagcaaggaaccgatcgtgatgaaaaacctctattggatccaaaaaaacgcctattcacacaaagagaatctccagttgaatcaagaaacagaggccattaaggaggagctgttgtactttaaagcgaatggggggggcgcacttgtggagaacaccaccactggaatcagcagggatacccagactctgaaaagactggctgaagagacgggcgtccacatcatttccggcgctgggttctacgtcgatgccacgcactccagtgagacaagggccatgtctgtggaacagttaaccgacgtcctgatgaatgaaatcctacacggggcggacgggactagcattaagtgtgggatcatcggcgaaatcggatgttcgtggcccctcacggaaagcgaaagaaaagttctgcaggctaccgcccacgcacaggcacagttgggctgtcccgtcatcatccaccccggacgcagtagtagggcgccgtttcaaatcattaggattttgcaggaggctggcgcggatatttcaaagactgtgatgtctcatctggatcgagtgaggctgctggttgaggaaggctgtgaagataggatccttgtcgcacacgacatccacactaagacccgattaatgaagtacggcggtcacggctacagtcatatcctcaccaacgtggttcccaagatgttgcttcgtgggatcactgaaaacgtcctcgacaaaattttgattgagaaccctaagcagtggctcacatttaaatag

SEQ ID NO: 199645 - DNA, 1050 bp, Artificial Sequence
  Description of Artificial Sequence: Synthetic coding sequence
atgagcagcctgagcggcaaggtgcagaccgtgctgggcctggtggagccttccaaactcggaaggacactgacgcacgagcacctcgctatgactttcgactgttgttactgtccacccccaccttgccaggaggctatctcgaaggagcccatcgtgatgaagaacttgtattggatccagaaaaacgcctattcccacaaggagaatctgcagctgaatcaggaaaccgaggccataaaggaagaactgctgtacttcaaggcgaatggcggcggagccctggtagagaacaccaccaccggaatatcacgcgatacccaaacactcaaacgacttgctgaggaaaccggtgtgcatatcatcagcggagccggcttttacgtcgatgccacccactctagcgagaccagggcaatgtccgtggaacaactcaccgatgtcctcatgaacgagattctgcacggggctgacggaacatccataaaatgtggaatcattggtgagatcggctgctcctggcctctcaccgaaagtgagcggaaggtactgcaagccactgcacacgctcaggcccaactgggttgccccgtaatcatccacccgggtcgctcctcgagggcaccatttcaaatcatccgcatccttcaagaggcaggggccgacatctcaaagaccgttatgtcacatctggaccggactattctggataaaaaagaacttctcgagttcgcccaactgggatgctacctggaatacgacttatttggcactgaacttctccactaccagcttggtcctgacatcgatatgccggacgacaataagagaattagacgcgttcgcctcctggtcgaggagggatgtgaggacaggatccttgtcgcacacgatatccatacaaaaacaagactgatgaaatacggcggtcacggttactcccacatcctgactaacgtggtccccaagatgctgctgcggggaataaccgagaatgtgctggataagattctcatagagaatcccaaacaatggctgactttcaaatag

SEQ ID NO: 199646 - DNA, 753 bp, Artificial Sequence
  Description of Artificial Sequence: Synthetic coding sequence
atgttcagcctgcccctgagcctgcccctgtgcgaggacaccgcctttctgcctagcaagtgttgttcgagtcataagaccataaaacaggcaaggactcttatcatgatcttccttgcctctggtacccattttcagactatgttgaaatccaagctaaacgttctcacactgaaaaaagagccgttacctgctgtgattttccacgaacccgaggctattgagctctgtactacaactccgctgatgaagaccaggacacatagcgggtgtaaggtcacttacctggggaaagtgtcgactaccgggatgcaattcctgtccggctgcacagaaaagccagtgatagagctctggaagaaacacacgttagccagggaggacgtgtttccagctaatgccttactcgagattagacccttccaggtgtggctgcatcatttggatcataaaggtgaggcgactgtgcatatggacacatttcaggtggcacgcatcgcttactgtacagccgatcataacgttagccccaacatctttgcttgggtgtacagggagatcaacgacgacctgagttaccaaatggattgccacgccgtggagtgcgagagtaagctggaggctaaaaagctcgctcacgcgatgatggaggcctttagaaaaactttccacagcatgaaatcagacggtcggatccatagcaacagctcgtcagaagaggtctcccaggagctcgaatcagacgacggctag

SEQ ID NO: 199647 - DNA, 747 bp, Artificial Sequence
  Description of Artificial Sequence: Synthetic coding sequence
atgccccggatcgccggcaaccacctgatgctggaggagagccggacatgctctagtcccgagttgctcgacggcgtctggccatgtcagcctctccactttgggctgccagccagtgagatgcattttcaaacaatgctaaagtctaaacttaatgtgcttacgctcaagaaggaaccgctaccagccgtgattttccatgagccagaggccatcgagctctgcacaactacacctttgatgaaaacgcgcacacactctgggtgtaaggtgacctatctcggcaaagtatccaccaccggcatgcaattcctctctggttgcaccgagaaaccagtgatcgagctgtggaaaaaacatactctagccagggaagatgtctttccagcaaatgcacttctggagataaggcccttccaggtctggcttcatcatttggaccacaagggcgaagccacagtgcatatggatacgtttcaggtcgcccgcatcgcttattgcacagcagaccataatgtgagccccaatatctttgcatgggtgtaccgggaaattaacgacgatctatcataccagatggactgccacgcagttgagtgcgagtctaaactggaggcgaagaaactggcccacgccatgatggaggcattccggaagacgtttcacagcatgaagtccgacggcaggatacacagtaatagcagtagtgaagaggtgagccaggagctggaatctgatgatggctag

SEQ ID NO: 199648 - DNA, 654 bp, Artificial Sequence
  Description of Artificial Sequence: Synthetic coding sequence
atgtggcagcccgccaccgagcggctgcagcacttccagaccatgctgaaaagcaaactaaatgtgctcaccctgaagaaggagccgttaccggcagtgatattccacgagcccgaagctatcgagttgtgtaccactacccctttaatgaagacaaggacacactcaggctgcaaagtgacgtatctgggaaaggtttctactacaggaatgcaatttttgtctgggtgcacagagaagcccgtaattgaattgtggaaaaagcacactctggcccgtgaggatgtgtttccggccaacgccctgttggaaattcgaccatttcaggtgtggctgcaccacctggatcacaaaggggaagctaccgtacatatggataccttccaggtggcaagaattgcatactgtaccgcggatcataacgtcagcccaaatatctttgcatgggtgtacagagagatcaacgatgatctttcttaccagatggactgtcacgcagtggaatgtgaatctaaactcgaggctaaaaaactcgctcatgccatgatggaggcatttagaaaaacgttccatagcatgaagtccgacggtcgcatccatagtaacagtagttcagaagaggtttctcaggaacttgagagtgacgatggttag

SEQ ID NO: 199649 - DNA, 507 bp, Artificial Sequence
  Description of Artificial Sequence: Synthetic coding sequence
atgtggcagcccgccaccgagcggctgcaggtgacctacctgggcaaggtgagcacgactgggatgcagtttctgagcggctgcaccgagaagccagttattgagttgtggaagaagcatacccttgcccgagaggatgtcttcccagccaacgccctgctggagatccgaccatttcaagtgtggctgcaccatctcgatcataaaggggaagctaccgttcacatggatacttttcaggtggcccgaatcgcctactgtactgctgaccacaacgtgtctccgaacatctttgcttgggtgtatcgtgagatcaacgatgacctttcctaccagatggactgtcatgcggtggaatgtgaatccaaactggaggctaagaaactagcccacgccatgatggaggccttcagaaaaacgttccacagcatgaaatcagatggtaggatccactctaatagctcaagcgaagaagtgagccaagaactcgaaagtgatgatggctag

SEQ ID NO: 199650 - DNA, 753 bp, Artificial Sequence
  Description of Artificial Sequence: Synthetic coding sequence
atgttcagcctgcccctgagcctgcccctgtgcgaggacaccgccttcctgccaagcaagtgctgttcctctcacaaaaccataaagcaggcccgtacattgataatgatcttcctcgcttctggtactcactttcagactatgctgaaatccaagctgaatgtgctaactctgaaaaaagaacctttgccggccgtgatcttccacgaaccagaggcaatagagctttgcactactacgcctttgatgaaaactaggacacattctggctgcaaggttacttacctgggtaaagtgtccacaacaggaatgcagtttctgtcgggctgtaccgagaagccagtcattgaactatggaaaaagcacaccctggcccgggaggatgtatttcccgccaacgctttgctggaaattagacctttccaggtgtggctccaccatttagaccataaaggggaagctaccgtacacatggataccttccaggtggccaggatagcctactgcactgctgaccataacgtgagcccaaatatcttcgcatgggtgtaccgagagattaacgatgacttaagctaccagatggattgccatgccgttgagtgcgaaagtaaactggaagctaagaagctagctcacgctatgatggaagctttcaggaagacattccactctatgaagagtgatggccggattcacagtaactcgtcctccgaagaagtgtcacaggagttggaatccgatgatggatag

SEQ ID NO: 199651 - DNA, 1017 bp, Artificial Sequence
  Description of Artificial Sequence: Synthetic coding sequence
atggagcagctgcgggccgccgcccggctgcagatcgtgctgggccatcttggtcgcccttccgccggcgccgtagtggcccatcctacctctggaacgatctcctccgccagttttcacccacaacagttccagtacacgctggacaacaatgtcttgactcttgaacagaggaagttctatgaggagaacggattcctcgtgattaaaaacctggttccagatgcagacatccagcgcttcagaaacgagttcgaaaagatttgtcgcaaggaagttaaaccgttgggcttaactgttatgcgggatgtgactatctctaagagcgaatatgcccccagcgaaaagatgattaccaaggtgcaagattttcaagaagacaaggagctgtttcggtattgcactctgccggagatattgaagtacgtggagtgctttacgggaccgaacatcatggctatgcacacaatgctgatcaataaacctccggacagtggaaaaaagacatctagacatcctctccaccaggacctccactactttccattcagaccttctgacctgatcgtgtgtgcatggactgcaatggagcatatttccaggaacaatggctgcctggtggtccttccagggacccacaaagggagtctgaagccacacgactacccgaagtgggaagggggcgttaacaaaatgttccatggaatccaggactatgaagagaataaggctagagtgcacctcgtgatggagaagggtgacaccgttttcttccatcccttacttatccatggatctgggcaaaataagacacaaggcttccgcaaagccatctcatgccattttgctagtgccgattgccactacatcgacgtcaaaggaacaagccaggagaacattgaaaaagaggtagtcggaatcgctcataagttctttggggccgaaaactccgtgaacctcaaagatatctggatgttccgtgctagactggtcaagggtgagagaaccaacctgtag

SEQ ID NO: 199652 - DNA, 717 bp, Artificial Sequence
  Description of Artificial Sequence: Synthetic coding sequence
atgcgggacgtgaccatcagcaagagcgagtacgcccccagcgagaagatgattacaaaggttcaggatttccaggaagataaggagctttttcgctattgtaccctaccagaaattctcaaatatgtggaatgcttcacagggcctaacataatggctatgcataccatgctgattaacaaacctccagattccgggaagaagacctcacgccacccactccatcaggaccttcactactttccgttcagaccttctgacctcatcgtgtgtgcctggacagcaatggaacatattagcaggaataacggctgcctggtggttttgcccgggactcacaaaggtagtctgaagccccacgattatccaaaatgggaaggtggcgtgaataagatgtttcatgggatacaggactatgaggagaataaggcgcgagtacacctagtgatggagaaaggggatactgtgttcttccatccactgctaatccatggctccggtcagaacaaaacccagggattccgtaaggcaatctcatgccactttgcgtcagccgattgccactacatcgacgtgaagggaacctcacaggaaaatatagagaaggaggtcgtcggaattgctcacaagttcttcggcgccgaaaattcggtcaatcttaaagacatctggatgtttcgcgcaagactggtcaaaggcgagagaacaaatctctag

SEQ ID NO: 199653 - DNA, 15429 bp, Artificial Sequence
  Description of Artificial Sequence: Synthetic coding sequence
atgggcaacgaggccagcctggagggcgagggcctgcccgagggcctagctgcagctgccgccgctgggggaggggcatccggtgcaggctccccatcacacaccgctattcccgcaggcatggaagctgacctctcccagttatcggaggaagagcggcgacagatcgccgctgtcatgagcagagcacagggtctgccaaaaggatccgtgccacccgcagcagcggagtcaccatccatgcaccgcaagcaggagttggatagctcccatcccccgaaacaaagcgggcggccacccgatcctggccggccagcgcagcctggcctctcaaagtctagaacaacagacaccttccgttcagagcaaaaattgcccgggcggagcccaagcaccattagtctcaaagagtctaagagccggactgacctgaaagaagagcataaaagctccatgatgcccggctttctttccgaggttaatgccctgagtgcagtgagtagcgtggtgaataagtttaaccctttcgatctgatttcagattcagaggctagccaggaggagacgactaagaaacagaaagtagtacagaaagaacagggtaagcccgaaggtatcattaagccccccctgcagcagcagccacccaagcccatcccaaaacaacaggggcccgggcgagacccactgcagcaggacggaaccccaaagtccatttcttcccagcaacctgaaaagattaagagccagccgcccggcaccggcaaaccaatccaggggcccacccagacacctcagacagaccacgctaagctgcccctgcagcgggatgcctcgcgcccgcagacgaagcaagcagatatcgtaaggggcgaatctgtcaagccctccttacctagtccgagtaagccccctatacagcagccaactccaggaaagccgcctgctcagcaacctggccacgagaagtcccagcccgggccagccaagcccccagctcagcccagtggtctgaccaagcccttggctcagcagcccggcaccgtgaagccgcctgtccagcctcccggtacaaccaagcctccagcccagcccttaggacctgccaagccccccgcccaacaaacgggcagcgaaaagcctagctcggagcagcctggcccgaaagcactcgcacagcccccaggagtcggcaaaacaccagctcagcagcctgggccagcgaagccccccactcaacaagtcggaacacctaagccactggctcagcaaccagggctacagagtcctgctaaagctccaggtcctaccaagactccagtacagcagccagggcccggaaaaatcccggcgcaacaagcaggacccgggaagacgtctgcccagcagacaggcccaacaaagcccccttctcaattgccgggtccagctaaaccacccccacagcagccagggcctgcaaagcctccaccccagcagcccggctctgcgaaaccgccctcccagcaaccaggttctacaaagcccccccctcagcagccaggcccggcaaagccgagtcctcagcagccaggttcgacgaaaccgccatcccagcagcctggctccgctaaaccaagcgcacagcaaccaagccccgccaaaccatcagcccagcagtccacgaagcccgtatcacagaccggttcaggaaagcctctccagccgcccactgtttcgccgagtgccaagcagcccccatcacagggactccctaagactatttgtcccctctgcaacacgaccgagctgctgctgcatgtcccagaaaaggccaatttcaatacctgtactgagtgccagactaccgtatgtagcttgtgtggattcaatcctaacccccatctaacggaagtgaaagagtggctttgtctgaattgtcagatgaagcgggcacttggcggagatctggcccctgtgccaagttcaccccaaccaaagctgaaaacagcgccagtgacgactacctctgccgtctctaagtcaagcccacagccccaacaaacaagtccaaaaaaggacgccgcgccaaaacaggacctgtccaaggcacccgaacctaaaaaaccccccccactcgtgaaacagcccaccctacacggtagccccagcgcgaaggctaaacagccccctgaggcagattcattaagcaagccagcaccgccgaaggaacccagcgtgcctagtgaacaagacaaggcgcctgttgctgacgacaaaccaaaacaacctaaaatggtgaagcccacaaccgatcttgtcagtagctctagcgcaacaaccaagcctgatataccatcctctaaagtgcagtctcaagccgaagagaaaacaaccccacccctgaaaaccgatagcgctaagccctcgcagtcctttccccctaccggcgagaaggtctccccttttgacagcaaggcaattccacggcctgcaagcgattctaagatcattagtcacccagggccaagttcagagagtaaggggcaaaaacaggtcgatcccgtccagaaaaaagaagagccaaaaaaggctcagacaaagatgtcacccaagcctgatgccaagcctatgccaaagggtagccccactccccccggaccccgccctacagccgggcagaccgtgccaacgccccagcagagccctaagccacaggagcagagcaggaggttcagtctgaacctgggatctatcacggatgctcctaagtcacagcctaccactccacaggaaacagtgactgggaaactattcgggttcggcgccagtattttctcgcaagcgtccaatctcatctcaaccgccggccagcccggcccacactcccagagcggtcccggagcaccaatgaagcaggccccagccccctcacagccccccaccagtcaggggccacccaaaagcactggccaggcccctcccgctcctgcaaagtccatccctgtcaagaaggagaccaaggcgccagctgcggaaaagctcgaacccaaagcagaacaggcccccaccgtgaaaagaacagagacagaaaagaagcctccacccatcaaggattctaagtcgctgaccgccgaacctcagaaggcagtgctgcccaccaaactcgaaaaatctccaaaacccgaatcaacctgccctctctgtaagacagaactcaacataggatctaaggatccacctaactttaatacatgcacggaatgtaagaatcaggtctgcaacctgtgcgggtttaacccaacccctcacctaaccgaaatacaggagtggttgtgtttgaattgtcagactcagcgagccatatctggccagctgggggatatccgtaaaatgccacctgccccaagcggacctaaggcttctccaatgcctgtgcctacagaaagcagttcacaaaagaccgctgttcctccccaggtgaagcttgtgaagaaacaggagcaggaggtaaaaacagaagctgaaaaagtgattttggagaaggtcaaggagactttgtccatggaaaaaataccccccatggtgacgacagaccagaagcaggaggaatccaagctggagaaagacaaggccagcgctttgcaagagaagaagcctctcccagaggagaagaaactcatccctgaggaggaaaaaattagaagtgaggaaaaaaaaccccttcttgaggaaaaaaaacccaccccagaggataagaaactacttcctgaggccaaaacttctgctcccgaagaacagaagcatgacttgctgaagagtcaggtgcagatcgctgaagagaaactggagggtcgggttgctcccaagacggtccaggaaggcaaacagccccagacaaagatggagggtttaccttcgggcactccccaatcacttcccaaagaagacgataaaacaactaagacgataaaagagcagccacagcccccctgcacggcaaaacccgaccaggttgagcctggcaaagaaaaaaccgaaaaggaggatgataaatcagacacttcttcgtcccagcagcccaaaagtcctcaaggtcttagtgacacagggtactcctctgacggaatttcttcctcactgggggagatacctagcctgatcccaaccgacgaaaaggacatattaaagggactcaagaaggacagcttttctcaggagagcagcccgtcctccccaagtgacctcgccaagctggagagtacagtgctgtccatattggaggctcaagcttcaacactggctgatgagaaatctgaaaagaagactcagcctcacgaagtatctccagaacagcccaaagaccaggaaaaaacacaatcactgtctgaaacactcgagatcaccattagtgaagaagaaatcaaggagtctcaggaagagagaaaagataccttcaaaaaggatagccagcaggatatcccatcaagcaaagatcacaaggagaaaagcgagtttgttgatgacataaccacccgccgcgaaccttacgatagcgtggaggaaagcagcgagtccgagaatagtcctgttccgcaaaggaaacggcgcacctcagtaggatccagctcctctgatgaatataaacaggaggattcccagggtagcggggaggaggaagacttcatccggaaacaaatcatcgagatgtctgcagatgaggacgccagcggatccgaggacgacgagttcataaggaaccagctcaaagagatcagttcctccacagagagccaaaagaaagaggaaaccaagggcaaggggaagatcacagcagggaaacatcggcgccttaccagaaaatcaagtacatcaatcgatgaggacgccggccggagacatagttggcatgacgaggatgacgaagcattcgacgagtccccggaactgaagtaccgtgaaactaagtcacaggagtccgaggaattggtggtgacaggcggcgggggtttgagaaggttcaaaacaatagagctcaattctaccattgccgacaagtatagtgcggaaagctcccaaaagaaaaccagtttgtactttgatgaagagccagaactcgagatggaaagtctgactgacagccctgaggaccggagtcgcggtgaagggagcagttcactacatgcttcctcattcacgcctgggacatcccccacctccgtgtcatccctggatgaggactcagacagttcaccttcccacaagaagggagaatccaagcagcaacgcaaagcacgacatcgaccccacggccctctgttgcccacaatcgaggattcaagcgaagaggaggaattacgggaggaagaagagttgctgaaggaacaggaaaagcagagggaaatagagcagcagcaacggaagagctctagcaagaaaagcaaaaaagacaaggatgagttacgcgcccagaggagacgggagcggccaaagacaccaccgtccaatctgtcccccattgaagatgcgtcaccaaccgaggaattgcgtcaagctgccgaaatggaggaactgcacagatcaagttgtagcgagtattctccctcaatcgagagtgatcccgaggggttcgagatcagcccagagaaaatcattgaagtacagaaggtgtacaagctccctacagcagtgagcctgtattcaccgactgacgagcagtccatcatgcagaaggaaggctcacagaaagccctcaagtcagccgaggagatgtacgaagaaatgatgcataaaacccacaaatataaagcttttcctgctgcaaacgagagagatgaagtgtttgaaaaagaaccactgtacgggggcatgttaatcgaggactatatctacgagagcctcgtcgaggatacctacaatgggagtgtggacggatctcttctcacccgtcaggaggaggaaaacggctttatgcagcagaagggccgcgagcagaagatcaggctctccgaacaaatctatgaagaccctatgcagaaaatcaccgatctccagaaagagttttacgaactcgaatcactccacagtgtggtgcctcaagaagacatcgttagttcctcctttatcattcccgaatctcacgaaattgtcgatctcggaacgatggtgacctccaccgaagaggagaggaagctgctcgatgcagatgctgcgtatgaggaattaatgaagcggcaacagatgcagttgacaccaggatcctcacctacacaggcccccatcggagaggatatgacagaaagtaccatggattttgatcggatgcccgatgcatcattaacctcttcggtgcttagcggggcctcgctcaccgactccactagcagcgccacattgtctatcccagatgttaagataactcaacatttttccacggaagagatcgaagacgagtatgtcacagactatacacgggaaattcaggaaattatagctcacgagagtttgatcctgacctactccgagccttctgagtcagccacgagtgtgcccccctccgacacaccttcccttacctcatccgtgtcatctgtgtgtacaactgattcatcgtctcccattacaacattagatagcatcactaccgtatatactgaacctgtcgacatgattactaagttcgaggacagtgaggagatatcatccagcacatacttccccggcagcataattgattatcctgaggagatctccgtgtctcttgaccggactgccccgccagacgggagagcaagcgctgatcacatcgtgatctctctctctgatatggcttctagcataatagagagcgtcgtcccaaaaccagaggggcccgtggctgacaccgtgtcgaccgatctattaatttctgagaaagacccggtaaaaaaggctaagaaggagacaggaaacgggattatcctggaagtgttagaggcctatagggataaaaaggagcttgaggcggagcgcacaaaatcctccctgtctgaaactgtttttgaccaccctccaagcagtgtgattgccttgcccatgaaagaacagcttagcaccacttatttcacttccggagagaccttcggccaggagaagcctgcctcccagttgccgtccggcagcccgtcagtctcttctctacctgctaagccgcgcccttttttccgctctagtagcctcgacatatcggcacagcccccacccccaccgcccccaccacccccacctcctccacctcctcctccacctccacccccaccattacctcctcctacttcaccaaagcccacgatcctgcctaaaaaaaaattaacggtggcttcccctgttacgacagcgacgccgttatttgacgctgttactaccttagaaacgaccgccgtactccgcagcaatggcctgccagtgacacggatttgtaccacagcacctccccccgtgccacccaaaccttcgtccattccatccggcttagtgtttacccacagacctgagccatccaagccaccaatcgcaccgaagcctgtgatcccacagctgcctaccactacacagaaacccacagacattcacccgaagccaaccggactgtctctgacgagttccatgacgttgaatctggtgacaagcgcagattacaaactgccgtcacctacctctccactcagcccccatagtaacaaaagcagcccgagattctcaaagtctctgacagagacttacgtggtgattacgctgccctcggaacctggaacaccaacagacagttcagcttcacaggcgatcacctcatggccccttggtagtccctctaaagatctggtgtcagtggaacccgtgttcagtgtggtcccccctgtcacagcagtggaaatccctatttcttcagaacagacattttacatcagtggagcactccagactttctctgctaccccagtcactgctccgtcttccttccaagctgccccaacgtcagttacacaatttctgacgaccgaggtttcgaagaccgaggtgtcagctacaagaagtactgctccttcagtcggactatcttcaatctctatcactatacctccagaacctctcgcgctggataatatccatctcgagaaacctcagtacaaagaagacgggaaactgcaattggtaggcgacgtgatagatttgcgcacagttccgaaggtggaggtcaaaactaccgataagtgtattgatctctccgcatcaaccatggatgtcaagaggcagatcacagctaatgaggtgtatggaaagcagatttcagcggtgcaaccgtcgattattaatctgagcgtcaccagctcaatcgtcacaccggtaagcttagccactgaaaccgtcaccttcgtgacttgcactgcgtctgcatcgtacacaactggcacagagagcctcgtgggggcggaacatgctatgaccactcccttgcagttaaccacaagtaagcatgccgaacccccctaccggatcccctcagaccaggttttcccgatcgcacgggaagaggcccctataaatctctcgctggggacccccgcgcacgccgtgactctggctatcactaagcccgttaccgttccccccgtgggagtgaccaatggctggactgacagcaccgtttcccaggggattaccgacggggaagtggtagacctgtccacgacgaagtcccatagaaccgtagtcacaatggacgagtccacctctagcgtaatgacaaagatcatcgaggacgagaagccagtagatctgacagctgggaggagggccgtttgctgcgacgtcgtctacaagctaccattcggccggtcctgcacagcgcagcagccggctacgacacttccagaggacagattcggctaccgggatgaccattatcagtacgaccgctctgggccatacggctatcgtggcataggggggatgaagccttctatgtcagatacaaacctggccgaggccggtcatttcttttataagagcaagaacgcatttgattactcagaagggacagacacagccgtcgacctgaccagcggccgggtcaccacgggggaggtgatggactactcaagcaaaactacagggccttaccctgaaacgaggcaagtgatctctggggctggaatcagtacccctcagtattccaccgccaggatgacccctcctccaggcccacagtactgtgttggatctgtcctccgctcatcgaacggtgtggtttattcgtctgtcgccacccccacaccttccacattcgctatcacaacacagccagggagcatcttctccaccacagtacgcgacttgtcaggtattcacaccgcggacgccgtgaccagcctccctgccatgcatcacagccagcctatgccacgctcctacttcatcaccactggcgcctcagagactgatatcgcagtcacaggaatagacattagtgcctcactccagaccattaccatggagtccctcacggcggaaaccatcgatagtgttcctactttaacaaccgcttctgaagtgttccctgaggtcgttggcgacgaatctgcgctccttattgtgccagaagaggacaaacagcagcagcagttagatctggagcgggagctgctcgagctcgagaaaatcaagcaacagaggttcgcagaggaactagagtgggaacggcaggagatccaaaggttccgagagcaggagaaaatcatggtccagaaaaagctggaagaactgcagtctatgaagcagcacctactgttccagcaggaagaagagcggcaagctcagttcatgatgaggcaggaaaccctggcccaacagcagttacagctggagcaaatccaacagctacagcagcaactgcatcagcagctcgaagagcagaagattagacagatttatcagtataattacgacccctccggcactgcgtcgcctcagacaaccacagaacaagctattctggagggacagtatgccgcccttgagggttctcaattctgggctactgaggacgcaaccaccaccgcgagcgccgtagtcgctatcgagataccccaatcccaaggctggtacacagttcagtctgatggcgtgacccagtacatagctcccccaggtattctcagtacagtgagtgaaatccccctgactgacgtcgtggttaaggaagaaaagcagccaaagaaacgaagttctggcgctaaggtccgcggacagtacgacgatatgggcgaaaatatgacggacgatcctagatctttcaaaaagatcgttgattcgggagttcagaccgacgacgaggatgccaccgacagaagctatgtttcccggagacgccgcactaagaagtcggtggataccagtgtccaaacggacgatgaggaccaggacgagtgggatatgccaactagatcaagaagaaaggctcgggttggcaaatatggtgacagtatgacagaggccgacaagacaaagcccctgagcaaagtgtcgtcaattgccgtgcagactgtggcggagatttcggtccaaaccgaacctgtgggcactatcaggactccttctattcgagcaagagtggatgcgaaagtcgagatcatcaaacatattagcgcccccgagaaaacatataaagggggcagcctgggctgtcaaacggaagccgactctgatacccagtcgcctcagtacctgtcagcaacttctccgccaaaggacaaaaagcggccaactccccttgaaatcggttattccagccacctgcgtgccgactctacagtccagctcgcaccatctccccccaaatcgcctaaagtgctctattccccaatttcccctctcagcccaggaaaggctctcgagtcagcatttgtcccgtatgagaagcccctgcccgacgacatctcacctcagaaagtgctgcaccccgacatggcaaaggtgccccccgcctcccccaagaccgccaaaatgatgcagcggtctatgtctgacccgaagcctcttagcccaacagctgacgagtcatctagagcaccctttcagtacaccgagggctacaccaccaagggctcccagacgatgactagttctggcgctcagaagaaggttaagcggaccctccccaatcctccaccagaagagatttcgaccggcacgcagagcaccttctctactatgggaacagtttcacggcgccggatctgtcgtactaatactatggccagagcaaaaatcctgcaggacatcgacagagaactcgacctcgtcgagagggaatccgccaagctgcgaaaaaaacaggcagagctggatgaggaggagaaagaaatcgatgcaaagctcagatatctcgaaatgggaatcaatagacgaaaggaggctctgctgaaggaaagagaaaagcgggaacgagcatacctccagggggtggcggaggaccgtgattatatgagtgacagtgaggtgagttctactagacccacacggattgaatcccagcacggtatcgagcggcctcgcaccgcgccccagactgagttctcccagtttattccaccccagacccaaaccgagtcacaactggtcccccctacaagcccgtacactcagtaccagtattcaagcccagctcttccaacccaggctcctacgtcatacacacagcagtcccactttgagcagcagactctgtatcaccagcaggtctctccataccagacccagcccacctttcaggcggtagccaccatgtcctttactcctcaggtccagcccactccaacaccacaacctagttaccaactcccgtcccaaatgatggtcatacagcagaagccaaggcagacaacgctgtacctggagcccaaaataacctccaattacgaagtaatcaggaaccagcctttgatgatagcaccagtctcaacagataacacgtttgctgtttcccacctggggtccaaatataattcccttgatctgaggattggcctcgaagagaggagttcaatggcatcctcacctatatctagtatctccgctgactccttttatgctgacatcgatcaccataccccacgcaattacgttctgatcgacgatatcggggagattaccaagggtactgcagctctgagcaccgcattctcattgcacgaaaaagatttgagcaagacagatcgactcctccgtactacagagacacgtaggtcccaggaggtgacagacttcctggcacccctccaatcgagttcacgcttgcattcttacgtaaaagccgaggaggatcctatggaagatccctacgaactgaagcttcttaagcaccagatcaaacaagaattccggagggggaccgaaagtctggaccatctggccggactttcccactattaccatgcagacacttcgtaccgccactttccgaagtctgaaaagtacagcatctccagactgacgctcgagaagcaggcagccaaacagttaccagcagccattctctaccagaagcagtctaagcataagaaatcgctcatagaccccaagatgagtaagttttctcctatccaggaatccagggatttggagccggactatagctcttatatgaccagctctacctcttctatcgggggcattagctcacgagcaagactgctgcaggacgatattacattcggattacggaaaaacatcaccgaccaacagaagttcatgggatcttcactcggcaccggactgggaactcttggcaatactattagaagcgctttacaagatgaggccgataagccttacagcagcggcagccggtcacggccttcaagcaggccatcttccgtgtacgggctagacctatcaattaagcgcgacagcagctcaagctcccttaggctgaaggcacaggaagctgaagctctagacgtgtctttctcacatgcatcgtcaagcgctcggacaaaacctacctctttgcccatctcccagagcagggggcgaatcccaatcgtggcccaaaactcagaggaggagtcacctctctcacctgtggggcagcccatgggtatggctagagctgcggctggccctctgccgcccatctctgcagacacccgagaccagttcggttctagccatagtctcccagaagtgcagcagcatatgcgagaggaatcccgcacgcgggggtacgaccgggacatcgccttcatcatggatgacttccaacacgctatgtccgattctgaggcctatcatctcaggagagaggagacagattggttcgataagccccgcgagagccgcctggagaacggccacggccttgatcgcaagctcccagaacgtctcgtccatagccggccattgagtcagcatcaagagcagatcattcagatgaacgggaagacgatgcattatatttttcctcatgcccgaataaagataactagggacagcaaagatcacactgtgtcggggaacggacttgggatccggattgtgggcgggaaagagattcctggccactcgggcgagattggcgcttatatcgctaaaatcctgcctggagggtcagcagagcagaccggcaagctgatggaaggaatgcaagtcttagagtggaacggcatacctctcacgagtaagacttatgaggaggtgcagagtattatttcccaacagtctggagaggcagagatctgtgtgaggctggatctgaatatgctatctgatagcgaaaattcacagcacctggagttgcacgaaccacctaaggcagtcgacaaggcaaagtcaccgggcgtggatcccaagcagttggcagccgaactgcaaaaggtaagcttgcagcagagccctctggtgctgagcagtgtcgtcgaaaaggggtcccatgtccatagcggtcccacatcagctgggagcagtagcgtgccctccccaggacagcctggtagtccttccgtcagcaagaagaagcatggatcgtcgaaacccaccgatgggactaaggttgtctcccacccgattaccggagagatacagttgcaaataaactatgacctgggcaatctaataattcacattctgcaggcaagaaacctggttccaagagacaacaatggctactcagatccctttgtgaaagtgtatctcctgccaggcagaggccaagtaatggtggtgcagaacgcaagtgctgagtataagaggagaaccaagcacgttcaaaaaagcctgaatcccgagtggaaccagaccgtcatttacaagagcatatctatggaacagctgaagaagaagacactcgaggtgacagtttgggactatgatcgcttttctagtaacgatttcctcggagaggtgctcatagatctgagttctacaagccatctcgacaacacaccccgctggtaccctcttaaagaacaaactgaatccattgatcacggaaagagccacagttcccagagtagccagcagtccccaaaacccagtgtaattaaatcccggtctcacggcatcttccccgacccaagcaaggatatgcaggtccctaccattgaaaagtctcactcatccccaggctccagcaagagttcatctgagggtcacctcaggtctcacgggcctagcagaagtcagagcaagacatcagtcacccagacccatttggaagacgcgggagccgctatagccgctgctgaagccgccgtacagcagttgagaatacagccgactaagcccccaaaccaccgccccgcagagagctctgtctcaaccggatcaagcggatctagttttggctccggctacagtgtggattctgagggctcttctagcactgccggagagaccaatttgtttcccattcccaggatcggcaagatgggacaaaatggacaggagccagtaaaacagcccggagtcggcgtaggactcgccgatactgaggccaagacacaggtaatgggagaaattaaaatcgcccttaagaaggaaatgaaaactgatggagagcagctcattgtcgaaattctccagtgcagaaatattacatataagttcaaatccccagaccacctgccggatctttatgtaaagatatacgtaatgaacattagtacacaaaagaaagtgattaagaaaaaaacacgggtgtgtagacatgatcgagaaccctcattcaacgaaaccttcaggttctccctctctccagcaggccactcattacagatattgctgttttctaacggtggcaaatttatgaagaagacactcattggtgaagcttgtatctggctggataaagttgatctacgcaaacggattgtgaattggcacaaactgctggtctcgcctacacaaactcactag

SEQ ID NO: 199654 - DNA, 1269 bp, Artificial Sequence
  Description of Artificial Sequence: Synthetic coding sequence
accaaggtgtggaacagcaacggcctgggcatccggatcgtgggcgggaaagaaattccaggtcactccggcgaaatcggcgcctacattgcaaagatcttgcccggcggaagcgcggagcagacggggaagctcatggaaggtatgcaagtattggaatggaatgggatcccactaactagcaagacatatgaagaagtccagtcgatcatctctcagcaaagcggcgaagcagaaatatgtgtgcgcctcgaccttaacatgctgtcagactcagagaatagtcagcatctcgagttgcacgaaccaccaaaggccgtagataaggccaaaagccctggtgtggatccgaagcaactggctgctgagctgcagaaagtgagcctgcagcagagccccctcgtgctctcatccgtggtagagaaagggagccatgttcattcagggcccaccagcgcaggctcatccagtgtgcctagccccgggcagcctggctcaccctctgtctctaagaagaagcatggcagctcaaagccaacagacggtactaaggttgttagccaccctatcactggggagatccagctgcaaattaactatgatctcgggaacctaatcattcatatactacaagcgcggaacttagtgcccagggacaataacggatatagcgacccatttgtaaaggtataccttctccctggtcgaggcgctgaatataagagacgaaccaaacacgttcagaagtccctgaatcccgaatggaatcagaccgtaatttacaagtcaatttctatggaacaactgaagaagaagactctagaagtgaccgtatgggattacgacaggttcagctccaatgatttcctgggcgaggtgttaatagatctgtcgtcaacttcgcacctggacaacactccccgatggtacccactgaaagaacagaccgaaagcattgaccacgggaagtcccactccagtcagtcttcacagcaaagcccaaaaccctctgtcattaagtctaggtctcacggcattttccccgacccctctaaagatatgcaggtcccaaccatcgagaagtcccattcctccccgggctcatccaagagctcgtctgaaggccatctccgctctcatggcccaagtcgctcacagtccaaaacaagcgtcacacagacccatctcgaggacgcaggagcagccatcgctgctgccgaagctgcagtccagcaacttcgcattcaaccgtctaagcgccgaaagtag

SEQ ID NO: 199655 - DNA, 14808 bp, Artificial Sequence
  Description of Artificial Sequence: Synthetic coding sequence
atgggcaacgaggccagcctggagggcgagggcctgcccgagggcctagccgcggctgctgctgctggcggtggggcgtccggagctggctccccttcacatacagccatacccgctggcatggaggccgacctgtcacagttaagcgaagaagaacggcgacagatcgcggcagttatgtcacgcgcgcagggcctgcctaagggctccgtgcccccagcagccgccgagtccccctccatgcatcgcaagcaggaattggatagttcccatccccctaagcagtctgggcgcccccctgatcccggtaggcccgctcagccaggtctgagtaaatctcgtaccaccgacaccttccggagtgagcagaaattacctggccgcagcccaagcaccatctccttaaaagagtccaaaagtcgaacggatctgaaagaagagcacaagtccagtatgatgcccggtttcttgtctgaagtcaatgccttaagcgcagttagcagtgtcgtgaataagtttaatccatttgacctcatctctgactcagaggcatcccaagaggaaaccaccaaaaaacagaaggttgtacaaaaggaacagggcaagccagagggcattatcaaacctccgctgcagcagcagccacccaagcccatcccaaagcagcaagggcccggcagggatccactgcagcaggatggtactccaaagagcatcagctcacagcagcccgagaaaattaagtctcagccgcccggcacaggcaagcccattcaggggcccacacagactccacagactgaccacgccaagcttcccctccagagggacgcctcacgtccacagacgaagcaggctgacatcgtgcgcggagagtctgtgaagccttctcttccatccccgagcaagcctcccattcagcagcctacacccgggaaaccacccgcacagcagcctgggcacgagaaatcccaacccggccctgctaagcctccagctcagccaagcggactgaccaagccgctcgcccagcagccaggcacagtgaagcccccagtgcagccgcctgggacgacgaagcctcccgcccaacccctggggccggccaagccgcctgcacagcagaccggctctgagaagcccagctccgagcagcctggccctaaggcactggcccaaccccctggtgtgggtaaaactcccgcccagcagcctggaccagctaaacctcccactcagcaggtcggtacacccaagcccctagcccagcagcccggtctccagtccccggccaaagcaccaggacctaccaagactcccgtacagcagcctggcccagggaaaatccctgcccaacaggccggtcccggcaagacctccgcccagcaaactggcccaacaaaaccccctagccagctccctggccctgcaaaaccgcctccacaacaacccggccccgctaagcctccgcctcaacagccaggttccgcaaaacccccttcccagcagcccggaagtacaaaaccaccccctcagcagcccgggcccgccaaacccagtccgcagcagccggggtctaccaagccccccagtcagcagcccgggagtgccaagccatcagctcagcagccaagtcctgccaagccttcagcccagcagagcactaaacccgtgagccagacaggcagcggaaagcccctgcagccacccaccgtcagtcctagcgcaaaacagcccccctcacagggtctacccaagaccatctgtccactgtgtaacacaactgaactgcttctgcatgtccctgagaaggccaactttaacacttgcaccgagtgccagaccacagtatgttccttgtgcggctttaatccaaatccccacctaactgaggttaaagagtggctctgtctgaactgccagatgaaacgggccctgggtggggatctggcgccagttccatcatcaccccaacccaagttaaagacagcgcccgtgacaacaacatctgcggtgtccaaatccagtccccagcctcagcagaccagtccaaagaaagacgcggcgcctaaacaggatctgagcaaggcacctgagccaaaaaaaccaccccccctggtcaagcagccaactctccatggctctccaagcgcgaaagcaaagcagccccccgaggctgattcactgagcaaaccagcaccccctaaggagccctcggtgccctcagaacaagacaaggcgccggtcgccgacgacaaacctaaacagccgaagatggtgaagcccacaacggacctggtgagtagttcctctgccacaacaaagccagacataccctcctctaaagtgcaatctcaggccgaggaaaagactacccctcccctaaaaacggactccgcgaagcctagccagagctttcctcccaccggagaaaaagtttcacctttcgacagtaaggcgatcccaagaccagccagcgattccaagattatatctcacccggggcccagcagtgagtctaagggccagaagcaagtggaccctgttcagaaaaaagaagagccgaagaaggctcagacaaagatgagtcctaaacccgacgcaaaaccaatgccaaaagggtctcctacaccacctggaccccgaccaaccgccggacagaccgtgcctaccccccaacaaagtcctaagcctcaagagcagtcacgccgtttcagtctgaatctgggcagcattaccgacgcccctaagtctcagccaaccactcctcaagagaccgtgacaggcaagttgtttggcttcggcgcctcgatttttagccaggctagcaatttaatcagtaccgccggccaaccgggccctcacagtcagagcgggcccggtgcccctatgaagcaggcgcccgccccttcccaaccccccacgagccaagggcctcctaaatctacagggcaggcaccccctgctccagctaagtcaataccagtgaagaaagagaccaaggctccggcagcagagaaactggaaccaaaggctgagcaagccccgacagtcaagaggaccgaaactgagaagaaaccaccccccatcaaggacagcaaaagccttactgctgaacctcagaaagcggttctgccaacaaaactggagaagtctcccaaaccagagtcaacttgtcccctgtgcaagaccgaattaaatattgggagtaaggatcctccaaactttaatacttgcactgaatgcaagaatcaagtctgtaacctgtgcgggtttaatccaactccacatctgaccgagatccaggaatggctctgcctcaattgccagactcagcgggccataagcggccaattgggggacatccgtaagatgccgcccgctccatccggtcccaaagcctctcccatgcctgtacccaccgaatcctccagccaaaagactgctgtgccaccacaggttaagctggtaaaaaagcaggagcaggaagtaaagaccgaggcagaaaaggttatactggagaaggtgaaggaaactctgagcatggagaaaatacctcccatggtcacgacagatcagaagcaagaggagagcaagctcgagaaagacaaagccagtgccctccaggagaagaagccactcccagaggaaaagaagctgattccggaagaagagaaaattcgcagcgaggaaaagaagccacttctggaggagaagaaaccgaccccagaagacaaaaagctgcttcccgaagcgaagacatccgcacccgaggaacagaaacacgacctgcttaagtcacaggttcagatcgcagaagagaaactagagggcagagtcgcaccaaagaccgtccaggaaggaaaacaacctcaaacaaagatggaagggctcccatccgggacccctcagagccttcctaaagaggatgacaaaaccacaaagacaattaaggaacagcctcagcccccatgcacagctaagcccgaccaggtcgagcctggtaaagaaaagaccgaaaaagaagatgacaaatctgacacctctagttcacagcagccaaaatcacctcagggcctgtctgataccggatattccagtgatggcatctccagtagtctcggtgaaattccaagcctcatcccgacggatgagaaagatatactgaaggggctgaagaaggatagcttcagccaagaaagctcgccaagttccccatctgacctggctaagctagagagcaccgtgctttcaattctcgaggctcaggccagcacccttgcggatgaaaaatccgagaagaagactcaaccccatgaagtgagccctgagcagcctaaagaccaagagaagactcagagcttgagcgagaccctagagatcacgatcagcgaggaggaaattaaggagagtcaagaggaacgtaaggacacatttaaaaaggatagtcaacaagacattcccagcagcaaggatcataaggaaaagtctgaattcgtggatgatatcactactagacgcgaaccatacgattcagtggaggagagtagtgagtcagaaaactcacctgtgccacagaggaaaaggagaacgtcagtagggagctcaagctcagacgaatataagcaggaagatagtcaagggagtggcgaagaggaggactttattagaaaacagatcatcgagatgtcagccgacgaagatgcgtctggctctgaggatgatgaattcattcgtaaccagctgaaagagatcagtagctctacagagtctcaaaagaaggaggagactaaagggaagggaaaaatcactgctgggaagcaccgccgcctcacccggaagtcgtctacgagcatcgacgaggatgctgggagacggcacagttggcacgatgaggacgacgaggcgtttgacgaatccccagagctcaagtacagagaaactaagtcccaggaatcggaggagctggtggtcactggtgggggaggtttacgacgctttaaaaccatcgaattaaactccaccattgccgataaatactcggcggagagttctcagaagaaaacaagcctctacttcgatgaagaacctgaactcgaaatggagtctctgacagactctccagaggaccggagtagaggagaagggtccagctctctccacgctagctcctttaccccaggaacttcacctaccagcgtgagctctctcgacgaagacagtgattcgtctccgtcccacaaaaagggagaatctaagcaacagcggaaagcccggcaccgtccccacggtcccttattgcccaccatcgaggacagtagcgaagaagaggaactgcgggaggaagaagagcttctgaaggaacaggagaagcagagagagattgaacaacaacagcgaaagtccagcagtaagaaatccaagaaagacaaggacgaactgagagcgcagcgtagacgcgaaaggcctaaaactccccctagcaatttaagccccatcgaagacgctagcccaactgaagagttgcgccaggctgcggaaatggaagagctccaccgctccagctgcagtgagtattcgccgtctatcgaatctgacccggaaggattcgaaatctccccagagaagatcatcgaggtgcagaaggtgtataagcttcctactgcggtgtctctgtactcccccacagacgagcagagtatcatgcaaaaagaaggctctcagaaggctttaaagagcgccgaagaaatgtacgaagaaatgatgcacaagactcacaagtataaggctttccctgctgccaatgaaagagacgaagtgttcgagaaagagcctctgtacggcgggatgttaatcgaagactacatctacgaatcactcgtcgaggatacctataatggatcagtggacggtagcctactaaccagacaggaggaagagaacggcttcatgcaacagaaaggaagggaacagaagataagactttctgaacagatatacgaagaccccatgcagaaaatcacagacctgcagaaggaattttatgaactcgagagcttgcactccgtagtgccccaggaagacattgtgtcatccagcttcataatacctgagtcacacgaaatcgtggatttgggaactatggtcaccagtaccgaggaagaaagaaagctgctggatgctgacgccgcatacgaggaactgatgaagcgtcagcagatgcaactgacaccgggttctagtccaactcaagcgccgattggagaagacatgaccgaatccacaatggattttgataggatgccagacgcatccctcaccagcagtgtgttgtctggggcgagcttgactgacagtaccagttctgcgactctgagcatcccagacgtcaaaataacccaacacttttccaccgaggaaattgaggacgagtatgttacagactatacccgcgaaatccaagagatcatcgcacatgagtctctcatcctgacttatagcgaaccctccgagagcgctacctccgtcccaccaagcgatactccctctctcacctccagtgtgtcttccgtttgtacaacggattcttcttcccccattacaacactagacagcattaccaccgtgtacacagaacctgttgacatgattactaaattcgaggatagcgaggagatttccagctcaacctactttccgggctcgattattgactatcccgaagaaattagtgtgtcccttgatcggacagcccccccggatgggcgtgccagcgcggaccatatagtgataagcttaagtgatatggctagcagtataatagagagtgttgtgcccaagcctgaggggcccgtggctgatacagtatccaccgatcttctgatttccgagaaggatccagtgaagaaagcgaagaaggaaacaggcaacggtatcatcctggaggtccttgaggcctatcgggataaaaaggaactcgaggccgagcgaaccaaatcatctctgtctgagaccgtgtttgaccatcctccttcctccgtgattgctttgccgatgaaggagcaattgtccaccacctacttcacttccggcgaaacattcggacaggagaagcctgcaagccaactaccaagtggatctccaagcgtgagtagtctccccgccaagcctaggcctttctttaggagctcctctctcgatatctctgctcagcctcctccccctcctcctccgccgccgccaccaccgccaccaccacctccacccccgccgccccccctacctccaccaacgagccccaaacccaccatactgccaaagaaaaagttaacagttgcatcacccgtcacgactgcaacgcctttgtttgacgccgtcaccaccttggagaccacagccgtgctgagatcgaacggcttgccagttaccaggatctgtacgaccgcaccacccccggttccaccaaagccgagtagtatcccatcgggactcgtcttcacacatcgccctgaaccctcaaagcccccaatagccccaaagccagtgattccccagttacccactaccactcaaaagccaacagacatacatcctaaacctactggactgtctctcacctcatcgatgactcttaacctcgtcacctcggccgattacaaactcccatccccaacctctccactgtcccctcattcaaataaatctagtccccgattttcaaagtctctgactgagacctacgtggtaatcacccttccaagtgaaccaggtacaccaaccgattcctcagctagccaggcgataacgagctggccattaggatccccaagcaaggatctagtatccgttgagcctgtgttcagtgttgtgccgcccgttacagcggtggaaatccccattagtagcgaacagactttttatatctcaggagcactgcagacgttctcggctacacctgtgactgcccctagcagctttcaggctgctccaaccagtgtgacgcagtttttgacaacggaagtcagtaagacggaagtatctgctacacggagcaccgctccctctgtgggcctgagctccatcagcatcaccataccaccggaacctctcgcccttgacaatattcacttggaaaaaccacagtacaaggaggacggaaagcttcagctcgttggcgacgtaatcgacctgaggactgtgcccaaggtggaagtgaagacaactgacaaatgtatcgatctgtccgcgtcaactatggacgttaagcgtcagattactgcaaatgaagtgtacggaaagcagattagcgccgtgcaaccaagcatcattaatctctccgtgacgtcttccatcgtcacgcctgtaagtctggcgacggagaccgtgacatttgtgacgtgtacagctagcgcaagttacaccacaggcactgaatctctggttggggcagaacacgccatgactactcccctacaactgacaacctctaagcacgccgagcctccatatcggatcccttccgatcaggtgttcccaatagctagggaagaggcgcccatcaaccttagccttggtactccagcccacgcagtgacccttgccatcaccaaacccgtgaccgtgccaccagtcggcgtgactaacggctggaccgactccaccgtaagccagggaatcacagatggcgaagtggtagacctttccaccacaaagtctcatcgaacggttgttactatggatgaaagcacctccagtgtcatgaccaagataatcgaggacgaaaagccggtggatttgactgccgggaggagggcagtgtgctgtgacgtcgtatataagcttccctttggcagatcctgcacggcacagcaacccgccacaactctgccggaagaccgattcggttatagagatgaccattaccagtacgaccggagcgggccatatggatacagaggcatcggcgggatgaagccatcgatgtccgacaccaatttagcagaggcaggccatttcttctacaagtctaagaacgctttcgactactccgagggcaccgataccgctgttgatctgacctctggacgcgtcactacaggcgaggttatggattactcttcgaagaccaccgggccttatcccgaaacccgccaagtcatttcgggtgccggtatcagtactccgcagtactcaactgcccggatgacccctccacctggccctcaatattgcgttgggtctgtgctgcgctcttctaacggtgtggtgtactcctctgttgcaacccctacgccatcaaccttcgcaataaccacccaacctggcagcatcttcagcaccaccgtgcgggatttgagcggcattcacactgcagacgctgtgacatcactgcccgcgatgcaccactcacagcccatgccccggagttactttatcacaaccggggccagcgaaacagacattgcggtgaccgggatcgacatcagcgcatccctgcagaccattaccatggaaagcctaaccgcagagactatcgattctgtcccaacactgacgactgccagcgaggtgttccccgaggtagttggagacgagtccgcattgcttattgtacctgaggaggacaagcagcaacaacagctcgatctcgaacgcgagctcttggagctcgagaagatcaagcaacagaggttcgcggaagagttggagtgggaaagacaggagatccagcgtttcagagagcaggaaaaaattatggtccagaagaaactggaggagctgcaatcaatgaaacagcatttactctttcagcaagaagaagaacgccaggcccagttcatgatgaggcaagagacgcttgcccagcagcagctgcagctcgagcagatccagcagctccagcagcagctccaccagcagctcgaggagcagaagataaggcaaatataccagtacaactacgacccctctgggaccgcctcaccacagaccacaacagagcaagctatcctcgagggacaatacgctgccttagagggtagccagttctgggccaccgaggatgccaccactaccgcttctgccgttgtggccattgaaattccgcagtcccagggttggtacactgtgcagtctgacggagtcactcaatacatcgccccacccggcattctgagtaccgttagcgaaataccactgacggatgtggttgtcaaagaggaaaaacagccgaaaaaacgttcttctggcgctaaagtgcggggacagtatgacgacatgggcgagaatatgacggatgatcctcgctcttttaaaaagattgtcgactcaggcgtgcagactgatgatgaagacgccaccgaccgtagctatgttagccgccggagacggacaaagaagagtgtggatacttctgtacagaccgacgatgaagaccaggacgaatgggatatgcctaccagatcaagacgtaaggccagagtgggtaaatacggtgatagcatgacagaagcagataaaaccaaaccgctctcaaaagtgtcttccatcgccgtgcagaccgtggccgagatttccgtccagaccgagcctgtgggtacaatccgaaccccatcaatccgggcaagagtggatgctaaggtcgaaataatcaagcacattagcgcaccggaaaagacctacaaaggtggctcattaggctgccagaccgaagcagattccgacacgcagtctccacagtacctcagtgcaacttccccccccaaggataaaaagagaccaacccctctggaaattggttatagctcacatctacgggctgatagtaccgtgcagctagccccatcccctcccaagtccccgaaggtcttatatagccccatctcccccttatcccccgggaaggcacttgagtcagcattcgttccgtacgagaagcctctgccagatgacattagtcctcagaaagtgctgcatccagacatggctaaggttcctccagccagtcccaagaccgctaaaatgatgcagcggagcatgtcagatccaaagcccctttcgcccaccgctgacgaatcatcccgggctcccttccagtatactgagggttacaccaccaaagggtctcaaacaatgacgtcctcgggggctcagaaaaaagtcaagcgcacactccccaatcccccccctgaagaaatctccactggaactcagtctaccttttcaacaatggggaccgtgagccgccgacgcatttgtcgcaccaacacaatggcccgggcgaagatcttgcaggacattgacagggagctagatttagtggagagagagtccgccaaattgcgcaagaagcaggcagaactggacgaggaggaaaaagaaatcgacgccaagcttcggtatttggagatgggcattaatcgccggaaagaggccctgctgaaggaacgggaaaaacgagagcgcgcgtatctgcagggtgtggcggaggacagagattacatgtctgactcagaggtaagctcaacacgtcccaccaggatagagtcccagcacggcattgagagaccccgcactgctccacagaccgagtttagccaatttatcccaccccagactcagactgagtctcagttggtgccacccacttcgccttatacccagtatcaatactcatccccggccctccccacacaggcgcccacttcctacactcagcagtcacacttcgagcagcagacactgtaccatcagcaggttagcccataccagacccagccaacgttccaggcggtggccaccatgagttttactcctcaagtgcagcccacgcctacacctcagcccagctatcagctccccagccagatgatggtcatacagcaaaaaccgcgccaaactaccttgtacctagaacctaagattacctccaactatgaggttatacggaaccagcccttaatgattgcaccagttagcactgacaataccttcgccgtatcccacctcggcagcaagtataattcgctggatttacgcatagggctggaagaacgctcgagcatggcctcgtctcccatatccagcatttcggctgattcgttttacgccgatatagatcatcacacaccccgtaactatgtactcattgacgacatcggtgagataaccaaagggactgccgccctctctactgcctttagtctccatgaaaaggatttatctaagacagaccgcctgctgcgtacaaccgaaactaggagatctcaggaagttaccgatttcttagcccccttgcaatccagctctcggctgcattcctatgttaaagcggaagaagatcccatggaagatccatacgaacttaagctgttaaaacaccagattaagcaggagtttcgtagaggaacagagagtctggaccaccttgcgggcctctcacactactaccatgccgatacaagttatcgccacttcccaaagagcgaaaagtatagcatttctcgactcaccctggagaaacaggcagctaaacagttgcccgccgctattctttaccaaaagcaatcaaagcataagaagtccctgatagatccgaagatgtcaaagttcagtcccatccaggagtcacgggacctggagcctgattacagctcgtatatgacatcgtcaacttcgtccataggcggaattagctcccgagctcgcctcttgcaggacgatatcacatttggtctccggaaaaacataaccgaccagcagaaatttatgggaagctcgcttgggacaggattaggcacactcgggaatactatcaggtcggctcttcaggacgaagcagacaagccatactcctccggaagtaggagtcgcccttcaagtagaccctcatctgtctacggcctggatctgtcaattaaacgtgacagctctagctccagtcttcgcctgaaggcccaagaggctgaagcccttgacgtgtctttcagtcacgccagcagcagtgcgcggacaaagccaacttccctgcccatatcacagtcccgagggcggattccaatcgtagctcagaactctgaggaggaatcgcccctttccccggtgggccagcctatgggcatggcaagggccgcggccggacctctgccacctattagcgcagacactagggatcagttcggatctagccacagtctgccagaggtgcaacagcacatgcgtgaagaatcacgtactcgcggttatgaccgtgatattgcctttatcatggatgacttccaacacgctatgtctgattctgaggcctaccaccttcgcagggaggaaacagactggttcgataaaccccgagaatcccgcttagagaacggacacggcttggatagaaagctgcctgagcgcttggtccattctagacccttatcccaacatcaggaacagatcattcagatgaatggcaagacgatgcactacatattcccacacgcacgcattaagattaccagagactctaaggaccacacagtgtctgggaatggtttggggatccggatagttgggggaaaagagataccggggcattccggcgaaatcggcgcctatatagcaaagatcttaccaggaggatctgctgaacagactggaaagctgatggaagggatgcaagtgctcgaatggaatggcatccctctgacaagcaaaacatacgaggaggtccaatctatcatctcccaacagtctggcgaggcggaaatatgcgtccgtctagacctcaatatgctctccgacagtgagaacagccagcacttggagttacacgaacccccaaaggccgtagataaagccaaaagcccaggagtcgatcctaagcagcttgccgccgagctccaaaaggtgtccctccagcaaagccctctcgttctgagctctgttgtggagaaaggtagccacgtgcactctggaccaactagcgccggatcttcttccgtgcccagcccgggccagcccggcagccctagtgtgagtaagaaaaagcacggaagctcaaaaccgactgacggaactaaggttgtgtcgcaccctattacgggagagattcagttacagatcaattatgatctgggaaatctgattatccacatcctgcaggcaagaaatctggtgcctcgcgataacaacggctattctgacccattcgtgaaagtgtacctcttacccggacgggggcaagtcatggtcgtgcagaacgcctccgcagaatataaaagacgcaccaagcatgtgcagaaatctctaaaccccgaatggaaccagactgtgatctacaaatcgatcagtatggagcagctcaaaaaaaaaacacttgaggtgaccgtatgggactacgatcggttcagctctaacgacttccttggcgaggtactcattgacctgtcttccacttctcacctggataacacgcctcggtggtacccactaaaagaacagactgagagcattgatcacggtaagtcccactcaagccaatcaagccagcagtcccccaagccctctgtgatcaagtctcgtagtcacggtatattccccgaccccagcaaagacatgcaggtgccaaccatcgaaaaatcccattcctccccggggtcctccaagagcagcagcgagggtcacttgcggagtcacgggccctcacggagtcagtccaaaaccagcgtcacacagacccatctcgaagatgccggagcagcgatagccgctgccgaggctgctgtgcagcagttaagaattcagccaagcaaaaggcgaaagtag

SEQ ID NO: 199656 - DNA, 10908 bp, Artificial Sequence
  Description of Artificial Sequence: Synthetic coding sequence
atgggcaacgaggccagcctggagggcgagggcctgcccgagggcctcgcggcagccgctgccgcgggaggcggagcttctggcgcaggttctccttcacacacagcgatccctgccggtatggaagcggacctctcacagctatctgaggaagaacgacgtcagattgcagccgtgatgagtcgggcccagggcctgcccaagggctcagtgccaccagcggccgccgaaagtcccagtatgcatcggaaacaggaactggattcttctcaccctcctaaacagagcggacgcccgcctgaccccggcagacccgcacagcctgggttgagcaagtcacgcacaacagatactttcaggagtgagcaaaagttgccagggagatccccctctactatctcactgaaggaatctaaatctcgaaccgatctgaaggaggaacacaagtcttctatgatgccgggcttcctgagcgaggtgaatgccctgagtgccgtgtcttccgtggtgaataagtttaacccattcgacctgatcagtgattctgaagcttcccaggaggaaacaaccaaaaagcagaaggtggtccagaaagagcagggaaaaccagagggcatcattaaaccacctttgcaacagcaacctccaaagccaattcctaaacagcaaggacctgggcgcgacccactccaacaggatgggacaccaaagtcaataagctcacagcagccagaaaaaatcaagtcacagcctcccgggaccgggaagccgatccagggccccactcagaccccccagacagaccatgccaaattacccttacaacgggacgcttctcgaccccagactaagcaagccgatatagtcaggggcgagagtgtcaaaccaagtctaccttcgccctccaagccaccgatccagcagccaactccaggtaaaccacctgcccagcagccagggcacgagaaatctcagccagggcctgccaagcccccagcccaaccttctgggcttacaaagccgctcgctcaacagccgggaacggtgaaaccccccgtccaaccccctgggaccaccaaaccccccgcccagccgctggggcccgccaagcccccggcccagcagaccggcagcgagaagcccagctctgaacaacctggcccgaaagctctggcacagcctcccggagtcgggaagacacctgcccaacagcccggtcccgccaagcccccgacccagcaggtgggcacacccaaacccctggcacagcagccgggtctccagagcccagctaaggcaccagggcctacgaagaccccggtgcagccaaagccaccatctcagcagccaggatcaacaaagcccccccctcaacaacccggacctgccaagccctcccctcagcagccagggtcaacaaagccgccatcccaacaacctggcagcgccaagccatccgcgcagcagccctcacccgcgaagcctagtgctcagcagagtacaaaacccgtctcccaaacgggctcaggcaaacctctgcagccccctaccgtgtctccatcggcaaaacaaccaccgagtcaggggctgcctaaaacaatctgcccactatgtaacactactgagctgttgctgcacgtgccggagaaagcaaattttaatacttgtactgaatgtcagacaactgtatgttctctctgcgggttcaacccaaacccccatctaacagaggtgaaagagtggctttgcttaaattgccagatgaagcgagctctgggcggagatctcgcccccgttccctcaagcccccagccaaagctaaagaccgctcctgtgaccaccacatcagcagtgtctaagagcagcccccagccgcaacagaccagcccaaaaaaagacgccgcacctaagcaagacctgagtaaagcaccagagcccaagaagccccctcccctggtcaagcagccgactctccatgggtccccaagtgctaaagccaagcagccccctgaggcagattccctgtcaaagcctgctcctcctaaggagcctagcgtgcccagcgagcaggacaaggccccggtggccgacgataagcccaaacagccgaagatggttaaacccactaccgatctagtgagctcgtcaagcgctaccactaagcccgacataccatccagcaaggtgcagtctcaggccgaggagaagaccaccccccccttaaagactgattctgctaaaccgagtcagagcttcccccccacgggggaaaaggtatccccgttcgactccaaggcaataccgcgacccgctagcgacagtaagatcatcagccatcctggaccaagttcggaatcgaagggacagaagcaagttgacccggtgcagaaaaaggaagaaccaaaaaaagctcaaaccaaaatgtcaccgaagccggacgccaaaccaatgccgaagggtagcccaacgcccccagggcctagaccaacggcaggccagacagtccctacaccgcagcagagtcccaaaccacaggaacaatcaagaaggttctccctgaatctgggttcaattacagacgctccaaaaagccagccgactacccctcaggagactgtgactggtaagctcttcggcttcggagcctcaatcttcagtcaagcctctaatttaatctctactgccgggcagcccggtccccacagccagagcggcccaggcgcgcccatgaaacaagcccccgctcctagccagccgccaactagtcaggggcctcctaagagcaccggccaggccccaccagcgcctgctaagtccattcccgtcaagaaggaaaccaaggcccctgctgctgagaagcttgaacctaaagccgaacaggcccctactgtgaagcgtaccgaaaccgagaagaaaccaccacccattaaagatagtaaatcattgaccgctgagcctcagaaagcggtcctgccaaccaagctcgaaaagtcacctaaacccgagtcaacttgtcccctgtgtaagactgaactgaatattggaagcaaggacccccccaatttcaacacttgtactgagtgcaaaaaccaagtttgcaatctgtgcggatttaaccctaccccgcatctgactgagaactgccagactcagagggcgatttctgggcaactgggtgatatacggaaaatgccaccagcccccagtgggcccaaggccagtcccatgcctgtgccaacggagagcagctctcagaagacagcagtacctcctcaggtgaagttagtcaagaagcaggagcaagaagtgaagactgaggcagagaaagtgatcctggagaaagttaaggagaccctttctatggagaaaattcctccaatggtcactacggatcagaagcaggaggagtcaaagctggagaaggataaggcaagcgccctgcaggaaaaaaagcccctgccagaagaaaagaagctgatcccagaggaggagaaaatcaggtcagaagaaaagaagccccttctggaagaaaaaaagcccactcctgaagataaaaagcttctacctgaggccaaaacatcggcccctgaggaacagaagcacgacctcttgaagtcgcaggttcagatcgccgaggagaaactggagggcagagtcgcaccgaaaaccgtccaagaaggaaagcaaccgcaaactaagatggaaggtctgccatcagggacgccacagtcattacccaaggaggacgataagaccacaaagaccatcaaagaacagccgcagccaccatgcactgccaaacctgatcaggaaaaagaggatgacaaatccgacacaagcagtagccagcagccaaaatctccccagggcctgagcgataccggctactctagtgacggcatttcttccagcctgggagagatccctagcctgattcccaccgatgagaaggacatccttaaaggcctaaaaaaggactcgttttctcaggaatctagtccgagttctccgagtgacctggccaaactagagtccaccgttctgtccatactggaagcccaggcgagtacactcgcagacgagaagtctgagaaaaaaacgcagccgcatgaagtgtcacctgaacaacctaaggatcaggaaaagactcaaagcttgtccgagaccctggagataaccatctcagaagaagagattaaggaaagccaggaagagcggaaggacacatttaagaaggactctcagcaggatattccctcctcaaaggaccacaaggagaagagtgagttcgtagacgatatcacaaccagaagggaaccctatgacagtgtcgaagaatctagtgagtcagagaactctccagttccccagcgcaagagacgcaccagcgtgggcagtagttcgtcagacgagtataagcaagaggacagtcagggatccggtgaggaggaagatttcattcgtaagcagatcattgagatgtctgccgacgaagacgccagtggcagcgaggatgatgaatttatccggaatcaacttaaagagataagctcgtcaaccgaatcccagaagaaggaggaaacgaaagggaagggaaagattaccgcggggaagcatcgccgcctgaccagaaagtcctcaaccagtattgacgaagatgcagggcgccgtcactcctggcacgatgaggatgacgaggcctttgatgagtcccctgaattgaagtaccgcgagactaaaagccaggagagcgaggaactcgtggtgacaggaggcggcgggttacggaggttcaaaactatagagctgaattcaaccatagcggataaatattcagccgagtcctcccagaaaaagacttctttatattttgatgaggaacccgaactggaaatggagtcgctcaccgattctccagaggatagatccagaggcgagggcagctcatctctgcacgcctcgtctttcacacctggcacctcacctacctccgtctcgtcactggatgaggacagcgatagttcgccaagccataaaaagggggagagtaaacaacagcgcaaagcccggcacaggccccatggcccactactgccgacgatcgaagacagctccgaggaggaagagctccgggaggaagaggaattgttgaaagaacaggagaagcagagagaaatagagcagcagcagaggaagtctagtagtaagaagtccaaaaaagacaaagacgaactccgggcgcagaggcgtcgggagcgacccaaaaccccaccttcaaacttatccccgatcgaggacgccagccctacagaagagctccggcaagctgcagagatggaggaactccacaggtcttcttgcagtgaatacagtccttccatcgaatccgatcctgagggcttcgagattagcccggaaaaaatcatcgaggtccaaaaggtctataagctgcccactgccgtgtccctgtattcaccaaccgatgaacaatccattatgcagaaagaaggatcccagaaggcactgaagtctgccgaagagatgtatgaagagatgatgcacaagacacacaaatataaggctttcccagcagcgaatgagcgggacgaggtctttgagaaggagcctctgtacggggggatgttgattgaagactacatctacgagagcctggtagaggacacctataatggtagcgtcgacggaagcctgctcacacgccaggaggaggagaacggcttcatgcaacagaagggacgtgagcagaagatccgactgtccgaacagatttacgaggatcctatgcagaagataaccgaccttcaaaaggaattttatgaacttgagtcactacacagcgtggtcccgcaggaagacatcgtgtcaagtagcttcatcataccggaatcgcatgaaattgtcgatttggggaccatggttaccagcaccgaggaagaacggaagctgctcgatgccgacgcggcctacgaagagcttatgaagcggcagcagatgcagcttactcctggtagtagccccacccaagccccaataggagaggacatgacagaaagtacgatggattttgatcgcatgccagatgctagcctgacgtcaagtgtgctgtcaggtgcatctctgactgacagcacatcttctgcaaccctctccattcccgacgtgaagattactcagcatttctccacagaagagatcgaagatgagtatgtgactgattatacccgcgagattcaggaaataatcgcccacgagagcttgattctgacctacagcgaaccatccgagagtgcaacctctgtaccaccgtccgacacaccatctctgaccagtagcgtgtcaagcgtttgcacaactgattcatctagtcctataaccactcttgatagcattactaccgtgtacaccgaacccgtagacatgattaccaagttcgaggatagtgaggaaatttctagtagcacctactttccaggctccatcattgactatcccgaagaaatctcagtctctttggaccggacagctccccccgatggcagggcatccgcagatcatatcgtgatctctttaagcgatatggctagctcgattattgaaagtgttgtccctaaacccgagggccccgtggctgacacggtctccacggacctccttatctctgagaaggatccagtgaaaaaggcaaagaaggagaccgggaatggcataatcctggaagtcctggaggcctatcgggataagaaggaactggaggccgagagaaccaaaagcagcctcagcgagacagtcttcgatcatccaccatctagtgtgattgccctccccatgaaggagcaattatctactacctactttacaagtggtgaaactttcggacaggagaaaccagcatcacagttgcctagcggctccccctcagtcagcagtctccccgcaaagccgcgccctttcttcagaagctcctccctggatatttccgcacaacctcctccacccccaccgcctcccccccctccacctcccccccctcctccacctccacccccaccacttcccccccctacgtctccgaagcctaccattctgcccaaaaagaaactaactgtagcaagcccagtcaccactgctacaccactattcgacgccgttaccaccctggaaactaccgctgttctccgcagcaacggcctgccagtgaccagaatctgtaccaccgcccccccaccggttcctcctaagccctcttccatcccctcaggacttgtctttacgcaccgaccagagccaagcaagcctcctatcgcgcccaagcctgtgataccgcaactgcccacaaccacacaaaagccaactgacattcacccaaaaccgaccggattgtctctgaccagctcaatgacactgaacctggttactagtgctgattataaattgcccagcccaacatcacccttatcccctcactccaacaagtcaagccctaggttttctaagagcctcactgagacttacgtagtcatcacgctcccgtccgaacctggaacacccacagattcaagtgcaagtcaagctatcaccagctggcccctcggttccccctccaaagatctggtgtcagtggagccagtcttttccgtcgtaccgcctgttaccgccgtggagatccctatctctagcgagcagaccttttatatctccggcgccctccagacattctcagccactcccgtaaccgctcctagcagttttcaggccgctcccacgagcgttacccagtttctgacaaccgaggtctccaagacagaggtttccgcaacccgcagcaccgccccctcagtagggttgagcagtatcagtattactatccctcctgagcccctggcattggataacatacacttagaaaaaccacaatataaggaagacggtaaattgcagttagtcggagacgtaattgacttgcggaccgtccccaaggtagaggtgaagacaaccgataagtgcatagacctttctgcaagtacaatggacgtcaagcgccagataacggctaatgaagtttacggcaaacagatatccgccgtgcaaccgtctataatcaaccttagcgtcacaagctccatcgttactcccgtatccctggccactgaaaccgtcacattcgtgacttgtactgcttctgcatcctacactacaggcacagaaagcctcgtgggagccgaacatgctatgaccacaccattgcagctgaccacgtctaagcacgccgaaccaccataccgcattccctccgatcaggtgtttcctatcgctcgtgaggaagcacctattaacctgagtttgggcacccccgctcatgccgtcacccttgcaattacaaagccagttacagtgccgcccgtgggggtcactaatggctggaccgattcgacagtgagccaggggatcaccgatggagaagttgtcgatttgtctactacaaaaagtcaccgcacagtggtgacaatggatgaaagcaccagtagtgttatgacaaaaattatagaagacgaaaaacctgttgacctgacggctggtagacgcgctgtctgctgtgacgtcgtctacaagctcccatttgggaggagctgcacagcccagcaacccgccactacattgcccgaggatcgttttggctaccgcgacgaccattatcagtacgatcggagcggcccttatgggtatcggggtatcggaggcatgaagcccagtatgagcgatactaatctagctgaggctggtcattttttttataagtctaaaaatgctttcgattactccgagggcactgatacagccgtcgacctcacgagcggtagggtgacaacaggagaggtgatggattatagcagcaaaacaactgggccataccctgagactaggcaggtgatttcaggcgccggcatcagtactccccagtatagcacagcaagaatgactcccccacccgggccccagtactgcgtgggctcagtgcttcgcagctctaatggagtggtgtacagttcagtggctacccctaccccatccactttcgcaatcaccactcaacctggaagcatatttagtactactgtgagagatctcagcggaatccacacagccgatgcagtcaccagtcttccggcaatgcaccatagtcagcccatgcctcggtcctattttatcactaccggggcgtcagagacagatatcgcagtgactgggattgatatcagtgccagtcttcaaacaattacgatggagtctctgactgcagaaaccattgattccgtgcctaccttaaccactgcaagcgaggtgttcccagaggtggtgggggatgaaagtgccctgctcatcgtgccagaggaggacaaacagcagcagcagctggatctggagcgcgagttgctggagttggagaaaatcaagcagcaaagattcgccgaggaacttgagtgggagaggcaggaaattcaaagatttagggaacaggagaaaattatggtgcagaagaagctcgaagagctgcagagcatgaaacaacatcttctctttcagcaggaggaagaacgccaggcgcagtttatgatgaggcaagagacactcgctcaacagcaactgcagctcgagcaaattcaacaactgcaacagcagctacaccagcagctggaagaacagaagatcaggcaaatctatcagtataactacgatccttcaggaactgcctcacctcagaccacgactgaacaggccatcctggagggtcaatacgctgcacttgagggcagtcagttctgggcaactgaagacgcgacaacaacggcatccgcggtggtcgcaatcgagatcccccagtcacaggggtggtatactgtacagtcagatggcgtaacccagtatattgcccctcccggtatcttatctacggtgtccgagataccactcacggatgtggttgtgaaggaagaaaagcagccgaaaaaacgatcgtcaggcgctaaagtacggggtcagtacgacgacatgggggagaatatgaccgacgaccccagatcgtttaagaagattgtggattcaggcgtgcagacagacgatgaggacgcgactgacagatcttacgtatcgaggcgtaggagaactaagaagtcagtcgatacgtctgtacagaccgacgatgaggaccaggacgagtgggacatgccgactcggtctcggcgtaaggcccgagtcggcaagtatggagattccatgactgaggctgacaaaacgaaaccgttgtcaaaggtgtccagcatcgccgttcagaccgtcgcggaaatctctgtgcagacagaacctgtcggcacaatccgaacaccgtccattagggctcgcgtcgatgccaaggttgagatcataaagcacatcagtgcccccgaaaaaacctacaagggcggatcccttggctgccagactgaagcagactccgacacccagtctccccagtatctgagcgcaacttctccgcctaaggacaagaaacgacccactccactagagattggatacagcagccacctacgggccgatagcacggtccaactggccccctctcctcctaagagccctaaggtactctactccccaataagcccactgagccctggtaaggccctggagtcagcctttgtaccctatgagaagcccctgccagacgacatcagccctcagaaggtgctgcatcccgatatggccaaggtccctcccgcttcacctaaaaccgctaagatgatgcagcggtcaatgagcgatcctaaaccactttcccctacggccgacgagtccagccgcgccccatttcagtacacagagggctatacgtag

SEQ ID NO: 199657 - DNA, 1635 bp, Artificial Sequence
  Description of Artificial Sequence: Synthetic coding sequence
atggagaagctgcaggagcacctgatcaaggccaaggccttcaccatcaagaagaccttagagatatacgtcccaatcaagcagttcttctacaacctcatccacccagaatactccgccgttaccgatgtatacgttctgatgttccttgcagataccgtagactttattataattgttttcggcttttgggcctttggaaagcactctgcggccgccgacatcacatcatcactgagtgaggatcaggtacctggtcctttccttgttatggttttgatccaatttggcactatggttgtggatagggccctgtatctacggaaaaccgttctcggtaaagtaatctttcaggtgattctggtgttcggtattcacttttggatgttcttcatactcccaggtgtaactgagcgcaagttcagccaaaacctcgtggcacaactctggtattttgttaaatgtgtctactttggtttatccgcataccagattagatgtggatacccaacgcgcgtcttaggaaacttcctcaccaaatcatacaattacgtgaatcttttcctgttccaaggcttccgactggtgcctttcctgactgagcttcgggccgtcatggattgggtgtggaccgacactacactttccctatccagttggatctgcgttgaagacatttacgcccacatttttatactcaagtgctggagagagtccgagaagcccatctttacaatgagtgctcagcagtcgcagctgaaagtgatggatcaacagtctttcaacaaattcattcaggcttttagccgcgacactggggctatgcagtttctggaaaattacgaaaaggaggacatcaccgtggctgagctcgaaggaaacagcaactccctgtggacaatcagtcccccctctaaacagaagatgatccacgagttgctcgatcccaatagtagtttttcggtagttttctcatggagcatccagcggaatctctcactgggcgcaaagtcagaaatcgccactgataagctgagttttcctctcaagaacattactcgaaagaatatcgcaaagatgatcgcaggaaacagcacggagtcaagtaagactcccgtcaccatcgaaaaaatctacccatactatgtgaaagcgccctctgacagtaattcaaaacctatcaaacagttgctgtccgaaaataattttatggatatcacaatcatcctgtctagagataataccaccaaatacaactcggaatggtgggtgctgaatcttacaggcaatagaatctacaacccaaactcccaggctctggagctggtcgtctttaatgataaggtaagcccgcctagtctgggctttttggcagggtatggcattatgggcctgtacgcaagcgtggtgctcgtaattggaaaattcgtgcgtgagttttttagcggcattagtcactctattatgtttgaagaactgcctaacgtagaccgcatactgaaactgtgcaccgacatcttcttagtacgggagacaggagagttggagttggaagaagacctatatgcaaagcttattttcttatacagaagtcccgagaccatgatcaaatggacaagggagaagacaaactag

SEQ ID NO: 199658 - DNA, 8259 bp, Artificial Sequence
  Description of Artificial Sequence: Synthetic coding sequence
atggccagcgaggtggtgtgcggcctgatcttccggctgctgctgcccatctgcctcgccgtggcatgtgcattccggtataacgggctttcgttcgtgtacctgatctatctgttgttgatacctttgttcagtgaacccacaaaaacaactatgcaaggacacacaggccgccttctgaagagcctttgcttcattagcctatcttttctcctcctgcatattatctttcacatcacactcgtaagcctggaagcccagcacagaatcgctccaggttataactgttctacctgggagaagacgtttaggcaaattggattcgagtccttgaagggtgcagatgccgggaacggtattagggtatttgttccagatattgggatgtttattgctagcctgactatatggctgctgtgtcgcaatattgtgcagaagcctgttacagacgaagccgcccagagcaatccggagtttgaaaacgaggaactggccgaaggtgagaaaatcgactccgaggaggctcttatttacgaagaagacttcaatggcggtgacggagtggagggcgaactggaagagtccaccaagctcaagatgttccgcaggctcgcctccgtggccagcaagttaaaggagtttatcggaaatatgattacaactgcggggaaggtggtcgttacaatccttctgggcagctcggggatgatgctgccttctctcacctcttcagtgtacttctttgtgttcctgggcctatgtacctggtggtcctggtgtagaacatttgatccactcctgttctcctgcctctgcgtgttgctggcaatctttaccgccggtcatctcatcggtctctacctgtaccagttccagtttttccaagaggcagtacctccaaatgactattatgcacgcctgttcggcataaagtccgtgattcaaacagattgtagttctacgtggaagataattgtcaaccccgacttgagctggtaccaccacgccaatccaatactgttattggtgatgtactacaccctggccaccctcattcgtatctggctgcaggagccactcgtgcaggacgaaggcaccaaagaagaagacaaagctctcgcgtgctcacctatccaaattactgcagggcggcgccgctctctgtggtacgccacacattatccaaccgatgaacgaaagctactctcaatgactcaagacgattacaaacctagtgatggactcttggtcaccgtgaatggtaatcccgtggattatcacacgatccacccttcccttccgatggagaacgggccaggcaaggcagacctttatagcacacctcagtatcgatgggagccctcagatgagtcttcggaaaaaagggaggaggaggaggaggagaaggaggagtttgaagaggaaagatctagagaggaaaagagatccatcaaggtccacgccatggtctcagtcttccaatttattatgaagcagagttacatctgtgcgcttattgctatgatggcctggtctattacctaccactcttggttgacatttgttctgttgatttggagctgcactctgtggatgatcaggaatcgcaggaaatatgccatgattagttcacccttcatggtcgtgtatggaaatctgctcctgattctgcaatatatatggagttttgaactgcccgagattaagaaagtgcccggattccttgagaagaaagagcctggagagctcgccagcaaaatacttttcaccattactttttggttactcctaaggcagcatctgactgaacaaaaggctctgcaggagaaagaagcactgttgtccgaggtcaagatcgggtcccaggagaacgaggagaaggatgaagagctgcaagatatccaggtcgaaggagagcccaaggaggaggaagaagaggaagctaaggaagagaagcaggagcgtaagaaagttgaacaggaggaagcagaggaagaagacgagcaggatattatgaaagtcctggggaacctggtcgtcgctatgttcatcaagtactggatatacgtatgtggcgggatgtttttctttgtctctttcgaggggaagatagtcatgtacaagattatctacatggtgttattcctcttctgcgtagccctctaccaagtgcactatgagtggtggcgcaaaatcctaaagtatttttggatgagcgtagtaatctacaccatgctcgtgctcatctttatatacacctatcagttcgagaatttccctggactctggcagaatatgacaggactgaaaaaagaaaaactagaggatttggggttgaaacagtttactgtggcagagctgttcactcggatctttatccctacctcctttttgttagtgtgtattctacatttgcactactttcacgacaggtttctcgaactaaccgacttgaagtcaattcccagcaaagaggacaataccatttataggctggcgcatcccgaaggctccctgccggacctaaccatgatgcaccttactgcttcgctagaaaaacccgaggttaggaagcttgcagaacccggcgaagagaagctggaaggttattctgagaaggcccagaagggcgatctgggcaaggacagcgaagagtccgaagaggacggcgaagaagaggaagaatcggaggaggaggaggaaacatctgacttgcggaacaaatggcatctggtcattgaccggctgaccgtcttatttctgaagtttctcgagtactttcacaaactccaagtcttcatgtggtggatactagagctccatattatcaagattgttagctcctatataatttgggtgtccgtaaaagaagtaagcctgttcaattacgtcttcctgatcagctgggcctttgcactgccgtatgctaagctgcgtcggctggcctcctctgtctgcaccgtttggacatgcgtcattattgtgtgcaagatgctgtatcaattgcagactataaaacctgagaatttttccgtgaactgctccttaccaaatgaaaaccagaccaacattccgtttaatgagcttaataaaagcttactgtattcagcccccattgaccctaccgagtgggttgggctgcgcaaatcaagtccgttgctggtttacctgaggaataacctactgatgctggctatacttgcttttgaggtgactatctacaggcaccaggagtattacaggggtcgtaataacttgaccgcccctgtgtcaagaaccatattccacgacatcactcgcctgcacctggacgatggattgattaactgtgcaaaatactttatcaattactttttttacaagttcggcctggagacttgctttcttatgagtgttaacgtgataggtcagcggatggatttttacgctatgatacacgcctgctggctgatcgccgtcctctataggcgcaggcgcaaggcgattgctgagatatggcccaagtactgctgctttttagcatgcattatcacctttcagtacttcatctgcatcggcatcccacccgctccctgccgcgactacccgtggcgctttaagggagcctcctttaacgataatataattaagtggctctactttccagattttattgttaggcctaatcccgtctttctggtgtatgatttcatgctcctgctctgtgccagcctgcagagacaaattttcgaggacgagaataaagccgcggtgaggataatggcgggcgacaatgttgagatttgtatgaatctcgacgccgctagcttttcccaacataacccagtccccgacttcatccattgtcgctcttacctagatatgagcaaggtcatcatcttctcctatctgttctggttcgtgctcactattattttcatcacgggcacaactagaatcagtattttctgcatgggttatctagtggcttgtttctattttttacttttcggtggtgatctgctcctcaaacccattaagagcattctgcggtattgggactggctgatcgcctacaatgtgttcgtgatcaccatgaagaacattctgagcattggagcctgtggctatattggcaccctagtgcacaacagttgttggttgatccaggcctttagcctggcctgcacagtgaagggctaccagatgcctgccgcaaactccccatgtacactgcctagtggagaggccggaataatctgggactctatctgctttgcctttctactactccagagaagagtattcatgagttactatttcttgcatgtagtggctgatataaaggcaagccagatcctggcttcaaggggggctgagctgttccaggccactattgtgaaagccgtgaaagcaagaatcgaggaggagaaaaaatcaatggaccagctgaaacggcaaatggatagaataaaagcaaggcagcagaagtacaagaaaggaaaggaacgaatgttaagtttgacccaggagcccggcgaaggccaggacatgcagaaactctctgaggaagatgacgagcgcgaggcagacaagcagaaggcgaagggcaagaagaagcagtggtggcgcccctgggtcgatcacgcttccatggtacggagtggagattattatctgtttgagacggactctgaggaggaggaagaagaggagctgaagaaggaagatgaggagcctcctcgccgcagcgcttttcagttcgtttatcaggcctggataactgaccctaaaacagctcttcggcagcgccacaaggaaaaaaaacggagtgcccgagaggagcgcaaaagacggagaaagggtagcaaagagggtcctgtggagtgggaagatagggaggacgagcctattaagaaaaaaagtgatggccctgataacattattaagagaatcttcaatatcctcaaattcacctgggtgctgttcctggctacagttgactcgttcaccacttggctgaacagcatctcccgcgagcatatcgacatctctaccgtgttaaggatcgagaggtgtatgctcacaagagagatcaagaagggaaacgtccccactagagagtcaattcacatgtattaccagaatcacattatgaacttaagccgcgagtccgggttggatactatagatgagcaccccggggcggcatctggcgcgcagaccgctcaccgcatggattccctggattcacatgactccatcagctcagaacccacgcagtgtaccatgctatattcgcgtcaggggacaaccgagaccatcgaggaagtggaagccgaacaggaagaggaagctgggtctacagccccagaaccacgggaggcaaaagaatatgaagccacaggatacgacgtgggagcaatgggggccgaggaggcttccctcacccccgaggaggagctgacccagttcagcaccctcgacggcgacgtggaggcccctcccagttacagcaaggccgtgtctttcgaacacctcagtttcgggagccaggatgactctgccggcaaaaatcggatggccgttagccccgacgattcacggacagacaagttgggtagcagcatcctgccccccctcacccacgaactgactgcctctgaactgctgctaaagaagatgttccatgatgatgaactggaggaaagcgaaaagttttacgtgggacaaccgcgcttcctactgctcttctacgcaatgtataacactctggtggccaggtcagaaatggtgtgctacttcgtgattatcctaaaccacatggtgtccgcctccatgatcacactgctgctcccgatcctcatttttctctgggctatgctcagcgtgccccggccaagcagacggttttggatgatggccatcgtgtatacggaggtcgccattgtagttaagtacttcttccaatttggttttttcccttggaataagaatgtcgaggtgaacaaggataagccatatcaccccccaaatatcattggggtggaaaagaaagagggatatgtcctctatgacctgatacagctcctcgcactttttttccaccgatcaatcttgaagtgccatggactctgggatgaggatgatatgaccgagtccggtatggcaagagaggaaagcgacgacgagctcagcctaggtcacggccgcagggattcctcggactctctgaagagtatcaatctcgccgcctctgtggaaagcgtgcacgtgacatttccagaacagcagactgcagtcagacgcaagcgatctggatcgagcagcgagccatcgcagagaagctccttcagcagtaatcgcagccaaagagggtcaacatcaactcgcaacagctctcagaagggttcttccgtgttgagcattaaacagaaaggaaagagagagttatatatggagaagctgcaggaacatctgatcaaagccaaggccttcacaatcaaaaaaactttagagatctacgttccaattaagcagtttttctataatctaatacaccctgaatattccgcggtcacagacgtgtacgtcctgatgtttcttgcggacacggttgacttcatcatcattgtgtttgggttttgggcttttggaaagcactccgcagcagcagacataacatcttccctctccgaagatcaggtgccaggtccatttctcgtgatggttttgatacagttcggaacaatggtcgtcgaccgcgccctgtatctgcgaaagacagttctcggaaaggttattttccaggtgatcctcgtgtttggcatccatttctggatgttcttcatcctgccaggcgttaccgaacgaaagttcagccaaaatttagtggcacaactgtggtacttcgtcaagtgtgtttatttcggccttagcgcctaccagatccggtgtggctacccgacccgggtcttgggaaatttcctcaccaaaagctacaactacgtgaacctctttctatttcaaggattcaggttagttcccttcctgaccgagctgcgagcagttatggactgggtttggacagacaccacactgtcgctctcctcctggatctgcgtcgaggatatttacgcccatattttcattctgaagtgctggagagaatcggaaaagagatatccacagccacgcggccagaaaaaaaaaaaggtggtgaagtatggcatggggggtatgatcatcgtcctcctcatttgcattgtgtggtttccactgctattcatgagtttaatcaaaagcgtcgccggcgtgatcaaccagcccctggacgtatcggtgactattacgctcggtggataccagccgattttcacaatgtcagcccagcaaagccagctgaaagttatggaccagcagtcatttaataaatttatccaggcttttagtcgagacactggggccatgcagttcttagaaaattatgaaaaggaggacatcactgtggcagagttggaggggaactcaaatagtttgtggacgatttcccctccgtcaaaacagaaaatgatccatgaattgctggatccaaacagctccttttctgtggtttttagttggagtatccaacgcaatctcagcctgggtgctaagagtgagatagctacagacaaacttagcttcccactaaagaacattacccggaaaaacatcgcaaaaatgattgccggaaactccacagaaagctctaagacccctgtcaccatcgaaaagatctacccttattatgtgaaagccccttccgacagtaactcaaagcctataaagcagttgctttctgaaaataactttatggatattacgatcattctgtccagggataatactaccaagtataattcagaatggtgggtactgaatctgaccggaaatcgtatctataacccgaatagtcaggcccttgaactagtcgtctttaatgataaagtgtctcctccctctctgggattcctggctggctacggcattatggggctctatgcatcggtggtcctcgttatcggtaagttcgttcgcgagttcttttctggaattagccactccattatgtttgaagagctgcccaatgtggaccgaatcttgaaactgtgcaccgacatttttcttgtgcgggagacaggggagctcgaactggaagaagatctgtacgccaaattgattttcctgtaccgctcccccgagaccatgatcaagtggacaagagagaaaaccaattag

SEQ ID NO: 199659 - DNA, 1692 bp, Artificial Sequence
  Description of Artificial Sequence: Synthetic coding sequence
atgagcgtggtgatctacaccatgctggtgctgatcttcatctacacataccagtttgaaaacttcccaggcctctggcaaaacatgacaggactcaagaaggagaaactggaggacctagggctcaaacagtttacagttgcagaattgtttactcgaatctttatcccaactagcttcttgttagtttgtatactgcacttgcattactttcatgatcgcttccttgagcttacagatttaaaatccatcccttctaaggaagataacaccatttactcgcatgcaaaggtgaatggacgcgtatacctaattattaactcaattaagaagaagttgcccatccatcagaacgagctcgctcacccagaggggagcctgcctgatttaaccatgatgcatctgaccgccagtctagaaaaaccagaggtcagaaaacttgccgaaccaggtgaagagaaactggagggctattcagagaaagcccagaaaggggatctggggaaggattcggaggaatccgaagaagatggcgaagaagaggaagaatcagaggaggaggaagaaaccagcgatttgaggaacaagtggcatctggtgatagataggctcacagtgctcttcctgaaattcctcgagtattttcataagcttcaggtgtttatgtggtggatcttagagctgcatatcattaagattgtcagcagctacattatctgggtgagtgtgaaggaagtcagtctatttaattacgtgtttttgatctcatgggctttcgccctgccatacgctaagcttcgccgcctggcatccagtgtgtgcaccgtgtggacatgcgtgataatcgtttgtaaaatgctgtaccagctgcagaccatcaaacctgaaaatttcagcgtgaactgcagtttaccaaatgagaatcagactaatatcccctttaacgaactgaataagagcttgctgtattctgcccccatcgaccccacagaatgggtcggcttgcgcaagagcagcccacttctagtctacctgaggaataacttgctgatgttggccattcttgcgtttgaggtcacaatctatcggcatcaagaatactatagaggccgaaacaatttgacagccccagttagcagaactatctttcacgacataactagattgcatctcgatgacgggttgatcaattgcgcaaagtacttcatcaattacttcttctacaaatttggtcttgaaacatgtttcttaatgtccgtgaatgtgattggacagcgtatggatttttatgctatgattcacgcctgctggttgattgcggtgctgtaccgacgaaggcggaaagcaattgctgagatctggccgaagtactgctgttttctcgcttgcattataacctttcagtattttatctgcattggtattccccccgccccctgtagggattacccatggaggttcaagggcgcgtcgtttaacgataatataatcaagtggctgtacttccctgatttcatcgtcagacctaaccctgtgtttctagtgtatgattttatgctgctcctttgtgcatctctacagagacagatctttgaggacgaaaacaaagctgcagttcgtattatggccggggacaatgtggaaatttgtatgaatctggacgccgcttccttcagccagcacaatccttag

SEQ ID NO: 199660 - DNA, 1941 bp, Artificial Sequence
  Description of Artificial Sequence: Synthetic coding sequence
atgaccgagagcggcatggcccgggaggagagcgacgacgagctgtctttaggacacgggaggagggattcctcggactctttaaaaagcatcaacctggccgcctccgtggagagtgtgcacgtgacattccctgaacagcaaactgctgtacggagaaaaagatcaggctcttcatctgagccttctcagcgttcatcattttcaagcaacagatctcagagaggcagcacaagcacaagaaacagctcccagaagggcagcagtgtactttccatcaagcagaagggaaaaagagaactgtacatggagaagctgcaggagcatcttattaaggctaaggctttcactattaaaaaaacgctggaaatatacgttccgatcaaacagttcttctataacctaatccatccggagtactccgctgtgacagatgtatacgtccttatgttccttgcggacacagtcgatttcataatcatcgttttcggcttctgggccttcggcaagcactcagctgcagcagatatcacctccagcctctcggaggaccaggtgcctgggccttttctagtgatggtcctgatccagttcggaacaatggtcgtggatcgcgccctgtatttgcgcaaaacagttctcgggaaagttattttccaggtgatattggtcttcggcatccatttctggatgttctttattctgccgggagtcacagaacggaagtttagtcagaacttggttgcacagctgtggtattttgtcaagtgcgtgtactttggcttgagtgcctatcagattaggtgcggctatcccactcgcgttttgggtaacttccttactaaatcctacaactacgtgaacctttttcttttccaggggttcagactggtcccatttctgacggaacttagggctgtaatggactgggtgtggactgacacgaccctaagtctcagctcatggatctgcgtggaggacatttatgcccatatttttattctgaaatgctggagagagtccgagaaacctatttttacaatgtccgctcagcaatctcagttgaaggtgatggatcagcaatcatttaacaaatttattcaggccttctcccgcgacactggcgccatgcagtttctggagaactatgagaaggaagatattacagtcgccgagttagagggcaattccaactccctgtggaccattagccccccatctaagcagaagatgatccacgagttattagatccaaactcttcatttagcgtggtttttagctggagcattcaacgcaatctctccttgggcgctaagtctgaaatcgccacagataaattatcttttccactgaagaacatcacaagaaaaaacatcgccaagatgatcgcgggtaattcaaccgagagcagcaagaccccggtgacaatcgagaagatatacccttattatgtcaaggctccaagtgactcgaactcaaagcctattaagcagttgctttcagaaaataactttatggatattactatcatactcagccgagacaacaccactaaatacaacagcgaatggtgggtattgaacttaaccgggaacaggatctacaacccgaacagccaagctctggaactggtggtgttcaatgataaggtgtcaccaccgtctcttggctttttggctggctatggcattatgggcttgtatgcatcagtggtgctggtaatcggcaagttcgtccgagagttcttttcaggcatcagccacagcatcatgttcgaagagctgccaaacgtcgaccgcatcctcaaactatgcacggatattttcttggtgagagaaacgggggagctggagttagaggaggacttatatgccaagctgattttcctttacagatcccctgaaacaatgatcaaatggactcgcgaaaagacaaactag

SEQ ID NO: 199661 - DNA, 2130 bp, Artificial Sequence
  Description of Artificial Sequence: Synthetic coding sequence
atgaccgagagcggcatggcccgggaggagagcgacgacgagctgagcctgggccatggcaggagagattcctctgattctttgaagagtattaatcttgccgcatccgtggagagcgtgcacgtgacctttcctgaacaacagactgccgtgaggaggaagcggagcggatctagctctgagcctagccaacgtagttcatttagctcaaatagaagtcagagggggagcacctcaactaggaattcttcccagaaagggtccagtgttctgtccatcaaacagaaaggcaagcgtgagctctacatggagaagctccaggagcatttgattaaagccaaggctttcactattaagaaaaccctggagatctacgtgcctatcaaacagttcttctacaatttgattcatcccgagtattcagccgttaccgacgtctatgtgcttatgtttcttgcggacactgtggatttcataattatcgtattcggcttctgggcttttggaaaacacagtgctgccgcggatatcacatccagcctcagcgaggatcaggtgccaggccctttcctggtgatggtgctgatccaatttggcactatggtggttgaccgcgccctgtacctccgtaaaactgtgctgggaaaggtcatctttcaagtcatcctggtctttggcatacacttctggatgtttttcatcctccccggcgtgacggagcgcaagtttagtcagaacttggttgcgcagttgtggtactttgtaaagtgcgtctatttcggcctgtcggcctatcagatccgctgcgggtaccccactcgcgtgctcggtaatttcctgactaagtcgtacaattatgttaatcttttcctgttccaaggtttcaggctcgtgcccttcctaacagaacttcgcgcagttatggattgggtttggacggatactacactttcactgtcaagttggatctgcgttgaagacatatatgcccatatttttattctaaagtgttggagagaatctgagaaacgatatccccagccacgcggccagaaaaagaagaaggtggtgaaatacggaatgggggggatgataattgtgctacttatctgcatagtctggtttccactcctgttcatgtctttaatcaaatctgtggctggcgtcatcaaccagccactggacgtgagtgtgacaatcactctggggggctatcaacctatcttcaccatgtccgcccagcagtcccagctgaaggtcatggaccagcaaagcttcaataaatttatccaggctttcagtagggatacgggggctatgcagtttcttgaaaactacgaaaaggaggatattaccgtggccgaactagaaggcaactctaacagtctctggacaatctctccacctagtaagcagaagatgattcacgagctcctggatccaaatagcagtttttccgtagttttcagttggtccatccagagaaacctctccctgggcgcgaaatccgagattgctaccgacaaactctccttccccctaaagaatataacccgcaagaacatcgccaaaatgattgccggcaattctaccgagagctcaaaaactccagtcactattgaaaagatctatccttattatgtaaaggccccctctgattctaactccaagcctatcaagcagctgctgagcgagaataacttcatggacatcaccattattttgagccgggataacaccacaaagtacaattctgagtggtgggtcctgaacctcactggaaaccgcatttataaccccaattctcaggcccttgagcttgtggtgttcaatgataaggtgtccccaccttcgctaggatttctggccggctacggaattatgggcctatacgccagtgtcgtcctcgtaataggcaagtttgtgagagaattcttttctggaatcagccattcaattatgtttgaagagctgccgaatgtcgacagaattcttaaactgtgcactgacatattcctggtgcgcgagactggggagttagagttagaagaggatctgtatgccaaattaattttcctgtatcgttcccccgagacgatgatcaagtggacccgcgagaagactaattag

SEQ ID NO: 199662 - DNA, 2565 bp, Artificial Sequence
  Description of Artificial Sequence: Synthetic coding sequence
atggccctgcggctggtggccgacttcgacctgggcaaggacgtgctgccgtggcttagagcccagcgtgccgtaagcgaggcctcgggcgcaggaagtggcggggccgatgtattagagaacgattatgaaagcctgcacgtcctaaacgtggagagaaacggaaacattatatacacttacaaggacgacaaggggaacgtggtgttcgggctctatgactgccagaccagacaaaacgagctgctctatacttttgagaaagacctccaggtcttctcttgttcagtgaattctgagcgcactctgcttgccgcatctctcgtacagtcaacgaaagaaggaaagagaaatgagttgcagccgggctctaagtgcctcacactgttagtagaaattcacccagtcaacaacgttaaggtcctgaaggcagtggactcctatatttgggttcaatttctttaccctcatatcgaaagtcaccccctgccagaaaatcatctcctcctcatctctgaggagaaatatatcgagcagtttaggattcatgtagcccaggaagatggcaaccgtgtcgtaattaagaattccggccacctgccccgcgatcggatcgctgaagatttcgtatgggcccagtgggatatgagtgagcagcgcctttactacattgatctgaagaaaagccgttctattttaaagtgcatccaattttatgccgacgagtcttataatctgatgtttgaagtacccttggacatcagtctatcgaacagcggcttcaagctggttaacttcggctgcgactaccatcagtatcgcgacaaattttcaaaacacctcaccttatgtgtgttcactaaccatacaggttccctgtgcgtgtgttacagtccgaagtgtgccagttggggccagatcacctatagcgttttctacatccacaaggggcattctaagactttcacaacgtccttggagaacgtcgggtcacacatgacaaaaggcatcaccttcctgaatctggactactatgttgcagtatacctcccgggtcactttttccatttgctaaatgtccagcatccagacctgatttgtcataatcttttcctaacagggaacaacgaaatgatcgacatgctgcctcattgtcccctgcagtcgctgtctgggtcactagtgcttgactgttgctcaggcaagttatacagagccctactatctcaaagttccctcctgcagctcctccagaacacatgcctggattgcgaaaagatggcagccctccactgcgccttgtactgcggccagggagcacagttcctggaggcccagatcattcaatggataagtgagaacgtgtctgcttgtcactcgtttgaccttatccaagaatttataatcgcgagctcatattggtcggtgtatagcgagaccagcaatatggacaagctgctgccacacagcagtgtgctcacctggaatacggaaattcctggaatcacgctggtcactgaggatatagccctgccactgatgaaggttctctcttttaagggatattgggagaagctcaactctaatctggagtatgtcaagtatgcaaagccacattttcactacaataacagcgttgtgaggcgggagtggcacaatctcatctctgaggaaaagacaggaaagcgacggagcgccgcatatgttcgcaacatcttggataacgccgtgaaggtaataagcaatctcgaggcccggaatctcggtcctagactgacccccctgttgcaggaggaggattcccaccagcgtctcctgatgggattgatggtcagcgagctaaaagaccacttccttaggcacctgcagggcgtagaaaaaaagaaaatcgaacaaatggtgttagattacatttccaaactcttggacctaatatgccacattgtggaaacgaactggaggaagcataatctgcatagttgggtgcttcatttcaattcacgtggtagtgccgcggagtttgcagttttccacattatgactcggatcctcgaggcaactaacagcctttttctcccccttccccctggatttcacaccttacacacgatcttgggggtgcagtgtctgcccctgcataatctgctgcactgtatagatagtggagttcttttgctaacagaaactgccgtgattagactgatgaaggatctcgataacaccgaaaaaaatgagaagctcaagttctccatcatcgtgcgcttgccccccctcattggtcagaagatttgtaggctgtgggaccatccaatgagttccaatattatcagccgtaaccacgtgactcgccttctacagaactataaaaagcagcctcggaatagtatgattaataaaagttcattctccgttgagttcttaccattgaactacttcattgagatcctgaccgatatcgagtccagcaatcaggcactttacccgttcgagggacatgacaacgttgatgcagagttcgtggaggaggccgccttgaaacacactgctatgctgctgggactctag

SEQ ID NO: 199663 - DNA, 528 bp, Artificial Sequence
  Description of Artificial Sequence: Synthetic coding sequence
atgacccggatcctggaggccaccaacagcctgttcctgcccctgccgccagggtttcatacattgcatactatcctgggcgtgcagtgtctgccactacacaatcttcttcattgcatcgattcaggggtcttactcctcacagaaacggcagtaatcaggctgatgaaggacctggacaacaccgaaaagaacgagaagttaaagttcagcatcattgtccgtctgcctcctctgattggccagaagatctgtaggctttgggatcaccccatgagttctaatatcataagccggaatcatgtaactaggctgctccaaaattacaagaagcagccccgtaatagcatgatcaataaaagcagcttcagtgttgaatttttaccactgaactacttcatagaaattctgacagacatcgaatccagtaatcaggcactgtatcccttcgaaggccatgacaacgtcgatgccgaattcgtggaagaggcagccctgaaacataccgccatgctcctcggtctgtag

SEQ ID NO: 199664 - DNA, 873 bp, Artificial Sequence
  Description of Artificial Sequence: Synthetic coding sequence
atggccaaccccaagctgctgggcatgggcctgagcgaggccgaggcaatcggcgccgacagcgccaggttcgaggagctccttcttcaggcctctaaagagctgcagcaagctcagaccactcgaccagagtctactcagatacagccccagccggggttttgcattaagactaattcaagcgaaggcaaggttttcataaatatctgccactctcccagcatccccccacctgccgacgtcactgaggaggagctgctccagatgctcgaagaggaccaggctggcttccgcatcccgatgtcactgggggaaccccacgcagaattagatgcgaaggggcagggctgcacagcttacgatgtagcagtgaacagtgatttttatagacggatgcaaaattccgatttcctgagagagctcgtgatcactattgcgagagaaggactggaggataagtacaaccttcaactcaaccccgaatggaggatgatgaaaaacaggccgttcatgggatcaataagccagcaaaacatcagatctgagcagcgcccccgcatacaggaactgggcgatctctacacccctgcacccggtcgggcagaaagcgggccagagaagcctcatttaaacctgtggctggaggctccagatttgctgctggctgaggtagacctccccaagctggacggggcactgggactgagtcttgagattggcgagaatcgcctcgtaatgggcggcccacagcagctctaccacctcgatgcatatattcccctacagatcaactcacacgaatctaaagcggccttccaccgaaagaggaagcaattaatggtcgccatgcctctcctccctgtgcctagttag

SEQ ID NO: 199665 - DNA, 942 bp, Artificial Sequence
  Description of Artificial Sequence: Synthetic coding sequence
atgctgctgagcaagatcaacagcctggcccacctgcgggccgccccctgtaatgatctgcacgccacgaaacttgccccaggtaaggagaaggaacccctagaatcacagtatcaggtgggtcctctgctaggaagtggaggttttggtagtgtgtactccggaatccgggtgtccgacaacctcccagtggccatcaaacacgtcgagaaagaccgtattagcgactggggagaactgcccaacggtacccgcgtacccatggaagtcgtcctcttgaagaaggtgtcctctggtttcagtggggtgattaggctgctcgactggttcgagaggcctgactccttcgtgctgatcttagagaggcctgagcctgtgcaggacctgtttgatttcataactgagcgcggcgctctacaggaggagctggcccggtcatttttctggcaggttcttgaagctgtgcgccattgtcataactgtggagtcctgcatcgggatatcaaggatgaaaatattctcattgatctgaatagaggagaactgaagctcattgactttggtagtggggccttactgaaagacaccgtgtacacggacttcgacggcacgcgggtgtatagtccgccagagtggattagataccaccgctaccacggaagatcagccgctgtgtggtccttgggaattctgctgtatgatatggtgtgcggcgatattcccttcgagcacgatgaggagatcattagaggccaggtgttcttccgccagcgcgtgtctagtgaatgtcagcacctgatccgatggtgcctggcactccggccttctgacagacccaccttcgaggaaatccagaaccacccttggatgcaggacgtattacttcctcaagaaactgccgaaatccacttacacagcctctcaccagggcctagcaaatag

SEQ ID NO: 199666 - DNA, 936 bp, Artificial Sequence
  Description of Artificial Sequence: Synthetic coding sequence
atgctgaccaagcccctgcagggcccccccgccccccccggcaccccaactcctcctcccgggggtaaggatcgagaggcattcgaggccgagtatcggcttggtccattgctgggcaagggaggcttcgggactgtgttcgcaggtcacaggttaaccgacagactgcaggtagcgatcaaagtgattccgcgcaatcgagtgctcggttggtcaccgttgtctgattcggtgacctgccccttggaagttgcactgctttggaaggtaggcgccggcggtggacatcccggtgttattcgactcctggactggttcgaaactcaagagggcttcatgctggtcctggaacgccctttacctgcacaagatctgtttgattacatcactgaaaaaggtcccttaggcgaaggcccatcaaggtgcttctttggacaggtagttgctgccattcagcactgtcacagtcggggcgtcgtccacagggacataaaggatgaaaatatcctcatcgacctgcgtagggggtgcgctaagttgattgacttcggaagcggcgcactccttcacgacgagccttataccgattttgacggcactcgcgtctacagcccgcccgaatggatttcacgccaccagtaccatgccctgccggccactgtgtggtcccttggaattctgttgtacgacatggtttgcggcgacatcccatttgagagagaccaggagatcctcgaggccgaattacatttccctgcccatgttagcccggactgctgtgctctcattaggcgttgcctcgcccccaaaccatccagtcgaccttcactcgaggagatcctgttggacccctggatgcagaccccagcagaggatgtgcctctcaaccccagtaaaggtggacccgccccactggcttggtcccttcttccttag

SEQ ID NO: 199667 - DNA, 438 bp, Artificial Sequence
  Description of Artificial Sequence: Synthetic coding sequence
atgctggtgctggagcggcccctgcccgcccaggacctgttcgactatattacggagaagggccccctcggagagggcccctcaagatgcttcttcggtcaggtcgtcgcggccatccagcattgccattcacgaggagtggtgcacagggatattaaggacgagaacatcctgatagacttgcgtcgtggctgcgccaagctcatcgacttcggctcaggcgccctgctccacgatgaaccctacactgatttcgacggcacgcgtgtatactctccccctgagtggatcagtcggcaccaatatcacgcactgcccgccacagtgtggtcgctgggtattctgctctacgatatggtgtgtggagatattccttttgagagggaccaggagatccttgaagcggagttgcatttcccggcccacgtgagtccttag

SEQ ID NO: 199668 - DNA, 2925 bp, Artificial Sequence
  Description of Artificial Sequence: Synthetic coding sequence
atggccaaggccggccgggccggcggccccccccccggcggcggcgccccctggcacctgagaaacgtgttgtccgattcagttgaaagttcggatgatgaatttttcgacgcccgtgaagaaatggccgaaggtaagaacgctatcctaattggaatgagccagtggaacagcaatgatttggttgagcagatcgagacaatgggcaagctggacgaacaccaaggcgaaggcaccgcaccctgtacatcctccattctccaggagaaacagcgagagttatatcgggtgtctctacgtcgacagcggtttccagctcaggggtctatcgagatccacgaggactcggaggaaggctgcccccagcggagctgcaagacccatgtgttgctgctggtgttacatggcggtaatattctggataccggggccggagacccttcctgcaaagccgccgatattcataccttctcgagcgtcctcgagaaggtaacccgtgctcattttccggccgctctgggacacatactcatcaagttcgttccctgccctgcaatatgctccgaagcattcagcttggtgagccatttgaatccttacagccacgacgaaggctgtctttcatcttcgcaggaccacgtcccactggcggcgctacccttactggcgatttcttctccccagtaccaagacgccgtcgccacagtgattgagcgggcaaatcaggtgtatcgcgagtttttgaagagctcagacgggattggcttttcaggtcaagtttgtctgattggcgattgcgttggcggacttctggcttttgatgccatttgttatagcgccggcccgagcggggatagtcctgcatcaagtagccgcaaagggtccatctcttccacccaggatactcccgttgctgtggaagaggattgttcactggctagcagcaagcgtctgtccaaatcaaacatcgacatatcctcaggccttgaggacgaagaaccgaagaggcctttaccccgaaaacagtcagatagctccacctatgactgcgaggccatcacccagcatcacgcttttctgtccagcattcacagtagcgttctgaaggatgaatcagagacacctgccgctggaggcccgcagttgcctgaggtcagccttgggagatttgacttcgatgtttcggacttcttcctgtttggcagccccttgggactggtgttagccatgcggcgaaccgtgctgccgggcctagacggcttccaggtgcggcccgcgtgcagccaggtgtatagcttttttcattgcgcagatccctccgcttcccggttagaacccttgttggagcccaagttccacctggtgcctcctgtgtcagtcccccggtaccaaaggtttcccctcggcgacgggcagagcttgctcttagccgacgccctccatacacactctcccctttttctggaggggtcttcccgggattcccccccgctgctggatgcccccgcttctccgccacaggcttcacgttttcaaaggccaggccggcgcatgtcagaggggagtagtcattcggagtccagtgagagttccgacagcatggcacctgtcggagcctctcggattactgccaagtggtggggatcgaagaggattgactatgcgctgtattgccctgatgtcctgaccgccttccccaccgtggcccttccccaccttttccacgcttcctattgggaatccacagatgtggtcgcctttattctgagacaggtgatgcgctatgaatccgtaaatatcaaggaatctgcacgactagaccccgctgctttatctccagctaaccccagagagaagtggctgcggaagagaacgcaggtaaagctgagaaatgttaccgcaaaccacagggctaatgatgtcatcgcggctgaggatgggccacaggtgctggttggccgatttatgtacggacctctggacatggtggcactaacgggggagaaggtggatatactggttatggccgagccaagctcaggtcggtgggtgcacctcgacacagagatcacaaattcaagcggcaggataacatacaatgtgccccgccctaggcggctaggagtgggcgtttacccagtcaagatggtggtccggggtgaccagacctgcgcaatgagctatctgaccgttctgcctagagggatggagtgtgtcgtcttctcaatagacgggtctttcgcggcttccgttagcattatgggatctgatccaaaggtccgacctggagctgtcgacgtcgtgaggcattggcaggatctgggctatatgatcctgtacattactggccggcccgatatgcaaaagcagcgcgtggtgtcttggctgagccagcataacttcccacaggggatgatattttttagcgatggcctggtacacgaccccttgcggcaaaaggccatcttcctgaggaacttgatgcaagagtgcttcattaaaatttcagcggcatatggttctacaaaggacatcagtgtgtattctgtgttgggcctgcctgcgtcccagatatttatcgtgggccgaccgaccaaaaaatatcagacacaatgtcaatttttaagtgaggggtacgcagcgcatctggccgcccttgaagcatcacacaggtcacggcctaagaaaaataattccagaatgatcttacgtaaggggtcttttgggttgcacgctcagcccgagtttctgcgcaagcggaatcatctaaggagaactatgtccgtgcagcaaccagacccaccagctgctaaccctaaaccggaaagagcacagagccagcccgaatccgataaggaccacgagcggcctctgcccgcattatcatgggccagggggccaccaaagtttgagtcagtaccttag

SEQ ID NO: 199669 - DNA, 2817 bp, Artificial Sequence
  Description of Artificial Sequence: Synthetic coding sequence
atggccaaggccggccgggccggcggccccccccccggcggcggcgcaccatggcacctccgaaacgttctctcagactccgtggagtcaagtgacgacgaatttttcgatgcacgtggagagggtactgctccttgtacatccagtatcttgcaggagaagcagcgggagttgtatagagtgagtttgaggcgtcaacgatttcctgcccagggaagcattgagattcacgaggacagcgaggaagggtgtcctcagcggagttgcaagacccacgtgctgctgctggtgctgcatggtgggaacattctggatacaggagccggtgatccttcctgtaaggcagccgacattcatacgtttagcagtgtcttagagaaggtgacccgggcacactttcccgccgccctggggcacatcctgatcaaatttgttccctgtccggcgatctgttctgaagcctttagtctcgtctcacatctcaatccttacagccacgacgaaggctgtcttagctcttcacaggaccacgtgccattagcggcgctgcctctgctggcaattagttcacctcagtaccaggacgccgtggctaccgtgattgaacgggccaaccaggtgtatcgagaatttttaaaaagcagtgacggaatcgggtttagtggccaggtctgcctcataggggactgtgtggggggcttgctggcattcgatgcgatctgctattctgcagggccttcgggcgactcaccagccagttcttccaggaagggctctataagcagcacacaagatactccagtggctgtggaggaagactgcagtctggcgagctcgaaaagactgtcaaagagtaatatcgacatctccagcggcctggaagatgaggagccgaagaggccactgccgcgtaagcagtccgattccagtacatacgattgtgaagccattacccagcaccacgcctttctctccagtatccacagttctgttttgaaagacgaaagcgaaacacctgcagccgggggcccacagctgcctgaagttagcctgggccgctttgactttgacgtctctgacttttttctatttggctccccgcttgggctcgtccttgcgatgagaaggaccgtgctcccggggctcgatggctttcaagtgcgccccgcctgttcccaagtttactccttcttccattgcgcagatccctcggcctccagacttgaaccgctgctagagcctaagtttcacctagttccacctgtgtcggtgcctaggtatcagcgctttccactcggtgacggacaatcacttctgttggccgacgccttgcatactcactctcccctgttcctggagggcagcagcagggactcgccgccgcttctcgatgccccagcctcccccccacaggcctcacgatttcagcgccctgggaggagaatgtctgagggttcttcacactcagagtcatcggaatcaagcgacagcatggcccctgtgggggccagtcgtattacagcaaagtggtgggggtctaagaggatcgattacgccctgtattgtcccgacgtgctgaccgcatttccaaccgttgcactgccccacctgttccacgcctcatactgggagagtaccgatgttgttgcctttatcttgcgacaggtcatgaggtacgaaagtgtcaacattaaagagtctgcaaggctcgaccccgcggcactcagcccagcaaatccacgagagaagtggttaaggaagcgaacgcaggtgaaacttaggaacgtaactgcgaatcatagggccaatgacgtgatagctgccgaagatggacctcaggtgctggtggggagattcatgtatggtcctttagatatggtggctctcactggcgagaaggtggatatccttgttatggctgagccttcctctggcagatgggtgcatcttgatacagagatcacaaacagttccggcaggatcacatataacgttcccagaccgcgacggctaggagtgggggtgtatccggtgaagatggtggtgcgaggtgaccaaacctgcgcgatgagttatctgactgtcctccccagggggatggaatgcgtggtattttctatcgacggatcttttgctgctagcgtaagcatcatgggctccgaccctaaggtgcgccccggcgccgtagatgttgtgcgtcactggcaggacttggggtacatgatcctttatattactggaagacccgacatgcagaagcagagagtggtgtcatggctaagccaacacaattttccccagggcatgatcttctttagcgatggtctggttcacgatcccctgagacaaaaggcaatcttcctccgtaatctcatgcaggagtgcttcatcaagatctccgccgcttacgggtccacaaaagatatcagtgtctatagtgtactcggactgcctgcttcccagatttttatcgtagggcgccctacaaagaagtaccagactcagtgtcaattcctgtccgaaggctacgccgcgcacctggcagcactggaagccagccataggagcaggccaaagaagaataattccaggatgatcctcagaaaaggatcctttggcctgcatgcacagcctgaattcctcagaaagaggaatcacctcaggcgcacaatgtctgtgcagcaaccagaccctcccgcggctaatccaaaacccgagcgggctcagagccagcctgaaagtgataaagaccacgagaggcccttacctgcccttagctgggccaggggacctcctaaattcgagagcgtaccttag

SEQ ID NO: 199670 - DNA, 609 bp, Artificial Sequence
  Description of Artificial Sequence: Synthetic coding sequence
atggccaccctgatctacgtggacaaggagaacggcgagcccggcacacgggtagtggccaaagatggactgaagttgggaagcggcccctctatcaaggcactcgatggccgctctcaggtgagcacacctagattcggcaagacttttgacgcaccaccagctctgccgaaggcaacacgcaaagccttgggtaccgtgaaccgagccaccgagaagtccgtgaagacgaaaggccctctgaagcagaaacagccgtcattcagtgccaaaaagatgaccgagaagacagtgaaggctaagtcctcagttcccgcttccgacgacgcgtaccctgaaatcgagaagttcttcccatttaatcctctggatttcgagagctttgatctcccagaggagcaccaaatcgctcacctacccctcagtggcgtgccccttatgattctggatgaggaacgggagctggaaaagctgtttcaactcggacctccatctccagtcaagatgccaagcccgccatgggagtctaacctgttacaatctccctcttctatcctatctaccctggacgtcgagttacctcccgtctgttgcgacattgatatctag

SEQ ID NO: 199671 - DNA, 609 bp, Artificial Sequence
  Description of Artificial Sequence: Synthetic coding sequence
atggccaccctgatctacgtggacaaggagaacggcgagcccggcacacgggtagtagccaaggatgggctgaaactcggctcaggaccatctattaaagctctagatggcaggagccaggtgtccacccccaggtttggtaagacattcgatgcccctcccgcacttcccaaggctacgagaaaggcactgggcacagtgaaccgggccacagagaaaagcgtgaagacgaagggaccgctgaaacagaagcagccatccttcagcgcgaagaagatgaccgagaagacagtgaaagcaaaaagttccgtgcctgcttccgacgatgcttatcctgagatcgaaaaattcttcccgttcaatccgctggactttgagagttttgatctgccagaagagcaccagatcgcccacctaccacttagcggagtgcctctgatgatcctggacgaggagcgggagctggaaaagcttttccaactgggcccacctagccccgtgaagatgcctagccccccatgggaatccaatctgctgcagtcaccaagttccattctgagtactctcgatgtggagttaccgcctgtctgttgtgatatcgatatttag

SEQ ID NO: 199672 - DNA, 609 bp, Artificial Sequence
  Description of Artificial Sequence: Synthetic coding sequence
atggccaccctgatctacgtggacaaggagaacggcgagcccggcacacgcgtggtcgcgaaagatgggctgaagctgggaagtggccctagtattaaagctcttgatggaaggagccaggtctccaccccaaggtttggcaaaactttcgacgccccccccgccctccctaaggcaactcgcaaggctttaggcacagtcaacagggcgaccgaaaagtctgtgaagacaaagggtcccctgaagcagaagcagccaagttttagtgccaagaagatgaccgaaaaaactgtgaaagctaaaagctctgtgcctgccagtgacgatgcataccctgagattgaaaagttctttcccttcaaccctctggattttgaaagtttcgacttacccgaagaacatcagatcgcgcacctcccactaagtggggtgccactcatgattttggatgaagagagagagctagagaaactcttccagttagggccaccctctccagtgaagatgccaagccctccatgggagagcaacttattacaaagtcctagctccattttatcaacgctggatgtggagttgccacctgtgtgctgcgatatagacatatag

SEQ ID NO: 199673 - DNA, 543 bp, Artificial Sequence
  Description of Artificial Sequence: Synthetic coding sequence
atggcccccggcgtggcccggggccccaccccctactggcggctgcgattaggaggcgcagccctgctactgttactcatccctgtggccgccgctcaggagcctcccggagcagcatgctctcagaacaccaacaaaacttgcgaagaatgcctgaagaacgtttcatgtttatggtgcaacactaataaggcgtgcctcgattaccccgtcacctccgtcctccccccagcctcgctatgcaaattaagttctgctaggtggggcgtgtgttgggtaaatttcgaggcactgatcatcaccatgagcgttgtcggcggcacattgttgttggggattgccatctgttgttgctgctgctgcagaaggaaaagaagccgaaagccagaccgctcagaagaaaaggctatgagggagagggaagaaagaaggattcggcaggaagaaagacgggcggagatgaaaacgagacacgatgagatcagaaagaagtacgggctgttcaaggaggaaaatccttacgctcggttcgaaaacaactag

SEQ ID NO: 199674 - DNA, 429 bp, Artificial Sequence
  Description of Artificial Sequence: Synthetic coding sequence
atggcccccggcgtggcccggggccccaccccctactggcggctgaggctggggggggctgcgcttctcttactgctgatacctgtggctgccgcacaggagccccctggcgccgcatgttctcaaaacaccaacaagacctgcgaggaatgcttgaaaaatgtgtccgcatgtctaaagaaaaagactcggatgctggatcttaagactacgaaggctctccaacatatatctcctgatgcatcctgcgaagtgcatgccccccagccatccccagctggccggccacgggggcactgtggactgctgacccttgccagcgaacctgcctcactcccaggccaagcagccggcgaactccctttgaaggacagccccctcgtccttcagacaggcgatttactgtttcccgtgcacctgtgcttttag

SEQ ID NO: 199675 - DNA, 576 bp, Artificial Sequence
  Description of Artificial Sequence: Synthetic coding sequence
atggccaccctgatctacgtggacaaggagatcggcgagcccggcacacgggttgccgctaaggacgtgctgaagcttgaatcccggcccagcattaaggctctagacggaatatcgcaggtgctgacgcgccgctttgggaagacatacgatgccccgtccgccctgcccaaggccactaggaaggccttagggactgttaaccgtgctaccgaaaagagtgttaaaacaaatgggcctaggaagcagaaacagccgtcattctcagcaaagaagatgaccgagaaaacagtcaaaaccaagtctagtgtgcccgctagcgacgatgcttaccctgagattgagaaattttttccctttaatctgctggactttgagtccttcgaccttcccgaagagcggcaaatagcacacctgccgttatcaggcgtgccacttatgatcctcgatgaagagggggagctggaaaaactgttccagcttggtcctcccagccctgtaaaaatgccctctccgccatgggaatgcaacctatttgcggtgtcgtttaagcatagcgtggatcctggttgttag

SEQ ID NO: 199676 - DNA, 2586 bp, Artificial Sequence
  Description of Artificial Sequence: Synthetic coding sequence
atgaccggccgggcccgggcccgggcccggggccgggcccggggccaggaaaccgcacagcttgtaggcagtacagcatctcaacagccaggctacatccagccgagaccacagccaccccccgcggagggtgagctctttggtcggggcaggcaacgtggcactgcaggaggaaccgccaaatctcagggactgcagataagcgctggttttcaggagctatctctagcagagcggggtgggagacggagagattttcacgacctgggggttaataccaggcaaaacctggaccacgtgaaagaatccaagaccggaagttctggcataatcgttcgcttgtctacaaatcactttagactgacctcgaggccccagtgggccctgtatcagtatcatattgattataatcccctgatggaggcacggcgactgcgaagcgccctgctgttccagcatgaggacctcattggcaaatgtcacgcttttgatggcactattctgttcttgcctaaaagactgcaacagaaggtcaccgaggtcttttccaagacccggaatggcgaagacgtgcgtatcaccattacactcactaatgaactgccgcccaccagcccgacttgcttgcagttctataatatcatcttccgcagactgctcaagattatgaacctacagcaaattggtcgcaattattacaaccctaatgaccctattgacataccatctcaccggttagtgatttggcccggcttcaccacaagcatcctacagtacgagaactccataatgctctgcactgacgtgagtcacaaggtgcttagatccgagaccgtgttagatttcatgtttaacttctaccatcaaaccgaggagcacaaattccaggagcaagtgagcaaggaacttattggccttgtcgttctgacaaagtacaacaataaaacttatagggtcgacgacatcgattgggatcagaaccctaagtctacattcaagaaagctgatggaagcgaggtaagttttctcgagtattaccggaagcagtacaatcaagaaatcaccgatctcaagcagcccgtgctggtgtcacaacccaagaggagaaggggccctggcggcaccctccccggacctgcaatgttaattcccgagctttgttacttgactggtctaacagataaaatgagaaacgatttcaatgttatgaaggatctggcagtgcatactaggctgaccccagagcagaggcagagggaagtgggccggctgatcgattacatccacaagaatgacaacgtgcagagagaactcagggattgggggctcagtttcgattccaacctgttatcattctctggaaggatcctgcagaccgaaaagatccaccagggaggaaagacgttcgactacaacccgcagttcgcagactggtccaaggagactaggggcgcccctctaatttctgtgaaacctctcgacaattggttgttgatctacacccggcggaactacgaggccgctaattccctgatccagaacctgtttaaagtaactcctgcgatggggatgcagatgcgaaaagcaattatgatcgaggtggacgaccggaccgaggcctacctgagggtcttacaacaaaaagttacggcggacacacagatagtggtgtgtctactctcttcaaacagaaaggacaagtacgacgctatcaagaaatacttgtgcacggactgtccaacacccagtcagtgcgttgtagcacggactctcggaaaacagcagaccgtcatggctatagcgaccaaaattgccctgcaaatgaactgcaaaatggggggagagttgtggcgtgtggatatccctctgaaactggttatgatagtgggaatcgactgttaccacgacatgactgcaggacggcgatccatcgcaggtttcgttgcttcaatcaatgaggggatgacccgttggtttagccggtgcatatttcaagaccggggccaggagttagtagatggactgaaggtttgcctgcaggcggcactccgggcctggaatagttgtaatgaatacatgccttcccgaattatcgtgtaccgggacggagtaggggacggccagttgaaaacactggtaaactatgaggtaccccagtttctcgattgtctcaagtcaatcgggcgaggatataatcctcgcttgaccgtgatagtggtgaagaaacgggtgaatacccgtttctttgctcaaagcggcggccgcttgcaaaacccactcccaggcaccgtcatcgatgtggaggtgaccaggcccgagtggtacgatttttttatagtgtctcaggcagttaggtccgggtctgtgagccctactcattataacgtcatctacgacaactctggcttgaaaccggaccacattcagcgattaacctataagctgtgtcacatatattacaactggcctggagtgattagagtacctgcaccatgtcagtatgctcacaaactcgcctttttggtagggcaaagtattcatcgcgaacccaacctgtcattaagtaataggttgtactacctgtag

SEQ ID NO: 199677 - DNA, 369 bp, Artificial Sequence
  Description of Artificial Sequence: Synthetic coding sequence
atgaccggccgggcccgggcccgggcccggggccgggcccggggccaggagaccgcgcagcttgtcgggagcacagcttcccagcagcccggctacattcagccaagaccccaacctccacctgcggaaggcgagctctttgggagaggcagacaacgcgggactgcaggaggtacagctaagagtcagggtctgcagatctctgcggggtttcaggagctgagcctggccgagagggggggacggcgacgggactttcacgatctgggagtgaacactaggcagaacttagaccacgtaaaggaaagcaaaacgggaagttccggcattatcgttcggttgtccaccaatcacttccgtttgacctag

SEQ ID NO: 199678 - DNA, 453 bp, Artificial Sequence
  Description of Artificial Sequence: Synthetic coding sequence
atgaccggccgggcccgggcccgggcccggggccgggcccggggccaggagacagctcagcttgtcggcagcaccgcatctcagcagcctggctatatccagcccagacctcagcctccaccggcagagggtgagctgtttggtcgtgggaggcagcgggggaccgcaggagggactgccaagagccaggggctccagatttctgctgggtttcaggaattatcgctggcggagcgtggaggccggagacgagactttcacgacctaggggtcaacactcgccagaatttggatcacgtgaaggagagcaagaccggctctagtggaatcatagtccgtctttctacaaatcacttccgtctgactagcaggccacagtgggcactgtatcagtaccatatcgactacaatccacttatggaggctcggcgcttgaggtccgccctcttatag

SEQ ID NO: 199679 - DNA, 519 bp, Artificial Sequence
  Description of Artificial Sequence: Synthetic coding sequence
atgaccggccgggcccgggcccgggcccggggccgggcccggggccaggagactgcccagcttgtcggaagcactgcttctcagcagcctggatatattcagcccagaccccagccaccaccagccgagggcgagttatttggacgggggcgccagcggggaactgctggcggaactgccaaaagccagggccttcagatctctgcgggctttcaggagttgtctttggcggaaagaggagggcggaggcgcgatttccacgacctgggcgtgaataccaggcagaatttggaccatgtgaaggagtcaaagacggggagcagcggcataattgtcaggctatcaacgaaccattttcgcttaaccagccggccccaatgggctctttaccagtatcacatcgattataatcccctgatggaagctcgtaggctccgctcagctctgctttttcaacacgaagatctgatcggcaaatgccacgccttcgacggtactatcctctttctccccaaatag

SEQ ID NO: 199680 - DNA, 498 bp, Artificial Sequence
  Description of Artificial Sequence: Synthetic coding sequence
atgaccggccgggcccgggcccgggcccggggccgggcccggggccaggaaaccgctcagctggtcggaagcactgccagccagcagcccggatatatccagccccgccctcagccccctcctgcagagggcgagctgtttgggcggggccgacagcgcggcactgcgggtgggaccgccaaaagccagggcctgcagatcagcgcaggctttcaggaactgtccctagccgaaagaggtggcaggcgaagagacttccatgacttgggagtgaatactcgccagaacctagatcatgtgaaggaatcaaagacgggtagtagcggcatcatagtgagactttccaccaaccattttagactcacaagtaggcctcagtgggctctgtaccaataccatatcgattacaatccactgatggaggcccgtagactgcgttcagccctgcttttccagcacgaggacttgataggcaagtgccatgccttcgatggatag

SEQ ID NO: 199681 - DNA, 2922 bp, Artificial Sequence
  Description of Artificial Sequence: Synthetic coding sequence
atggaccccttccggcccagcttccggggccagagccccatccacccctcccagtgtcaagcggtccggatgccaggctgctggccgcaggcctccaagcctttagaccccgccctcggtcgaggagcaccggctggcaggggacacgtgttcggcaaaccagaggaaccatcgacccagcggggcccagcgcagagggagtctgtgggactggtgagcatgttccgagggttgggcattgaaaccgtgtccaagactcccctcaaaagggagatgttgccgagcgggcgcggtattttaggcagaggtttgagcgctaacctcgtgagaaaagatcgagaagagcttagtcctactttctgggatcccaaagtcctggccgcaggcgacagcaaaatggctgagacaagcgtgggttggtcccgtacgctagggagaggatcttcagacgcatcgctactaccactaggacgtgcagcggggggcatttcaagagaagtggacaaacccccctgcacatttagtaccccatcccgaggacctcctcagctgtctagtccaccggctttgcctcagtcacctctccactctcccgaccggccccttgtcctgacggtggagcataaagagaaggaactgatcgtcaaacagggtagcaaggggactccccagagtctcggattaaatctcgtcaagatccagtgtcacaatgaagctgtgtatcaataccatgttaccttctctcctaacgtggagtgcaagtccatgcgtttcggtatgctgaaggatcaccaggccgtgaccggaaacgtgactgcctttgatggatcgatcctctatttacctgtgaagctccaacaagttttagagctgaaatcccagcgtaagaccgatagcgctgaaattagcatcaaaatccaaatgacaaaaatcctggaaccctgtagcgatctgtgtatccccttctataacgtagtattccggagggtaatgaagctgctcgatatgaaattggttggacgaaacttctacgatcctacatcagccatggtcctccagcagcatcgattgcagatctggccagggtatgctgctagcatcagaagaactgacggaggattgttcctcttggcagatgtgtcgcacaaggtgattaggaacgactgtgtcctggacgtcatgcatgcaatctatcaacaaaataaggagcacttccaggatgagtgtaccaagctgctagttggcaatatcgtgatcactcggtataataatcgaacttataggatcgatgacgtggattggaataaaacccctaaggacagttttaccatgtctgacgggaaggagattaccttcttggagtattatagcaaaaactatggcattacggtcaaggaggaggaccaaccattgctgatccatcgtccaagcgagcgtcaggacaaccacggaatgctgctgaagggagaaatcctgcttctccccgaactgtcattcatgaccggcattccggagaagatgaagaaggacttcagagcaatgaaggacctagcccaacagattaatctttcacctaagcaacaccatagcgccctcgaatgccttctccagcgcatcgcaaagaacgaggccgcaaccaatgaacttatgaggtggggactcagattgcagaaggatgttcacaaaattgagggaagggttcttcccatggagagaataaatctgaaaaacacctcttttattacctctcaagagctaaactgggtgaaggaagttacgagagacccatccattctgacaatcccgatgcacttctgggccctgttttatccaaaacgggcaatggaccaggcccgggaactggtcaacatgcttgagaaaattgcagggcccatcggcatgaggatgagcccccccgcttgggttgaattaaaagacgacagaatcgagacctatgttcgtaccattcagtccaccctgggagcagagggaaagattcagatggtcgtctgtattataatggggcctagggacgacctctatggagccatcaagaagctctgttgcgttcaatctcctgtgccatcccaggtcgtgaatgttcggactatcggacagcccacccgcctcagatcagtggctcaaaagatactactgcagatcaattgcaagttagggggagaattgtggggtgtggatatccccttgaaacaactcatggtaattggaatggacgtgtatcacgaccccagtagagggatgcgatctgtggtggggttcgtcgcatccataaatctgactcttactaagtggtatagccgggtggtttttcaaatgccacatcaggagattgtggattcattgaagttgtgtcttgtgggctcactgaagaaattctatgaggtcaatcactgcttacccgagaagattgtagtttacagagatggcgtaagcgatggtcagttaaaaaccgtggccaattatgagatcccgcagctccagaaatgctttgaagcttttgagaactatcaacccaaaatggtggttttcgtcgtgcagaaaaaaattagcaccaatctctatctcgctgcgccgcaaaatttcgttactccaaccccaggcacggtcgttgaccacacaatcaccagttgcgagtgggtggacttttatctgcttgcccaccatgttcgccagggctgtgggattccaacacattacgtgtgtgtgttgaacacagctaacttgtcccctgatcatatgcagcgcctcacgttcaagctgtgtcatatgtattggaactggcccggcactattcgcgtaccagccccttgtaagtacgcgcataagttagcctttctttccgggcacatcttgcatcatgaacccgcgatccagctgtgtgagaatctgttcttcctctag

SEQ ID NO: 199682 - DNA, 2922 bp, Artificial Sequence
  Description of Artificial Sequence: Synthetic coding sequence
atggaccccttccggcccagcttccggggccagagccccatccacccgtctcagtgtcaggccgtcagaatgccagggtgttggccccaggccagcaaacctctggatcccgccctcggacggggagcacccgcgggcaggggtcacgtcttcggcaaacccgaggaacctagtactcagaggggacctgcccagcgcgagtctgtgggtctggtgtcaatgtttcgaggcctgggcatcgagaccgtgagcaagacgcctctcaaaagggagatgctgccctccggcaggggaatcctggggcgtggccttagcgccaacctagtgcggaaagaccgggaggagctgtctcctaccttctgggaccctaaggttctcgccgccggcgacagcaagatggctgagacatcggtgggctggagtaggactcttggcaggggttcctcagacgccagtcttctccccctgggtagggcagctggcggcatcagccgagaggtcgataagcctccgtgtaccttttccactcccagtcgaggaccccctcaactttcaagcccacccgcgttgcctcagtcccccctccacagccccgaccgtccactcgtgctgaccgtcgagcacaaagagaaagagctgatcgtcaagcagggatctaaggggaccccacagtccctagggctgaatctggttaagatacagtgccacaacgaagcggtttaccagtatcatgtgacgttctctccgaatgtagaatgcaagagcatgcgtttcggaatgctgaaggatcaccaggccgtgactgggaatgtaacagcattcgatgggagtatcttgtatctacctgtgaaactgcagcaggtgcttgagttgaagtctcagcgtaaaaccgactccgctgaaatctcgatcaagatccagatgacgaagatcctggagccttgttctgatttatgtatccctttttacaatgttgtgttccgacgagttatgaaactcctggatatgaagctggtgggacgaaacttctatgatcctacatccgcaatggtgctacagcagcaccgactccagatttggccgggctacgctgcgtccatccgacgcaccgacggcgggctgtttctgctggctgacgtgagccataaagtcattagaaacgattgcgtattggacgtcatgcatgctatttaccagcaaaataaggagcacttccaggacgaatgcacgaagctgctggtgggcaatatcgttatcacaagatacaataatcgcacttataggatcgatgatgtcgattggaacaagactcctaaggatagctttactatgagtgacgggaaggagatcactttcttagagtactacagcaagaactacggtatcaccgttaaagaggaagatcagccgctgttaatacataggcccagcgagcgccaggataaccatggaatgctgcttaaaggcgaaatcctgcttttgcctgagctttcattcatgacaggaatacctgaaaagatgaaaaaggacttccgcgcgatgaaagacttggctcaacagattaacctatctccaaaacagcaccattcagctctggaatgtctcttacagagaattgccaaaaacgaggccgctactaatgaattgatgcggtgggggcttagactccagaaagatgtgcacaaaattgagggccgagtgctgccgatggagagaattaatttgaagaatactagtttcattacctctcaggagcttaactgggtgaaggaggtgacccgggacccttcgatcctgaccattcccatgcatttctgggcgttattttatccaaagagggccatggatcaggcccgggaactcgtgaatatgctggaaaagatcgccgggcctataggcatgagaatgagcccccctgcatgggtggagctgaaggatgatcgtattgagacgtatgtccgaacaattcaatctaccctgggcgccgaggggaagattcaaatggtggtttgtatcattatgggccccagggatgacctttacggggccatcaagaaactctgctgtgtgcaatcccccgtgccgagccaggtcgtcaatgtccgtaccattggtcagccaacacggctaaggtccgtcgcacagaaaattctgctgcagattaactgcaaactggggggtgagctttggggggtcgatatacccctgaaacagctcatggtgatcgggatggatgtataccacgacccttctagaggtatgcgcagtgtggtcggcttcgtagcttcaattaacttgaccttaacaaaatggtacagcagggtcgttttccaaatgccccatcaggaaattgttgattccctgaagctgtgtctggtcggctccttgaaaaaattttacgaagtcaatcactgcctgcccgaaaagattgtggtttatcgtgacggggtgtctgacggacaactgaagaccgtagcaaactatgaaattccccagctgcagaagtgcttcgaagcctttgagaattaccagccaaagatggttgtgttcgtggtacagaaaaaaatttctactaacttgtacctggcggcaccacagaacttcgtgactcctactcctgggactgtggtggaccacaccattacaagctgcgagtgggtagatttctatcttctcgcacatcacgtaaggcagggatgcgggatacccacacactacgtctgtgtgctcaatactgcgaacctgtcacctgaccatatgcagagactgacctttaaattgtgccacatgtactggaactggccaggaaccattcgggttccggcgccctgtaaatacgcacacaagctggcttttctgagcggacacatcctgcatcatgagcctgccatacagctgtgtgagaatctgtttttcctgtag

SEQ ID NO: 199683 - DNA, 639 bp, Artificial Sequence
  Description of Artificial Sequence: Synthetic coding sequence
atgaaggtgttcaagttcatcggcctgatgatcctgctgaccagcgcattcagcgctggcagcgggcagagccccatgaccgtgttgtgttcaatcgactggtttatggttactgtgcatccgttcatgctgaacaatgacgtgtgcgtccacttccatgagctccaccttggcctgggttgccctcccaaccacgtgcagccgcatgcttatcagtttacgtaccgcgtgaccgagtgcggtatacgcgcaaaggcagtgtcacaggacatggtcatttactcaacagagatacattattcaagcaagggaacccccagtaagtttgtcattcctgtgtcgtgcgccgccccacagaagagtccatggcttaccaagccgtgctccatgcgagttgcgtccaaatcacgcgctaccgctcagaaagatgaaaagtgctacgaagtcttttcgctgtcccagtctagtcagcggcctaattgcgactgccctccttgcgtgttcagcgaggaagagcatacccaagtaccgtgtcatcaggcaggagcccaggaagcacaaccactgcagccttcacattttctcgatatttccgaggactggtccctgcacactgatgacatgatcgggagcatgtag

SEQ ID NO: 199684 - DNA, 294 bp, Artificial Sequence
  Description of Artificial Sequence: Synthetic coding sequence
atgcggcccctgctgtgcgccctgaccggcctggccctgctgcgggcggctgggagtctggccgcagcagagcccttctctcctccgaggggcgatagtgctcagtctaccgcctgcgacaggcatatggctgtccagaggcgcttggatgtcatggaagagatggtggagaaaactgtagatcacttgggaacggaggtcaagggcttgttgggactgctagaggagttagcttggaacttgcctcctgggcccttctccccggctccagacctgcttggcgacggcttctag

SEQ ID NO: 199685 - DNA, 264 bp, Artificial Sequence
  Description of Artificial Sequence: Synthetic coding sequence
atgcggcccctgctgtgcgccctgaccggcctggccctgctgcgggcggccggatcgttagctgccgctgaacccttttctcctccccgcggagacagtgctcaatccaccgcgtgtgacaggcacatggcagttcagagaaggctcgacgtcatggaggaaatggcctccgagccttggtcctggagcccagctgtcggcgggggcgctcccgctcgacagagaccacagaaccagccatgtccccttgactttttgccctag

SEQ ID NO: 199686 - DNA, 168 bp, Artificial Sequence
  Description of Artificial Sequence: Synthetic coding sequence
atggccgtgcagcggcggctggacgtgatggaggagatggtggagaagacggttgatcatctgggaacagaggtgaagggcctgctgggcctactggaagaactagcttggaatctgcctccaggacccttcagccctgcgccagacctgctcggggacggtttctag

SEQ ID NO: 199687 - DNA, 2244 bp, Artificial Sequence
  Description of Artificial Sequence: Synthetic coding sequence
atgaaccacagccccctgaagaccgccctggcctacgagtgcttccaggatcaggacaattccacccttgcactcccaagtgaccagaagatgaagaccggtacttccggccgccagagagtgcaggaacaagttatgatgaccgtcaaaagacagaagtccaagtccagtcagagctctactctgtctcattctaaccgcgggtccatgtatgacgggttggcagataattataactacggtacaacaagccggagctcttactattcgaagttccaggcaggcaacggaagctggggctaccctatatataacgggactctgaagagagagccagacaacagaaggttctcctcctatagtcagatggagaactggtccagacactaccctagagggagctgtaataccactggagcggggtccgacatttgttttatgcaaaaaatcaaggcgagtaggtccgaacccgatctgtattgtgacccacgcggaactctacggaaggggactcttggcagcaaaggtcagaagaccacgcaaaatcggtactctttttactccacatgcagcggtcaaaaagcaattaaaaagtgccctgtgagacccccctcttgtgcctcaaagcaggatcctgtgtacattcctccaatttcctgcaacaaggatctctctttcggtcactctcgagcctcttctaaaatctgcagcgaggacatagagtgctctggcttaaccatccctaaggccgtgcagtatttatcatctcaggacgagaagtatcaggccataggcgcatactacatccagcatacgtgctttcaggatgagtctgccaaacaacaggtgtatcagctcggcggaatctgtaagctagtggacctattaaggagcccaaaccaaaatgtacagcaggcggcagctggcgccttgcggaacctggtgttccgcagcacgactaacaagctcgagacccgtcgtcagaacgggatacgggaggccgtcagtctcttgcggcgtacgggcaatgcagaaatccagaaacagctgacaggcttgctgtggaatctatcaagcactgatgaactcaaggaggaacttatcgccgatgcccttcccgttttggcagaccgggtcataattcccttttcaggctggtgcgacggcaactctaacatgagccgggaggtggtcgacccagaggttttcttcaacgccaccggctgcctgaggaaaaggctggggatgcgagagcttcttgccttagttcctcaacgggccacatcatcccgagtcaacctctcgagtgccgatgcaggcaggcagacaatgcggaactattctggccttatcgactctctcatggcctacgttcagaattgcgttgccgcaagtcgatgcgatgataagtcggtcgagaactgcatgtgcgtcttacacaacttgagctatcggctggacgccgaagttccgacacgctacagacaacttgagtacaacgctaggaatgcctacaccgagaagagctctacgggatgcttttctaacaaatccgataagatgatgaacaataactatgattgccctcttcccgaagaagaaaccaatcccaagggctcaggatggctttaccatagcgatgctataaggacttacctcaacctgatgggcaaatctaagaaggacgccacacttgaagcatgtgcgggtgcattacagaatctgaccgccagtaaagggttaatgagcagcgggatgagccagctcattggactgaaagaaaaaggcctgccccagatcgcgagactgctccagagcggaaactctgacgtcgtccgcagtggggccagcttgctttcaaacatgtccagacatcctctattacaccgagtgatgggtaaccaggtctttcccgaggtgacgaggctactcacaagccatacggggaatactagcaactcagaggacatcctcagctcagcctgttacaccgtcagaaaccttatggcaagccagccacaactcgccaagcagtacttcagtagctccatgctgaataatattattaacctctgccggagcagcgcgtcgcctaaggccgctgaggcagccaggcttttactgtctgacatgtggtcctccaaagaactgcagggtgtcctgaggcagcagggtttcgatcgcaacatgctgggcaccttagcaggcgccaactctctccgtaactttacatcacgcttctag

SEQ ID NO: 199688 - DNA, 2244 bp, Artificial Sequence
  Description of Artificial Sequence: Synthetic coding sequence
atgaaccacagccccctgaagaccgccctggcctacgagtgcttccaggaccaagacaatagcaccctggcactcccctccgaccagaagatgaagaccgggacttcgggacggcagcgcgtgcaggagcaagttatgatgactgtgaaacgccaaaaatctaaaagtagccaatctagcacattgagtcacagtaataggggtagcatgtacgatggactcgctgacaattacaactatggtacgaccagcaggtccagttactatagcaagttccaggccgggaacgggagctggggctatcccatatataacggaacccttaagcgagagcccgataacagacgattttcatcttattcgcagatggaaaactggtcaagacattaccccaggggttcttgcaacaccactggggcgggttccgatatatgcttcatgcagaaaatcaaagcctcaagatcggaacctgacctctattgtgatcctagaggtacactgaggaaagggacgcttggctctaaaggacagaaaactacacaaaacaggtattcattctactcaacttgcagcggacagaaagcaataaaaaagtgccccgtaaggccaccgtcttgtgcatcaaaacaggatcctgtgtatatcccaccaatctcctgcaataaggatctttcatttggccactctcgtgcaagctctaagatctgttcagaggatatcgagtgtagcggactgacaatcccaaaagcagttcagtatctttcctcccaggacgagaagtaccaggccatcggagcctactatatacagcatacctgcttccaggacgagagcgctaagcaacaggtctaccagctggggggaatctgtaagctggttgatctccttagatccccaaatcaaaatgtgcagcaagccgcagccggggctcttcgtaatctagtcttccggtctactactaacaaattggagacccgaaggcagaacggtatccgggaggccgttagtctgctccggcgcaccggaaatgccgaaattcagaagcagctcactgggctgctttggaacttgagctctactgacgagttgaaggaggaactcattgcagatgctctgccggttcttgccgacagagttattatcccttttagcgggtggtgtgacggcaattctaacatgtctcgggaggtcgtcgatcccgaagtctttttcaatgcaacagggtgtctacgaaaaagattgggcatgagggagctcctggccctcgtccctcagagggcaacaagttcacgtgtgaatctgtcatctgcagacgctggccgccaaacaatgagaaattattccgggctaatcgactcactgatggcatatgtgcagaactgcgtggctgccagtaggtgtgacgataaatcagtcgagaattgcatgtgcgtgttacacaacttgtcttataggctggacgccgaggtgccaacgcgctatcgccagctggaatacaacgcccgaaacgcctataccgaaaagtcgtccacaggttgtttctctaacaaatcagacaagatgatgaataataattatgactgcccactgccagaagaggagaccaaccctaaaggcagcggctggttatatcacagcgatgcgatccggacatacctcaaccttatggggaagagcaagaaggacgccaccctcgaggcctgcgctggtgctcttcagaacctgacagcatctaaagggctcatgagttctggaatgtctcagttgatcggtctgaaggaaaaaggactgcctcaaattgcacgtttgttacagagtggaaactccgatgtcgtaagatctggagcctctctcctgagcaatatgagcaggcatcctcttcttcatcgggtcatgggaaaccaggtgttccccgaggtcactaggctcctgacctcacatacaggcaacacgtcgaattccgaagacattctgtcttctgcttgctatactgtgcggaacctcatggcatcacaaccccagctcgcaaaacaatatttcagcagttcaatgttgaataatattataaacttatgccggtccagcgcatcacccaaagctgctgaagctgctcgcctgcttcttagtgatatgtggtcatctaaggagttgcagggagtgctgcgccagcagggtttcgatagaaatatgctcggaacactggcaggggcaaattccctgcggaactttaccagtagattttag

SEQ ID NO: 199689 - DNA, 2181 bp, Artificial Sequence
  Description of Artificial Sequence: Synthetic coding sequence
atgaaccacagccccctgaagaccgccctggcctacgagtgcttccaggaccaggataactccactctggccttgccatccgaccaaaagatgaaaacaggcacttctggacgtcagagggtgcaggagcaagtgatgatgacggtgaagagacagaagagcaaaagcagccaatcctcaacacttagccattccaatagaggcagcatgtatgacggcctagcagacaattataattatggcactacgagtagatctagctactattcaaagttccaggctgggaatggctcttggggttaccctatttataacggcactctgaagagagagcccgataacagacgtttctcttcctatagccagatggaaaattggtcgcggcattatccgaggggcagctgcaatacaacaggggcagggagcgatatttgcttcatgcagaagattaaggcaagtcgtagtgagcctgacctatactgtgatcctagagggacattaagaaagggcacgctgggttctaagggacagaagacaacgcagaataggtatagtttctattccacttgtagtggacagaaggccatcaaaaaatgccccgtaaggcctcctagctgcgcttctaagcaagatccagtctatatcccacccatctcctgtaataaggacctttctttcgggcactcccgcgcgagctcaaagatatgcagtgaggacatcgaatgctctgggctgacaatccccaaagccgtacagtatctgagttcgcaggacgaaaagtaccaagccataggagcttattacattcagcacacgtgctttcaggacgaaagcgctaagcagcaagtataccagctcggcggcatctgtaaattagttgatctgctgcgctccccgaaccagaatgtgcaacaggccgcagcaggggccctacgcaacttagtatttagaagcacaaccaataaactagagacccgaaggcagaatggaatacgagaggcagtgagcctcctacgcaggacgggcaatgccgagatccagaaacagctgaccggcttgctttggaacctgagctcaactgacgagctgaaagaggagctgattgcggacgcccttcctgtcctagctgaccgcgtgattatacctttttcagggtggtgcgacggcaatagcaatatgtccagagaggttgtcgatcccgaggtgttcttcaatgctacgggctgcctccgcaatctgtccagcgcggatgccggccggcagacaatgcgaaattacagcggcctcatcgatagtctcatggcctatgttcagaactgtgttgcagcaagtaggtgtgacgataaatctgtggaaaattgcatgtgtgtgcttcataacctgtcgtaccggctggacgccgaagtgccaacgcggtacagacagctggagtacaatgcccgcaacgcctacaccgagaagagttctaccggttgtttctccaacaaatccgataaaatgatgaataacaactacgactgtccccttccagaggaggagaccaacccaaaggggtcgggttggctctatcattccgacgccatccggacttacctgaacttgatgggcaagagcaaaaaggacgcgaccctcgaagcttgcgcaggagcgctacagaatctgacggcttctaagggtctaatgtcttcaggcatgtctcaactcattggcctcaaggaaaaggggctcccgcaaattgctaggctgctgcaatctggaaattccgatgtggtgcgcagcggagcctccctgttgtctaacatgtcccgtcatcctctgcttcatagagttatgggtaatcaagttttccccgaagttactagacttctcacatcccatactggcaatacctctaacagcgaggacatcctaagttcggcctgctataccgtacgtaatctgatggccagtcagccccaactggccaaacagtacttcagctcatccatgctgaacaatataataaacctgtgtagatcgtccgcctctccaaaggctgctgaggctgcgaggctgctgctctcagatatgtggagcagtaaggagcttcagggcgttctacgccaacagggatttgacagaaacatgttgggaacccttgcaggagcaaatagtctccgaaattttacatctcgcttctag

SEQ ID NO: 199690 - DNA, 2646 bp, Artificial Sequence
  Description of Artificial Sequence: Synthetic coding sequence
atggccgcccccggcgcccccgccgagtacggctacatccggaccgtgcttggacagcagatcctgggccagttggattccagctccctggcactgccgtccgaggccaagctaaaacttgcgggctcttctggcagggggggccagaccgtcaagtcattgcggattcaagagcaggtgcagcaaacactggcacgcaagggaaggtcctccgtaggaaatgggaatctccacagaacatctagtgtgcctgaatacgtgtacaatctgcatctagtcgagaatgacttcgttggtggcaggagcccagttccgaagacatacgacatgctcaaggctggcaccaccgccacctacgaagggcgttgggggagaggcacagcccagtattcctcacagaagtccgtggaggaaagaagtctgaggcatccacttcggaggctggaaatctcccctgactcctcaccagaaagggcacactatacccactccgattatcagtattcgcagaggagccaggccggacataccctgcatcatcaggaatcgagaagagccgcccttttggttcccccaagatatgctcgcagcgagatagtcggcgtgagtagagccggaacgaccagcaggcaacgacatttcgacacctatcaccgtcagtaccagcacggttcagtcagcgacacagtgtttgacagcataccagcaaaccccgcactgctcacgtaccccaggccaggcaccagtagatccatgggcaaccttctagagaaagaaaattatctcacagcaggcctgactgtgggccaggtgcggccattggtcccactgcagcccgtcacccagaacagggcctctcgctctagttggcaccagagctccttccactctactcggacactgcgagaggctgggccttcagtggctgtggatagctccggtaggcgcgcccacctaacagtggggcaggctgccgcgggcggatccggcaacttactgaccgaacgctccacatttaccgatagccagctgggcaacgccgatatggagatgaccctagaaagggccgtgtccatgctggaagccgatcatatgctgccatcccgcatttcggcggctgccacatttattcaacacgagtgcttccagaagagcgaagctcgcaaacgggtaaaccagttaagaggaattttgaagcttctgcaattgttgaaagtgcagaacgaagatgtgcaacgggccgtgtgcggagcccttcgaaaccttgtattcgaggacaacgataacaaactggaggtagctgagctcaacggcgtccctagacttctgcaggttctgaagcaaacgagggacttagaaactaagaagcagatcactgatcatactgtgaatctgaggtctcgcaatggctggcctggagccgtcgcacatgcctgtaacccctccaccctggggggccagggtggcagaatcactcggtccggggttagggaccagccggaccagcatggcctgctgtggaatctgagttctaacgataagctgaaaaacctgatgatcactgaggcactgctgactctgacagaaaacattatcatccccttttcaggatggcctgagggagactaccctaaggccaacggactcctcgactttgacatcttctataacgtaactgggtgcttaaggaacatgagtagtgcaggcgctgacggacgcaaagctatgcggagatgtgatggattgattgacagtcttgtccactatgtgagggggaccatagccgattaccaaccagacgacaaggctaccgagaattgcgtgtgcattctccacaacctctcttatcagctggaagccgaactgcccgagaagtattcccagaacatatatattcagaatcgtaacatacagaccgataacaacaagtccattgggtgtttcggcagccggagcagaaaggtaaaagagcaatatcaggacgtcccgatgccagaagagaaatccaaccccaaaggggtcgaatggctctggcactccatcgtcatcagaatgtatctgagtctcattgccaaatctgttcgtaattatactcaggaggcttcattaggcgctctccagaacctgacggccggcagtggcccaatgcctacctccgtcgcccagaccgtggtccagaaagagtctgggctccagcacactagaaaaatgctccatgtgggagatcctagtgtgaaaaagacggcgattagcttgctgagaaatttgagtcggaatctgtctctccaaaatgagatagctaaggagaccttgcccgaccttgtgagcattatccccgacaccgtgccttccactgatctgctgattgaaacgactgccagcgcctgctacaccctcaataacataatccagaacagctatcaaaatgctagggacctgctgaataccggtggaatccaaaaaattatggcgatcagtgccggcgacgcatatgcatctaacaaggcttctaaagccgcatccgttctgctttactccttgtgggcccacactgagctccaccacgcctacaagaaggcccaatttaaaaagactgatttcgtcaattccagaacagcgaaagcataccacagtctcaaggattag

SEQ ID NO: 199691 - DNA, 2514 bp, Artificial Sequence
  Description of Artificial Sequence: Synthetic coding sequence
atggccgcccccggcgcccccgccgagtacggctacatccggaccgtgctgggccagcagattcttggacagcttgattcctctagtctagccctgcccagcgaagcgaagctcaaactggccggcagcagcggccgaggcggacagacagtgaagagcctccggatacaagagcaagtgcaacagaccctagctaggaaaggtaggtcatccgtgggcaatggtaacctgcacaggacttcctctgtgcccgaatacgtttataatctccatttggtggagaatgatttcgtcggtggccgctctcccgttcctaagacctatgacatgctgaaggccggtaccacagccacttacgagggtcgttggggtcgcggcactgcccagtatagttcccagaagagtgtcgaagagagatccctcagacaccctctccgcaggctagagatcagccccgactcctcccccgagcgcgctcactacactcattccgattaccagtattcacagcggagtcaagccggccataccctccaccatcaggaaagtagaagggccgccctgttagttcctcctagatatgccagatccgagattgtgggtgtgagccgggccggaactactagccgtcagcgtcatttcgacacctaccatagacagtaccagcacggatcagtctccgacacagtattcgacagtatccctgctaatcctgcacttttgacgtaccctagacccgggacttctaggagtatgggcaatctgctggaaaaggaaaactaccttaccgcgggccttacagttggtcaggtccggccattagtgccattgcagcctgtaacacagaaccgggccagtagatcatcatggcaccagtccagttttcactctactcgaaccttgagggaagccggaccttctgtggcagtcgactcctccggccgtagagcccacttaaccgtgggccaggccgctgcaggggggagtggtaatttactgaccgagcgctcaacgttcacggattcccagttaggtaatgcagacatggagatgacactggaacgagccgtgtctatgcttgaggctgatcatatgctgccctctagaatctctgcagctgcgacattcatacagcatgaatgctttcagaaaagcgaggcgagaaaaagggtgaaccagttgcgcggtatcctcaagttattgcaattactaaaagtgcaaaatgaagatgtgcagagggcagtttgtggcgccctgaggaatcttgtgttcgaggataacgacaataaactcgaggtggccgagctgaacggagtgccccgtctattgcaggtgttaaaacagacgagggacttggagaccaagaaacaaatcacaggactgctatggaacctgtctagtaatgataagttgaagaacctgatgatcacggaggccctccttaccttgacagagaatattatcatcccattctctggttggcccgaaggtgactaccccaaggccaatgggctgctcgacttcgatatattctacaatgtcacaggatgtctgcgcaatatgtcttccgccggtgctgacggccggaaagccatgaggaggtgcgatgggctgatcgatagtttagttcattatgtgaggggaacaatcgcggattaccagcccgacgacaaggcaaccgagaactgcgtttgtattctccacaacttgagttatcagctagaggccgaactcccagaaaaatatagccagaacatctacatccaaaatcgcaatattcagaccgacaacaacaaatctatcgggtgcttcggctctcggtccagaaaggttaaggagcagtatcaagatgttccgatgcccgaggagaaatccaatccaaagggcgtggaatggttatggcactcgatcgtgatacggatgtacctgagcctgattgccaagagcgtgaggaactacacgcaggaggcgagcctgggcgctctgcagaacctcaccgcggggtcaggcccaatgcctacctcagtggcgcagactgtggtccagaaggaatctggcctccagcacacccgtaagatgctccacgttggcgatccatcagttaaaaagaccgctatctcccttctgaggaacttatccagaaaccttagtctgcaaaacgagattgccaaggaaacgctgcccgatcttgtgagcattataccagacacagttcctagtactgacctcctcatcgagacaacagcatccgcctgctatacactgaacaatatcattcaaaattcttatcagaacgcccgggatctgctgaacacaggtggaattcagaaaattatggccatatccgccggggatgcctacgcaagcaataaagcatccaaagccgcaagcgtccttctgtactcactatgggctcacactgagctgcaccacgcttacaaaaaagcgcagttcaaaaaaaccgacttcgttaactctcgcacggctaaggcataccatagtctcaaagattag

SEQ ID NO: 199692 - DNA, 2475 bp, Artificial Sequence
  Description of Artificial Sequence: Synthetic coding sequence
atggccgcccccggcgcccccgccgagtacggctacatccggaccgtgctgggccagcaaattttgggtcagctcgactcatcctctctggccctgccaagcgaggccaaattgaagttggctgggagcagcgggcgcggcggacaaacagtgaagtcacttcggattcaagagcaggtgcagcagaccctggcccggaaaggacggtcatccgttggcaacggcaatctgcaccggacttcctccgtaccagaatatgtgtacaatcttcatctggtggagaacgattttgtgggggggagatctccagtcccaaagacgtacgacatgcttaaggctgggaccactgccacctacgaggggcgttgggggcgcggcaccgcccagtattcgtctcagaaaagcgtggaggagcgctctcttcgccaccctctccggaggctcgaaatcagccctgattcctcccccgaacgtgcccattacactcacagtgactatcagtattcacagaggtctcaggccgggcatacattgcatcaccaggagagcaggagggcagccctgctggtgccgccacgttatgcaaggtcagagatcgttggcgttagcagggctggaaccacatcgcggcagcgccattttgatacataccatcgccagtaccaacacggaagcgtaagcgacacagtgtttgatagcattccagctaacccagcactcttaacctatccacgcccaggcactagcagatcgatggggaatctgctcgagaaggagaattacctgaccgctggcttgacagtgggccaggttcggcccttagttccgcttcagcctgtaactcagaaccgcgcttcacgctccagctggcaccagtcttcatttcattctaccaggactctgcgggaagctgggccatctgtggccgtcgatagcagtgggcggagagcacacctgactgtgggacaagcagccgcgggtggatcaggaaacctcttaacagaaagatctacattcaccgattcccagctcggaaatgcggacatggagatgaccctagagcgagccgtcagcatgctcgaagcggatcacatgctgcctagcagaattagcgctgctgctacctttatccagcacgaatgctttcagaagtccgaggcacgaaaacgcgtgaatcagcttaggggcatattgaagctcctgcagctcctgaaagtccagaatgaggatgtacagcgggctgtttgcggagccctaaggaacctcgtgtttgaggacaacgacaataagttggaagtcgccgaacttaatggcgtacccagactcttgcaggtgctcaaacagacccgggacctggagaccaagaaacagattaccgatcataccgtcaacctaaggtccagaaatggatggccaggtgccgtcgcccacgcttgtaatcccagtaccctaggaggccaggggggtaggattactcgcagcggagtgcgggatcagcccgaccagcacgggttactctggaacctatccagtaatgataagctgaagaacctgatgatcacagaagcactgctcacgctaaccgagaacataatcatcccattcagtggatggccagagggagactacccaaaagcgaacggcctcctggacttcgatatcttttataacgttactggatgtcttaggaatatgtcctctgcgggagccgatggccggaaggccatgagaagatgtgacgggttgattgacagcctggtgcattatgtaaggggaaccatcgccgattatcagccggacgataaagccacagagaattgtgtttgcatactgcataatctcagttaccagctggaggccgaactgcctgagaagtattcccagaatatctacatccagaataggaacatccagactgataataataaatcaatcggctgttttggttcaagatccaggaaagtcaaggaacaataccaggatgtccccatgcctgaggaaaaaagcaaccccaaaggagttgagtggctgtggcacagtattgttattcgcatgtacctctcgttaattgccaagtccgtgagaaattacacacaggaagcatcactcggcgcgttgcagaacctgaccgctgggtccggccccatgcccacctccgtggcacagaccgtggttcaaaaagaatctggactgcaacatacacgcaagatgctgcacgtgggcgatccctcagtcaagaagacggccatttcactgcttaggaacctgtcacggaatctcagcttacaaaatgagatcgcgaaggagactctgccggacctggttagcattattcccgataccgtgcccagcacagacttactcattgaaactacagctagcgcatgttacacactgaataatatcatacagaatagctaccagaatgccagagacctgctgaacaggggacatcctgaaaactacggccattag

SEQ ID NO: 199693 - DNA, 2394 bp, Artificial Sequence
  Description of Artificial Sequence: Synthetic coding sequence
atgcaggacggcaacttcctgctgagcgccctgcagcccgaggccggggtctgtagcctcgctctcccgtcagaccttcagctggacaggcggggagccgaggggcctgaggccgagagattgcgggctgcgagagttcaggaacaggttcgagccaggctgctccagcttgggcagcagcctaggcacaacggcgcagccgagcccgagcccgaggccgaaactgcgagaggaacgtcccggggccagtaccacacactccaggcaggtttttctagccgatcccaaggcctctccggtgataaaactagtgggttccgtccaatcgcaaaacccgcctattcccccgcctcatggtcctctagatcagctgtagacctgagttgctctcgcagattgtcatcagcacataacggaggttctgcattcggagccgctggctatgggggggcccaacccaccccacctatgccaacacgacctgtcagcttccacgaaagggggggagtcggcagcagggccgactacgacacactaagcttgagatctctgagactcggcccaggcgggcttgacgatcgctactcactggtcagcgaacagctggaaccggccgcaacatctacatatagagcctttgcctatgagaggcaagcctctagctcttcttctcgggctggaggcttggactggccagaggcgaccgaagtgtctccgagcaggacaatcagggcacccgcagtgcgcactttgcagagatttcaaagcagccatcgttctagaggcgtgggtggagccgtgcccggcgcagtactggagcctgttgcacgcgcgccaagcgttagatcattatcattgtctctggccgactcaggccatcttcccgacgtacacggcttcaatagttatggatcacatcgaacgctgcaacgcctgagctctggattcgacgatatcgatttaccttcagccgttaagtatctgatggcaagcgaccctaacctgcaagtcttgggcgcagcatacatacagcacaagtgctacagtgacgcagcagccaagaaacaagcccggtctctccaagctgttcctaggttagtaaaacttttcaaccatgctaaccaagaggtccagcgccacgcaaccggcgccatgagaaatcttatctatgataacgccgacaacaagttagcactggtcgaagagaatggcatttttgaactgctgagaacactgcgtgaacaagacgatgagctgagaaagaacgtgactggtatcttatggaacctttcgagtagcgaccacctcaaagaccgattagctcgggatactcttgagcagttgaccgacttggtgctatcccccctatcaggggccggcggacctcccttgattcagcaaaatgctagcgaagccgaaattttctacaacgccacaggtttcctgcgcaacctcagctccgcaagccaagcaaccaggcaaaaaatgcgagaatgtcacgggctggtggacgctctcgttacatcgattaatcacgcccttgacgcagggaagtgcgaagacaagtccgtggaaaatgccgtgtgtgtgctgaggaacttgtcataccgcctgtacgacgagatgccccccagcgcccttcaacgcctggagggccgcgggaggagggacctggcaggggctccacccggtgaggttgtcggctgcttcacgccccaatcccgccggctgcgggagctacccttggccgccgatgcccttacattcgctgaagtgtcgaaagatcccaaagggctggaatggctgtggtccccccagattgtagggctatataacagattgctgcagcgatgtgagctcaataggcatactaccgaagccgccgcaggcgcactacagaacattacggctggtgatcgccgctgggcgggtgtcctcagcagactcgctctggaacaggagcggattctgaaccctctcttggatcgagtgagaactgccgatcaccaccaacttagaagcctgactggactgatccggaatctgagccgcaatgctcggaataaggacgagatgagtacaaaagttgtgagccatctgattgagaagctcccagggtctgtgggtgaaaagtcacctcccgcagaggtgctggtcaatatcattgccgttctgaataatttagtagtggcttcgcctatcgctgcgagagacctcctttacttcgatggattgcgaaagttgatttttatcaaaaagaaacgcgactcgcctgattcggaaaaaagctcccgtgctgcttcctcacttttagccaacttgtggcagtataacaagttgcatcgtgacttcagggccaaagggtacagaaaggaggactttttaggaccctag

SEQ ID NO: 199694 - DNA, 276 bp, Artificial Sequence
  Description of Artificial Sequence: Synthetic coding sequence
accgccttccggcggacccccggcgaggagttcgcctggcgggaccctgagttacctgaggtcatccacatgctccaacaccagtttccaagcgtgcaggctaatgcagctgcctacctgcagcacctctgctttggagataacaaagttaagatggaagtgtgtcggctgggcggcatcaagcacttggtagatctgctggatcatcgggtgggctcctccgaagaatgtttatggtgcccttccaagcctagattctggcaggtgtacagatag

SEQ ID NO: 199695 - DNA, 3450 bp, Artificial Sequence
  Description of Artificial Sequence: Synthetic coding sequence
atgcccgcccccgagcaggccagcctggtggaggagggccagccccagactagacaagaagccgccagtacaggtccaggaatggagcccgaaactaccgcgaccactattcttgcaagtgtgaaggaacaggaactgcaatttcagcgactgactagggagctggaggtggaacgtcagatcgtagcctctcagctcgaaaggtgtcgccttggggcagagtccccgtcaatcgcaagcacttcgagcaccgagaagtccttcccctggcgctctaccgacgtacccaacaccggagtaagcaaaccgcgcgtgtcggacgctgtgcagcctaacaactacctgatcaggacggaacctgaacaaggtaccctctacagtcccgaacagaccagcctgcacgagtctgagggaagtttggggaactcgaggagtagcactcagatgaatagctattcagattcaggatatcaagaggccgggtcctttcataatagccagaacgtcagcaaggctgacaaccgccagcagcactcttttattgggagcacaaacaatcacgtggtgcgcaactcacgcgctgaaggccagactctggtgcagcccagcgtcgctaatagggccatgcggcgggtcagttctgttcctagtcgtgcgcagagccccagctatgtaatctccaccggcgttagccccagcagaggcagccttcggacctcactggggagcgggttcggcagtccctctgtgactgacccacgcccgctaaacccttccgcctattcgtctacaacattaccagctgcacgagccgccagcccgtatagtcagagacctgcttcaccgactgccataaggcgcattgggagtgtgacaagccggcaaacgagtaaccctaacggacctacaccccagtatcaaactacagctagggtgggcagcccgctcacgttgaccgatgcgcagacaagagtggcttcaccgagccaagggcaggtggggtcttccagccctaaacggagtggcatgaccgcggttcctcaacatctgggtccttcccttcagcgcactgtccatgatatggaacagttcggccaacagcaatacgatatctacgagcgcatggtgcctccgaggcctgatagcctgactggacttcgctcttcctacgcttcccagcattcccagctgggccaggatctcaggtccgcagtaagcccggacctgcacatcactcccatctatgaaggacgcacatactatagtcctgtgtaccgatcccccaaccacggtacagtggagctgcagggctctcaaaccgcactttacaggaccgggagtgtgggtattggcaatttgcaacggaccagcagtcaaagatcaaccctgacataccaacgaaataactacgccttgaatactaccgccacctatgcagagccctataggcctatacagtaccgtgtgcaggagtgtaactacaacagactgcagcatgcagtgcccgcagatgatggcaccactagatctccttccatcgactccatccagaaagacccccgggaatttgcttggagagacccagaactgcccgaggtcatccatatgctgcaacaccaatttccttctgtacaggcaaatgccgccgcatacctgcagcacctgtgtttcggagataacaaagtgaaaatggaggtctgtcgccttggcggcatcaagcacctggttgatctactagaccaccgggtgctggaggtccagaagaacgcgtgcggcgcccttcgtaacctcgtgtttggcaaaagcacagacgaaaacaaaatcgctatgaagaatgtgggaggcatccccgccctgttaagattgcttcgcaaatctattgacgccgaagtgcgggagcttgtgactggggtactgtggaatctcagctcatgtgacgccgtgaaaatgaccatcatcagagatgcactgtccacattgaccaataccgtgatcgtgccacatagtggttggaacaatagttccttcgacgacgatcacaagatcaagtttcagacctccttggttttaagaaatactaccggctgcttaagaaatctgagttcagccggggaagaggcaagaaagcaaatgcgcagctgtgagggactggtagatagcttactttacgttattcacacgtgtgttaacaccagcgactatgatagcaaaactgtggaaaattgcgtttgcacgctgcgtaacttgagctatcggttggagctggaggtgccacaggcgaggctacttggtctgaatgaattggacgacctgctcggaaaagagagcccatccaaagattcagagccttcatgttggggcaagaaaaaaaaaaagaaaaagcgaactcctcaggaggaccagtgggatggagtcggacccattcctgggctctcaaaatccccgaagggagtggaaatgctgtggcacccctcggtggtcaagccttatctgacgctgctcgctgagtcatctaatccagcaacactggagggttctgcaggatctctacaaaacttgtcagcaggcaactggaaattcgccgcatacattagagctgcagtgcggaaagaaaagggactgccaattctggtggagttattaaggatggacaatgaccgcgttgtttcttcggtcgctaccgcccttaggaatatggcactcgacgtgcgtaataaagaactcatagggaagtacgccatgcgagaccttgtgaatagactgcctggcggaaatggaccatcagttttgagcgacgaaactatggccgctatctgttgcgctctgcacgaagtcactagcaagaacatggaaaatgccaaggctctagctgactctggcgggattgaaaagttagtgaatataacgaagggcaggggggaccgatcatctctgaaagtggtgaaggctgctgcccaagtccttaacactctatggcaatatcgggatttacgctcaatatataaaaaagacggatggaaccagaatcattttatcacgcccgtctccaccctcgagcgggatcggttcaagtcccatccctccttatccacgacaaatcagcaaatgtctcctatcatccagagcggaagcagcaagcctagccccatttacatcagctcttactctagtcctgctagggagcagaatcgcaggctccaacatcagcaattgtactacagccaggacgattctaatcgaaaaaactttgatgcatatagactctacctgcaaagcccgcattcttatgaagatccctattttgatgaccgcgtgcattttccagcctccacggactacagcacacagtacggcttaaagagcaccaccaattacgtcgacttctactccactaaaaggccatcctaccgggccgagcaataccctggatcccccgatagctgggtctag

SEQ ID NO: 199696 - DNA, 3579 bp, Artificial Sequence
  Description of Artificial Sequence: Synthetic coding sequence
atgcccgcccccgagcaggccagcctggtggaggagggccagccccagacgaggcaggaggctgcatccaccgggcccgggatggagcccgaaactaccgctaccactatactggctagtgttaaggagcaggagctgcaattccagcggttaacccgtgagctggaagttgagaggcaaatcgttgctagccagctggaacgctgcaggttgggggcggagtccccaagtatagcctcaacgtcatccacggagaaatcatttccttggcgttccactgatgtccccaatactggggtttcaaaaccccgggtcagtgatgcggttcagcctaacaattatctaatccgaaccgaacctgagcaggggaccctctattctccagagcagacttcccttcacgaaagtgaaggatcgctgggcaatagtaggtcaagcactcagatgaacagctatagtgattccggctaccaagaagccgggtcgtttcataactcacagaacgtgtccaaggctgacaatagacagcagcatagctttataggatctactaataatcatgtcgtgagaaatagcagggcagaggggcagaccctggttcagcccagcgtcgcaaatagagccatgcgcagggtctcaagcgtgccctccagagctcagagcccctcttacgttatcagcactggagtaagtccctctaggggctccttaaggacttcccttgggtcaggcttcggcagtccctcagtcacagaccctaggcccctgaatccaagcgcctacagcagcaccactttacccgccgcccgagctgcctcaccatatagccagcgaccagcgtcccctactgcaatcaggcgaattggcagcgtgacctctcgccagactagcaatcccaatggccctacccctcagtaccagacaaccgctcgggtcggtagcccactgactctaacagatgctcaaactagggtggccagcccatcccaggggcaggtgggatcttcctcgcctaaacgcagcggaatgaccgctgtcccacaacacttggggccttctctccagagaaccgtccatgatatggagcagtttggccaacagcagtatgatatctatgagcgtatggttccaccacgtcctgattcacttactggcctgcgtagctcatacgcatctcaacacagccagctgggccaagatctgcggtcagcggttagtcccgacctgcatatcactccaatctatgaagggcgcacttattatagtcctgtctatcggagccctaaccacgggactgtggagctgcagggtagccagactgcactgtaccgtaccggctctgtcggaatcggtaacctacaacgcacctcatcccagaggagcacattgacttatcagcgaaataactacgccttgaataccacagcaacttatgcggagccgtatagaccgattcagtaccgcgttcaggagtgcaactacaacagacttcaacacgcagtcccagcagacgacggtaccacaaggtcacctagtatagactccatccaaaaagaccctagggagttcgcctggcgtgatcccgaattacccgaggtgatccatatgctgcagcatcagtttcccagcgtgcaggcgaacgccgctgcttacctccagcatctctgcttcggcgacaacaaggtgaagatggaagtgtgtcggctgggcggaatcaaacacttggtggacctgctggaccatagagtgctggaggtgcagaaaaatgcctgcggggctctgaggaatctcgtgttcggaaagtctactgatgagaataagatcgctatgaaaaatgtgggtggtattcccgccctgttgagactgctgaggaaatctatcgatgccgaggttagggaactcgtcaccggggtgctgtggaacttgtccagttgtgacgctgtgaagatgacgatcatccgtgacgcattgtccacgctcactaacactgttattgttccgcactccgggtggaataacagcagtttcgatgatgatcacaagatcaagtttcaaacatccctggtgctgcgcaataccacaggctgcctgcggaacctgtcatctgctggcgaagaggcccgcaagcagatgcggtcgtgcgaaggactcgttgatagtctgctctacgttattcacacgtgcgtaaatacatccgattacgatagcaagaccgtggagaattgtgtgtgcactctgagaaacctcagctatcgcctggaactcgaggtgccccaggctcggctgcttgggttgaatgagctggacgatctacttgggaaggagtccccctctaaggatagtgaacccagctgctggggcaagaagaaaaagaaaaagaaacgcaccccgcaggaggatcagtgggacggcgtggggccaatcccaggactgagcaaaagcccaaaaggagtagaaatgctgtggcacccgagcgtggtaaagccttacttgacactgctcgctgaaagcagtaaccctgctactctggaaggcagcgccgggtccctgcagaatctctcagccggcaactggaaattcgcagcctacatcagagccgcagttcgcaaagagaaggggctgcccattttagtcgaactgctgcggatggataatgaccgggtggtatccagtgttgcgactgctctcagaaacatggctctggacgttcgaaacaaagagcttattggaaaatacgctatgcgagatctggtcaacagactgccaggtggcaatggcccatcagtactgagcgacgaaacaatggccgccatctgttgtgctctgcacgaagtgacctcaaaaaatatggagaatgccaaagcattagctgacagcggcgggatcgaaaagttggttaatataacaaaggggaggggagatcgctcttcactcaaagttgtgaaagccgccgcccaggtcctgaacaccctatggcagtatagggaccttcgctccatctataagaaagacgggtggaaccaaaaccatttcatcacaccagtgtctactctcgaacgggaccggttcaaaagccatccctccctgagtactactaaccagcagatgagtcctatcattcaatccgtagggtcaacttcatcctctccggccttgttgggcataagagacccaaggagcgaatatgaccggacacagccaccaatgcagtattacaatagtcaaggtgacgccactcacaagggcctgtacccaggctctagcaaacctagtcccatctacatcagcagctactcttcaccagctagggaacagaaccgtcggctccagcatcaacagctatactacagccaggatgacagtaataggaaaaatttcgacgcgtacaggctgtatctgcaatcaccccattcttacgaagatccatatttcgatgatcgagtacacttccccgcgtcgacagactactcaacccagtacgggctgaaatcgacaaccaactatgtggatttttactcaacgaagaggccaagctaccgggcagaacaatacccaggcagcccagacagctgggtgtag

SEQ ID NO: 199697 - DNA, 1845 bp, Artificial Sequence
  Description of Artificial Sequence: Synthetic coding sequence
atgaacagctacagcgacagcggctaccaggaggccggcagcttccacaacagccaaaatgtgtccaaggctgacaaccggcaacagcatagttttatagggagtacaaacaaccacgttgtcaggaactctcgggccgagggccagacattggtgcaaccttccgtggcgaaccgcgccatgcgaagagtcagtagcgtgccatcccgagcacagtcaccgtcctacgtaatttcgaccggcgtctccccttctcgcgggagcttgagaacaagtctcggcagtggttttggaagcccttcagtaacagatcctaggccacttaatccttctgcctattccagtacaacactcccggctgctcgcgcagcttcgccctattctcagaggccggcttccccgacggctatccggcgcatagggtctgtgacatctaggcagacatccaacccaaatggtccaacgccacagtaccagaccactgcaagggtgggttctcccctgactctgaccgacgcacagacaagggtggcctctccctctcagggacaggtggggtctagcagccccaaaagatcaggcatgacagctgtcccccagcacctcgggccctccctgcagcgtacagtgcacgatatggaacagttcgggcagcagcagtatgacatctatgagaggatggtgccgccaagaccggattcactgactgcctatggggtccctatgctcgtgtctatcgtgtctcttgggaagacctttgtgctgccctgtccagacctccacatcaccccaatctacgaggggcggacctactacagcccggtttacagaagcccaaatcacgggaccgtggagctgcagggcagccaaacagccctgtaccgcacaggatctgttggcataggcaatcttcagcgcacatcttctcaacggtcaacactgacctaccaaagaaacaattacgccctgaatactaccgccacctacgcggagccttatcgccctattcaataccgggtgcaggagtgtaattacaacagactccagcatgctgttcctgccgacgacggtacgactagaagtccatctatcgattcaatccagaaggacccccgtgaattcgcttggagagaccccgaactcccagaggttatacacatgctgcagcaccagtttccaagtgtgcaggccaatgccgctgcctatctgcagcacctgtgtttcggggataacaaagtcaagatggaggtgtgtagacttggtggtattaagcatctagttgacctgctagaccatcgagttctcgaggttcagaagaacgcatgtggggctcttaggaacctcgtattcggcaaatctactgacgagaacaagatcgccatgaaaaacgtggggggcatccctgccctgttgcggctcctgagaaagtcgatcgacgccgaggtgcgcgagctcgtgaccggcgttctgtggaacctctccagctgcgacgccgtgaaaatgacgatcattagggatgccctgtccacgctcactaacactgtaattgtacctcattcaggctggaataacagtagcttcgatgatgaccacaaaatcaagtttcagacctcactcgtcctccgtaacaccaccggatgtctgcggaatctctcctccgcaggcgaagaagctcggaagcaaatgagaagctgtgagggtctggtggattctctgttgtacgtcatccacacatgcgtcaacacatcagactacgattccaagaccgtcgaaaactgcgtctgcacactgcgcaacctgattggttggtcttggagatgtccacgccctggatactgggattag

SEQ ID NO: 199698 - DNA, 1329 bp, Artificial Sequence
  Description of Artificial Sequence: Synthetic coding sequence
atgggcctggccatggagcacggcggcagctacgcccgggccggcggaagttcaagggggtgttggtactatttgcggtacttttttctgttcgtctccctgattcaattcctgatcattctgggactggtgctttttatggtctacggaaatgttcacgtttccaccgagagcaatctccaggccaccgagaggcgcgcagagggtctgtactctcagctcctcggcttgaccgcctcgcagtcaaaccttactaaggaactgaactttaccaccagagcgaaggacgcaatcatgcagatgtggttgaacgcacgaagagatttggatcgcattaatgccagctttcgacagtgtcaaggcgaccgcgttatctatactaataaccagcggtacatggccgccattatcctgagtgaaaagcaatgcagggaccagtttaaggacatgaataaatcctgtgacgccctgcttttcatgcttaaccaaaaggtaaagacactggaggtcgagatcgccaaagagaagacaatctgcactaaggataaggaatctgttctcctgaacaagagggttgctgaggagcaactcgttgaatgcgtgaagactagagagctgcaacatcaggagcgccagcttgccaaagaacagcttcagaaggtccaagctctgtgccttcccttggataaagataaattcgaaatggacctgcgaaacttatggcgagatagtattattccacgctcactcgacaaccttggttacaatttgtaccaccccctgggctcagaattggcatctatccgacgcgcctgcgaccacatgccatcactcatgagcagcaaagtagaagaactggctcgatctctgcgagccgatatcgagcgcgtcgcccgcgaaaactctgatctccagcgacagaagcttgaggcgcaacaagggctgcgggcatcccaagaagcaaaacagaaggttgagaaggaagcgcaggccagggaggcaaagctccaagccgaatgcagccgccaaacccagctcgccctggaggagaaggccgtgttgagaaaagagcgggataaccttgcgaaggagttggaagagaagaaacgggaggcggagcagctgagaatggagctggccatccgaaactcagcactcgatacatgtataaaaaccaaatcacagccaatgatgccagtttcccgaccaatgggccccgtcccaaacccccagcccattgaccccgcttcccttgaggagtttaaaaggaaaatcctcgaatcacaacggccaccagcaggtatacccgtcgctccatcatctggctag

SEQ ID NO: 199699 - DNA, 291 bp, Artificial Sequence
  Description of Artificial Sequence: Synthetic coding sequence
atggagcacaaggaggtggtgctgctgctgctgctgttcctgaagtccggtcagggtgagcccctggacgattacgttaatacacagggaccctctttgttctcggtgaccaagaaacagctgggggccggctcccgcgaggaatgcgcggcaaagtgcgaggaggacaaagagttcacatgcagggcattccagtaccatagcaaagagcagcagtgcgtaatcatggctgagaaccgaaaatcaagcattataataaggatgcgggacgccgttctgtttgaaaaatag

SEQ ID NO: 199700 - DNA, 291 bp, Artificial Sequence
  Description of Artificial Sequence: Synthetic coding sequence
atggagcacaaggaggtggtgctgctgctgctgctgttcctgaagtctgggcagggagagcctctagatgactatgtcaatacacagggaccttcgctttttagcgtaaccaagaaacagctgggcgccggaagcagggaagagtgcgccgccaagtgtgaggaagataaagaatttacctgccgcgcgttccagtatcactcaaaagaacaacagtgcgtgataatggctgagaaccgaaaaagctctatcattattcgcatgcgagacgccgtcctgtttgaaaaatag

SEQ ID NO: 199701 - DNA, 291 bp, Artificial Sequence
  Description of Artificial Sequence: Synthetic coding sequence
atggagcacaaggaggtggtgctgctgctgctgctgttcctgaagtctggccagggcgaaccactcgacgattatgttaacacccagggcccttctcttttcagtgttacaaagaaacagttaggggcaggatcaagagaagaatgcgcagctaaatgtgaggaagacaaggaattcacctgcagggcttttcagtatcattcaaaagagcaacagtgcgtaattatggctgagaatcgtaagtctagcataatcattagaatgagagacgccgtcttatttgagaagtag

SEQ ID NO: 199702 - DNA, 492 bp, Artificial Sequence
  Description of Artificial Sequence: Synthetic coding sequence
atggacgccctggagggcgagagcttcgccctgagcttcagcagcgcctcagacgcagagtttgacgccgtggtcggctacctggaggacatcataatggacgatgagttccagctgttacagaggaattttatggacaagtattacttagagttcgaagatacagaggagaacaagttaatctacactccaatcttcaacgagtacatctccctggttgagaaatacatagaggaacagttgctccaacgcattcctgaattcaacatggcagcctttacgactaccctgcagcatcataaggacgaagtagctggcgacatatttgatatgctccttaccttcactgatttcttggcctttaaggagatgttcctcgattatagagccgaaaaggagggtcgcggactggacctcagctcaggtctcgtcgtcacgtctttgtgcaaatccagcagcctacccgcgagtcagaataatttacggcattag

SEQ ID NO: 199703 - DNA, 1890 bp, Artificial Sequence
  Description of Artificial Sequence: Synthetic coding sequence
atggagaacagcaccaccaccatcagccgggaggagctggaggagcttcaggaagcttttaataaaatcgacatcgacaactccggttatgtcagcgactacgagctccaggacctgttcaaggaagcaagcttgccgctgccaggctacaaagtgcgagagattgtggagaagattctaagtgtggccgacagcaacaaagatggcaagattagctttgaagagtttgtttccctgatgcaggaactaaagagcaaggacatttccaagacattcaggaagataattaacaaaagagaagggatcacagccattgggggaacatcgacaatcagcagcgaaggaacacagcactcatactccgaggaggagaaggtggccttcgtcaactggatcaacaaagcgctggagaacgatccggattgcaagcatttgattcctatgaatccgaatgatgacagcctgttcaaatccctggcagatgggatccttctctgtaaaatgatcaatctctcagagcctgacacaatcgatgaacgcgccattaacaagaaaaaactgacgccattcacaataagcgaaaatctcaatttggccttgaactctgccagcgcaatcggctgcacagttgtcaacatcggggcgagcgatctgaaagagggcaagccgcacttagttctcggtttattgtggcagatcatcaaagtggggctgttcgccgatattgagataagcagaaatgaggcactcatcgccttactgaatgaaggagaggagctggaggaactcatgaagcttagccctgaggagttactccttcggtgggttaactaccacctgaccaatgcgggctggcacaccatttctaactttagtcaggacatcaaggactcccgggcatactttcacctgctgaatcagatcgcacctaaaggaggcgaagatggccccgcaatcgctatcgacctgtcaggaatcaatgaaacaaatgacttgaagagggctggcctcatgctgcaagaggccgataagctgggatgcaaacagtttgttacccctgcagacgtcgtatctggcaaccctaagctgaacctggcgtttgtggccaatctattcaatacctatccatgtctgcataagccaaataacaatgacatcgatatgaacctgctcgaaggcgaaagcaaagaagaaaggactttcaggaattggatgaacagcctcggcgtgaacccttatattaaccatctttatagtgaccttgctgacgccctggtgatcttccagctttatgagatgatcagggttcctgtgaattggtcacacgtcaacaaacccccatacccagccttaggtggtaacatgaagaaaatcgaaaattgtaattatgcggtggagctaggtaagaataaggcaaaattctccctcgtcggtatcgcgggccaggacctcaatgaaggcaactcaaccttgactcttgcactcgtgtggcagctcatgcgaaggtacacactgaacgtccttagcgatctgggcgagggcgagaaggtgaacgacgagattattattaagtgggtgaaccagacgctaaagagcgctaataagaaaacctccattagctcattcaaggacaagtcaatttccacaagtctgcccgtcctggacctgattgacgctatcgcgccgaacgcagtgcgccaagagatgattagaagagagaacctgagtgatgaagataaacttaacaacgccaaatacgccatttctgtcgctaggaagatcggcgcccgaatttatgccctgcctgacgatctcgtcgaagtgaagcccaaaatggttatgacagttttcgcctgcttgatgggtaagggcctgaaccggatcaagtag

SEQ ID NO: 199704 - DNA, 1890 bp, Artificial Sequence
  Description of Artificial Sequence: Synthetic coding sequence
atggagaacagcaccaccaccatcagccgggaggagctggaggagttgcaagaggcatttaacaaaatcgatatcgataactccggatacgtttcagattacgaactccaagacttgttcaaggaggcctccttgccgctacccgggtacaaggtgagggaaatcgtggagaagatcttgtctgtggcagactctaacaaggatggaaagattagctttgaggaattcgtatctcttatgcaggagttaaaatctaaagacatcagcaagacattccgcaagattatcaacaagcgcgaggggatcaccgctatcggaggaacctcaacaatctcctcggaaggcacccagcattcgtacagcgaagaagaaaaagtcgcatttgtgaactggattaataaggctttagagaacgacccagattgcaaacatttgatccccatgaacccaaatgacgattccctgttcaaaagtctggctgacgggatcctgctgtgcaaaatgattaacctctccgagccggacacgatcgacgagagagccatcaataagaaaaaactgaccccgttcactatctctgagaacctcaatctggccctcaactctgcaagcgcaataggctgcactgtggtgaacattggcgcttcagacctgaaagagggcaagccacacctggttttggggcttctgtggcagatcattaaggtcggcttgtttgcagacatcgaaatctcccgcaatgaggctctaattgcattgttaaacgaaggcgaggagctcgaagagctcatgaagctttcaccagaggagctgcttctccggtgggtaaactaccacctgaccaacgccggctggcatacgatctctaacttcagccaggatattaaggactcccgagcctacttccacctcctaaatcaaattgcccccaaaggcggggaggatgggcccgctattgcaattgatttgtcgggcattaacgaaaccaacgatcttaaaagggctggacttatgcttcaggaagctgataaactggggtgtaaacagttcgtgacaccagcagacgtggttagcggcaaccctaagctgaacctggccttcgtagccaatctcttcaatacctacccttgccttcacaaacccaataacaacgacatcgacatgaatctcttggaaggagaatcgaaggaggagcggaccttccgcaactggatgaacagcctgggggttaacccttatatcaatcacctttacagcgacctcgccgatgccctcgttatattccagctttacgaaatgattcgtgtgccggtgaattggagccacgttaacaagcctccttaccctgcactcggcggtaacatgaaaaaaattgagaattgcaattacgccgtggagttgggtaaaaacaaggccaaattttctctggttggcattgccgggcaggatctgaatgagggcaactcaactctgactttggctctggtgtggcagcttatgcggcggtatacattgaacgtactgtcagacctgggggaaggcgagaaggttaatgacgaaatcataattaaatgggtgaaccagacacttaaaagcgcaaacaagaaaacgtccattagttctttcaaggataaaagcataagtaccagtctgcccgtgctggatctcatcgacgcaatcgctccaaacgcagtgcggcaagagatgattagaagagaaaatctgtccgatgaagataagctcaataatgccaaatacgctatttcggtggcccgaaagataggcgcccgtatctatgccctccccgacgatttagtggaggtaaagccgaagatggtgatgaccgtgttcgcctgcttaatgggcaaaggcctgaatcgtattaagtag

SEQ ID NO: 199705 - DNA, 165 bp, Artificial Sequence
  Description of Artificial Sequence: Synthetic coding sequence
atggagaacagcaccaccaccatcagccgggaggagctggaggagctgcaggaggccttcaacaaaatagacatcgataatagcgggtatgtgagtgactatgagctgcaggacttgttcaaggaagcaagccttccgctgccggggtataaggtccgagaatag

SEQ ID NO: 199706 - DNA, 363 bp, Artificial Sequence
  Description of Artificial Sequence: Synthetic coding sequence
atggagaacagcaccaccaccatcagccgggaggagctggaggagttgcaggaagctttcaacaaaatagatatagataacagcggttacgtctcagattacgaactgcaggacctctttaaagaagccagcctcccactgcccggatacaaggttcgggaaatcgtggaaaagatcctgagcgtcgccgattccaacaaagacggtaaaatctccttcgaagaatttgtgtcactcatgcaggagttgaaaagtaaggacattagcaaaacatttcgaaaaataattaataaaagagaaggcatcaccgctattggcggaacctccactattagttctgaggggacacaacatagctattag

SEQ ID NO: 199707 - DNA, 360 bp, Artificial Sequence
  Description of Artificial Sequence: Synthetic coding sequence
atggagaacagcaccaccaccatcagccgggaggagctggaggagttgcaggaggccttcaacaaaattgatatagataatagcggttacgtgtctgactacgagctccaggacctcttcaaggaggcatctctgcccctgcccgggtacaaagtgagagaaattgtagagaagatcctgtccgtcgccgattccaataaagacggcaaaatatctttcgaggaatttgtgtctctgatgcaagagctgaaaagcaaggacatctccaaaacttttagaaaaatcattaacaaaagagagggcattacagcaatcggcggtacctcaacgatctcatccgaaggtacacaacacagctag

SEQ ID NO: 199708 - DNA, 102 bp, Artificial Sequence
  Description of Artificial Sequence: Synthetic coding sequence
atggagaacagcaccaccaccatcagccgggaggagctggaggagcttcaggaggcgttcaacaagattgatatagacaatagcggttatgtatcggattag

SEQ ID NO: 199709 - DNA, 177 bp, Artificial Sequence
  Description of Artificial Sequence: Synthetic coding sequence
atggagaacagcaccaccaccatcagccgggaggagctggaggagcttcaggaggcatttaacaaaatagatatcgataactccggctacgtcagtgactacgagctccaggacttgtttaaggaagctagtttacccctgcccggctacaaggtgagagaaatcgtggagaaatag

SEQ ID NO: 199710 - DNA, 1890 bp, Artificial Sequence
  Description of Artificial Sequence: Synthetic coding sequence
atggagaacagcaccaccaccatcagccgggaggagctggaggagctccaagaggccttcaacaaaatcgatatcgacaactcgggctacgtgagtgactatgagctccaggatttgtttaaggaggcctccctcccgctgccaggctataaagtgagagaaatagttgaaaagatcctttctgtggcagattcgaacaaggatggtaagatatccttcgaggaatttgtctccttaatgcaggagctgaaatctaaggatatttcgaagacctttcgcaagataattaacaaacgggaaggcattaccgctatcggaggtacgagcacaatcagctctgaaggaacacagcactcgtactcagaggaggagaaggtggccttcgtcaactggattaataaggcccttgagaatgaccctgactgcaagcatctaatcccaatgaatccaaacgacgactccctgttcaagtctttggcggatggtatcctcctatgtaagatgattaacctgtctgagcccgacaccatagatgagagggccattaataaaaagaagctgactccatttaccatctcggagaacctgaacctcgccctgaattcagcatccgctatcggatgtacagtagtcaatattggggcttctgacctcaaagaaggcaagccccatttggtcctgggcctgctgtggcaaattattaaggttggcctttttgccgatatcgaaatctctcgcaacgaggccttaatcgccctcctcaacgagggagaagaactcgaggagctgatgaagctgtcacccgaggagctactgctgcgctgggttaactaccatctgacgaacgccggctggcataccatttccaacttcagccaggacatcaaagattcacgagcctatttccatctgctgaatcaaatagcccccaaggggggcgaagatggtcccgccatcgctatagatctgtcaggcatcaacgagacaaatgatctgaagagggccggtttgatgctccaggaagctgacaaacttggctgcaagcaatttgtgacgcctgccgacgtggtgtcagggaacccgaagctgaatttggcctttgtggcaaatctgtttaacacctacccatgccttcacaagccgaataataacgacattgacatgaatttgctcgaaggcgaatccaaggaagagaggacctttaggaattggatgaactcactcggtgtgaatccatacataaaccacctttacagtgacctcgctgatgcactcgtaattttccaactctatgaaatgatacgggtacccgtcaattggagtcacgtgaacaagcccccatatcccgcccttggtgggaatatgaaaaaaattgagaattgtaattatgcagtcgaactcgggaaaaacaaagccaaatttagcctcgtgggcatcgctggccaagacctgaacgagggtaattctaccttgacactggcccttgtttggcagctgatgaggcgatacacactgaatgtgctgtctgaccttggcgagggcgagaaggttaacgacgaaattattatcaaatgggtcaaccagaccctcaagtctgctaacaagaaaacctccattagctccttcaaggataagtctatttcaacatccctgcccgtgctcgatttgatcgatgccatcgcgccgaatgccgtcaggcaagagatgattagacgggagaacctctccgatgaggataaattaaacaatgccaaatatgctatctcagtggcaagaaagattggcgcacgaatttatgccctgcctgatgatttggtggaggtgaaacctaaaatggttatgaccgtgttcgcctgccttatgggaaagggtttaaacaggatcaagtag

SEQ ID NO: 199711 - DNA, 162 bp, Artificial Sequence
  Description of Artificial Sequence: Synthetic coding sequence
atggagaacagcaccaccaccatcagccgggaggagctggaggagctccaggaggcctttaacaagatagacatagacaactccgggtacgtgagtgattacgaattacaagacctattcaaggaagcttccctccctttgcctgggtacaaagtgagatag

SEQ ID NO: 199712 - DNA, 1785 bp, Artificial Sequence
  Description of Artificial Sequence: Synthetic coding sequence
atgcccctgcccggctacaaggtgcgggagatcatccagaagctgatgctggatggcgacaggaataaagacgggaagatctcatttgatgaattcgtctacatttttcaggaggtcaagtcgtcagacatagctaaaaccttcagaaaggcaataaaccgcaaagaggggatttgcgcgctgggaggcacttctgagctctcatccgaaggcacgcagcacagttacagcgaagaagagaaatatgcattcgtgaattggatcaacaaagccctggagaacgaccccgactgccgccatgtcatccctatgaaccccaatacagacgatctctttaaagcagtaggcgacggaattgtcctctgcaagatgattaacttatcagtacctgataccatcgatgagagagcaattaacaaaaaaaaactgacgccgttcatcatacaggagaaccttaatttggctctgaactccgcaagcgcaataggatgtcatgtcgtgaacataggggctgaggacttgcgggccggcaaaccccacctagtactgggacttctgtggcagattatcaagattgggctcttcgcggatatcgagctgtctagaaatgaagcactcgccgcactgttgcgcgatggggagaccctcgaagagctgatgaagctgagtccggaggagctgcttcttaggtgggccaatttccatctggaaaactcaggttggcagaaaatcaacaacttctctgctgatattaaattaattgatttttctaactccgttaaggatagtaaggcatatttccacctcttgaaccagatagctccaaagggccaaaaggaaggtgagccccggatcgacattaacatgagtggctttaacgagaccgacgatctgaaacgggccgaaagcatgctgcagcaggcagacaaactaggctgccgccagtttgtgactcctgctgatgtcgtgtctggtaacccaaaattgaatcttgcgttcgtggccaacctgttcaataagtaccccgctcttactaaacccgagaaccaggacattgactggacgttactggaaggagagactagagaggagcggacctttaggaattggatgaattcacttggagtgaatccgcatgttaaccacctctacgcggacttacaggacgcactggtgatccttcagctttatgagcgcatcaaggtgcccgtggactggtctaaagtgaacaagcctccctatcccaagttaggcgctaacatgaagaagcttgaaaattgtaattatgccgttgagttgggcaagcaccccgcaaagttctcacttgtgggcatcggggggcaggatcttaacgacggtaatcagactctgacattggctcttgtctggcaactcatgaggcgctataccctgaacgtgctcgaggacctgggggatggtcagaaagctaacgatgacataattgtcaattgggtgaatcggactctttccgaggccggtaaatccacatcaatacaatcatttaaagacaaaacgatctcgtcctcattggcggtagtggacttgatcgacgctatccagcccggttgtattaactacgatctggtgaagtccggaaacctcaccgaggacgacaaacacaataacgctaagtacgcagtttccatggctagacggatcggagcgagggtatacgcccttcccgaagacctggtcgaagtcaaacctaaaatggtcatgaccgtattcgcttgcctgatgggaagagggatgaagcgtgtctag

SEQ ID NO: 199713 - DNA, 1893 bp, Artificial Sequence
  Description of Artificial Sequence: Synthetic coding sequence
atggacgagatggccaccacccagatcagcaaggacgagctggacgaacttaaagaagcctttgctaaggtagatctgaactccaatggctttatatgcgattacgagctgcatgagctgttcaaggaagccaacatgcccctccccggatataaggtgcgcgagatcattcaaaagttgatgctggatggggacaggaataaggatggaaaaatcagttttgatgagtttgtctacatctttcaggaagtgaagtcttcagacatcgcaaaaacattccggaaagctatcaaccggaaggaaggaatctgcgctctgggtggcaccagcgaactgtcctccgagggtactcaacacagctacagtgaggaggaaaaatacgccttcgtgaactggattaacaaggctctggagaacgaccctgattgtcgccacgttatccccatgaaccccaacactgacgatctgttcaaagctgtcggggatggaattgtgctgtgcaagatgattaacctgagcgtgcctgacaccatcgacgagcgcgcaatcaacaagaagaaacttaccccctttatcattcaagagaatctgaacctggccctgaattctgcctctgccattggctgccacgttgttaacatcggcgctgaagatctgcgggccgggaagccacacctcgtgctgggccttttatggcagatcattaagatcggactctttgccgatatcgagcttagtcgcaacgaagcacttgccgctctccttcgcgatggagaaaccctcgaagagctgatgaagctttctcccgaggagctgttgctcagatgggctaattttcatctcgagaactctgggtggcagaagatcaataacttttccgcagacattaaggacagtaaagcttacttccacctgctgaatcagatagcacctaagggacagaaagaaggggagccacgcattgatataaacatgtccgggtttaacgagaccgacgatctgaaacgggccgaatctatgctgcagcaggccgacaaactcgggtgccgacagtttgtcacccccgcggacgtggtgtctggcaatccaaaactgaatctcgcctttgtggccaatttgtttaacaagtatcctgcgcttactaagcctgagaaccaggatattgattggaccttgctagaaggcgaaacgcgtgaagagcgtacctttaggaattggatgaatagcctaggagtaaatccacacgtgaaccatctgtatgctgacctgcaagacgcactggttatcctccagctgtacgaacggatcaaggtgccggtcgactggtccaaggtcaacaagcctccgtatcctaagctgggggccaacatgaagaaactggaaaactgcaactatgccgttgaactgggtaagcatccagctaaattttcattagtgggcatcggcggacaggatctgaacgatggaaatcagaccctgaccttggcgctcgtctggcagttgatgaggaggtataccttaaatgtgctggaggacctgggtgacggacagaaggccaatgacgatattattgtcaactgggtgaatcgtaccctgagcgaggccggaaaatctactagcatccaaagcttcaaggacaaaacgattagcagctcactggcagtggtcgatttgatcgacgcgattcagcctggttgcattaattacgaccttgtcaaatccggaaacctgactgaggacgataaacacaacaatgcaaagtacgctgtctcaatggccagacgcatcggcgctcgagtctatgccctgcctgaagatctggttgaggtaaaacctaaaatggtcatgactgtctttgcatgtcttatgggcagagggatgaaacgggtctag

SEQ ID NO: 199714 - DNA, 1893 bp, Artificial Sequence
  Description of Artificial Sequence: Synthetic coding sequence
atggacgagatggccaccacccagatcagcaaggacgagctggacgagttaaaggaggcattcgccaaagtcgatctgaacagcaatggatttatctgcgactacgaactccacgagttgttcaaggaagctaacatgcccttaccagggtacaaggtgcgcgagataatccagaaactcatgcttgacggagacaggaataaggacgggaagatcagttttgatgagttcgtgtatattttccaggaagtgaaatcttctgacatcgctaagacctttcgtaaggcaattaatcggaaggagggaatctgcgcactaggcggcaccagcgaattaagctccgaggggacacagcatagctacagcgaggaagaaaaatacgctttcgtgaactggattaataaagccttggaaaacgatcctgactgccgacatgtgataccaatgaatccgaacacagatgatttgtttaaggccgtgggagatgggatcgtcctgtgtaagatgatcaacctgagcgttcccgatactattgacgagagagctattaacaagaagaagctcaccccttttattattcaagaaaatctcaatttggcactgaattctgcatcggctatcggctgtcacgtcgtaaatattggggccgaggatcttcgtgctggcaagcctcacctagtgcttggactgctatggcagatcatcaagatcgggcttttcgccgacatcgaactgtcccggaatgaagccttggccgccctattaagggatggcgagacactcgaagaacttatgaagttatctcccgaggagctgctcctgaggtgggcaaactttcacctggagaacagtggctggcagaaaataaacaacttctccgccgacattaaggacagcaaggcttactttcacttactgaatcagattgcacctaagggacagaaggagggcgaaccacggatcgatatcaacatgtcaggttttaacgaaacagacgatctgaagcgtgccgagtctatgctgcagcaagccgacaaactcgggtgtagacagtttgtcacgccagccgatgtggtgagcgggaaccccaagcttaatctggcatttgttgcgaacctatttaacaaataccctgcactgacaaagcctgaaaatcaagacatcgactggactctgctggagggtgagacccgagaagagcgcaccttccgcaattggatgaactctttaggtgtgaatcctcacgttaatcacctctatgcagacctgcaggacgctttggttattctacagctgtatgagaggattaaagtgcccgtggattggtcaaaggtgaataagccgccctaccctaagttaggagcgaatatgaaaaagctcgagaattgtaattatgccgtcgagctggggaagcacccagcaaagttctcactggtgggaatcggaggacaggatttgaatgatggcaatcagaccctgactctggccttggtgtggcagctaatgcgtaggtacactctgaacgtcctggaagacctgggcgacggtcaaaaagcaaacgacgacataatcgtgaattgggtgaataggactctatctgaggcggggaagtctacctccattcaatcttttaaggataagactatcagctcgtcccttgccgtggtggatctgatagacgctattcagcctggatgcattaactatgacctcgtgaaaagcggcaacctcactgaggacgacaagcacaataatgcaaagtacgccgtgagtatggcccgaagaataggagcacgtgtttacgccttgccagaggatctcgtagaagtgaaaccaaagatggtgatgacagtgtttgcgtgtcttatgggtagaggaatgaagagagtgtag

SEQ ID NO: 199715 - DNA, 1854 bp, Artificial Sequence
  Description of Artificial Sequence: Synthetic coding sequence
atggaggacctgaacagcaacggcttcatctgcgactacgagctgcacgaactgtttaaggaggccaacatgccactgccaggttataaggtgagagaaatcattcagaagctgatgctcgatggcgataggaacaaggatggcaaaatatcctttgatgagttcgtgtatatctttcaggaggtcaaatcatcagacatcgcgaagaccttccgtaaggccatcaaccgtaaggaggggatctgcgcactgggcggcacgtccgaactgagttcggagggcacacagcactcttatagtgaggaggaaaagtatgccttcgtgaattggatcaataaagcccttgagaacgacccagattgtcggcacgtaatccctatgaatcccaatacggacgatctgttcaaggcagtgggagacggaatcgtcctttgcaagatgatcaatctgtccgtgccagataccatcgacgaaagggctatcaataaaaagaagctgactcccttcatcatacaagagaacctgaacctcgccctgaatagtgccagtgccattgggtgtcatgtggttaatattggggccgaggacctgcgggctgggaaaccccacttggtacttggactcctgtggcaaattatcaagatcgggcttttcgcagacatcgaactgagtcgcaatgaggccctggccgcactgctgagggacggggaaactctagaggaactgatgaagctgtcccctgaggaactactcttgcgatgggcaaacttccacctcgaaaactccggatggcagaaaataaataatttttccgccgatatcaaactcatcgactttagtaactccgtgaaagattccaaagcttattttcatctgctcaatcaaatagcaccgaaagggcagaaagagggggaaccaaggattgatattaacatgtctggattcaatgagacggatgacttgaaaagagccgagtcaatgttgcagcaggcagacaagctgggctgtagacagttcgtgaccccggccgatgttgtctcaggaaaccccaagttaaatctggcattcgtggccaacctcttcaataagtatcccgcgctgactaagcctgagaatcaagatatcgattggaccctcctggagggggaaactcgagaagagcgtacgttccggaattggatgaacagcctgggagtgaaccctcacgtcaaccacctctatgcagatctgcaagatgccctggttatcttacagctgtacgaacgcattaaagtgccagtggactggtcaaaagtgaataagccaccctatcccaaacttggggctaacatgaaaaaactggagaactgcaattatgctgtcgaacttggaaaacaccctgccaagttcagtctcgtcgggatagggggccaggacctcaatgacggaaatcagacccttacactcgcactggtgtggcaactgatgcgccggtacacccttaacgtgctggaggacctgggtgacggacagaaggctaacgatgacatcatcgtgaattgggtaaacagaactctcagtgaggccggcaaaagcacgagcattcaatcctttaaggacaagactatctcaagttctctcgcagtagttgatctgattgacgccatccagcctgggtgcatcaactatgatttagtaaagagtgggaatctgaccgaagatgacaaacataataacgctaagtatgcagtatcaatggcacgaagaattggagctcgggtttatgcgctacccgaagacttggtggaggtgaaaccaaaaatggtgatgactgtatttgcctgtctcatgggaaggggaatgaagcgagtctag

SEQ ID NO: 199716 - DNA, 1758 bp, Artificial Sequence
  Description of Artificial Sequence: Synthetic coding sequence
atgcccctgcccggctacaaggtgcgggagatcatccagaagctgatgctggacggcgacagaaacaaggacggaaaaatctccttcgacgaatttgtttacatcttccaggaggtgaagagctctgacatcgctaaaacattcaggaaagcaataaacagaaaagaaggaatttgtgccttgggtggtacttccgagctgagtagcgagggcacgcagcactcctactctgaggaagaaaagtacgcctttgttaattggataaacaaagccctggaaaatgatcccgactgtaggcacgtgattcccatgaatcctaatacggacgatttatttaaggccgtcggcgatggtattgtgctgtgcaagatgatcaacctctccgtccccgatacgatcgatgagcgggctatcaacaagaaaaaactgacaccattcattattcaagaaaacctgaacctggccttgaactcagccagcgcaattggctgccacgtggttaacatcggggctgaagacctgcgtgcgggtaagccacatcttgtcctggggctcctgtggcagatcataaaaattggcctgttcgccgatatcgagttgtctcggaatgaagctctcgccgccctgttgcgcgacggagaaactctggaggaactgatgaaactgtctccggaagaactcctgctgcgctgggctaatttccatctcgaaaactcaggatggcagaagatcaataacttttcagccgatataaaggactccaaggcatatttccacttgctcaaccagatagcacccaaagggcagaaggagggtgagcctaggatcgatatcaacatgtctgggttcaacgaaactgacgacctcaaacgggcagagagtatgctacagcaggctgataaactgggctgtaggcagtttgttacacccgcggatgtagtatccggtaaccccaaactgaatctcgcctttgtcgccaatcttttcaacaagtatccagcacttacaaagcctgagaaccaggacatcgactggacccttcttgagggggagacccgcgaggaaaggacattccgcaattggatgaacagcctaggtgtcaacccccacgtgaatcatctttatgccgatttgcaagatgctctggtaatcctccagttatacgaaaggataaaggtgcccgtggactggtctaaggtgaataaacctccttatccgaaactcggcgcgaacatgaagaaactcgaaaattgcaactatgctgtggaacttggcaaacatcctgcgaaattctcactggtgggtatcgggggccaagacctcaacgacggaaaccagacactcactcttgctttggtgtggcaactgatgcggagatatactctcaacgtactggaggatttaggcgacggacagaaggctaacgacgatattatagttaactgggtgaatcgaaccctgtcagaggcaggcaaatcaaccagtatacagagcttcaaagataaaacaatcagttcatcccttgcggtagtagatctgatagatgccattcaacctgggtgcatcaactatgacctggtcaaatctgggaatctaacagaagatgataagcacaataacgccaagtacgcggtgtctatggctcggagaataggagcccgggtctacgccctaccagaggaccttgtagaggtcaagccgaaaatggtgatgacggtattcgcctgtttgatgggtagaggcatgaagcgcgtctag

SEQ ID NO: 199717 - DNA, 675 bp, Artificial Sequence
  Description of Artificial Sequence: Synthetic coding sequence
atgaacagcctgggcgtgaacccccacgtgaaccacctgtacgccgatctgcaggatgctctggtgatcctacagctgtacgaacgcatcaaagtcccagttgactggagtaaggtgaacaaaccgccttacccaaaactcggagcgaatatgaaaaagctggaaaattgcaattacgctgtggaactgggcaaacatccagctaaattctctttggtcggcatcggtggccaggatcttaatgatggcaatcaaactctgaccctggctctggtgtggcaactcatgcgaaggtatactctgaacgtgctagaggacttgggcgatggacagaaggccaacgatgacatcatcgttaactgggtcaatcggaccctgtcggaggctggcaaatctacatctatccagagctttaaagacaagaccatttctagttcactggcagtggtcgatttgattgatgccatccagccaggatgcatcaactatgacctggtaaaaagtggcaacctcacagaagacgataaacacaataatgcaaagtacgcagtgtcgatggctagaaggatcggagctcgtgtgtatgctttaccagaggatctggtggaggttaagcccaaaatggtgatgaccgtctttgcgtgtctcatgggcaggggcatgaagagagtgtag

SEQ ID NO: 199718 - DNA, 306 bp, Artificial Sequence
  Description of Artificial Sequence: Synthetic coding sequence
atgagcagcgccgccggcttctgcgccagccggcccggcctgctgtttttgggcctcctgctgctgccgttagtagttgcgtttgccagtgctgaagctgaagaagacggagatctgcagtgtctgtgcgtgaagacaacttcccaagtgcgcccgcgacacatcacttccctcgaggtgattaaggccggaccccactgtccgacggctcagcttatcgcgacgctgaaaaacggaaggaagatctgtttagacttacaggcccctttgtacaagaagattatcaagaagctccttgaaagttag

SEQ ID NO: 199719 - DNA, 405 bp, Artificial Sequence
  Description of Artificial Sequence: Synthetic coding sequence
atgaagagcctgacctggatcctgggcctgtgggccctggccgcctgtttcaccccgggagagtctcagcggggaccaaggggtccttatcctcccggacccctggcccccccgccacccccctgttttcctttcggcaccggattcgttccgcccccacacccccctccatatgggccgggacggtttccgcctcccctgagtcctccctacggccctggaagaatacccccttcacctccacccccctatggaccgggccggatccagagtcactccctccctcccccgtacggccctggctacccccagccgccttcccagccccgcccatacccccccggacccccttttttccctgtcaacagccccacagatcctgcgctccctacgcctgccccctag

SEQ ID NO: 199720 - DNA, 399 bp, Artificial Sequence
  Description of Artificial Sequence: Synthetic coding sequence
atgagccagggcgacagcaaccccgccgccatcccccacgccgccgaggatatccagggggatgacaggtggatgtcacagcacaatagattcgtcctggattgtaaggataaggaacctgatgttctgttcgtgggggactcgatggtgcagctgatgcaacagtacgagatttggcgcgaactgttcagtccactgcatgctcttaactttgggataggtggagacactactcggcacgtattatggaggctgaaaaacggagaactggaaaacatcaagcccaaggtgattgtcgtttgggtggggacgaacaaccacgaaaacactgcagaagaagtagccggggggatcgaggctatcgtgcaattaattaacactcgccagccgcaggcttag

SEQ ID NO: 199721 - DNA, 690 bp, Artificial Sequence
  Description of Artificial Sequence: Synthetic coding sequence
atgagccagggcgacagcaaccccgccgccatcccccacgccgccgaagacatccaaggcgatgatcgttggatgtcacagcacaaccggtttgtgctcgattgcaaagacaaagaacccgatgtcctatttgttggtgactctatggtgcagctgatgcagcagtatgaaatctggagggagctgttctcccctctgcatgccctcaatttcggcataggtggcgacacgactaggcatgtactgtggaggcttaaaaacggagaactggaaaatatcaagcccaaagttatagtcgtctgggtcggtaccaataaccatgaaaataccgcggaggaagtcgcgggaggaattgaggctatcgtgcaactgatcaacacacgccaacctcaagcaaaaattattgtgctcgggttgcttccgagaggagagaaaccaaatcctctccgccaaaaaaacgctaaggtgaaccagttgttaaaagtgtccctgcccaaacttgcaaatgtacagttgctcgacacagacggaggcttcgtgcatagtgatggcgccattagttgtcatgatatgttcgactttctgcatttgacaggcggcggctacgccaagatatgcaagcccctgcatgagctgattatgcagctgctagaggagacgcctgaggagaagcagactaccatcgcttag

SEQ ID NO: 199722 - DNA, 468 bp, Artificial Sequence
  Description of Artificial Sequence: Synthetic coding sequence
atgagccagggcgacagcaaccccgccgccatcccccacgccgccgaggacatccaaggtgacgatcggtggatgtctcaacacaatcgcttcgtcctggactgcaaagacaaggagcctgatgtcctgtttgttggcgacagtatggtgcagctgatgcagcagtatgagatctggagagagctgttttcacccctgcatgctctgaatttcggcataggcggcgacactaccaggcatgtactatggagacttaagaacggagagctcgagaacatcaagcctaaggtgatcgtagtatgggtggggacaaacaaccacgagaacaccgccgaggaggtagctggtgggatcgaagctatcgtgcagctgattaacactaggcagccccaggctaaaattatcgtgttaatcatctattggcaggatgaacaggattatcacgagagaaaggttcaaatggactag

SEQ ID NO: 199723 - DNA, 609 bp, Artificial Sequence
  Description of Artificial Sequence: Synthetic coding sequence
atgagccagggcgacagcaaccccgccgccatcccccacgccgccgaagatatccagggtgacgatagatggatgtcacagcacaataggttcgtgttggattgtaaagataaggagcccgacgttctatttgtcggagactcaatggtgcagctcatgcagcaatacgagatctggagggagttgtttagcccacttcatgcactgaatttcggaatagggggcgacaccactagacatgtgctgtggcgcctaaagaacggcgagcttgagaatatcaaaccgaaagtgatcgtggtgtgggtgggtacaaacaaccacgagaacactgcagaagaggtggccggcgggatcgaggcaatcgtgcaactaataaatacgcgccaaccgcaggctaaaatcatcgtgctcgggaaggccgctgctagtaaatatagtatctctgaaattgtgcggttagagcagggatcagtcaactggtctatcggcacctaccccgacgacacaccagctactacccgaccggcaattttacaactgttcaccggcaaaatgagtagaattaccatgaaggagaaatcacgatggaccgaagaaattttgcactag

SEQ ID NO: 199724 - DNA, 696 bp, Artificial Sequence
  Description of Artificial Sequence: Synthetic coding sequence
atgagcggcgaggagaaccccgccagcaagcccacccccgtgcaggacgtgcaaggcgacggcagatggatgtcactgcaccacaggttcgtggcagacagtaaagataaagagcccgaagtggtatttataggggattcactggtgcagctgatgcatcagtgtgaaatctggagggagctcttcagcccgctccacgcattgaactttggcatcggcggcgacggtacccaacatgtcctttggcgactagagaacggggagttagagcatatcagacccaaaatcgtcgtggtgtgggtagggactaacaatcacgggcacacagcagagcaagtgacaggcggcattaaggctatcgtgcagctcgtcaacgaaaggcagcctcaggcacgggtggtagtcctgggattactgccccgcgggcaacacccgaacccactgcgcgaaaagaaccggcaggtgaatgagctggttagggccgccctggccggacatcctagagctcatttcctagacgctgaccctggcttcgtacactctgacggaacaattagtcatcacgacatgtatgactacctacatctcagcaggctcggctacacccccgtgtgtcgggcactgcacagcctactcctccgcctgctggcccaggaccagggtcaaggagcccccctcctggagccagcgccatag

SEQ ID NO: 199725 - DNA, 696 bp, Artificial Sequence
  Description of Artificial Sequence: Synthetic coding sequence
atgagcggcgaggagaaccccgccagcaagcccacccccgtgcaggacgttcaaggcgacgggcggtggatgagtcttcatcatcggttcgtcgctgatagcaaggacaaggagcccgaagtcgtctttatcggggattcactggtgcaactgatgcatcagtgcgaaatctggagagagctgtttagcccactccacgctctcaactttggtatcggcggggacggcacccagcatgtgttatggcgactggaaaatggagagctggaacacataagaccaaagatcgttgtcgtgtgggttggtacaaataaccatggacacacagccgagcaggtcaccggcggtattaaggccattgtccagctggttaacgagagacagccccaggcgagggtcgtcgtactggggctgcttcctcgtggccagcacccaaaccctctccgcgagaagaacaggcaggtgaatgagcttgtccgggctgctctggcgggccaccctcgtgctcactttctggatgctgaccctggttttgtacatagcgatggaacaattagtcatcatgacatgtacgattatctgcatctctcaagacttggctatacgccagtgtgtcgagccctacatagcctgctgctgaggttacttgctcaagatcaagggcagggcgcacccctgcttgagcccgcaccctag

SEQ ID NO: 199726 - DNA, 720 bp, Artificial Sequence
  Description of Artificial Sequence: Synthetic coding sequence
atgaccatcaagctgtgggacttccagggcttcgagtgcatccggacaatgcatggccacgatcataatgtgagcagtgtggccattatgcccaatggagaccacatcgttagcgccagccgggacaagactatcaagatgtgggaagtgcaaactggttactgcgtcaaaacctttacaggccaccgagaatgggtaaggatggtccggcccaatcaggacggtaccctaattgctagctgtagcaacgatcagaccgtaagggtgtgggtggtggctacaaaggagtgcaaggccgaactgagggagcatgaacacgtggtggagtgtatttcctgggcgccagaatcctcttatagttccatcagcgaagccacgggctcagagaccaaaaagtccggtaaaccgggacctttcttactgagtggaagccgcgacaagactattaaaatgtgggatgtgtccacagggatgtgcttaatgacactggttggtcacgataattgggtccggggcgtgctcttccacagcggaggcaagttcatactgtcatgcgccgatgataagacactcagagtgtgggattataaaaacaaacgatgtatgaagacactaaacgctcacgaacatttcgttacatccctcgacttccacaagacagcaccctatgtggtgactggctccgtggaccagacagtcaaggtttgggaatgtagatag

SEQ ID NO: 199727 - DNA, 1233 bp, Artificial Sequence
  Description of Artificial Sequence: Synthetic coding sequence
atggtgctgagccagcggcagcgggacgagctgaaccgggccatcgcagattatcttagaagcaatgggtacgaggaggcctattccgtgttcaagaaggaagccgaactggacgttaatgaggaacttgataaaaaatatgctggattactggagaagaagtggaccagcgttatccgcctccaaaagaaagtgatggaattagaatcaaagctgaacgaagcgaaggaagagttcacctctggggggccactgggccaaaagagagatcccaaagagtggattccacgtcctcccgagaagtatgcgctgagcggacacaggagccctgtaacacgggtgattttccatccggtttttagcgtcatggtaagcgcctccgaagacgctactatcaaggtttgggactatgagacaggcgactttgaacggactttgaaaggccacactgattcggtgcaggacatcagttttgatcattctggaaagttgctggcttcttgcagcgctgacatgacaattaaactctgggacttccaggggttcgagtgcattagaaccatgcatggtcatgatcacaacgtctcaagtgtagccatcatgcccaacggggatcacattgtgagcgctagccgggacaaaacaattaagatgtgggaagtccagaccggctattgtgtgaaaacatttaccgggcatcgggaatgggtgcgcatggttcgcccaaatcaggatgggaccctaatcgcttcctgttcaaacgaccagacggtaagggtgtgggtggttgctacaaaggaatgtaaggctgaactgcgcgaacacgaacacgtggtggagtgcatttcgtgggcccctgagtcatcttattcaagtatctcagaggccactgggagtgagactaaaaaaagcggcaaacccgggccgttcctgttgtctgggagcagagacaaaacaatcaaaatgtgggacgtgagcacagggatgtgtctgatgaccctggtcgggcacgacaattgggttaggggggtgcttttccactctggtggaaaattcattttgtcttgcgctgacgataagactctgagggtctgggactacaagaacaaaaggtgcatgaagaccttgaatgcccacgaacatttcgtgacgagcctggattttcataaaacggcgccctacgtggttacgggtagcgtggatcagaccgttaaggtctgggaatgtcgctag

SEQ ID NO: 199728 - DNA, 618 bp, Artificial Sequence
  Description of Artificial Sequence: Synthetic coding sequence
atgaccatcaagctgtgggacttccagggcttcgagtgcatccggacaatgcacggacacgatcataatgtgtcctcagtggccattatgcccaacggtgatcacattgtgagcgccagccgggacaaaacaattaaaatgtgggaagtacagaccgggtattgcgttaagactttcaccggacaccgcgagtgggtcagaatggtgcgtccaaaccaggacgggactttgattgcgtcttgctcaaatgaccagactgtgagggtttgggtggtcgcgacaaaggaatgtaaggctgaactgcgggagcatgagcacgttgtcgagtgcatcagctgggccccggaaagtagctactctagtatatcagaggctaccggctcagaagtcggccacgataactgggtgcggggtgtattgttccacagcggaggaaagttcatcctgtcctgtgcagatgacaaaactctgcgggtgtgggattacaagaacaaacgttgtatgaaaacgctgaacgcccacgaacacttcgtgacttcacttgacttccacaagacagcaccgtacgtcgtaactgggtcagtggatcagactgtcaaagtgtgggagtgtaggtag

SEQ ID NO: 199729 - DNA, 1029 bp, Artificial Sequence
  Description of Artificial Sequence: Synthetic coding sequence
atggagccccacgacagcagccacatggacagcgagttccggtacacgctgtttcctattgtgtattcaatcatattcgtgttaggcgttattgcgaacggatacgtgctgtgggttttcgcacgactgtatccttgcaaaaaatttaacgagattaagattttcatggttaatcttactatggccgacatgctgtttctgattaccttacccttgtggattgtctattatcaaaatcaagggaattggatactcccgaaatttctgtgcaacgtggctggatgcctgttctttattaatacttattgtagcgttgctttcctgggcgtaattacttacaatcgcttccaggccgtcacacgtcccataaagacagcccaggctaacacccgaaaacgtgggatatcattgagcctcgtcatctgggtggccattgtcggagcagcctcttacttcctgatcctcgattctactaacactgtaccagactctgccggatctggcaacgtaacacgctgcttcgaacattacgagaaaggcagtgtccccgtgcttatcatccacatcttcatcgtcttctctttctttctggtgtttttgattatcctgttttgtaatctcgtcatcattcgaacgctgctgatgcagcctgtgcagcagcagcgaaatgccgaagtcaagcggagggctctatggatggtttgcactgtccttgcagtttttatcatttgctttgtgccgcatcacgtggtgcaactcccatggaccctagctgagctcggatttcaggatagcaagtttcaccaagccataaatgacgcccaccaggttaccctgtgcctcctttcaactaactgcgttctggaccccgtgatatactgcttcctcacaaaaaagtttaggaagcacctgacggaaaagttttactctatgaggtcctcgcggaaatgttcccgagcaaccactgatactgtcacagaagtagtggtacccttcaaccagatccctgggaacagtctgaaaaactag

SEQ ID NO: 199730 - DNA, 1029 bp, Artificial Sequence
  Description of Artificial Sequence: Synthetic coding sequence
atggagccccacgacagcagccacatggacagcgagttccggtacaccttgttccctattgtttattccatcatctttgtgctgggcgtcatcgctaatggatacgtgctctgggtatttgctaggctgtatccctgtaaaaagtttaatgagattaaaatctttatggtgaacctgaccatggcggatatgttgtttctcatcacactgcccctgtggatcgtgtactatcaaaaccaaggcaactggatattacccaagttcctctgcaacgtcgccggctgtctgttttttataaacacatactgttccgtcgcattcctgggtgtaattacttataaccgctttcaggccgtgacccggcctattaaaactgcacaggcgaatacccgaaaaagagggatcagcctttcccttgttatatgggtcgcaatcgtgggcgcagcatcctacttcctgatccttgacagcaccaacaccgtccctgactccgcaggttctgggaatgttacccgctgcttcgaacactacgagaaagggtcagtgccagtgctgataattcacatttttattgtcttttcctttttcttggtatttctcatcatcctcttctgcaacctcgtgatcattcgtacacttctgatgcagccggtgcaacagcaacggaatgccgaggtgaagcgccgagctttgtggatggtttgtaccgtgctggcagtcttcatcatttgtttcgtccctcatcatgttgtccagctcccttggacactggccgagcttgggttccaagacagcaaattccaccaggccataaatgacgcacatcaagttaccctttgtttgttgtcaacaaattgtgtcttagatccagtgatctattgcttcttaacaaagaagttcaggaaacatctaactgagaagttttacagcatgcgcagctcaagaaaatgctcccgtgcaactactgacaccgtaacagaagtggtggtgccctttaaccagattcccgggaattccttgaaaaactag

SEQ ID NO: 199731 - DNA, 1029 bp, Artificial Sequence
  Description of Artificial Sequence: Synthetic coding sequence
atggagccccacgacagcagccacatggacagcgagttccggtacaccctctttccaattgtttatagtatcatttttgtgcttggtgtaatcgccaacggatacgtgctatgggtgttcgcacgcctatacccatgcaagaagtttaatgagatcaaaatttttatggtgaatctaactatggcagacatgctttttttgataactttacccttgtggatcgtctactaccagaaccagggaaactggattctgcccaaatttctgtgcaatgtggccggctgtctcttcttcattaacacatactgctcagtggcatttctgggagtgattacatataatcgatttcaggccgtgactcggcctataaaaacagcgcaggcgaatacacggaagcggggtatctctctcagcttggtcatctgggttgctatcgttggcgccgcaagctactttttgattctggactcaactaacacagtcccagattcagctggctctgggaacgtcacccgttgtttcgaacattacgagaagggaagcgtgccagtcttaatcatacatatctttatcgtgttttccttctttctggtcttcctgatcatccttttttgtaacctcgtcatcatcaggactctcttgatgcaaccagtccaacagcaacggaacgccgaagtcaagcgccgagctctttggatggtatgtaccgtgcttgccgtcttcatcatatgcttcgtgccccaccacgtggttcagctgccttggaccctcgcagagctcgggttccaggacagcaagttccatcaggcaatcaacgatgcacaccaggtgacactgtgtctgttgagcacaaactgcgtgttggacccggtgatttactgctttctgacaaagaaatttcggaagcacctgacagagaagttttatagcatgcgtagctcccggaaatgttcgcgagctacaacagatacagtgactgaagtggtagtgccattcaaccagataccgggcaacagccttaaaaattag

SEQ ID NO: 199732 - DNA, 1128 bp, Artificial Sequence
  Description of Artificial Sequence: Synthetic coding sequence
atgaaggtgtggctgctgctgggcctgctgctggtgcacgaggccttggaggacgtgaccggccagcatcttcccaaaaataagcggcccaaagagcccggcgagaacagaatcaagcccactaataagaaggtaaaaccaaaaatccccaaaatgaaagaccgtgatagcgcgaattccgccccaaagacccagtctatcatgatgcaggtcttggataaaggtcggtttcagaagcctgcagcaacactttccctgctggccggccagacggtcgagcttaggtgcaaggggtccaggatcggatggagctacccggcctaccttgacacattcaaagactcacgactctccgtaaagcagaacgaaaggtacggccagctgacactggtgaattccacctcagcggacaccggagagttcagttgctgggtccagctgtgcagcggctatatttgccggaaagacgaagccaagactggatctacctacatattctttaccgagaagggagaacttttcgtaccatccccaagctactttgacgtggtctatctgaaccccgacaggcaagctgtggtcccctgccgagttactgtgctgtcggccaaggtgacacttcaccgggagttcccagcaaaggagatccctgcaaatggaactgacattgtttatgatatgaaacgaggattcgtgtacctccagcctcatagcgaacaccagggcgttgtgtattgcagagcggaggcaggcgggcgctcccagatttccgttaagtatcagttgctttatgtggcggtgccgtctggaccccctagcacgacaattctcgcttccagtaacaaggtgaaatccggcgacgacatatcagtcctatgcactgttctgggcgaacccgacgtcgaggtggagtttacttggatttttccgggtcagaaggacgaaaggcccgttacaatccaggacacgtggcggctgatccaccgtggcttggggcacacaactcgcatatcacagtctgtgatcacggtcgaagactttgagaccattgatgccggttactatatctgtaccgcccagaacttacaggggcagaccaccgtggcaactaccgtggagttttcctag

SEQ ID NO: 199733 - DNA, 1128 bp, Artificial Sequence
  Description of Artificial Sequence: Synthetic coding sequence
atgaaggtgtggctgctgctgggcctgctgctggtgcacgaggccctagaggacgtgaccgggcagcatttgcctaaaaataagcgtcctaaagagcccggagagaaccggatcaagcctaccaataagaaagtgaaaccaaaaatcccgaaaatgaaggaccgggactccgccaattctgcccctaaaacacaaagtattatgatgcaagttctcgacaaggggcgattccagaagccagcagctaccttgagcctcctggcaggacagacagtggagctcagatgcaaagggagccgcattggttggtcgtatcccgcctatcttgataccttcaaggacagtagactgtccgttaagcaaaacgaacgctatggtcagctgactcttgtcaatagcaccagcgctgatactggagaattcagctgttgggtgcagttatgtagtggctatatctgtaggaaggatgaagccaagaccggatcgacatatatttttttcaccgaaaaaggcgagcttttcgtcccctctccctcttactttgatgttgtctatctgaatccagatcggcaagcagtcgtaccttgtcgtgtcacggtgctgtctgccaaagtcacattgcaccgggagtttccagctaaggagattccagctaacggcacggatattgtctacgatatgaagagggggttcgtataccttcaaccacatagcgagcaccagggagtggtttactgccgcgcagaggcgggcggcaggagccagattagcgtgaaataccagctgctgtacgtggctgttcctagcgggcctccaagtactaccattctggctagctctaataaggtgaagtcaggggatgatatctccgttctatgtaccgtgttgggtgagcccgacgtggaagtggaattcacctggatatttcccggccagaaagacgaaaggccagtgaccatccaggacacttggaggctgattcaccgcggactggggcatacaacacgcattagtcaaagtgtgattactgtcgaggactttgagaccatcgatgcaggctattacatctgcacagctcagaacctgcaggggcagacgacagtggcaaccactgtcgagttcagctag

SEQ ID NO: 199734 - DNA, 1128 bp, Artificial Sequence
  Description of Artificial Sequence: Synthetic coding sequence
atgaaggtgtggctgctgctgggcctgctgctggtgcacgaggccctggaagatgtcaccgggcagcatcttcccaagaacaaaaggccaaaggagcccggtgaaaaccgtatcaaacccacaaacaagaaggttaagcctaaaatcccaaaaatgaaagatagagattccgccaacagcgccccaaaaacacagtccattatgatgcaggtcctcgacaaaggcaggtttcagaaacctgcagctacactgtccctgctggcgggccaaaccgtggagctgagatgcaagggttcccggatcgggtggtcttacccagcctatttggacacatttaaagattcgcggctgtctgtcaaacagaacgagcgctacggacagctgaccctggtgaactcaaccagtgctgatactggcgagttttcatgttgggtccagctttgtagtggctacatttgccgaaaggatgaagccaaaacagggtctacctacatctttttcactgagaagggagagctgttcgtgccctcaccttcatactttgatgtggtgtacctgaatccagaccgccaggcggtcgtaccatgtcgcgtcactgtgttaagtgccaaggtgaccttgcatcgtgaatttcccgctaaggagatcccagccaacggcacggatattgtgtacgacatgaagaggggtttcgtttacctgcagccacactccgagcatcagggcgtggtatattgccgggcggaagcaggaggtcgtagccagatctcggtgaaatatcaactcctgtacgtcgctgtcccttcagggcccccatcaaccaccattctcgccagctctaacaaggtgaaatctggcgatgatatcagcgtgctttgtactgtgttgggcgagcccgacgtggaggtagagttcacctggatcttccccggacaaaaggacgaacgccccgtgactatccaggatacttggagacttattcacagaggcctagggcatactactcgcattagtcaatctgtgataactgtggaggactttgagacaatcgatgctgggtactatatttgcacagcacagaatctgcaagggcagaccaccgtcgccacaaccgttgagttctcatag

SEQ ID NO: 199735 - DNA, 3075 bp, Artificial Sequence
  Description of Artificial Sequence: Synthetic coding sequence
atggcccagggcgccatgcggttctgcagcgagggcgactgcgccattagtccacctcgctgcccccggagatggctcccagaaggccctgtgccccagtcgcctcctgcatctatgtacgggtctacaggaagtctattgcggagagttgccggtcccggcccacgtggacgggaactcggtcgcgttactgccccgtgtacgcccttaagaggccctccaagtcccagggtggccccaagtccttgggctccctcctctccaacgggccagccgccacctggcgcccagagctctgtggtaattttccggttcgtggagaaggctagcgttagacccctgaacggcctgccagccccaggcggcctgtcacggtcgtgggatctcggcggcgtttctccgcctagacctaccccagccctggggcccgggagcaacagaaagctgaggcttgaggccagcacttccgaccccttgccagctcgagggggctccgcactgccaggctctaggaatctcgtgcacgggccacctgccccgcctcaggtgggggcagatggactgtactcttcactcccgaatgggctggggggtccaccggagcgcctcgctacgctgtttgggggtcccgccgacactggattccttaaccaaggagacacctggagcagtccacgggaggtcagtagccacgctcagagaatcgccagagccaaatgggaatttttctacggcagcctggatcccccgagctccggtgcaaagcctcccgaacaggcccccccatcccccccaggtgtcggctccagacaagggtccggcgttgccgtggggcgcgcagcaaaatactccgagaccgacctcgacacagtgcctttaagatgctatagggagaccgacatcgatgaggtgttggccgaaagagaggaggcagactctgctattgagtctcagccctccagtgagggaccgcccggaacggcctatccgcctgccccacggcctggacctctgcctgggcctcatccaagcctcggctctggcaatgaggacgaagatgacgacgaggcaggcggggaagaagacgtggacgatgaggtgtttgaggcctctgagggggcaagaccagggtctcgcatgcccttaaagagtcccgtgccatttctgcctggcacaagcccgtcggctgatggccccgactcttttagttgtgtgttcgaagcaattctggaatctcacagggccaaagggacctcttatacgtcactggctagcctggaggctcttgccagccctggacctacccagtcccccttttttaccttcgagctgcccccacagccccccgccccgagacctgaccctcctgcgcctgctcctctcgccccacttgaaccagattcaggaaccagttccgccgcagacggaccatggactcaaaggggcgaagaggaggaggcagaagcccgtgctaagctggcccctggtcgtgaaccaccgtccccttgtcacagtgaagactcacttgggctaggggcagccccactaggctcagaacctcctctttcccagctggtgtctgacagcgattcggaattggatagtactgagaggctggcactcggcagtaccgatacattaagcaacggtcaaaaagccgacctggaagcagcccagcgactggccaagcgactctatcggctcgacggatttaggaaagccgatgtggccagacacctgggtaagaacaatgacttttcaaagctcgtcgctggcgagtacctgaaattctttgtgtttacaggcatgaccctggatcaggcactgcgcgtatttttgaaggagctcgccctgatgggtgaaacccaggaaagagaacgcgttctcgctcactttagccagaggtacttccagtgtaatccagaggcgttgagcagcgaggacggcgctcacacactgacatgcgccctgatgctgctgaacaccgaccttcacgggcataacatcggaaaacggatgacatgtggagactttattgggaatctagagggcctcaatgatggcggggacttccctagagaactcctgaaggctttatactcatctatcaagaatgagaagctacagtgggcaatcgacgaagaggagctgaggagatcattgtccgaactcgccgatcctaatccgaaagtcatcaaacgaattagtgggggaagtggctccggcagctctccctttctcgatctcaccccagagcccggcgctgccgtgtacaagcacggcgccctggtcagaaaggtacacgctgaccccgattgtcgcaaaacacctcgcgggaaacggggctggaagagctttcacggcattctcaagggcatgatcctgtatcttcagaaagaggagtataaacccggcaaagcactctctgagaccgagctcaagaacgccatatctatccaccatgctctggccacccgggcctccgattactcgaagcgccctcacgttttttacctgcggaccgccgattggagggtgttcctcttccaagcaccgagcctagagcagatgcagtcctggatcacacgaatcaatgtggttgctgccatgttctctgcaccacctttccccgctgctgtatcctcccagaagaagtttagcaggcctttgctgcccagtgccgctacgcgcttgtcccaagaggagcaggttcgcactcacgaagctaagctgaaggctatggcaagtgaactgagagaacacagagcagctcagctgggaaagaagggaagaggtaaagaggcggaggagcagaggcaaaaggaagcatacctggagtttgagaagtccagatactctacctatgccgctttgctccgcgttaagctgaaagccggatcagaggagctggatgcggtagaagcggccttagcccaggccgggtctacagaggacggtctgcctcctagccatagcagcccttcactgcagcccaaaccatcttctcagcctagggcacagcggcattcctcagagccccggccaggcgcgggatccggccggcgcaagccttag

SEQ ID NO: 199736 - DNA, 3075 bp, Artificial Sequence
  Description of Artificial Sequence: Synthetic coding sequence
atggcccagggcgccatgcggttctgcagcgagggcgactgcgccatttctccacctagatgtccacggagatggctgcccgaggggccggtgccccagtctccaccggcttccatgtacggatcaaccgggtctctgctgcggcgtgtcgcaggacctggtccaagaggccgggagttggggagggtaaccgccccatgcacaccccttcgcgggcctccatctcccagagttgcaccatcaccttgggctccatcctcccctaccggacagccacctcccggggcccagagtagtgtcgtgatatttagattcgtggagaaagcctctgtacgcccgctgaatggcttgcctgcgcccgggggactaagcaggagctgggacctcggtggggtatccccgcctcggcctacacccgcgctaggtcctggctccaaccgaaaactcagactcgaagccagcacgagcgacccgctccccgcaagaggcggcagcgcgctcccaggctctaggaacttggtacatggtccgccggcccctccacaagtgggtgctgatggcctatactcctccctacctaatgggcttgggggcccacctgagcgtctggcaacactcttcggcggcccagctgatacgggctttctaaaccagggtgatacttggtcatcgcctagagaagtaagctctcatgcacagcgtatcgcaagagccaaatgggagttcttctacggaagtctggaccccccctcatctggggcaaagcctccagagcaggctccgccaagccctcctggtgtgggatcgagacaaggcagcggggtggcagtggggcgggccgccaagtacagcgagaccgacctggacaccgtcccattgagatgctaccgcgaaactgacattgacgaggtgttggccgagagagaagaagctgacagtgctatcgagagtcagccttcaagtgaaggcccgccagggacggcttaccccccagcccccaggcctggcccactgcccggtcctcatccatctttgggctccggcaacgaggatgaggatgatgatgaagcagggggggaagaagacgtcgacgacgaagtatttgaggcgagtgaaggcgcccggcccggctcgcgcatgcctttgaaatccccagttcccttcttgccaggtacatctccctcagcggacgggccagatagcttttcatgtgtatttgaagccatcttggagagccaccgtgctaaaggcaccagctatacaagcttggcaagcctggaagctctggctagtccaggaccaactcagagtcccttcttcactttcgaactgcctccacagcctcccgccccgcggcctgaccccccggcaccagccccgctggctccattggagcccgacagcggcacgtccagcgctgcagatggaccttggacccagcggggtgaagaagaggaggcggaggccagagctaagctggccccaggaagggaacccccttccccgtgccactccgaagatagcttaggcctgggcgcagctcccttgggctccgagcctccgttgtcccagctcgtgtccgattccgatagcgagctggacagtactgagcggctggccctgggctccacagacactctgagtaatggtcagaaggccgacttagaggccgcccaacgcctggctaagcggctttatagacttgatgggttccgcaaggcggatgtggccaggcacctgggtaagaacaacgacttctccaaacttgtggctggggaatatctcaaattcttcgtatttaccggtatgactctggaccaggcgcttcgtgtgtttttgaaggagctggccctcatgggagagacccaggagagagagagagtgttagcacacttcagccaaaggtattttcagtgtaacccagaagctctaagctccgaggacggcgcgcacacgctgacgtgcgccttgatgctgctgaacaccgacctgcacgggcataatatcggtaagcggatgacttgcggagacttcattggtaacctggaagggctcaatgacggtggagactttcccagggaacttctcaaagccctttatagttcgataaaaaatgaaaaattacagtgggccatcgatgaagaggaactgcgccgaagtctgtctgagctagcagatcctaatcctaaggtgatcaaacgtatctctggtggctccgggtccgggagctcgccgtttctggacttgacacccgaacctggagctgctgtatataagcacggagcgctcgtgagaaaagttcatgccgaccctgactgtcggaagacacctagaggcaagcgaggctggaaatcctttcacggcattctgaaggggatgatactgtatctgcagaaggaagagtataagccggggaaagccctttctgaaactgaactcaaaaacgctatcagcattcaccatgccctggccaccagagcctccgactactccaagcgcccccacgtgttctacctccgaacagcagactggcgagtgtttttattccaggccccctcccttgagcagatgcaaagttggattactaggattaacgtcgtagcggccatgttttccgcccccccttttcccgctgccgtctccagccagaagaaatttagtcgaccactcctgcctagcgctgcaactcgactgtcacaggaagaacaggttcgcacccacgaggctaaactcaaagctatggcgagcgaattacgggagcatagagctgcacagctggggaaaaaaggtcgaggtaaggaggctgaggagcagcgacagaaagaggcttacctggaatttgaaaagagcaggtacagtacatatgcggcgctgttgcgcgttaaattaaaagccgggagcgaggaactcgacgcagtagaagctgctctggctcaggctggctctacagaggacggcctgccaccttcgcactccagcccctctttgcagcccaaaccgtcttcccagccccgtgcccagaggcactctagcgagcctcgacccggtgctggctccggccggcggaagccatag

SEQ ID NO: 199737 - DNA, 2784 bp, Artificial Sequence
  Description of Artificial Sequence: Synthetic coding sequence
cagatctggcggtgccccctgcagcaccacgccgagagcgcccccccactacctgcactcagctgggcacagcccctgctctgtctttcatccgtttccgcattaggagagcagaggcctactcccgctctagggcccgggagtaacaggaaactgcggctggaagcctccaccagcgaccccctgccggctagaggagggtcggctctgcccggatcccgcaacctggttcatggcccaccagctccaccccaggttggcgctgacggcctgtattcatccctgcccaatggtctggggggcccccctgaaaggctggcaacacttttcgggggccccgccgatacgggcttcctgaatcagggtgacacttggtccagtccgcgggaagtgagttcgcacgcccagagaatcgcccgggcaaagtgggagttcttctatggaagccttgatccaccatccagcggagccaaaccaccagagcaagccccccccagccctcctggtgtgggctcacggcagggctcaggggtggccgtgggaagggccgccaagtacagtgagacggatttggatacagtcccactgcgctgttacagggagactgatatcgacgaggtgctggccgagagggaagaagcagatagcgcgattgagtctcaaccttccagcgaaggtccgccaggaaccgcgtatcctcctgcaccaaggcctggaccactaccaggcccacatccgtcgctcgggtctggcaacgaggacgaggacgatgacgaggcgggcggtgaggaggatgtggatgatgaggtgttcgaggcgtccgagggtgctcggcccggctcaagaatgccactgaagagccccgttcctttcttaccaggcactagcccatccgccgatgggccagattccttttcctgtgtttttgaagccatacttgaaagtcatagggccaagggcacaagttacaccagtttagcaagcctggaggctctcgcctctcccggccccacccagtctcctttcttcacattcgaactgcccccccagcctccagctccacgaccggatccccctgcccctgctcccctcgcgccactcgagcctgactccggcacatcatcggccgccgatggcccttggacgcagaggggagaggaggaggaggcggaggcacgggctaagttagccccaggaagggagcctccctcaccttgccacagcgaagatagcctggggctcggtgctgccccactgggtagcgaacctccgctgtctcagttggtgtccgattcagactccgaattggatagcactgaacgcctcgctttgggatcgacagataccctcagtaatggccagaaggctgacctcgaagccgcacagcgcctggccaagcggctctacaggctggacggtttccgcaaagcagatgttgcgcgtcacctgggaaagaacaacgattttagcaagcttgtcgccggtgagtatctgaagtttttcgtgttcaccggaatgaccttagaccaggcactgagagtgtttctgaaggagctcgccctaatgggagaaactcaggagagagaacgcgtgctggcccacttttcccagcgctacttccaatgcaatcctgaagccttgagcagtgaggacggcgcccataccttgacatgcgctctgatgctcttgaatacggacttgcacggccacaacattggcaagcgcatgacctgcggtgattttatcggcaaccttgaggggctaaacgacggcggagattttcctcgagagctgctcaaggccctctactcttcaatcaaaaacgagaagttgcaatgggccattgacgaagaagagctgagacggtctcttagtgaacttgcggaccctaatccaaaagtgattaagagaatttccggcgggagcggttccggcagtagcccctttctcgatttgacaccagagcccggggcagcggtgtataaacatggcgctctggtccggaaggtgcacgcagaccccgattgtcgaaagacccctagggggaagcgggggtggaaatccttccatggaatcctcaagggaatgatactgtatctgcagaaggaagagtacaagcccggaaaggcgctgtctgagaccgaactgaaaaacgctatatccatccatcacgctcttgctacccgtgcctcagactactccaaacgccctcatgtgttctatttgaggacagcagattggcgtgtgtttctgttccaggccccttcgctggagcagatgcagtcttggattactcgtataaatgtcgtagccgccatgttctctgcacctccgttcccagctgctgtctctagccagaagaaattttcccgtccgttgctacccagtgcggcaacccgtctgtcacaggaagagcaggtgaggacgcatgaggcgaaactgaaagcaatggcgagtgagttgcgcgagcatagggctgcccagcttggcaagaagggcagggggaaggaggctgaagaacaaagacagaaggaggcgtacctagaattcgagaagagccgttatagtacctacgccgctctgctacgcgtcaagctgaaggccggctcagaggaactggatgctgtggaggcagctctggcacaagctggaagtacagaggacggcctcccaccgagccattcctcaccgtctctgcagccaaaaccatcctctcagcctcgcgcacagagacacagctctgaacccagacccggagcgggtagtggtcggaggaaaccctag

SEQ ID NO: 199738 - DNA, 1542 bp, Artificial Sequence
  Description of Artificial Sequence: Synthetic coding sequence
atgggcagcagctggtgcctgtacggctgctgcaacgccggcgtgaagacaacccggctggaggcccactctgagatggggtctacagagattctggaaaaggagacacctgaaaacctgtctaacggcacatctagcaatgtggaggccgccaaacgtctggctaagcggttgtaccagctggatcgtttcaagcgtagcgatgtggccaaacatctgggcaagaataatgagttttcaaaattggtcgctgaagagtacctgaaattttttgatttcactgggatgactctggatcaaagcctacgatacttcttcaaagctttctctcttgttggtgagactcaggaacgtgagcgggtactgattcattttagtaatcgctatttctactgtaatcccgacacaatcgcttcacaggacggagtgcattgtctgacttgcgccatcatgttgttaaatacagatctgcacgggcacaatataggcaagaagatgacatgtcaagaatttattgcaaacctgcagggtgtgaacgagggagtcgatttcagcaaggatctactcaaagcattatacaattctattaagaacgagaagctggagtgggcagtggacgacgaggaaaaaaaaaagtccccttcagaaagcactgaggaaaaagccaatggtacccatccaaaaacaattagccgcatcggcagcacaaccaacccattcttagatatcccccacgaccctaacgccgctgtgtataaatccggctttctggctcgcaagatacatgccgacatggacgggaagaaaaccccccgcgggaagagaggttggaaaacattctatgcagttctaaagggcactgtcctttatctccagaaggacgagtacaaacccgaaaaagccctatcagaagaagacttgaaaaacgccgtgtcagtgcaccacgcactcgctagcaaggccacagactatgagaaaaaaccaaacgtgtttaaattgaagaccgctgactggagggttctgctgtttcagacgcagtccccagaagagatgcagggttggataaataagataaactgcgtagctgccgttttcagcgcccctcctttcccggctgcaataggcagtcagaaaaaattttccaggccactgttgcctgccacaactactaaactttcccaggaagagcagcttaaaagtcacgaatcaaaacttaaacagatcaccaccgagttagctgaacatcgaagctatccgcccgataaaaaggtgaaggccaaggacgttgacgagtacaagctgaaggatcactatctggagtttgagaagaccaggtatgagatgtatgtgtctattctcaaggaggggggcaaggagttactctcgaacgatgagtctgaggctgctgggctcaagaaatcacactcgtcaccctctttaaaccccgatacttcacctatcaccgccaaggtcaaaaggaacgtgtctgaaaggaaagaccaccgtcctgaaacccccagcattaagcagaaggtgacttag

SEQ ID NO: 199739 - DNA, 3144 bp, Artificial Sequence
  Description of Artificial Sequence: Synthetic coding sequence
atggagggccggagcgccgccgccgagaccttcgtgtgggtgaacaacgcaagcgctcactcccagtctgtggctaaggctaagtacgaattcctcttcgggagatccgagggcaaggccccagataccagcgatcatgggggttcaaccctgctgccacctaacgtaaccaatgagttccctgaatatgggacaatggaggaagggggagagggtctgcgcgcaagcctggagttcgacggggaagctcttccctgccacccccaagagcagcagggcgttcagccactcaccggttgccactctggcttagatagcgtaacagaggggcctaaggacgtgcgcgaagctcccagccaatcacatctgaaggagcaaagcctccagcccatcgattcattaatcagtgcgctgaaggcaaccgaggcgcgcattatcagtggtacccttcaggccaccaaagtgctagaccaggacgcagtgtcatctttttctgttcagcaggtagagaaggaactagatacagcgtcacgaaaaacacagcgggtaaataaaactctccctgcgggccaaaagaacctgcctgaaatcccactctcggcggaggtaacaacggaggagtcattctacctaagcattcagaaagacctgacggcactgcttactggggatacgcaggccgaaatatcgcagatcatgaacaatgggcgaaagggggcagtctgtgtgcaggagcccagctgcccgctggccagtttagggtcatctgcggtcacctgccattctgctggatctgtcgggttccttaaagaacaacgatctgccctgggacgtgagcaccctggtgggtgtgaccgctccagttctatgggtcgaccgggaagggtgaaacacgttgaatttcaaggtgtcgagatcttatggactgggggggataagagggagactcagcacccaatcgattttgagacatccctgcagaggactgccagtcctgactctaaagagtcctcaaaagtgccgcggcatctgatttcaagtgctgggctttgtaattcctcttcactgaccgagaacgtgtgggacgaatcttggaaggcccccagcgaacggcccggtacatcatctggtacctttagcccagtccgtcttgacgaatccggcgaagatgaggtttttctccaggagaacaaacagcacctggagaaaacccctaagcctgagcgcgatcgggaaagaatctcagagcaggaggagcatgtgaaaggagaggacgaggatatacttggacctgggtataccgaagattcaactgatgtgtactctagccagttcgagacaattttggacaacacgagtctgtattactctgccgaaagtttggagacactgtattccgagccagacagttacttctcgtttgagatgcccttgactcccatgatccagcaaagaatcaaggaaggtggccagttcctggagagaaccagcggaggtgggcaccaggacatactttccgtttcagccgatggcggtatcgtgatgggctattcttcgggcgtcaccaatgggttgaatgacgcaagtgattccatatacactaagggtacccccgagatcgctttctggggctcgaacgccggagtgaaaactactagattagaggctcattcagagatgggaagcacagagatcctcgagaaggaaaccccagaaaatctgagcaatggcacttcctctaacgtggaggccgctaaaagattagccaagaggctgtatcagctcgatagattcaaaaggtcagacgttgctaaacatcttggtaaaaataacgaatttagtaagctggttgccgaggaatatctgaagttttttgactttaccggtatgacactggaccagtcactcagatacttcttcaaggcattttccctggtgggtgaaacacaggagcgtgagagagtccttattcacttctccaatagatacttctactgcaatcccgataccatagctagccaggatggcgttcattgtcttacgtgtgccatcatgctgttaaacaccgatctacatggtcacaatatcggtaagaagatgacgtgccaggagtttattgctaatcttcagggagtgaatgagggagtcgatttcagtaaggatctccttaaggccctctataacagcattaaaaacgagaaactggaatgggccgtggacgacgaggagaagaaaaaatcccctagcgagagcaccgaagagaaggccaacggaacacatccaaaaaccattagcaggataggcagtacaaccaatcccttcctagacatcccccatgatccgaatgcagctgtgtataagagcggcttcctcgcccgcaagattcatgccgacatggacgggaagaagaccccccgtggcaaacgtgggtggaagactttctacgccgttttgaagggtacagttctgtacctgcaaaaggatgaatacaagcctgagaaggccctctcagaagaagatctgaagaatgccgtatctgtccatcacgcactggcgtctaaggccacagactacgagaaaaagcctaatgtatttaagcttaaaacagcagattggcgcgtgctcttatttcagacccagtcgccggaggaaatgcaaggctggattaataagattaactgtgtggcagctgtattcagcgcacctccgttccccgcagcaattggcagtcaaaagaaattctcacgccctctcctgccagccactaccacgaaactatcccaggaggagcagcttaagagccacgaatcgaaactgaaacagataaccaccgaattagcagagcacaggtcctatcctcctgataagaaggtcaaagctaaagacgtagacgagtacaagttaaaggaccattatctggaatttgagaagacccgctacgagatgtatgtatctatactgaaggaaggcggcaaagagctgctgagtaacgacgaaagtgaggccgccgggcttaagaagtcccattcctctccaagcctcaatccagatacatcccccataactgccaaggtcaagaggaacgtgagcgaacggaaggatcacaggcccgaaactccttcaattaagcagaaggtaacatag

SEQ ID NO: 199740 - DNA, 810 bp, Artificial Sequence
  Description of Artificial Sequence: Synthetic coding sequence
atgatcggcgtgaacagcgtgcagagcgccagcaaggtgcgggtgagaacatctggcagcgtaaagtattcgcgcgaggactcaatacggcgtcagagtcaccggtcgaaatccatgaagatatctaatagcagcgaattctccgccaaagagaacaaggctctgtataatagcatcaagaatgagaagcttgaatgggccgtggacgacgaagagaagaaaaagtcaccttcagaatctacagaagagaaggctaatggaacccatcctaagactatctcacgcataggttccaccacaaacccgtttctggatattcctcatgacccaaacgcggctgtgtacaagtccggattcctcgcaaggaagattcacgccgatatggacggtaagaaaacacctaggggcaaaagaggttggaagacattctacgctgtcctcaagggtacggtactgtacttacagaagcacgagagcaaactaaagcaaatcacaactgagctggccgagcatagaagttatccgccggacaagaaggttaaggctaaggacgtggatgaatataagttgaaagaccactacctggagttcgagaaaacccgctatgagatgtatgtttccattctaaaggagggtggaaaggagttgctttctaacgacgagtccgaggccgccggattaaagaaatcacattctagcccatcactgaatcccgatacgagcccaattactgcaaaagtcaagcgcaacgtgagcgagcgaaaagatcaccgaccagagactccgtcaatcaaacaaaaggttacatag

SEQ ID NO: 199741 - DNA, 3150 bp, Artificial Sequence
  Description of Artificial Sequence: Synthetic coding sequence
atggagggccggagcgccgccgccgagaccttcgtgtgggtgaacaacgcatcagcacattctcagagcgtggcaaaggccaagtacgagttcctctttggaagatcagaaggaaaagctcccgacacatcagatcatggagggtccaccctcctgcccccgaatgtgacaaacgaattccctgagtatggcactatggaggagggaggcgaaggcctacgcgcttcactggaattcgatggcgaggcattgccttgccatcctcaggaacaacagggcgtgcagcctttgaccggatgccatagcggactcgattccgtcacggaaggacctaaagatgtgagagaggctccctctcagagccatctcaaggaacagtccctccagcccatcgatagtctaatttcagccttaaaggctactgaggcccggattattagcggtaccctgcaagctacaaaagtccttgaccaggatgcagtatcgtctttctccgtgcagcaggtcgagaaagaattggatacagcgagtcgtaagactcagcgggtgaacaaaacacttccagcgggccaaaagaatctccctgagatccccctgagtgctgaagtgacaaccgaggaaagtttctatcttagcatccagaaggacctgacagcccttctgaccggcgacacacaggccgaaatctcacaaatcatgaataatgggaggaaaggggcggtttgtgtgcaggagcccagctgtcctttggcctcccttggctctagcgctgtcacgtgtcattcagctggttctgtcggatttctaaaagaacagaggtctgcgcttggtcgagaacaccctggaggatgcgacagaagttcctctatggggcggcctgggcgggtgaaacacgtagagtttcagggagtggagattttgtggacaggtggcgataaaagagagacccagcacccaatcgacttcgagacaagtctccaacggaccgctagccctgattccaaagagtcatctaaagtgcctcgccacttgatctcgtcggccggtctctgtaactcttccagcctcactgaaaacgtgtgggacgagtcctggaaggctccttcagagagaccaggcacctcctccggcaccttcagtcccgtgcgcctggacgaatctggcgaagacgaagtgttccttcaggaaaacaaacaacacctcgagaagacacctaaacctgaaagagatagagagcgtatctccgagcaggaggagcatgtgaaaggtgaagatgaggatattttggggccggggtacactgaggattctacggatgtgtattcaagtcagtttgagactatactggacaatacgagtctgtattacagcgccgagtcactggagaccctctacagcgaaccagatagctattttagctttgaaatgccacttacacccatgattcagcagaggattaaggagggtggacagttcctggagcgaacctccgggggagggcaccaagatatcctcagtgtgtcggccgacgggggtatcgtgatgggctacagttcaggtgtgactaatggcctgaacgatgcaagtgattcaatatacacgaaaggcacacctgagatcgcattctggggttccaacgcaggggtgaagacgaccagacttgaggctcacagcgagatgggctccacggagatacttgagaaggaaacccctgaaaatctatccaatggcacctcgagcaacgtcgaggcagctaagcgtctggcgaaaaggctgtaccaactggatcgtttcaagagatctgatgtggctaagcacctgggcaaaaataatgagttttccaagttggttgcagaggaatatctgaagttttttgactttaccgggatgactctcgaccagagcttacgatacttctttaaagccttttcgctcgtgggcgagacccaggagcgtgaacgggtactgatccattttagtaatcggtacttttactgtaaccccgatacaatagctagccaagatggggtgcactgtctgacctgcgccatcatgctgttgaacactgacttgcatggtcatgtgtcgaacatcgggaagaagatgacatgccaggagtttatagcgaaccttcagggcgttaacgagggtgtggatttcagtaaggacctgctaaaggcgctctataatagtattaaaaacgaaaaactggaatgggcagtcgacgacgaagagaaaaagaaaagtcccagcgaaagcacagaggagaaggccaatgggacccatcccaaaacgatatctagaatcgggagcaccacaaaccctttccttgacataccccatgacccaaatgccgccgtgtacaaatctggttttcttgcacgcaagatccacgctgatatggatgggaaaaagacacctaggggtaaacgcggctggaaaacattttacgccgttctcaaggggactgtgctttatttgcagaaagatgaatacaagccagaaaaggccctgagcgaagaagacctgaagaacgccgttagcgtacaccacgctctggcaagtaaggctacagactatgagaaaaagccgaacgtctttaagttgaagaccgcggactggagagtcctcctgtttcagacacagagtccagaggaaatgcaggggtggataaataaaattaattgtgtcgccgccgtattcagtgctccccctttccccgctgccatagggtcacagaagaaattctctcgccccctgttgcccgcgacaaccacaaaactaagccaggaggaacagctgaaaagccatgaatctaaattaaaacaaatcactacagagttggctgagcaccgatcctaccccccggataagaaggtgaaggcaaaggacgtcgacgaatataagctgaaagatcactatctggagtttgagaagactcgatacgagatgtacgtgtctatccttaaggaaggagggaaagaacttctcagcaacgatgagagtgaagcagccggactgaagaaatcccatagcagcccctcactgaaccctgatacatcccccatcaccgccaaagttaaacggaacgtgtccgagagaaaggatcaccgacctgaaacacctagcatcaaacagaaggtgacatag

SEQ ID NO: 199742 - DNA, 3171 bp, Artificial Sequence
  Description of Artificial Sequence: Synthetic coding sequence
atgatgggcgactaccggctgcccgaccacccccagcccatggagatcctgaatctttacctgggagactccctggagccacacccaggcgagtgtcctcgcgagacctgctcacacgaggaccctccagagccctttgaagagcagacctgggctacagatcctcctgagccgactcggcagaatgtgccaccttggggcagcggtgttgagctgacacacctggggtcatgggtccatcaggatggactggaaccgtgtcaagaacagacaagggccaccgaccctcctgagagcaccaggcaagacgctcccccatggggctcgggcgtagagctgacgcatttgggatcccccagcgctcaaagggaacataggcagaatacggcatcacccgggagcccagtcaacagtcacctgccagggagccccaaacaaaataggtcgacatcaactcaggttgtgttttgggcgggcattctgcaagcccagatgtgcgtactggacctggaagaggaattggagaaaaccgaagggttgaaggccggtctgaaatgctgtcttcctactccgcccgtggatttacctggcgatacgggactgcactcaagcccccccgagaatgaagattcaggggaagattcgtcggagccggagggtgaaggccaagcttggcttcgcgagggaacaccagattcctcaccccaatggggagcagaggaggaatcaatgtttttctccaatccactatttctcgcctcaccttgttccgagaatagtgcatccggagaatgctttagctggggtgccagcgattcgcacgccggcgtccgcacaggccctgaatctcctgccacactagagcctccacttcctgaggacactgtgctgtgggaactggaatccgaacctgatctgggcgatggggccgctataagtgggcactgtaccccaccatttcccgtgcccatttacaaaccacactctatttgctgggctagcgtggccgccgcagaaggggctcccgccgccccgccaggtcatggagaaagcgagggagaccgactcgggccagccccgagtgcagcaccatgcgtcgatgaagctcttacatgggagagcggctgtgtggggtctgatttagggcctgccgcccaccctgttcagccctgggcatctttaagccctgagggttggcagcgcggcggtcctttttggccccaggtcacattaaattcacaagatagagacgaacgcgagggtggtcacccgcaggaatcactgccttgcacactggcaccatgtccatggcgcagtccggcctcttcacctgaaccttcatcccccgagagcgaatccagaggacccggcccacgcccttcgccagcgtcctctcaagaaggatcccctcagctccaacaccattcgtccggaatcctccccaagtggaccctcgatgctagtcagtcgtctttattagagactgatggcgagcagccatcatccttaaagaagaaagaggctggagaagctccaaaaccaggcgaagaagtaaagagtgaaggcactgcccggccagcggagactggcgacgtgcagcctgatattcacctcacatcggcagaacacgagaacctgagaacacctatgaactcttcctggctgcccggatctcctatgcctcaggcccagagcccagaagaaggtcaaaggccccctgcaggagacaagctcgctaatggcgttaggaataacaaggttgcttggaatttagccagtaggctgtaccggttggaaggcttcaggaaatccgaggttgctgcctaccttcagaagaacaatgatttctcccgggccgtcgcagaggaatatcttagcttcttccaatttggaggccaaagtctcgaccgggccctgagaagtttcttacaggctctggttttgagtggcgagacccaggaaagagagcggattttatatcagttcagccggcggttccatcactgtaaccccggcatcttcccgtctgtggactccgtccacaccctgacctgcgccattatgctgttgaatactgacctccacggtcaaaacatcggaaagagcatgtcctgtcaggaattcatcaccaacctgaacggactgcgcgacggggggaattttcccaaggagctgctcaaagcactctactggagcattcggagtgaaaagctggaatgggccgttgacgaggaggatacggctcggccagagaaggcccaaccgagtcttccagccgggaaaatgtcaaagcccttcttacagctagcccaggatccaaccgtcccaacctacaaacagggcattctggccagaaagatgcaccaagatgccgacggaaagaaaactccttggggcaaacgcggatggaagatgttccatacccttctgagaggtatggtcctctacttcctgaaacagggtgaggatcactgcctggagggggagtccctggtgggccaaatggtggacgaaccagtgggcgtccatcatagtcttgcgactcctgctacacactacaccaagaagccccacgtgttccaattgagaacagccgattggcgcctgtacctctttcaggctcctaccgccaaggaaatgtcaagttggattgcaaggattaatctggcggctgccacccacagcgctccaccgtttcccgctgcggtgggttctcaacggcggttcgtaagacctatcctaccagttggaccagcacagagctccctcgaggaacagcatcggagtcacgagaactgtctcgatgcggcggcagatgaccttctggatttgcagcggaacctgcccgaacgtcgaggcaggggtcgcgagctggaggagcacaggctgcgaaaggaatatctggagtatgagaagactcgctatgagacgtatgttcaactgttagtggcgagactccattgcccgtctgatgccttagacctttgggaagagcagctcggtcgagaggctggaggtactagagagcctaaactgagcttaaagaagtcccacagcagcccttctttgcaccaggatgaagccccaacaactgccaaagtgaagagaaacatctctgaaaggcgaacttacaggaagatcattcctaagaggaacagaaaccaactatag

SEQ ID NO: 199743 - DNA, 1152 bp, Artificial Sequence
  Description of Artificial Sequence: Synthetic coding sequence
atgccctacgtggaccggcagaaccggatctgcggcttcctggacatagaagaaaatgaaaactccggaaagttcctccgacgttatttcattctggataccagagaggactcattcgtgtggtacatggacaacccccagaatctcccatcaggcagcagtcgtgtaggagctatcaaactaacttacatctctaaggtcagcgacgccacgaagctgcgaccaaaagccgagttctgcttcgtcatgaacgcagggatgcgcaagtacttcctgcaagctaatgatcagcaggatctggtcgaatgggtcaatgtgctgaacaaggctattaaaattactgtgcccaagcaatctgattcacaaccgaactccgataacttatctcggcacggtgagtgtggaaaaaagcaggtgtcgtaccgaaccgatatcgttgggggcgtgcccatcattacccccacccagaaggaagaggtaaatgagtgcggggaatcaatcgatagaaacaatctcaaacgctcacagtcccatctgccttactttacccccaaacctccacaggacagcgccgtgatcaaggctggatactgtgtcaagcaaggtgccgtgatgaaaaattggaagcgtagatacttccagctagatgagaacactatcggatactttaaaagtgagctcgagaaagagcctctaagggtgatcccacttaaagaagtccataaggttcaggagtgcaagcagtctgatatcatgatgcgggataacctgttcgagatcgtgaccacaagcaggaccttttatgtgcaggccgacagtcctgaggagatgcattcttggattaaagccgtttccggcgctatcgtcgctcagcggggcccaggccgtagtgcttcgtctatgcgccaggccagacgactatcaaacccctgcatccagcgctccattcctccagtactgcagaatccaaacactttatcagtgcttcctacacagcccccgcctcctcacattcctcagccgttagctgccaccctctggtctcagccattaccatggcggtcggaggatttcacgtctctgctgccacgatcttcccaaggcacatcacggagcaggctttcattgcaggaaaaccagctcccgaagtag

SEQ ID NO: 199744 - DNA, 1152 bp, Artificial Sequence
  Description of Artificial Sequence: Synthetic coding sequence
atgccctacgtggaccggcagaaccggatctgcggcttcctggacatcgaagagaatgagaatagcggaaaattcctaaggcggtatttcatactagacactagagaggattcattcgtctggtatatggacaatcctcagaatctgccctccggctcttcaagggtcggcgccattaagcttacctatatttcaaaagtgtctgacgccacaaagcttagacccaaggctgaattctgtttcgtgatgaacgctgggatgagaaaatactttctccaggctaacgaccagcaggatttagtcgagtgggtcaacgtgttaaataaggctattaagattaccgtcccaaagcagagtgatagtcagcctaattctgacaacctgtcccggcacggtgagtgcggtaagaaacaggtatcatataggaccgatatcgtgggtggcgtccctatcattacacccacacaaaaggaggaagtaaatgaatgtggcgagtctatcgatcgaaataatcttaaacggagccagtcgcatctaccatattttacaccaaagccaccccaggactcggccgtcattaaagctggatattgcgtgaaacagggcgccgtgatgaagaattggaaacgccggtatttccagctggacgagaataccatcggatacttcaaatcagaactggagaaagagccactgagagtcatcccacttaaggaggtgcataaggtccaggagtgcaagcagtccgatataatgatgcgtgataatttgttcgagatcgtcacgactagcagaacattctacgtccaagcggactcaccggaggaaatgcacagttggatcaaggccgtcagtggcgcaatcgtcgcgcagcggggccccggcagaagcgcatctagcatgaggcaagctcgacgcctcagcaacccatgtattcagaggagcattccgccagtgctccaaaaccccaatacactcagcgttctgccaactcagccacctcctccacatataccccaaccactggctgccacactgtggagtcagcctttaccctggaggagcgaggactttacctctcttctccctcgatcctcacagggcacctcgcgctctcgtctgtctctccaggagaatcagcttcctaagtag

SEQ ID NO: 199745 - DNA, 1215 bp, Artificial Sequence
  Description of Artificial Sequence: Synthetic coding sequence
atgccctacgtggaccggcagaaccggatctgcggcttcctggacattgaggagaatgagaactctgggaagtttctgagacggtactttatactggacacccgagaagattcatttgtgtggtacatggataatccccagaacttgcctagcgggtctagccgggtgggagccatcaaactaacatatatctctaaggtatccgacgccaccaagctgcggcctaaggcagagttttgtttcgtcatgaatgcggggatgagaaagtatttccttcaagctaacgaccagcaagaccttgttgaatgggtgaacgtgttgaataaagccatcaagatcacggtgccgaaacaaagcgacagtcagccaaacagcgataacttgagcagacacggcgagtgtggcaagaagcaagtaagctaccgcaccgacatagtaggcggcgtacccatcatcactcccactcagaaggaggaggtaaacgagtgtggggagtctattgataggaataacctgaaacggtcccagtctcatcttccatactttacacctaagccaccgcaggacagcgccgtgattaaggcggggtattgcgttaagcagggtgcagtgatgaagaactggaagcgtcggtacttccagctggatgaaaacactatcggatacttcaaaagcgagttggaaaaggaaccactccgcgttattccgcttaaggaagttcacaaggtccaagaatgcaagcagtctgatattatgatgcgggacaacctctttgaaatcgtgaccacatccaggaccttttacgtgcaggctgattcgcctgaggagatgcattcttggatcaaggcagtcagtggagccatagttgcgcagcgcggcccaggcaggagtgcgtcatctgaacatccacccggaccatccgaatctaaacatgccttccgcccaactaatgccgccacggcgacttcacattccacagccagcaggtcaaactcactggttagtacatttactatggagaaaagaggcttctacgagagccttgccaaggtaaaacccggcaactttaaagtgcagaccgtatctcctcgagagcccgcctccaaagtaactgagcaagctcttctcaggcctcagtcgaagaacgggcctcaagaaaaggactgtgacctggtcgatttggatgatgcatcattgccggtctcggacgtttag

SEQ ID NO: 199746 - DNA, 345 bp, Artificial Sequence
  Description of Artificial Sequence: Synthetic coding sequence
atgccctacgtggaccggcagaaccggatctgcggcttcctggacattgaagaaaacgagaactccggaaaattcttgcgaagatattttatcctggatacacgcgaagactcgttcgtttggtacatggacaacccgcagaaccttccaagcggatcttcccgggtaggcgccatcaaacttacttacatttcaaaggtcagtgatgcaaccaagctgaggcccaaagcagaattttgttttgtaatgaacgctggaatgagaaagtactttttgcaggctaatgatcagcaggaccttgtcgaatgggtgaatgtgctaaataaggccataaagatcacatag

SEQ ID NO: 199747 - DNA, 1215 bp, Artificial Sequence
  Description of Artificial Sequence: Synthetic coding sequence
atgccctacgtggaccggcagaaccggatctgcggcttcctggacatcgaggaaaacgaaaatagcggtaaatttctgcggcgttacttcattctggacacaagggaggatagctttgtgtggtatatggataatccacagaaccttccttctggttcatccagagttggcgctattaagcttacgtatatttctaaagtctctgacgccaccaagctccggccaaaagccgagttctgttttgtgatgaacgccgggatgcggaaatatttcttgcaggcaaacgatcagcaagacctggtggagtgggtgaatgtgctgaacaaagccatcaagatcacagttccaaagcagtccgattcccagccaaattccgataatctgagtcggcatggagaatgtggcaagaaacaggtatcatatcgaacagacattgtgggaggcgtgccaattattacccccactcaaaaggaggaagttaacgaatgcggggagagcattgaccggaacaatctgaagcgctctcagtcacatttaccctacttcactcccaagcctcctcaggattcagccgtgattaaagcgggctattgcgttaagcagggcgctgtaatgaaaaattggaaaagacggtattttcagcttgatgagaacactatcggctattttaaaagcgaactggagaaagagccgttgcgggttattcccctgaaagaagtgcacaaagtgcaagagtgcaaacaatcagacatcatgatgcgggataatctgtttgagattgtgactacctctcggacgttttacgttcaggcggactcaccagaagaaatgcactcctggatcaaggctgtgtcaggagccatagtcgcacagcggggccctgggaggtctgcgagctccgagcatccacccggcccgtccgaatctaagcatgcttttaggcctactaatgctgcaactgcgacatctcacagcacagcaagcagatccaattctctcgtttccacctttacgatggaaaagcggggattttacgaaagtctagcaaaggtcaaacccggaaactttaaagtccagactgtgagcccacgtgaacccgccagtaaagtcacagaacaggctcttctccgacctcagtctaagaacggtccacaggaaaaagattgcgacttggtggatcttgacgacgctagcttacccgtaagcgatgtgtag

SEQ ID NO: 199748 - DNA, 1215 bp, Artificial Sequence
  Description of Artificial Sequence: Synthetic coding sequence
atgccctacgtggaccggcagaaccggatctgcggcttcctggacatcgaagagaatgaaaattcggggaaattcctccgtagatacttcatcttggataccagagaggattccttcgtgtggtatatggataatcctcagaacctcccctccgggagttctcgtgtgggagccattaagctcacctacattagcaaggtgtccgacgctaccaaactaaggccaaaggctgagttttgttttgtaatgaacgccggaatgcgaaagtactttttacaggcgaatgatcagcaggacctagtggaatgggtcaatgtgctgaataaagcaattaagatcacagttccaaagcagtctgattctcagccgaacagcgacaacctcagccgccacggtgaatgcggaaagaagcaagtgagttataggacagatattgtgggtggagtgccaatcattacacccacacagaaggaagaggtgaacgaatgtggggagagcattgacagaaacaacctgaagcgtagccagagccatttgccctattttactccaaaaccaccccaagattctgccgtcataaaggctggatattgtgtgaaacaaggggctgtgatgaagaactggaagaggagatacttccaattagatgagaatacgatcggatattttaaaagtgaattggagaaagagccccttagagtaataccactgaaagaagtccataaggtccaggagtgcaagcagtccgatattatgatgagggataacctgttcgaaattgtgacaacatcgagaaccttctacgtgcaggccgactctcccgaggagatgcatagttggatcaaagcagtctctggcgccatcgtggctcagcgcggccctggcagaagtgcgtcatctgagcacccgcccggtcccagtgagtccaaacacgcatttcggcctaccaacgctgcaacagccactagtcactcgactgcatcccgaagtaactctcttgtatcaactttcaccatggaaaaacgcgggttttacgaaagtttggcaaaggtgaaacccggcaacttcaaggttcagacagtgtcgccccgggagcctgcctcgaaggtcaccgagcaagcgcttctgaggccacagagcaagaacggtccacaggagaaggactgcgatcttgtcgacctggatgatgcatctttacccgtgtcagatgtgtag

SEQ ID NO: 199749 - DNA, 1005 bp, Artificial Sequence
  Description of Artificial Sequence: Synthetic coding sequence
atgccctacgtggaccggcagaaccggatctgcggcttcctggacatcgaggagaacgaaaactctggaaaattccttcgtcggtatttcattcttgatacccgggaagacagttttgtgtggtacatggacaatccccagaacctccctagcggctctagccgggttggagccattaagttaacctacattagcaaggtatccgacgccacgaagctgaggcctaaggcggagttttgtttcgtaatgaatgcagggatgagaaaatatttcttgcaagccaatgatcagcaggacctggtagagtgggtcaatgtgctcaataaggcaatcaagatcactgtgcccaagcagtcagattcgcaacccaattcggacaatttgagccgacacggcgagtgcggcaaaaagcaggtgagttaccgaacagacatagtcgggggggttcccattatcacaccaactcagaaggaagaggtcaacgaatgtggagaaagcatcgaccggaacaatcttaagcgatcccagtctcacctgccgtattttaccccgaagccaccccaggactccgcagtaattaaagctggctactgtgtgaaacagggtgctgtgatgaaaaactggaaacgacgctactttcagctggatgaaaacacaatcgggtactttaaatctgagttagaaaaggagccattgcgcgttattccattgaaggaggtgcacaaagtccaggagtgtaaacaaagcgatataatgatgcgagacaatttatttgagatcgtgactacgtcgcggaccttttacgtacaggctgactcaccagaggaaatgcactcttggatcaaggccgtatccggcgctatcgtagcgcagaggggtcctggcagaagcgcgtctagcatgcgccaggctcggagattgtccaatccctgtatacagcgctacaccagcagagcaggagaatgcagcacatatgtgggaagccacgctaatgtcccttcctag

SEQ ID NO: 199750 - DNA, 1278 bp, Artificial Sequence
  Description of Artificial Sequence: Synthetic coding sequence
atgccctacgtggaccggcagaaccggatctgcggcttcctggacatcgaggaacatgagaactcgggcaaattcctgagaagatacttcatccttgatacgcaagccaactgccttctttggtatatggataacccacagaacctggccatgggagccggtgctgttggggctctgcagttgacgtacatttccaaagtctctatcgccactccaaaacagaaacctaagactccgttctgctttgtcataaatgcacttagtcagcggtatttcctgcaggcaaatgaccagaaagacatgaaggattgggtcgaggcgcttaaccaggcatccaaaatcaccgtgcccaaaggcggtggcctcccaatgacaaccgaggtccttaaatcattggcagccccccccgcgctggagaagaagccccaggtagcctataaaactgaaatcattggcggggttgtggtgcacactcctatcagccaaaacggcggggatgggcaggaaggttctgagccaggaagccacactatcttgagacggtcccagtcttatattccaactagtgggtgtagggcgagcacgggccctcctcttattaagagcgggtactgtgtgaagcagggtaatgttcgcaagtcctggaaacgcagatttttcgcattggatgattttacgatttgctactttaagtgtgagcaggaccgggagcccctccgcacaatctttctcaaagacgtgttaaagacacatgagtgcctggtcaaaagtggtgacctcctcatgcgcgataacctgtttgaaatcatcaccagcagtagaaccttctatgtccaggcagactctcccgaagacatgcatagctggataaaggaaattggggccgccgtccaggccctgaaatgccatccacgggaaacctcattcagccggtccattagtctgactcgaccagggagctcatccctgagtagtggccccaactcaatactgtgtcgagggcgcccaccactagaggagaagaaggctttgtgcaaagcacctagcgtggcttcaagctggcagccctggacccctgtgccccaggccggcgagaagctcctgccacccggggacacaagcgaggattctttgtttactccacgcccgggtgaaggcagtgccccgggggtcctccccagcagcaggatccggcaccgcagtgagccacagcacccaaaagagaagccattcatgttcaacttagacgacgagaacattagaacgtccgatgtctag

SEQ ID NO: 199751 - DNA, 348 bp, Artificial Sequence
  Description of Artificial Sequence: Synthetic coding sequence
atgccctacgtggaccggcagaaccggatctgcggcttcctggacattgaggagcatgaaaacagcgggaagtttctgcggcgatactttatcttggatactcaggctaactgtctcctatggtatatggacaaccctcagaatctggcaatgggggctggtgccgtaggcgccctccagttgacctacatatcaaaagtcagtatagcaacccctaagcagaaaccaaaaactccattctgtttcgtgatcaacgctctctcacagcggtactttctgcaagccaacgatcagaaagacatgaaggactgggtagaagcactaaaccaggcatccaaaatcacctag

SEQ ID NO: 199752 - DNA, 1128 bp, Artificial Sequence
  Description of Artificial Sequence: Synthetic coding sequence
atgggcgccggcgccgtgggcgccctgcagctgacctacatcagcaaagtgtccatcgcaacaccaaagcagaaaccaaaaacccctttctgcttcgtcattaatgcactctcccaaagatactttttgcaagcaaacgatcagaaggacatgaaagattgggtggaggcactgaatcaggctagtaagatcaccgtcccaaagggcggaggtctgcctatgaccactgaggtgcttaagtccctggccgcacctccagcactggaaaagaagcctcaggttgcttacaagacggaaatcattggcggtgtcgtcgtgcacacaccaattagccagaatgggggggatggccaggagggaagcgagcctggatcccataccattctccgaaggtctcaaagttacattcctacaagtggctgccgagctagcactgggccccctttgatcaaatctggctattgcgtcaaacaggggaacgtacgcaagagttggaaaaggagattcttcgcactcgatgattttacaatatgctatttcaaatgcgaacaggacagagaacctctgaggacaatctttctgaaggacgtgctgaaaactcatgaatgcttagtgaagagcggcgacctgctcatgcgtgataatttattcgagattatcaccagctccagaacattttatgtgcaggctgattcccccgaagatatgcactcttggatcaaggaaattggagcagccgttcaggctctgaaatgtcatccacgggaaacaagtttcagcagaagtatttctctgaccaggcccgggagctcatctctcagcagcggccctaattctattctatgccgagggcgcccgcctcttgaggagaaaaaagctctctgcaaagccccctccgtggccagctcctggcagccctggacaccagtgcctcaggccggcgaaaagctacttcctcccggtgacacgagtgaagactccctgttcacccctaggcctggggaggggagcgctcctggtgtgttaccaagttctaggatcaggcaccgatcggagccacagcaccctaaggagaaaccttttatgtttaacttggacgatgaaaatattcgcacatccgacgtatag

SEQ ID NO: 199753 - DNA, 4083 bp, Artificial Sequence
  Description of Artificial Sequence: Synthetic coding sequence
atgagccggcagagcaccctgtacagcttcttccccaagagccccgccttgtctgacgcaaataaggcctcagctagggcttctagggaaggcggcagggctgcagcggcccctggcgcgtctccttctccgggtggggatgcagcttggtccgaggccgggccgggcccgaggccattggcacgctccgcttcccctcccaaagccaagaatctcaatggtggtctgcgcaggagtgtcgcccccgctgctcccacctcttgcgatttctctcctggagatttggtttgggccaagatggagggttacccctggtggccctgcctggtttataatcacccattcgacggcacctttatcagggagaagggcaagtctgtgagagtgcacgtgcaatttttcgatgactctcctacacggggttgggtgtccaaaagactgctcaaaccgtatacagggagtaaatccaaagaggctcaaaagggcggccatttttatagcgccaagccagaaattcttcgcgctatgcagagggcagacgaggcgctgaacaaagataagataaagaggctcgaactggcagtgtgtgatgagcccagcgaacctgaggaggaggaggaaatggaagtggggacaacctatgtcactgacaaatccgaggaagacaatgaaatcgagtcagaagaggaggttcagcccaaaacacagggcagtcggcgatcgtctcggcaaattaagaaaagacgagtgatctcagactcggaatccgatatcggcggatccgacgtggaattcaaaccagatactaaggaagagggctctagcgatgagatcagcagtggcgtgggtgacagcgagtctgagggtctcaactccccagtgaaggtggcacgtaaacgcaaaagaatggttaccggtaatggatcattgaagaggaagagcagccgcaaagagacccccagcgcgacaaaacaggccaccagcatatcttccgaaactaagaacaccctaagagcattcagcgcccctcaaaattctgaatcccaggctcacgttagtggcggtggcgacgactccagtcgcccaaccgtgtggtatcacgagactctcgaatggctaaaggaggaaaagcggcgagatgagcatcgccgccgccccgaccacccagacttcgatgccagtacgctgtatgtgcccgaggacttcctgaattcatgtacccccggcatgcgaaaatggtggcagattaagtctcagaatttcgacctggtgatatgctataaagtgggcaagttttatgaactgtaccacatggatgccctgattggggtgtcggagttaggtctcgtgttcatgaagggtaattgggcacattccggatttcccgagatcgccttcggccgctatagcgactcccttgtccaaaagggatacaaagttgcgagggtcgaacaaaccgagaccccggaaatgatggaagcccgctgccgcaagatggcccacatcagcaagtacgatcgcgttgtaaggagagagatttgcagaatcataacgaaaggaacgcagacctactctgtcctagaaggtgacccttctgaaaattattcaaagtatctcctgtctctgaaggaaaaggaagaggatagcagtggccacactagagcttatggagtgtgctttgtcgatacctctctgggtaagtttttcataggacagttcagtgatgacaggcactgttcccggttcaggactcttgttgcccattatcccccagttcaagtgttatttgagaaagggaatctgtccaaggaaaccaaaaccatcctgaagtctagcctctcatgctccctccaggaaggattgataccggggtcacaattctgggatgcctccaagaccttgagaacgctgctcgaagaggaatatttccgagagaagttatctgatgggattggcgttatgttaccccaggtgctgaaggggatgacaagcgagtcagatagtattggcctgacccccggggagaagtctgagctggcccttagcgctctgggggggtgtgtattttatctcaaaaagtgccttatagatcaggaactcctgtcaatggcgaactttgaggaatacataccactggatagtgatacagtctccaccacacgcagcggagcaattttcacaaaggcctatcagagaatggtgcttgacgccgtcaccctgaataatttagaaatctttctaaatggcacaaatggttctactgaaggaactctcctcgagcgggtggatacttgccacacaccattcggaaagcgccttttgaagcagtggttgtgcgcacctctttgcaatcactacgccatcaacgaccgcttagatgcaatcgaagacctgatggtggtgcccgacaagatcagcgaggtcgtcgaactgttgaagaaactgcctgatcttgagaggctcctcagcaagatacacaatgtgggctccccacttaagagccaaaatcatcccgactctcgagccattatgtacgaggagacaacctactcaaagaaaaaaattattgacttcctgagcgcactcgaaggcttcaaagtgatgtgcaaaatcattgggattatggaggaggttgctgacggattcaagagcaagatcttaaagcaagtgatcagtcttcagaccaaaaaccccgaaggccgatttcccgatcttacagttgagttaaaccgctgggatacggcatttgatcacgaaaaggctcgaaagactggccttatcacaccaaaggctgggttcgattctgattatgatcaagcactagccgacattcgagaaaacgagcaatcacttcttgagtacctggaaaaacagagaaaccgcattggttgtaggactatcgtgtactggggaatcggcaggaaccggtatcagctggagattccagagaatttcacaacacggaacctccctgaggaatatgaattgaaaagcaccaagaaaggctgtaaacgctactggacaaagactattgagaagaagttagctaacctgataaatgcggaagaaaggagagacgtgtccttgaaagactgcatgcgcagactgttctacaattttgataaaaactacaaagactggcagtcagctgtcgagtgtatagccgtgctggatgtgctgctttgcctggccaactattcacggggaggcgatggcccaatgtgccggcccgtgatactgcttcctgaggacactcccccgtttcttgaacttaaaggcagtcgccacccgtgtatcaccaagacattttttggggacgacttcattcccaacgacattctgattggctgtgaagaagaggagcaagaaaatgggaaggcctattgtgttctcgtaaccggcccaaacatgggggggaagtccaccctgatgcgacaggccggcctgctggcagtgatggcccagatgggctgctacgtccctgcggaagtgtgccggttaactcccattgaccgggtgtttactagactcggagcgtcggatcggatcatgtctggagagtcgacattctttgtggaactgtccgagactgctagcattttaatgcacgccaccgcccacagtctcgtcttggtcgatgaactgggcagggggactgctactttcgacggaaccgcaattgccaacgctgtggtgaaggaactggctgagactataaagtgtcggacactgttttccacacactatcactccctcgtggaagattattcacagaacgtggctgtaagactgggccatatggcgtgcatggtcgaaaacgagtgcgaggacccaagtcaggaaaccatcactttcctgtacaaattcatcaaaggggcctgccctaagtcctacggctttaacgcggcccgtctggccaatttgccagaggaagtgattcagaagggacataggaaggcccgcgagtttgagaaaatgaaccagagcctcaggctttttcgggaggtctgtctggcctccgaacgatcaaccgttgacgcagaggccgtgcataaactccttacattaattaaggagctgtag

SEQ ID NO: 199754 - DNA, 2340 bp, Artificial Sequence
  Description of Artificial Sequence: Synthetic coding sequence
atggagggcagccggccccggagcagcctgagcctggccagcagcgcctccaccatcagctcgctctcatccctcagccctaagaaacctacacgggctgtgaataagattcatgcattcggaaaaagaggcaacgctttacgtagagaccctaaccttcccgtgcacattagggggtggctgcataaacaggacagcagtggtttgagactatggaaacggagatggtttgttctgtccggccactgtctgttctattataaggattcacgcgaggagtctgttctagggagcgtgctgcttccatcatacaatataaggccagacgggcctggagcacctaggggtaggcgttttactttcaccgccgaacatccaggtatgcggacatatgtgctggccgcagatactcttgaagatctccgggggtggctgagagccttgggtcgggcatcaagagccgagggggatgattatggacaacctagatctcctgccaggccacagccaggagagggacccggcgggcccgggggacccccggaggtcagtcggggagaggaagggcgcatctccgagtctcccgaggtcaccaggctctcacgcggccggggacggccccgcctgttgactccaagcccaaccacggatctgcactctggactccaaatgaggagagctaggtcgcccgaccttttcacccctctttcccggcctcctagccccctcagcctgccacgacctcgatctgcccccgcacggcgccctcctgccccaagtggagatacagctccccctgctcgaccgcacaccccattatctaggattgacgtacggccccctctcgactggggaccccagagacagaccctctctaggccacccactccacgcagaggaccaccttctgaggctggtggtggcaaaccaccccgcagcccacagcattggagtcaagaacctagaacccaggcacacagcggtagcccaacatacctccagctaccacctcgaccgcccggcacgcgcgcttctatggtgcttctacctggaccaccactggagagtacatttcaccagtctttagaaactgacacactactcacaaaattatgtggccaggatcgattactgcgtcggctccaggaagaaatagaccagaaacaggaggagaaggagcagctagaggctgcattggagctcacaaggcagcagttggggcaggccacaagagaagccggtgcaccgggaagagcctggggacggcagcgcttattacaggaccggctcgtgagtgtgagagctacactttgtcacttaacacaggaacgcgaaagagtctgggacacttattcaggactggagcaggaattaggtacactcagggagaccctagaatacctcttgcatcttggaagtccccaggatcgagtgtctgcccagcagcagctgtggatggttgaagacacccttgccggcctcgggggcccgcagaaacctcctccccatacggagcccgactctccctcccccgtactgcagggtgaggagtcctccgagcgggagtccttgcctgaaagtctggaactatcctccccacgcagccccgagactgactgggggcgccctccgggtggagataaggacctggcctccccgcacctgggcctggggagccccagagtctcaagggcgtcctcaccagaaggcaggcatctcccttccccgcaactcggcaccaaggcccccgtcgcacggccccggatgtccgcccaggagcagctggagcggatgcgacgtaatcaggagtgcggacgcccatttcccaggcctactagcccaaggctcctgacccttgggagaacgctgagtcctgcacgacgacagcccgatgtggagcagcggccagtcgtgggacactccggggcgcagaaatggctgaggtcaagcggatcctggtcctcaccacgcaatactaccccgtacctgccaacttctgaaggacacagggagcgcgtattaagcctttcccaggcactggccactgaagcctcccagtggcaccgtatgatgaccggcggcaatttggactctcaaggagaccctttgcccggggttcccctgcccccaagcgatcccactaggcaagaaaccccacccccccgaagccctccagtcgctaattcaggatctaccgggttttctcgaagaggctctgggagaggtgggggccccaccccttggggaccagcatgggacgccgggattgcacctcctgtcctgccccaggacgagggtgcatggcccttaagggtgaccttactccagagcagtttctag

SEQ ID NO: 199755 - DNA, 1752 bp, Artificial Sequence
  Description of Artificial Sequence: Synthetic coding sequence
atggagggcagccggccccggagcagcctgagcctggccagcagcgccagcacaataagcagcctgagctcgttgagccccaagaagccaacccgtgcggtcaacaagatacacgctttcggtaaacgcggcaatgctctccgccgggatcccaatttacccgtgcatattcgtggttggctgcataagcaggatagttccggtctgcgtctctggaagcggcgctggttcgtgctgagtggacattgtctgttctactacaaggacagccgcgaggagagtgttctgggaagcgtgctactgccatcgtataatatccgaccagacgggcctggcgctccccgcggaagacggttcacctttacagctgagcatcccgggatgcggacttacgttctcgccgctgacacactggaggacctccgaggttggctgcgcgctctgggacgtgcctcccgcgcagagggcgacgactacggacagcctagatctcccgcccggccacagcccggtgagggccccgggggccccgggggcccacccgaggtgtctaggggagaagagggacgcatctccgagagtcccgaggtgacaagattatcccgtgggcggggccgacctcgtctgctaacaccttcaccaaccacagacctccactccggtctgcagatgcgcagagctcgaagccccgatctctttactcctttatctcgccccccgtccccactgagccttccgcgcccgcggtctgcccccgcccggcgtccacctgctccaagcggtgacaccgccccaccagctcgcccccacacacctctgagccggattgacgtgcggccccctctggattgggggccgcaaagacagaccctctcccgccctccgacaccccgccgtggtcccccttcggaggcaggaggaggaaaaccacctaggtccccgcagcattggtcacaagaaccgcgaacccagccggggccccctctcgagtcaactttccaccaatctctggaaaccgacacgctgcttaccaaactgtgcggccaggatagactcttacgaaggctgcaggaagagatcgatcagaagcaggaggaaaaagagcagttagaagctgccctggagctcacccgacagcagcttggccaggctacaagggaggcgggagctccgggccgagcttggggacggcaaaggctactgcaggatcggttagtgagtgtgcgcgccaccctgtgccacttgacacaggagcgagaacgagtgtgggacacgtacagtgggctggagcaagaattgggcaccctgcgtgagactcttgagtatctcctccatctggggtctcctcaggatcgcgtttctgctcagcagcagctctggatggtggaggacactctggctggtctcggggggccccagaaacccccaccgcacaccgagccagactctcctagtcctgttctgcagggcgaagagtcatcggagcgtgagtccctcccagagtctctcgagctgtcctcaccccgctccccagaaactgattggggccgtccgccaggcggggacaaagacctggcttccccacatttggggctgggtagtcccagggtgtccagagccagttctccagaggggcgccatttaccttcaccccagctgggtacaaaatcaaaggagcaccatcctctcttagccgacttccgtagatctccaggcgctggatctcaacccctcccctccccagggtactag

SEQ ID NO: 199756 - DNA, 3366 bp, Artificial Sequence
  Description of Artificial Sequence: Synthetic coding sequence
atggccgccgccaccgtgggccgggacaccctgcccgagcactggtcctatggcgtatgtagagacggccgcgtctttttcattaacgatcagctccgctgtactacctggctgcaccccaggacaggcgagcctgtaaatagcggccacatgattcgctccgaccttccacgaggctgggaggaaggttttaccgaagagggggcaagctacttcatcgatcacaatcaacagaccactgcctttcgccaccctgttacagggcagttttctcctgaaaatagtgaatttatcctgcaggaagaacccaaccctcatatgtctaaacaagacagaaaccaacgaccaagctcgatggtgagcgagacttccactgctgggactgcgtcaactttagaagcaaaacctggcccgaaaataatcaagagctcttcgaaagttcattcctttggtaagcgggatcaggccatcagaaggaatccaaacgtgcccgtggtagtaagaggctggcttcacaaacaggactcgtctggtatgcgcctgtggaagaggcgatggttcgttttagcggactactgtctcttctattacaaggacagcagagaggaggcagtgctcggcagtatccccttgccatcttacgtgatctcccccgtggcccctgaagacaggatttcaagaaagtatagctttaaggccgtacacactggaatgagagcgttgatttataatagttccactgctggatcccaagccgagcagagtgggatgaggacatattattttagcgctgatacccaggaggacatgaatgcttgggtgcgagccatgaaccaggctgcacaagttctgtcacgttcttctctgaaacgggatatggagaaggttgagaggcaggccgtgccccaagccaatcacaccgagtcttgccacgagtgtggccgcgtcggccccggccacactcgggactgcccacatcgggggcatgacgatattgttaattttgagcgacaggagcaggagggcgagcagtacagatcacagcgtgatccgttagaaggtaagagggataggtcaaaagcgcgctcaccctactcccctgccgaagaggatgcgttgttcatggacctcccaactggacccagaggacagcaagcccagccccaaagagccgagaaaaacggaatgctgccggccagttatggcccgggtgagcagaacggaaccggcgggtatcagagagcattcccaccccgcaccaatcccgagaagcattcccaaaggaaatccaatctggcacaggtggagcattgggcacgagctcagaagggtgacagcaggtcgctaccactcgatcagactcttcctcgacaggggcccgggcagtccttatcctttccagagaattaccaaactctgcccaaatcaacacggcatcccagtggaggcagctctccaccacctcggaatctaccctcagattataagtatgcccaggacagggcatctcaccttaagatgtcatctgaagaacgtcgggcccacagggacggcacagtgtggcagctctatgaatggcagcagcggcagcagtttcgccacggctctccgaccgctcccatttgtctgggtagcccggagttcacagatcaggggcgaagcagaagtatgctggaggttccccgatccattagcgttccaccctcccctagcgatattcccccacctggaccccctagagttttcccccccagacgaccgcacacacccgccgaacgagttacagtgaaacctccagaccagaggcgctccgtggatatctcattaggcgactctccacggcgcgcaagaggtcatgccgtgaagaatagcagccatgttgacaggagatcgatgccttctatgggttacatgactcacaccgtgagcgccccatccctgcacggtaagtcagctgacgatacatacctccagttaaagaaggatctggagtacctggaccttaaaatgactggacgtgatcttctcaaggacaggtccctgaagcctgtcaaaatagccgaatctgatactgacgtgaaactttccatcttctgtgagcaggacagagtgcttcaggaccttgaagacaaaattcgggccttaaaagaaaacaaggatcaactggagtcagttctggaggtgctgcaccggcagatggagcaatatagagatcaacctcagcacctggagaaaattgcctaccagcaaaaactcctccaggaagacctcgtgcacatcagagcagagttatcgagggagagcacagagatggaaaatgcctggaatgagtatcttaagctggagaacgatgtagagcagctgaagcagaccctccaggaacagcatcgccgcgctttttttttccaggagaaatcacaaatccaaaaagatctatggagaatcgaggatgtgaccgctggactgtctgctaacaaggagaacttccgaatcctggtggaatcagtcaagaatcccgagagaaagactgtgccgttgttcccccacccgcctgtgcccagtttgagtaccagtgagtccaagcccccaccgcagcccagcccccctacctcacccgtgagaactcctctggaggtacggctattcccacagctgcagacatatgtcccataccggcctcacccccctcagctgaggaaggttacaagcccactccagtcccctacaaaagcaaaaccgaaagtggaagacgaggcaccccctcgcccccctctgcccgaactctactcccccgaagaccaaccccctgcggtcccaccactgcccagggaagcgacaattatcagacacacgtccgtacgtggcctgaaacgccaatcagatgaacggaaacgagacagagaactgggccaatgtgtgaacggggactctagagtcgagctgaggtcatacgtgagcgagcccgaacttgcaaccctgtccggagatatggctcagcccagcctgggattagtgggaccagagagcagatatcaaacactcccaggaaggggcctgagcgggagtacctcccgtttgcagcagtcgtccactatcgcaccctatgtgacgctgcgccgcggactgaatgccgagtctagcaaggcaactttcccgagacctaaatcggctctggagcgattgtattccggcgaccatcagcgcggcaaaatgagtgccgaggaacagctggagcgcatgaagcgtcatcagaaagccttagtgagggagcgaaaacgtaccctgggtcagggagagcggacgggccttcctagctcgagataccttagtcggcccctgccgggagacctggggagtgtgtgctag

SEQ ID NO: 199757 - DNA, 3369 bp, Artificial Sequence
  Description of Artificial Sequence: Synthetic coding sequence
atggccgccgccaccgtgggccgggacaccctgcccgagcactggtcttatggcgtgtgcagggatggacgcgtcttctttataaacgatcaattgaggtgcaccacctggcttcatccacggacaggggagcccgtgaatagcggccatatgatccgttcggacctcccccgcgggtgggaggaggggttcaccgaggaaggcgcctcatattttatagatcacaaccagcagacaacggcctttcgccatcctgtgaccggacaattctctccagagaatagtgagtttattctccaagaggagccgaatccccatatgagtaagcaagacaggaatcaacgtcctagttccatggttagcgagacctctaccgccggaaccgctagcacgctcgaagcgaagcccggtcccaagataatcaagtcctctagtaaggtgcatagttttggcaagagagatcaggcaattcggcgtaatcccaatgtgccggtcgtcgtccgagggtggcttcacaaacaggatagcagcgggatgaggctgtggaagagacgatggtttgtgctcgcagattattgccttttttattacaaggattcccgggaggaggccgtcctgggttctatcccactgcccagttacgttattagtccagtcgcaccagaggaccgaatcagcaggaaatactctttcaaggcggtacataccgggatgcgggctttaatttacaattcctctaccgctggcagccaggctgagcagtcgggtatgagaacatactacttcagtgccgacacccaggaggatatgaatgcctgggtgcgggcaatgaaccaggccgctcaagtgttgagcaggagcagcctgaaaagggacatggagaaagtcgaaaggcaggccgtcccacaagcgaatcatactgagtcttgccacgagtgcgggagggtgggacccgggcatacgcgcgactgtccacacaggggccacgatgatatcgttaatttcgagcgacaagaacaagaaggcgaacaatataggagtcagcgagatcctctcgagggaaagcgggacagatccaaagccagatctccctacagccccgccgaggaagacgccttgttcatggacctgcccacaggtcctcggggacagcaggcacagccccaacgggccgagaaaaatggtatgctccccgcaagttacggcccaggcgagcagaatgggactgggggctatcagagggctttcccgccacggactaatccagagaagcactctcagaggaaaagtaacctagctcaagtggagcattgggccagggcccagaagggtgactcacgctccttgcctttggaccaaacactgcctagacaggggccaggccaatctctgagcttccctgagaactaccagaccttgcctaagagcacaaggcacccgagcggtggttcttctccgcctcctcggaatctgccttccgactataaatacgctcaggatcgcgcctcgcatctaaaaatgagctctgaagaacgccgcgcccacagagatgggactgtctggcagctgtacgagtggcaacagaggcagcagtttaggcatggctcccccacagctccaatttgtcttggctcaccagagtttaccgaccaggggcgcagtcgcagcatgctcgaagtgccccgttcgatctctgttccaccgagcccgtcagatatcccaccccctggcccccctcgggtattccccccccgacgcccacacactcctgccgagcgggtaacagttaagccccccgatcagcgcagaagcgttgacatttctctaggggacagcccgagacgggctagaggccacgctgtaaagaatagcagccacgtagacagacgttccatgccgagcatgggctacatgactcatactgtgtcagccccctccctgcacggcaagtccgccgatgacacatacctccagctgaagaaggacctggagtaccttgatctcaaaatgactggaagggatctgcttaaggaccgatcgttaaagcccgtcaagattgccgagagcgacaccgatgtgaaattgtctattttttgcgaacaagaccgagttttacaggacctggaggataaaattcgggctcttaaagagaacaaagaccagctagagagtgtcctcgaggtccttcataggcagatggaacagtaccgcgaccaaccccagcacctcgaaaaaatagcctaccagcagaagcttctccaggaggacctggtccacattcgggcggaactttcacgcgaaagtactgaaatggagaacgcgtggaacgaatatctgaagctcgaaaatgatgtggaacagctgaagcagactctccaagaacagcataggagagcttttttttttcaagaaaagtcacaaattcaaaaagatttatggcgaatcgaggatgtcaccgctggcctatcggcaaacaaggagaattttagaatcctcgtcgagtccgttaaaaaccccgaacgtaaaaccgttcctctattcccccatcctcctgtgccatccttgagcacctcggagtcaaagccccccccacagcccagccctcctacatcccctgtgagaactccattagaggtcagactatttccacagctccagacctacgtgccctacaggcctcacccaccacagctcagaaaggtgacttctcccctgcaatctcccactaaagccaagcccaaagttcaagaggatgaggctccaccccgaccaccactgccagagctgtattcccctgaggatcagccacctgccgtcccgccactaccgcgtgaggcgacgataattcgccataccagtgtgcgaggtctgaagcgccaaagtgacgagcgtaagcgggaccgggaactcggacaatgcgtcaacggagactcacgggtggaactgagaagctacgtttctgagcccgagctcgcaactttatcaggggacatggcgcaacccagcctgggtttggttgggcctgagagcaggtaccagactctacctggtcggggactctcaggctctacctcgcgcttgcagcagtctagtaccattgccccttacgtcacgttacgcagaggccttaacgcagagtcatcaaaggcaactttccctcgcccaaagagtgccttggagcggttatatagcggggaccaccagcgtgggaagatgtctgccgaggagcaactggagcgcatgaaacgccaccaaaaagccctggttagagagaggaagcggactctgggtcagggggaaaggaccgggctaccaagcagccgttaccttagtcgccctttgccaggagacctcgggagtgtttgctag

SEQ ID NO: 199758 - DNA, 2262 bp, Artificial Sequence
  Description of Artificial Sequence: Synthetic coding sequence
tgagacgccctgttcatggacctgcccaccggcccccggggccagcaagctcagccccagagggccgaaaagaacgggatgctccctgcctcctacggcccgggagagcagaacggcaccggtggctatcagcgggcatttcctcctaggacgaatcctgagaagcattcgcagcgcaaaagcaacctcgcccaggtggagcattgggcgagggcccagaaaggggattcccggtcattgccattagaccagacactgcctcgccagggccccggccagtccctctccttccctgagaactatcagacacttccgaaaagtactagacacccgagtggaggaagctctccacccccccggaatctcccaagcgactacaagtacgcgcaagatcgcgctagccacctgaagatgtcctctgaagagagaagggcgcacagggatggtacagtctggcagttatacgagtggcaacagaggcaacaatttcggcacggatctcctactgctcctatttgtctcggaagtcctgaatttaccgaccagggcagatcccgcagcatgctcgaggttccccggtcaatttctgtgcccccaagtcctagcgacattcctccacccgggcccccgcgcgtgttccctccaagaagaccccataccccggccgaacgtgtcaccgtgaaaccaccggatcagaggcggagcgtcgatatatcattaggcgatagtccgcggcgagcaagaggacatgccgttaagaattctagccatgtcgacagacggagcatgccttctatggggtatatgacccataccgtaagcgctccctccctgcacggaaagtccgcagacgacacctacctgcagttgaaaaaagacctcgaatatctagacctgaaaatgactgggagggatctccttaaagaccgtagcctcaaacccgttaagatcgcggagtccgacactgatgtgaagttatctattttttgcgagcaggatcgggttcttcaggacctcgaagacaaaattagggcgctgaaagaaaacaaggaccagctggagagcgtgctcgaggttctgcatcgccagatggaacaatacagagaccagccacagcatctggagaaaatagcttatcagcagaaactgcttcaagaggacttggtccacatcagagctgagctctcgagagaaagcacagaaatggaaaatgcctggaacgagtatcttaagctcgagaatgacgtggaacagttgaagcaaacgctgcaggagcagcatcggagagccttctttttccaggagaagtctcagatccagaaagacttgtggaggatcgaagacgtcacggctggattatccgctaataaggaaaatttccggattcttgttgagtccgttaaaaatcctgagcgcaaaaccgtacccctgttcccgcatcccccggtccctagcctctcgacgagcgagtctaagccacctcctcagcccagtccccctacctcccctgtgaggactccactggaggttagactatttccgcagctgcagacctatgtcccttatagaccccatcctcctcagctgaggaaagtcacatcccccttacaaagtcccaccaaggccaaacccaaggtgcaggaggatgaggctccgccaagacccccgctccctgaattatattcgcctgaggaccagccacccgcagttcccccactgcccagagaggcgaccattatacgccacacatcagtacgaggactgaaacgccagtcggacgagagaaagagagatcgggagttaggtcagtgcgtaaacggtgacagtcgggtggagcttagatcctacgtctctgaaccggagttggcgacactgagtggcgacatggcacaaccaagtcttggattagtggggcctgaatccaggtatcagactctgccagggagaggcctctcggggagcaccagcaggttacagcaatcaagcactatcgctccttatgtgacccttcgcagggggctaaacgctgaaagcagcaaagccacatttccccggccaaagtcagcactggagcgcttgtattccggcgatcaccagaggggaaaaatgtccgccgaggaacaactggagcgcatgaagcgtcatcagaaggcactcgtgcgggagcgaaaacggaccttgggacagggggaaaggacggggctcccttcatcaaggtatctgagtaggccactgccaggagacctgggatctgtttgttag

SEQ ID NO: 199759 - DNA, 816 bp, Artificial Sequence
  Description of Artificial Sequence: Synthetic coding sequence
atgctgcaggcctgcaagatggagggcttccccctggtgcccccccagccatctgaggacctcgtcccttacgacaccgatctctatcagcgccaaacccatgaatattatccatatttatcgtctgacggcgagtcgcattccgatcactattgggacttccatccacaccacgtgcactccgaattcgagtctttcgctgaaaacaattttacggaattacaatcagtccagccaccacagctgcagcagctgtacagacatatggagctagagcaaatgcacgtgcttgacacaccaatggttccaccgcatccatcactgggacaccaggtatcctatctaccacgcatgtgcctccagtacccatccctgagtcctgctcagccctccagtgacgaagaggaaggcgagaggcagtcaccacccctcgaagtctccgacggagaagccgatggcctcgagcctggccctgggctcctacccggagagaccggatcaaagaagaaaatccgcctgtatcagtttcttctggacttactgcgcagtggagatatgaaggattctatctggtgggtcgataaagataaggggacattccaattctcctctaagcataaggaggcattagctcaccggtggggcattcagaagggaaaccgaaaaaagatgacttaccagaaaatggcacgagctttgcgaaactatggcaaaacgggtgaagtgaagaaggtgaagaaaaaactgacttaccagttttcaggcgaagttctgggacgaggcggactggctgagaggaggcacccaccacattag

SEQ ID NO: 199760 - DNA, 732 bp, Artificial Sequence
  Description of Artificial Sequence: Synthetic coding sequence
atgagccccgccgcccccgtgccccccgacagcgccctggagagcccattcgaggagatggccttagtgaggggaggatggctgtggaggcagtcttccatcctgaggcggtggaaacggaactggtttgccttatggttggacggaacacttggctattatcacgatgagaccgcccaggatgaggaagatcgggtgttaatccattttaacgtgagggacatcaagattggcccagagtgccacgatgtgcagcctcccgagggcagaagccgtgatggcttgctgaccgtgaaccttcgggaagggggcagactgcatctgtgtgcggagacgaaggacgatgccctggcctggaaaaccgccttgctggaagccaatagcacaccagctccggccggggcaacagttcccccccggtccaggagggtgtgttccaaagtaaggtgtgtgacccgcagttggtctccttgtaaggttgaaagacgaatttgggttagagtgtatagcccctaccaagactactacgaggttgtgcctcccaacgcccacgaagcaacttacgtccgatcctattatggcccgccttatgcaggtcccggggtgacacacgtgatagttagggaggacccatgttatagtgcaggcgccccactggccatgggaatgctggctggcgctgccaccggcgctgctcttggcagcctcatgtggagcccatgttggttctag

SEQ ID NO: 199761 - DNA, 627 bp, Artificial Sequence
  Description of Artificial Sequence: Synthetic coding sequence
atgagccccgccgcccccgtgccccccgacagcgccctggagagcccttttgaggagatggccctggtacgcgggggttggctttggcgtcaaagttcgatcctacggcgatggaaacgaaattggtttgcactgtggctcgacggaaccctcggatactatcatgacgaaacagcacaggatgaggaggatcgagtgcttatacattttaacgtgcgggacattaagatcgggccagagtgccacgacgtgcagccaccggagggccgtagtagggatgggctgctgaccgtgaacctgagagagggggggcgattacacctttgcgccgaaaccaaagacgatgcattggcctggaagacagcgctgttggaggcaaattccacgccagtgagggtatactccccctatcaggactactacgaggtggtgccacctaatgctcatgaggccacttacgttagaagctattatggcccaccttacgccggcccgggggtgactcatgttattgttcgcgaagatccctgctactctgctggcgcaccgttagctatgggtatgctggcaggggcggctacgggtgcagccctagggtccctaatgtggtcgccctgctggttctag

SEQ ID NO: 199762 - DNA, 675 bp, Artificial Sequence
  Description of Artificial Sequence: Synthetic coding sequence
atggccctggtgcggggcggctggctgtggcggcagagcagcatcctgagaaggtggaagaggaactggttcgcactgtggctggatggtactttggggtattatcatgacgagactgctcaggacgaggaggatcgggtactcattcatttcaacgtgcgcgacatcaagatcggacccgagtgccacgacgtccagccacctgagggccggtctcgcgacgggctgctgacagtaaacctgagggagggcggacggctgcacctgtgcgctgagaccaaagacgacgcactcgcatggaagactgctctgctagaagccaatagtacgcccgcacccgctggcgctaccgtccccccccggagcaggcgagtttgttctaaggttagatgcgtgacacgttcctggtctccctgtaaagttgagcgtagaatctgggtgcgagtatacagtccctaccaggattattacgaggtggttccacctaatgcacacgaggccacatatgttcgtagttactacggccctccttacgccgggcccggtgtgacacacgtgatcgtacgggaagatccttgttattcagcaggtgctccgctggctatgggcatgttggccggggcagctaccggggcagccctggggtctctgatgtggagcccttgctggttttag

SEQ ID NO: 199763 - DNA, 570 bp, Artificial Sequence
  Description of Artificial Sequence: Synthetic coding sequence
atggccctggtgcggggcggctggctgtggcggcagagcagcatcctacgcagatggaagcgcaattggttcgccctctggctggacggcactctgggatactatcatgacgaaactgcgcaggacgaggaagaccgtgtcctcatccactttaatgtgcgagacatcaagatcggcccagagtgccacgacgtgcagccgcctgaaggccgaagccgtgatgggctgctaaccgtaaacttaagagaaggaggaagattgcacctttgtgccgagacaaaggatgacgccctcgcctggaaaaccgcattgttggaggccaattcaacgcctgtgcgtgtctactccccttatcaggattactacgaggtcgtgcctcccaacgctcatgaggccacatacgtgaggtcctactatggacctccgtatgctggaccgggtgtgacacacgtgatcgtgcgcgaagacccctgttacagtgcaggcgccccactcgcaatgggaatgctcgcgggggctgcaacgggcgcggccctcggctctctgatgtggtctccatgctggttttag

SEQ ID NO: 199764 - DNA, 354 bp, Artificial Sequence
  Description of Artificial Sequence: Synthetic coding sequence
atggccctggtgcggggcggctggctgtggcggcagagcagcatcctacgtcggtggaagaggaattggtttgctctgtggctggacggtactctagggtattatcacgacgagacggcccaggacgaggaggaccgcgtcctaatccactttaacgtgcgtgatatcaaaatcggtccagagtgccacgacgtccagccccccgaggggcgcagcagagacgggctgctgaccgtgaatctccgcgaagggggcagattacacctgtgcgccgagactaaggacgacgccctggcgtggaaaaccgccctcctagaggccaacagcacacccgtccgcgtgtactccccttag

SEQ ID NO: 199765 - DNA, 492 bp, Artificial Sequence
  Description of Artificial Sequence: Synthetic coding sequence
atggccctggtgcggggcggctggctgtggcggcagagcagcatcctgcgcagatggaagagaaattggtttgcgttgtggcttgacggaactcttggatattatcacgatgagaccgctcaggacgaagaagaccgcgtacttattcactttaacgtgagagatataaaaatcggcccagaatgccacgacgtccagcccccagagggtagaagcagagatggcttattgactgtgaatctgcgtgagggcggtagacttcacctgtgtgcagagaccaaagatgatgccctcgcgtggaagactgctctgctcgaggcaaacagcacccctgtacgggtctacagcccttaccaggactattatgaggtcgtaccgccaaatgcgcatgaagctacctatgtgcgttcctactatggccccccctacgccgggccgggagtaacacatgtgattgtgcgcgaagatccatgctacagtgcaggtgcctag

SEQ ID NO: 199766 - DNA, 480 bp, Artificial Sequence
  Description of Artificial Sequence: Synthetic coding sequence
atggccctggtgcggggcggctggctgtggcggcagagcagcatcttgcggaggtggaaaaggaattggttcgcactgtggctcgatgggacattgggttattatcacgacgaaactgcacaagacgaagaggaccgggtgctgattcacttcaacgttagagatatcaagatcgggcccgagtgtcatgacgtccaacctcccgagggcagaagtcgagacggcctgcttactgttaacctcagggagggcggcagactgcatttatgcgccgaaactaaagacgatgccctggcttggaaaacggcgctcctggaagcaaactctacacctatgatccggctaaagctgattcatccacacaataagtatctcttaagttgttacagcgccggagcaccgctggcaatggggatgttggcgggtgccgctaccggtgccgccctaggatcgcttatgtggtccccttgttggttctag

SEQ ID NO: 199767 - DNA, 483 bp, Artificial Sequence
  Description of Artificial Sequence: Synthetic coding sequence
atggccctggtgcggggcggctggctgtggcggcagagcagcatcttgagaaggtggaagaggaactggtttgccctctggttggatggtactctcggctattaccatgacgagacagcccaggacgaggaagaccgggttctcatccacttcaatgttcgagatatcaagatcggaccagagtgtcacgacgtgcaacctccagaaggacgctctagagatgggctgctgacagtgaacctgagggaaggcggaaggctgcacctgtgtgccgagaccaaggatgatgcactcgcctggaaaaccgccttgctagaggccaattccacccccgcccccgcaggtgctaccgtgcctccgaggtctcgccgtgtgtgttccaaggtccgatgcgtgaccaggagctggagtccctgtaaggtagagcgccggatatgggtaagggtttattcaccctatcaggactactatgaggtagtctag

SEQ ID NO: 199768 - DNA, 465 bp, Artificial Sequence
  Description of Artificial Sequence: Synthetic coding sequence
atggccctggtgcggggcggctggctgtggcggcagagcagcatcctgcggcggtggaaaaggaattggtttgctctgtggttggatggcaccctggggtactaccacgatgaaactgcacaagacgaggaggaccgtgtacttattcattttaacgtacgggacatcaagatcggaccggaatgccacgacgtccagccaccagaagggcgtagtagagatggattgttaaccgtaaatctgcgggaagggggcagacttcatttgtgtgccgagactaaggacgacgcactggcttggaagaccgccctcctggaagctaactctacccccgtgagggtttacagcccctatcaggattactacgaagtcgttccccctaatgctcatgaggcgacatacgtgcggtcctactacgggcccccatacgccgggcctggtgtgacccacgtaatcgtgagatag

SEQ ID NO: 199769 - DNA, 258 bp, Artificial Sequence
  Description of Artificial Sequence: Synthetic coding sequence
atggccctggtgcggggcggctggctgtggcggcagagcagcatcctgagaaggtggaagaggaattggttcgccctctggctggatggcactctagggtactaccacgatgagaccgcacaggacgaggaagaccgagtcctaatccattttaacgttcgggacattaagattggcccagaatgccatgacgttcagccaccagaaggccgttcaagggacggtcttttgacagtgaatctccgcgaaggcggctag

SEQ ID NO: 199770 - DNA, 3576 bp, Artificial Sequence
  Description of Artificial Sequence: Synthetic coding sequence
atggagcggcccctggagaacggcgacgagagccccgacagccagggacacgccacggattggcgctttgcagtgtgttctttccgtgatgcctgggaggaggaggagcctgcctcacaaatgcatgtcaaagacccaggccctcctcgccctcctgccggagccactcaggacgaggagctccagggttctcctctttctagaaaatttcagctgcccccggccgcagacgagagcggcgatgcacagcggggaaccgtagaatctagtagcgttctgagcgaggggcctggcccctccggagttgagtccctgttgtgtccgatgtcgagtcaccttagtctagcacagggtgagtccgacacacccggggtcggcctagttggggaccccggaccctcccgggcaatgccttcgggactgagtccaggagctcttgattccgatcctgtcggcctcggtgaccccctctcagaaattagtaagctgctagaggccgcaccctctggatctggtctgcctaagcccgctgactgcctgttggcacaagacctctgctgggagctcttagcctctggaatggccacgcttccaggcacaagggacgtgcagggccgagccgtgctcctcctgtgcgcacatagcccagcctggctgcagtctgagtgcagctcacaggagctcattcggctcctactctacttgagatccattccaagacctgaagttcaggctttgggactgacagtgctcgtggatgcaaggatttgtgccccctcatcaagcctcttttccggactgtcccagctgcaggaagccgcgcctggtgctgtgtatcaggtgctgttagtgggtagtaccttactgaaggaggtaccaagtgggttacaactagagcagcttcctagccagagcctgctgacccatatcccaaccgccggcctgcccacttccttgggtggaggcttgccttactgtcatcaagcctggctagattttcggagaaggctggaggccctgttgcagaactgccaggccgcgtgtgcgttgttacaaggagccattgagagcgtgaaagccgtacctcaacccatggagcccggtgaggtgggccagctcctgcagcaaacagaggttctgatgcagcaagttctggactctccctggttggcttggcttcaatgccaaggcggcagggaactgacttggctgaagcaggaggtgcctgaggtgactctctctcccgactaccgtacagccatggataaagccgacgagctctacgacagagtggatggactgctgcatcaactgacccttcaaagcaatcagaggattcaggctttggaactggtccaaaccctagaggcccgcgagtctgggctgcaccagatcgaggtgtggctgcagcaagtgggatggcctgctctcgaggaggccggagaaccttccttggacatgttactccaagcacaggggtctttccaagagctttaccaggtagcccaggagcaggtcagacagggggaaaagttccttcagcccctcaccggctgggaggccgctgagcttgaccctccgggggctaggttcctggccttaagggctcaactgaccgagtttagcagggctttagctcagaggtgccagaggctggcggacgcagaacggctgtttcagctctttcgcgaagcactcacctgggctgaggaggggcagcgcgttctggcagagctggaacaggagcggccaggcgtggtactgcagcagctacagttgcactggacccgccaccctgacttgccacctgcacacttccgcaaaatgtgggccctcgccacagggctgggttccgaagcgatcagacaagagtgtcgctgggcgtgggcccgatgccaggacacctggcttgcactggatcagaagctcgaagctagtctaaaactgccacccgttggaagcactgctagtctttgtgtatcccaagtgcccgcagccccagcccatcctcctctgcgtaaggcatattcattcgatagaaacctggggcagtcactaagcgagcccgcttgccactgtcatcacgccgccaccattgctgcgtgtcgtcgccctgaggcgggaggtggcgcactccctcaagcctcccccaccgtgccgcctcccggatcaagtgaccctcgttcccttaataggctacagcttgtcttggccgaaatggtggctacagagcgcgagtatgtacgcgcattagagtataccatggaaaactactttccagagctcgacagaccggatgtgccccagggcctcaggggccagagggctcacctgttcggaaacttggagaagcttagggatttccactgtcacttttttttaagagagctggaggcctgcacacgccaccctcctcgggtcgcctatgccttccttcggcatcgcgtgcagttcggcatgtatgcgctctattccaagaacaagccacgttcggacgctttgatgagttcatatgggcatacatttttcaaagataagcagcaagcactgggggatcatttagacctggctagttacctgctcaagcctatacagcgcatgggtaagtacgcacttcttctccaggaacttgctcgagcttgcggcggcccgacccaggagctcagtgctctgagagaggcccagtccttagtgcacttccagctgcgccacggcaatgatctgttggctatggatgccattcagggatgtgatgttaacttaaaggagcaaggccagctcgtaagacaggatgagtttgtggtccgcaccggacgccacaaatctgttcgtagaattttcctatttgaagagctcctgctcttcagcaagcctcggcacggccccacaggggttgacactttcgcttacaagcggagctttaaaatggcagatctcggcctgactgaatgctgcggaaactctaatctgcgctttgaaatctggtttcgcagaagaaaagctcgtgataccttcgtactgcaggctagctcacttgcaatcaagcaggcctggaccgctgacatttcccatctgctgtggcgccaggccgtgcacaacaaggaagtgagaatggccgagatggtgtccatgggtgtcgggaataaagcattccgagatatcgctccaagcgaggaagccattaacgatcgtaccgtgaattacgtgcttaaatgccgagaggtgcggtcccgtgcctccatcgccgttgctccattcgatcacgatagcctgtatctcggcgcctccaatagccttcccggggatcctgcctcctgtagcgtcttgggaagcttgaacctccacctctaccgggatcccgctctgctgggcctgcggtgtccactttacccaagcttccccgaagaagctgctctggaggccgaagccgagcttggaggccagccctccctgaccgcggaggactctgaaatcagctctcagtgtccgtccgccagcgggagcagcggctccgattcctcttgcgtgtctggtcaggccctaggacgtggactggaagatctgccctgcgtatag

SEQ ID NO: 199771 - DNA, 3576 bp, Artificial Sequence
  Description of Artificial Sequence: Synthetic coding sequence
atggagcggcccctggagaacggcgacgagagccccgacagccaggggcacgctacagattggaggtttgctgtgtgtagcttccgggacgcatgggaagaggaagagccggcctcccagatgcacgtgaaagatccaggaccccccagaccgccggcaggcgccacccaagatgaggagctgcagggttctcctctgagccgcaaattccaactgcccccagccgcggatgaatccggagacgcccaaagaggaacagttgaaagcagttccgtcctaagcgaaggaccgggcccttccggagtggagtcgctcttgtgtccaatgtcctctcatctctcactggctcagggtgagtctgacaccccaggagtgggacttgtgggcgatcccggtccttcaagagctatgccttccggcttgtctccgggcgctctggatagtgatccggtcggactgggtgacccactgtcggaaatttctaagttgctggaggccgccccctctggctctgggttgccaaagcccgcagactgcctgctcgctcaggacctctgctgggaattgttggcgagtggcatggcgactcttccaggcacccgagacgtgcagggacgggctgtgcttttgttgtgtgctcattcacccgcctggttgcagtcagaatgtagctcacaggagcttattagactgttgttgtatctgaggtccataccccggcccgaggtacaggccttgggtcttacagtgcttgtagatgctcggatatgcgccccaagcagctcactgtttagtggcttgtcacagctccaggaggccgcccctggggccgtgtaccaggtactgctcgtcggctccacgctgttaaaggaagtgccgtccggactgcagctggaacagctgcctagccaatcactgcttacgcacattcctaccgccggccttcccacatcgctaggtgggggacttccatactgtcaccaggcctggctggactttcggcggcgtttagaggcactgcttcagaactgtcaggcagcatgcgcattgctgcagggagccatagagtccgtgaaggctgtgcctcagcccatggaacccggagaggtgggccagcttttacagcaaacagaggtgcttatgcagcaggtactcgattctccctggctggcttggttgcagtgtcaaggaggccgggagctcacttggctcaaacaggaagtgcccgaggtcacactgagtcctgactaccgaacggctatggacaaggccgacgaactgtacgaccgggttgatggcctcctgcaccagttgactctacagagcaatcagcgtattcaagctctcgagctcgtacaaacactggaggctcgggaaagtggcttgcatcagatcgaggtttggctccagcaggtcggctggcctgccctggaagaagctggtgaaccttctttagatatgctgcttcaagcccaagggtccttccaagagctgtaccaggtggcgcaggaacaggtccggcaaggcgaaaaattcctccaacctctcaccggatgggaggccgccgaactggatccccccggagcacgatttctcgccctcagagcccaactgaccgaattcagcagggcccttgctcagcggtgccaaaggctcgctgacgccgaaaggctgttccaactcttccgagaagctctcacctgggcggaagagggacagagggtgctcgctgagctcgaacaggagcgcccgggggtggtcctccagcagctgcagcttcattggacgcggcaccccgacctgccgccagcacatttccgcaaaatgtgggcgctggcaacgggactcggatccgaggccatcagacaggagtgcaggtgggcctgggcgcggtgccaggatacgtggctggctcttgaccagaaactcgaggcctctctcaaactaccccccgttggctccacagccagcctatgcgtgtcacaggtgcccgctgcccctgctcaccctcctttaagaaaggcttacagctttgatcgaaaccttggccagagcctcagcgaaccggcctgccactgtcatcatgctgccacaatcgccgcatgtcgccgccccgaggccggtggcggcgccttaccccaggcctcaccaaccgtcccaccaccagggtcctctgacccgaggtctctgaacagactccagctcgtgttggccgagatggtcgccactgaacgggagtatgtgcgcgccctagagtacacaatggagaactactttccggaattggaccgcccagatgtcccgcagggactgagaggacaaagagctcacctgttcggaaacctggaaaagctgcgggactttcactgccatttttttctaagagagttagaagcttgcactcggcaccctccaagagtggcatatgccttcctccggcaccgggtccagtttggaatgtatgcactgtattctaagaacaaacccagatcagacgccctcatgtccagctacggacatacattttttaaggataaacagcaggcactgggtgatcacctcgatcttgccagttacctgctgaaacccatacagcggatgggaaagtacgccctcctgttacaggagcttgctagagcttgcggcgggcctacccaggaactctcagcgttacgtgaggcccagtcactggtccatttccagctgcgccatgggaatgatttgcttgccatggatgctattcaaggatgtgatgtcaatctcaaagagcagggccaactggtacgtcaggacgagtttgtcgttaggacagggaggcacaagagcgtgcgcagaatcttcttgttcgaagaactgcttcttttcagtaagcctcgtcatggccccactggggtggacacattcgcatataagcggagcttcaagatggccgatcttggacttactgagtgctgcggcaattcaaacctgcggtttgaaatctggttcaggcgccggaaggcaagagatacattcgtgcttcaggcctccagccttgccatcaagcaggcttggacagctgatattagccatcttctttggcgccaggctgtgcacaacaaagaagtcaggatggctgaaatggtcagtatgggcgtgggtaataaggccttcagggacatcgcacccagcgaggaggcgatcaacgacaggaccgttaattacgtgctaaagtgccgggaagtgcgctcacgtgctagcatcgctgtggcaccatttgatcacgattctctgtatttgggcgccagcaacagtctccctggggatccagccagttgttcagtcctgggatccctcaatctgcacctgtacagggaccctgctctgctgggcctgagatgccctctttatccatcctttccagaggaggccgcactggaagccgaggcagagttgggtggccagccctctctgaccgcagaagattcagaaatttccagtcagtgcccttccgccagcgggagcagtggctcggacagcagttgcgtaagcggtcaggccctcggacgaggcctggaggatctgccatgtgtctag

SEQ ID NO: 199772 - DNA, 582 bp, Artificial Sequence
  Description of Artificial Sequence: Synthetic coding sequence
atggagcggcccctggagaacggcgacgagagccccgacagccaggggcacgccacggactggagattcgccgtttgtagcttccgagatgcgtgggaagaagaggaaccagcatcacagatgcatgtgaaggaccctgggccaccacgcccccccgctggcgcaacacaggatgaagagctccaaggtagccccctgtccaggaagtttcagctgcctcccgctgccgatgaatctggcgatgcccagagagggacagtggaaagctcatccgtgctgagcgaaggtccagggccaagcggcgtggaaagtctgctctgcccgatgagcagccacctttccctcgcacagggagaatctgacacccctggagtcgggcttgtgggcgaccccgggcccagtagggccatgccatccgggcttagccccggagctctggactccgatcctgtaggactgggcgacccattgagcgaaattagcaaattactcgaggctggcaaggagggttgggccagggaagtatgggagggtaacggagatgcgtggcgggacgaatgtcaggactttggcgggctgtag

SEQ ID NO: 199773 - DNA, 3576 bp, Artificial Sequence
  Description of Artificial Sequence: Synthetic coding sequence
atggagcggcccctggagaacggcgacgagagccccgacagccagggccatgccaccgattggaggttcgctgtgtgcagctttcgggatgcatgggaagaggaggaaccggctagtcagatgcatgtcaaggatcctgggccgccccggccccctgcgggcgccacacaggatgaggaattacaaggttcgccactgtcgagaaaatttcagcttccccccgccgccgatgaatctggcgacgctcaacgcggcaccgtggagtcctcttctgtgctttctgaaggtcccgggccatctggggtggagtccttactgtgccctatgagttctcacctctccctggcacagggtgaaagcgacacacccggggtggggcttgtgggcgatcccggtccaagccgcgcgatgccttcagggctgtctcctggcgctctagactctgaccccgttggattgggcgatccgctgagcgagatctcaaagttgttagaagcggcaccatcaggttccggcttgccaaaacctgcagactgcttactcgcccaggacctttgctgggagctgttggcctcaggaatggctaccctgcccggaaccagagatgttcagggacgggcggtgctccttctttgcgcgcactcccccgcctggttgcagtcagagtgtagcagccaggagctgattaggcttctcctgtacctgcggagcatccctcggccagaagtccaggcactaggactgacagtgctcgtcgacgcacgaatttgtgcacccagtagctctctgttttccgggctttctcaacttcaagaggcagcccccggcgccgtctatcaggtgctgctcgtcggcagtacactgctcaaagaggtgccgtccggcctgcagctcgagcaacttccaagccaaagcctattaacacacatccccaccgccggtcttcccaccagtttaggcggcggtctgccttattgtcatcaggcctggctggactttaggcggcgtctggaagcactcttacagaactgccaggcagcatgcgccctcctccagggtgccatagagtcagtaaaggccgtccctcagccaatggagccaggcgaagtaggtcagttgctgcagcagacagaggtgctaatgcagcaggtgctggattcaccctggctagcctggctgcagtgccagggcggccgggagctcacatggcttaagcaggaagttcccgaggttaccctgagcccggattatagaacagcaatggataaagcagacgaactctatgaccgcgttgatggcctgcttcaccaattgacacttcagagtaaccagcggattcaggctcttgaacttgttcagacattggaggcgcgcgaaagcgggctgcaccagattgaagtgtggctacaacaagtgggctggcccgccctcgaagaggccggtgagccaagcctagatatgctgttacaggcccagggcagtttccaggaactctatcaggtggctcaggaacaagtccggcagggcgaaaagttcttgcaaccgctcactggatgggaggccgctgaacttgatcctcctggcgctcgattcctcgctctccgagcccagctgaccgaattctcacgcgctctggcccagcgatgccagagacttgccgacgcagagcgcctttttcaactctttcgagaggctcttacctgggccgaggagggccagcgggtgctggccgagttggaacaggagagacctggagtggtgctacagcaacttcagttacactggacacggcaccccgacctaccaccagcgcatttcaggaagatgtgggccttagctacaggcctaggatcagaagctatccgccaagaatgccgctgggcatgggcacggtgccaggatacttggctggccttagatcaaaagctcgaggcctcattaaagctcccacccgtgggtagcaccgccagtctatgtgtttcgcaggttccagctgcccctgcgcaccctccactgaggaaggcctattccttcgacagaaacctgggccagtccctctcagaaccagcctgtcattgtcatcacgcggccaccatcgcagcctgtcgccgtccagaggccggaggcggggcactccctcaagcttctccgaccgtgccacctcctggaagttctgatccgcggtcactgaaccgactgcagctggttctcgccgagatggtggccaccgagcgggagtatgtccgcgctctcgaatacaccatggagaactatttccctgaattagataggcccgatgtcccacaggggctgaggggccagagagcccatctgttcggcaacctggagaagctaagggatttccactgtcatttcttcctgcgagaactcgaggcgtgcacccggcatcctccgcgagtagcctacgcctttcttcgccatagggtccaattcggcatgtacgcactttatagtaaaaataagccaaggagcgatgcgttaatgagcagctatggtcataccttctttaaggacaagcaacaggcgcttggagatcatctagatctggcctcatacttgctgaagccgatccagagaatgggaaaatatgccctcctcctccaggaactcgccagggcttgtggtggtccaactcaggagctgtcggctctacgtgaggcacagagtttggtgcactttcagctaagacacggaaatgacctgctggctatggatgccatccagggatgtgacgttaacctgaaggagcagggtcaacttgttcggcaggatgagtttgtagtgcgaactggcagacacaaatctgttcgtagaatatttctgtttgaggagctactacttttctcaaagccacggcacggacctactggtgttgacacctttgcttacaagagatccttcaagatggcggacctaggcctaaccgagtgctgcgggaatagcaatctaagattcgagatttggttccgcaggcggaaagcaagagacacttttgtccttcaggcctccagcctggcaataaagcaggcatggaccgcagacatcagtcacctgctttggcgccaggccgtacacaacaaggaggtgaggatggcagaaatggtctcaatgggggtcgggaataaagcatttagggacatcgccccatccgaagaagccatcaacgatcggacggtcaattacgtgctgaagtgccgcgaggtaaggagccgggctagcattgccgtggctccgttcgatcacgattctctgtacctgggagccagcaattcactgcctggtgatcccgcgtcttgtagcgtgctcgggagtctgaatttgcatctctatcgcgaccccgcacttctcggcctgcggtgcccgctctacccttcattcccagaggaggcagcccttgaggctgaagctgaactcggtggccagccatcactgacagccgaggattctgagattagcagccagtgcccatctgctagtggaagctctgggtctgatagctcttgtgttagcggccaggccctaggcagaggcctggaggatttgccttgtgtgtag

SEQ ID NO: 199774 - DNA, 3333 bp, Artificial Sequence
  Description of Artificial Sequence: Synthetic coding sequence
atggagcggcccctggagaacggcgacgagagccccgacagccagggccacgccacagactggaggttcgccgtctgttctttcagggatgcttgggaagaagaagaacctgccagccagatgcacgtgaaggatccgggcccgcccaggcccccagcgggtgctacccaggatgaggaattgcaaggctctccattatctcgcaaatttcagctgcccccagcggccgatgagagtggggacgcacagagaggcacggtggaatcaagctctgtgttgtctgaggggcctgggccttctggagttgaaagcctgctgtgccctatgagttcccatctctctcttgcacagggaacaagagacgtgcaagggcgagctgtgttacttctgtgtgcccatagcccagcctggctacagtccgagtgctcttctcaggagctgatacgcttgctgctctacctcagaagtatccccaggcccgaagtccaggcgctcgggctgacagtgctggtagacgcacggatctgcgctcctagttcctctttgttttctggtctgtctcagctgcaggaggcagctccgggggctgtgtaccaggttcttctggtaggcagtaccttgttgaaagaggtcccatctggactccagctcgaacagctgcccagccagagtctcctgacccacatcccaacagcaggcctccccactagcctgggtgggggcctgccttactgtcatcaggcctggctggacttccggaggagactggaggcactgctgcagaactgccaggccgcttgcgctttactccagggggcgatcgagagcgtgaaagctgtgccccagcccatggagccaggcgaagtgggccaattgctccagcaaactgaggtgctcatgcagcaggtcctagacagcccttggctggcctggcttcagtgccagggaggcagagagcttacctggcttaaacaggaggtgcctgaagtgactctgagcccagattatagaacggcaatggacaaagccgatgagctgtacgatcgggtggatggcctgcttcaccagctaacactccaatcaaatcagaggattcaggccttggagctggtgcagactttagaggcccgggaaagcggcctgcaccagatagaggtgtggttacaacaggtgggctggcctgctctcgaggaagccggcgaaccgagtctggacatgctattgcaggcgcagggcagttttcaagaattataccaagtggctcaggaacaggtcaggcaaggagagaagttcttgcaaccattaacgggctgggaggccgctgagctggacccgccaggggcccggttcctcgcattacgggcccagttaacagagttcagccgagccttagcacagcggtgtcagagattggcggacgccgagcggctattccaactctttcgcgaggcactaacctgggcagaagaaggacagagagtgctcgccgaactggaacaagagcgacctggggtggtgctgcagcagctccagctccattggacccggcatccagatctgccgcctgctcacttccggaaaatgtgggctcttgcgaccggattgggctcagaggctatccggcaggaatgtagatgggcgtgggccagatgccaggatacctggttagctcttgaccagaaactggaggcttctctgaaactgcctcccgtgggaagcactgccagcctttgtgtctctcaagtgccagctgcacccgcgcacccccccctgagaaaagcctacagctttgaccggaatctgggccagagtctgagtgagccagcatgccactgccaccacgccgccaccatcgccgcgtgtaggagacctgaagccggagggggcgcactcccacaggcgagtccgaccgtgccccctccaggcagcagcgacccgcgcagtctgaatcgattacaactggtactcgcagagatggtagccacagagagagaatatgtccgagcactcgagtacaccatggagaactactttcctgaactagacagacctgatgtgcctcagggtctacgcggacagagagcccatctctttggaaatttagagaagctgagggatttccactgtcatttctttttgagggaactcgaggcatgtacacgtcacccccctagagtggcatatgctttcctccggcaccgagtccagttcggcatgtatgccctctattcaaagaacaaaccccggtcagacgctctcatgtcttcatatggacacacgtttttcaaagataagcagcaggccctcggggatcatctggacttggctagttacctgctgaagccgatccagcggatgggcaaatatgcactcttgctgcaggagctggcgcgtgcttgtgggggcccaactcaggagctcagcgccctccgtgaggctcagtctctggtgcatttccagctgagacatggcaacgatttgctggccatggacgctatccaagggtgcgacgtgaatcttaaagagcagggtcagttggtgcgccaagacgaattcgtggttcgaaccggcaggcataagagtgtgcgtcggatatttctgtttgaggagctcttactattttccaaaccacgtcacggcccgactggcgtcgatacttttgcctacaaacgtagcttcaagatggctgatctagggctcacagagtgttgcgggaactcgaatctgaggtttgaaatttggttccgccgccgtaaggctcgcgacacatttgtcttgcaggcaagtagtcttgccataaaacaggcttggactgcggacatctctcacctgttgtggcggcaggccgtccataacaaggaagtaagaatggccgagatggtctctatgggtgtcgggaacaaggcattccgggacatcgcaccgtccgaggaagccattaacgacaggacagtcaattatgtcttaaaatgccgcgaggtccgctcccgagcgagtatcgcagttgccccattcgaccatgacagcctctacctgggggcctccaactcattacctggcgaccctgcctcatgctctgttctaggatcacttaaccttcacttgtaccgcgaccctgcgcttcttggacttcgctgtccactttacccctcattccctgaagaagccgcgctcgaagccgaagctgagctgggcggtcaaccgagtctgaccgctgaagattccgagatcagctcacagtgccccagcgcaagtggatcctcaggttctgactcatcctgcgttagcggccaggccctcgggcgtggcctggaggatttaccgtgcgtctag

SEQ ID NO: 199775 - DNA, 3021 bp, Artificial Sequence
  Description of Artificial Sequence: Synthetic coding sequence
atgcactacgacggccacgtgcggttcgacctgcccccccagggcagcgtgctggcacggaacgtgtcaacacgaagttgccctcccaggacttcccctgccgtggacctggaagaggaagaagaggaatcaagtgtcgatggtaaaggcgacagaaaatccacaggcctcaagctgtccaagaaaaaggccagaagaaggcacaccgatgaccctagtaaggaatgtttcactttaaagtttgatctcaatgtcgatatcgagactgagattgtgcctgccatgaaaaagaagtctctgggggaggtgcttctgcccgtctttgaacgaaagggtatcgctctaggaaaagtagatatttacttggaccagagtaataccccattatcccttacctttgaggcctatagattcggtggccactacctccgggttaaagcccccgccaagcccggcgacgagggaaaagtggagcagggcatgaaggatagcaaatcattatctcttccgatactgcggccagccggcaccggaccgcctgcactggaacgggtggacgcacagtcaagaagggagagccttgacatcttagcccctgggagaaggcggaaaaatatgagcgaatttcttggtgaagcgagtatccctggtcaagaaccgccaacaccttcatcctgctctctgccgagcggatcttctgggtctacaaacaccggcgactcttggaagaatagggcagcaagccggttctctggcttcttctccagcggccccagtacatctgcgtttggtcgggaggttgataagatggaacaattagaagggaaactacatacctactctttgtttggtctcccgagactcccccgggggctccgcttcgatcacgatagctgggaagaggaatacgacgaggatgaagacgaggacaatgcatgccttcgcctggaggactcttggagagaactgatagacgggcacgaaaaattgacacgtcgtcagtgtcatcagcaggaggctgtttgggagttgcttcacaccgaagcgagctatattagaaaactgcgagtgattatcaatctatttctctgctgtttactgaatctgcaggaatcgggtctcctttgtgaggtcgaggccgaacgattgttcagtaatatcccggagatagctcagctccatcgacgcttgtgggcttctgtaatggcaccagtgttagagaaggccaggcgcaccagagcactgttgcaacctggggacttcctaaaagggtttaaaatgttcggaagcctgttcaaaccatacatccgctactgtatggaggaggaaggttgcatggaatatatgcgtgggctactccgtgataatgacctgtttagggcttatatcacctgggctgagaagcatcctcagtgtcagcgcctaaagctgtctgacatgttagctaaaccccaccagaggttaacaaagtacccactgttactcaaatctgtcctgcgaaagacagaggagccccgggccaaagaagcagtggtcgccatgatcggctccgtagagagatttattcatcacgtgaacgcttgcatgcggcaacggcaagaaaggcagagattggccgccgtggtttcgcgcattgacgcctatgaggtcgtcgagtcctcttctgacgaagttgacaagctcctgaaggaattcttacaccttgatcttaccgctccgataccgggtgcgtcccccgaagagacaagacaactgttgctggagggctcccttcgcatgaaggagggaaaggatagtaagatggatgtctattgcttcctgttcacggatttgttacttgtcactaaggctgtgaagaaggcagaaagaaccagagtcattcgtcccccactgctcgttgataagatcgtgtgccgagagctgcgcgacccaggatccttcctgctgatctacctgaatgaatttcatagcgctgtcggggcatacacctttcaagcctccggacaagccctctgccggggctgggtggatacaatctacaacgcacagaatcagttacagcaacttagagcccaggagccgcctggcagccaacaacccttgcaatcgctcgaggaggaggaggacgaacaggaagaagaggaggaagaggaggaagaggaggaagaaggggaagacagcggcacgtccgctgcgtctagcccaaccatcatgcggaagtcttctggatcccccgacagccagcattgtgcgagcgatggctccacggagactttggcgatggtagtagtggagcccggtgacactctgtctagtcctgaattcgactccgggcccttttcctcacagtctgatgaaacctccctcagtacgaccgcttcaagcgcaacccccacatcagagctgttgccgctggggcccgtggacgggcgatcgtgttcaatggactctgcgtatggaacgctctcacctacatccctccaggacttcgtggccccaggcccaatggctgagctcgtgccacgcgctccagagagccctcgggtaccctctcctcccccaagccctcgtctccggcgacgaacacccgtgcaactgctgagttgccccccacacttactgaagagtaaatcagaggcctcactcctgcaactgctggcaggcgcaggaacacatggcaccccctcagccccatcccgatcacttagcgagttatgcttggctgttccggctccgggcatacggacacagggctccccccaagaagctggcccttcctgggactgcagaggggcacctagtcccggctcaggccctgggctggttggctgcctcgccggggagcccgctggttcacacagaaagagatgcggggacctcccaagcggcgctagtccccgcgtccagcccgagccaccaccaggcgtgtctgcccagcaccgtaagctgacactggcccagctgtaccgcatacggaccaccctattgctcaacagcaccctgactgcttcagaggtttag

SEQ ID NO: 199776 - DNA, 2793 bp, Artificial Sequence
  Description of Artificial Sequence: Synthetic coding sequence
atgcactacgacggccacgtgcggttcgacctgcccccccagggctcagtgctcgccaggaacgttagtacaaggtcctgccctccccggaccagcccagcagtggatctcgaggaagaagaggaagaatcctcagtagacgggaaaggcgaccgtaagtccacaggcttaaagcttagtaaaaaaaaggcccgccggaggcacactgacgacccaagcaaggaatgttttaccttgaagtttgatctaaacgtggacattgaaacagagatcgtgcctgccatgaagaagaagtctcttggggaggtcctgctgccagttttcgaacgtaagggcatcgccctggggaaggttgacatctacctggatcagtcaaacacacctctttcgctgacttttgaggcctatcgtttcggaggtcactatctccgggtgaaagcacctgcaaaacctggagacgaggggaaagtggagcaaggtatgaaagattctaagagcttaagcttacccattctcagacctgcaggaaccggaccgcccgcgctcgaacgggttgacgcccaatcacgccgagagtctctcgatattctggcacctggacgcagaaggaaaaacatgagcgagtttctgggggaagccagtatcccaggtcaggagccccccacccctagtagctgttccctcccatccggatccagcggttctaccaacacaggggactcatggaagaaccgcgcagcaagtagatttagtggatttttttctagcggtccttcgacctcggcctttggacgggaggtggataaaatggaacaactagagggaaagctgcacacctattctttattcggcttgccacgactgcccagaggattgagatttgatcacgactcctgggaagaggagtacgacgaggatgaagatgaggacaacgcctgcttgcggctcgaggatagctggcgcgaactgatcgatgggcatgagaaacttaccagacggcagtgccatcaacaggaagctgtgtgggaactgctgcacacggaagccagttatatccgaaaactgagagtcattatcaaccttttcttgtgctgtttactgaatctgcaagaatctgggcttctctgcgaagtcgaagccgagcgcctgtttagcaacatccctgaaattgcccagctacaccgcagactatgggctagcgttatggcaccagttcttgaaaaggcccgcaggacacgcgccctgttgcagcccggagacttcttgaagggttttaagatgttcggaagcttgtttaagccttacatacgatattgcatggaagaagaaggatgtatggagtatatgaggggcctactaagggataatgacttatttagggcgtacattacctgggcagaaaagcatcctcagtgccagagactaaagctttctgacatgctggccaagccccatcagcggctgacaaaatacccattgctgctgaaatcagtgttacggaagacggaggaaccccgcgccaaggaggccgtcgtagctatgattggatcagtggagcgctttattcatcatgtgaacgcatgcatgcgccagaggcaagaaaggcagcggttggcagccgtagtctcacgaatcgatgcatacgaggtcgtggagtcttctagcgatgaggtagacaaactgctcaaagagttcctgcacttggatctgacggcgcctatccctggtgcttccccggaagaaacacgacagctcctgttagaggggtccctacgcatgaaagagggcaaagattcaaagatggatgtgtactgctttctctttactgacctgctcctcgtgacaaaagccgtaaagaaggctgagcgtacacgcgttattagacctcctctgctggtagataaaatcgtttgcagggagcttagagacccgggaagcttccttttaatatacctgaatgaattccactctgcggtaggggcatatacttttcaagcatcaggtcaggcactgtgtcgaggctgggtggacaccatttataacgcacagaaccagctgcagcagcttcgtgcccaggagcctccaggctctcagcagcccctgcagtcactggaggaggaggaagacgagcaggaggaggaagaagaggaggaagaggaggaagaggagggggaggatagtggcacgtccgccgcctcgtcccccacgatcatgcgaaaaagcagcggctctccagatagccagcattgcgcaagcgacgggtctacagaaactctggcaatggtcgtggtcgagccaggagacaccttgagttcacctgagtttgacagcgggccgttcagttctcaaagcgacgagacaagtctctcgacaacagccagctccgctaccccgacctcagaattgctcccgctaggtccagtggatggcagaagctgttcaatggattccgcttatggcaccctcagccccactagcctccaggactttgtggcacctgggccgatggctgagctcgtcccaagggctccagaatcccccagggttcccagcccccctccctcaccacgtctcagacgacgaacacccgtgcaactcctcagttgccccccacatctcctgaaaagtaaatcggaggcctctctgctccaactattggcaggagctggtactcacgggaccccgtcggctccttcgcgctccctctcagaactctgcttagcggtgccagcccccgcacaggaggccgatcccggcccagcactgcctaaccaggaccaccctgctgcgtag

SEQ ID NO: 199777 - DNA, 3021 bp, Artificial Sequence
  Description of Artificial Sequence: Synthetic coding sequence
atgcactacgacggccacgtgcggttcgacctgcccccccagggctccgtcctcgctcggaatgtgtctacaagatcttgtcctcctaggaccagcccagcggtggatctggaagaagaggaggaggaatcaagcgtcgacggaaaaggggacaggaagagcacaggccttaaactgagcaagaagaaggctagacgacgacacaccgacgacccaagcaaagagtgcttcactttgaagttcgatctgaacgtagatatcgagacggagatagtccctgctatgaagaagaagagtttgggggaggtgctgctgcctgtcttcgagcgcaagggcatcgcgctgggaaaagtcgatatctatctagaccaatcaaacactcctctgtctctcaccttcgaggcctaccgatttggtggccactatcttagggttaaggcccctgcaaagccaggcgacgaaggcaaggtggagcagggaatgaaggacagcaaatccctgagcctccctattctgcggccagcgggaactggtcctccagcactggagcgcgttgacgcacaatcccgtcgagagtcattggatattctggccccagggcgcagacggaagaacatgtccgagtttcttggagaggcctctatccctgggcaggaacctccgactccatctagctgctcactacccagtggctcttccggatctacaaatacaggggacagctggaaaaatcgggccgccagtagattctccggattcttctcctctgggccatctacatctgccttcgggagagaagtagataaaatggaacagctcgaggggaagctgcacacctatagcttattcggactcccgagactgcccagaggtctgcgctttgatcacgattcatgggaagaggagtacgatgaggatgaggacgaggacaacgcatgcctgcgactcgaggactcatggagggaactgatcgatggtcacgaaaaactgacaaggcggcagtgccatcaacaggaagcagtgtgggaattgctgcacaccgaagcttcctatattcggaaactgcgggttatcataaacctgtttttgtgctgcttgcttaatctgcaggaatctggtttgctatgcgaggtcgaggcagagagattattctctaatataccagaaattgctcaactacatcggcggttgtgggctagtgtaatggcgccagtgttggaaaaagcacggaggacacgagctctgctgcagcccggcgactttctaaagggcttcaagatgtttggcagcttgtttaagccctatattcgctactgcatggaggaggaggggtgtatggaatatatgcgaggccttctcagggacaacgacctgttccgcgcctacatcacttgggccgaaaagcacccccagtgccagcgcttaaaactttccgatatgctggctaagcctcaccagcgcctgaccaaataccctctgctcctcaagagcgtcctcaggaagactgaggaaccaagagccaaagaggccgtcgtggctatgataggcagcgtggaacggttcatacaccacgtcaatgcttgcatgaggcagcgccaagagcgacaaaggctcgcagcggtagtgtcccgcatcgatgcctatgaggttgtggaatcgagctctgatgaggtggacaagctcctgaaggagttcctgcacctcgaccttactgcaccaatccctggggcttcccccgaagaaactcgtcagctgctactggagggaagcctgaggatgaaggaagggaaggatagtaaaatggacgtttactgcttcctgtttaccgacctgctgctcgtcactaaggcagtgaagaaggcagagcgcaccagggtgattcggcccccacttcttgtggataagatcgtatgccgcgagctgagagatcctggttctttcctgctcatctaccttaatgagttccactcggctgtcggggcatatacctttcaggcctccggtcaggccctttgcagaggttgggtggacactatctataacgcccagaatcagttacagcaactccgggcacaggagccccctgggtctcagcagcctctgcaaagcctagaagaagaggaagatgagcaggaagaggaagaagaagaggaggaagaggaagaggaaggcgaggatagcggaacgagtgctgcttcgtctccaactatcatgaggaagtccagcggctctcctgattcacagcactgtgcgagtgacggctcgaccgaaacactcgctatggttgttgttgaacccggggacaccctaagctcgcccgagttcgattccggccccttctcctcacaaagtgacgaaacctccctgagcacaaccgcgtcatctgccactccgacctcggagctgctgcccctgggacccgtggacggacgaagctgttctatggatagcgcgtatggcaccctgagccccacctctctgcaggacttcgttgcacctgggcccatggccgagctcgtacccagggcccctgagtcaccaagggtcccaagcccccctccatctcctaggcttcgacgaaggacacctgtccagcttctctcatgtcccccacacctgctcaagtcaaaatcggaagcgtccctgctgcagctgctggctggcgccggcacccacggcacaccctcagccccctcaaggtcactgtcagaattgtgcctggccgtgcccgcacccgggattcgaactcagggctctcctcaggaggctggcccaagttgggactgcagaggggccccctcaccgggctccggccccggtctggtgggatgcctcgctggagagcccgctgggagtcatagaaaacgctgtggtgatctcccatcgggcgccagccctagggtgcagcctgagccacctcctggcgtaagcgcacagcaccggaaactgactcttgctcagctctaccgtatcaggactactcttctgctgaacagcacgctgactgcatccgaggtgtag

SEQ ID NO: 199778 - DNA, 3132 bp, Artificial Sequence
  Description of Artificial Sequence: Synthetic coding sequence
atggacaagggccgggccgccaaggtgtgccaccacgccgactgccaacaactccacagacggggacccttaaatctttgtgaggcctgcgatagcaaatttcattcaactatgcactacgacgggcacgtgagattcgacctccctcctcaggggagcgtgctcgcccggaatgtgagtactagatcctgcccaccaagaacctccccagctgtcgatctcgaggaggaggaagaggagtcctcagtcgatggaaaaggcgaccggaaatctaccgggctgaagctgtccaaaaaaaaggccagaagacgacacactgacgatcctagtaaggaatgctttaccctgaagtttgatctaaacgtggacattgagacagaaatcgtgcctgccatgaaaaaaaagtctctcggagaagtacttttgccagtgttcgagagaaagggcattgctttaggaaaagtcgacatttacctagatcagtccaacactcctctgagcctgacattcgaagcctacagattcggcggccactacctgcgcgtgaaggccccggctaaacccggcgacgaaggtaaagtcgagcagggcatgaaggactcaaagagtctctctttgcctattctgcgaccagctggaaccggcccccctgccctcgagagggttgacgctcaaagccgccgggagtcgctggacattctggctccgggtaggcggaggaagaacatgtcagagtttctcggcgaggcaagtattcccggccaggagcctcccactccaagctcatgcagcctaccctctggctcctccgggtcaacaaacaccggagactcctggaagaatagggccgcttcacgcttcagcggctttttctcttccggtcccagtacatccgcattcggacgtgaggtcgataagatggagcagcttgaggggaaactccacacctattcattatttgggctgccaaggctgcccagaggtctacgcttcgatcatgactcgtgggaggaggaatatgacgaagacgaagatgaggacaacgcctgccttcgattggaggacagttggcgggagttaatcgatggccacgaaaagcttacacggcggcaatgccaccagcaggaagctgtgtgggagctacttcacactgaagctagttacatccgcaaactccgagttatcattaatcttttcctgtgttgcctcctgaacctgcaggaaagtggattactgtgtgaggtggaggccgaacgcctcttcagcaatattcctgaaatcgcccagctccacagaaggctctgggcctcagtgatggcacccgttttggagaaggctcgtcgaacacgggccctccttcagcccggggacttcctgaaagggtttaaaatgtttgggagtctatttaaaccatacatcaggtactgtatggaggaggaggggtgtatggagtacatgcgcggcctgctgagagacaacgacctgttccgcgcatacataacatgggcagaaaagcacccacagtgtcagcggctcaagctatctgatatgctggcgaagccacaccagcgcctgaccaagtatccgctccttttgaagagcgttctgcgcaaaactgaggaaccaagggccaaggaggcggtggtcgctatgatcggttctgtggagagatttattcatcatgtcaacgcatgcatgagacagagacaagagcgacagagattggcagctgttgtgagccgtatagacgcctatgaggtggtggaatcatcctctgacgaggtcgacaagcttctgaaggaattcttgcatctcgatctgactgcacctattccaggggccagtcctgaggagaccaggcagttgcttctggaagggtctttgcgaatgaaggagggcaaagactcaaaaatggatgtttactgtttcctgtttaccgacctgctgctggtgaccaaggccgtgaagaaagcagagaggacaagggtgatccggccacctctcctggtggataaaatcgtatgtcgggagctacgcgacccggggtcttttctgctgatctacttgaatgagtttcacagcgcagtgggcgcctacacgtttcaggctagcggccaggccctgtgcaggggatgggtggacactatatacaatgcccaaaaccagctccagcagctgagagctcaggagccccctggcagccagcagccgctccagtctctggaggaggaagaagacgagcaggaagaggaggaggaagaagaggaggaggaggaggaaggagaagatagtggcaccagcgccgcttcatcgcccaccattatgaggaagagctcaggttctcctgatagccagcattgtgccagcgacgggtcaactgagacactggccatggtggtagttgaaccaggtgataccctgtcctcacccgaattcgactccggcccatttagtagccagtcagacgaaactagtctttcaacaactgcatcgtctgccacgccgacaagtgagctcctgcccctgggcccagtcgatggacgctcctgctctatggactccgcctatggcacactgtcacctactagcttgcaggattttgtggcacctggacctatggccgaacttgtgcctcgcgcccccgagagtccgcgggtgccctctcctccaccttcaccgcgtcttcgccgcaggactccagtccagcttctgagctgtccaccacatctcctgaagtcaaagagtgaagccagtctcctacagctgctggcaggcgccggcacccacgggaccccttcagcccctagccgctctctgtccgaattatgcctggccgtgcctgcccctggcatccgaactcaggggtccccccaggaagcaggacccagttgggactgccgaggggcaccaagtccaggctcaggcccgggcctggtgggctgtctcgctggcgaacctgccggatcccatcggaaacgctgtggggacctcccttcaggagcctccccaagggtacagcccgagccccctcctggtgtgtctgcacagcatcggaaattgacactcgctcagttgtaccggatccgaactactttgctgctaaatagcacactgacggcctccgaggtgtag

SEQ ID NO: 199779 - DNA, 3021 bp, Artificial Sequence
  Description of Artificial Sequence: Synthetic coding sequence
atgcactacgacggccacgtgcggttcgacctgcccccccagggctccgtgctggcaaggaatgttagcaccaggagctgtccccctaggacttcccctgcggtggatctcgaagaggaggaagaggaatcttccgtcgatgggaaaggggaccgaaaatctaccggcctgaagctctcaaagaaaaaagccaggcggagacataccgacgacccgtccaaggagtgcttcaccttgaaatttgacctgaacgtagacatcgagactgagattgttcctgcaatgaagaagaaaagcctcggtgaagtactgctacccgtatttgaacgcaagggcattgccctgggaaaagtggatatataccttgaccagagtaacactcctctatctctgaccttcgaggcatatcggttcggaggacactacttgagggtcaaggccccggccaagcctggggatgaaggcaaagtcgaacagggcatgaaggattccaagtctttatctctgccaattttgcgtccggctgggactgggccaccagcactcgagcgggtcgacgcgcagtctcgccgcgagagcctggatatcctggcgccaggcaggaggaggaagaacatgtcagagttcctgggggaggcaagcattcctggccaggagcccccaactccctcgtcgtgcagtctcccgagcggatcttcaggtagcacaaataccggtgatagctggaaaaatcgcgccgccagccggttcagtggattttttagctcagggccctctacttccgccttcgggcgggaagtagataaaatggagcaattggaaggcaaactccacacctattctctcttcggacttcctcgattgccgagggggcttagattcgatcacgacagctgggaggaggaatatgacgaagatgaggacgaagacaacgcatgcctgcgtctggaagacagctggcgcgaactgattgatggacacgaaaaactcacaaggcggcagtgccatcaacaagaagccgtctgggagttgctccatactgaagcctcttatatccgtaagcttagggtgattatcaatctctttctttgttgcctgctaaaccttcaagaatctgggctcttgtgcgaagtcgaggctgagcggctgttttctaatatcccagagatcgctcagttgcacaggaggttgtgggcctcagtcatggcacctgtgttggagaaagctcgtcgcaccagagccctgctgcagcctggggactttctgaagggatttaagatgttcggcagtctcttcaagccttacatacgctattgtatggaggaggaagggtgtatggaatatatgagagggctgctgagagacaacgaccttttcagggcctatataacttgggccgagaaacacccgcagtgtcagcggctgaagttatcagacatgctggcaaagccccaccagcgcttaacaaaataccctctcctgcttaagagtgtactgcgaaaaaccgaagagcctcgggcaaaagaggcagtggtggctatgatcggctccgtcgaaaggttcattcaccacgtaaatgcctgcatgcggcagagacaagaaagacagcggttggccgccgttgtctccaggatcgacgcttacgaagttgtggaatcgtctagtgacgaggtcgacaaactgctgaaagaatttctgcacctcgatctgaccgcccctatacccggggcgtctccagaggaaacaaggcagctcctgctggagggtagtctaagaatgaaggagggtaaggattccaagatggacgtgtactgtttcctgttcaccgatctgctgctcgttaccaaagcagttaaaaaagctgaacgtaccagggtgatcagacctcccctgctggtagataaaattgtgtgcagagagcttcgcgaccccgggtcattcctgctgatctacctgaatgagtttcacagcgctgtcggagcctatacattccaggccagtggacaggcactgtgtcgtggctgggtggacaccatatataacgcccaaaatcaattgcagcagctgcgcgcgcaggagcctccgggatctcaacagcctctccaaagcttagaagaggaagaagatgagcaagaggaagaggaagaggaagaggaagaggaagaggagggtgaagatagcggaactagcgcagccagcagtccgactataatgcgcaaaagcagtggcagccccgattctcaacattgcgcgagcgacggatccaccgaaaccctcgctatggttgtcgtggaacctggggataccctgtcctccccagagtttgactctggcccattttcaagtcaatctgacgagacctcgctgtctacaaccgccagcagtgccacaccgacttcagagctgctccctctgggacccgtcgatggccgcagctgctcaatggacagcgcctatgggactctgagcccgacctcgctgcaggactttgtcgctcccggacccatggcagagctcgtgcctcgggcccccgaatcacctagagtgccctcccctccacccagccctcggctaaggcgaagaacacctgtgcagctgttgagctgtcctccgcatctcttgaagtcgaagagtgaggccagtcttttacagcttcttgctggcgctggcacacatggcacccccagtgccccttcgaggtcactgtctgagctgtgcctggccgtgcctgcaccgggtattagaacgcagggcagcccacaggaggctggcccttcttgggactgtaggggtgccccctccccaggaagcggccctggactggtgggctgtctggcgggcgaacccgctggttcccatcgcaagcggtgcggtgatctgccaagcggcgcctcgccgagagttcaaccagaacctcctcctggggtgtccgcacagcacagaaagctgactttggcgcagttgtaccggattaggacaaccttactgttaaacagcacgctaaccgcgtcagaggtatag

SEQ ID NO: 199780 - DNA, 2559 bp, Artificial Sequence
  Description of Artificial Sequence: Synthetic coding sequence
atgaacagcgtgctgaccaagcacggcagccccccccggagctggctgagtctgtgctccggcacagacgaccaatcgccggctgaaaaaaaggggctccgctgccagaaccccgcctgtatggataaaggccgggcggcaaaggtgtgtcaccacgctgactgccaacagctccacaggcgagggcccctgaatttatgcgaggcttgcgatagtaagttccactccaccatgcactacgatggtcacgtcaggtttgatcttccacctcaagggtctgtgttagcacgcaacgtgagcacgaggagctgtccccccaggacctctcccgcggtggacctggaagaggaagaagaggaaagctccgttgacggaaagggcgataggaaatcaaccggtctaaaactgagcaagaaaaaggcacgccgtcgacatacagacgacccttcaaaggagtgcttcacactgaagttcgacttaaacgtggacatcgagactgagatcgttccagccatgaagaaaaaatctttgggagaggttttactgcccgttttcgaaaggaagggcatagccctcggtaaggtggatatctatctcgaccaaagtaatactcctctctctctaacgtttgaggcttatcgtttcgggggccactatctcagggtcaaagcacctgcaaaacctggggatgagggaaaggtggaacagggtatgaaggattcgaagagtcttagcctgcctatactccggccagccggtacaggaccacctgcactggagagggtagatgcacagagcagacgcgagagcctcgacattcttgcccccgggaggagacggaagaatatgtcagagtttctcggcgaagcaagtataccggggcaggagccacctacaccctctagttgttccctgcccagtgggagctccggctcgactaataccggggactcctggaaaaatagagctgcgtccagattcagcgggttcttcagtagcggaccctcaacctcggcctttggtagggaggtggacaagatggagcagctggaggggaagctgcacacttacagcctcttcggtctcccgagactcccgcgcggcctgcgttttgatcacgatagctgggaggaagaatacgatgaggacgaggacgaggataacgcatgcctaaggctggaagacagttggagggaactcattgacggacacgagaagctcaccaggagacagtgccaccagcaggaggccgtgtgggagctcttgcacacagaagcctcctacattaggaaactcagagtgataatcaacctgttcctgtgctgtctactcaatctgcaggagtccggcctactgtgcgaggtggaggctgagcgcctctttagtaacatacccgaaatcgcgcagctccaccgccgcttgtgggcctccgttatggcccccgttttggagaaggcgcgtcgcacacgtgctctgttgcagccaggggactttctgaaggggtttaagatgttcggctccctctttaaaccttatattagatattgtatggaagaggagggatgtatggaatacatgagggggctgctaagggacaacgacctgttccgcgcttacattacctgggccgaaaaacacccccagtgccagcgcctgaaactctccgacatgttggcaaagccccaccaaagactgacgaagtaccccctgctgctcaaatctgtcctccggaaaaccgaagaacctagggcaaaagaggccgtcgtggccatgatcggctccgttgagcgcttcatccaccacgtgaatgcatgtatgcggcaacggcaagagagacagagacttgctgctgtggttagcaggattgatgcctatgaggtcgtggagagcagctccgacgaggtggataaattgctgaaggagtttttgcatctcgatctaaccgcacctatccctggtgcgagccctgaggagacccgtcagctgttactggagggttcactccgcatgaaagagggaaaagactcgaagatggacgtatactgctttctttttacggacttactgttagtgactaaggccgtaaagaaggccgagcggacccgcgtgatacgtccgcctctgctcgtggataagattgtgtgtcgggaactgcgggatccaggaagttttctactcatatatctcaacgaatttcactcagcagtcggggcctacacctttcaggcatccggacaggccttgtgcagggggtgggtggacactatttacaacgctcaaaatcaattgcaacagcttagagcgcaagagcctccgggatcccagcaacccctgcagagcttggaagaagaagaggacgaacaagaggaggaagaggaggaggaggaggaggaggaggaaggggaagatagcggtaccagcgccgcttcctcccccactatcatgcggaagtcctctgggagcccggattctcagcactggaagctgacccttgcccagctgtacagaatacggaccaccctcctattaaattctaccttaacagcctctgaggtttag

SEQ ID NO: 199781 - DNA, 3252 bp, Artificial Sequence
  Description of Artificial Sequence: Synthetic coding sequence
atgaacagcgtgctgaccaagcacggcagccccccccggagctggctcagcttgtgctcgggtacggatgatcagagccctgccgagaaaaagggcctgcggtgccagaaccctgcttgtatggacaaaggacgagccgccaaggtgtgccaccacgcagactgtcagcagcttcaccggagaggaccgctgaatttgtgtgaggcttgtgattctaagttccatagcactatgcattacgacgggcatgtgcgcttcgatcttccccctcagggctcagtcctcgctagaaatgtaagcacgaggtcttgccctcctcgcaccagccctgctgttgatctagaagaagaagaagaggaaagctcagtggatggcaagggcgatagaaaatctaccggattgaaactgagcaaaaagaaggcccggcgtagacacacagacgacccttcgaaggagtgttttacattaaagtttgatctgaacgtggacattgaaaccgagattgttcccgccatgaagaaaaaatcgctgggagaggtgcttctgcccgtgttcgagcgcaaagggatcgcactgggcaaagtcgatatttacctggatcagtccaatacccccttgtctctcacatttgaagcctatcgcttcggggggcactacctgagggtgaaagctccagccaagcccggcgacgaaggcaaggtcgagcaaggcatgaaagattcgaaatctctgtccctgcctatattaagacctgccgggacgggtcctccagcgttagaacgagtcgatgctcaatcacggcgagaatctctggatatcttagctcctggtcgcaggagaaaaaacatgtctgagttcctgggagaggcatcaattccgggccaagagccccctactccttcgtcgtgcagtctcccaagcggatctagtgggagcacaaacaccggggacagttggaagaaccgcgccgcgagtagattttctggcttcttttctagcggcccgtcaaccagtgcatttggtagagaagtggacaaaatggaacagctggaaggaaaactgcatacctattctctgtttgggcttccccgactcccgaggggactgcgtttcgaccatgacagctgggaagaagagtacgatgaggacgaagacgaagataacgcctgtcttaggctggaagacagctggcgggaactcatcgacggccacgagaagctcacgagaagacagtgccatcagcaggaagcggtgtgggagttgctccatactgaagcctcctacatccgaaagttacgcgtcataatcaatctgtttttgtgctgtcttctgaatctccaagagtccgggctgttgtgtgaagtagaagccgaacggctgttcagtaatattcctgagatcgcccagttgcatagaaggctttgggcatccgtcatggcgcccgtgttggagaaggccaggcgcacgagagcgctgctacagcccggagacttcctgaagggcttcaagatgttcgggtctctgtttaaaccatacatcaggtactgcatggaagaagaaggatgcatggagtacatgagaggccttttgagggacaatgacctcttcagagcctatattacctgggctgaaaagcaccctcagtgccagagactgaaattaagcgatatgttggccaaacctcatcagcgcctgaccaagtatcccctcctcctgaaaagcgtgctgaggaagaccgaggagcccagggccaaggaggccgtagtagctatgataggttctgtcgagaggttcatccatcatgtgaacgcatgcatgcggcagcgccaagagcggcaaaggctcgccgccgtagtctcacgaatcgatgcttacgaagtggtcgaaagctcctctgacgaggttgataagctacttaaggaattcctgcatctggaccttacagctcccatccctggtgcctctccagaagagactcgccagttactcctcgagggctctctgcgaatgaaggaagggaaagactccaagatggatgtttattgcttcctctttacagacttgctgctggtcacaaaagctgtgaagaaggccgaaagaactcgagtaatacggccacccctactcgtggacaagatagtgtgccgggagctgcgggacccaggctccttcctgttaatatacctgaatgagttccatagtgctgtgggggcttatacattccaggcttccggccaggccctgtgccgaggttgggtagatactatctataacgcccaaaatcagctccaacagttacgagcccaggaacccccaggttctcagcagccattgcagagcctggaagaagaggaggacgagcaggaggaagaggaagaagaggaggaggaggaggaggagggagaagactccggcactagcgctgcctccagtcccacaatcatgagaaaatctagtggctctccggatagccagcactgcgcatccgatggttccaccgagacccttgctatggttgtcgtcgagcccggcgacactctgtcctctccagagtttgattcgggcccatttagctctcagagcgacgagaccagtctatctactacagctagctccgccaccccgaccagcgagctgcttcccctgggcccagtggacgggcgcagttgttctatggatagcgcttacggaacactcagcccaacctctcttcaggattttgtcgcccccgggccaatggcagaactagtgccccgtgctccagaatctccacgggtaccatctccaccaccaagcccacggctgagacgccgaactccagtccagcttttatcctgccccccccacttgctcaagagcaagtccgaggctagtctgctgcagctcctcgccggcgccgggacacacgggacaccgtctgctccaagcagaagtctaagcgagttgtgtctggccgttccggctcctggaattcggactcagggatcaccccaagaagccgggccttcttgggactgcagaggtgctccatcgccaggtagtggaccaggcttggtgggctgcttggccggggaaccagctggctcccacaggaaacggtgcggggatctcccatcaggtgcgtcgccccgggttcagcctgagcctcctccaggggtctctgctcagcatcgcaagttgaccttagcccaactataccgcattcggacaactttactgctgaatagcaccctcactgcgtcggaggtgtag

SEQ ID NO: 199782 - DNA, 3021 bp, Artificial Sequence
  Description of Artificial Sequence: Synthetic coding sequence
atgcactacgacggccacgtgcggttcgacctgcccccccagggctctgttctggcccgcaatgtcagcacacggagctgtccaccaaggaccagccctgcagtggacttagaggaagaggaggaggagtcatcagtggacggcaagggcgatagaaagtcaacggggctcaagctgagcaaaaagaaggccagacgacgccataccgatgatccgtcgaaggaatgtttcacgctgaagttcgatctgaacgtggatattgagacagaaatcgtgcctgccatgaagaagaaatcactgggcgaggttttgttgcctgtcttcgaacgtaaggggatagcgctggggaaggtagacatttatttagatcagtctaataccccgctgagccttaccttcgaggcatacagattcggaggacattatcttcgagtgaaagcgcctgccaaacctggtgatgagggtaaggtagagcagggaatgaaggattcgaagtccctatcacttccgattctgaggccagccggcacggggccacctgcactcgaacgagtggacgcccagtccagacgggaatcgttggacatactggctcccggccggagacgtaaaaacatgtcagagttcctgggagaggctagcatccccggtcaggaaccccccactccaagttcctgttcattaccatctggcagctctggttccaccaatacaggtgactcttggaaaaatcgggcggctagtcgattctcagggtttttctcaagtggccctagcaccagcgcattcgggcgggaagtagacaagatggagcagctggaagggaaactccacacatacagcctttttggcctgcccaggttgcctcgcggtctacgcttcgaccatgacagttgggaagaggaatacgacgaggatgaagacgaggataatgcctgcctgcgcttggaagatagctggagagaactcattgacgggcatgagaaactgacacggcgacagtgccatcaacaggaagccgtgtgggagctcctccataccgaggcatcctacatccggaagctgagggtcataatcaacttgtttctgtgctgcctactcaacctccaggaaagtggacttctatgcgaggtggaggctgaaagactcttctccaatatcccagagatcgctcagctgcaccggcgtttgtgggctagcgtcatggcacccgtgctggagaaggcacgccggacaagggccctgctgcaaccgggtgactttttgaaggggtttaagatgtttggaagtctgttcaaaccctatatccgatattgcatggaggaggaaggctgtatggagtacatgcgaggcctgttgcgagacaacgacctgttccgcgcttacattacttgggcagaaaagcacccacagtgccagagactcaagctgagcgatatgctcgcaaaaccccatcaacgtctgactaagtacccgctcttacttaaaagcgttctgaggaaaacagaggagccaagagctaaggaagctgtggtcgctatgattggaagcgtcgagcggttcattcaccacgtaaacgcgtgtatgagacaaagacaagagcgtcagagattagcagcagtcgtgtcccggattgacgcctacgaagttgtggaaagttcctctgacgaagtggataagctgctgaaagaattcctgcacctggatctgacagctcctatcccaggcgcttccccagaagaaacccgccagcttctcctggaaggaagcttgcgaatgaaggagggtaaggatagcaagatggacgtatactgtttcctgttcactgatctgttactggtgactaaggcagtaaaaaaggcggaaaggacccgcgtgatcaggccaccattgttggtcgacaaaatcgtctgtagggaacttagggatcccgggagcttcctactgatctacctgaatgagtttcactcggcggtcggtgcctatacgttccaggccagcggccaggcattatgcaggggatgggtggacacaatttacaatgcacaaaaccagctccaacagttgcgcgcacaagagcctcccggttcccagcaacccctccagagtctggaagaagaggaggacgaacaggaagaggaggaggaggaggaagaggaagaggaggagggagaggatagcggtaccagtgccgcgagctctccgacaatcatgaggaaatcctctgggagccctgacagccagcactgcgcatcagatggttccacagaaacgctggccatggtagtggtggagccaggtgacaccctgtcgtcgcctgaatttgatagtggtccattctccagtcagagtgacgagacttccctgtcaacgacagcctcctcagctactcccacctcagaactccttccactcggtcccgtcgatgggaggtcttgctccatggattcagcatatgggacactgtcccccacttcactgcaggactttgttgcccctgggcctatggctgagttagtgcctcgcgccccggaaagtcctcgcgtaccgtccccccccccgtctccaaggcttaggcgccgaacaccagtccaattactctcatgcccaccccacctgctcaagagcaaatccgaggcatcactgctgcaattactggcgggagctgggacacatgggacacccagtgcaccttccagatccttgtcggagctgtgtcttgcagtgcccgcacctggaattcgcacccaaggcagtccacaggaggccggtccttcgtgggattgccgaggtgccccatctcccggctccggtcctggcctggtagggtgtctggcgggagagcctgcaggctctcaccggaagcggtgcggcgacctcccgtctggtgcaagtccacgggtgcaaccagagccacctcccggagtaagcgctcagcaccgcaaattgacccttgctcagctctatcgtattcggactactctgctgcttaacagtactttgacggcttcagaagtttag

SEQ ID NO: 199783 - DNA, 3189 bp, Artificial Sequence
  Description of Artificial Sequence: Synthetic coding sequence
atggacgaccagagccccgccgagaagaagggcctgcggtgccagaaccctgcttgtatggacaaagggcgtgctgccaaggtctgtcatcatgccgattgccagcagttgcatcggcgtgggccacttaacctgtgtgaagcttgcgatagcaaatttcattccacaatgcactatgacggccacgtcaggttcgacttgccaccacagggatctgtgttagcgcggaatgtttcaacgcgctcatgtccacctcgaaccagccctgccgtggacttagaggaggaggaagaagaaagcagcgtcgacgggaagggggacagaaaatctacaggactgaagctctcgaagaagaaggcccgcaggcggcatacagatgaccccagcaaagagtgttttacgctcaagtttgatttaaacgtcgatattgaaaccgagatcgtgccagcaatgaaaaagaagagcctaggggaagttttactgcctgttttcgagcgtaaggggatcgccctggggaaggtcgatatctacctcgaccagagcaacacccccttgagtctgacgttcgaagcgtataggtttgggggacattatctgcgagtgaaagctcccgctaagccaggcgacgaaggaaaggtggaacaagggatgaaggactctaaatcgctgtcactgccgatcctgcggcctgccggtaccgggcctcctgcgctcgagagagtggacgcgcaaagtagacgcgaatccctggatatcctggcgcctgggaggagaagaaaaaatatgtctgagtttttaggcgaggcttccatccctggccaggagccccctacgccttcttcctgttccctgcctagtggatcatctggctccacaaacacgggcgattcctggaaaaatcgagctgcatccagatttagcggttttttttcaagtggtccatccacgtctgcatttgggcgggaggttgacaagatggagcagcttgagggcaagctacatacttacagcctttttggcctccctcgcctccctagagggctccgattcgatcacgattcctgggaagaggagtacgacgaggacgaggacgaggataacgcttgtctgcgcctggaggattcgtggcgagagctaattgacgggcacgagaaactaactcgtcggcagtgtcaccagcaagaggctgtctgggaactactgcacaccgaggcaagctacatcagaaaattaagggtgataatcaatttatttctatgttgtcttctgaatttgcaggagagcggcctgttgtgcgaagtggaggctgagaggctgttctctaatattccggagatcgctcagttacataggaggctgtgggccagcgtgatggctcccgtgttggagaaggctcgaagaaccagagccttacttcagccaggggatttcctgaagggctttaagatgttcggttctctattcaagccctacattaggtattgtatggaggaagaggggtgcatggagtacatgcgagggctgctgcgcgataatgacttatttcgagcgtatataacctgggctgagaaacacccacaatgtcaacggctgaagttgtccgacatgttagccaaaccccaccagcggcttaccaaatatcccctgctgttgaaaagtgtattacgaaagaccgaggagcctagggccaaagaggcagtagttgcaatgattggtagcgtagaaagattcatccaccacgtgaatgcgtgcatgagacagcgccaggagcgccagagacttgctgctgtcgttagtcggatcgatgcttatgaggtcgtggagagcagctctgatgaagtcgacaagctgttaaaagaatttcttcatctggacctgactgccccaatacctggagcctcacctgaagaaacccgacagctgctgctagaagggagccttaggatgaaggagggaaaagattctaaaatggacgtttattgttttctctttacagacttgcttttggtgaccaaggccgtcaagaaagccgaaagaacccgcgtgatcaggcctccactgctggttgacaaaatagtgtgtcgtgaattgagggatcccggaagctttcttcttatttacctgaacgaatttcactcagccgtgggggcttatacattccaagccagtgggcaagctctgtgtagaggatgggttgacacgatctataatgcccagaatcagctgcagcaactgcgggcacaggaaccaccaggctcccaacaacccttgcaatcgcttgaggaggaagaagatgaacaggaggaagaggaggaggaggaagaggaagaggaagaaggtgaggacagtggcacttcagcagccagttcccccacaattatgaggaagagttccggttctccggatagccagcattgtgccagcgacggctcgaccgagacattggccatggttgtcgtggagcccggggacaccctgtcctccccggaatttgactctggacctttcagctcacagtctgacgaaacctcactgtcaaccacagcctctagcgccaccccgacatcagagctacttccactggggcctgtggacggtaggtcttgttccatggattctgcctacggtactctgagcccaaccagcctgcaggacttcgttgccccaggtccaatggcagagctggtcccacgcgcccctgaatcccctagagttccaagtccccccccgagcccacgcctgagacgccgaacccctgttcagctgctgtcatgccccccacatcttctcaagtctaagagcgaggcttcgcttctgcagctgctggctggggccgggacgcacggaacgccctcagctccatcccgaagtttgtctgagctgtgtctggccgttccagctcctggcatcaggactcaggggagcccccaggaggcagggccgtcctgggactgtcgcggggctccctcgcccgggagcggcccgggcctagtggggtgtctcgctggcgagcccgccggttcccacaggaagcgctgtggcgacctcccgagtggtgcctccccgagggtgcagccagaaccaccaccaggcgtcagcgcccagcaccgaaagctgacacttgcacagctttacagaattcgtaccacacttcttctgaattctacgttgaccgcaagcgaggtgtag

SEQ ID NO: 199784 - DNA, 3228 bp, Artificial Sequence
  Description of Artificial Sequence: Synthetic coding sequence
atgggcaccggccccggcgtgagcggccggctggccgccagccggcctggcccaggtcttcctctaagggactctgaacccagctgggctggtggacgggctagggatggagacagccaagtgtgtcatcacgccgactgccagcagctgcaccggaggggtccactgaatttgtgcgaggcctgcgatagcaaattccactcaacaatgcattatgatggccacgttcggtttgacctgccaccacagggaagcgtcctagctcgtaatgtgtctacaagatcttgcccacctcgtaccagtcctgcagttgacctggaggaggaggaggaagagtcttctgtagatgggaagggcgaccggaagtctacaggcttgaaactgtctaagaaaaaagcacggcggcgccacacagatgatcctagcaaggagtgctttaccctgaagtttgatcttaacgtggacatcgaaactgagatcgtaccagccatgaaaaaaaaatccctgggagaagttctgttgccagtcttcgagagaaaggggatcgcacttgggaaggttgacatctacctggaccagtctaacactcctctgagcctgaccttcgaggcgtatcgcttcggtgggcactacctgagagtgaaggccccggctaaacccggagatgagggcaaggtggagcagggtatgaaagactctaaaagtcttagcctgccaatactgcgcccggccgggacaggcccccccgccttagaaagggttgatgcccagtcgaggcgcgaatccctggatattttggcccctggccgacgacgaaaaaatatgagcgaatttctgggtgaagcatccatccctgggcaggagcccccaacaccgtcctcatgttctctgcctagcggcagctctgggtctacaaatacaggcgactcctggaaaaatagagctgcgtctaggttttctggattcttctcatcaggaccgagcacttctgcttttggtagagaagtggataagatggagcaactggaaggtaaattacacacctattctctatttggattgcctagactgccaagggggctccgattcgaccacgattcatgggaagaagagtatgatgaggatgaggacgaagacaacgcctgcttgcgccttgaggacagctggcgggagttgattgacgggcacgaaaagctaacacgcagacagtgtcatcagcaagaggcagtgtgggaattgttgcacactgaggcaagttacatacgaaaattgcgggttatcattaacctctttctgtgttgcctcctgaacctccaggagtccggcctgttatgcgaagtcgaggctgagcggctgttctcgaatatccccgagatcgcgcagctgcatcggcggttatgggcttcagtgatggcaccagtcctggagaaagcacgtaggactagggcacttctgcagcctggagattttctaaaggggtttaagatgtttggcagcctgttcaagccctatatcaggtactgcatggaggaggagggctgtatggaatacatgcgcggactcctccgggacaatgatctctttagagcttacataacatgggccgagaaacacccacaatgtcagaggctgaagctgtctgacatgctggctaagccacaccagaggcttactaaataccctctactcctgaaaagcgtgttgcggaagacagaagagccacgagctaaggaggcagttgtggctatgatcgggtcagttgaaagattcatccatcatgttaacgcatgtatgcgccagaggcaggaacgacaacgcttggccgccgtcgtctctcgcattgacgcgtacgaggtagttgaaagcagctctgatgaagtagacaagcttctgaaggagtttcttcacttggatttaacagctccgatcccaggagcctcacccgaagaaacaaggcagctgttgctggagggcagcctgaggatgaaagagggaaaggattccaagatggatgtgtattgctttcttttcaccgatctgttgctggtgactaaggccgtgaaaaaggcggaaaggactagggttatcaggccccctttgctcgttgacaagatcgtctgccgcgagttgagggaccccggctcattcttgcttatctacctgaatgaatttcattccgccgtgggtgcgtacaccttccaggcctccggtcaggctctctgtcgaggctgggttgacactatctacaacgcgcagaaccaactccaacagttacgcgcccaggaacctcccggatcacaacagcctctgcagagtctagaagaagaggaggacgaacaagaggaagaggaggaagaggaggaggaagaagaagagggggaagattccggtacatccgccgcaagtagccctacaataatgcgcaagtcctcaggaagccccgattctcagcactgcgccagtgatggctctacagagacactagccatggttgttgttgaaccgggggatacgttgtcaagcccagaatttgatagcggcccttttagcagccagtcggatgagacttcactcagtaccaccgccagtagcgccaccccaacttccgagctcctgcctctgggtcccgttgatggcagatcttgctcgatggacagcgcgtatggcacactcagtccgacatctctgcaggactttgtggcccccggtccaatggccgaactggtaccaagggcaccagaatctcctagagttccgagtccacctcccagccctcgcctaagacgccgaacacccgttcaattactgtcatgtcctccacacctgttgaagtccaaatcagaggccagcctcctgcagttattggcaggagcagggacacacgggacgccctctgctccatctcgctccctctccgagctctgtctggccgtgcccgctccaggtattaggactcagggtagtccccaagaggcggggccatcatgggattgccgcggggcgccttctccgggatctggacccggactggtcggctgcctggccggggagccagctgggtcacacaggaagcgttgtggtgacttgccatcaggggcatctcctcgagtgcaacctgaacctccgccgggagtctccgcccagcacagaaagcttacgcttgcccagctgtacagaattaggactacattgctgctgaacagcacgctcacagcttccgaagtctag

SEQ ID NO: 199785 - DNA, 2739 bp, Artificial Sequence
  Description of Artificial Sequence: Synthetic coding sequence
atgaagaagaagagcctgggcgaggtgctgctgcccgtgttcgagagaaaagggattgcactcggaaaagtagacatttatctggatcagtccaacacacccctgtcactgactttcgaggcatacagatttggggggcattatctccgagtcaaggctcctgccaaacccggtgacgagggaaaggttgagcagggcatgaaggactctaaaagcttgagcctacccatccttcgccctgcagggacgggaccacccgccttggagagggttgacgcgcaaagcaggagggaaagccttgatatactggctccaggccggcgccgtaagaatatgtccgagtttctgggcgaagcctcaattccaggacaagaacctcccactccatcaagctgctctcttccctcagggtcatctggtagcaccaataccggggattcctggaaaaatagggctgctagcagattttcagggttcttttcttccggcccatcaaccagcgcgtttgggcgagaggtggacaaaatggaacagcttgaaggtaagttgcacacctactccctttttgggctgcctaggctaccacggggtctcagatttgatcacgactcatgggaagaggaatatgatgaggatgaggacgaagataacgcttgcctcaggctcgaggatagctggagagagctgatagatggccacgaaaagctgactcgccgccaatgccatcagcaggaagccgtgtgggagctactacataccgaggcatcctatatccggaagcttcgggttattattaacctgttcctgtgctgcttactgaacctgcaagagtcaggactgttatgcgaggtggaggcagagagactgtttagcaatattccagaaattgcacagctacatcgtcgcctgtgggcttctgttatggcccccgtactagaaaaggccagacgcacccgggctctgttgcagcccggggatttcctgaaagggttcaaaatgtttggctcactgttcaaaccatatatccgctattgcatggaagaagagggatgcatggaatatatgaggggtctcttgagagataacgacctctttagagcatatatcacttgggccgagaagcatccgcagtgtcaacgcctaaaactgtccgacatgttggcaaagcctcaccagcgcctgacaaagtacccgctactgctcaagtctgtgttgaggaaaaccgaagagccacgcgcaaaggaagctgtggtggctatgattgggtctgtcgaacgttttattcaccatgttaacgcatgcatgaggcagcgccaggagagacagcggctcgccgccgtagtcagtagaattgatgcctatgaagtggtggagtcttcatccgacgaagtggacaagctgctgaaggaatttctccatctcgatctgactgcgcccatacctggggcctcgccagaggaaacgcgacagctgctgctcgagggctctcttagaatgaaagaggggaaggattcaaagatggacgtgtattgtttcctcttcacggatctgctgctcgtcactaaggccgtgaaaaaggccgaaagaacccgcgtgatcaggccacccctgttagtcgacaaaatcgtgtgccgcgagctgagggatcctggctcatttcttctgatttacctaaacgaattccattccgctgtgggcgcatacacatttcaagctagcggacaggctttatgtcgaggttgggtggacaccatttataacgcgcaaaaccagctccagcagttgagggctcaggagcctcccgggtcacaacagcctttacaaagcctcgaggaagaggaagacgagcaggaggaggaggaggaagaagaagaggaggaggaggagggggaagatagcggtacaagcgcggcaagcagccccaccatcatgaggaagtcaagcggctcacctgactctcagcattgcgctagtgatggcagcacagagaccctcgctatggtagtcgtggagccaggggataccctgagtagcccagaattcgatagcggacccttcagttctcagagtgacgaaacatcactgtccacgaccgcttcttctgccacaccgacatctgaacttcttccgctggggcctgtggatggcaggagttgcagcatggactctgcctatggcacactctcccccactagtcttcaagattttgtggctcccggacctatggcagagctggtcccgcgagcccccgaatcccctagagtcccttctccacccccttccccgaggttacggagacgcacaccagtgcagctccttagctgccctccacacctgttgaagagcaaaagcgaggcttccctcctgcagctgctcgccggggccggcactcatggtacgccctccgccccatcacgctccttgtcagagttgtgccttgctgttccagctcctgggattcggactcagggtagcccgcaggaagcgggcccctcatgggactgtaggggcgcgccttcaccaggaagcgggccaggactggttggatgtctggccggagagcccgctggatctcaccgaaagcgttgcggcgaccttccctcgggcgcgagtccacgcgtacagccggaaccccccccaggggtgtctgctcagcatcgcaaactcactctagcccaactgtacaggataaggaccacactcttactcaactcaaccctgactgctagcgaggtatag

SEQ ID NO: 199786 - DNA, 3258 bp, Artificial Sequence
  Description of Artificial Sequence: Synthetic coding sequence
atgagcctgggcgagcggggcagcccccagaccttcggcggcagcagtgttagcaaaggctccgacgccggacacgatcaatcccctgccgaaaagaagggtctaagatgccagaaccccgcatgcatggacaaaggaagagccgctaaagtttgtcatcacgcggactgccagcagctgcacaggcgggggccccttaacctgtgtgaggcttgtgattccaagtttcactcaaccatgcattatgacgggcacgtgagattcgacctaccaccacagggctcagtgttggccagaaatgtgtcgactagatcatgtcctccaagaacctccccggcagtggacctggaagaggaggaggaggaaagctctgttgatggaaaaggagatcggaaaagtaccggcttaaagttatcaaagaagaaggctaggaggagacatacagacgatccgagcaaggagtgttttacactcaaatttgatttgaacgtggacattgagacggaaattgtgcccgcgatgaaaaaaaagtcactgggagaggtgctgctgccggtgttcgaacgaaagggcatagccctgggcaaagtggacatctatctggatcagtcaaacactccactctctttgaccttcgaggcgtacagatttggcgggcactacctccgggtcaaggcccccgcaaagcctggggatgaaggcaaggtggaacagggcatgaaggacagtaagtcgctatcattacccatccttcggccagctggcactgggccacctgctctggaacgggtggacgctcagagcaggagagagtcactagacatcctggctccaggtaggcgacggaaaaacatgagcgagtttttaggcgaggccagcatccctggccaggaaccccctacaccatcatcttgtagtctcccaagcggctcctccggatcaacaaataccggggactcttggaagaatagggccgcctcgagattctcaggcttcttttcgagcggaccctcaactagcgcattcggtcgtgaggtagacaaaatggagcagctggaggggaagttacacacctattccctgttcgggctgcctagactccctagaggtctcaggttcgatcatgatagttgggaggaagagtacgacgaggatgaggacgaggacaatgcctgcctgaggctggaggacagctggcgcgaactgatagacggacatgaaaaactaactcggcgtcagtgtcaccagcaagaggcagtctgggagttgctgcatacagaggcctcatacatccgtaaactgcgcgttatcataaatctttttctttgttgtttgctcaacctacaagagtctgggctgctgtgcgaagtcgaggccgaacgactcttttcaaacataccggagatcgcacaactccataggaggctatgggcaagcgtaatggctccggtgttggaaaaagccaggcgcactagagcactcctgcagcctggagactttctcaaaggattcaagatgtttggatccctgttcaagccttatattcggtattgcatggaagaagagggctgtatggaatacatgcggggtctgctgcgggacaatgacctattccgggcctatatcacatgggccgaaaagcacccacaatgccagagactgaaactgtctgacatgctggcaaaaccgcaccaacgcttaacaaaataccccttactgctaaaaagcgtactccggaagacggaagaacccagggccaaagaagctgtggttgcaatgatcggatcagtcgaacgcttcatccatcacgtcaatgcttgtatgagacagaggcaagaacggcagcgactggctgccgtggtgtctcgcatcgacgcttacgaggtagttgagtcgagttcggatgaggtcgacaagctcctcaaagagtttctgcatcttgatttaaccgctccaattcccggtgcatcccccgaggaaacaaggcagctgcttttggagggatccttgagaatgaaagaaggcaaggatagtaagatggatgtgtattgttttcttttcacagacttgctgctagtaaccaaagccgtgaaaaaggcagagcggaccagagtcattagaccacctctcttagtagataaaatcgtctgtagagaattgagggaccccggtagtttcctcctaatctatcttaatgagttccactccgcagttggagcgtatacatttcaggcaagcggccaggctctctgcagagggtgggtggatacaatatataatgcgcagaatcagttacagcagctgagagcccaggagccacccggatctcagcagccactgcagtccctggaggaggaggaggacgagcaggaagaggaagaagaagaagaggaagaggaggaagaaggtgaggatagcggcacgagcgccgcctccagccccaccataatgcgtaaaagcagcggttctccggattctcagcactgcgcctctgacggcagtacagagacactggccatggtggtagttgagcccggcgacacgctgagcagcccggaattcgattccggccctttttctagtcaatctgacgagacatccctgtcaacaaccgcctcatccgctaccccaacctccgagttactccccttagggcctgtggacgggcggtcttgttctatggacagcgcttatgggaccctctcgcctacatcactccaggattttgtcgccccaggtcccatggccgaactggtcccccgagccccagagtctcccagggtgccctctcccccaccttctccccggctaagacgtcgaacaccggtgcagttactgtcctgtccacctcatctactgaaaagtaagtccgaggcttccctcctgcaactgctggctggcgccggaacccatggaacaccttcggccccaagtagatcgttgtcagaactgtgtttagcggtcccagccccaggcatccgcacgcagggaagtccccaggaggctgggccaagctgggattgtaggggcgcaccatctcccgggtctgggccaggactggttggatgtttggccggggaacctgccggaagccaccgtaaaaggtgcggcgaccttcccagcggagcctcacctagagtgcagcccgagccccccccgggcgtgagcgctcagcataggaagctcactttggctcagttatatcggatccgcacaaccctgctactgaattctacactcacagctagcgaggtgtag

SEQ ID NO: 199787 - DNA, 2793 bp, Artificial Sequence
  Description of Artificial Sequence: Synthetic coding sequence
atgcactacgacggccacgtgcggttcgacctgcccccccagggctccgtgcttgccagaaatgtgagcactcgttcttgtccgccacggaccagtcccgccgtggacctggaagaagaggaggaagagtccagcgtggacggcaagggagaccgtaagtcaactggtctgaaactcagcaaaaagaaggccaggaggcgacacacagatgatccatcaaaagaatgcttcacactgaagttcgatctgaatgtagacatcgagacagaaatagtaccagccatgaagaagaagagtctgggcgaggttttacttccagtgtttgagcgtaagggaattgcgctaggcaaggtagacatatacttagatcagtccaacacgcccctatccctgaccttcgaggcctataggtttggtggacattatcttcgggtgaaggctcccgccaagcctggagacgaggggaaggtggaacaaggcatgaaagacagcaaaagtctcagcttaccaatactgagaccagcgggaacaggaccccccgctctcgaacgcgtagacgcgcagtcccgcagagagagcttagatatccttgccccagggcggcgtagaaaaaacatgagcgaatttcttggcgaagctagcatcccgggccaggaaccgccaacgccttcgtcatgtagcttgccctcaggatccagtgggtctacgaacacaggagactcttggaaaaatcgtgccgccagtagattctcaggtttcttctcctctggaccgagcacctcagcttttggacgggaggtggacaagatggagcagctggaggggaaactgcacacctattcactgttcggattgcctagactcccgcggggcctgcgctttgatcatgatagctgggaagaagaatatgatgaggatgaagatgaagacaacgcctgtctgcgcttggaggacagttggagagagctgatcgatgggcacgagaagctgaccagacgacagtgtcatcagcaggaggctgtgtgggagctgcttcacaccgaggctagttacattagaaagctgcgggtgatcatcaacctgttcttgtgttgcctgttaaatctccaggagagcggtctactgtgtgaggtggaagcagaacggctgttcagtaatatccccgagatcgcacaattgcatcggcggctctgggcgagtgtaatggctcccgtgctggagaaagcgcggcgcaccagagctcttctccagccaggtgacttcctgaagggctttaaaatgtttggcagcttattcaaaccttacatcagatattgtatggaggaggagggatgcatggagtatatgaggggattgttgagagacaacgacctgtttagagcctacattacttgggcagagaaacatccccagtgccaacgcctcaaacttagcgatatgcttgccaaaccgcaccagcggcttacaaagtacccgcttctgctgaagtccgtgcttcgtaagaccgaggagccccgcgcaaaggaagctgtcgttgctatgattggaagcgtggagaggttcattcaccacgtgaacgcctgtatgagacagcggcaggaaagacagaggctggccgctgttgtaagcaggattgacgcgtacgaggtggtcgaaagcagctcagatgaagtcgataagctgctaaaagagttcttgcaccttgatctcacagcccccatacctggcgcttcaccagaggagacaagacagcttttactggaaggcagcttgcgaatgaaagaggggaaggatagcaaaatggacgtatactgttttttattcactgatctcctgctcgtgaccaaagccgtgaagaaagctgaaaggacgcgggtcatacgacccccccttcttgtcgataaaatagtttgtcgggaactccgtgatcctggctccttcctgctgatctacctgaacgaatttcacagcgctgtaggcgcttatacattccaggctagcggccaggcattgtgccgcggctgggttgatactatctataatgcacagaaccaactccagcagctccgcgcacaggaacccccagggagccaacagccattgcagagcttggaagaggaagaagatgagcaggaggaggaggaggaagaagaggaagaagaggaggagggagaagatagcggcacctccgcggcctctagccccaccattatgagaaaatcgtccggaagccccgattcccagcactgcgcttctgatggcagcaccgagacactggctatggtggtcgtcgagcctggagataccctgagctctcctgaatttgattctggccctttttcttcacagtctgatgagacctctctgagcaccactgctagctcagcaactccgacaagcgaacttcttcctctcgggccagtcgatggcagatcctgcagtatggatagcgcttacggaacgctaagtcccactagtctgcaggattttgtcgcgcctggacccatggctgaattggtacctcgggctccggaatcccccagagtgccctcaccccctccgtcaccccggcttagacggcgcacgcccgtacaactgttatcatgccctccccatcttctgaaatcaaagtctgaagcctcactgcttcagctccttgccggcgccggaacacacgggactccttccgctccaagccgtagccttagtgagctgtgcctggccgttccggcacccgcccaggaggccgatcctggaccagccctccccaaccaagatcatcccgcggcttag

SEQ ID NO: 199788 - DNA, 2373 bp, Artificial Sequence
  Description of Artificial Sequence: Synthetic coding sequence
atgaaggccttcggccccccccacgagggccccctgcagggcctggttgctagccgaattgaaacgtatgggggtagacacagagcctcagctcagtctactgcaggccgattatacccgagagggtatcccgtgctcgacccaagcagacgccgtctccaacagtatgtgccgttcgcaagaggttccggacaagcccggggcctcagcccaatgcgactccgggacccggagcccgagaaaagacatggaggacatgtaggagccggactcctgcactcccccaagctgaaagagcttacaaaagcccatgaactggaagtgcggctccatacattttccatgttcgggatgcccaggttgccaccagaggacagacggcactgggagataggtgagggcggtgacagcgggttaaccatcgaaaagtcctggagagagcttgtaccaggtcacaaggagatgtcgcaggaactatgccaccagcaggaggccctgtgggagcttcttacaacagaactgatttatgttcgaaagcttaagatcatgacagatctcttagcagctgggctcctgaatctccaacgcgtcggacttttgatggaagtttccgctgagaccctttttggcaacgttccatctcttatcaggacacaccggtctttctgggatgaagtgcttggccctacacttgaggagactcgggctagcgggcaacccttggacccaattgggttacaatctggtttcctcaccttcgggcagcgctttcatccctatgtccagtactgcctcagagtgaaacagaccatggcgtacgcacgggaacaacaggagactaatcccctttttcacgcctttgtgcagtggtgtgaaaaacataagcgttccggccgccaaatgctgtgtgaccttctgataaagccacatcagagaatcactaagtatccattgttactccatgccgtgctcaaacggagcccagaggcacgggctcaggaggctctcaacgcgatgattgaggctgtggagagcttcctccggcatatcaacggccaggtgagacagggtgaggaacaggagtcgctcgcggccgcggcccagagaattggaccctacgaagttctagagccaccaagcgatgaagtagagaagaatctcaggcccttcagcaccctcgacctgacttcccccatgctcggcgtcgcatcagagcatacaagacagttgctactggagggccctgttcgggttaaggaaggaagagagggcaagcttgacgtttatctgtttcttttttctgacgtgctcctcgtgactaaaccccagcggaaggcagataaagccaaggtcatccgccccccgctgatgctggagaagctggtttgccagcccctaagggacccaaatagttttctgctgatccacctgacggagtttcaatgtgtctccagcgctcttctagttcattgtccctccccgaccgatagggcacagtggctggagaaaactcagcaggcacaagcagctctgcaaaagttaaaggccgaagagtacgtgcagcagaaacgagaacttctcaccctctatcgtgaccaggatagagagtcaccgtccacacgcccaagtactccctccctggaagggagtcagtcaagtgctgaaggcagaacgccagagttctctacgatcatcccccatctcgtggtcacggaggacaccgatgaggacgctcccctggtccctgacgacaccagcgattcaggttatggcacgctaataccagggacaccaaccggctcccgctctccactttccaggcttaggcagagggccttacgtagagatccacggctcacgttctctacacttgagctcagggatatacctctgcggcctcacccgcccgacccacaggcccctcaaagaagatctgctccggaattgcctgaaggaatcctgaagggcgggagccttccgcaggaggatcctccaacctggtctgaagaggaggacggagctagcgaacgcggcaatgtggtggtcgagaccctgcaccgcgcgcgactgaggggccagctgccctcaagtcccacccacgcagattccgcgggcgaatcaccttgggaatccagtggggaggaagaggaagagggcccgctgttccttaaggctggccacacctctctcaggccaatgagagccgaagatatgctgagagagataagggaagaattggcttcccagcggatagagggggccgaggaaccccgggattccagacctaggaagttaacacgagctcagttgcagcggatgaggggtcctcatattattcagctggacactcccctcagcgcttccgaagtttag

SEQ ID NO: 199789 - DNA, 963 bp, Artificial Sequence
  Description of Artificial Sequence: Synthetic coding sequence
atgtgcccccgggagggcggccgggccagcaccatccaccagaagaccgaaaaggcattcggtcagctgttgtgccagcctcttggtgagcccaagattcagcaccctctgaaggccgctctgcaaaaactgaaggctgaagaatacgtgcagcagaaaagagagttactaacgctgtaccgggaccaggatcgcgaaagcccttctacccggccctccacgccgtccctggaaggcagtcagagttcggcggagggcaggacaccagaattctccactattattccacacctcgtcgtcacagaagacactgatgaggacgcacctctggtgccagatgacacatccgactcaggttacgggacgctcattcctgggaccccaacaggcagccgttctcctttaagcagattgcgccagcgggctttgcggcgggacccccggctgacattcagtactcttgagttgcgggatattcctttaagaccccaccctcctgacccgcaggcccctcagaggagatccgcaccggagctgccagaaggaatactgaagggcgggagcctgccgcaggaggatcctcctacttggagcgaggaagaagacggcgcctccgagcggggtaacgtggttgtcgagactttgcatagagctcgcctccgcggtcagctcccatccagcccaacacacgccgactcagccggcgagtccccttgggaatcatccggcgaggaggaggaggaaggtcccctgtttctgaaggccggtcacacttctctgagaccaatgagagccgaagatatgctcagggaaatccgagaggaactcgcttctcagagaatcgagggtgccgaggagccccgcgactcaaggccccgcaagctcacgcgagctcagttgcaacggatgcgcggcccccacataatccagctggacacccccctatccgcttctgaggtctag

SEQ ID NO: 199790 - DNA, 2373 bp, Artificial Sequence
  Description of Artificial Sequence: Synthetic coding sequence
atgaaggccttcggccccccccacgagggccccctgcagggcctggtcgcctctaggatcgagacttatgggggccgacaccgcgctagtgcccaatccacggctggacgcctctatccacgtggctaccccgtgttagatccaagcagaagaagattgcagcagtacgtcccctttgcccggggtagcggacaggcacgtggcctctccccgatgaggctgcgtgatccagagcctgagaagcgtcatgggggacatgtgggcgcgggtctgctgcattctccaaaactgaaagagctcactaaagctcacgagctggaggtgcgactgcacacatttagtatgtttggtatgcctcgcctgccgccagaggatagaagacactgggagattggagaaggaggggactctggcctgactattgaaaaatcttggcgtgagttggtgccaggtcacaaggaaatgtctcaggaactctgccaccagcaagaggctctgtgggaactccttaccactgagctcatttacgtcaggaaactgaagatcatgactgatctcctcgccgctggactgctcaatctgcagagagtgggcctcctaatggaagtctctgcggaaactctctttggcaatgtaccaagcctgatacgcacccataggtcattctgggatgaagtgctgggacccactctggaggagacacgggcttcgggacagcccctggaccccatcggtctgcaatccgggttcctgacattcggccaaagattccacccgtatgtccaatattgcctgcgcgtgaaacagactatggcctacgctcgcgaacagcaggagaccaaccccctcttccatgcctttgtgcaatggtgcgaaaaacacaaacgctccgggcgccagatgctttgcgacttactgataaagccccaccagcgcattacaaagtatcctctgctgctgcacgctgtgttgaagcggagtccggaagcccgcgcacaggaggcactaaacgcgatgatagaagccgtggagagcttcctcaggcacatcaatggtcaggtgcgacagggcgaggagcaagagagtctggccgcagcagcccagaggattggaccatacgaagtgctcgagcctccctcggacgaggtggagaagaacctgcggccttttagcacactggatttgacctctccaatgctcggggtggccagcgagcacaccaggcaactgctgctcgagggcccagtcagagtaaaagaggggcgggaaggcaaactggacgtgtacctgtttttgttttcagatgttctcctggtcaccaagccccagcgcaaagccgacaaggccaaagtgatcagacccccactgatgcttgaaaaactggtgtgccaaccgctgcgtgatccaaacagcttccttctgatccatttgacagagtttcagtgcgtaagcagcgctctattggtgcactgcccatccccaaccgaccgcgctcagtggctggaaaagactcaacaagcccaggctgccctgcagaagctgaaggccgaagaatacgttcagcaaaagcgggagctgttgactttgtaccgagaccaggacagggaatccccctcaaccagaccttcaacgccttctttggaaggctctcagagttcggctgagggccgaactccggagtttagtaccattatccctcacctggtcgtcactgaagatactgacgaagacgccccccttgtgcctgacgacacttctgattccggctatgggactctcattcctgggacaccaaccggatcccggagccccctgtcacggctgcgacagcgagctttaaggcgggacccccggctcacattttcgacccttgagctgcgtgacattcctttaagaccacaccccccggacccccaggccccacagcgccgcagtgcccctgagttgcccgaaggaatcctaaaggggggttctcttccgcaagaggatcccccgacttggtctgaggaggaggacggagcctccgagcgggggaacgtagtcgttgagactctacacagagctagacttagagggcagttgccttcctcaccaacccacgcggactctgccggcgagagcccctgggaaagttctggggaggaggaagaggaaggccctctgttcctcaaggccgggcacacatcacttagaccgatgcgcgccgaagacatgctgcgcgagatccgagaggaactggccagtcaacgtatagagggcgctgaggaaccacgcgactctcgacctaggaaactcacgcgtgctcagttgcagcggatgcgcggccctcacattatacagcttgacactcctttgtctgcctcagaagtctag

SEQ ID NO: 199791 - DNA, 2277 bp, Artificial Sequence
  Description of Artificial Sequence: Synthetic coding sequence
atgggctgccggctgcacgcccccggcgagaaggccgcccacgacccaagcagacgacggctgcagcaatacgtgccattcgcccggggctctggccaagcccgtggcttatctcctatgcgcctgcgtgaccccgagcccgagaagcggcacggaggccacgtgggcgccgggctacttcattctcctaaactgaaagaactcacaaaggctcacgaactggaagtgaggctgcatactttctccatgttcggtatgcctcgactcccacccgaggaccgccgccactgggaaatcggtgaggggggagacagcggactcacaattgaaaagagctggcgggagctggtgccaggacacaaggagatgtcacaggagctctgtcaccaacaggaggcactatgggagttgctgacaaccgaactgatctatgttcgcaagctgaaaatcatgaccgatctgctggcagccggcctgctcaatctgcagcgggtgggactgctgatggaagtctccgcggagacactctttggcaatgtgccttctttaatccgcacacacaggagcttctgggacgaggtgttaggtccgaccctcgaggagacacgcgccagcggtcaacccctcgatcccattggcctgcaaagtgggttcctgacatttggacagcgattccatccctatgtgcagtattgcttgagagtgaagcaaaccatggcctacgcccgggagcaacaagagaccaatcccttgtttcacgcctttgtgcagtggtgtgagaaacataagcgatctggcaggcagatgctctgtgacctgctgataaagcctcatcagaggatcacaaagtaccctctactgctgcacgcagtgctgaaacgaagccccgaggcccgagctcaggaggcccttaacgccatgatcgaggccgtggaaagctttctgaggcatatcaacggacaggtccgccagggtgaagaacaggagagccttgccgccgcagctcagcggattggcccctatgaggtactggagcctccctctgacgaggtcgagaaaaacctcagacctttctcaacactggatttgaccagccctatgctcggagtcgccagtgagcatacaagacagctattgttagaaggccccgtgcgagttaaagaaggaagggagggcaagctcgacgtgtatctgttcctgttttcggacgttctgttggttaccaagccccaacgcaaggcagacaaagcaaaagtaattagaccccccctgatgctcgaaaagctcgtctgtcagcctctgagagatcccaactctttcctcctcattcacctcacagagttccaatgtgtttcctccgctctgctggtccattgcccttctccaaccgatcgagcacaatggctggagaagacccaacaggcacaggcggccctacagaagcttaaagcagaggaatacgtgcagcagaaacgcgagcttctgaccctctaccgggatcaagaccgggagtccccttcaacacgcccctccactcccagtctggagggttctcaatcatccgccgaggggcgaacaccggagttcagtacgataatacctcatttggtggttacggaggacaccgatgaagatgcgcccttggttccggacgatacatcagattccggttacggaaccctgattcctgggactcccactggcagcaggtcacctctgagccgattgaggcagcgggccctccgcagagacccgagactcaccttcagtacgctggaactgcgcgacatccccttgaggccacaccccccagatccccaggctccacagcgccggagtgcacccgaactgcccgagggaatcttgaagggcggaagcttaccgcaggaggacccccctacatggtccgaagaggaggacggcgcctctgaacgaggcaatgtggtggttgagacgctgcaccgagctcggctgcgggggcagctgccctcctcaccgacgcacgccgactctgccggtgagagcccatgggaatcgtctggagaggaagaggaggaggggccactctttctcaaggcggggcacacgtccctcagacccatgcgcgccgaagacatgctgcgtgagatcagagaagagctcgcatctcagcggatcgagggtgccgaagagccaagagacagcaggccaagaaaattaaccagagcacagctacaaagaatgaggggcccacatatcatccagctggatacccccctgagtgcctccgaagtttag

SEQ ID NO: 199792 - DNA, 4482 bp, Artificial Sequence
  Description of Artificial Sequence: Synthetic coding sequence
atggccgagctgagcgagcccgagggccccgtggactggaaggagaggtgcgttgcattagagagccagctgatgaagttcagggtacaagccagcaaaattagggagttgctggctgagaaaatgcagcaactggagcggcaagtaatcgatgccgagaggcaggctgaaaaggcattccagcaggtccaggttatggaagataagcttaaggctgctaacattcagactagtgagagtgagactagactgtacaacaagtgccaggacctggaatccctaattcaggagaaggatgatgtcatccagaatctggagctgcagcttgaggaacaaaagcagattcgcattcaagaagctaagatcatcgaagagaaggcagccaaaataaaagagtgggtcactgttaaactaaatgagttagagctggaaaatcagaatctgcgcttgatcaatcaaaatcagacagaggaaattaggactatgcagtcaaaactccaggaggtccagggaaaaaaatctagcactgtctcgactctcaagctaagtgagggccagagactaagtagcctaacttttggatgttttctcagcagggcgcggagcccaccgcaggtagtgaaatctgaagaaatgtcaaagatatccagcaaggagccagagttcacggaaggaaaagacatggaagagatggagattccagagaaatccgtggataaccaggttctcgaaaacaatcgaggacagcggaccttgcatcaaaccccctgtggttctgagcagaaccgcaagacgagaacaagtttcgctactgacggaggcatcagtcagaatagcggcgcaccggtgagcgattggagctctgatgaggaagatgggtcgaagggccgatctaagtcacgttgcacatccacgctgtcaagccatactagcgaagagggcgtacaatgcagccggatggggtctgagatgtatctgactgcttctgatgactcttcaagcatttttgaggaagagacatttgggatcaagaggccggagcacaaaaagctttattcctggcagcaagaggctcagtggaaggcactgaacagccccctcggcaagggcaattccgaactcagtaagaaggaacaggacagttccagtgatgaactgaataaaaaatttcagagccagcgactagactactcaagcagcagtagcgaagctaacacaccaagtccgatactgacccctgctcttatgcccaagcaccccaattctctgtcaggtaaggggactcagctagtgccatcttcccatctgcccccaccaaagctccgaattcccaacgtgttcagtatttctgtggctctagccaagaggcacttgtctcagccgcagctctctagtgatcgtatgtttggcaccaacagaaacgcgatttccatgattagacccttgaggcctcaggagactgacttggatctagtggatggggacagcactgaagtcttggaaaatatggacaccagctgtgacgatggattgttctcgtacgactccctggactccccgaactccgacgaccaggagcactgcgattccgcaaaaaaggttgcgtattcaaagcctccaaccccaccccttcatagatttcccagctgggaatctcgaatatatgcggttgctaagagcggcatccgtatgagtgaagcttttaacatggagagcgtgaataagaactccgccgcaacattgagttatactacatctgggctctatacatctttgatctacaagaacatgaccacacccgtgtacacaacactcaaaggcaaggccacacagatctcatcctctccatttttagacgactcctcaggctctgaggaggaagacagtagcaggtcatcatctcgcaccagtgaaagcgatagcagaagcaggagcggccctggaagcccccgcgcaatgaaaagaggggtgagtctgtcctccgtggcctcggaatccgactatgctatacccccggatgcctattcaacggacaccgagtactcccagcctgagcaaaagttgccgaaaacatgttcctcttccagtgacaatgggaaaaatgaacccctagaaaaaagcggttacctgctcaagatgtcaggaaaagtaaaaagctggaaaaggcgctggtttgtgttgaaaggaggagaactgctttactataaatctccaagcgatgtgattcgaaaaccacagggtcatattgagctgagcgccagctgttcaattctgcgcggggacaataagcagacagtgcagttaacaaccgaaaaacacacatactatctcacggcggatagtcccaacatcctggaagagtggatcaaggtgttgcagaacgtcctccgtgtccaagcggccaacccactgagcctgcaacctgagggtaaaccaaccatgaagggacttctgacaaaggtgaagcacggatattctaaacgggtgtggtgcactttaatcgggaagaccctgtactactttcgatcccaggaggataagtttcctctgggtcagatcaaactctgggaagccaaagtggaggaggtcgaccggagctgcgattctgacgaggactacgaggcttctggccgtagtttgctctctacccattacactatcgtgattcacccaaaagatcagggaccaacctatttattaatagggtctaaacacgagaaagacacttggctatatcatctgaccgtcgcagcaggtagcaataatgttaatgtgggtagtgagttcgaacaattggtgtgtaaactgctgaatattgacggcgaacccagttctcagatttggcgccacccgacactctgtcactcaaaggagggcattatttctccgctgacgacgctgccgtctgaggccctgcagaccgaggctattaagctctttaagacctgccagctgttcataaatgcagccgtggattcacccgcaatagattaccacatttctttggctcagtcagctttacagatttgcttaacacacccggagctgcaaaacgagatatgctgccagctgattaagcagacccggcgacgtcaacctcagaaccaacccggaccactgcagggttggcagctactggccctgtgcgtggggctgttcctgccgcaccaccctttcctgtggcttcttcgcttgcatctgaaaaggaacgccgactcccgtactgagttcgggaagtatgccatctattgccagaggtgcgttgagcggactcaacagaacggggatcgtgaggcaaggccatcccgcatggaaattctgagtaccctgcttcggaatccttaccatcacagcctcccgttcagcatccccgttcatttcatgaacggcatctatcaggttgtgggctttgatgcaagtacaaccgttgaagagttcctgaataccctcaaccaggacacaggtatgaggaaacctgcacagtccggcttcgcactgtttaccgacgatccttctgggcgcgacctagaacactgcctgcaaggtaatatcaagatctgcgacattatttccaagtgggaacaagcttcaaaagagcagcagcctgggaaatgtgagggaactcggactgtacgactcacctacaaaaatagactgtactttagtgtccaggcccggggcgagactgatcgagagaagttgctgctcatgtaccagactaacgaccagatcataaatggactgtttcccctgaacaaggatctggcacttgaaatggccgctttgctgtctcaggtggagattggagattttgagcgtccgtttagtacccccgcagggcacgtgacaaatcagtgcaaggtgaaccagactctcaaacaggtcatcgagaagttctacccgaagcggtaccgcgacggatgtagcgaggaacaactgaggcagttgtgtcaacggttgagcacacgatggatggcgcttcgaggccattcagctgccgattgcgtcaggatatacctgacagtcgcacgcaaatggccttttttcggcgccaaactctttcttgcaaagcccataactccttcaagccttggtagcacgttcctctggttggccgtgcatgaggatggcttaagtctgcttgagtacaatagcatgcggctgatagtgtcatatgtgtataaatctctcatgacattcggtggctaccaggacgactttatggtcgtcatcaacaatacacattcaaaggataaacccacagagaagctcttattcgcgatggctaagcctaagattctggagattactctcttaattgcttcttatatcaacaacttccatcagcagaaagccgcctttcatcatctctcagctcccgctctccttagtgctcagactagagggccccaggcaagaatgatgggatcgcagcctctgctgagttcctctcggcctacaaaagggcctacgttactgtag

SEQ ID NO: 199793 - DNA, 2904 bp, Artificial Sequence
  Description of Artificial Sequence: Synthetic coding sequence
atggactggaccccccggctgcccagccggcacatcatcagcgagctcgaacatttaacttttgtcaacacagatgtgggtcgctgtcgggcctggctccgactggcactgaacgacggtttgatggagtgctacctgaaactcttgctccaggagcaggctcgtctccacgagtattaccaaccaaccgctctcttgagagatgctgaggaaggggaatttctgttgtccttcctccagggactgacgtccttatcttttgaactatcttacaaatccgctatcctgaacgagtggacgctgactccgctcgctctgtccgggttgtgtcctctgagcgaacttgacccgttgagcacctccggcgctgaactgcagagaaaggaatccctagacagtatctcacacagtagcgggtcagaagatatcgaagtccatcactcagggcataagattcgtcggaatcagaagttgactgcctcctccctctcattggatacagcgtcatcctcccagctgtcctgcagcttaaattcggatagctgcctcctccaggagaacggctccaaatccccagatcactgcgaggaacccatgtcatgcgacagcgatcttggcacagccaacgcagaagacagtgatcgtagtcttcaggaggtcctgctggagtttagtaaagcccaagtaaactctgtaccaactaacgggctctcccaggaaaccgagatccccacacctcaagccagcctctccctccatggactgaacacatccacatatctgcactgcgaagctccagccgaacctttgcctgcccaagccgcttccggaacacaagacggagttcatgtgcaggaacctcgtccacaggccccatcaccgctcgatctgcagcaacctgtggagtccacatcgggccagcagccatcatccaccgtcagcgaaacagcccgcgaggttgggcaggggaacggcctgcaaaaggcacaggcccacgacggcgccggcctcaagctcgtggtgtcaagcccaacaagccccaaaaataaatcttggatctctgaggatgatttttatcgtccaagtcgcgaacagcccctggaatctgcaagcgaccaccccatagcctcataccggggtacccccggctcaaggccgggtcttcacagacactttagtcaggaaccaaggaaaaattgctcactcggggctctggatcaggcatgtgtcccaagtcctggaagaagacaggcccaagccgctcctagtcagggacacaaatcatttagggtcgtgcatcgacggcagatgggtttatcaaatccattccggggcctgatgaagctcgggaccgtggagaggaggggagccatgggaatttggaaggagctcttttgcgagttgtccccactggagttccgcctgtatctgtcaaatgaagagcacacgtgtgtggaaaattgctcgctcttacggtgcgagtccgtcggacctgcccacagcgacggtcgcttcgaactggtgtttagtgggaagaagttggccctgcgcgccagctcccaggacgaggcagaggattggctggatagagtgagggaggccttgcagaaagtccgcccccagcaggaggacgaatgggtaaacgtgcagtatccagaccagccagaggaacccccagaagccccacagggctgtctgtcccctagcgacttgctatcagaacctgctgcccttcaggggacacaatttgactggtcctcagctcaggtgcctgaacctgacgcaatcaaagaatcccttttgtacttgtatatggaccggacgtggatgccctatatatttagcctctccttggaggccctcaagtgcttccgcatcagaaacaacgagaagatgctgtccgattcccacggggtcgaaacgatacgggacatattgcctgatacgtctctgggcggaccctcctttttcaagatcatcacagctaaggcagtactaaagcttcaggcaggcaatgccgaggaggctgccttatggagggatcttgttagaaaggtcctcgcctcctatctggaaaccgccgaggaggccgtcactctcggagggtctctcgacgaaaattgccaagaagtcctcaagtttgcgacacgggaaaatggcttcctgctgcagtacctggtggccataccgatggagaagggcctggattcccaggggtgtttctgtgctggatgcagccggcaaatcggcttttcctttgtgcggcctaagctctgcgcatttagtgggttgtactactgcgatatttgccaccaggacgacgcctctgtgattccagctcgaataatccacaattgggacctgacgaaacgccccatctgccgacaggcgctgaaattcctcacacagatcagagctcagcccctcattaatctccaaatggtcaacgcatctctgtacgagcacgtcgaaagaatgcacttgatcggcagacgtcgcgaacagctgaaattactgggggattacctggggctgtgtcggtccggtgccctgaaagaactgagtaaacgactaaatcaccgcaactacttacttgaatccccacaccggttctccgtggctgaccttcaacagatagcagatggcgtatatgaagggtttttgaaagctctcatcgaattcgcaagccagcatgtttatcactgtgacctttgtacgcagagaggatttatttgtcagatctgtcagcaccacgacataatctttccctttgagttcgatactactgtaagatgcgcagagtgtaagaccgttttccatcagtcctgccaagcagtggtgaaaaaaggatgcccccggtgtgctcgacgcaggaagtaccaggaacagaacatctttgcttag

SEQ ID NO: 199794 - DNA, 3171 bp, Artificial Sequence
  Description of Artificial Sequence: Synthetic coding sequence
atgctgagcgtggtggagaacggcctggacccccaggccgccatcccagtgattaaaaaaaaactggtgggcagtgtgaaagccctccaaaaacagtatgtctccctggacactgtcgtgactagtgaagacggggacgctaatactatgtgctcggccctcgaggctgtttttatacacggccttcacgcaaaacatattcgcgcagaggccggcgggaagagaaagaagtctgctcaccagaagccactgccacagccggtgttctggcctttactgaaggctgtcacacataagcacattattagcgagctggagcatctgacgttcgtgaatacagacgtgggcagatgtcgtgcatggttgcgactggccctcaatgacggattaatggagtgttatctaaagttactgctccaggaacaagctaggctccacgagtactaccagccaaccgccctgttgagagatgccgaggaaggggaattcttactgagcttcctgcaggggttgacatctctaagcttcgaactatcctacaaatccgccattctgaatgagtggaccttgacccccctggccctgtctggcttatgcccgctcagcgagctggatccactctcgaccagcggtgcagagcttcagagaaaagagtcactagattctatctcgcacagctctggcagcgaggacatcgaggttcatcactctggacacaagatcaggaggaatcagaaactgacagcctcgtcgctttcattggatacagccagtagttcacaactttcttgtagtctcaattcagatagctgcctgctgcaggaaaacggctccaagagtcccgatcactgtgaggaacccatgagttgcgactcagacctgggtacagctaacgctgaggactcagatagatcccttcaagaggttctgctcgaattcagtaaggcccaggtcaatagtgtgcccacaaacggcctgtcccaggagaccgagatacctacccctcaggcaagcctgtctctgcatgggctcaacaccagtacctatttgcattgcgaggcccccgcagaacctcttccagcccaggcagcctcagggacccaggatggggtccacgtgcaggaaccaagaccccaggccccgagccctctggaccttcagcaacccgttgagtccaccagtggtcagcagccatcttctactgtgtccgaaaccgcacgtgaggttggacagggcaatggcctccagaaggcacaagcacacgacggagctggactgaaattagtcgtgagttctcctacgtctcccaaaaacaaatcatggatctcagaagacgatttctaccgcccctccagagaacagccgctggaatcagccagtgaccatccgatcgccagctaccgaggaactcccgggtctcgcccaggcctccatcgccacttttcgcaggagccgagaaaaaattgcagcctaggtgcccttgaccaagcctgtgtcccatcacccggtagacgccaggcccaggccgccccctcccagggacacaaaagctttcgggtcgtccacaggcgccagatggggctgagcaatccgtttagagggctgatgaaattgggaacagtcgaacgcagaggcgccatgggaatctggaaggagctgttctgcgagctgtcccctctcgagttccggctctacctctcaaacgaggaacacacatgtgtcgaaaactgtagcctccttaggtgcgagtccgtaggccctgcacattccgacggccggtttgaacttgtatttagcgggaaaaaacttgcgttaagggcatctagccaagatgaggccgaggattggttggatagggtcagagaagccctccagaaggttcggccccagcaagaagacgagtgggtaaatgtacagtatcccgaccaacctgaggaaccacccgaggctccccagggctgtctttccccttccgacctgctctcagagcctgccgccctccaagggacacagttcgattggtctagcgctcaagtgccggaacctgatgcaatcaaagagtccctcctttacctgtacatggataggacgtggatgccatacatcttttcactttctctggaagcccttaaatgttttagaatacggaacaatgagaagatgctctccgactctcacggggtcgaaaccattcgcgatattctgcctgacactagtcttggaggtccttcttttttcaaaataatcaccgcaaaggccgtcctgaaacttcaagccgggaacgccgaagaggcagcgctctggcgtgatcttgttcggaaagttctagcttcctacctggaaacggctgaggaggcagttacgctggggggatcactagatgagaactgccaggaggtgctaaagtttgccacaagagagaatggatttttgcttcagtacctagttgcaatccccatggagaagggactggactcccagggatgcttctgtgctggatgctcccgtcagatcggcttctcctttgttagacctaagctttgcgcgttcagcggattatattattgcgatatctgtcatcaggatgatgcctcagtcatccctgcaaggataatacataattgggacctcaccaagcgacccatatgtagacaggctctgaagtttctgacacagatcagggctcagccgctgatcaatcttcagatggttaacgcatctctgtacgaacacgtggagcggatgcatcttattggcagacggagagagcagcttaagttgctcggagactatctggggctgtgccggagtggcgcactaaaggagctatccaaacggctgaaccatcggaactatttgctcgaatctccacataggttttccgtggcagatctgcagcagatagcagacggtgtgtacgaagggtttctgaaggctttgatagagtttgctagccagcacgtgtaccactgcgacctgtgcacccagagagggttcatttgccaaatctgtcagcaccacgacatcattttcccatttgagtttgatacaaccgttcgctgcgcggagtgcaaaacagtatttcatcagtcctgccaggcggtcgtgaagaaaggctgtccaaggtgcgcacggcgcagaaagtatcaggaacagaacatctttgcatag

SEQ ID NO: 199795 - DNA, 3003 bp, Artificial Sequence
  Description of Artificial Sequence: Synthetic coding sequence
atggtggagtgcttcgagagcggcggcacccggctgagcctgagctcatttaacgtttcatgtgactccctccgtgaacaattgagagaatggcgttgtttccagtggtggcggatggactggacgccgaggctgccctcacggcacattatctcagaactggaacacctcaccttcgtgaataccgacgtcgggaggtgccgcgcatggctgcggctggcactgaacgatgggctcatggaatgctatttaaagttgttactccaagaacaagcccgcctgcatgaatactaccaaccgacagccctcctgcgagacgccgaggaaggagagtttttattgagctttcttcagggactgacctcacttagcttcgaattgtcctataagtctgcaatcttgaacgagtggacactgacaccattggcacttagtggcctgtgtccactgagcgaattggatcctttatctacctccggcgcggagctgcagcgcaaggaatcactcgattcaataagccactcttcaggcagcgaagacatcgaagtgcaccactccggtcacaaaatcagacgaaatcagaaactgacagctagctctctgagcctggatactgcgtcctccagccagctgagctgttccctgaatagtgactcttgtctcttacaggaaaatggtagcaagagccccgaccattgtgaggaaccgatgtcatgtgattccgatttgggaactgccaatgcagaagactcagatagatcactgcaggaagtgctgctggaattttctaaagctcaggtaaattccgttcccaccaacggcctctcacaggagacagaaatccccactccacaagcttctctcagtctccacggcttaaacacatctacctatctgcattgtgaggccccagccgaaccactaccagctcaggccgctagcggaacccaggatggtgtccacgtccaggagcctcgccctcaggccccttcgccgctcgatctgcaacagccagtcgagtccaccagcgggcagcagcctagtagcaccgtttcggaaactgccagagaagtcggccagggtaatggactgcaaaaagctcaagcgcacgatggagcgggcctgaagctagtggtgtcctcccctacttctccgaagaataaatcttggatctccgaagatgacttttatcggccctctagggagcaacccttggagagtgcaagcgatcatcctattgccagttacagggggacacccggttcaaggcccgggctacataggcacttctcccaggagccccgaaaaaattgtagcctcggcgcccttgaccaagcctgtgtccccagtcctggaagacgccaggctcaagccgctccctcccaaggccataaaagctttagagtggtacataggcgacaaatggggctcagtaaccccttccgcggactcatgaagttaggcacagtagaacggcgaggcgctatgggcatttggaaagagctgttttgtgaattgtctcctctggaatttcgactgtacctatccaatgaggagcacacgtgtgttgaaaattgctcactactgcgttgtgaatccgtgggaccagcccacagcgatggcaggttcgaactggtattttctggaaagaagttagcgctgagagcttcctctcaggacgaggccgaggactggcttgatcgtgtgcgggaggccctacaaaaagtccggccgcagcaagaggacgagtgggtcaacgtgcaatatcccgaccagccggaggagccaccggaagcaccccaaggctgcttgtcccctagtgacctgctgtccgagcctgccgccttgcagggaactcaattcgactggtcttccgcacaggttccggagcctgatgctatcaaggaatctttgttatacctttacatggacagaacatggatgccatatatattctccctctcgttggaggcacttaaatgctttcgcatcaggaataatgaaaaaatgctgagcgatagtcacggggtggagacaattcgagacatactcccggatacctccctgggtggaccttctttctttaaaatcatcaccgcaaaggccgtgctcaaacttcaagccggcaacgccgaggaagctgcactctggcgtgatcttgtccgtaaggtgttagctagctacctggagacggccgaggaggcagtaacattgggcggcagcctggatgagaattgccaagaggtactcaaatttgctaccagagaaaacgggtttttgctacagtaccttgtggccataccaatggaaaagggcttggatagccagggatgtttttgtgccggctgtagcaggcaaattggattttcttttgtgaggcctaaattatgcgctttcagcgggctgtactactgcgacatttgtcatcaagacgatgcctcagtcatacccgccaggataatacacaactgggacctgactaagcggccaatatgtaggcaggctctcaaattccttactcaaatccgagcacagcctctaatcaatctgcagatggtcaacgcatctctgtatgagcacgtggagcggatgcatttaattggacggcggagagaacagctgaaacttctcggagactaccttggactatgtaggagtggtgctctgaaggagttgtcaaagaggctcaatcaccgaaattacctgctggagtccccccacagattttcggtcgccgatctgcagcagatcgccgacggggtgtatgaggggttcagccctaaagtacctagcgaggccgctgggttgcgcccgtggggggcacggagtcctgaggctgcatccgccttccggtgtatcgatagctctcgcttaccctcactgcggaaggtcgtacccactctgtttctgaagtgctatttcatgcagtacactgtgcctagtgagcagggctcgggacccgaggaaagcctgcaatgcatcgaaggcatcgcagccgtgtag

SEQ ID NO: 199796 - DNA, 5466 bp, Artificial Sequence
  Description of Artificial Sequence: Synthetic coding sequence
atgagctgcgagcggaagggcctgagcgagctgcggagcgagctgtactttttgattgctcgattcctggaggacgggccctgccagcaagccgcccaggtccttattcgcgaggtcgctgagaaagaactgctgcccaggcgcaccgactggaccggcaaagagcatccccggacctaccagaacctagttaagtactaccggcacttggctcccgaccatctgttgcagatctgtcataggctgggcccacttctggagcaagagattccccagagcgttcctggcgtacagacattgctgggcgctgggcggcaaagcttattgagaacaaacaagtcttgtaagcatgtagtctggaaaggatccgcccttgcggccctgcattgcggcagaccgcccgaatctcccgttaattacggctcccccccctcaattgctgataccttatttagtcgtaaactgaacggcaaatatcgtttggagcggctggtcccaaccgccgtatatcaacacatgaaaatgcataaaaggatactcggccaccttagctccgtttactgtgtcacattcgatcgtacaggacgtcgtattttcacaggcagcgatgactgtctggtaaagatctgggccacggacgacggtagattactcgcaaccctgagaggtcatgcggcagagattagtgacatggccgtgaattatgagaatactatgatcgctgctggcagctgtgataagatgatccgggtgtggtgcctgcggacatgcgccccattagcagtgctgcaaggccattccgccagtattacctctttacagtttagtcctctctgcagcgggtcgaagagatacctttcaagcaccggagccgacggaacgatttgtttttggctgtgggatgccgggaccctaaaaattaacccccgccccgcaaagtttactgaacggccccggccgggcgtgcagatgatttgcagctccttctccgccgggggcatgttccttgcaaccggctccacggaccatatcattcgtgtgtacttcttcggatctgggcagcccgaaaagatttcagagcttgaatttcacactgataaagttgatagtatccagtttagcaacacatccaacaggttcgtgagtggatcaagggacggtacagcccgcatttggcagttcaagaggagggaatggaagtctattctgctagacatggcaaccagacccgcgggacagaatctgcagggaatcgaggacaagattactaaaatgaaagtcaccatggtagcatgggacaggcacgataacacagttattacagccgtgaataacatgaccttaaaggtgtggaactcctatacagggcagctcattcacgtcctgatgggacacgaagacgaggtttttgtgcttgagccgcatccttttgatcccagggtcttattctccgctggccatgatgggaatgtaatcgtgtgggacctcgcaagaggcgttaagattcgctcctattttaatatgattgaagggcagggtcatggcgcggtgtttgactgcaagtgcagccccgacggtcaacactttgcctgcacagatagccacggtcacctgctcatcttcggctttggcagctcatcgaaatacgataagatcgctgatcagatgtttttccacagcgactaccgccccctaattagggatgccaataatttcgtgctggacgagcagacgcagcaggcgcctcatctgatgccccctccattcctggtcgatgtcgacgggaacccgcacccatcacgctaccaaagactagttcctggcagggaaaattgccgcgaggagcagctgatcccccagatgggagtgacgtcctccggtctcaaccaggttttatcgcagcaggcgaaccaagagatctcaccgctggacagtatgatccagcgtcttcaacaagagcaggatctgcgcaggagcggagaggcggtcatctctaacacttccagactctctcggggttcgatcagctcaaccagcgaagtgcactcgccacctaacgtgggtctgcgaaggagcgggcagatcgaaggcgtgcggcagatgcatagcaatgcccctcgctctgaaattgccacagagcgggacttggtagcgtggtcacggcgggtagtggttccagagctgtcagccggcgtggccagtaggcaggaagaatggagaacggccaagggggaagaagaaatcaagacgtacaggtccgaggagaaaagaaaacacttaacggtcccaaaagaaaacaaaatccctactgtcagtaaaaaccacgcccatgagcatttcttagatctaggggagtccaagaaacaacagaccaaccagcacaactatcggactcggtccgccctcgaagaaacacctcgaccaagcgaggagatagagaacggctcctcatcttcagacgaaggcgaggtcgtggcagtgagcggagggacttcagaggaggaggagcgggcttggcactctgacgggtccagctctgactacagcagtgactatagtgattggactgctgacgccgggatcaatctgcagcctccaaaaaaagtccctaagaacaaaactaagaaagccgaatcctctagtgatgaggaggaagagagtgaaaagcagaagcagaaacagatcaagaaagagaagaagaaagtgaacgaagagaaggacggacccatcagccctaaaaagaagaaacccaaggaacgcaagcaaaagcgcctggcggtaggagagctgaccgagaacgggctgacactagaagagtggcttccaagcacctggatcacagatacaatcccacgaaggtgccccttcgtgcctcagatgggcgatgaagtttactactttcgtcagggccacgaagcatacgtggaaatggcccgaaagaacaaaatctactcaatcaatcctaaaaagcagccctggcacaaaatggagcttagggaacaggaattaatgaagatcgtcggaataaagtacgaggtcgggttgcccaccctgtgctgcctcaaactcgcctttctcgaccctgacactggaaagctcactgggggcagtttcactatgaaataccacgacatgcccgacgttatagactttcttgtgctgcgacaacaattcgacgatgccaagtaccgcagatggaatatcggcgatagattcaggagcgttattgacgacgcctggtggttcggaaccatcgaaagtcaggagcctctgcagctggagtaccccgacagcctgttccagtgctataatgtgtgttgggataatggtgataccgagaaaatgtctccctgggatatggagctgattccgaataacgcagtgtttcccgaagagctgggaacaagcgtgccgctaacagatggagagtgcagaagccttatttataagcctttggatggagagtgggggaccaatcctagagacgaagaatgcgaaaggatagtcgctggcatcaaccaactcatgacactggatattgcctcagctttcgtggctccagttgacttacaggcttatccaatgtactgcaccgtagtagcctatcccaccgatctctctactatcaagcagcgcctagaaaatcggttttaccgcagggtgagcagcctgatgtgggaagtgcggtatatcgaacacaatacacgcacattcaatgagcccggatcccccatcgtcaaaagtgccaaatttgtgaccgaccttctgctgcatttcatcaaggatcagacttgctacaatatcatccccttgtataacagcatgaaaaagaaagttctaagtgactccgaagacgaagaaaaggacgcagatgtgcccggcacatcaactcgcaaaaggaaggatcaccaacccagaagacgcctgcggaacagggctcaatcatacgacatacaggcctggaaaaagcagtgtgaggagctacttaatttgatcttccaatgcgaggattccgaaccattccgacaacccgtggacctgctggagtacccagactacagagacataatcgacactccaatggacttcgcaacagtgagagaaacactcgaagccgggaactatgagtccccaatggaactctgtaaagatgtgaggttaatcttctccaactccaaggcctataccccgtctaaaagaagccgcatatatagcatgtccctgcgcctgagtgccttcttcgaagaacacatctcatcagtgttgtccgattacaaatctgccctccggtttcataaaagaaacacaatcactaagagaagaaagaagcgcaaccgctcctcttcagtgagcagctccgctgccagtagccccgaacggaaaaagagaatcctgaagcctcagctcaaaagcgaaagctccacatccgccttttctacccctacaaggagcatccccccccgccataacgctgcccagatcaatggaaaaacggaaagctccagcgtggtccggaccaggtctaatcgagttgtggtcgatcccgttgtgacagagcagccgtccacgagcagtgccgccaagacattcatcactaaggcaaatgcatccgccattcccgggaaaactattcttgagaattctgtgaaacattctaaggcactaaatacactctcctctcctggccagtccagcttttcccacggtacccgaaataacagcgcaaaggaaaatatggaaaaagagaagcccgttaaaaggaagatgaagtcgtcagtacttcccaaggcttcaaccctgtccaagagctctgccgttatagagcagggagattgtaagaataacgcgctcgttccagggaccatacaggtcaacggccatgggggacagccttccaaactggttaaacgtggccctgggagaaagcctaaagtagaggtgaatactaattcaggagagataatacataaaaagcggggcagaaagccgaagaaacttcagtatgctaagcctgaagatctcgagcagaacaatgtccatcctattcgggatgaggtcctgccctcatccacttgcaatttcctatctgaaaccaacaatgtcaaagaggacctgctccagaagaaaaaccggggcggacggaaaccgaagcggaagatgaaaacccagaagctggacgccgatctgcttgtgccggcctctgtaaaggtgctgaggagaagcaacaggaagaagatcgacgaccctatcgacgaagaggaagagttcgaagagctaaagggatcagagccacacatgcggacgcgcaaccagggccggcgcaccgcattttataacgaagatgattcagaagaggagcagcgccagctgctgtttgaagacacttctctcaccttcggtacgtcgagccgaggaagggtgcggaaactcacggagaaggccaaggctaacttgatcggctggtag

SEQ ID NO: 199797 - DNA, 1197 bp, Artificial Sequence
  Description of Artificial Sequence: Synthetic coding sequence
atgaagaagaaggtgctgagcgacagcgaggacgaggagaaggacgcagacgtgcccgggacgagcacgaggaagaggaaagaccaccagccaaggagacggctcagaaatcgcgcgcagtcctatgatattcaagcctggaaaaaacagtgtgaggaattgctcaacctgatcttccagtgcgaggacagcgagccctttcgacaaccagtagatcttttggagtatcccgactaccgagatatcatcgacaccccgatggactttgccacggtccgcgagactttggaggctggcaattatgaatccccaatggaactctgtaaggacgtccgactgatattttctaattctaaggcatacaccccgagtaaacgcagtaggatttatagtatgagccttcgtctgtccgcattttttgaagagcacatcagttccgttctctccgattataagagcgcactacggtttcataaacgaaacacgattaccaaaaggaggaagaaacgcaacaggagcagctcagtgagctcatctgctgccagctcacctgaacggaagaagaggatcctgaaacctcagctgaaatctgaaagctccactagcgcctttagcacccctacgcgctctattccgcctcggcataatgcagctcaaataaatggaaagactgaaagctcttcagtggttaggacacgttcaaatagggtggtggtcgatccggtagtgacagaacagcctagcacatcctcagcggccaagaccttcatcacgaaggcgaatgctagcgcaatccccggcaaaactatactggaaaattcagtgaagcatagtaaggccttaaatactctgtcgtctccaggacagtcctccttcagccatgggactcgcaacaattccgcaaaggagaatatggaaaaagagaagcctgtgaaaagaaaaatgaagtcttctgtcctgcccaaagccagcaccctgagcaaatcgtctgccgtcatagagcagggagattgcaagaataatgccctggtgccagggacaatccaggtgaatggccatggaggccagcccagcaagctggttaaaaggggccccgggagaaaacctaaagtggaagtgaatatagtggtgaaattgtatactcgtaagggagtcgaaagtcctaagagttattccatgcagtctcagaaaatctag

SEQ ID NO: 199798 - DNA, 1206 bp, Artificial Sequence
  Description of Artificial Sequence: Synthetic coding sequence
atgcggcgggcccccgccgccgagcggctgctggagctgggcttccctcccaggtgcggaagacaggagcccccattcccccttggggttacccgtggctggggacgttggcccattcaaaaacggagagaaggggcccggcccgtgcccttttccgaaagatctcaggaggacgggcggggtcctgcagcgagatcttccggtaccctatggcgaatcagaaccaggctctcactttgtagagatcctgagccccctcctcctttgtgcctgttgcgggtcagcctgctctgcgctctgcgggcaggcggtcgggggtcccgatggggagaagatggggcacgcctgctccttttgcctcccgcccgcgcggccgggaacggagaagccgagccctcggggggtcctagttatgctggtaggatgttggagtcttccggctgcaaggccttaaaagagggagtgctggagaagcgatcggacggactattacagctatggaaaaaaaaatgttgcatcttgacagaggagggccttctgctcatacctcccaagcagttacagcatcagcagcagcagcagcagcagcagcaacagcagcagcaacaacagcctggccagggtccagctgagccttcacaaccgtcgggccctgccgtggcctcgctggaacctccggtcaagttaaaggagctacatttttcaaacatgaagaccgtggactgtgtggaacgtaaagggaagtacatgtattttactgtggttatggccgagggtaaggaaattgacttcagatgtccacaggaccagggctggaatgctgagatcactctgcaaatggttcagtataagaatcgccaggccatcctcgcagtgaaaagcacgcgacagaaacagcagcacttggtccagcaacagcccccatcgcagccgcagccgcagccacagctgcagcctcagccccagcctcaaccacagccacagccacaaccacaatcacagccacagccgcagcctcagccaaaaccccagccacagcagctgcacccatacccccaccctcacccacacccacattctcatcctcacagtcaccctcacccccatccccatccccatccccaccaaattccgcatcctcatccccagccacacagtcagcctcacggacaccggttgctgcggtccaccagcaatagcgcctag

SEQ ID NO: 199799 - DNA, 660 bp, Artificial Sequence
  Description of Artificial Sequence: Synthetic coding sequence
atgctggagagcagcggctgcaaggccctgaaggagggcgtgctggaaaagagatccgacggtttgctccaactctggaagaaaaagtgttgcatcttaaccgaagaagggctgttacttatcccacctaaacagctgcagcatcagcagcagcagcaacagcagcaacagcagcagcagcagcagcagccgggtcaagggcctgccgagcccagtcagccttctgggcctgcggtcgcttcattggagcctccagtaaagttgaaagagctgcacttctcaaatatgaagaccgttgattgtgttgagcgtaaaggcaagtatatgtattttacagtcgttatggccgagggaaaggaaatcgattttagatgcccacaggaccaagggtggaatgctgagatcaccctacagatggtgcagtataaaaacagacaagccatcttagctgtcaaatctactagacagaagcagcagcacctggtgcagcaacagctgcacccttacccacacccacatccccaccctcatagccatccacattcccatccacacccgcatcctcatccacacccacaccagataccgcatcctcatcctcaaccgcacagccagcctcatggacaccgcctgcttcgatccacatccaatagtgcttag

SEQ ID NO: 199800 - DNA, 459 bp, Artificial Sequence
  Description of Artificial Sequence: Synthetic coding sequence
atgaagagccccgacgaggtgctgcgggagggcgagctggagaagaggtcagactctctgtttcagctctggaaaaagaaacgtggagtcctcacctctgatcgcctgtcattgtttccggcatcccccagggctagaccaaaggaactgcggttccattccattctgaaggtggattgcgttgagcggacgggaaagtatgtgtatttcaccattgtcaccaccgaccacaaggaaatcgacttcagatgtgccggagagtcctgctggaatgccgcaattgccttggctctaatcgattttcagaatagaagagctttacaggatttcagaagtagacaagagaggaccgctcctgctgcccccgctgaagacgccgtcgctgcggctgccgcagctccgagcgagccctctgaacccagccgcccgtcaccccagccgaaaccaaggacgccttag

SEQ ID NO: 199801 - DNA, 3960 bp, Artificial Sequence
  Description of Artificial Sequence: Synthetic coding sequence
atggacgccctgaaccggaaccagatcggccccggctgccagacccagacaatggtccaaaaagggccccttgacctcatcgaaacaggcaaaggtttaaaggtccagactgacaaaccccacctcgtttctttaggttccgggcgcctttctactgccattactttattgcccctcgaggaggggagaaccgtcatcggctcggccgccagagacatctccttacaaggaccaggtctggccccagaacattgttacatagaaaatctgcgagggacactcaccctttacccttgcggcaacgcctgcaccatcgacggcctgcctgtgaggcagcccacacggctaacgcaaggctgcatgctgtgcttaggccagtcaacgtttctcagatttaatcaccccgccgaggctaagtggatgaagagtatgatccccgcaggcggcagagctccgggacccccgtactcaccggtgccggctgaatctgagagcttagttaatggcaaccatacaccccagaccgccacgcggggccccagcgcctgcgcgagtcacagttctctcgtaagcagcattgagaaagatctccaagagattatggacagtctggttctcgaggaacccggcgccgcgggtaaaaagcccgccgccacttctccgctgtcacccatggccaacggcggacgctatctgctcagcccacctacctctcccggtgcgatgtctgtcggttccagttacgagaatacctctccagccttctcaccgctgagcagccccgcatcatctgggagttgtgcttcccactctccaagcggtcaggaaccgggcccctcagtccctccattggtgcccgcaagatcctcatcttaccacctggccttacagcccccccagagcagacccagcggcgcacgctctgagagtccccgcttgagccgtaagggaggccacgaaagacctccatcccccggtcttcgggggcttcttacagatagtccagctgcgactgtgctcgctgaggccaggcgggctaccgagagtccgcggctgggaggacagttgcccgtggtagctatttccctgtctgagtacccagccagcggagctctctcccagccaacgtccatccctggcagcccaaagttccagcctcccgtgcccgctccacggaataaaatcgggactttgcaagatagaccaccatcgccattccgtgagcccccagggagtgagcgtgtgctcacgacctctcctagccggcagcttgtgggtcgtacgtttagtgacgggcttgcaacccgaacgctgcagccacccgaatccccccgactcggcaggaggggcctcgatagcatgagggaattgcctcccctcagccccagcctctcacggagggccctgtctccattgcctacccgtactaccccggatccaaagttaaacagggaagtggccgagagccctaggccccgccgttgggctgctcatggggcctcccccgaggatttcagcctgacccttggggcacgcggcagacgtacccgcagtccctccccgaccttgggagaatcactggccccccataagggcagctttagcgggcggctctcaccagcctattccctgggctccctcacaggggcctcaccctgccagtcgccttgcgtccagcggaagctgtcatccggggatttgcgtgtcccggtgacaagggagaggaagaactcgatcaccgagatctccgacaacgaggacgacctgctggagtaccataggcggcagcggcaggaacgcctgcgggaacaggagatggaacgacttgaacgccagaggctggagaccattcttaacttgtgcgctgagtactctagggctgatggggggcctgaagcaggcgaattgccgagcattggcgaagcgaccgctgctctggctttagctggccggcgaccaagccgtgggctcgccggtgcatcaggacgaagtagtgaagagccaggcgtcgctacacagcgcctgtgggaatccatggagaggagtgacgaagaaaacctgaaggaagaatgttcctcgacagaatcgacgcagcaggaacacgaggatgctccctcaacaaaactgcagggggaggtgctggccctggaggaagagcgggcccaggtgttaggacacgtcgagcagctcaaagtgagagtgaaagaattagaacagcagctacaggaatccgccagagaagcagagatggaacgtgccttgctgcaaggagagcgcgaagccgaaagagcactgctgcagaaagagcagaaagctgtggatcaactccaggagaagctggtggcgctggaaacaggaattcaaaaggagagggacaaggaggccgaagcgctcgagacagagacgaagctgtttgaagaccttgagttccagcagttggagcgagagagcagagtagaggaggagagagagttagccggccagggactgctccggtctaaagccgagctcctgcgctcgatcgccaagagaaaggagcgccttgctatcctggattctcaagcaggacagattcgcgcacaggcagtgcaagagagcgagagactggccagggataagaatgcttcactgcagttactgcagaaggaaaaggaaaagttgacagtgctggaacgtcgctaccacagtctgaccggaggccggccttttcctaagactacaagcacacttaaagaagtgtacaggagtaaaatggacggtgaggcaacttctccactcccacgcaccaggtcaggcccactgccttcctctagtgggtctagctctagttccagccagctctcagtggcaaccctcggtcggtcccctagtcctaagtctgctctcctaacccagaatggcaccgggtccctcccaagaaacctggccgcaaccttacaggacattgagactaagagacagctggctcttcagcagaaaggtcaacaggttatcgaagaacagcgcaggcggctggccgaattaaagcagaaagcggcagctgaggcccagtgccagtgggatgcgttgcacggtgcagctccattccctgcgggtcctagcgggtttcctccattaatgcaccactccattctccatcatctgccagccggcagggagcgcggtgaagagggggaacatgcgtacgatacactgtcccttgagtcctctgatagcatggagactagcatcagcactgggggtaacagtgcttgttctcctgacaatatgagttccgcctctggactggacatgggaaaaatagaggagatggagaagatgctgaaagaggcgcatgctgaaaagaacaggctcatggagtcccgtgagcgggagatggagctgcgcaggcaggccctggaagaggagaggaggaggcgggaacaggtggagcgccggcttcagtctgagagtgcaaggcggcagcagctggtcgagaaggaagtgaaaatgagggagaagcagttcagccaggcacggcctcttactaggtacctcccaattaggaaagaagactttgatttaaagacgcacattgaatcaagtgggcatggggtggacacctgtctacatgtagttctgagctccaaggtctgccgcggctacttagtaaagatgggtggcaagataaaaagctggaagaagaggtggtttgtcttcgaccggctcaagcggaccctgtcttattatgtggacaagcacgaaactaagctcaagggagttatttacttccaggcaatcgaggaagtgtactacgatcatcttcgcagtgccgcaaaaagtccaaatccagcacttaccttttgtgtcaagacccacgatcggttgtattacatggtagcaccaagtgcagaagccatgagaatttggatggatgtgatcgttaccggggcagagggatacacacagtttatgaattag

SEQ ID NO: 199802 - DNA, 2193 bp, Artificial Sequence
  Description of Artificial Sequence: Synthetic coding sequence
atggagcggagcgacgaggagaacctgaaggaggagtgcagcagcacagagtctacccagcaggagcatgaagacgcaccttccaccaaactgcagggcgaagtgctggctctagaggaggagcgggcacaggtcctgggccacgtcgaacagctaaaagtgagggtgaaggaactcgaacagcagctgcaggaatcggcacgggaagcggagatggagcgggccctgcttcagggcgagagggaagctgaaagagctttactacaaaaggagcagaaagccgtggaccagctccaagagaaactggtcgcgttggaaaccgggatacaaaaagagcgcgacaaggagagggccgaactggccgccgggcggcgacacctggcccggcaagcactgtacgctgagctgcaaacacagttagataactgtccagagagtgtgcgtgagcagcttcaggagcagctgaggagagaagctgaagcactggagacagagacaaagctgttcgaagatctggagttccagcagctcgaaagagaatcaagagtagaagaggaacgggagcttgcaggtcaggggctgttgcgctccaaggccgagctgctacgctcaatagcaaaacgcaaggagagactggcgatcctagactcacaggccggtcagattagagctcaggccgtgcaagagtcagagcgcctggcccgggacaagaacgcctctctacaactccttcagaaagagaaggaaaaattaaccgtgttagaacggcggtatcactccctgacagggggccgcccctttccaaaaactactagcacactgaaggaaatggagaaattgctgttgccagccgttgacctcgaacagtggtaccaagagctgatggccggcctgggcacaggccccgctgcagcgtcaccccactcttctcccccaccccttcccgccaaggcatcaagacagctgcaggtgtaccgcagcaagatggatggggaagcaacgtcccccctcccacgcacacgatccggccctctgccttcctccagtggcagttccagctctagcagccagctgtctgtggcgaccctcgggcgatccccgtcgccaaagagcgctctgctgacacagaacggaacgggttcattgccaagaaatctggccgcaacgctgcaggatattgaaaccaagaggcagttagccttacagcagaagggacagcaggtcatcgaagagcaacgcagaagactggccgaacttaagcagaaagccgctgctgaggcacagtgccagtgggacgcactgcatggcgctgccccgttcccggccggcccctctggcttccccccactgatgcaccactccattctgcaccaccttccagcaggccgcgaaagaggagaggaaggagaacacgcctatgatacattgagtcttgagtcctctgactcgatggagacatctatctccacgggaggcaactccgcatgttctcctgataatatgagctcagcctcagggctcgatatgggcaaaatcgaggagatggagaaaatgctgaaggaggcccatgccgaaaaaaaccggctgatggagtctagagagcgagagatggagctgcggaggcaggctctggaggaggaacgaaggaggagagagcaagtcgagagaaggctacagagcgaatctgcaagaaggcaacagctggtggagaaagaggttaaaatgagagaaaaacaattcagccaggcgagacctcttacacgctacctccctattcgaaaggaagatttcgacctgaagacccatatcgaaagctccggccatggagtcgatacttgtctacatgtcgtcctcagctcgaaagtgtgcagaggatacctagttaagatgggagggaagatcaagagctggaaaaagcggtggttcgtttttgaccggctgaagcgcacgttgtcttactacgtggataaacatgaaacgaaactgaagggagtcatttactttcaagccatagaagaggtgtattatgatcaccttcgaagcgcagccaaaagcccaaacccagccttaaccttctgtgtcaaaacccacgacaggctgtactacatggtcgcaccatccgctgaggctatgcgtatctggatggacgttatagtgacaggcgccgagggctacacccagtttatgaattag

SEQ ID NO: 199803 - DNA, 4134 bp, Artificial Sequence
  Description of Artificial Sequence: Synthetic coding sequence
atggacgccctgaaccggaaccagatcggccccggctgccagacccagacaatggtgcagaagggcccactcgatctgatcgagacagggaagggtctgaaagtccagacagataaaccacacctcgtctccctaggttcgggccggctctcgactgccatcactctgctgcccttggaggaaggccgcaccgttatcgggtccgccgcccgcgatatctccctccaaggccctggactggccccagagcattgctatattgaaaatctccgcggaacactgactctgtacccatgtggcaatgcctgcacaatcgacggcttgcccgtacgccaaccaactcggcttacccaggggtgtatgttgtgtctcggtcagtcaacctttctgcggttcaaccatcctgccgaagcgaaatggatgaaatctatgattcccgcaggaggacgcgcgcccgggcccccatactcccctgtacccgctgagagtgagagcctcgtgaacggcaaccacactccacagaccgccactaggggcccatcggcgtgtgcttcccactcatctctcgtcagttcaatcgaaaaggacctgcaggaaatcatggacagcctggtgttggaagagcctggtgctgctgggaaaaagccagctgccacctctccattatccccgatggccaatggaggacggtacctgctgagccccccgacctcccccggcgccatgtcggtgggtagcagttacgaaaatacatcgccagccttttcacccctcagcagtcccgctagcagtggcagttgtgccagtcactccccctccggtcaggagcctggtccatctgtgccaccgctagtccctgccaggtcgagttcctatcacttggccctacagcctcctcagagccgaccttccggcgcccggtccgagtcacctagactgagcaggaagggggggcatgagaggccaccctctcctggactccgcggcctcctaaccgacagccctgcagcaacggtcctagcggaagccagacgtgctaccgaatcgccgcgccttgggggacagctgcccgtcgtcgccatttctctatccgagtatccagcttcgggcgccttgtcccagccgacatcaatccccgggtcccctaagtttcagccacctgtccctgccccccgcaacaagataggtactctgcaagaccgcccaccttccccttttagggaacctccagggagcgagagggtgctgactacgtccccgtctcgccagttggtaggcaggacattttcagacggactcgccactcgcacacttcagccccccgaatcgcctcggctgggacggcgcgggctcgatagtatgagggagctgcctcccctttctccgtccctttctaggagagctttatcaccactgccaacacggacaacccccgatcccaagctcaaccgcgaggtcgcagaatccccccggccacggcggtgggccgcccatggtgcatcaccagaggacttctctctgacgctgggagcccgcggaagacgcacacgatctccgtctcccaccctgggcgaatcccttgctccccataagggctcattttccgggaggctgtcccccgcttatagcctggggtcattgaccggagcgtcgccctgtcaatcaccatgcgtccagcgtaagctttctagcggtgacttgcgtgtgcccgtgacaagagaaaggaagaactcaattacagagatatcagataacgaggatgacctgctagagtaccacaggaggcagcgtcaggagcgactgcgtgagcaggagatggagaggctggaaaggcagcgtcttgagacaatcctcaacctctgtgccgaatactcacgcgcagatggcggcccagaggccggcgaattgcctagcattggcgaggccacggccgcactcgcactggccggtcgccgcccaagccgaggcctggccggggcttctgggcgctcttcagaggagcccggcgtggccacccagcggttatgggagtctatggagcgatcagacgaggagaatctgaaagaagagtgcagttcgactgagagtactcagcaagagcatgaggatgccccatctaccaaactgcagggtgaagtactagcattggaagaggagcgcgctcaggtgctgggccacgtcgagcagctcaaagtgcgcgtgaaggaactggagcagcagttacaggagtccgctcgggaggcagagatggagcgggctttacttcaaggtgagcgcgaagcagagcgtgccttgttacagaaggagcagaaggcggtggaccagcttcaggaaaagctggttgcactggaaactggtatccagaaggaaagggacaaggaggcagaggcactggaaacagaaaccaagctctttgaagacctggaatttcagcagctcgagcgggagtcaagagtcgaggaagaacgggaattggctggccagggtctcctccgcagcaaggctgagctgctgagaagtatcgccaaaagaaaagagcgcctcgctattctcgattctcaagcaggacagattagggctcaagccgtccaggaaagcgaacgccttgctagagacaaaaatgctagtctgcagcttctccagaaggaaaaggaaaaactaacagtactggaaagacgctaccactcacttacaggagggcgccctttcccaaagacaacatctactttgaaggaaatggaaaagttgttactccctgctgtcgatctagaacagtggtatcaagagctgatggctggactgggtactgggccagccgccgcttcgccgcattctagtccccctccacttcctgcgaaagcaagcaggcagcttcaggtgtacaggagcaagatggatggcgaggctacttcacccctgcccaggactagaagcggtccacttcctagctctagcgggagcagctcatcctcctcccagctatcagtagctaccctcggaaggtcaccctcaccaaaatcagccctgctgacccagaacggaacaggtagtctgccaagaaacctggccgcaacccttcaggacatcgagactaagcgacaattggctctccaacagaaaggtcagcaggttattgaagaacagaggcgccgtctcgcagaattgaagcagaaagcagcggctgaggcacaatgtcagtgggacgcgttacacggcgcggcccccttccccgctggaccatctgggtttccacctttgatgcaccattccattctgcaccacctgccggcagggcgcgagcggggagaggagggcgagcatgcctatgatacactttctctggaaagtagtgattctatggagacctcaatttccaccggggggaactctgcatgcagccccgataacatgtccagcgcctccggcctggatatgggcaaaatcgaggagatggagaagatgcttaaagaggctcatgctgagaaaaatcgcctaatggagtcaagagaaagggaaatggaacttcggagacaggccctcgaggaggagaggaggaggcgtgaacaagtggagcgaaggctccagagtgagtcggcacggcgtcagcagctggtggaaaaagaagtgaagatgcgagaaaaacagttttcccaggcacgccccctaacccggtacctgcctattagaaaagaggatttcgatttaaaaacacacatcgagagtagcggccacggagtcgatacatgtctgcacgtggtactttcctctaaggtgtgtcgtggataccttgttaaaatgggaggcaaaatcaaaagctggaagaagcggtggttcgtcttcgataggctgaaacggaccctcagctattacgtggataagcacgagaccaagttaaaaggggtgatctactttcaggccatcgaagaggtatactacgatcatctcaggtctgcggccaagaaacggtttttccgctttacaatggtgaccgagtcacccaatccagccctaacgttctgcgtgaaaacccacgacaggctttactacatggtcgctcccagcgcagaagctatgcgaatttggatggacgttatcgtgactggagcggaaggctacacccagttcatgaattag

SEQ ID NO: 199804 - DNA, 3423 bp, Artificial Sequence
  Description of Artificial Sequence: Synthetic coding sequence
atgagcgtgggcagcagctacgagaacaccagccccgccttcagccccctgtcttcccctgcaagtagcgggtcctgcgcctcccatagtccttcagggcaggagcctggacctagcgtgccccccctggtccctgccaggtccagtagttaccacctcgcactccagcctccccaaagtagacccagtggcgctaggtcagagagtcctagactcagccggaaaggcgggcacgagcggccaccgtcacctggcctgcgcggacttcttaccgactccccggccgcaaccgttctggcggaggcccgtagagctacggagagcccacggctgggcggacaacttcccgttgtcgccatctccttaagcgagtatcctgctagcggcgccctgtctcagcccacctctattcctggctcacctaagttccagcctcctgtgcctgcacctcggaataaaatcgggacgcttcaggatcggcctccgtcgccctttagagagccgccaggtagcgagcgcgtgttaaccacttcgccgtcccggcagttagtgggcagaacatttagtgacggcctggcaacccgaacgctgcaaccccctgagtcaccacggctgggccgacggggactggactctatgagggaacttccacctttgagtccttcactgtcaagacgggccttaagccccctgcccacaagaaccactcccgacccgaaactcaaccgtgaggtggctgagtcgccacgtcccagacgctgggccgcacacggcgccagccccgaagatttttcactgaccttaggcgctcggggccggcgcaccagatctccgtcgcccacattgggtgagtctttggcgccacataaggggtctttcagcggaagactgagcccagcctactccttggggtccctcactggagccagcccatgtcagtctccctgcgtgcagcgaaaactgagctccggggacttgcgggtgcccgtgacccgcgagcgcaaaaactcaattacagagatctccgacaacgaggatgacctgttagagtaccaccgacgccaacgccaggagaggcttcgggaacaggagatggaaaggcttgagcgccagaggctggaaacaattctcaacctgtgcgcagagtacagccgtgctgacggcgggcccgaggctggagagctcccttcaatcggcgaagcaacagctgccctcgccctggccggaaggaggccatcaaggggactggcgggagcctccgggcgttcatcagaggagccaggcgtcgcaacccagaggctttgggaaagcatggagcgatctgacgaggagaatctgaaggaggaatgcagctctactgagagcactcagcaagaacatgaagatgcaccctctacaaaactccagggggaggtgctcgcactcgaggaggaaagggctcaggtcctgggacatgttgaacagctgaaagtgagagtcaaggagcttgagcagcagttacaagaaagtgcacgcgaagctgaaatggaaagagcgctgctacagggtgagagagaagcagagcgggcacttctgcagaaagagcaaaaagccgttgatcagctgcaagagaagctcgttgcattagagacgggcattcagaaggagagggacaaggaagcagaagcattagagaccgagaccaagctgttcgaggatctggaatttcagcagctcgagcgggagtcacgtgttgaagaagagagggagcttgctgggcaggggctgctgcgatcaaaagcggaactgcttcggtccatcgccaaacgcaaggagcgtctggcaatcctcgactcccaggcaggccagataagggcccaagctgtccaagaaagtgaaaggctggcaagagacaaaaatgccagccttcagctactgcagaaagagaaggaaaagctcacagtactggagcgcaggtatcattccctgaccggcggacgaccatttcccaagactacttctactctcaaagagatggagaagcttctgctgcccgcggtcgatctggaacaatggtaccaagagctgatggcaggcttaggaactgggcctgccgccgcctccccccattcatcaccacccccactgcctgcaaaggccagtcggcagcttcaggtatatcgatcaaagatggacggtgaagccacatcccccctgccgcggacccgctcaggtcctctgccatcttctagcggctctagctcttcatcttcccagctgtccgtggccaccctcggacggagccccagtcccaaatcagcattgctcacccagaacggcaccggctccttgcccagaaaccttgctgccacactgcaggatattgaaacgaaaaggcagctagctctccagcagaaagtggagtctctcccagctgagccactccccaccgacgaccccgccgggcagcaggtgattgaggagcaaaggcggcgtctagccgaactgaagcagaaagccgccgctgaggcgcagtgccagtgggacgcccttcatggggccgcccctttcccagccggcccgtccgggtttcccccactgatgcatcactccatcctgcatcacctgccggcgggtcgggaacgcggagaggagggcgaacacgcatatgatacgctatctcttgagtcttccgattccatggaaacctctatcagcacagggggcaatagtgcctgtagccctgataacatgtcatcggcatccggtttggacatggggaagatcgaggaaatggaaaagatgttgaaggaggcacacgccgagaaaaaccgcctgatggagtcccgcgagcgcgagatggagcttcgcaggcaggcactagaggaggaaagacgcaggagagagcaggtggagaggaggctgcagagtgaaagtgcacgcagacaacaactggtggagaaggaggtgaagatgagggaaaagcagttctctcaggctcgtccccttacccgatacctgccaatccgcaaagaagatttcgacctgaagacccacatagagagctccggccatggtgttgacacctgcctacacgtggtgttaagttcaaaggtttgcagagggtatctggtgaagatggggggcaagattaagtcctggaaaaagcgctggtttgtattcgaccggctcaaaagaactctgtcctactacgtagacaagcatgaaacaaagctgaagggtgttatctactttcaggcaatcgaagaggtctattacgatcacctgagaagtgctgccaaatcacctaacccagcccttacattttgtgttaaaacacatgaccggctgtattacatggtggccccatccgccgaggccatgcgcatctggatggacgtcatagtgaccggagccgagggctacacccagtttatgaactag

SEQ ID NO: 199805 - DNA, 306 bp, Artificial Sequence
  Description of Artificial Sequence: Synthetic coding sequence
atgggcggcaagatcaagagctggaagaagcggtggttcgtgttcgacagattaaaacgtactctctcttactatgtggataagcatgagaccaagttgaaaggggtgatttacttccaggcaatcgaggaagtctattacgaccaccttaggtccgccgccaagagccccaatcccgcattgaccttctgtgtgaaaacacatgacagactttattacatggttgctccctctgccgaagccatgcgaatctggatggacgtgattgtgactggagccgaaggatacacacagttcatgaattag

SEQ ID NO: 199806 - DNA, 1119 bp, Artificial Sequence
  Description of Artificial Sequence: Synthetic coding sequence
atggacgccctgaaccggaaccagatcggccccggctgccagacccaaactatggtgcagaagggacccttagacctgattgaaactggcaaaggtctgaaggtgcagactgataagccacacttggtctccctcgggtctgggcgcttatctacagctatcacactgctgccactggaggaggggcggaccgtgattggctcagccgcaagagatatttcacttcaaggacccggtctggcccctgagcactgctacattgagaacttgcgtggcacgctgactctgtatccttgtggcaatgcctgcactatcgacggcctgcccgtccggcagccaacccggttaactcagggctgcatgctttgtctcgggcagtcaacatttttaaggttcaatcatcctgccgaggctaagtggatgaaaagcatgattcctgccggcggaagggctccaggcccaccctactctcctgttccagagagcgaaagcctggttaatgggaaccacacccctcaaaccgcaaccaggggtccttccgcttgtgcctcccattcttctctggtgtccagcatcgaaaaagacttgcaggagattatggacagtctggtgttggaagaaccgggggcagctggcaaaaaaccagccgcgacctcacccctgtccccaatggccaatggcggtaggtacctgctgtcaccaccaacctcaccaggggccatgtctgtggggagttcatacgaaaatacaagtccagcattttcgccactctcctcacctgcatccagcgggtcatgcgctagccactctcctagcggacaagaacccggcccttcagttccccccctcgttccggccaggtccagctcctaccacttagccttgcagcctccgcaatcccggccttctggggcccgctctgagtcacctcgcctgtcacgaaagggtggccacgagcgcccgccaagccctggtctgcgcggtctgttgacagacagtccggccgcaaccgtcctggccgaggcacgcagagccactgagtcgcctagactgggcggacagctgccggtggtggctatctcactgagcgaatatcccgccgccaggcgatgtacttag

SEQ ID NO: 199807 - DNA, 744 bp, Artificial Sequence
  Description of Artificial Sequence: Synthetic coding sequence
atggacgccctgaaccggaaccagatcggccccggctgccagacccagacaatggttcaaaaggggcctctggatctcatagagaccgggaaaggtctgaaggtgcagaccgataagccacatttggtgagtcttggtagtgggcggcttagtaccgccattacattactccccctggaggagggccggacagtgataggtagcgccgcaagagacatctcactgcagggccccggccttgctccagagcactgctacattgagaacttgcgcggcactctgacgctctacccctgcggtaatgcctgcaccattgatggtctgcccgtcagacagcccacgcgcctcactcagggctgcatgctatgcttggggcagagtaccttcctgcggtttaatcaccctgccgaggcaaagtggatgaaatcaatgatccctgctggcggcagagctccaggccccccatacagtcccgtgcccgccgagagtgaatcccttgtcaacggtaatcacacaccccagacagctacccggggaccaagtgcctgcgcttcccacagctctctggtgtcaagcatcgagaaagatttgcaggagataatggattccctggtcctggaagagcccggcgctgctggcaaaaagcccgctgctacaagtcctctgagccctatggcaaacggcggccgctacctcttgtctccccctacttcccccggccatgtgtgcgggcttcagctatag

SEQ ID NO: 199808 - DNA, 14055 bp, Artificial Sequence
  Description of Artificial Sequence: Synthetic coding sequence
atggtggccggcatgctgatgccccgggaccagctgcgggccatctatgaagtgttatttagggaaggtgttatggtggctaaaaaagacagacgcccccggagtctccatccccatgtaccaggcgtgaccaacctgcaggtcatgagagcaatggcttctcttcgagcccgaggcttggtgcgggagacctttgcgtggtgccatttctattggtacctgaccaatgagggtatagcacatctaagacagtacctccacctgcctccagagattgtccccgcgtcattacagcgcgtccggaggcctgtggcgatggtcatgcctgctcggcggacaccacacgttcaagcagttcaaggacctctaggctccccgcccaagagggggcctttaccaaccgaggaacagagggtgtacagacgcaaagagctggaagaggtttctcccgagacgcctgtggtgcctgctacaacccaacggactctggcgcggccgggcccagagccagcacctgccacagatgagagggaccgagtgcaaaaaaagaccttcacaaaatgggtaaataaacacctgatcaaagcccagaggcatatatcagacttgtacgaggatctaagggatggacacaaccttatctccttgttggaggttctgtccggcgactcactcccccgggagaagggaaggatgagatttcacaagttgcaaaatgtacagatcgctctcgattacctgagacaccggcaggtgaagctcgtgaacatccggaatgacgatattgccgatggaaatcccaagctcaccttgggtctgatctggactataatcctgcattttcagatatcggacattcaggtttcgggccagtccgaagacatgacagctaaagaaaaactcctgctctggtcgcagcggatggtggaaggttaccaaggactgagatgcgataacttcacttccagctggcgggacgggagactgttcaacgcaattatacacagacataagccactgctcatcgacatgaacaaagtttacaggcagacaaatctagaaaacctggaccaggctttcagtgtggccgagagagatctgggcgtaactcgacttctggatcccgaggacgtggacgtacctcagccagacgaaaaatccattatcacttatgtgtctagtctgtacgatgccatgccccgggtcccagatgtgcaggacggagtgcgcgccaatgagcttcagcttcgctggcaagaataccgcgagctcgtactcttactgttacagtggatgaggcatcacactgccgccttcgaggaaagacggttccccagctcatttgaggagatagagatactgtggagccagtttctgaagttcaaagagatggagctacctgcaaaagaagctgacaagaacagaagtaagggaatttatcagtctctggaaggcgctgttcaggctggacaactgaaggttccgcccgggtatcaccctctggatgtcgagaaggagtgggggaagctgcacgtggccattctggagcgggagaaacagctgagaagtgaatttgaacggcttgagtgcttacagcggatagtgaccaaactccagatggaggcaggcctctgcgaggaacaactcaatcaggcagatgcactgctccagtccgacgttagattactggccgcaggtaaagtcccccagcgggcgggtgaggttgagagggatttggacaaggccgactcgatgattagattactctttaacgatgtgcagacactgaaggacggacgccacccccagggcgagcagatgtacaggcgcgtgtaccgattacacgaacgactcgttgccatacggaccgagtacaaccttaggctcaaggcaggagtggccgctcctgcaacccaggtggcccaggtaaccctgcaatctgtgcagcgccgccctgaactcgaagacagcacattgcgatacctgcaggacctgttagcgtgggtcgaagaaaatcagcatcgggtagacggcgcggaatggggtgtggatttaccctctgtcgaagcacagttgggatcccaccgtggattacatcagagcattgaggaatttcgtgcaaaaatcgagagggcgcgctcggatgaaggccaactgtccccggcaactcggggggcgtatcgagattgcctgggccgattagacctgcagtacgcgaagcttctgaattcgagcaaagcgcgacttcggtcgcttgagtctctacattccttcgtggccgccgccacgaaagagctgatgtggctcaatgaaaaagaggaagaagaagtaggtttcgattggagcgacagaaataccaacatgaccgcaaagaaagaaagttactcagcacttatgcgcgaactcgagttgaaggagaaaaagattaaagaactccaaaatgctggtgacaggctcctccgggaggaccaccctgcaaggcccaccgtggaatctttccaggctgcgctgcaaacacaatggagctggatgctccagctctgttgttgcatcgaggcccacctaaaagagaatgcagcttatttccaattcttttccgatgtgcgcgaagccgaagggcaactgcagaagttgcaggaggctctaagaaggaagtactcttgcgaccgcagcgcgacagtcacacgactcgaggacttgctgcaggacgctcaggacgagaaggaacagcttaacgaatacaaggggcatctcagtggcctggcaaaaagagctaaagcagttgtgcagctgaaacctcggcaccctgcccacccgatgaggggaaggttgcctctgctggctgtatgtgattacaaacaggtcgaggtcacggtacacaagggcgacgagtgtcagctggtgggtccagctcagccctcccactggaaggtcctcagttcctctgggagtgaggccgccgttccttcagtgtgttttctggtgccaccacccaatcaggaagctcaggaggctgtcacccggctggaagctcagcaccaggccctggtgaccttatggcaccagctccacgtcgatatgaagtccctgttggcctggcagagcctgagaagagatgttcagctgataagaagctggtccctggctaccttccgcacactgaaaccagaagagcagagacaggcccttcattccctggagttacactaccaagccttcttgagggacagccaggacgccggcggatttggtcctgaagatcgactcatggccgaacgggaatacgggagctgctcacaccattatcaacagctcctacagtcactggaacagggagcccaggaagagagccgttgccagcgttgtatcagtgagctgaaagacattcggctgcagcttgaggcctgtgagacgcgcaccgtgcatcgacttcgactcccactggacaaggaaccggctagagagtgtgcccagagaattgccgagcagcaaaaggctcaggccgaggttgaggggctcggcaaaggggtagcacgactctcggctgaagcagagaaggttctggcacttccagaaccctcccctgctgcccctacactccgatccgagcttgaactgacattggggaagttggaacaggttagaagcctaagcgccatctaccttgagaaattgaaaacgattagcctggttatccgtggtacgcagggggccgaggaggtcctgcgcgcccacgaagagcagttaaaagaggcgcaggccgttccggccacgctccctgagctcgaagccaccaaggctagcctgaaaaagcttagggcccaagcggaagctcaacagccaacctttgacgcactgcgggatgaactgcgaggggctcaagaagtgggagagaggttacagcagaggcatggcgagagggacgtggaggtggaaagatggcgcgagcgcgtggcacagctccttgaaagatggcaggccgttctggctcagaccgatgtgagacagagagagctggagcagttgggacgccaactgcgttactatagagagtccgccgaccctctgggcgcctggcttcaggatgccaggaggagacaggaacagatccaggctatgccactggccgattcccaggctgtgagggagcagttacgccaagaacaagctctgctggaggaaatcgaacgacatggggagaaagttgaagaatgtcagcgttttgctaaacagtacattaacgccattaaggattacgaactgcaactggtaacatacaaagcccagctggaaccagtggccagcccagccaagaagcccaaggtgcagtcgggctccgagtcagtcatacaggagtatgtcgacctacgaactcattattctgagttaacaaccctaacaagccaatacatcaaatttatcagcgaaacactgagacggatggaagaggaagaaaggctggccgaacagcagcgggccgaggaacgagagcgcctcgcagaagtagaggccgccctggaaaaacagagacagctcgccgaggctcacgctcaggcaaaagcgcaggccgaacgtgaggccaaggagctgcaacagcgaatgcaggaagaagtggtgcgtcgcgaggaagccgctgtagacgctcagcagcagaaacgatcaattcaagaggaactgcagcagctccggcagagtagcgaggcagaaatccaggctaaggctagacaggcagaagccgccgaaagatcacggctgcgcattgaagaagagataagagtggtcagactgcagttagaagcaacagagcgtcagagggggggcgcggagggcgagctgcaggcccttcgcgctcgcgccgaagaagcggaggcacaaaaaaggcaggctcaggaggaggctgaacggctacgtcgccaggtccaggatgaatcccagaggaagaggcaggcggaggtggaactggctagcagagtaaaagctgaagctgaagcggcccgggagaaacagagagctctacaagcattggaagagctacgcctgcaggccgaagaagctgaacggcggctgcgtcaggccgaagttgagagagcacggcaggtgcaggtggctctggaaaccgcccagcgcagcgcagaagcagagctgcagtccaaacgcgcttccttcgccgagaaaaccgctcagctcgaaaggtctcttcaggaagagcatgtcgccgtggctcagcttagagaagaggccgagcggagggcacagcagcaagccgaagcagaacgagcacgggaagaagccgagagagagttggagcgttggcagcttaaagcgaacgaggcactgagactccggctacaagcagaggaagtagctcagcagaaaagtctcgcccaagccgaggctgagaaacagaaagaagaggccgaaagggaggctaggagacgcggcaaggctgaggagcaggcagtccggcagcgcgagctcgccgaacaagaactcgagaagcagagacaactggcagagggtaccgctcagcagaggcttgccgctgagcaggagctgatccggttgagagcggagaccgagcagggtgaacagcaacgccagctgttggaagaggaactggcaaggctgcaaagggaagctgccgcagctacccagaagcggcaggaactggaggccgaacttgccaaagtccgggccgagatggaggtgttattagcgtcgaaagctagagccgaagaagagagcagaagcaccagcgagaaatccaagcagcgactggaggctgaggctggccgcttcagagaactcgctgaagaagctgcccgactacgtgccttagcagaggaagccaaacgtcaacgacagctggcagaggaggacgcagccaggcaacgcgcagaggctgaacgagtgctggcggagaaacttgcggccatcggtgaggctacaaggttaaaaactgaggctgagatcgccctcaaagagaaggaggctgaaaatgagagactgagaaggctcgccgaagacgaagcattccagcgtaggcggttagaagagcaagctgcccagcacaaagccgacatcgaggagcgactcgcccaactccgaaaagcctcagactccgagcttgagagacagaaggggctcgtcgaagataccctccgccagagaagacaggtcgaagaggaaattttggccctgaaggcgtcctttgagaaagccgccgccggcaaggctgagctcgaactcgagctgggccgcatccgtagcaacgctgaggacacattaaggagtaaggagcaagccgagcttgaagcagcacgccagaggcagctagctgccgaagaagaaagaaggcgccgcgaagccgaggagagggttcagaagtccttagctgccgaggaagaggccgccaggcaacgtaaggctgcccttgaggaagttgagaggctcaaggcaaaagtggaggaggcaaggcggttacgggagagagcagaacaggagagtgccagacaactgcagctggctcaggaggctgcacagaagcgcctgcaagctgaggagaaggcccatgctttcgccgtccagcagaaggaacaggagctgcaacagactctgcaacaggaacagtctgtgctcgaccagctgcggggcgaggccgaagctgctcggcgtgcggcagaggaagcagaggaagccagggtgcaagctgagcgggaagctgcacaaagccgtcggcaagtggaagaagcggagaggctgaagcagtcggcagaggaacaggcccaggctcgggcccaagcacaggctgctgcagaaaagctccggaaggaggctgagcaagaagctgcccggagggcacaggccgagcaggcagcattaagacagaaacaggctgccgatgctgaaatggagaagcataagaagtttgcggaacagacactgagacaaaaggctcaagttgaacaggagctcactacgctcagactgcagctcgaggagactgatcaccagaagaacttactggacgaagagttacaacgactgaaggctgaggccacagaggctgcgagacagagaagtcaagtggaagaggaactcttcagcgtcagagtgcagatggaagagctaagcaaattaaaggctcggatcgaagcagagaatagagcgctaatcctgagagacaaggataacactcagcgattcctgcaggaagaagccgagaaaatgaaacaagtcgcagaagaagctgccaggctcagtgttgccgcacaggaggccgcccggctgcggcagctggcggaagaggatctagcccagcagagggccttggcagaaaaaatgctcaaagagaaaatgcaggcagtgcaggaggccacccgactcaaagctgaagcagaactgcttcagcagcagaaggaacttgctcaggaacaagccagacgattgcaggaggataaagagcagatggcccagcagttggctgaggagacccaaggattccagagaacactggaagccgaacgccaacgccaactggaaatgtcagccgaagccgaacgcctcaagttgcgagttgccgagatgtctagggcacaggcgcgagctgaagaagatgcccagcggttcaggaagcaagccgaagaaatcggagaaaaattgcacagaactgaactcgccacacaggagaaggtgacgctggttcagacactggaaatccagcgtcagcagtcagatcacgacgcggaacgactgagagaggccatcgccgagcttgagcgcgagaaagagaagctgcagcaggaagccaagttactccagctgaagagtgaagagatgcagaccgtccagcaggagcagttgctgcaagagacacaagccctgcagcaatctttcctgagcgaaaaggactccctcctccagagagaaagatttatcgaacaagaaaaggctaagctggagcagctatttcaggatgaggtcgcgaaggcccagcagctaagagaggaacagcaaagacagcagcagcaaatggagcaggaacggcagagactggtggccagtatggaagaagcccggagacgccaacacgaagccgaagaaggagtgcgaaggaaacaagaagagctacaacagctggagcagcagcgtcggcagcaggaggaacttctggctgaggagaaccaaagactgcgcgagcaacttcagctcctagaggagcagcaccgggctgctttggcccattcagaggaggtgacggccagtcaggttgctgctacaaaaacactccccaacgggagagatgctctggatggtcctgctgccgaagctgagccagaacactccttcgacggtctgcgccgaaaagtgagcgctcaaaggctgcaggaggccggtatcctgagcgctgaagagctccagaggctggcccagggacacacgaccgtggatgagctcgccaggagagaggatgttcgccactatcttcaggggcgttcgtctattgcggggctcttgctaaaagcaacaaacgaaaagttatcagtgtatgccgcattacagcgacagctcctaagcccaggaacagccctcatcttacttgaggctcaggctgcaagcggttttttgctggatccagtacgaaatagacgccttacagtcaatgaggctgtgaaagagggggtagttggccctgagctacatcacaaactgctctccgcagagcgggccgtcaccggttacaaggatccttacaccggacaacaaatcagcctctttcaggcgatgcagaaaggccttattgtgcgcgagcatggaatccgtcttctggaggcccagattgccacaggaggcgtcatcgacccagtccattcccatcgtgtacctgtggacgttgcatataggcggggttattttgacgaagaaatgaatcgcgttctcgccgacccatccgacgatacaaaaggtttctttgaccccaacacacacgagaatctaacatacctgcagcttttggagcgttgcgtggaggatcccgaaacaggactgtgcctgttaccactgactgacaaggctgccaaggggggagaactggtgtatactgactctgaagcccgcgatgttttcgagaaagctacggtgtcggcgcccttcggaaaatttcaaggaaaaacagtcacaatatgggaaatcattaactctgagtatttcaccgcagagcagagaagggatttactgcggcagtttaggacaggaagaatcacagtcgagaaaattattaaaatcataattaccgtcgtcgaggaacaggagcaaaaaggaaggctgtgtttcgaaggtctgcgaagcctggtgccagcagccgagttgctagagtctagggtcatcgaccgagagttataccagcaactgcagagaggggagaggtcagtccgcgatgtggccgaggtggacacagtgcgtcgggccctgagaggcgccaacgtgatagcaggagtatggctggaggaagcaggccagaagttaagtatttacaatgccctcaagaaagacctgcttccgtcagatatggccgttgctcttctcgaagctcaagctgggaccggtcatattattgacccagcaacgagcgccagattaactgtcgacgaagccgtgcgggctggcctggtcggacctgagttccatgagaagctcttatccgctgagaaagcagtcactggttatcgcgatccgtacactgggcagtccgtttccttattccaggctctcaagaagggactgataccccgtgagcagggtctccggctcttggatgctcagctttctacgggggggatagtcgaccccagtaagtctcatagagtgcccctcgatgttgcctgcgccagaggttgtctcgatgaagagacatctcgtgcgctttctgcaccgagggccgacgctaaggcctattccgacccctcgaccggcgaacccgcgacttatggggagctgcagcaaagatgtcggcctgaccagcttaccgggttatccttgttgcccttaagcgagaaagccgcccgtgccagacaggaggagctctatagcgagcttcaggctcgggagacctttgaaaaaacaccggtagaggtccccgtgggcggttttaagggccggacggtgaccgtgtgggagctcatctcctctgaatatttcaccgccgagcagcgccaagagttgctcagacagtttagaaccggaaaggtgaccgtggagaaggtcataaaaattctaattactatcgtggaggaggtggaaaccctcagacaagaacggttgagttttagcgggctcagagcccctgttccagcaagtgagctgctggcgtctggggtgctgagtagggcgcagttcgagcagctgaaggacggcaagaccacggttaaggatctgtcagaactgggctcagtcaggacacttctccaggggagcgggtgcttggccggtatttacctggaggataccaaggagaaggtgtccatctacgaggcgatgagaagaggactgctgcgcgccaccactgccgccctgctccttgaagctcaggcggcaactggctttctggttgaccccgtccgaaatcagcgtctatacgttcacgaggctgttaaagcgggagtggtggggccggagctccacgaacaattgttgagcgccgagaaggcagtgaccggatatcgcgatccatatagcggtagcactatctctttgttccaggctatgcaaaaaggcttggttctgcgccagcatggaatcagactgttggaggctcaaatcgctacaggcggaattatcgacccagtccactctcaccgggtcccagtggatgtggcctatcagcgtgggtacttttcagaagaaatgaatcgcgtacttgccgacccttccgatgatacaaagggtttctttgatcccaatactcacgagaatctaacataccggcagctgctagaacggtgcgttgaggatcccgagacgggattgcgcctgcttccactcaagggcgcagaaaaggcagaagttgtcgagacaacccaggtatacaccgaagaagagacacgcagagcttttgaagaaactcagatcgacatccccggaggtggttcccatggaggcagcactatgtcgttatgggaagtgatgcagagcgacctcatacctgaggaacagcgagcacagttgatggccgattttcaagccggcagagtgacaaaagaaaggatgattataataataatagagatcattgaaaagaccgagattatacgccagcagggcctggcctcatacgactatgtgcggaggagattgacggctgaggacctgttcgaggccaggatcatttccctcgaaacatataatctgctgagagaaggcacccggtcattacgagaggcattggaagccgagagcgcgtggtgctacttatacggaactggaagtgtagcaggcgtctacctccccggatcacgacagactctgagcatctaccaggccttgaagaaagggctgctgtcagcagaggtcgcaaggcttctgttggaggcccaggcagcaacaggtttcctcctggatcccgttaaaggtgagaggctgacagtcgacgaagcagtgcggaagggccttgttggtccagaactgcacgacagactgttgagcgctgagcgggcagtcactggctatcgggacccctacactgagcaaacaatctcgttattccaggccatgaagaaagaactgattcctaccgaggaggccctgcggctgttagacgcccagctggctaccggggggatcgtcgatccacggctgggctttcacttgcctctggaagtcgcgtatcagcgggggtatctcaataaagacacccacgaccagctgtctgaaccctccgaagttagaagctatgtggatccctcaacagacgagcgacttagttatacacaattgctgaggcgctgtcggcgagatgatggaacaggccaattacttcttccactgtctgatgcacggaaactgactttccgcggactcagaaaacagatcaccatggaagagctagtaaggtcccaggtgatggacgaggccactgcccttcagctgagggagggcctgaccagcatcgaggaagtgactaaaaacttacagaagttcctggaaggtacgtcttgcatcgcgggagtctttgttgatgctacaaaggagcgactgagtgtgtaccaggcaatgaagaaaggcataatcagacctggcaccgccttcgaattactggaggcccaggccgccaccggatacgtcatcgaccctataaagggactgaagctgactgtggaggaagcagtgaggatgggcatcgtagggcctgagtttaaggacaaattactgtctgctgaaagggcggtgacgggctacaaggacccttattccgggaaactcattagtctcttccaggctatgaagaaggggctgattcttaaggaccacgggattaggctactcgaggcccagatcgcaacagggggcatcatcgaccccgaggagtcccacaggcttcccgtggaggtggcttacaagaggggtctgttcgacgaggaaatgaatgaaatccttacagatccttcagacgacacaaagggtttctttgaccccaacaccgaggagaacctgacctaccttcagctgatggaacgctgcatcactgacccgcagacagggctttgcctgctgcctcttaaggagaaaaagagagaacgtaagactagtagtaagtctagcgttcggaagcgacgcgtcgtcatagtcgatccagagaccggtaaagagatgtccgtgtatgaggcgtatcgcaagggactgatcgatcaccaaacctatctagagctttctgaacaagaatgtgagtgggaagaaattacaatcagtagctcagacggagtggttaagagtatgatcatcgatcgacggagcggccgccagtacgacatcgacgacgccattgcgaagaaccttatcgaccgctcagctttggatcagtatcgagccggaactctctctatcaccgaatttgcagacatgcttagcggcaacgccgggggattccggagccgttcctcgagcgtgggctccagctccagttaccccatcagccctgccgtctcaaggactcagctagcttcttggtctgatcctaccgaggaaaccggaccggtcgcgggcattctggatactgagaccctggaaaaggtctccatcaccgaagctatgcaccgcaatctggtagataatattaccgggcagcggcttctggaagcccaagcttgtacaggaggtattatcgaccccagtaccggagagaggttccccgttaccgatgccgtgaataagggactggtggataagataatggttgacagaattaatctcgcccaaaaggccttttgcggcttcgaagacccaaggactaaaaccaaaatgagcgccgctcaagcactcaaaaagggatggctctattacgaggccggtcagagatttctagaggtccagtatcttacaggtggtctaatcgaacccgatacccctggcagggttcctttggacgaagccttacagagaggaaccgtagacgccagaacagctcaaaagctgagagatgtgggagcatatagtaaatatcttacctgccccaaaacaaaactgaaaatcagttacaaagatgcgcttgacaggtcaatggtggaggagggaacaggccttcggctgctggaggcagccgcacaaagcactaagggctattattccccatacagcgtgtccgggagcgggtcaactgccgggtctagaacgggaagtaggaccggttcaagagccggctctcgaagaggttcttttgacgcaactggctcgggctttagtatgacctttagctcctcatcttatagttcctcagggtacggcaggcggtacgcctctggatcatcggcatccctgggaggacccgagtccgcagttgcctag

SEQ ID NO: 199809 - DNA, 13644 bp, Artificial Sequence
  Description of Artificial Sequence: Synthetic coding sequence
atgagccagcaccagctgcgggtgccccagcccgagggcctgggccggaaaaggactagctcggaggacaacctctatttagccgtgctgcgagcttccgaggggaagaaggatgagagggacagagtgcaaaaaaaaacattcacaaagtgggtgaacaaacacctcatcaaggcccagagacatatcagcgacctttacgaggatttacgcgacggccataatctaattagtctgcttgaggtcctgtctggcgactccctgccacgagagaaaggcagaatgagatttcataagttgcaaaacgtccagatcgctctggattatttgcgccaccggcaggtgaagctagttaacatccgcaatgatgacatcgccgatgggaaccccaagcttactcttggacttatttggaccatcattttgcatttccagattagtgatatacaggttagcggacagagcgaggacatgactgccaaggagaagctgcttctgtggagccaaaggatggtcgagggctaccagggcctgaggtgtgacaacttcacaagctcatggcgtgacggacggctcttcaacgcgatcattcaccggcacaagccgctgttaattgacatgaataaggtgtatagacagacaaatctcgaaaatctggatcaagcgttttccgtcgctgagagagatctgggggtgacccgcctgctggaccccgaagatgtagacgttccacaaccggatgagaagtcgataatcacatatgtgtcatccctctacgacgcaatgccccgggttccggacgtgcaggacggggtgagggcaaatgagctccaactgcggtggcaggaatatagagagctggtgcttctactgctacagtggatgcgccatcataccgcggcgtttgaagaaagaagatttccttcttcatttgaagagatcgaaatcctatggtctcagttcctaaagttcaaggagatggagctcccagcgaaggaagctgataagaataggagcaaaggcatctatcagagcctcgaaggcgccgtgcaggcaggacaactgaaggtaccccccggctaccatcctctggatgtggagaaagagtggggaaagcttcacgttgcaattcttgagcgcgagaagcagctgaggagtgagtttgagcggctcgaatgcttgcagcggatcgtcacaaagctccaaatggaggccggcctctgcgaagaacagttgaatcaagctgacgctttattacaatccgatgtgaggctgctggctgcaggcaaagtgcctcagcgagctggtgaagtggagcgggacttggataaagccgacagcatgattagactgctattcaacgatgtccaaacgctcaaggacgggagacaccctcaaggtgaacagatgtaccggagggtgtatcgcctgcatgagcgtctggtggccatcagaaccgaatataatctgaggctcaaggcaggggtggccgccccggccacccaagtggcccaggtaaccttgcagtcagtccagaggcgccctgagctggaagattctactctgagatatctgcaggacttactcgcctgggtcgaggaaaatcagcacagggtcgatggagcagagtggggggtggacctgccaagcgtggaggcccagctgggaagccacaggggtctacaccagagtatcgaggagtttcgtgccaagattgaaagagcacgcagtgatgaaggacagttgtcccccgctactaggggggcttacagagattgcctcgggagacttgacctgcaatacgcgaaacttctaaactctagtaaagcccgcttaagatcccttgaaagtctgcactcctttgtggctgcggctactaaagagcttatgtggctgaacgagaaggaggaagaggaagtcggattcgattggtcagataggaacacaaatatgactgccaagaaggagtcatactccgcactgatgcgggaactggagttgaaggagaagaagatcaaagagctgcagaacgccggtgaccgtctgttgcgggaggaccaccccgctcggccaacagttgagtctttccaagcagcgcttcaaactcagtggagttggatgctgcagctctgctgttgtatcgaggctcaccttaaggaaaacgccgcttacttccagttcttctctgacgtccgcgaagctgaaggacaattgcagaagctccaggaggcccttcgacgaaagtacagttgtgatcgatcggcaacggtgacacgcctggaggacctcttgcaggacgcacaggatgagaaggagcagttgaatgaatacaaaggccatctgtccggcttagctaagcgcgccaaagccgttgttcaacttaaaccaaggcacccagctcaccctatgcggggcaggttgcctctgcttgctgtgtgcgactacaaacaggtggaggtgaccgttcataagggagatgaatgtcagttggtaggcccagctcagccttcccactggaaggttcttagtagctctgggtcggaagccgctgtccccagcgtctgctttttggtaccccccccgaaccaggaggctcaggaagcagtgactcggctggaggcccagcatcaggcgcttgttaccctgtggcatcagctccatgttgacatgaagtccctcttagcctggcagagcctaagacgggacgtgcaactgatacgctcttggagcttggccacatttcgtacactgaagcccgaagaacagcggcaggccctccacagcctggagctgcattatcaagccttcctcagagactctcaggatgccgggggcttcggccccgaagaccgcctgatggctgaacgggagtacgggagttgcagtcatcattatcaacagctgctccagtccctcgagcagggggctcaagaggagtctcggtgccaacgctgtataagtgaactgaaagacattcgactgcagctggaagcgtgcgagacacgtactgtgcaccggttgcgcctccctctcgataaagaacctgccagggagtgtgcccaaagaatagcagagcaacagaaggcacaggcggaagttgagggcctgggaaagggagtagctaggttgtcggcagaagccgagaaagtcctcgcgcttcctgagcccagccctgctgcaccaacgcttcgtagcgagttagaacttactctgggcaaacttgagcaggtccgctccctctcggccatttaccttgagaaattaaagacaatttctcttgtgattcgcgggactcagggcgctgaagaagtcctcagggcccacgaagaacagttgaaggaggcacaagctgtaccggctacgctgccggaactggaggctaccaaagcctcactgaaaaaattaagagcacaggccgaagctcagcagcctaccttcgacgcacttcgagatgagctgcgcggcgcccaggaggtcggagaaagactccagcagaggcatggagaaagggacgtggaagttgaacgctggagggagcgagtggctcagctcttggagcgctggcaggccgtgctggcacagacagatgttcggcaaagagaattggaacagctagggaggcagctccggtactaccgggaatcagcagatcccttgggagcttggcttcaggacgctcgcaggcggcaggagcagatccaggccatgccccttgccgacagtcaagcggtgagagaacagctgcggcaggaacaggctctgctcgaagagattgagcggcacggcgagaaggttgaggagtgtcaacgcttcgcgaagcagtacattaacgccattaaagattacgaactccaactcgttacatacaaggcccagctggagcccgttgcttccccagccaagaaaccaaaggtgcagagcggctcggagtcggtcatccaggagtacgttgatctgaggacacactattcggagttgacgaccctaacttctcagtatatcaagttcatctccgagacccttcgcaggatggaggaggaggagcggttagccgagcaacaacgggctgaagaacgggagaggctggctgaagttgaggccgcactagagaaacagcggcagctggcagaggcgcatgctcaggccaaggcccaagccgagagagaggcaaaggaacttcaacaacgaatgcaggaggaagtagtccgcagggaggaggcggcagtcgatgcccagcagcagaaaagaagcatccaagaggaacttcagcagctcaggcagagcagcgaagccgaaatacaggccaaagcacgccaggctgaggccgctgaacgcagtagactgagaatcgaggaagagattcgcgtcgtgcggctgcagctggaggcaacagaaagacaacgcggcggcgccgagggggagctccaggccctgcgcgcaagggctgaagaggcagaggcacagaaaaggcaggcgcaggaagaagccgagcgccttagacggcaggtgcaggatgaatcccagaggaagcggcaagctgaagtggagctggccagcagggtcaaagccgaagctgaggccgcacgagagaagcagagagcccttcaggcccttgaagagctccggctccaggccgaagaagccgaacgacgcctgcgccaggccgaggttgagcgggccaggcaggtccaagtggccctcgagacggcacaacggtcagcagaagccgagctccagagcaaaagggcctccttcgcagagaaaactgcacagctggaacggagccttcaggaggagcacgtcgccgttgctcagcttagggaggaagcagagagacgcgctcagcaacaggccgaggcagagcgcgcaagggaggaggccgagcgcgagctggaacgttggcagcttaaggctaatgaggccctgaggctcagacttcaggccgaggaggtcgcacagcagaaatcgttagcccaggctgaggcagagaagcaaaaggaagaggccgaaagagaagctcgtagaaggggaaaagcagaggaacaggctgttcgtcagagggagcttgccgagcaggaactagaaaagcagaggcaattggctgaaggaaccgcacaacaacgactggctgccgaacaagagctaataagactccgcgcagagacagagcagggcgagcagcagagacagcttttggaggaggaattggcccgcctccagcgtgaggccgccgccgctactcaaaaaagacaagaattagaggccgaactcgctaaggtgagggccgagatggaggtcctgttggcatctaaggcacgcgcagaggaggagtcgaggtccactagcgagaagtccaaacagcggctagaagccgaagctggtaggttccgggaattggcagaagaggccgcacggctgcgcgctttagctgaggaggccaagcgccagaggcaacttgccgaggaggatgcagctcgtcagagagctgaagctgagcgggtcctggctgagaaactggccgccataggggaagccacccgccttaaaaccgaagccgaaatcgcactgaaggagaaagaagctgaaaacgagcgccttagacgtcttgctgaggatgaggccttccaacgacggagactcgaagagcaggcagcacaacataaggcagatatcgaggaaaggctggcccagctgaggaaagcaagcgactcggaactcgaaagacagaagggcctggttgaagatacccttaggcaacgcaggcaggtggaggaggagatcttagcactcaaggccagcttcgagaaagccgcagccggcaaagcagaactggaactcgagctgggtagaatcagatctaacgctgaagatactctcaggtcaaaagaacaggcggaactcgaagccgctaggcagaggcagttagccgcagaagaggagcgacgcaggcgtgaggctgaagaaagagttcagaaaagtcttgctgccgaagaggaggccgcgagacaacggaaggcggctctggaggaggtggaaagattaaaggccaaggtggaagaggcccgcaggctgcgcgaacgagctgaacaggagtctgctaggcagttgcagctggcccaagaggcagcacagaagagactgcaagctgaggagaaggcgcatgctttcgccgtgcagcaaaaagagcaggaactccagcagacccttcaacaggaacaatccgtcctcgaccaactgcgcggcgaagcggaggctgcccgccgcgcagccgaagaagccgaagaagccagggtccaggccgaacgggaggccgcgcagtctagacggcaagtagaggaagctgagcgactaaaacagagtgccgaggagcaggcccaggcgcgagcgcaagcccaggccgcagctgaaaaactccgaaaggaggccgagcaagaggctgcccggcgtgcccaagccgagcaggctgccctgcggcaaaagcaggcagcggacgccgagatggagaaacacaagaagttcgctgagcagactttacgccaaaaagcccaggtggagcaagagctcactaccctgaggctgcagttggaagaaaccgatcaccagaagaatctgttagatgaagagctgcaacggttgaaggctgaggctaccgaggccgcaagacagcggtctcaggtcgaggaagagttatttagcgtgcgcgttcagatggaggaactatctaagttaaaggcgaggatagaggcagagaacagggcgcttatcttgcgcgataaggataatacacaacgcttcctgcaagaagaggccgagaagatgaagcaggtagccgaggaagctgcaaggttaagcgtagcagcccaggaggccgctcgcctcagacagttggcagaagaggatctagcgcagcagagagcattggctgagaaaatgctgaaggagaaaatgcaggcagttcaggaggctacaaggcttaaagcagaggcggagcttctccagcagcagaaagaactggcacaggagcaagctcggcgtctgcaagaagataaggaacaaatggcacagcagctggcggaggaaacccagggatttcaacgtacgctggaagctgagcgacagcggcagctagagatgtccgctgaggccgaaaggctgaaactgcgcgtcgcggagatgagccgcgcgcaggcacgagcagaagaagacgcccagaggtttaggaaacaggcagaagagatcggagaaaagctccatagaaccgagttagctacacaagagaaggtgacgctggtgcagactttagagattcagagacaacaatccgatcacgacgcagagcggctgcgtgaggccatcgcagagcttgagagggaaaaagagaaactgcagcaggaggccaagctgctgcagctgaaatccgaggagatgcaaacagtgcagcaagaacagctgttgcaggagacacaggccctccagcagtccttcctgagtgagaaggatagcctcttgcagcgtgagcgcttcatcgaacaggaaaaagccaagttagaacaactgtttcaggatgaggttgctaaggcccagcagctgagggaagagcagcagcggcaacaacagcagatggagcaagaacgtcagagactcgtagcttctatggaggaagcaaggcgtcggcagcatgaagccgaggaaggtgtgcgccgcaagcaagaagagttgcagcaattggaacagcaacgacgtcagcaggaagaactgttagccgaggagaatcagcgacttagggagcagctccagctactcgaggaacaacaccgcgcagcgctggcccattccgaggaggttaccgcaagtcaggtagcggccacgaaaaccctgccgaacggtagagatgcattagacgggcctgcggcggaggcggaaccggaacattctttcgatgggttgaggcggaaggtgtcagcccaaagattgcaggaggctgggatcttgagcgccgaagagctgcaaaggttggcccagggccacactacggtcgacgagctagcgcgccgcgaagatgttagacattaccttcagggcaggtcttccatcgcagggcttcttctgaaagctacaaacgagaaactgtctgtttatgccgcgctccagcgccagctccttagcccaggaacagccttaatcctgcttgaagctcaagcagcgtccggtttcctgctggaccctgtgcgaaacaggagactgacagtgaatgaagcagttaaagaaggcgtggtgggccccgagctccaccataaactgctgagtgctgagagagcggtgacagggtacaaggatccttacacgggccagcaaattagtctctttcaggccatgcaaaagggtttgattgtccgtgagcatggcatccgactgctcgaggctcaaattgctaccggaggtgtaatcgatcctgtgcactcacatagagttccagtggatgttgcctatcgcagaggctacttcgacgaggagatgaatcgggtgcttgctgatccttccgatgacaccaagggcttcttcgatcctaatacccatgaaaatctgacttacctgcagctgctggagaggtgcgtggaggaccctgaaaccggactgtgtcttttaccgctgacagataaagcagcgaagggcggcgaattggtctacacagatagcgaagccagggatgtgttcgagaaagccacagtgtcagcaccctttggaaagttccaaggaaaaacagttactatatgggagataattaattctgagtatttcactgccgagcaacgcagggacctgctgaggcagtttaggaccggccgaatcacagttgagaagattataaaaatcattataactgtggtagaggagcaggagcaaaagggtcgcctgtgctttgaaggacttcggagcctcgtcccggcagccgaactgttggaatcccgtgtaattgacagggaactgtaccagcagctgcaaagaggagaacggtccgttagggacgtggctgaggtagacaccgtgcggagagcacttcggggggcaaacgtgatcgccggcgtatggctcgaggaggcaggacagaaattatctatttataatgccctgaaaaaagacctgttgcccagtgatatggccgttgcactcttagaggcccaggcaggcactggacacatcatagaccctgccacttcagcacggttgaccgttgatgaggccgtccgagctggcctggttggcccagaattccatgagaaattgctgtctgcagagaaagccgtgacaggttacagagatccgtacaccggtcaaagtgtctccctgtttcaggccctgaaaaagggactgatcccccgagagcagggcctgaggctgctggatgcacagcttagcaccggaggcatcgtcgatccctcaaaatcccatagggtccccctagatgtggcttgcgcccgcggatgtctcgacgaagagacctcacgggcgctgtctgcgccaagagctgatgcaaaagcttactcagacccgtcaacaggggagcccgccacctatggggagctgcagcagagatgtagacctgatcagctgacagggctctcgttactgccgctcagcgagaaagctgcaagagcacgccaggaggagctgtactccgagctgcaggcgcgggaaacttttgaaaaaacgccagttgaggtgcctgtgggcggctttaagggccggacagtaacagtttgggaactgattagcagtgagtattttacagctgaacaaaggcaagagctgcttagacagttcaggacaggaaaggtgacagtggaaaaggtcataaaaatcctgatcactattgtggaggaggtcgagacgctgcggcaggagcgtctttcttttagcggactacgagctcctgttccggcctcggaattactggcttccggcgtgctctcacgggcacagttcgagcagctgaaggatgggaagacaaccgtcaaagatctgagcgagctgggctctgtcaggactctgctgcaagggagcggctgcctcgcaggaatatacctggaagataccaaagagaaggtctccatatatgaggccatgcgcagaggtttgctgagagccacgactgccgcccttctcctcgaagcacaggccgcaacggggttccttgtggatccagtgaggaatcaacgcctttacgtccacgaggcggtgaaggctggggtcgtcgggcccgagctccatgagcaactgttatcagccgaaaaagcagtcaccggttatcgtgacccctactcagggagtaccatctctctgttccaagcaatgcaaaagggacttgtattgcgtcaacatgggattagattgctggaggctcagattgccaccgggggcatcattgatcctgtacacagccaccgggttccagtcgatgttgcctatcagagggggtacttctccgaggagatgaaccgggtcctggcagatccttccgatgataccaagggattcttcgacccaaacacgcacgaaaaccttacttaccgccaattgctggaacggtgcgtggaggatcccgaaacagggcttaggctgctgcccctgaagggagccgagaaggccgaggtggtcgaaaccacccaagtttacacagaagaggagacccggcgggccttcgaggaaacacaaatcgacatacctgggggggggtctcatgggggttctaccatgagcttgtgggaagtgatgcagtccgatttaattccagaggaacagcgtgcgcaactaatggctgattttcaggctgggagagtgacaaaggagaggatgataataataataatcgaaattattgagaagaccgaaataatccgtcaacaaggcctcgcctcatacgattacgtgaggagacgtctcactgccgaagatctttttgaggcccgcattatctctctggaaacatacaatctccttagagaggggacccggagcctgagagaggccttggaggccgaatccgcctggtgctacctctacgggacaggcagcgtcgccggggtatacctaccggggtcccgccagacattatccatataccaggctttgaagaagggactcctgagcgccgaggtggcacgactgcttctggaagctcaggccgcgaccgggttcctgttggacccggtaaagggggaacgtcttactgtagacgaggcagtccgaaagggattagtaggccccgagctgcatgatcgcttgctgtctgccgagcgagcagtgactggctaccgtgacccctataccgagcagaccatcagtctgttccaggccatgaagaaggagttaattcccaccgaagaggctttgaggcttctggatgcgcagctggccactggagggattgtggatccacggctcggcttccatttgccactggaagtcgcctatcagagggggtatctgaataaggatacacacgaccagcttagtgagccttctgaagtgcggtcctacgtagacccatctacagacgagaggctgtcctacacccagttgctgcgacgttgcagacgggacgatggaaccggccagttgttgctcccattaagtgacgcgcgaaaactaacttttagaggtctccggaagcagatcaccatggaagaactggtccgttcgcaagtcatggacgaggccacagccttgcaattgagggagggtctgacttctatagaagaggtgaccaaaaacttacagaagttcctggaagggacctcatgtatcgccggcgtgtttgtggacgctacaaaggagcgtctgagtgtgtaccaggcaatgaaaaaaggaatcatcaggcccggcacagcattcgagctcctggaggcccaggctgccaccggctacgtgattgacccaatcaaggggttgaaactgacggtggaggaggctgtccgcatgggaattgtcggtcccgagtttaaggacaaattattaagtgctgagagggccgttaccggctacaaggatccatactctggtaaactcatctccctttttcaggccatgaagaagggcctgattttgaaagatcacggtattcgtcttctagaggcacaaattgctacaggtggtattattgatcctgaagaatcccataggctgcccgtggaggtggcatacaagagggggcttttcgatgaggaaatgaatgaaatccttacagaccccagcgacgacacaaagggtttcttcgatcccaacaccgaagaaaacctaacctatctgcagctcatggaaaggtgtattactgacccccagaccggtctatgccttctgcctcttaaggagaaaaagagagagaggaagacgtcctccaaatcctccgtgcggaagcggcgggtggtaattgtggacccggaaacaggcaaggagatgtccgtgtatgaggcatacaggaagggcctcatcgaccatcagacgtatctcgagttatccgagcaggagtgcgagtgggaagagataactataagttccagtgacggtgtggtgaagagcatgatcatcgacaggcgtagcggccgtcagtatgatatagacgacgcaatcgcaaaaaacctgatagaccggagcgccctggaccagtacagggccggaactctgtcgatcacggagttcgctgacatgctgagtggcaacgccggcggttttcgaagccgctcttccagtgtcggatcttcatcgtcctaccctatcagcccagccgtgagtcggacacagttggcgagttggtccgaccccaccgaagaaactgggcctgtggcaggcattctagacacagaaacactcgaaaaggtgagtattaccgaggccatgcacagaaacctcgttgataacatcacgggtcagcggctgctagaggcccaagcctgcacgggcggtataatcgatcctagtacaggggagcgctttccagtgacggacgcagtaaataaagggctcgtggacaaaatcatggtggaccgcattaacttggcccagaaagccttctgtggctttgaggatcccagaacaaagacgaagatgagcgcagcccaggcgctgaagaaagggtggctgtattacgaggccggccagcgattcttagaagtgcagtacctgaccgggggcctgatcgagcctgatactcccggacgagtacccctggatgaagctctgcagaggggcactgtggatgcaaggacagctcaaaaattgcgcgacgtgggggcatactccaaatacctgacatgtcccaagacaaagctcaaaattagttacaaagatgctctggacaggtctatggtagaagagggcacagggctgcgactgttggaggccgccgcacagagcaccaagggttattatagcccctacagcgtgtctggatcaggctctaccgccggctccaggaccgggtcccgtaccgggagccgtgccggcagcaggcggggatcatttgatgccacaggaagtggttttagcatgacgttctcctcatcctcatactccagtagtggatacgggcgccgctatgccagtggatcctctgcatctcttggcggccccgaatccgccgtggcatag

SEQ ID NO: 199810 - DNA, 13644 bp, Artificial Sequence
  Description of Artificial Sequence: Synthetic coding sequence
atggagcccagcggcagcctgttccccagcctggtggtggtgggccacgtcgtgacccttgccgcagtgtggcattggagacgcggccgccggtgggcccaggacgaacaggatgaacgtgaccgggtccagaagaagaccttcaccaaatgggtcaacaaacacttgataaaggcccaacgacacatttccgacctgtatgaagatctgcgggatggccataatctgatcagtctcctggaggtgctctccggggattcgctgccaagggagaaaggaagaatgcgattccataagttacagaatgtgcaaatcgcactggattacctgcggcatcgtcaagtaaaacttgtaaacattcgaaacgacgacattgccgatggaaacccaaagcttaccctaggcctgatttggacgattatactgcatttccaaatttctgatattcaagttagtgggcaaagcgaagacatgacagctaaggagaaattgctgctctggtcgcagcgcatggtggagggatatcagggcctgcgctgcgataatttcacttcgtcctggagggatggccgcctcttcaacgcaatcatccacaggcacaagcccctcttgattgacatgaacaaagtgtacagacagaccaacctggagaaccttgatcaggcatttagtgtggccgaaagagatttgggcgtaactcgcctgctggatccagaggatgtcgatgtgcctcagcccgacgagaaatcaatcattacctatgtatccagtttatacgatgctatgcctcgagtgcctgatgtgcaggatggggtgagggctaacgagctacagctgcggtggcaagaatatcgtgaattggtgctcctgctgctccaatggatgcgtcatcatactgccgcttttgaggaacggaggtttcccagttcctttgaagaaatcgaaatcttatggagccaatttctcaaattcaaagagatggagctcccggccaaagaagcagataaaaaccggagtaaggggatttatcagagcctagaaggggccgtgcaggcaggtcaactgaaagtgccgccggggtaccaccctttagatgtggaaaaagagtggggcaagctccatgttgctatccttgaacgcgaaaaacagctgcggtcagagtttgagagacttgagtgcctccagagaattgtgaccaaattgcagatggaggcagggctttgcgaagagcagcttaaccaggccgatgcccttctgcagagtgacgtccgattacttgctgctgggaaagtgccgcagcgtgctggagaagtagagcgcgatctggacaaggcggattctatgatcaggctgctttttaatgacgttcagacgctaaaggacggtagacatccccagggggagcagatgtatcgacgagtttaccgtttacatgaaagattggtggccattagaaccgaatacaacttaaggcttaaggcaggggttgccgctccagcgacacaggttgcccaagttactctgcaatcggtccagaggaggccagaactagaggactcaactttgcgctatctccaggatctactggcttgggtggaagaaaaccagcacagagtcgacggcgcagaatggggcgttgatctgccgtccgttgaagcccaacttggttcccacagagggctccaccagagcattgaggagttccgtgccaagatcgagcgcgctcgtagtgatgagggccagctctcaccggctacacggggtgcctaccgcgactgccttggcagactcgacctgcagtatgccaagctgctgaattcttctaaggcacgccttcgttcattagagtctctacacagcttcgtggcagcagccactaaagaactgatgtggttgaacgagaaagaggaggaagaggtggggtttgactggtcagacagaaacaccaatatgactgctaagaaagaatcatactccgctctcatgcgcgagttagagcttaaggaaaaaaagattaaggagttgcagaacgctggagatagactcctgcgcgaggatcaccccgcaagaccaaccgtcgaatcctttcaggcagcgctgcagactcagtggtcttggatgcttcagctgtgttgctgcatagaggcccatctgaaagagaacgccgcctatttccagttctttagtgacgtacgggaagccgaaggtcagctccagaagctccaggaagctctaagacggaaatacagctgtgaccggagcgcgactgtgacccggctcgaagacctgctgcaagacgcccaagacgagaaggagcaactgaacgagtacaagggccatctctcaggcctggccaaacgcgccaaggccgtcgtccaactcaagccacggcacccagcacatcctatgcgtggccggttgcccctccttgccgtctgcgattacaagcaggtagaggtaacggtgcacaaaggagacgaatgccaactcgtgggaccggcccagcccagccattggaaggtgctctcctcctctggcagtgaagcggccgtaccgagcgtttgtttccttgtgcctccgcccaaccaagaggcccaagaggcggtgacccggctggaagcccagcaccaggccctggtcactttgtggcaccagctccacgttgacatgaagagcctattagcttggcaaagtctgagaagggacgtccagctgataagaagctggagtctcgccacctttcgcactctaaaaccggaggaacagcgccaggcattacatagtttagaactgcactaccaggcattccttcgcgactctcaggatgcggggggatttggtcctgaggacaggctgatggctgaaagagagtacggctcgtgttcgcatcactaccagcagctgcttcagtccttggagcagggagcccaagaagagagtagatgccagcgctgtattagcgaactgaaagatattcgcttgcagttagaggcctgtgaaactaggaccgtgcataggctgagactccccctggataaggagcctgccagggaatgcgcccaacgaatagccgagcagcagaaagcccaggctgaagttgagggcttaggtaaaggtgttgcccgtctgtccgctgaagctgagaaggtgttggccctgcctgaacctagccccgctgcaccaacactgcggtctgaactcgagttaaccctgggcaaactagagcaggtgcgctcattatcagctatctacctggagaagctgaagaccataagtctggtcatcagggggacccagggcgcagaggaagtgctgagagcacatgaggaacagctaaaggaagcacaggcagttcccgccaccctgccggagctggaagctaccaaagctagcctgaagaaactcagagcacaggccgaggctcagcagcctacatttgatgcccttcgcgacgagctccgaggcgcccaggaagtcggagaaagactgcagcagcgccacggagaaagggatgtggaagtagagaggtggcgggaaagggtggctcagctgctggagcgttggcaggctgtgttggcccaaaccgacgtaaggcagcgggagcttgaacagctcggtcggcagcttaggtattatagagagagcgctgatcctctcggcgcctggctgcaggacgctaggagaaggcaggaacagatacaggcaatgccgttagccgattcacaggctgtgagggaacaacttcggcaggaacaggccctgcttgaggagattgagagacatggcgaaaaggttgaagaatgtcagaggtttgccaagcaatatatcaacgcgataaaggactacgaactgcagctggtgacctacaaggcccaattggagcccgttgcgtctccagccaagaaacctaaagtgcagagcgggtcagagtctgtgatccaggagtacgtcgacctgagaacccactacagcgaactgactactctcacgtcccagtacatcaaatttatttctgaaacactccgcagaatggaggaagaggaacgcttagccgagcaacaaagagctgaggagcgtgagcggctggctgaggtcgaggcagcccttgaaaagcagaggcagctcgccgaggcacatgcccaagcgaaggcccaggcagagagagaagcaaaagagctgcagcaacggatgcaagaggaggtagtgcgcagggaagaggcagccgtggatgcccagcagcagaaacgctcaatccaggaggagctgcagcagcttcgacaatcttccgaggcggaaatccaagccaaggctcgccaggctgaggccgccgagcgtagcaggttgcgaatagaagaggagataagggtggtccgcctgcaattggaggctaccgagcgtcagaggggcggtgctgagggggagcttcaggcactcagagcaagggcagaggaggcggaggcccagaagaggcaagcccaagaggaggcagagcgcttgaggagacaggtgcaggatgagagccagcgcaagcggcaggcagaggtggaattggcaagccgtgtgaaagcagaagctgaggctgccagggagaagcagagggcactgcaggccctcgaggagcttcgcctccaagccgaggaagctgagcgacgactacgccaggctgaagtggaacgagcccgccaggttcaggtggcactggaaacagcccagcggtccgcggaggctgaactgcagtcaaaacgagcgtcattcgccgagaagacagctcagctggagaggagtctccaagaagagcacgtcgccgtggctcagttgcgagaagaggcggaaaggcgggcccaacagcaggctgaagctgaacgtgcccgggaagaagcggagagagagctggaaaggtggcagctcaaagccaacgaggcactccgactccggttgcaagccgaagaggtcgcccagcagaagtcactggctcaggccgaggcagaaaaacagaaggaagaggccgaacgcgaggctcgccgaaggggtaaagccgaagagcaggctgttcgccagcgggagctggctgagcaggaattagagaagcagcgccagctggcagagggtaccgcccaacagcgtctggccgcggagcaggagctgatacggttgagagcagaaaccgagcagggcgaacagcaaaggcagttgttggaagaagagctggcaagattgcagagagaggctgccgccgccacacagaagcgccaggaacttgaggccgaactggccaaagtaagagcagagatggaggtgctgctggcctccaaggcgagggcagaggaggagtccaggagcactagcgagaagagcaaacaacgattggaggccgaagccggacgcttccgggagttggcggaagaagcagcacgccttcgcgcactcgcagaggaagctaagagacagagacagctggctgaggaagacgccgcacgacaaagggcagaagccgaacgcgtgctggctgagaagcttgcagccataggtgaggcaactcgactaaagaccgaagctgagatcgcactcaaagaaaaggaagcagagaacgaacgcctgaggcgattggctgaggatgaagccttccagagaaggcgcctggaggagcaggccgcacaacacaaggcagatatcgaagagagactggcccagctcagaaaagctagtgatagcgaactggaaagacagaaagggctggtggaagacactctgcgacagaggcgccaggtggaagaagaaattctagcactgaaagcctcgttcgagaaggcagccgctggtaaggccgaactggagttggaacttggaagaatcaggtctaacgctgaagatacccttaggtccaaagaacaggctgagttggaagccgcaagacaacggcagctggcagcagaagaggagagacgcaggagggaagccgaagaacgcgtacagaagagtctggccgccgaggaggaggctgcccgccagagaaaagcggccctcgaagaggtggagaggctaaaggctaaggtggaagaggctcgccggctgagggagagagccgaacaggagagcgcgagacaactgcaattagcccaagaggccgcacagaagaggctgcaggcggaagaaaaagcgcacgccttcgccgtgcagcagaaagagcaggagctgcagcagacgctacagcaggagcagagcgtcctggatcagctgcggggggaggccgaggctgctcgacgggctgccgaagaagcagaagaggctcgcgtacaggctgagagagaggctgcccagagccgtcgccaggtcgaggaggctgagcggctgaagcagagtgctgaagaacaggctcaggcaagggcacaggcacaggccgccgccgaaaagctccgcaaagaggctgagcaggaggccgccaggcgcgcccaggccgagcaggccgctctgcggcagaagcaagccgctgatgctgaaatggaaaaacacaaaaagtttgctgagcagacattgcgacagaaagcccaggtcgagcaggagttgacaacactgagactgcaactggaagaaactgatcatcagaaaaatctgctcgacgaagaacttcagagactgaaggccgaggccaccgaagcggcccggcaacgcagtcaggtcgaggaagaactgttttccgtgcgcgtacagatggaggaacttagcaagctgaaagctagaatagaggcggagaatcgagctttaatattgagggataaagataacacacagcggtttctccaggaggaggcagaaaagatgaagcaagtcgcggaagaggcggcccgcctctcggttgctgctcaagaggctgcccgcttgagacagttagctgaggaagacctggcccagcagcgggcgctggctgaaaaaatgttgaaggagaagatgcaggccgtacaggaggccacccggctcaaggctgaggccgaactcttgcagcagcagaaggagctggcccaggaacaggcaaggcggctgcaggaggacaaagagcagatggcacagcagctggcagaagagacccaaggattccagcggaccctcgaggccgagaggcagcgacagttggagatgtctgcggaagctgagcgactgaagcttagggtagcggaaatgtctagagcccaggctagggctgaggaggatgcacaacgctttagaaaacaagctgaggagattggagagaagctgcatagaacggagctggcaacccaagagaaggttactttggtgcagacattggagattcagagacagcagagtgaccatgacgcagagagactcagggaggcaattgccgaattagagagggagaaggagaaattgcaacaggaggctaagctgctgcaattgaagagtgaagagatgcagacagtccagcaggagcaactgcttcaggaaactcaggcattgcagcaatcttttttatcagaaaaggattctctcttgcaacgggagcggtttatagagcaggagaaggccaaactggagcagctgttccaggatgaggtggcaaaagcacagcagctgagggaggagcaacagaggcagcagcagcagatggagcaagagcgtcaacgactcgtagcatctatggaagaggccaggcgccgtcagcacgaagccgaggagggggtgaggcggaaacaagaagagctgcagcaattagagcagcagcgccggcaacaggaagagctgttagcggaggagaaccaacgactgcgggagcagctgcagttacttgaggagcagcacagagctgccttggctcactccgaagaagtgaccgcaagccaggtggctgccaccaaaacattgcctaacggccgggatgccctggacgggcccgctgcggaggcagaacccgagcatagtttcgatgggctgcgccggaaggtttcagcccagaggctgcaagaggccggcattctgtccgccgaggagctgcagcgcctggcccagggccacaccactgtggatgaactggctaggcgggaagatgtccgccactatctgcagggtagatcgagtattgcaggcttgctcttaaaagccacaaacgaaaagctgtctgtgtacgctgccctccagcgccagctcctcagtcccggaactgccttgatactgctcgaagcccaggctgcttctgggttccttctggatccagtccgtaaccggcgtctaaccgttaacgaggcagtcaaggaaggagttgtgggccctgaactacaccacaagctacttagcgcggaacgagctgtaactgggtacaaggacccctataccggtcagcaaatttctttgtttcaggcaatgcagaagggcctgattgttagagaacacggtattcgactcctcgaagcccagattgccaccggcggcgttattgacccggtgcatagtcatcgtgtgcccgtggatgtcgcatatcgcaggggatactttgacgaagagatgaacagagtgctggcggatccaagtgacgatacaaagggcttttttgacccaaacacccatgagaatttgacctatctgcagttgctggagcgatgcgtggaagatccagagacaggattgtgcttgctgcccctgacggacaaggccgcaaaaggcggagagctggtgtatacggattctgaagctcgagatgtttttgagaaagcgacggtctcagcccccttcgggaagtttcagggaaagaccgttacaatctgggagataataaacagtgagtactttaccgcggagcagaggcgagacctgttacgccaatttcgcaccggccgaatcaccgttgaaaagatcatcaagatcattatcaccgtagtggaggaacaggaacaaaaaggacgtctctgcttcgagggcttgcgctccctggtcccagcagccgaattgctcgaatcacgcgttatcgatcgagagttgtaccaacaactccagagaggcgagaggagtgtgagagacgtggccgaagtggataccgtcagaagggcactcaggggagcaaatgtgatcgctggagtctggctcgaagaagcaggacagaaactgtctatatataatgctctaaagaaagacttgctgccttctgacatggcagtggctctcctggaggcacaagccggcaccggccacattatcgacccagcaacgtccgcaagactgactgtggatgaggccgttagggcaggtctggtgggcccagaattccatgaaaagctcctctcagcagagaaagcagtgaccggatacagggacccatacacaggtcaaagcgtgtccctattccaggcattaaaaaaagggctgattccgcgagaacagggccttcgcttgctagacgctcagctgagtaccggaggtattgtggacccctctaagagccatcgagtgccactcgatgtggcctgcgcacgcggatgtctggacgaggagacatcgagagcactttctgccccacgggccgatgccaaagcatattcagaccccagtaccggcgagcctgccacatacggcgagctccaacaacgatgtagacccgatcagctcaccggcctgtctttgctaccattgtcagagaaagccgctcgtgcccgccaagaagaactttactctgagctccaagctagggaaaccttcgagaagacacctgtggaggtccctgtgggtggattcaagggcaggacagtaaccgtttgggaattgatctccagtgaatacttcaccgctgagcagcggcaggagttgttaaggcaattccgcaccgggaaagttaccgttgagaaagtgattaaaatccttatcacaattgtagaagaagtggagaccctgagacaggaacgattaagttttagtggtctccgcgcccctgtacccgccagtgagcttctggcttccggtgtgctttcccgggcccagttcgagcagctaaaggatggcaaaacaacagtgaaagatctatctgaactggggagtgtgagaactctgctccagggatctggttgtctggcgggaatctacctcgaggacacaaaagaaaaggtgagcatctatgaagcaatgcggcgaggacttctgagggccacaaccgcagcactactattggaagcgcaagcagctacagggttcttggtagatcctgtccgcaaccaaaggctatacgtgcacgaagcagtcaaagccggcgtggtcggccctgaactccatgagcaactgctcagtgccgaaaaggccgtcaccggttaccgcgacccctacagtgggagcacgatttccctgttccaggcaatgcagaaggggctggttctcagacagcatggtattcgccttctggaggcgcaaatcgcaaccggtggcattatcgaccctgtacactcccacagggttcctgtcgacgtagcataccagagaggctactttagcgaggaaatgaatagggtcttagccgacccatccgacgacactaaagggttctttgacccgaacacccacgagaacctcacttatcggcagctcctcgagaggtgtgtcgaggacccagaaacaggcctcagattgctgcctctgaaaggagctgaaaaggctgaagtggtggagacgacccaggtgtacacggaggaggaaactagaagagcttttgaggagacacagatcgacatccctgggggagggtcccatggagggagcacaatgtctttatgggaggtaatgcagtctgatctgatcccggaagagcagcgagcacagttaatggccgactttcaggcgggccgcgttactaaggaaagaatgataatcatcatcatcgagatcatcgaaaagactgaaattatccggcagcagggcctcgcctcttacgactacgtgcgaagaagactgactgctgaggatctgttcgaggctaggattatcagcctggagacgtacaatctgttgagggaggggaccagatcactcagagaggccctggaggccgagtctgcatggtgctacctctacggcaccggcagcgtcgctggtgtctacctacccggatctcggcagactttgagtatctaccaggctcttaagaaaggcttgctgtcagccgaggtggctcgcctgcttctcgaagcacaagctgcgaccggattcttactggaccctgtgaagggagaacgccttactgtcgatgaggcggtacgaaaaggccttgtgggtcccgaattgcacgatcgactgctttcagccgaacgtgccgtgacaggctaccgagatccctatactgaacagactattagcctcttccaggctatgaagaaagagttgattccgacagaagaggcactgcgtctgttggacgctcaactggccaccgggggaatcgttgatcctcggcttggcttccacctcccattggaggtagcataccaacggggctacttaaacaaagatacccacgatcaattatctgagcctagcgaagttcgcagttacgtggatccttccactgacgagcggctgtcttatacccaactgctgaggcgatgcaggcgcgatgacggcacaggccagctgctgctacccctgtctgacgctaggaagttaacttttcggggccttagaaagcaaattactatggaggagctcgtgcgcagccaggtcatggatgaagcgaccgccctgcagctgagggaagggctcactagcatcgaagaggtcactaaaaatctgcagaagtttctggaggggacatcttgtatcgctggcgtttttgtcgatgctactaaggaaaggctttctgtttaccaggctatgaaaaagggcatcatcagacctgggaccgcttttgaactcttggaggcccaagccgccaccggttatgttattgacccaataaaaggcttgaaattgacagttgaggaagccgtgcgcatgggaattgtggggcccgagttcaaagataaactcctcagcgccgagcgggcagtcaccggatataaggacccatacagcgggaagcttatttctctatttcaagctatgaagaaagggctgattctgaaggatcacggcatccggctgctggaagcacagatcgctaccgggggaatcattgaccctgaagagtcgcatcgactgccagtggaggttgcctataaaagaggactattcgatgaggagatgaatgagatcttaaccgaccctagcgatgatactaaggggttcttcgaccccaataccgaagagaatctgacctatctccaactgatggagcggtgtatcacagacccccagactggcctatgtctgcttcccctaaaagagaaaaaacgcgagaggaagacctcatctaaatcatccgttcggaagaggcgtgtcgtgatcgttgatccggagacaggcaaagaaatgagcgtgtatgaggcctaccggaagggcctcatcgatcatcagacgtatttggagctgtccgaacaggagtgtgaatgggaagagattacaattagctctagtgacggtgtggtcaaatcgatgattatcgacagaaggagcggcaggcagtacgacatcgacgacgcaattgcaaaaaatctgattgatcgctccgcactggaccagtacagggcgggcaccctgtcaatcactgagtttgcggatatgctctccgggaacgctggcgggttccggagccggtcctcttccgttggctcgtccagctcctaccccatctccccggcagtcagtcggactcagctggcttcctggtccgatcccactgaagagaccggtcccgttgccgggattctcgacactgagacactggagaaggtgtctatcacagaagctatgcatagaaacctggtggacaatatcaccgggcagcgcttgctggaagctcaggcctgcaccggcggcattatcgatccaagcacgggcgaacggttcccggtgactgacgccgtgaataaaggattggttgataagatcatggtggacagaattaatttagcccagaaggcgttttgtgggttcgaagatcctaggacaaagaccaagatgagcgcggcgcaggcactgaagaaaggctggctctactacgaagctgggcagcgttttctggaagtgcagtatctgacaggcggcctgatagaacctgacactcccggaagagtgccccttgatgaagccctgcagagagggacggtcgacgcacgaacagcccagaagctgcgcgatgtgggagcctattcaaagtacttgacctgtccaaagacgaagctgaagatttcctataaagatgcgctggatcgatcaatggtggaagagggcactggtctacggctcctggaagcagctgctcaatccaccaagggctactattcgccttattcggtgtctggctcaggaagcacggctggatctcgcacaggctcccgtacgggctctcgagctggctctagacgtggcagctttgacgctaccggctccggcttttccatgacattcagctcctccagctattcctcctccggttatggccgcagatacgcgagcggcagttcagcttctttgggaggaccagaatcggccgtggcctag

SEQ ID NO: 199811 - DNA, 13578 bp, Artificial Sequence
  Description of Artificial Sequence: Synthetic coding sequence
atggaccccagccgggccatccagaacgagatcagcagcctgaaggacgagagagacagggtacagaagaaaacgttcactaagtgggtgaataaacatctaatcaaggcacaaaggcacatctcagatttgtatgaggacctaagggacggtcataacctgataagcctgctggaagtcctatccggagattccctaccgagagaaaaaggacgcatgcgatttcacaagttacaaaatgtgcaaattgcacttgattacctccggcacaggcaggtcaaactggtcaatatcaggaatgacgatatagctgatggtaatcctaagctgacgcttggattaatttggaccatcattttacacttccagatctccgacattcaagtttccggacagtcagaggatatgaccgccaaggagaagctactgctatggtcccagaggatggtcgaggggtatcagggtcttcgttgtgacaactttacttcttcttggagggatggcagactgttcaacgcaatcattcaccggcataaaccactgctgatcgacatgaataaagtataccgtcagactaatctcgaaaacctagatcaggcattctctgttgcggagcgcgacttaggagtcaccaggctgctggacccggaagatgtggacgtcccacagccagacgagaaaagcataatcacctatgtatcttccttatacgacgctatgccccgcgtccctgacgtccaggacggggttagggcaaatgaactgcaactcaggtggcaagagtaccgagagctggtgcttctcctcctgcagtggatgaggcaccataccgccgccttcgaggaaaggagatttccctcctctttcgaggagattgaaatattatggtcacagtttctgaagttcaaagagatggagctcccagctaaagaggcggacaaaaatagaagcaagggcatatatcagtcactcgagggcgcggttcaggctggacagttaaaggtgccaccagggtaccacccgttggatgtggagaaagagtgggggaagctgcacgtggcaatccttgaaagggaaaaacagttgcgcagcgagttcgagcgtctggagtgcctgcagcgcatcgtgacaaagttacagatggaggctggcttatgcgaggaacagctcaaccaggcggatgcactcctccagtctgacgtacgcttgttagccgccggcaaggttccacagcgggccggggaggtagagcgggatctggataaagctgattctatgatccggctgttgtttaatgatgtacaaaccctgaaagacggacgccatccgcagggcgaacagatgtatcgcagggtgtataggctgcacgaaaggctggtggctatccgcactgagtataacctcaggcttaaggcaggggtggctgcccctgcaacgcaagttgcccaggtaacactacaaagtgtccagaggcgacctgagctcgaggattctacactgcggtatctgcaggatttgcttgcctgggtcgaggagaaccagcaccgagtggacggcgccgagtggggcgtggatttaccgagcgtcgaggcgcaactgggcagtcaccgtggcttacaccaatccatcgaagaattccgggctaagattgagagagcacggagcgatgaaggccaactcagccctgcaactagaggtgcataccgggattgcctggggcgcctggatttgcagtacgctaagttgctcaattcttctaaagctcgattgagaagcttggaatccctgcactctttcgttgccgccgccacaaaggagctgatgtggctgaacgagaaggaagaagaggaggtgggattcgactggtctgacagaaatacgaatatgacagccaagaaggaatcttatagcgctctcatgagggaactggagctaaaggagaaaaaaatcaaagaattacagaacgccggagacaggctgctgcgggaagaccaccctgctcgtccaactgtagaaagctttcaagctgctttgcagactcaatggagctggatgctgcaactgtgctgctgtattgaagcacatctcaaggagaatgcagcatacttccagtttttttcagacgtaagagaggcggagggtcagctccagaagcttcaagaagcacttcggcggaagtactcatgtgatagatcagctacggtgacgcgcctcgaggacctcttacaggacgctcaagatgaaaaagagcaactcaacgagtataaaggccacctgagcggactggcgaaacgggcaaaagctgtagtccagcttaaacctcgccatcccgcacatcccatgaggggccgcctgcccctgctggcagtgtgtgattacaaacaggtggaagtgacagtacataagggcgacgaatgtcaactggttgggcccgcccaacccagccactggaaagtgctcagttcctccgggtccgaagcagcagtgccctctgtttgcttcctggtgccgccccccaaccaggaagcccaggaagcggtgacccggctggaggcccagcaccaggccttagtgacactatggcatcagctgcatgtggatatgaagtctctgcttgcctggcagtccttacggcgggatgtgcaactcatacggtcatggagtctggctacgttcaggaccctcaagcctgaggaacagcgtcaagctttgcacagccttgaactccattatcaagccttcctgcgcgatagccaggatgccggtggctttgggccagaagacagactgatggccgagagggagtacgggtcatgctcccaccactatcagcaattgctgcagtctcttgaacagggcgctcaggaagagtcaaggtgtcagagatgtatttcagaactgaaagacattaggctgcagctcgaggcctgcgagaccagaacggtgcataggttaaggcttccgctggacaaagaacccgcacgggagtgcgcccagcggatcgccgaacagcagaaagcccaggccgaagtggaaggtttaggcaaaggtgttgccagactgagtgccgaagctgaaaaggttctggccctgcccgaaccatctcccgccgccccgactcttagaagtgaactggagctcacattgggcaagctggagcaggtgcggtcccttagcgcaatctacttagagaagctgaagacaataagtttagttattcgcggcactcagggggccgaggaagttctgagggcacacgaggaacagcttaaagaggcccaggccgtgccggccaccctgccggaactggaggcaaccaaagcctccttgaagaagctccgggcgcaggccgaagcccagcagcctacattcgacgctcttagggacgagctgagaggggcacaggaggtgggcgaacgactgcagcagagacacggtgaaagagatgtcgaagtcgaaagatggcgcgagcgtgtggcccagctcctggagcggtggcaggccgtgctggcccaaacagatgttcgacagcgcgaactcgagcaactgggcaggcagctcaggtactatagggagtcagccgaccctcttggagcatggcttcaagatgcacggcgccggcaggaacagatccaagccatgccccttgcagattcacaggccgtaagagagcagttaaggcaggagcaagccttgctcgaggagatcgagcgccacggcgaaaaagtcgaggagtgccagagatttgctaaacaatacattaatgccatcaaggactacgagctacagcttgtcacctacaaggctcagctggagcctgtggcctcaccagctaagaaacctaaagtgcagagcggttccgaaagcgtcatccaggaatacgtcgacctgcgcacgcattactcggagctcacaaccctgacatctcagtacatcaaattcatcagcgagaccctgcgtcgcatggaagaagaagaacgactagcggagcagcaacgtgcagaagagagggagagactggccgaggttgaagccgctctagagaagcagagacagttagccgaggcgcatgcacaagccaaggcacaggcggagagggaagctaaggagctacagcagaggatgcaggaagaagtagtccggcgcgaagaggccgcagtcgacgcacaacagcaaaagcggtcaattcaggaggaactgcagcagctgaggcaaagcagcgaggctgaaatccaggcgaaggcccgtcaagccgaggccgccgagaggtcccggctgcgaattgaggaggagatccgtgtggtgcgcctgcagctggaagccaccgaaaggcagcgcgggggcgccgagggcgaactgcaagccttaagagccagagctgaggaagcggaggctcagaaaagacaagctcaggaggaggctgagagattgcgaagacaggtgcaggacgaatctcagagaaagagacaggccgaggtggaactcgcaagtcgagtgaaagcagaggccgaagccgctcgtgaaaaacagcgcgcgcttcaggctctggaggagcttcgactgcaagcagaggaagcagagaggcgtctgcgacaggccgaggttgaacgagcccgccaggtacaggtggctttagagactgcacagcggtctgccgaggccgagctgcagtcaaaacgggcttcatttgcagaaaagacagctcaactggagagaagccttcaggaggagcacgtagccgttgcgcagctgagggaagaagctgagaggcgggctcagcagcaggctgaggctgaacgggcccgtgaggaagccgaaagggagttggagagatggcaacttaaggccaacgaagctctccgtctgcgccttcaagccgaggaggttgcccagcagaagagtctggcacaggcggaggccgagaaacaaaaggaggaggcagagcgcgaggctaggagaaggggcaaagctgaggagcaggccgtgcggcaacgcgaattggcggagcaagaactggagaaacagcgacagttagccgagggaacagcccagcagcgcttggctgccgagcaggagctaatacgcctgcgagccgagactgagcagggagagcagcagcgccaactgctcgaagaagagcttgctcgccttcagagggaagcggcagccgccacccagaaacggcaggagctagaagccgaacttgctaaggtcagggcagagatggaagtgcttcttgccagcaaagctcgagccgaagaagagtcacgctccaccagtgaaaaatccaaacagcgcctggaggctgaggccggcagatttcgggaacttgcggaggaggccgcccgcctccgcgcccttgctgaggaagctaagcggcagaggcaactggccgaagaagatgccgctcgccaacgcgccgaggcggagcgggtgctagccgaaaaactcgccgctattggggaagctacccgtctaaagaccgaagcagagattgctctcaaagaaaaggaggctgaaaatgagcgcttgcgccggttggctgaggatgaggcctttcaaagaagacgactggaagagcaggctgcgcagcacaaggcagacattgaggaacgcttggcccagctccgaaaagcttctgatagcgagcttgaaaggcaaaaaggactggtcgaagacacactcagacaacgacgtcaggtggaagaggagatactcgccctcaaagcaagcttcgaaaaagcagccgccggcaaagctgagttggagctggaactaggcagaatccggtcaaatgcagaggacactctacgaagcaaggaacaagccgagctggaggctgcaagacaacgccagctggctgccgaggaagagcggaggcgaagggaggccgaggaacgggtgcagaaatccctcgcagccgaggaggaagcggcaagacagcggaaggcagccctggaggaggttgaaagactcaaagccaaagtcgaggaggctagaaggcttcgggagcgcgctgaacaggaaagcgctaggcagttgcagctggcgcaggaagccgctcagaagaggttgcaggcggaagaaaaggcacacgcctttgctgttcagcagaaggagcaggagttgcagcagactcttcagcaagaacagtctgtgttagatcagctaaggggggaagctgaagcagccaggagagccgccgaggaggccgaggaggctagggtacaggctgagcgggaggccgctcagtctagacggcaggtggaagaggctgaaagattaaagcagagcgctgaggagcaggcccaggcccgcgcccaggcccaagcggctgccgagaagctgcgcaaagaggctgaacaggaggcggcccgccgtgctcaggctgagcaggccgccttgcgacaaaagcaggccgcagatgccgagatggaaaagcacaagaagttcgccgagcagactctgcgtcagaaggctcaggtcgagcaagaactaaccacattgagactgcagcttgaagaaaccgatcaccagaagaacctgcttgatgaagaattgcaacggctcaaggcggaagccacagaagccgcccgtcaacgctcccaagtggaggaggagttgttctcagtgcgtgttcagatggaagaactttccaagctcaaagctagaatagaggctgaaaaccgcgccctcatactgcgggacaaggataatacgcagcgattcttgcaagaggaagcggagaaaatgaagcaggtggcagaggaagccgcacgactctctgttgcggcccaagaggccgcacgtctgcgacagctggctgaggaagatctcgctcaacagagggctctggctgagaagatgttgaaggagaaaatgcaggctgtgcaggaggcaacgcggttaaaggctgaagcagagctgctgcaacagcagaaggagttagcgcaggaacaggcccgtcggctgcaggaggataaggagcagatggcccagcagctggctgaggaaactcagggctttcagaggacactagaggcagaacgacagcgtcagctcgaaatgtcagcggaagctgagcggcttaaactgcgagttgcggaaatgtcacgggcacaggcgcgggccgaagaagatgcgcagcggtttagaaaacaagcggaggaaattggagaaaagctgcaccgcaccgagctagctacacaggaaaaagtgacgctggtgcagactctcgaaatccagcgacagcagagcgatcacgacgccgagcgactgagagaggcaatcgccgaactcgaacgggagaaggagaaactgcagcaggaggctaaattgctgcagttaaagagcgaagagatgcagacagttcaacaagaacagctcctgcaagagactcaggcactgcagcagtcctttttgtctgagaaagattctctgctgcagcgtgagcgctttattgagcaagaaaaagccaagctcgaacagttgttccaggacgaggtcgcgaaagcacagcagttgcgggaggagcagcagcgccagcagcagcaaatggagcaggaaagacagaggctagtcgctagtatggaagaggcaaggagacgacaacacgaagccgaagagggtgtgcgccgaaagcaggaggagctgcagcagctggagcagcaaaggcggcagcaggaggaactacttgcggaggaaaatcagcgcctcagggagcaactccaactccttgaagagcaacaccgcgctgcgttggcacattccgaagaagtcaccgcctcacaggttgccgccaccaaaaccctcccaaatgggcgggacgctcttgatggtccagcggccgaggccgagcccgaacatagcttcgacgggttaagacggaaggtgtcagcccagcggcttcaggaggcgggtatcctgtccgcagaagagctgcagcgcctggcccaagggcatactaccgtggatgaattggctcggcgggaagatgtgaggcactaccttcaagggcgctctagcatcgccggtctccttttaaaggcaacgaacgagaagttgtctgtgtatgctgcactgcaaagacagctgttgagccccggcacagcactcattttgctggaagctcaggctgccagcggctttctgctagacccagtgagaaataggcgactgacagtgaacgaggccgttaaagagggcgtggtgggccccgagttacatcataaattactgagtgcagaacgtgctgtcaccggatacaaggatccttatacaggacagcagatttctctgtttcaggccatgcagaagggactcattgtccgcgaacacggtatcaggcttttagaagctcaaattgcaacgggaggggtaattgacccagtccatagccatagagtgccagtggatgtggcctaccggcgagggtatttcgatgaggaaatgaacagggtgctggcggatccgtctgacgatacgaagggttttttcgacccaaacactcatgagaatctgacttacctccagcttctggagagatgcgttgaggatcccgaaacaggcctctgcctgctgcctctgacggataaagcagctaagggaggagagcttgtgtatacagattctgaggcgagggacgtcttcgagaaggccactgtcagcgcgcctttcggcaagttccaggggaagacagtgaccatttgggaaattattaacagtgaatacttcacagcagagcagcgcagggacttactgcgacaatttagaacaggtagaataacagttgaaaagatcatcaagattataatcaccgtagtggaagagcaggaacagaagggaaggctctgtttcgagggactcaggagtctggttccggccgcggaactattggagtcacgcgttatcgatagggagctgtatcagcagctccaaaggggagagcgcagtgtgagggatgttgctgaggtggataccgtcaggcgagcactgcgcggcgccaacgtcatagctggcgtctggctggaggaggccggacagaagctgtccatatacaacgctctgaaaaaggatttgctgcccagcgacatggctgtcgccctgctggaagctcaggctgggaccggccacattatcgatcccgctacaagcgcacggttaacggttgatgaggctgttcgagccgggctcgtcggtcctgagtttcacgaaaaacttctgagtgctgagaaggccgttactggctatcgggatccatacactggccaaagcgtcagcctattccaggctctgaaaaagggcctgatccctagggaacagggactcagactgctcgacgcccagctaagcactggagggatagtggatcccagcaaatctcacagagtgcctttggatgtagcttgtgccaggggctgcctggatgaagaaacttccagggctctaagtgcccctcgagccgacgccaaagcctattctgacccgagtactggagaacccgccacatatggcgagctgcagcagcggtgtcgcccagatcagcttacaggactaagtctgctgccacttagtgagaaggccgcacgggcgcgtcaggaggagttgtatagcgagttacaggcaagggaaacctttgaaaaaacacccgtcgaagttcctgtggggggcttcaaaggaagaaccgtcactgtgtgggagctgatctccagcgagtacttcacagccgaacagaggcaggaactattgagacaatttcgcactgggaaggtgaccgttgaaaaagtgataaagattctgattaccatcgtggaggaggtcgagaccctccgccaggaacggctgtctttttccggactgagggcccccgtgccggcctccgagcttctggcatcaggagtgctgtcgagagcacagtttgagcagctgaaagatggaaagacgactgtgaaggacctctctgagctgggcagcgtgcggacgctgctacaggggtccgggtgcctcgctggaatctatctcgaagacactaaggaaaaagtcagtatttatgaagctatgcgaagaggccttctccgcgctaccacagctgccttgttgctggaggctcaggccgctaccgggtttttggtggatcccgtgaggaaccaaagattatacgtgcatgaggcagtcaaggcaggtgtggtgggcccagagcttcatgagcagcttttgtcagctgagaaagctgtgacgggctaccgggatccctattccggaagtacaatctccctgtttcaggccatgcagaagggcctcgttctgagacaacacggcatccgcctactcgaggctcagattgcaaccggtgggataatcgaccccgtgcacagtcacagagtgcctgttgatgtagcctaccagcgaggctacttctccgaggaaatgaatcgggtactggcagatcccagcgacgataccaaagggttcttcgatcccaacacgcatgagaacctgacctatcgccagcttctggagaggtgcgttgaagacccggaaactggtctgcggctgctgcccctaaagggcgccgaaaaagcagaagtcgtggaaacaactcaggtttataccgaggaagagactcggcgcgcatttgaggagactcaaatcgacatacccggaggcggcagccatgggggatcaacgatgagcctctgggaagtaatgcagagtgatctgatccccgaggaacagcgggcccagctcatggccgactttcaggctggacgtgtgaccaaggaaagaatgataataatcattatagaaatcattgaaaagacagaaataatacggcaacagggactggccagttacgactacgtgaggcgccgtcttacagctgaagatctcttcgaagcacggatcatttccttagagacctataacctgttgcgcgaaggaacccggtctctgagggaagccctggaagccgagagtgcctggtgctatttgtacggcacaggtagcgtggcgggcgtgtacctccccggctcgcggcagaccctaagcatttaccaagccctgaagaaggggctgttgagtgcagaagtcgccagactactgctggaggcccaggctgctaccggctttcttctggatcccgtgaaaggggaacggcttactgttgatgaagccgttagaaagggactcgtgggccccgagttgcacgatcgactcttatccgctgaacgtgccgtcaccggctacagagatccctataccgagcagactatttcgttgttccaggctatgaaaaaggagctgatccctacagaggaggccctacgcctgttagacgcacagctggccacgggaggcatcgtcgatccccggcttggctttcacctacccctggaggtggcttaccagcggggctatctgaacaaggacacacatgatcagctcagcgaaccgtctgaggttaggagttacgttgacccctccaccgatgagcggctgtcctacacacagttgctgagacgatgcagacgcgacgacgggaccggccagctattactgcctttatccgacgcccggaagctgacattcagaggcttacggaaacagatcacgatggaggaactggttcgatcccaggtgatggacgaggcgacggctttacagctgcgagagggtctaacgagcatcgaggaagtgacaaagaacttgcagaagttcttggagggcacgagctgcatcgccggtgtgttcgtggacgcgacgaaagagcgtctgagtgtgtaccaggctatgaagaagggaatcatacggcccgggacagcttttgaactacttgaagcacaggctgctacaggctatgtaattgatcctataaaaggactgaagctcactgtcgaagaagcagtgcgcatgggcatcgtaggaccagagtttaaggacaagctgttgagcgctgaaagggccgtgacaggctacaaagacccatactccgggaagctcatcagcctgttccaggccatgaaaaagggtttgattcttaaggatcacgggatccgcctcctggaggcacagattgcgaccgggggaatcatcgaccccgaagagagtcacagactccctgtggaggtggcatataaaaggggactgttcgacgaagagatgaatgagatattaacagatccctccgatgacaccaagggcttctttgatcctaatactgaagagaatctaacgtacctccagctcatggaacggtgcattaccgatcctcaaactggactttgtctccttcctctcaaggaaaaaaagagggaacggaagacctccagcaagagcagcgtgcgaaagaggcgggtagtgatagtggaccctgagactggtaaagaaatgtccgtctatgaagcgtacagaaagggcctaattgaccaccagacctacctggagctttccgaacaggagtgcgaatgggaagagatcaccattagctcgtctgatggcgtggttaaatcgatgatcatcgatcgcagaagcggcagacagtatgacatcgatgatgcaattgctaaaaacctaatcgataggtccgccctggatcagtacagagccggtaccctgagtattaccgagttcgcagacatgctgagcggtaacgcaggtggcttccgctctcggtccagcagcgtgggctcaagctcctcgtatcccattagtcctgcggtgagccgcacccaactggcgtcctggagcgatcccacagaggagaccggtcccgtggccgggatactcgataccgagactctggaaaaggtgtcaataaccgaggccatgcaccgtaatttagtggacaatattacgggacagcggctgcttgaggctcaggcttgtaccggggggatcatcgatccaagcaccggagaacgttttccagttacagatgcggttaataaaggcttagtcgataagattatggtcgatagaatcaatttggctcagaaggcgttctgcggctttgaggaccctcgtacaaagaccaaaatgagcgccgcccaggccttaaagaaaggatggctgtactacgaagctggccagaggtttctggaagtgcagtatttaactggtgggctcatcgagcccgacacaccagggcgggtgccactggatgaggcactgcagcggggaactgtggatgctcggacagcccagaagctgagagacgtgggcgcatatagtaaatacctcacctgccccaagacaaagttgaagatttcttataaagatgctctggatcggtcaatggtggaagagggcaccgggctgaggctgcttgaagcggccgctcagagtacgaagggctattacagcccttactctgtgagtggctccgggagtacagcagggtcgaggaccggcagtcggaccggaagcagggcaggcagtaggcgaggatcatttgatgctaccggaagcgggttctcaatgaccttcagctcttcttcttatagcagctccggatacggaaggcggtacgcttccggatctagtgcttcattgggaggtcctgaaagcgctgtcgcatag

SEQ ID NO: 199812 - DNA, 13602 bp, Artificial Sequence
  Description of Artificial Sequence: Synthetic coding sequence
atggccggccccctgcccgacgagcaggacttcatccaggcctacgaggaggtgcgggagaaatataaggatgaaagggacagggtgcagaagaaaacgttcacaaagtgggttaacaagcaccttattaaggcccagcggcacattagcgacctgtacgaagatttgagagacgggcataacctcatctcgctcctggaagtgctgtcaggcgattcactcccccgagagaagggcagaatgcgcttccataagctccagaacgtgcagatagctctagactacctgcgtcacaggcaggttaaactggtgaatatccggaatgatgatatcgcagatgggaaccccaagcttacactcggcttgatttggacaatcatcctacatttccagatatctgacattcaggtctccggtcaatccgaggatatgactgcgaaagagaagctacttctgtggtctcagaggatggttgagggctatcaaggtctccggtgtgacaacttcacttccagttggcgtgatggccgcttatttaatgctatcatacataggcacaaaccgttactcattgacatgaacaaagtttaccggcagaccaaccttgagaacctggatcaagccttttctgtggctgagcgagatcttggtgtgacgcgtttgctggaccctgaagatgttgatgtcccacagcctgatgaaaagagtatcatcacttacgtttctagtctctacgatgccatgccccgagtccccgacgtgcaggatggcgtgcgggccaacgaattgcaactgcgctggcaggagtacagggagctggtcctgctgcttttgcagtggatgcgccaccataccgcagccttcgaggagcgacggtttccttcaagctttgaggagatcgagatcttgtggagccaattccttaagtttaaggaaatggagctgcctgctaaggaggcagacaaaaataggtctaagggaatatatcaatccctcgagggagcagtccaggccggacaacttaaggtgccccctgggtatcacccccttgatgtggagaaagagtgggggaaactgcacgtcgctattctcgagagggaaaagcagttgcgaagcgaattcgagagactggagtgtctgcagcggattgtgacaaaattgcagatggaggccggactgtgcgaggaacagctgaatcaggccgatgctctcctacagtccgacgttagattactcgccgccggaaaagttcctcaacgcgccggcgaagttgagagagacctggacaaagccgactctatgattaggttgctgtttaacgacgttcaaacccttaaagacggcaggcatcctcaaggagaacaaatgtacaggcgcgtatatagactgcatgagcggttagtggctattaggacagagtataacctccgtctaaaggcgggggttgccgcccccgctactcaagtggcacaggtgaccttacagtctgtgcagcgccgacctgagctggaggactctaccctccgctatctccaagatctgctagcctgggtggaggaaaatcagcacagggttgacggggccgagtggggagttgatctccccagcgtagaagcccagctgggctctcaccgtgggctgcaccagagcatcgaggagttccgcgccaagatagagcgcgctcgcagcgatgaaggtcaactctcccctgcaacacgcggcgcttaccgcgactgtctcggaaggctggatcttcagtatgccaaattattaaattctagtaaggcgagactgaggtctttagaatcattgcattcttttgttgccgcagccacaaaggagctgatgtggctgaatgagaaggaggaggaagaagtggggtttgattggtctgacagaaacacgaacatgacagctaagaaggaaagctattccgcgctaatgcgggaattggagcttaaggagaaaaaaatcaaagagcttcagaacgcgggggatagacttctaagggaggaccacccggcccggcctaccgtcgaatcattccaggctgcattgcagacacagtggtcttggatgctccagctctgttgttgtatcgaggcccacctcaaggagaacgccgcttatttccagttcttctctgatgtccgggaagctgaaggacagctccagaagctccaggaggccctgcgtcggaaatactcttgcgaccgatctgccacggttactagactggaggatttgttgcaagatgctcaggacgagaaagagcagctcaacgagtataaaggccacttgagcgggttggctaaacgtgcaaaggcggttgtgcagctgaagcccaggcaccccgctcaccctatgcgaggacgactgcccttattagccgtctgcgactacaaacaggtggaggtgaccgtgcacaagggggacgaatgccagctggtaggtcctgcccagcccagccattggaaggttctcagcagtagcggctctgaggcagccgttccctccgtgtgtttcttggtgcccccacccaatcaagaggcccaagaggcagttaccagattagaagcccaacaccaggcattagttaccctctggcatcaattacatgtcgacatgaaaagccttctggcatggcaatcgcttcgtcgagatgtccagcttattcgatcatggtcgctagcgacattcagaacactgaagcctgaagaacaaaggcaggcactgcatagtctcgagctgcactatcaagctttcttgcgcgacagtcaggacgccgggggctttggtccggaagatcggctgatggccgaaagagagtatgggtcatgttcccaccactaccaacagctactccagagcctggagcaaggagcacaggaagaaagccggtgtcaaagatgcatttccgaactcaaggacataagactccagctcgaggcatgtgaaacccgcacagttcatcgcctgcgccttcctcttgacaaggagcctgcgagggagtgtgcccagcgaatcgcagagcagcagaaggcgcaggccgaagtggagggcttagggaagggcgttgcccggctgtccgcagaagcggaaaaggttctagctctccccgagccaagtcccgctgccccaaccctgcgtagcgagcttgaattgactctcgggaagcttgagcaagtgaggagcctcagtgccatttacctcgagaaattgaagaccatctctctggttattcgtggcactcagggggctgaggaggtactgcgggctcacgaagaacagttgaaggaagctcaggctgtgccggctaccctgccggagttggaggccacaaaagcctctctgaaaaaactgagagcccaagctgaggcgcagcagccaacattcgatgctctgcgggatgagctgagaggagcacaagaggttggggaaagactgcagcagcggcacggtgagagagatgttgaggtggagcggtggagagaaagggttgctcaactcttagagagatggcaagccgtacttgcgcagactgacgtgaggcagcgagagctggagcagttgggacgacagctccggtactaccgagaatccgcggatccactgggagcctggctccaggatgcgcggcgtagacaggagcagatacaggcaatgcctctggccgactctcaggccgtgagggagcaactgcgtcaggaacaggctctcctagaggagatcgagcgccacggagaaaaggttgaggaatgccaacggttcgccaagcaatatatcaacgcgatcaaagactacgaattgcagctggtgacttacaaggcccaactcgaaccggtggcatctcccgcgaagaaacctaaagttcagagcggcagcgaaagcgtgatacaggagtatgtcgacttgcggacgcattatagtgagctgaccacattgacgtctcaatacatcaagtttataagcgaaaccttgcgacggatggaggaagaagaacgactcgctgagcaacagagagcagaagaaagagagaggcttgccgaagtggaagctgctttagagaaacagcgacagttagccgaagcccacgcacaagccaaagcccaggccgagcgggaggctaaggaactgcagcagagaatgcaggaagaggtagtgagacgggaggaagcggctgtcgacgctcaacagcaaaaacgcagcattcaggaagagctgcaacagctgagacagtcatctgaggctgagattcaagcaaaggcccggcaagccgaggccgcggaacgcagtaggcttcgtattgaggaggaaattagggtagtgagactgcagcttgaagccacggaaaggcagcgggggggcgccgagggagaactgcaggccttgcgcgctagagccgaagaggctgaagcacagaaacgccaggcccaggaagaggcggaaaggctccggcgccaggtgcaggacgagtcccagcgaaaacggcaggcagaagtggaactggcgtctcgggtgaaagctgaagcggaggccgcacgggagaaacaaagagccctgcaggctcttgaagagctgagacttcaagctgaggaggccgagcgcagactgagacaggccgaagtggagcgcgcaaggcaagtgcaggtagctctggagaccgcccagagaagtgccgaggccgagttgcagtctaagcgggcttccttcgcagagaagactgcacagttggagaggagcctccaagaggaacatgtggccgtggcgcaactccgcgaagaggctgaacgaagagcacagcagcaagcagaagcagaacgagcaagagaagaagcggaacgagagttagagcgatggcaactgaaggccaatgaagcccttcgtctaagactgcaagctgaagaggttgcccagcaaaaatcacttgcgcaggccgaggcagagaaacagaaggaagaggccgagcgggaggccaggcggaggggaaaagcagaggagcaggccgtcaggcagcgcgaactggccgaacaggagctggaaaagcagcgtcagctggccgagggaaccgcacagcagagactcgccgccgagcaggagctgatccggttgagggccgagacggagcagggagaacagcaaaggcagttgctcgaggaagagctcgccaggttacagcgggaggcagcagccgctacccagaagcggcaggagcttgaggctgaacttgctaaagttcgggctgagatggaggtcctgctggccagcaaagcacgcgcagaggaggaaagtcgctccacctccgagaagtctaagcaacggctggaagccgaagcaggccggtttagagagctcgccgaagaagcagctcgattgagggccctggcagaggaggcgaagcggcagagacaactggctgaggaggatgcggcaagacagcgggctgaggctgagagagtactggccgagaagctcgccgccatcggcgaggctaccaggctgaagacagaagccgagatcgctttgaaggagaaggaagccgagaacgaacgtctgagaagactggcagaagacgaggcctttcagcgtaggcgactcgaggaacaggctgcacaacacaaggcagatatcgaggagaggctggcgcaactgcgcaaagcatcggatagcgaactcgaaagacagaaaggactcgttgaggataccctgcggcagaggagacaggtggaagaagaaatacttgcacttaaagcgagttttgagaaggccgcggctgggaaggctgaactggaactggaactgggccgcataaggagtaacgctgaagacactttgcggtccaaagaacaggcagagctggaagctgcccgccagcggcagctggcagccgaagaggagcggcgacggagagaggctgaggaacgcgtccagaaatccctggccgcggaagaagaagcagcccgccagcgtaaagccgcactggaagaggtggaacggttgaaggcaaaagtcgaagaggcacggcggctgcgtgagcgggccgagcaggaatcagcgcgccagctgcagctcgcacaagaagccgcgcaaaagcgactccaggctgaagaaaaggcccatgcctttgccgtgcaacaaaaagaacaggagttacaacagacactccaacaggaacaaagcgtcctcgatcaactgcggggggaagccgaggcagcacgaagagcagccgaggaggcagaagaagcaagagtacaggccgaacgcgaagccgctcagtccaggagacaggtggaggaggctgagagactcaagcaaagcgcggaggaacaagctcaggcaagggcgcaggctcaggctgccgctgagaagctccgcaaagaggccgagcaggaagcagcgcgccgtgcccaagccgaacaggctgcgttgcgtcaaaaacaagccgcggacgctgaaatggagaagcacaaaaagtttgctgagcaaacattacgccaaaaagctcaggtggaacaggaactaaccacacttagactccagctggaggagactgatcaccagaaaaatctcctggatgaggaacttcagagactgaaggcagaggccactgaagcggccagacagcgcagccaggtggaagaggagttgttttccgtaagagtacagatggaggagctgagcaaactgaaagcccgtattgaggcagagaaccgcgcccttattctgagagataaagacaatactcagcgattcctacaagaagaggctgagaaaatgaagcaggtggccgaggaagccgccagactctcggtggctgctcaggaggctgctcgtctacgacaactcgcagaagaggatttggcccagcaacgagcactggccgaaaagatgcttaaggagaagatgcaggccgtccaggaggccacccggttaaaagcagaagctgagctgctgcagcagcagaaagaattggcccaagagcaggcgcggagattacaggaggacaaagaacagatggcccagcaactcgctgaggaaactcagggcttccagagaacactggaggccgagcggcaaaggcagctggaaatgtctgccgaggcagagcgccttaaattgagagtagcagaaatgtcaagggctcaggcgagagccgaggaggacgcgcagcggttcaggaaacaggccgaggaaatcggcgagaaactgcaccgcacggaacttgctacccaggaaaaggttaccctagtacagactctcgagattcagcgccagcaatctgatcacgacgccgagagactcagagaagccattgctgaactggagcgggaaaaagaaaaacttcagcaggaggctaagctccttcagttgaaaagtgaggagatgcagacagttcagcaggaacagttgctgcaggagactcaggcactgcagcagagtttcttaagtgaaaaggactctcttctccaacgcgagcggttcatcgagcaagagaaggccaaacttgaacaactatttcaggatgaagttgcgaaggcgcagcagcttcgagaagagcaacagcgccagcaacagcaaatggagcaggaacgccagcgcctagttgcctcaatggaggaggcacgcagaaggcaacacgaggcagaggaaggagttcggcggaaacaagaggagttgcagcagcttgaacaacagaggcggcagcaagaggaattgcttgcggaggagaaccagcggttgagggagcaactacaactgctcgaagaacagcatcgagcagccctggcccactccgaggaggtgactgcctcccaggtggccgccacgaagacattgcccaatgggcgcgacgctctagacggacccgctgccgaagcagagcccgagcattctttcgacggtctccgccgcaaggtcagcgctcagcggctgcaggaggcaggcattctgagcgctgaagagctgcagcgcttggcccaaggccacacaaccgtcgatgagctggctcgccgggaggatgttcgccactacctccagggacgaagctctatagctgggctgctcttaaaggctacaaatgagaagctgtccgtgtacgctgcattgcagaggcagctcctgtcccccgggactgcgctgatactgttggaagcccaggctgcctcgggcttcctgttggatccagtgcggaaccgccggcttaccgtaaatgaagccgtaaaagaaggcgtggtcgggcctgagctccaccataaattgttatccgcagagcgagcggtgaccggttacaaggacccctacaccggacagcaaatctccctcttccaagctatgcagaaggggctcatcgtgagagagcacggcattcggctgctggaggcacagattgcgactggcggtgtcattgatcccgttcattctcacagggttccagtcgatgtggcataccgtcgtggctatttcgacgaagaaatgaatagggtgctggctgatccctccgatgatacaaaaggcttctttgacccaaacacacacgagaacctgacttacttgcagttattagagcgctgcgtggaggaccctgagaccgggctgtgcctgttgcctctgactgataaagcggcaaaaggcggagaacttgtttacaccgacagtgaggctcgggacgtttttgaaaaagctaccgtatccgctccttttgggaaatttcagggcaagactgtcacgatttgggaaattatcaacagcgaatacttcaccgccgagcagcgccgtgatctgctcagacaattccgcaccgggagaattaccgtggagaagatcatcaaaatcataataacagtggtggaagagcaggaacagaagggacgactgtgttttgaaggcctgcgttcacttgttccagccgcagagctgctggagtccagggtaattgatcgggaactgtaccaacagctgcagaggggagaacgctccgtgcgagatgtggcggaggtcgacaccgtccgaagggccctgaggggagccaatgtaatcgcgggggtgtggctagaagaagccggccaaaagttgtctatctacaacgctctaaaaaaggatctccttccttctgatatggcagtagctctgctggaggcacaggccggaacaggacacataatagatccagctacttcagcccggctgactgtggatgaggcggtgagggctggtctggtcggcccagagtttcacgaaaagcttctgtccgccgagaaagcagtcacagggtacagggatccatataccggtcagagtgtgtctttgttccaagccctaaagaagggactaatccctagagagcaaggactccgcctcctagatgcccagctgtcaacaggcggaatcgtggaccctagtaaatctcaccgagtgccactggatgtggcgtgcgctaggggatgcttagacgaggagaccagtagagctctttcagccccacgagccgatgctaaggcctatagcgatccctctaccggcgagcctgctacgtacggggagttgcagcagaggtgccgcccggatcaattaacagggctgtctctgctccccttgtccgaaaaggccgcacgggcaagacaggaagaattgtattcagaactgcaggccagagagacctttgagaagactccggtggaagtgccggttgggggctttaaaggccggaccgttaccgtgtgggaattgataagtagcgaatatttcaccgctgaacagcgtcaagagctcttgcggcaattccgaacgggcaaggtgactgtagagaaggtgatcaagattttaattaccatcgtagaagaggtggagaccctgcggcaagagcggctctctttctctggactgagggctccagtacctgcttctgagctgttggcttccggcgtgctgtcaagagcccagtttgaacagcttaaagatggcaaaaccaccgtgaaggacctcagtgagctgggttccgttaggacgctgctgcaggggagtgggtgcttagcagggatttatctggaggacacaaaagaaaaggtgtcaatttatgaggcgatgagacgcgggctgctcagggcaacaactgcagccttactgctcgaagcccaggctgctactggatttcttgttgatccagtccggaaccagagactgtacgtgcacgaagccgtgaaagctggcgtagtcggtcccgaactgcacgagcagctcctctctgccgaaaaggcagtgacaggatatcgggatccatactccggaagcactatctcgctgtttcaggccatgcagaagggcctggttcttcgccagcatggcatccggctgctggaagctcagattgccactggcggtataatcgacccagtgcactcccaccgcgttcccgttgatgttgcatatcagagagggtatttctctgaagaaatgaaccgagtgctggcagaccccagcgacgacaccaagggcttcttcgaccccaacactcacgagaacctcacttacaggcaacttctggaacgctgtgtggaagatcctgaaacaggcctgcgcttactcccactgaagggagccgaaaaggccgaggtcgtggagaccactcaggtctatacagaggaggaaacgagaagagcatttgaagagacgcagatcgatatacccggcggcggaagtcatggggggagcactatgagtttatgggaagtgatgcagagcgacctcatcccagaggagcaaagagcacagctgatggccgactttcaagccggccgcgtcactaaggagagaatgatcattatcatcatcgaaatcattgagaagacggagatcatacgacagcaagggttggccagctacgattacgtccgccgccgcctcacagccgaggatctctttgaggccagaataatttccctggagacatacaatctgttacgcgagggtacgcgaagcctgcgggaggctttggaagccgagtctgcatggtgttatctgtatggaacggggagcgtcgcaggagtttatctcccaggttcgaggcagactctgtctatttaccaggctttaaagaagggactattgagcgcggaggtagcgcgtctgttgttggaggctcaggccgcgactggcttcttattagaccctgtgaagggagagcggctaaccgttgacgaggctgtgagaaagggtctggtgggacccgagctgcatgaccgattgctgagcgcggagagagccgtaactgggtatcgcgacccttacaccgagcagactatcagtctgttccaagcaatgaaaaaggagctgataccaacagaagaggccctgcgcctgctggacgcccagctggctactggggggatcgtcgaccccaggttaggtttccacctgcccctggaggtggcctaccaaaggggatacctaaataaggatacacatgatcaattgagtgaaccttccgaggtgaggtcgtatgtcgacccctctacagacgagaggctctcctacacccagctgctgcgcaggtgtcgccgagatgacggaaccggacagctcctcctccccctgtccgatgccaggaaactgacctttcgcgggctgaggaagcagatcaccatggaggaactcgtaaggagccaagtcatggatgaggctactgccctccagctccgagaagggttgacctccatagaggaggtaacgaaaaatttacagaaatttttggagggcacatcttgtattgctggagtgtttgtggacgccactaaagagaggctgagtgtgtaccaagcaatgaaaaaggggataatcaggcctgggaccgcttttgaacttctggaggctcaagctgctaccggatatgtgatcgatcccataaaagggctgaaactgacagtggaagaagcagtgcgcatgggaatcgtgggaccggagttcaaggataagctcctatcggccgagcgcgccgtgactggctacaaagatccatattcggggaaactgatctccttgttccaggccatgaagaaggggctgatcctcaaggaccacggcataaggctcctggaagcgcagatcgccacaggcgggataatcgatcctgaggagagccatagattacccgtcgaggtagcatacaaaaggggtttgttcgatgaggagatgaacgagatactcacagacccatcagacgacacaaaaggcttcttcgacccaaacacagaggagaatctcacgtacttgcagctcatggagcgctgcattacagatccacagacaggattgtgtctcctccccctgaaagaaaaaaaacgggagaggaaaacctcctctaaatcatccgtgcgaaaaaggcgggtagtcatcgtggatcccgagacaggtaaggaaatgtctgtttacgaggcctacaggaagggcttaatcgatcaccagacctatctagaattgagtgagcaagaatgcgaatgggaagagatcaccatttcctcctcagatggcgtggtgaagtctatgattatcgaccgtagaagcgggagacagtacgatatcgatgacgccatcgcaaaaaacttaattgacagaagcgccctggaccagtaccgagctggaactctttccatcactgagtttgctgacatgttatccggtaatgccggaggatttcgctcccgtagttcatctgtcggctctagcagctcctacccaatttcgcccgccgtttccaggactcaattagctagctggagcgatcccacagaggaaactggtccagtcgccgggattttggatacagaaaccctggagaaggtgagcatcacggaggcaatgcaccgcaaccttgtggataacatcacaggacaacgactgctcgaagcccaggcatgtacaggcggcattatagacccatccacaggcgaaagatttcccgtcactgacgcagtgaacaaaggtttagtcgacaaaattatggtggatagaatcaacctggcacagaaggctttttgcgggtttgaggatccgagaacaaagactaagatgtccgccgcccaggctcttaagaagggatggctgtactatgaagccggacagcgctttttggaagtgcaatatcttaccggcgggttgattgagccagacacaccaggtcgagtgccattggatgaggcattgcagcgcggcactgtagacgcccggactgcccagaagctgcgagacgttggcgcctattctaagtacctgacatgtcctaaaactaaactcaaaatttcgtataaggatgctctggataggagtatggtcgaggagggcactggactccggctgctcgaagctgcagctcagtccacaaaaggatattattcaccctattctgtcagcggctctggcagtactgccgggtcccgcactggctcccgcactggatcccgggccggaagccggcgagggagtttcgatgcaaccgggtccggcttctccatgaccttttccagctccagttatagttccagtggctatggccgcagatatgcttccggctctagcgcgagcctgggaggcccagaatccgcagtggcctag

SEQ ID NO: 199813 - DNA, 13656 bp, Artificial Sequence
  Description of Artificial Sequence: Synthetic coding sequence
atgagcggcgccggcggcgccttcgccagcccccgggaggtgctgctggagaggccctgttggctggacggtggctgcgaacccgcccgtcgcgggtacttgtaccaacagctgtgttgcgtggacgagcgcgaccgggtccagaagaagacctttacgaaatgggtgaacaaacatctcattaaagctcagcgacacattagcgacctctatgaagacctccgggacggtcacaacctaatttccctcctagaggtgctttccggcgactcgctcccacgtgagaagggacgaatgcgattccataaacttcagaacgtccagattgccctggactacctgagacacaggcaggtgaagctggtcaacatccgcaacgatgacatcgcggacggtaatcctaaattaaccctgggccttatctggactattattctgcacttccagatatcagatattcaagtctcgggccagagcgaggacatgaccgcaaaagaaaagctgctgctgtggtctcaacggatggtcgagggctaccaggggttgcgatgcgataattttacaagcagctggcgagacggccgcttatttaacgccatcatccatagacataagcctctcttgatagacatgaataaggtgtaccgacagaccaatctggaaaacctcgaccaggccttttctgtggccgagcgagacctcggcgtgactaggctgctggaccccgaggatgtggatgtgccgcagcccgatgaaaagtctataatcacctatgtctcgtcgctgtacgatgcaatgccccgcgttccagacgtgcaggatggcgtgcgagccaatgagctacaactgagatggcaagaataccgggaattggtgttgctgctacttcaatggatgaggcaccacacagccgcctttgaagagcgacgattcccctctagctttgaggaaattgagattctatggtcacaatttttgaaattcaaagagatggaactgccggctaaggaggctgacaaaaaccgatccaaggggatctaccagtctcttgaaggggccgtgcaggctgggcagctgaaggtgcctcccggatatcacccgctggatgttgagaaggaatggggcaaacttcatgtggcaatcttggagcgggagaagcagctccgcagcgaatttgaacgactcgagtgcctgcaacggattgttacaaagctgcagatggaggcagggttgtgcgaagaacagctcaatcaggccgacgcactccttcaaagtgatgtgaggctcctggctgccgggaaggtgccgcagagagcaggagaagtagagcgagacctggataaggccgactccatgatcagactcctctttaatgacgttcagacactcaaggatggaaggcacccccaaggcgaacagatgtatcgaagagtttatcgcctgcacgagagactcgtggccattcgaacggaatacaatctgcgattaaaggctggagttgctgcacctgccactcaggtcgctcaagttacacttcagagtgtgcagcgccggccggagttagaagattctactctccggtacctgcaggatcttctagcttgggtagaagaaaaccagcatagggtggacggggccgaatggggggttgaccttccctccgtcgaggcccagctcggttctcacagggggctgcatcaaagcattgaagagttcagggcgaagattgaacgcgcccgttctgatgaagggcagctgtcacccgctactcgcggagcttatcgggattgtctcggacgcctggacttacagtacgccaagttgctgaactcatccaaggcgcgtctgagaagcctggaaagcctccactcctttgtggctgcagcgacaaaggaattgatgtggctcaacgaaaaagaagaagaagaggtcggctttgactggagcgacagaaatactaatatgaccgctaagaaggagtcatacagcgctcttatgcgagaactagaactcaaggagaaaaagatcaaagagctgcagaacgcaggggatagacttctgagagaggaccatcccgctcggccaactgttgaatcatttcaggccgcactgcagacgcaatggtcatggatgctacaactatgctgctgcattgaggcccatctgaaagagaacgccgcctactttcagttttttagcgatgtgcgagaggcggagggccagctgcagaagttgcaggaggccctacgcagaaagtacagctgtgatagaagcgccaccgtaactcgactggaggacctgttgcaggacgcacaggacgagaaggaacagctcaatgaatataaagggcacctctcaggtctcgccaaaagagccaaagcagtggtacaattgaaaccacgacatcccgcccaccccatgagaggcaggctgcctctgctggcagtctgcgactataaacaggtcgaagtgaccgtgcacaaaggcgacgagtgccaattggtaggacctgcccaaccttcccactggaaagttctctcgtctagcggaagcgaagctgctgtccctagcgtttgctttctggtgccacctcccaaccaggaagcccaagaagcggtgacccgcttggaggctcagcaccaggccttagtaactctgtggcatcagctgcacgttgacatgaagtccctcttggcctggcagtctctccggagagacgtgcagctgattagatcttggagtcttgctaccttccgcacgcttaagcccgaagagcaacgccaagcccttcatagcctggaactccactaccaagcctttctccgggattcacaagatgctgggggatttggccccgaggataggttaatggccgagcgtgagtacggctcttgcagccatcattaccagcagttgctgcaatcacttgagcaaggagcacaggaggagtctcgctgtcaaagatgtatttccgagttgaaggacattagactgcagctagaagcttgtgagacccgtaccgtgcacaggctaaggcttcctctggataaagaaccagcgcgcgagtgtgcccagcgaatagctgaacagcagaaggcccaggcggaagtggaagggttaggcaaaggagtggcccgcctgtccgctgaggcagaaaaagtgttggccctccctgaaccatctcccgctgcaccaacccttaggtccgagcttgaactgacgctcggaaagctggagcaggtgcggagtttgagtgcgatttatcttgaaaaacttaagaccattagccttgtaattcgcggcacccagggtgccgaagaagtcctgcgtgcacatgaagagcaacttaaggaggcacaggctgtgccagctaccttgcccgaactcgaggctacgaaagcttctttgaagaagctgagagctcaggcggaagctcagcagcccacgtttgacgcacttagggatgagctacgcggcgcccaggaagtgggcgaaaggctccaacagagacacggcgagagggatgtagaggtggaacgatggcgagaaagagtggcccagctactagaacggtggcaggccgtactggcacagacagatgtacggcagcgcgagttagagcaactcgggcgccagctaaggtattatcgggaaagcgcggacccactcggcgcctggctgcaggacgcacgacggagacaagaacagatacaggcgatgcccctcgcagacagccaggccgttcgggagcagcttcgccaggaacaagctctcctggaggaaatcgagcggcacggggagaaagtagaagaatgtcagcgattcgcaaagcagtatataaacgctatcaaagattatgagctgcaactcgttacatataaagcccaactggaacccgtcgcctctccggcaaaaaagccaaaagtgcagtccggcagcgagtctgtgatccaagaatacgtcgacttgcgcacgcactacagcgagttgaccaccctcacttctcaatacatcaaattcatctccgaaacactccggagaatggaggaagaggaaaggctcgccgaacagcagcgggcagaggagcgtgaacgccttgcagaggtggaagcagccctagagaagcagcgccagttggccgaagctcacgctcaagctaaggcacaggctgagcgcgaggctaaagagttacagcaacggatgcaggaggaggttgtccgtcgcgaggaggccgccgtggacgcccagcagcagaaaagatcaattcaggaagagctccagcagctgcgtcagtcctcagaagccgaaattcaggccaaggcaaggcaagctgaagctgctgaaagatctcgcctgcgcatagaggaggaaatacgcgtcgtgagactgcagctggaagcaacagaacgccagagaggcggtgcggagggcgaactccaggccctgagggctagagccgaagaggccgaggcacagaagaggcaagctcaagaagaagccgaaagacttaggaggcaagtgcaggacgagagtcagcgtaagagacaagctgaagtggagctggcctcacgagtcaaggctgaggccgaggctgcgcgtgagaaacagagagcactacaggccctggaagaattgaggctgcaggcggaggaagctgagcgcagattaagacaggctgaagttgaacgagcaagacaggtgcaagtcgcccttgagactgctcagcgatctgccgaagctgaactgcagtccaagagagcctcgtttgccgaaaagaccgctcagctggagcgcagccttcaggaggaacacgtggccgtggcacagctgagggaggaagctgagcgccgggcacagcagcaggccgaagccgagcgcgcgagggaggaggctgagagagagcttgagcggtggcaactgaaagcaaatgaggctctgagactgcgcctgcaagcggaggaagtggctcagcagaaatcacttgctcaggccgaagcagaaaagcaaaaagaggaggcggagcgggaggcaagaaggagaggcaaagcagaagagcaggctgttcggcagcgggaattggccgagcaggaactcgagaagcagagacagcttgctgaggggactgcacagcagcgactggcagccgagcaggaactgattcgacttagagctgagactgagcagggagaacaacagcggcagctcttagaggaggagcttgccaggctccagcgggaagcagccgcggcaacacaaaagaggcaagagctggaagccgagttggcaaaggtgagggctgaaatggaggttctcctggcaagcaaggctagagccgaggaggaaagtagatcgaccagcgaaaagagcaagcagaggctcgaagctgaggctggcaggtttcgggagctggccgaggaagcagccagattgagagccctcgccgaagaggctaagagacaaaggcagctggccgaggaggacgctgcccggcagcgtgccgaagccgagcgcgtgctggcagaaaagctcgctgctatcggggaggccacacgactgaaaactgaagcagagatagcacttaaggagaaggaggcggagaacgaaagactgcgccgactggcagaggacgaggccttccagcgccgcagactggaagagcaggctgctcagcataaagccgatattgaagaacgtcttgctcaattgaggaaggcctcagactctgaactggagcggcagaaggggcttgttgaggacacattgcggcagcgccgccaggtggaagaggagatcctggccctcaaggcctcattcgaaaaagccgctgccggcaaggcagagttggaactggagttagggcgtataaggtcaaatgcggaagacactctgcgttccaaggagcaggccgaactggaagccgccagacaacgacagctcgccgccgaggaggagagaagacgacgcgaagcagaagagcgggtgcagaagagcctggctgccgaagaggaggccgccaggcaaagaaaggccgctttagaggaagtagagagactcaaagccaaggttgaggaggctaggcgcctcagagaaagggccgaacaagaatctgcccggcagctccagctggcacaggaagccgctcaaaaacgcctgcaggcagaggagaaggcgcacgcattcgccgttcagcagaaagagcaggagctccaacagacattacagcaggaacaatctgtactggaccagctgaggggggaggccgaggcggcccggagggctgccgaagaggcagaggaagcacgcgtgcaggctgaacgggaggccgctcagtcccgacgccaggttgaggaagcggaaagactaaaacagtcagcagaggaacaggctcaggcacgggctcaggcccaggcagctgctgaaaaattgagaaaagaggccgaacaggaggcagcaaggcgcgcacaggctgagcaagcggccctcagacagaagcaggccgctgatgctgagatggagaagcacaaaaaattcgcggagcagaccttgcgacagaaagcgcaggtggagcaggagctgaccacccttcgccttcagctcgaggagactgatcaccagaagaaccttctggacgaggagttgcagaggctgaaggcagaagctactgaagccgccagacagcggagccaggtggaagaggaactcttcagcgtacgcgtacagatggaagaactgtcgaaactgaaggcacgtatcgaagcagaaaacagggccctcattttacgcgacaaagacaacactcaaaggtttctccaggaagaggctgagaagatgaaacaagtggcagaggaagctgcacgcctttccgtggccgcccaagaggcagcgcggctccgacagttggccgaggaggacctggcccagcagagagctctggccgaaaaaatgttaaaggagaagatgcaggccgtacaggaagccactcggttgaaggcggaggccgagctgttgcaacagcagaaggagctcgcccaggagcaagcccgaaggcttcaggaagacaaggaacagatggctcaacagctcgctgaagaaacccaaggatttcagaggacactggaagctgaaagacagaggcagctggaaatgtctgccgaagccgagcgtttgaaattacgagtggctgagatgtcgcgtgcgcaagcgcgagccgaagaggatgcccagagatttcggaaacaggccgaggaaatcggggagaagctccatagaactgaactggccacccaagaaaaagtgacgctggtgcagacgcttgagatacaaaggcagcagtccgaccatgacgccgaacggttgcgggaagccatcgccgaactcgagcgtgaaaaggaaaaactgcagcaagaggccaagcttcttcagctcaaatcagaagagatgcagaccgtgcagcaggaacagctgctgcaggaaacacaggcgctgcagcagagtttcctctcagagaaggacagccttcttcagcgcgagaggttcattgaacaggagaaagctaaactggaacaactgttccaagacgaggttgctaaggcccagcagctgcgggaagagcagcaaaggcagcagcaacagatggaacaagagcgacagcgactggtcgccagcatggaggaagcgagacgcagacaacacgaagccgaagaaggtgttagaaggaagcaggaggaattgcagcaactggagcaacagaggcggcagcaggaagagcttctggccgaagagaaccagcgtctgcgcgagcaacttcagcttctggaggagcagcacagggctgctctcgcacattctgaagaggtcactgcaagccaagttgccgccacgaaaacgcttccaaatggcagagatgctctggatggacctgcagccgaagcagagcctgagcacagctttgacggtctgcgccgtaaggttagtgcacagagactccaggaagcgggaatactgagtgccgaggagttacagagactcgcccaggggcacaccacagttgacgaactcgcacgccgtgaagacgtacggcactatttacagggccgctcatcaattgcggggttgctgttgaaggctacgaacgaaaagctgtcagtctacgccgcattacaacggcagctgctgtccccgggaactgccctgattctgctcgaagcccaggcagcgagtggctttttgttggatcccgtgagaaaccgcagactgacagtgaatgaagctgtgaaggagggtgtcgtcgggcctgagctgcatcataagctgctgagcgcagaacgggcggttaccgggtacaaggatccttacaccggacagcagatctccttgtttcaggccatgcagaaaggcttgattgtgagggagcatgggatacgccttctggaggcccagatcgcaactgggggcgtcatagatccagtgcactctcatagagtgcctgttgacgtggcctatagaagaggatattttgatgaggagatgaaccgcgtgctggccgacccctctgatgacactaaagggttctttgaccccaatacgcacgaaaacctgacataccttcagctgctggaaaggtgtgtggaggaccctgaaacaggcctgtgtctgttgcctcttaccgataaggccgccaaaggaggggagctggtgtacacagacagcgaggcacgagatgtgtttgaaaaagccacagtgagcgccccctttggtaagtttcagggaaagaccgtaacaatctgggaaatcattaattcagagtatttcacggcagagcagaggcgggatctgctgagacaattccgaactggcagaatcaccgtagagaaaattattaagattatcataacggtggtggaagagcaggaacagaagggaaggttgtgctttgaggggcttcgttccttggtccccgccgctgaacttctcgagagtcgcgttatcgatcgtgagctatatcaacagctgcagagaggcgagcgcagtgtgagagacgtggccgaggtcgacaccgttcgtcgggccttaagaggcgccaatgtgattgccggcgtgtggttagaagaggcgggacaaaaactgtccatttacaatgccttgaagaaagacttgttaccgagtgatatggccgttgctctgctcgaggcccaggccggcacagggcatatcatcgatcctgcaaccagtgctcgcctgaccgtggatgaggccgttagagccgggctcgtgggaccagaattccacgaaaagttactgtcagctgagaaagcagtgactggttatcgcgatccatacacaggccagtccgtcagcctgttccaagccctgaagaaaggcttgatcccaagagagcaaggtcttagactgttggatgctcagctgtccaccgggggcattgtcgaccctagcaagagtcatcgcgttcctctagacgtggcctgtgccagaggctgcttagatgaggaaacttcacgcgccctctcagcccctcgcgctgacgctaaggcttacagcgatccatcaaccggtgagccagcaacatacggggaactccagcaaaggtgtcggccagatcagctaacaggcctctcccttctacccctatcggagaaagctgcacgggcgagacaagaggagctgtattcagagctgcaggcacgggagacatttgagaagactccggtggaggttcctgttggaggcttcaagggtaggactgtgactgtttgggagttgatctcatcagaatacttcacagctgagcagagacaagagctactccgccaatttagaaccggcaaggtgacagtcgaaaaggtgatcaagatcctgattacaatcgtggaagaggtggagacactgagacaagagcgccttagcttttctggcctgcgggctccggtcccagcttcagagctgctcgctagcggcgtcctgagtcgtgcacagttcgaacagttgaaagacgggaaaactacagtgaaggacctctcagaactgggctcggtccgcaccctgctgcagggctctggctgtctggcaggtatctacttggaggatacaaaagagaaagtctccatctatgaggccatgcgacggggtctcttacgggcaacaacagccgccctgcttctggaggctcaggctgccaccggctttctggtggaccccgtccgtaaccagaggctctatgtgcacgaggccgtaaaagccggagtcgtcggccccgagcttcacgagcagctgctgtccgcagaaaaagcggttactgggtatcgcgacccctatagcggatctacgattagccttttccaggcaatgcaaaaaggtctcgttctcagacagcatggaattcgccttttagaggcccagatcgccactggcggcataattgatcctgtacatagccaccgcgtgccagttgacgttgcctatcaaagaggatacttcagcgaagagatgaatagggtcttagctgaccccagcgacgataccaaaggcttcttcgatcctaatacccatgaaaatctgacatataggcagctgttggaacgatgtgtggaagatcccgagacaggcctaagactattgcccctcaagggagctgagaaagccgaagttgtggagaccacccaggtttatacagaagaggagactcggcgagccttcgaggagacgcagatcgacattcccggcggtggatctcacggcgggagtaccatgagtctctgggaggtgatgcagagcgatctgattcccgaagagcagcgcgctcagctcatggctgattttcaggcagggcgggtgactaaggagaggatgattatcatcatcatcgagatcatagaaaagaccgagattattaggcagcaggggctggccagttacgactacgtgcgcaggcgactaacggcagaggacttattcgaggcccggatcatctctctggagacctacaatcttttaagggagggcacacgatccctacgggaggcactggaagccgagtcagcttggtgctatttgtatggaactggtagtgtggccggagtgtacctcccagggagtcgtcaaaccctcagcatataccaggccctgaagaaaggactcctgtcggccgaagtggccagacttctgctggaggctcaggccgccaccggtttccttctggaccccgttaagggcgaacgtctgaccgttgacgaggccgtcagaaaaggccttgttgggcccgaactgcacgaccgcctcctgagcgccgagagagcagttacaggttatcgggatccctacactgaacagacaataagtctgtttcaggctatgaaaaaagagctgattcccaccgaggaagcacttcgcctcttagacgcccagctggctaccggaggcatagtggatcctcgcctagggtttcacttgcctctggaggtggcctaccagcggggatacctgaataaggatacacacgaccaactctcagagccatctgaagttcgctcttacgtcgaccccagtacggacgaacggctatcatacacgcagctccttcggcgctgccggcgggatgatggcactggacagctcctcctaccgttgagtgacgccaggaagttaacctttagaggcctgcgcaaacagatcactatggaagaattagtcagatctcaggttatggacgaggccacagccttgcagttacgtgaagggctcacttctattgaggaagtaaccaagaacctgcagaagttcttggaagggaccagctgcattgctggagttttcgtcgatgctacaaaagagcggctgagcgtttaccaggctatgaagaaggggattattcggcccggcacagcctttgagttgctggaagcccaggctgccacgggatatgtgatcgaccccataaagggcctgaagttaacagtggaagaggctgtgaggatgggtatagtgggcccggagtttaaagataaattattgagcgctgaacgcgccgtcactggttataaagatccctacagcggcaagctcatctctctgtttcaggcaatgaaaaaaggactgattctgaaggaccacgggatccgcctgcttgaggctcagatcgctacgggagggattattgaccctgaagaatcgcacaggctgcccgtggaagtcgcttataagaggggcctgttcgatgaagaaatgaacgagatcctgacggatcctagcgacgatacgaaaggattctttgatcccaatactgaagaaaacctcacctacttgcagttaatggaacgttgcattaccgatccgcaaactgggctttgcctgcttccactgaaggaaaaaaagcgcgagcgcaaaacgtcatccaaaagcagcgttagaaaaagaagagttgtcatagtggaccccgaaaccgggaaggagatgtctgtgtatgaagcatatcgcaaaggcctgattgaccatcaaacctatctggagctgtctgagcaggaatgcgagtgggaagagatcacgatctccagcagcgatggcgtcgtgaaatctatgatcatcgacagacggagcgggcggcagtatgatatcgacgatgctattgcaaagaatctgattgatcgctcggctctggaccagtacagggccggtaccctgtccatcaccgagttcgccgacatgctaagtggcaacgccgggggcttcaggagcagatctagctccgttggatcgtcttccagttaccccatcagcccagccgtgtcaaggacacagctagcttcatggagtgacccaacggaggagaccggacctgtggcagggattctcgataccgagacgctggagaaggtgtccatcacagaggccatgcatcggaacttagtggataatatcactggtcaacgactgcttgaagcccaggcttgcacaggcgggatcattgatcctagtactggcgaaaggtttcctgtgactgacgctgtcaataaaggcctggtagacaagattatggtcgatcgtattaacttggcccagaaagcattctgtggctttgaggaccctaggactaaaacgaagatgtcagccgcccaggcccttaaaaagggctggctgtactatgaggccggccagcggttcctggaggtgcagtacctgacagggggactcatcgaaccagatacacccggacgcgtgccgttggacgaagccctccaacgtggtaccgtggacgcacggactgcccaaaaactgcgcgacgtgggggcttattccaaatatctgacttgtcccaagaccaaacttaaaattagttacaaggacgcgttggacagatctatggttgaggaaggcaccggtcttcggctcctagaagctgccgctcagtctaccaaaggctattactctccatactccgtttccggatctggaagcaccgctggctcgagaacggggtccaggacaggtagtcgggcagggagcagacgcggatctttcgatgccaccggctcaggcttctctatgacgtttagcagttcctcctactcctctagtggatacggccgccggtatgcaagtgggtcttcggcctccctgggcgggcctgaaagtgccgtggcttag

SEQ ID NO: 199814 - DNA, 13548 bp, Artificial Sequence
  Description of Artificial Sequence: Synthetic coding sequence
atgaagatcgtgcccgacgagcgggaccgggtgcagaagaagaccttcacaaaatgggttaataagcatctgatcaaagcccagaggcacataagtgacctgtacgaggaccttagagacggccacaatttgatctctctgctggaagtgctcagtggagatagtctcccacgagagaagggcaggatgcgtttccacaagctacagaacgtgcagatcgctttggattacttgagacacagacaggttaaactggtgaacatacgcaatgatgacatagccgacggtaaccccaaactgaccctcggattgatttggactattatactacacttccagatctccgacatccaggtctccggacagagtgaggacatgactgctaaagaaaaattgctcctttggagccaacggatggtggagggctatcagggactgcggtgcgacaatttcacgtcgtcatggagggacgggcgtctgtttaatgccataattcatcgccataagcccctcctgatcgacatgaataaggtgtatcggcagaccaaccttgagaacctcgaccaagccttcagcgtagccgaacgtgacctaggagtcacgaggctgcttgacccggaagatgtggatgttccacagcctgacgagaagtctatcattacatatgtgtccagcctgtatgatgccatgccacgggtccccgacgtgcaggacggtgtccgtgccaacgagctgcagctcaggtggcaagagtaccgggagctcgtcctattgctgctgcagtggatgagacatcacacagccgcgttcgaagagagacgttttccctccagcttcgaagagatcgaaatactttggtcccaattccttaaatttaaggagatggaattgcccgcaaaggaggccgacaagaatcgctctaaaggcatctatcagtccttggagggcgccgttcaggccggacaactcaaggtaccacccggctaccacccactagacgtcgaaaaagaatggggaaaacttcatgtggctatactggagcgggaaaaacagctgcgctccgaattcgaacggctcgagtgtctgcagcggattgtgaccaagctgcaaatggaggccggattgtgtgaagaacaactgaaccaggctgacgctctgcttcagtccgatgtacgactgctggcggccggtaaggtgccccagcgcgcaggggaggtagagagggatcttgacaaagccgacagcatgattaggttactgttcaatgatgtgcagaccttgaaggatggtagacaccctcaaggggagcaaatgtataggcgagtctaccgcttacatgaaaggcttgtggcgatccgcaccgaatataatctccgtttaaaggcaggagttgccgctcccgcgacacaggtagctcaggtaaccctgcagagcgtgcagagaaggcctgagctggaagacagcaccttgaggtatcttcaggatctgctggcttgggtggaggagaatcagcatcgggttgacggggccgagtggggtgtcgatctccccagcgttgaggctcagctggggagtcatcgcggcttgcaccagagcatcgaagaattcagagcgaagatagagagagccaggagcgacgagggccaactgagccctgccacacggggagcctaccgagattgcctgggccgcttggatttgcagtacgctaaattgttgaacagctctaaagcccgcctgaggtctctggaatccctgcattcattcgttgctgccgccacaaaagagttgatgtggctgaatgagaaagaggaagaggaagttggcttcgattggtcagaccggaataccaacatgaccgcgaaaaaggaatcgtactcggctctcatgcgggagcttgaactcaaagaaaagaaaatcaaggagctgcagaacgctggcgacagactcctacgtgaggaccatccagcccgtccaaccgtggagagcttccaagctgctctgcagacccagtggtcctggatgttacagctttgctgctgtatcgaagcccacctaaaggagaacgcagcctattttcagttttttagcgatgtgcgagaagccgaagggcagctacagaaactgcaagaagctctacgaagaaaatattcttgcgaccggtccgccactgttacacgtctcgaagaccttctgcaagacgctcaggatgagaaagagcaactgaatgagtataaaggacacctttctggcctggccaaaagggctaaagccgttgtacagcttaagcctcggcaccctgcccacccaatgcgtggaagactgccactgctggccgtctgcgactacaaacaagtggaggtgacggtacacaaaggggacgagtgtcaattagtgggaccagcccagccttcgcactggaaggtgttatcctcatccgggtcagaagcggcggtgcccagcgtttgctttttagtgcccccacccaaccaggaagcccaggaagccgtgacccggcttgaggcccagcatcaggctctggtgactctgtggcatcaattacatgtcgacatgaagtctctactggcttggcagtcactgcggcgagacgttcagctcatccgatcctggagtctcgcgacattccgaactctcaaaccggaggagcagagacaagcgctccactcccttgaattacattatcaggcattcctccgagacagccaggacgcaggcggatttggacccgaggatcgcctcatggcagaaagggaatacggtagctgctcccatcattatcagcaactgttgcagtctcttgaacagggggcccaagaggagtccaggtgccagagatgcatatccgagctgaaagacatccgactgcagcttgaggcatgcgaaacccgtacagttcatcggctgcggttaccactggataaagagccagctcgcgaatgtgcccagaggattgcagaacagcagaaggctcaagcggaagtcgagggactaggcaagggggtggcaaggcttagcgcagaggcagagaaagtgcttgccttaccagaaccatcaccggccgcccccacgctgagaagcgaattggaactgacgctggggaaactggagcaggtgcggtcgctgagcgccatctacctggagaagctgaaaacgatatcactggttattagaggcacccaaggtgccgaggaagtgctccgagcgcatgaagagcagctaaaggaagctcaggcagtgcctgccacactgcctgagctcgaggcaaccaaagcatccttgaaaaaactgagggcccaagccgaggctcagcaaccgacgtttgacgccttacgggacgagctgcggggagctcaggaagtgggagaacgcctgcagcaaagacacggtgagcgtgatgttgaggtggagagatggagagaaagagtggcacagcttttggaaagatggcaggcagtgctggcccaaacggatgtgcggcaacgggaactggagcagttgggccgccagttgcggtattatcgcgaaagtgctgatcccctgggcgcctggctgcaggatgccagaaggagacaggagcagatccaagcgatgccactggccgactctcaggctgtgcgcgaacaactgcgtcaggaacaagcgttgctggaggaaatcgaaagacatggtgaaaaggtggaggagtgccagcgttttgctaaacaatatatcaatgctatcaaagactacgagctgcagctagtgacctacaaagctcagctggagcctgtggccagccccgctaagaaaccgaaagtccagagcgggtctgagtccgttatccaggaatacgtggacctacgaacccactacagcgagttgacgacactgacaagtcagtatatcaagttcattagcgagacactgaggcgaatggaggaagaagagcggcttgccgaacagcaacgggccgaggaacgggagcgtctggctgaggtagaagctgctctggagaagcaacggcagttggctgaggcacatgcccaggccaaggcccaagccgaacgggaggcaaaagagctgcagcagagaatgcaggaggaggtggtgcgcagagaggaagccgcggtggacgctcagcagcagaagcggagcatacaggaagagctgcagcagctacggcaaagttctgaggccgagatacaggccaaagcccgccaggcggaggccgcggaacgttctcgtttgcggattgaggaggagatccgggtggtccgactgcagctcgaggctacagagagacagcggggaggggcggaaggcgaactgcaggccttgcgcgctagggccgaagaggcggaggctcagaaaaggcaggcccaggaggaggctgagcggttgagacgacaggttcaggacgagtctcaaagaaaaaggcaggccgaggtggagctagcttcacgggtgaaagccgaggccgaagccgcacgcgagaaacaaagagctctgcaggcgttggaggagctccgccttcaagccgaagaagccgagaggcgcttgcgtcaggccgaagtcgagagggcccggcaggttcaggtggctctagaaacagcgcagagatcagctgaggccgagctgcagagcaagcgagcatctttcgccgaaaaaacagcacagctcgaacgaagcctgcaggaggaacatgtggctgtggcacagctgcgcgaggaggctgagcggcgagctcagcaacaggcagaagcggaacgggcgagggaagaggccgagcgggagctggagcggtggcaactgaaggcaaacgaagcccttagattacgccttcaggccgaggaagtcgctcagcagaaatctctggcccaggcggaggccgagaaacagaaagaggaagccgagagggaggctagaaggcggggcaaagccgaagagcaggccgtgagacagagggaactggctgagcaagaattagagaaacagaggcaactggccgaaggaactgctcagcagcgcctcgccgctgaacaggaactgattcgattgcgtgctgagaccgagcaaggtgagcagcagcgacaattacttgaagaggagctggcccggctccaacgtgaggctgctgctgcaacacagaaaagacaggaacttgaggccgagcttgcgaaggtgagggccgagatggaagtcctcttagccagcaaggccagagctgaggaggagtccagaagcaccagtgaaaaatccaagcagcgcttggaagccgaggcaggaagattccgggaactcgccgaagaggccgcccgtttgcgagcactagccgaggaagccaagcggcagcggcagcttgcggaggaggacgccgctcgtcaacgtgcagaagcagaaagagtgctcgccgaaaaactggctgctatcggggaggccactcgactgaagactgaagcagaaattgccctaaaggaaaaagaggctgagaatgaaaggttgcgcaggcttgccgaagacgaagcatttcagcgccgccgccttgaagagcaggcagcccaacataaggccgatattgaggagaggctggcacaattgaggaaagcgagcgacagtgaattggagagacagaagggattggtggaagacacacttagacagaggcgtcaggtggaggaagagattctggcgctgaaggcttcttttgagaaagccgccgccggaaaggcggagctggaactcgagctcgggcgaatccggagtaatgctgaggataccctgaggtccaaggaacaggccgagcttgaggcggctcggcagcgccaactagccgccgaagaagagcggagacgtcgagaagcagaagaacgagtgcagaagagccttgcagcggaggaggaggcggcaagacagagaaaagccgccttggaggaggtggaacggctgaaggctaaggtggaggaagccagacggctgagggagcgcgccgagcaagagtctgctcgccaactgcagctcgcgcaggaagccgctcaaaaaagattgcaggcagaagagaaagcccatgccttcgccgtccagcagaaagagcaggagctgcagcagactctgcagcaggaacaatctgtccttgatcaactgcgaggtgaggccgaggccgctagaagggctgctgaagaggctgaggaagcccgagtgcaagctgaacgcgaggcagcccaaagccgccgtcaggtcgaggaggccgaaaggttaaagcagtccgccgaggaacaggcgcaggcccgagcccaggctcaggctgccgcagaaaagcttaggaaagaagccgagcaagaggccgcccgccgagcccaggccgaacaggccgccctccggcaaaaacaagctgccgacgccgagatggaaaagcacaagaagttcgcggagcagaccctccggcagaaagcccaagtggagcaggagctgacaaccctcaggctgcaattggaagagaccgatcatcagaagaacttgctggacgaggagctgcaacgtcttaaggccgaggcgaccgaggccgcccggcagaggtcccaagttgaagaggaactgtttagcgtgcgggtacagatggaagagctgtcgaaactgaaagcaagaatcgaggcagagaaccgcgctttgatcctcagagataaggataacactcaaaggttccttcaagaggaggccgagaagatgaaacaggtagctgaagaggctgcgcggctgtcagtggcagctcaagaggctgctaggctgcggcagcttgcggaggaggacctggcccagcagagagcgttagcagagaaaatgcttaaggagaaaatgcaggcagtgcaggaggcaactaggctgaaagctgaggcagaattactacagcaacagaaggaactggcccaggagcaggcacgcagactgcaggaagacaaggaacaaatggcccaacaactggctgaggagactcagggatttcagcgaaccctcgaagccgagagacaaaggcagctagagatgtccgcagaagctgaacgcctcaaactcagggttgccgagatgtcgagagcccaggccagggcagaggaagatgcccagagatttagaaaacaggcggaggagattggggagaaacttcacaggactgaactggctactcaagagaaggtgacccttgttcaaactctggagattcaacgccagcagtctgaccacgacgccgagcgtctgcgcgaggcgattgctgagctggagagggaaaaagagaagttgcagcaggaagcaaagttgctgcagctgaagtctgaagagatgcagactgtgcagcaggagcagctgctccaggagacacaggccctgcaacagtcgtttctgagcgagaaggactccctgctccagagagagagattcattgagcaggaaaaggctaaactggaacagctcttccaggacgaagtggcaaaggcccagcagctcagggaagaacagcaaaggcagcaacaacaaatggagcaggaacggcagcgtttggtcgcctctatggaggaggcacgcaggcgccagcatgaggctgaggaaggcgtccgtcgcaagcaggaggagcttcagcagctggaacagcagaggcgccagcaagaggagttacttgccgaggagaaccagcgcctgcgggagcagctccagttgctagaggagcagcatcgggctgcactcgcccattctgaagaggttactgcttcgcaggtggcagctaccaaaaccctgccgaacggcagggacgccctggacggccccgcagcagaggccgagcccgaacatagttttgacggacttagacggaaggttagtgcacagcgccttcaggaagctggaatcctttctgcagaggagctgcagcgactggcccagggtcacactacagtggatgaactagcacgccgtgaagacgttcggcactacctgcaggggcggagctccatagctggtcttttgcttaaggctaccaacgagaagctgagtgtctacgccgcactccaacggcagctcctgagcccaggcacagccctcatcctccttgaggcacaggcagccagtgggttcttactggatcctgtgcgcaataggcggctgactgtgaacgaggcggtcaaagaaggagtcgtgggcccagaactgcatcacaaactattgtccgccgaaagagccgttacgggttacaaagatccctataccggtcagcagatatctttgtttcaggccatgcagaaggggctgattgttcgtgagcatggaatccggctcctcgaggctcagatcgccacaggcggggtaattgatccagttcacagtcaccgtgtccctgttgacgtcgcctacaggcgtggttacttcgacgaggagatgaacagggtgctggccgacccatccgacgacaccaaaggtttttttgaccctaacacacatgagaatctcacatacttacagttgctggaaagatgtgttgaggacccagagaccggattgtgtcttctgccgttgacagacaaggccgcgaaggggggcgaactcgtgtacaccgactcagaggctagggacgtcttcgaaaaagcaaccgtttcagcccccttcgggaagtttcagggcaagaccgtgacgatttgggaaattatcaatagcgagtacttcacagctgagcagaggcgagacctcctgcgccagttccgcacaggtcggattacagtggaaaaaatcataaagattatcattaccgtagtcgaggagcaggagcagaagggccgcctgtgttttgaagggctgcggtctcttgtgcccgctgctgaattactagagtcgcgagtgattgatcgagagttataccaacagttgcagagaggtgagaggagcgtaagggatgtggctgaggtagacactgtcaggcgcgctctgcggggggctaacgtcatcgcaggggtgtggctggaggaagccggtcagaagctgagtatctataacgccttaaaaaaggatttgctcccaagtgacatggctgtcgcactgctcgaggcgcaggctgggacaggtcatattatcgaccccgctacttctgctagacttacagtggatgaggctgtgcgggcaggactcgtgggacccgaattccatgaaaagctgctgtccgctgaaaaggccgtgaccgggtatcgagacccctacactggccaatccgtttctctattccaagccttgaagaaaggcctcatcccccgggaacaggggctacgcctcctggacgctcagctgagtaccggggggatcgttgatccttccaaatcgcatagagtgccgttggacgttgcctgtgcaagagggtgtttggacgaggaaacttccagagcactttccgcacctcgagctgacgccaaggcatattccgatccatctaccggcgagcctgccacttacggggagctgcagcagcgttgtcgcccagaccagctgactggcttgtctttgctgcctctgtccgaaaaggctgctcgggcgcgtcaggaggaattgtactcggagctgcaggcgcgcgagacctttgaaaaaactcccgttgaggtccccgtaggcggctttaagggccgcactgtcacagtctgggagctgatttcgtcagagtactttaccgcagaacagcgccaggagctgctcagacaattccgcaccggtaaagtcaccgtggagaaagttattaagattctcatcactatcgtagaggaagtggagacactgcggcaggagcggttgagtttcagtgggttgagagcaccagttccagcatcagaactcctggcgtcaggggttctgagcagggcccagttcgagcaacttaaggacgggaagactaccgtgaaggacctgagtgagctgggatctgtcaggaccctgctgcagggctcagggtgtctggctggcatctatctcgaagacactaaagagaaggtgtcgatctacgaagctatgcgaaggggtctgctccgcgccaccacagccgcattgttgcttgaggcccaggctgccaccggttttctcgtggatccagtcagaaatcagagactatatgtccacgaagcagttaaggcaggtgtagtaggtcctgagttgcacgagcagttactctcggccgaaaaagcagtaacggggtacagggatccctactcaggttctacaatctcactgttccaagcaatgcagaaaggactggtgttacggcagcatgggattcgtctcctggaggcccagatagctacaggaggaattatagaccctgtgcactcacaccgcgtccccgttgacgtggcctaccagcgtgggtatttttctgaagaaatgaatagggtgctcgctgatccgagtgatgatactaaagggttcttcgacccaaatacacatgagaatttgacgtacaggcagctgctggaaaggtgtgtcgaggaccccgagacaggtctcaggctgctgcctctgaagggcgccgaaaaggccgaagtggtggaaacaactcaggtctacacagaagaagagaccagaagagcgttcgaggagacccagatcgacattccaggtgggggcagccacggggggagcactatgtcactgtgggaggtgatgcagagtgatttaatcccagaggaacagagggctcagttgatggctgactttcaggcgggcagagtgacaaaagaaaggatgattatcattatcatcgaaatcatcgagaaaacagaaattatcaggcaacaagggctcgccagctacgattacgtaagacggagactcaccgccgaggacctcttcgaggcccgtattattagtctggagacttataacctgctgcgcgaggggacaagaagcttacgagaagccttggaggccgaaagcgcctggtgctatctatacggcaccgggtccgttgccggcgtgtatctgcccgggtcacggcaaaccctttcaatttaccaggccctgaaaaaggggctgcttagcgcagaggtggcccgccttttactcgaggcccaggccgctacaggtttcctgttggaccccgtaaaaggcgaacgactaacagtggacgaagctgtgagaaagggtctggtcggccctgagttgcatgataggctcctgagtgctgagagagccgtgaccggctatcgggatccttatactgagcagacgatcagcctttttcaagccatgaaaaaagaactgatccctacagaggaggcattaagacttctagacgcacagctggctaccgggggcattgtggaccccagattggggttccatctacccctagaagtagcctatcagcgtggatacctgaataaagacactcacgatcagctctctgaaccaagcgaagtgcgttcctacgtggatccgtccactgatgaacgccttagctacacccagcttctacggaggtgtagaagagatgacggtacggggcagttactcctacccttgagtgatgccaggaagttgacattcaggggcctccgtaagcagatcaccatggaagagctggttcgatcccaggttatggacgaagcaaccgccttgcagctacgtgaaggtctcacttcaattgaagaggtcacgaagaacctgcagaaattcctggagggtacatcgtgcattgctggtgtgtttgtagacgctaccaaggaaagactgtccgtctaccaggccatgaagaagggtatcattcgcccagggaccgcctttgaacttctggaggcgcaagccgccacaggctacgtcatcgaccccattaaaggtctgaagctcacggttgaggaagcggtccggatgggtatcgtgggccctgaattcaaggacaaactgctcagcgcggaacgggccgtcacagggtataaggacccatattcaggcaaacttatctcgcttttccaggcgatgaagaagggcctgatactcaaggaccacggaatcagactcctggaggcccagatcgctacagggggcattatagaccccgaggagagccataggttaccagttgaagtggcttacaagcgtggtctgttcgacgaggagatgaatgaaatacttacagacccctcagatgacaccaaggggttcttcgacccgaataccgaggagaatcttacatatcttcaactgatggagcgatgtattactgatcctcagaccggcctatgcctcctccccttgaaagaaaagaagcgagagcgcaaaacaagtagcaagtcgagcgtgagaaaaagacgggttgtaattgtggatccggaaactggaaaggaaatgtccgtgtatgaggcgtatcgaaagggcctgatcgaccaccagacctatttggaattaagtgagcaggaatgcgagtgggaggagattactatatcttcctcagacggagtggtgaaatcgatgatcatcgatcggagatcaggccgccaatatgacatcgatgatgctattgcaaaaaacttgatagatagatcagccttagatcaataccgggcaggaaccttgtccataaccgaatttgccgacatgttatctgggaatgctggcgggttccgatcgcggtctagctccgttggtagttcaagtagctacccgatcagccccgccgttagccggactcagctcgcaagttggtctgatcccacagaggaaactggtcccgtagctgggatcctcgacaccgagacactcgagaaagtgtcaattacagaagcaatgcatcggaatttggtcgataatatcactgggcaacgtttacttgaggcccaggcatgtaccggagggattatcgatccctcaacaggggaacgcttccctgtgacagacgccgtgaacaagggcctagtcgacaaaataatggtcgaccggataaacctggcccagaaggctttttgtgggttcgaagatcctaggactaagaccaaaatgtcggccgcccaagccttaaagaaggggtggctgtactatgaggctgggcagcgcttccttgaagtccaatatcttactggaggccttattgagcccgatactcccgggcgcgtgcctctcgatgaggccctgcagagaggtactgtggatgctagaacagctcagaaacttagggacgtaggtgcctactcaaaatatctgacctgtcctaaaaccaagctaaagattagttataaggatgccctcgaccggtccatggtggaggagggaacaggactgcgccttctcgaagccgctgcgcaatctaccaagggctactacagcccttattcagtgagcggaagtggaagcaccgctgggagcagaactggcagcaggacaggcagtagagctgggtctaggcgcggcagctttgacgcaaccggaagtggcttcagcatgacctttagttcgtcttcctatagctcatccgggtacggtaggcgttacgcctccggttcttctgcaagtctgggagggcccgagtccgccgtcgcttag

SEQ ID NO: 199815 - DNA, 13725 bp, Artificial Sequence
  Description of Artificial Sequence: Synthetic coding sequence
atgagcggcgaggacgccgaggtgcgggccgtgagcgaggacgtgtcaaacgggagtagcggctccccaagccccggtgacactctaccctggaacctggggaagacccagaggagtcggcggtctggcgggggtgccgggtcaaatgggtccgttctggaccctgccgagcgcgctgtgatccgcattgccgacgagcgcgatagagtacagaagaaaacatttaccaagtgggttaataagcacctcattaaggcccagaggcacatcagcgacctctacgaggacctaagagatggacataatctaatctctttgcttgaggttttgagcggggatagccttcccagggagaagggacgtatgcggttccacaaactccagaacgtgcagatcgctctggactatctacgacacagacaagtcaaactagtgaacattagaaatgacgatatcgcagacggcaatcccaaactcacgctgggactgatatggaccataattttacatttccagatatccgacatacaggtcagcgggcagtctgaggacatgacagcaaaagaaaagctgttactttggagccagagaatggtggagggttatcagggtttgcgctgcgacaacttcacttcttcctggagggatggtcgcctcttcaacgcgattattcatcgtcacaaacctctgctgattgacatgaacaaagtgtatcggcagaccaacctggagaacctcgatcaagctttttccgtcgcagagcgggacctgggcgtcactaggctgctggatccagaggatgtggacgttccccagcccgacgaaaagagtatcatcacgtatgtaagcagcctctacgatgctatgccccgggtgcccgatgtgcaggatggtgtgcgggccaacgaattacaattaagatggcaagagtatcgcgaactggtgctactgcttctgcagtggatgagacatcataccgcggcattcgaggagcgaaggtttccctcctcatttgaagagatcgaaattttgtggtctcagtttttgaaattcaaagagatggagttacctgcaaaggaagctgacaaaaataggtctaagggtatatatcagtctctggagggcgccgtgcaggcagggcaactaaaggtaccccccggctaccatcccctcgatgtcgagaaggagtggggaaaattacacgttgctattctagagagagagaaacagctgaggtcagagtttgagcgactggaatgtctgcagcgtatcgtcacgaagttgcagatggaggcaggactctgtgaagaacagctcaaccaggcagatgccctactgcaatccgacgtgcggctgcttgctgcaggcaaagtgccccagagagccggcgaggtcgagcgcgacttagacaaagcggatagtatgattaggttactttttaatgacgtgcagactctgaaggacggccgccatccccaaggagaacaaatgtatcgcagggtgtaccgactccatgagcgcttggtggctattcggactgaatacaacttgagacttaaggccggcgtggccgccccggctacgcaggtggctcaggtgactcttcagtcagtgcagcgcaggcccgagttagaggactcaactctgaggtatctgcaggaccttctcgcatgggtcgaggaaaatcaacaccgcgtggacggtgctgaatggggtgtggaccttcccagcgtcgaggcccagctcggcagtcatagaggtcttcaccagtcaatcgaggagtttcgagctaagattgagcgcgcaaggagcgatgaagggcaattatcacctgccaccagaggggcctaccgcgactgcctcggcaggctcgatctgcagtatgctaagcttctgaactcttctaaagctcgactgaggagtcttgagtcactgcattcattcgtagcggccgcaaccaaggaactgatgtggttaaatgaaaaggaagaggaggaggtcggtttcgattggtcggaccgaaacactaacatgaccgctaaaaaagaaagttacagcgctttgatgagagaattggagttgaaagagaagaagatcaaggagctgcagaatgcaggagaccggctcctgagagaagatcatcccgccaggcccacagtcgagagtttccaggctgccctccagacccagtggtcctggatgttacagctttgctgttgcattgaggcccacctaaaagagaacgccgcctactttcagtttttttccgatgtgcgcgaggcagaggggcagctacagaagttacaggaggcgctgaggagaaagtactcctgtgacaggtctgccaccgttactcgccttgaagatctgcttcaggacgcccaggatgaaaaggagcagctgaatgagtataaaggccacctctccgggctcgctaagcgggccaaggctgtcgtgcagctcaaacctcgtcacccagcccacccaatgcggggacgcctcccgcttctggctgtctgcgactacaagcaggtcgaagtgacggttcacaagggggacgaatgtcagctggttggacccgcacagccctcccattggaaggtgttgtccagttctggtagcgaggcagctgtgccttctgtgtgtttcttagtgcccccaccaaatcaggaggcccaagaagcagttaccagattggaggcccaacaccaggctctagtgacattgtggcatcagctacatgtcgacatgaaaagcctattggcctggcagtctttgcgccgtgacgtgcagctcatcagatcctggagcctcgcaacctttaggaccctgaaaccagaggagcagcggcaggctctgcacagcctcgagctgcattaccaagccttcctccgagattctcaggatgccggcggattcggccccgaagatagactcatggcagaaagggaatacggcagttgttcgcatcactaccagcagctgttacagtcattagagcagggggcccaggaagagtctcgctgccagcggtgcatttcagaactcaaggacatcagactgcagctcgaggcatgtgaaactagaacagtacatcgtttgcgcctcccgctcgacaaagaacccgctcgggagtgtgcccaacgcattgcagagcagcaaaaggcccaagctgaggtggagggcttaggtaagggagtagctagacttagcgcagaggccgagaaagtcttggccctacctgagccaagcccagcagcaccaactctgcgttcggagcttgagctgacactgggaaaattggaacaggtgcgtagtctctccgcaatatatttggagaaattgaaaacaatttccctggtcatccgcggcacccaaggcgcggaagaagtactccgagcccacgaagaacagctcaaagaggcacaggccgttccggcgaccctgccggagctggaagcaaccaaggcgagcctcaaaaagttgcgggcccaggctgaggcccagcagccaacctttgatgccttgagagacgagttgcgtggcgcccaggaggtgggtgaacggttgcagcagcggcacggggagagggacgtggaagtcgaacggtggcgagaaagggtggcacagcttctggagcgatggcaggctgtactggcgcaaactgacgtgaggcagagggagcttgaacaactcggcagacagctgaggtactaccgggagtcagctgatccacttggcgcctggttgcaggatgccagaagacggcaggagcagatccaggcaatgcccttagctgactctcaggcggtacgggaacagcttaggcaggaacaggccctccttgaagagattgagcgtcacggtgaaaaggtggaggagtgccagaggtttgctaaacagtatattaacgccatcaaggactacgaactccagctagtaacatacaaggcccagttggagcctgtggcctcaccagctaagaaacctaaagtccagtccggaagcgagagcgtcattcaagaatatgtggacttgcggactcactattccgaactgacgacactcacaagccagtacataaagttcatctccgagaccttgaggagaatggaggaggaagagcgcctggccgagcagcagcgagcagaggagagagagcggttagcagaggtcgaagcagccctcgagaaacagagacagttagcggaagcccacgctcaggccaaggcacaggccgagcgggaagctaaggaactgcagcagaggatgcaagaggaagtcgttcgtcgggaagaagctgccgtcgacgctcaacagcagaaaagaagcatccaggaggaactgcagcagcttcggcagagctcagaagcagaaatccaggccaaggcacggcaggccgaagcggcagagcggtcaagactacgaatcgaggaagaaattcgggtcgtacgactgcaattagaagccacagaacgtcagagggggggggccgaaggggaattgcaggctttgcgagcccgcgcggaggaagccgaggcccaaaaaagacaggcccaggaggaagccgaacggctccggcgacaggtgcaggatgaaagtcagagaaaaagacaggcagaggtggaactggcaagtagagtaaaagctgaagccgaagccgccagggaaaaacagcgagcgctacaggcccttgaagagctgcgattgcaagctgaagaggccgagcgaaggctgaggcaggccgaggtggagcgggcacggcaagtgcaggttgcactagagactgcacaaagaagtgctgaggccgagcttcaatcaaagcgcgcctcttttgctgagaagactgctcagctcgaacgatcactccaggaagagcacgtcgcagtggcccaactccgggaggaagccgaaagaagggcccagcagcaggccgaggccgagcgcgcccgggaggaggcagaaagagaacttgaaagatggcagcttaaggccaacgaggccctccgcctgcgcttgcaggcagaggaggtagcacagcagaaatccctggctcaggccgaagccgaaaagcagaaggaggaagcggaaagagaagcaaggcgaagaggcaaagcggaggagcaggccgtgcgccagcgagaactggctgagcaggagctggagaaacaacgccagttagcagagggcaccgcgcagcagagactcgctgcagagcaggagctcatacgcctcagggcagagaccgagcagggcgagcaacagcggcagctgcttgaagaggagctcgcccgcctccagcgggaggccgccgcagcaacccagaagcggcaggagctggaggctgaactggcgaaagtgcgggccgagatggaagttctcctggcgtcaaaggcaagggccgaggaggaaagtcggtccacttccgagaagagtaaacagcggctagaggccgaggctggacggttcagagaactcgctgaggaggcggctcggctgagggcccttgcagaggaagcaaagaggcagagacaactcgccgaggaggatgccgctagacagcgtgccgaggccgagcgggtgttagctgagaagttggctgcgattggcgaagccaccaggctcaaaaccgaggctgaaatcgcactcaaagaaaaggaggctgaaaacgaacggctcagaaggctcgcagaggacgaggcgttccagaggcggagactggaggagcaagccgcgcagcacaaggccgacatcgaagaacgcctcgctcagctgcgcaaggcctctgactctgagcttgagcgacagaagggtttggtcgaagacactcttagacagcgtcgccaggtggaggaagagattctggctctaaaggcatcttttgaaaaagccgcagcaggcaaggccgaattagaactcgagctgggaaggatcagatccaacgccgaggatacgctgcggtccaaggaacaggccgagttggaggccgcacgacagagacagctcgcggccgaagaagaacggcggagaagggaggcagaagagcgcgttcaaaaaagcctggcagccgaggaggaagcagcgcggcagcgaaaggctgcgctggaggaggtagagcgcctgaaggccaaggtcgaggaagccagacgtctgagagaaagagctgagcaggaaagtgcacgccagctgcagctcgcgcaggaggctgcgcagaagcggcttcaagcggaggaaaaggcccacgccttcgccgtgcagcagaaggaacaggagctgcaacaaactttacaacaggaacaaagcgttttagatcaactgcggggggaggccgaggccgcccggcgcgcagctgaagaggcagaggaagctcgggtccaagctgaaagggaagcggcgcaaagcagaagacaggtggaggaggccgaacgactcaagcaaagtgccgaggagcaggcccaggcccgtgcgcaggctcaggcggccgctgagaagctgaggaaggaagccgagcaggaagcagcgcgccgcgctcaggcggaacaggctgccttgcgccagaagcaagcagctgacgctgagatggagaagcataaaaagttcgctgaacagacattaaggcaaaaggcacaagtggagcaagaactgactactctgcgactgcaactagaagagacagaccaccagaaaaaccttctcgacgaggaactccagcgcctaaaagccgaagccactgaggcggcacgacagcggtcccaggtcgaagaagagctgttctccgtgcgggtgcagatggaggagctatcaaagctcaaggccagaatcgaagctgaaaatagagcactgattttacgtgataaagataacacacagagatttttacaagaggaggcggaaaaaatgaaacaggtagctgaggaggccgctcgactgagcgtggctgctcaagaggctgccaggttgcgtcagctcgcagaagaagatttagcacagcagagagccctcgctgagaaaatgctgaaagaaaaaatgcaggccgtgcaggaagcgactcgtctgaaggcggaagccgagctgttgcaacaacagaaagagctggcacaggagcaggcaaggaggctgcaggaggataaagagcagatggcccagcagttagcggaggagacgcaagggttccaaaggaccctcgaggctgagcgtcagcggcaactggaaatgtcagctgaggccgagaggttaaagctgcgggtcgccgaaatgtcgcgggctcaggcccgtgcggaggaggacgcacagaggttccggaagcaagcagaagagataggtgagaagttacacagaactgagctagcgacccaggagaaggtcacattggtgcagaccctagagatacagcggcagcagagtgatcacgacgcggagcggctgcgcgaggccatcgctgagcttgaaagagagaaggagaagttgcaacaagaagctaaactcttgcagttgaagagtgaggagatgcagacggttcaacaggagcagctgctgcaggaaacccaagctctccagcagtcctttctgtccgaaaaagattctctcctgcagagagaacgttttatagagcaggagaaggcaaaactggagcaactgttccaggatgaggttgcaaaggctcaacagcttagggaggagcagcagcgccagcaacagcagatggagcaggaacgccagcgtctagttgcctcaatggaagaggctcgcagacggcagcatgaggccgaggagggggtcagacggaaacaggaggaactgcaacagttagagcagcaacggaggcagcaggaagagctcctggcagaggaaaaccagcggctgcgggagcaactccagctgttagaggagcaacacagagctgctctcgcacatagcgaggaagtgacggcctcgcaggtcgcagccacaaaaaccctgccgaatggacgcgatgcgttagacggtccagctgctgaagctgaaccagagcattcctttgatggcctgcggagaaaggtgtcagcccaacggctccaggaagccggtatcttgtctgcggaggagctccagcgccttgctcagggccacactactgttgatgagctggctcgcagagaggatgtgagacactacctgcagggacgtagtagcattgcagggttactgctgaaagcaacgaacgagaagctcagtgtgtacgcagccctccaaagacagttgctgtctccagggaccgccctgatccttctggaggctcaggctgcctctggtttcctcctcgaccccgtaaggaaccggcggttgacagtgaatgaagccgttaaggagggagtggtcgggcctgagctccatcacaagctcctgagtgccgagcgcgccgtcacagggtacaaagatccctataccggccagcagataagcctgtttcaagcaatgcagaagggattgatagtgagggaacatggtattaggttgttagaggcccagattgccactggtggagttatagacccggtccattctcacagggtaccagtcgacgttgcgtaccgccgggggtacttcgatgaggagatgaatagggtcctagcggatccttccgacgacacaaagggcttcttcgatcccaacactcatgagaacctgacatacctgcagctgcttgagcgctgtgtagaagatcccgaaaccggtctatgtttactcccactcactgacaaagccgctaagggtggggaactcgtgtatactgactcagaagccagggacgtcttcgaaaaagccacagtttccgcccctttcgggaagtttcaaggaaagaccgtaacgatctgggagataatcaacagtgagtacttcaccgccgagcagcgaagagatcttctaagacaattcaggaccggcagaatcaccgttgagaagatcatcaaaattataatcacggtcgttgaggaacaggagcaaaagggcaggctctgcttcgaggggctccgctcccttgtgcctgccgcggaactgctggaatctagggttatcgaccgtgagctttatcagcaactccagcgaggtgaacgctctgttagggacgtggcagaggtagacaccgtgcgccgcgctcttcggggcgccaatgtaatagcaggcgtctggctagaggaggcaggccagaaactgtcaatatacaacgctctgaaaaaagacctgctgccatctgacatggctgtggccctgctcgaagcacaagcggggactgggcacattatcgaccctgctacgagtgcgaggctgaccgtagacgaagcagtgcgagctgggcttgtcggccccgagttccacgaaaagcttcttagtgccgagaaggctgtcacgggttacagagacccctacactgggcagagtgtgtccttgttccaggccctcaaaaaaggactgatcccacgtgagcagggcctccggctcctggacgcccagctgagcactggtggaattgtcgatccgtcgaaaagtcaccgcgtgcctctcgacgttgcctgtgctcgcggatgcctggatgaagaaaccagtagggccctcagcgccccaagggcggatgcaaaggcctattcggacccgtctacaggggagcccgccacatacggcgagctccagcaacgatgcagaccagaccagttgacagggctgtctttactccctctgagcgaaaaagccgccagagccagacaggaggagttatatagcgaactgcaggcgagagagacattcgaaaagactccagttgaggtgcccgtcggtggattcaagggacggaccgtgaccgtctgggagttgatttcctcagagtactttacagctgagcagaggcaagagctcctacggcagtttaggaccggtaaggtgaccgtggagaaggtcataaaaatccttatcactatagtggaggaagtcgagacactacgccaggagaggttaagctttagcggcctgagggcccctgtgccagccagcgagctgctcgcatcaggcgtactgagccgagctcagtttgagcaattgaaggatgggaagaccaccgtcaaagacctcagcgagctcggcagtgtgagaacattactccaggggtccggttgcctggccggcatttacttagaagacacgaaagagaaggtaagtatctatgaggcgatgaggcgaggtctcctacgcgccaccacggctgctctacttctggaagcccaagcggctacagggtttttggtggaccccgtgcgcaatcagcgcttatacgtgcacgaagccgtcaaagccggagtcgtgggtcccgaactccacgagcagttactgagcgcagagaaggccgtgacaggttaccgggacccatactcagggagcacaatttctcttttccaagcgatgcagaaaggactcgtattgcgacagcacggcatcagattgctggaagcccagatcgccaccggggggatcatcgaccctgtacatagccacagggtcccggttgatgtcgcctatcagaggggatacttctcggaagagatgaaccgtgttcttgcggatccctccgatgacaccaagggcttttttgaccccaacacccatgagaatttgacttaccgacagctgctggaaaggtgtgtcgaagatccagaaaccgggctgcgcctcctgcccttaaaaggagccgagaaggctgaagttgtcgaaacgacccaggtctacaccgaggaagagacacgaagggcctttgaggaaacacaaattgacatccctggcggaggctctcacggaggctccactatgtccctgtgggaggtgatgcagtccgacctgattccagaagaacagagagcacagttgatggctgattttcaggccgggcgcgtgacgaaggaaagaatgattatcattatcattgaaattattgaaaaaacagaaattattcgtcagcaggggctcgcgagttacgactacgtacgccgtagactgacggctgaagatctgttcgaagcaaggatcatttcactcgagacttataacttactgagagagggcactagatccttgcgcgaagccctggaggccgagagtgcgtggtgttacctttacggaacagggagcgtggcaggtgtatacctgccgggttcgcgacaaaccttgtcaatataccaggcactcaaaaagggtttactgagcgccgaggttgcacgtctgctcctggaggcgcaagccgcaaccggttttctgttggatcccgttaaaggcgagaggctgacagtggacgaggccgtgcggaagggactggtgggccctgagttgcacgaccgactgctcagtgctgagcgggccgtgaccggctatcgggacccctatactgaacaaaccatctctctgtttcaggcaatgaagaaggagctcatccccaccgaagaggccttgcggctcttagacgcccagttggcgacaggcggaatagttgatccacgcctaggattccaccttcctttggaagtggcataccaaagggggtacttgaacaaagatacccatgaccaactgtcggagccctcggaggtgcgatcttatgtggatccatccaccgatgagaggctgagttacacacagctgttgaggcggtgtagaagggacgatgggaccgggcagctgctgttgccactgtcagacgccaggaaactgacgttccgcgggcttcggaagcagatcactatggaggaactagtgaggtcccaggtgatggatgaggccactgcgctgcaactgcgagaggggctgacatcgatcgaagaggtgaccaagaacctgcagaagtttctggaaggcactagttgcattgccggggtgtttgttgatgccacaaaagagcgtctgtcagtttaccaagccatgaaaaaaggaatcattcggcctggtacagcttttgagctcctggaagcccaggcagccacaggttacgtgatagacccaatcaagggcctgaaacttaccgtggaggaggccgtgaggatgggcattgtgggccctgagttcaaagataagctcctgagcgccgagcgcgccgtgacggggtataaagatccctattctggcaaacttattagtctgttccaggctatgaagaaaggcctaattctgaaagatcatggcattagactcctggaggcccagatcgctacaggcggtattatcgaccccgaggagtcccaccgcctgccggtagaggtcgcttataaacgaggcctatttgatgaggagatgaacgagattctgaccgacccgtctgacgacaccaaaggcttttttgacccaaataccgaagagaacctaacatatcttcagctgatggagaggtgcatcaccgaccctcaaacagggctctgtctgctccccctcaaagagaagaaacgcgaaagaaaaacatccagcaagtctagtgtgaggaagcgccgagtggtgatcgtggatccggagaccggcaaagaaatgtccgtctatgaagcttaccgcaaaggccttattgatcaccagacctatttggagctatcggaacaggaatgtgaatgggaagaaattactatttcgtcaagcgacggtgtggtaaaatcaatgatcatcgatcgacggtcaggacgacagtacgatatcgacgacgccatagctaaaaatttgattgaccggtctgccttggaccaatatagggcaggcaccctctcgattacagaattcgcagacatgctttcaggcaatgctgggggctttaggtcccgttcttcttcagtcggatcatccagcagttatccaatctcacccgccgtttcccgcacacaactcgctagctggtctgatcctactgaggagacaggacccgtggctggaatccttgacacagagactctggaaaaggtgagtatcactgaagccatgcatcggaaccttgtggataacatcacaggtcagagactgttggaagcccaggcatgtaccgggggcattatagatccatccacgggcgagcgctttccggtcactgacgctgtaaacaagggactagtggataagatcatggtggatagaatcaacctcgcccagaaggccttttgcgggttcgaggatcccaggaccaagaccaaaatgtccgccgctcaagcccttaagaaaggctggctgtactatgaggccggccagcgctttctggaggttcagtatttaaccggcggcctgattgaaccagatacacctgggcgagtgccgcttgatgaagcgctgcagagaggtacagtagacgcacgaaccgcccaaaagctgcgggacgtaggcgcttattccaaatacctgacttgcccaaagaccaagctcaagatcagttacaaggacgcactcgatcggtccatggttgaggagggaacaggccttcgcttgctggaggctgccgcccagtccacgaagggatattactctccctattccgtatctgggtccggctctactgcggggtcaagaaccgggagccgcactggatcccgtgcgggaagtagaaggggatctttcgatgcaactggttcaggtttttctatgaccttttcctctagctcatactcctcctcaggctatggtaggcgctacgcgtctggctctagcgcgagcctcggggggcctgagtcagcagtggcatag

SEQ ID NO: 199816 - DNA, 13713 bp, Artificial Sequence
  Description of Artificial Sequence: Synthetic coding sequence
atgagcggcgaggacgccgaggtgcgggccgtgagcgaggacgtgtctaacggcagtagcggcagcccgtctcccggagacacgctgccatggaatctgggtaagacccaacgctccagacggagcggaggaggtgcaggctctaatggaagcgtgctggatccagctgagcgcgctgtaattcgtatcgccgacgagcgagaccgtgtccagaaaaagacctttacgaagtgggtgaacaagcaccttattaaagctcaaaggcacatttccgacctttacgaggatttaagggacggacataacttaatttccctgttagaggtgttgtcaggtgatagtctgccacgagagaagggccgtatgcggttccataagcttcagaacgtccagattgcgttagattacctgcgtcataggcaggtcaagctcgtgaacatacgcaacgacgatatagcggacggcaaccccaaactgaccctgggcttgatctggactattatcctgcactttcagatttcagacatccaagtctctggccagagtgaggacatgaccgccaaggagaagctgttgctatggtcccagcggatggtcgagggataccagggcctcagatgtgataactttaccagctcttggagggatggccgtctgtttaatgcaattattcataggcataagccactgctgatcgacatgaataaagtttacaggcagaccaacttagaaaacctggatcaggctttttctgtcgctgagcgggacctgggggtgactagacttcttgatccagaggatgttgatgtgccccagcccgacgaaaagtccatcattacctatgtgagctccctttatgatgccatgccacgggtgcctgatgtgcaggacggggaactgcaactccggtggcaggaatacagagaactggtactcttgctcttacagtggatgagacaccacacagccgcctttgaggaacggcgctttccatcttctttcgaggagattgagatcctgtggtcccaatttttaaaattcaaagagatggaactacctgcaaaagaggctgacaagaatcggtcgaaaggcatttaccagagcctagagggcgctgtgcaggccggtcaactgaaggttcctccgggttatcacccactggacgttgagaaagaatgggggaaactacacgtggctatcttggagcgagagaaacaactgcgtagcgagttcgagcgactggagtgtctgcagagaatagtgacaaagctgcaaatggaggccggactgtgtgaggagcagctgaaccaggcagacgcactcctgcaatctgacgttcgactgttagctgctgggaaggtgccacagcgtgcgggcgaagtggagagggacttggataaagcagacagtatgatccggctgctgtttaacgacgtccagacattgaaggatggcaggcacccccaaggggaacaaatgtacaggcgcgtctatagactgcacgaacgcttggtggcaatacggacagaatacaaccttagactcaaagcaggtgttgccgcacctgctacgcaggtggcccaagtgaccctgcagtctgtgcagagacgacccgaactcgaagactctactctcagatacctgcaggatctgcttgcttgggtggaagagaaccaacaccgtgtggacggcgctgagtggggtgttgatctcccaagtgttgaggctcagctcggttcgcacagaggccttcatcaaagcatcgaagagtttagggctaagatcgaacgagccagaagcgacgagggtcagctttctcccgctactcggggagcttaccgagattgtctggggcgactggacctacagtatgcgaaactcctgaactcaagtaaagcccggctgaggtctctagagtctctgcacagtttcgtggcagctgcaactaaggagcttatgtggctaaatgagaaggaagaggaggaggtcggttttgattggtccgaccgtaacacgaacatgaccgcaaagaaggaaagctactcagcgctcatgagggagttagagctgaaagagaagaaaatcaaagagctccagaatgcgggcgaccgactgctgcgtgaggatcatcctgccagaccaaccgtggagtcttttcaggccgcactgcaaactcaatggagctggatgctccagctctgctgttgcatcgaagctcacctgaaggagaatgctgcttattttcagttcttttctgacgtccgcgaggctgaaggtcagctccagaagctgcaggaagcattgcgccggaagtactcctgtgatcggagcgcaactgtgactaggctggaagatcttctccaggacgcccaggatgagaaggaacaacttaatgaatataaaggacacctgtcgggactggcaaagcgagctaaggcagtagtacagctaaagcctcggcaccccgcccacccaatgagggggagactgccgctcctggcagtgtgtgactacaaacaggtcgaagtgaccgtgcacaagggagacgagtgtcagttagtcgggcctgcacagcctagccattggaaggtgctgtcctccagtggatccgaggcagccgtgcccagtgtgtgctttctggtgcccccacctaatcaggaagcgcaggaggcagtcaccaggctcgaggctcagcaccaagctcttgtcaccctctggcaccaactacacgtagatatgaaatctttgcttgcgtggcagagtctgcgccgcgacgtgcagctcattcgttcatggtccctcgcaacctttcggacactcaagcctgaggaacagcgtcaggcacttcactcattggagctgcactaccaggcgttcctgcgggacagccaggacgcagggggatttggccctgaggataggctcatggctgagcgcgagtatggctcctgttcccatcattatcagcagcttctgcagagcctcgagcagggggcccaagaagagtctagatgtcagcgctgtatcagcgagctcaaagacattcgcctgcaattggaagcatgtgaaacccggactgtacatcgcctgcgccttccgctggacaaagagcctgcccgcgagtgtgcacagagaatcgctgagcagcaaaaagcgcaggcggaggtcgaagggctggggaagggcgtcgccagactcagcgctgaagccgaaaaagtcctcgcccttccggagccgtcccctgcagcacctaccttaaggagtgagctggagctgactctgggcaaattagaacaggttaggtccctgtctgcgatctacctcgaaaagctgaaaacaatttccctcgtgatcagaggcacccagggcgccgaggaggttcttcgcgctcatgaagagcagctaaaggaggcgcaggctgttccagcaacactgcccgaattagaagccactaaggcgtccctcaagaaactgagggcacaggccgaggcacagcagccaactttcgacgcgctgcgtgacgagctgcgaggtgctcaggaagttggagaaaggctccagcaaagacatggtgagagggacgtagaagtggagcgttggagggagcgggtcgcccaacttttagagcgctggcaggcggtgttggcacaaacggacgtgcgacaaagggaattagagcagttggggcgccaactgcggtattatcgggagtcagccgatcccctcggagcctggctgcaggatgcaagacgtcggcaagagcaaatccaagccatgccgctggcggactcccaagctgtgcgtgagcagttgagacaagaacaagctcttctggaagagattgaacgtcatggagaaaaggtggaggaatgccagcgattcgccaagcagtatataaatgccatcaaagactacgaactccagctcgttacctacaaggcccagctcgaaccagtggccagtcctgccaagaaacccaaagtgcagtccgggagcgagagcgtcatccaggaatacgtggatctgcgcacgcattactccgagttaacaacactaacttcacagtatatcaaattcatatctgaaaccttacgacgcatggaagaagaggaacggttagccgagcaacagcgggctgaggagcgcgaaagattagcagaagtggaggcagctctcgaaaaacaaaggcagctagcagaagctcatgctcaggccaaggcccaagccgaacgcgaggccaaagagttgcaacagaggatgcaggaagaggtggtgaggcgcgaagaggccgccgtggacgcccagcaacaaaagagaagcatccaggaggagctgcaacagctacggcagagcagtgaagctgagatccaagccaaggccaggcaggctgaggcggccgaaagatcacgcctccggatcgaggaagaaatacgggtggttagattacagcttgaggccaccgaaaggcagagggggggcgccgagggggaactacaggcattacgggcccgagctgaggaggcagaggctcagaagcggcaggcacaggaagaggctgagcgtctcaggaggcaggttcaggacgaatcccagagaaagagacaggctgaggtggaactggcatccagggtgaaagccgaggctgaagcggcccgggaaaaacagagggccttgcaggctctggaagaattgaggctacaggcagaggaggccgaaagacggctcagacaggctgaggtagagcgggctcgtcaagtgcaggtcgccttggagacagcccagcgcagcgcagaggctgaactgcagagcaagcgagcctcatttgctgagaagaccgctcagctggagcggagcctacaggaagaacacgtcgctgtggctcagctgcgcgaggaagctgaacggcgtgcccagcagcaagccgaagccgaaagagctcgcgaggaggcagaacgagaactggaacgttggcagctgaaggctaatgaggctctcaggctgaggctacaggccgaagaggtcgcacaacagaaatctctcgcacaggctgaggctgagaagcaaaaagaggaggctgagagagaggcacgacggagaggcaaagctgaggagcaagccgtgagacagcgcgaactcgccgagcaggaactggagaagcagcggcaactggcagagggtaccgctcagcagcggctagccgccgaacaggaacttattagactgagagcagaaaccgagcagggcgaacagcagaggcagcttctggaggaagaacttgcgcggctccaacgggaagctgccgcagccacgcagaaacgacaggagctggaggccgaactggcaaaggttagagccgaaatggaggtgttgcttgcctctaaagcgagggccgaagaggaatcccgttccacttccgaaaagagcaagcagcggctggaggccgaggctggtaggtttagggaactggcagaagaggctgctagattgcgtgctctggcagaggaggctaagcgtcagcggcagcttgccgaagaggacgcagcaaggcagagggctgaggcagagcgagtgcttgctgagaagctcgccgcgattggagaggcgaccagactgaagacggaggcagagattgccctcaaggagaaggaagccgagaatgaaagactacggcgccttgcggaggatgaggcatttcagaggcgtagactcgaggaacaggctgcacagcacaaggctgacatcgaggagcggctggcacagctccgcaaggcatcagatagtgagttagagcggcagaaaggtttagtcgaggacacacttcgccagaggagacaggtcgaagaggaaatcctggcactgaaggcatcctttgagaaagctgctgccggcaaagccgagctagaacttgagctgggacggatcaggtccaacgccgaggacacactgcgctctaaggaacaggcagagctggaagcggccaggcagaggcaactggcggctgaggaggaacgcagacgccgtgaggcggaggaaagggttcagaaatcactcgccgcagaagaggaagccgcccgccagaggaaggcagccctggaagaagtggaacgtttaaaggcgaaggtggaagaagcccggaggctccgtgaacgcgctgagcaggaatccgcccgccagctgcaactggcccaggaggccgctcagaagagattgcaggccgaggagaaggcgcacgcatttgccgtccagcagaaggaacaggagttgcagcagacgctgcagcaggagcagagtgtcttggatcaactgagaggggaggcagaagccgctagacgagccgctgaggaagccgaagaggcacgggtacaggcggagcgtgaagccgctcagagcaggaggcaagttgaggaggcagaacgccttaaacagagcgctgaggagcaagctcaggcgagagcccaagcgcaagctgctgcagagaaactgagaaaggaagcagagcaggaagctgccagacgcgcgcaagccgagcaggcggctcttagacaaaagcaagctgcagatgccgagatggagaaacacaaaaagttcgcggaacagacgttgaggcagaaagcacaggtagagcaggaacttactaccttacggctgcagctcgaagagacagatcaccagaaaaatctgctggacgaagagctccagcgtctgaaagcagaggctaccgaggcagcccgccagcgaagccaggttgaggaagaattattctcggtgagagtgcaaatggaggagttgtcgaaactaaaagctaggattgaggctgagaacagggcactgatcctgagagataaggataacacgcagcgttttctgcaggaagaagccgagaaaatgaagcaggtcgcggaggaggccgctcggctaagcgtcgcagcccaggaggccgcaagattacggcagctagcagaggaagacctcgctcaacagcgggctctagcagaaaagatgctgaaggagaaaatgcaggctgtgcaggaagcaacccgcctgaaagccgaggccgaactgctgcagcaacaaaaagaactggctcaagagcaggctagaagactgcaggaggacaaagaacagatggcacagcaattggcagaggaaacccagggctttcagagaaccttggaggcagagcggcagcgtcagctggaaatgagcgcagaggccgagcgcctcaagcttcgcgtggcagaaatgagtagggcccaggcacgagcggaagaggatgcccagcgctttagaaagcaggcagaggagattggtgaaaagctccatcgcacggagctcgcaacacaggagaaagtaaccttagtccaaaccctcgaaattcagagacagcagtcggatcacgacgctgagcggctcagagaggccattgcagaactcgagcgtgagaaagagaagctgcaacaggaagcaaaactgttgcagctcaaatccgaggagatgcaaacagtgcagcaagagcagctgttgcaggagacgcaggcgctccagcagtctttcctctccgaaaaagattccctgctgcaacgggaaaggttcatcgaacaggagaaggccaaactggaacagctgtttcaggacgaggtggctaaggcacaacagttgcgcgaagaacaacagcgacagcaacagcagatggagcaggagcggcagcggctggtggcttcaatggaggaggcgcggaggcggcagcatgaagcggaggaaggagtacggcggaaacaagaagaattacagcaacttgagcagcagcgccggcaacaagaagaacttcttgcagaagagaaccagaggctgagagaacagctgcaactgctcgaagagcagcaccgcgcggccctggcacacagcgaagaggtgaccgcaagccaggtagcagctactaagaccctgccaaatggacgagacgccttggacgggcccgctgcagaggcagaacccgaacattccttcgatgggctgaggcggaaagtgtctgcacagcgcctgcaggaagctggcatcctgtctgctgaagagctccaaaggctggcccagggtcacaccaccgtggatgaactggcccgacgagaggatgtcagacactacctgcagggccgcagcagtattgccggtctgctgctaaaggccaccaacgagaagctttcagtttacgccgccctgcagcgccagcttctgtcccctggaaccgcccttatcctgctggaggctcaggccgcctccgggttcctgctggaccctgttagaaacaggcggctgaccgtcaatgaggctgttaaagagggggtggttggacccgagctgcaccacaagctgctatcagcagaacgggctgtgaccggttacaaagacccttacacaggccagcagatttccctctttcaagccatgcagaaaggattgatagtccgcgagcatgggatccgcttattagaggctcagattgccactgggggggtgatagaccctgtgcatagccaccgcgtgcccgtggatgtggcatacaggagaggctatttcgacgaggaaatgaatcgggttctcgcagatcctagcgacgacactaaagggttctttgacccaaacacccatgaaaatctgacctacctgcagctactagagcggtgtgtggaggaccctgagactggcttgtgccttctgcctcttacagacaaggccgccaaagggggggagttggtctacaccgacagtgaggcgagagacgtctttgagaaagctacagtgagcgcaccctttgggaaattccagggcaagaccgtgacaatctgggagattataaatagcgagtatttcacagccgagcagcgccgagatttgctgcgccaatttcgtaccggccggataaccgtagagaaaattattaagataattatcaccgtggtcgaggagcaggaacagaagggacggttgtgcttcgaggggctccggtccctggtcccggcagcagagcttctggagtcccgggtcatcgaccgagaactgtatcagcagctgcagcgaggggagcgctcagttcgcgatgtagcggaggtcgatacagtgcgccgagcactacgaggggccaatgtcatcgcgggtgtttggctggaggaggcaggtcaaaagctgtcaatttataacgctctcaaaaaagatttgctaccttccgatatggccgtggctttgttagaagcccaggccggaactggccatatcattgacccggccacgagcgcacgtctcacagtagacgaggcagtgcgcgcgggcttggttggtccggagtttcatgagaaattgctctctgcagagaaagccgtgacagggtaccgcgatccctacactggacagtccgtatcactctttcaggcactcaaaaaaggcttgatccctagggagcaggggctccgtctgctggacgctcagctgtcaaccggaggcattgtagacccatctaaatctcaccgcgtgcctttggacgtggcttgcgcccgagggtgtctcgacgaggaaacatctcgagctctctctgctcctagagcagatgcaaaagcctactccgaccctagcaccggcgaacccgctacttacggagagctgcagcagcgctgccgccccgaccaactgacaggtctcagcctgctacccctctccgaaaaggccgcccgtgcccggcaagaggagctgtactcagaactgcaggcgcgggagacatttgagaagactcccgtggaggttccagtgggcggttttaaaggacggactgtcactgtttgggagctgattagcagcgagtattttactgccgagcagcgccaggagctgcttcgtcagttcaggactgggaaagttaccgttgagaaggttattaaaattttgatcacaattgttgaggaagtcgagacgttacggcaagagcggctgtctttttctggtctacgcgctccagttcccgcttccgagttgctcgcttctggcgttttatcccgcgcccaattcgaacaactaaaggacgggaaaacaacagtaaaggatctgtccgaactgggcagcgtgaggactctgcttcagggatccggctgtctggccgggatttacctggaggatactaaggagaaggtttctatttacgaggccatgcgccggggcctgctcagggccaccaccgccgccctgcttctggaagcccaagctgctacaggattcctggttgatcccgtgcgaaatcaaagactgtacgtgcatgaggcggtaaaggctggcgtggtgggccccgagctccacgagcagctgctcagtgccgagaaggcagtgactggataccgagacccctatagtggatctaccatttcactctttcaagccatgcagaagggccttgtattacggcaacacgggattcgcctgcttgaagcgcagattgcgacaggcggaattattgatccagtgcactcacatagagttcccgttgacgtggcttatcagagaggctacttcagcgaggagatgaaccgagtactcgctgacccatccgatgacaccaagggtttctttgatcccaatacccacgagaacttaacgtataggcagcttctggagcggtgcgtagaagaccccgagactggactcaggctactgccacttaaaggggcggagaaggcagaagtagttgagaccactcaagtgtatacagaagaagagacacggcgggcctttgaggagacccagatagatatcccgggaggggggtcacacggcggctccacaatgtcactatgggaagtcatgcagtctgacctgatcccagaggagcagcgcgcccagcttatggccgactttcaagcaggacgggtaacaaaggagagaatgatcataatcataatcgaaatcattgaaaagacagagataatcaggcagcagggactcgcttcatatgactatgtccgtagaaggctgaccgccgaagacctattcgaagccagaattatatctctggaaacctacaatctgctcagggaaggcacccgttctctgagagaggcactggaggccgagtcagcttggtgctatctctacggaacaggaagcgtcgcaggagtctatctgcccggcagccgtcagaccctttcaatctaccaggctctgaaaaagggattgctttcagccgaggtcgcacggctcctgttggaagcccaagccgcaactggattcttgctggaccccgtgaagggcgaacggcttacagtggatgaggctgtgcgcaaaggtctcgtgggacctgaacttcatgacagattactttccgctgaacgggcagtaaccgggtatagggatccctatacagagcagacaatttcactgtttcaggccatgaaaaaggagctcattcccactgaggaggccctacgccttctagatgctcagctcgctacaggaggtattgtggatccaagactaggatttcacttgcccctcgaagtagcctaccaacgggggtatcttaataaggatacgcatgaccagctgagtgagcctagcgaagtcaggagctatgtggatcccagcacggacgagcgcctgagctacactcagctcttaagaagatgtaggcgcgacgacggcacaggccagctgctactgcccttgtcggatgcccgtaagcttacgtttcgtggcctccgcaagcaaatcaccatggaggagctagtgcggtcacaggtgatggacgaagctacggctttgcagttgcgggagggcctcacctctatagaagaggtgacaaagaatcttcagaaattcttagagggcacaagttgcattgctggtgtgttcgtggacgctaccaaagaaaggttgagcgtgtaccaggccatgaaaaaaggtatcatcagacccggaacagcttttgagctcttggaggctcaagcagccaccggctacgttatcgaccccataaaggggctaaagcttaccgtggaagaggccgttaggatgggaattgtaggacctgaatttaaggataaactcctctctgcagaaagagcagtaacaggttacaaagacccctacagtgggaaacttatttctctgtttcaagccatgaaaaaaggtctgatcctgaaggaccacggcataagattactggaggcgcagatcgccacaggcggcatcattgaccctgaagagtcacaccgacttccggtggaagtggcctataagagggggctattcgatgaggagatgaacgagattctgacagatcccagcgacgacacaaagggattcttcgacccaaacactgaggagaacctcacgtatctccagctgatggaacggtgtataaccgacccacagacaggactttgtctcctgccactcaaggagaagaaacgggagcggaagacctccagcaaatcaagcgtgagaaagagaagggtggtgatcgtggaccccgagaccggcaaagagatgtccgtgtatgaagcataccgcaaaggcctaatagatcatcagacctatctcgagctgtcagaacaagagtgcgaatgggaggagatcacgatttcctctagcgacggtgtggtcaaaagtatgataatcgacagaaggtcaggcaggcaatatgacatagacgacgctatcgccaagaatttaattgatcggtccgcactcgatcagtatcgagctgggactctgtcgatcaccgaattcgccgatatgctgtcagggaatgccggagggttccgctcccggtccagtagcgtgggctcatcttcctcatatccgatctcgccagctgtcagcaggacccaactggcctcatggtctgacccaacagaagagacaggaccggtagcaggaatactcgacacagagactctcgagaaggtaagtattacagaggccatgcaccggaacctcgtggataacatcaccggacagcggcttttagaggcccaggcctgcacaggcggaatcatcgatcctagcaccggtgaacgcttccccgtgaccgacgccgtcaataaaggcttggtggacaagatcatggtggatcgcattaacctcgcccaaaaagctttttgtgggtttgaggatccacggacaaagacgaaaatgtctgccgcccaggccctcaagaaaggttggctctactatgaagctggacagcgttttctggaggtacaatacctgactggtggccttatcgagccggacacccccggcagagtcccactcgatgaggctctccagaggggtactgttgatgcacgaacagcccagaaacttcgggatgtgggagcctatagcaaatatctcacttgtccgaagacaaagctcaagattagctacaaagacgccctggacagaagcatggttgaagagggaacgggccttcggttgctggaagcggccgcgcagtctactaaaggctattattctccttacagcgtgtccggttccggctccacagccggaagtcggacagggagccgaacagggagccgagccggtagtcgccgagggagtttcgacgctaccggttccggttttagcatgactttcagtagctctagttatagctctagcggatacggccgacgatatgcttctgggtcttctgccagcctcgggggccctgaatcagctgtggcgtag

SEQ ID NO: 199817 - DNA, 1503 bp, Artificial Sequence
  Description of Artificial Sequence: Synthetic coding sequence
atggccaccgtgatccccggcgacctgagcgaggtgcgggacacccagaaggtgccgtccgggaaacggaaaagaggagagacaaaacctcggaagaacttcccttgtcagctctgtgataaagccttcaatagcgttgagaaacttaaagtgcactcctactcacatactggcgagcgtccttacaagtgcatccaacaagactgtacaaaggcattcgtgtcaaagtataaacttcagcgccatatggccacccacagccccgagaaaactcacaagtgcaactattgcgaaaaaatgttccaccggaaggatcacctgaaaaatcacctgcacactcacgacccgaataaggaaacctttaagtgcgaagagtgtggaaaaaattataacacaaagctcggtttcaaacgacatctggcactgcatgccgccacttctggcgacctgacctgtaaggtctgtttgcaaacattcgaatctacaggggtgcttctggagcatctgaagtcccacgctggtaaatcaagcggaggcgtaaaagagaaaaaacatcagtgtgaacactgtgataggcggttttacacacggaaagacgtgagacgacacatggtagtacacactggacggaaggacttcctgtgccagtactgtgctcaacgatttgggcgtaaggatcacctgacccgacacatgaaaaagtcccacaatcaggaactactgaaggttaaaactgaacctgtggatttcttggatccattcacttgcaatgtctccgttccgattaaagacgagcttctgcctgtgatgagccttccaagctcagaactgcttagtaaaccattcaccaatacactccagttaaacctttataatactccctttcagtccatgcagtcaagtggctctgcacaccagatgataacaactttgcctcttggaatgacctgtcccattgacatggacaccgtacaccctagccaccacttatcgttcaagtacccattcagtagcacctcatacgccatttctatacccgagaaggaacagccccttaaaggcgagatcgaaagctacttaatggaattgcagggcggcgtgccatccagcagtcaggacagccaagcgtccagctccagcaagcttgggctggacccccagatcggtagcctggacgatggggcaggtgacctgtcgctctccaagagcagcatatcaatatcagaccccctgaatacacccgctttggattttagtcaactgtttaactttattccgctaaatgggccaccctacaatcctctgtccgttggctctctgggaatgtcctatagtcaggaggaggcgcattccagcgtttctcagcttccaccccagacccaagacttgcaggatcccgccaataccattggcctgggctcattgcattctctgtccgcagccttcacctcaagcctctcaacttccactactctgcctaggtttcatcaagcgtttcagtag

SEQ ID NO: 199818 - DNA, 1257 bp, Artificial Sequence
  Description of Artificial Sequence: Synthetic coding sequence
atggccacccacagccccgagaagacccacaagtgcaactactgcgagaagatgttccacaggaaggaccacctgaagaaccatctgcatacccatgaccctaataaggagacgtttaaatgcgaagaatgcggcaagaattacaataccaagctaggtttcaaaagacacttggcattgcatgccgcaacaagtggcgaccttacttgtaaggtctgtttgcagacatttgagtctaccggggtgctgttggagcacctgaaatcccacgctggcaagagcagcggaggcgtgaaagaaaagaagcatcagtgcgagcactgcgatcggcgcttctacactcggaaagacgtgcgcagacacatggtggtccacaccggcaggaaagacttcctgtgtcaatattgcgctcagcggtttggaaggaaggaccacctgacccgtcacatgaaaaaaagccataatcaggaactattgaaagttaagaccgagcctgtcgacttcttggacccctttacgtgcaacgtgtcggttcctatcaaagacgaacttttgccagttatgtcactgcccagttctgaattgttaagcaaacccttcactaacacgctccagctgaatctctacaacactcctttccaatcgatgcagagctctggctcagcccaccagatgatcacaaccctgcccctcggcatgacatgtcccatagacatggacacagtgcatccctcccatcacctgagcttcaaatacccattctccagcacctcatacgccatcagcatccccgagaaggaacagccacttaagggcgagattgaaagctacctgatggagctgcaaggtggagtccccagtagttcccaagacagccaagcctcatccagctcaaaactaggtctggacccgcaaatcggtagcctagatgacggtgcgggcgacctgtcactgtcaaagtcttcaatttcgatcagtgatccactgaacacaccagctctagatttctcccagctgttcaactttattccactgaatggaccgccatataacccgcttagcgtcggaagtctgggcatgtcatattctcaggaagaggcccacagctcagtgtctcagcttcccccacagacacaggaccttcaggaccctgctaataccatagggctgggcagcctgcatagtctctcagccgccttcacatcaagcctgagtacatccaccaccttaccccgattccaccaggcattccaatag

SEQ ID NO: 199819 - DNA, 1503 bp, Artificial Sequence
  Description of Artificial Sequence: Synthetic coding sequence
atggccaccgtgatccccggcgacctgagcgaggtgcgggacacccaaaaggtgcccagtggtaaaaggaaaagaggagagaccaaacctcggaagaactttccctgccagctctgcgataaagccttcaattccgtggagaagttgaaggttcactcatattcgcacacgggagaaagaccttacaagtgcattcagcaggactgcaccaaagccttcgtctccaaatataagcttcagcggcacatggccacccacagtccagagaagacacacaagtgcaactattgcgagaaaatgttccatagaaaagatcacctgaagaaccatttacacacgcacgaccccaataaggaaacattcaaatgtgaggagtgtggtaagaattacaacaccaagctgggattcaagcgacatttggcccttcacgccgccacatcaggagatttgacctgtaaggtctgtttacagacattcgagtcaaccggcgtgctgctggaacatctgaaatcacacgccggtaaatcttcaggaggtgtgaaggagaagaagcaccagtgtgagcactgtgatcgtagattctacacgcgaaaggatgtaagaaggcatatggtcgtacatactggccgcaaggatttcctgtgccagtattgtgcccagcgtttcgggcgcaaggaccatctgacaaggcacatgaaaaaaagtcacaatcaggagctgttgaaagtgaagaccgaacctgtcgacttcctcgacccgttcacatgtaacgtgtctgtaccaataaaagatgagctactgcccgtgatgtccctaccaagcagtgaactgttgtcgaagccattcactaacaccttgcagttgaacctctataatacccccttccaatctatgcagtcatcgggtagtgcgcaccagatgattactactttaccacttgggatgacatgcccgatcgacatggatacagtccatccctcccaccaccttagtttcaaatatcctttcagctcaaccagttacgccatatccattcctgagaaggaacagcctctgaagggggagatagagtcctacctcatggagttgcaaggaggagtgccatctagttctcaagactcgcaagcctcgagttcaagcaagcttggacttgaccctcaaataggtagcctcgacgacggggcgggcgatctgtctctttcaaagtcttccatctcaatttctgaccccctgaatacgccggcattagatttctcacaactgtttaactttattccgctcaacggacctccatacaaccccctctctgttggcagcttaggtatgtcctactctcaggaagaggcacacagttccgtgtcccagctaccgcctcagactcaagacctgcaggatccagctaacactatcggtctcggctctctgcactccctgtccgccgcttttaccagctccctttctacatcaaccacgctgcctagatttcatcaggcttttcagtag

SEQ ID NO: 199820 - DNA, 1392 bp, Artificial Sequence
  Description of Artificial Sequence: Synthetic coding sequence
atggccaccttcccctgccagctgtgcggcaagaccttcctgacccttgagaagtttactatacataattactctcacagccgcgaacgaccttacaagtgtgttcagcctgattgcggtaaagcgtttgtgagcaggtataagctcatgcggcacatggccacccacagtccccagaagtcacaccagtgcgcccattgcgagaagacttttaaccgaaaggatcacctgaaaaatcatctccagacacacgatcctaataagatggctttcggatgcgaggaatgtggaaagaaatataatacgatgctgggatacaaaaggcacctagccttgcacgccgcatcatccggcgatcttacctgtggcgtttgcgcactcgaattggggtcaacggaggtgctccttgaccacctcaaagcccacgcagaagagaagcccccctccgggaccaaagaaaagaaacatcagtgcgaccattgcgaacgctgtttttatactaggaaggatgttagaagacatcttgtcgttcacacaggatgcaaggacttcctgtgccaattctgtgcacagcgcttcggaaggaaggaccacctgacacggcacaccaagaaaactcattcccaggaacttatgaaggagagcctgcagacaggtgatctgctaagcactttccacaccatcagtccaagttttcagctgaaagccgccgccctcccacccttcccactgggagcatccgcccaaaatggactcgcatcaagcctgcctgcggaggtccattctctgaccttgtctcccccggagcaggccgctcagcctatgcagccgctacccgagagcctggctagtttacaccccagcgtttcacctggtagtcctcctccacccctgcccaaccataagtacaatacgaccagcacatcgtacagtccccttgcctccctccctttgaaggccgacaccaaagggttctgtaatattagcctgttcgaggacctcccactccaggagcctcaatccccacagaaactcaacccaggattcgacctggctaagggcaacgctggaaaagtcaatcttcccaaagaactcccagcagatgcggtgaacctgactattcctgctagtcttgatctctctccgctcctcggtttctggcagctccccccgccagccacccagaataccttcggtaactcgacattagccctagggcccggtgagtccctgcctcacagactgagctgcttgggccagcagcagcaagagccacccctcgctatgggtacagtgagcctgggtcagctgcccctgccgcccattccccacgtgtttagcgccgggacagggagcgcgattttgccacactttcatcacgcattccgttag

SEQ ID NO: 199821 - DNA, 1392 bp, Artificial Sequence
  Description of Artificial Sequence: Synthetic coding sequence
atggccaccttcccctgccagctgtgcggcaagaccttcctgaccctggagaaattcacgatccacaactacagccactcaagagagaggccgtacaagtgtgtgcagcccgattgtggaaaggcttttgtgtctagatacaaactcatgcgtcatatggctacacattccccgcagaagtcccaccaatgtgcccactgtgagaagaccttcaatcgaaaggatcacctgaagaatcacctgcagacccacgatcctaacaaaatggcattcggatgcgaggaatgtggcaaaaaatataatacaatgctcggctacaagagacacctggccctccacgccgccagctctggggacctgacttgcggagtgtgtgctctcgagctgggatccaccgaagttctgctggaccacttgaaggcacatgcggaagagaagccccctagtggcactaaagagaagaagcatcaatgcgaccactgcgagcgctgcttctacacgcggaaagatgtgcggaggcaccttgtcgtgcacacagggtgtaaggatttcctgtgtcagttctgtgcacaaagattcggacgcaaggaccatctgacacgccacaccaaaaaaactcatagtcaggagcttatgaaagaatcactacaaacaggcgacctgctatctacattccatactataagcccatcatttcaactgaaagccgccgccctaccaccattcccacttggagccagcgcccaaaacgggttggcatcatccctgcccgcggaagtacacagcctgacccttagccctcccgagcaggccgcacagcccatgcagcctctcccggaaagccttgcgagcctacatccatctgtctcacccgggtctcctcccccaccactgcccaaccacaagtacaatacaacatccaccagctattcccctctggcgtctttgcctctaaaggcggacactaagggtttttgcaatataagcctgttcgaagacctgccgctgcaggagccgcaatctcctcagaagctcaaccccggttttgatctggctaaaggtaatgctgggaaggtgaacctccccaaggaactcccggccgacgccgtaaacctcaccatccctgcttctttggatctctccccactgttaggtttctggcaactcccccctccagctactcaaaatacttttggaaactcgacattggccctgggcccaggagagagcctgccccatcgcctgagttgccttggccagcaacagcaggagccgccactcgccatgggcactgtgtccctgggacagctgccactccctccaattcctcatgtgttttctgccggaactgggagtgctatcttacctcattttcaccatgccttccgctag

SEQ ID NO: 199822 - DNA, 1392 bp, Artificial Sequence
  Description of Artificial Sequence: Synthetic coding sequence
atggccaccttcccctgccagctgtgcggcaagaccttcctgacccttgagaagttcactatccacaattactcccattcacgcgagcggccttataagtgtgttcaacccgattgcggaaaggcgtttgtttcccggtataagttaatgcggcatatggctacccacagcccccaaaagtctcatcagtgcgctcactgcgagaagaccttcaatcgaaaggaccatctgaaaaatcatttacagacgcatgaccccaacaagatggccttcggctgtgaagagtgtggaaagaaatacaataccatgctcggctataaaaggcatctcgctctgcacgccgccagtagcggtgatctgacatgtggcgtctgcgccttggaactgggttctacagaagtgctgctggatcacttgaaagcacacgccgaagagaaacccccatctgggaccaaggagaagaaacaccagtgcgaccactgtgaacgctgcttttatacccgcaaggatgtgaggaggcacttggtggtgcatacgggatgtaaagactttctctgccagttttgtgcccagcggttcggccggaaagaccacctgaccagacatactaagaaaacccactcccaggaacttatgaaagaaagcttacaaacaggcgacctgctttcaacttttcacaccatctcaccctcctttcagcttaaggccgcggctctccctcccttccccctgggagctagcgctcagaacgggctcgcaagcagcctccccgccgaagtacacagcctcactctgagtccaccagaacaggcagcgcagccgatgcagcccctgcctgagtctctcgctagtctgcacccgagtgttagtccaggttcgccccccccccctctccctaaccacaaatacaataccacatcaacgtcctattcccccctggcatcgctgccgctgaaggctgacactaagggattctgtaatattagcctgttcgaggatctgccgttgcaagaaccacagtctccacagaagctcaacccgggctttgacttagccaaggggaatgccgggaaagtcaacttgccaaaagaactgccggccgatgccgtcaatctcacaatccctgcctcattggatttatcacctcttttggggttctggcaactaccccctccagcaactcagaatacctttggaaatagtactcttgcactcggtcccggggaatcactgccacaccggttatcttgtctgggccagcaacagcaagaacccccgctggccatgggcaccgtgagcctgggccagcttcctctgcccccaatcccccacgtgttcagtgctgggaccggctcggctattctgccccactttcaccatgcattcagatag

SEQ ID NO: 199823 - DNA, 1236 bp, Artificial Sequence
  Description of Artificial Sequence: Synthetic coding sequence
atggccacccacagcccccagaagagccaccagtgcgcccactgcgagaagacctttaatcggaaagaccatttgaagaatcacctgcagacacacgatcctaacaagatggcattcgggtgcgaggaatgtggaaagaagtacaacactatgttaggctataaacgacatcttgccttgcatgccgccagctcgggcgatctcacatgtggggtttgcgcccttgaattgggatcaaccgaggtgttgcttgaccatctgaaagcccacgccgaagagaaacctccctccgggaccaaagaaaaaaagcaccagtgtgaccactgtgagcggtgtttttacacaagaaaggacgtgaggagacacctggtggtccacactggctgcaaggacttcttgtgtcagttttgtgcccagcgctttgggcgcaaagatcacctgacacgtcacaccaaaaagacacattcgcaagaattgatgaaggagagtctgcagacaggcgatctattaagcacgtttcatacaatttcaccatctttccagctgaaggcggcggctttaccaccattccccctcggcgcaagtgcccagaacggactggcatcctctttgcccgccgaagttcattcgttaaccctgagccccccagaacaggctgcccagcctatgcaacccctaccagagagcctagcctcccttcacccttccgtgagcccaggatcgccccctcctcctttgcccaaccacaagtataacaccacaagtacttcttatagtcctcttgccagccttcccctgaaagcagacacaaagggattttgcaacatctcattgtttgaagatctgccactgcaggagccgcaatcccctcagaaacttaatcccggtttcgacctggctaaaggaaacgctggcaaggtcaaccttcctaaagagctccccgccgacgcagttaaccttaccatccctgcaagcctggacctcagtcctctgctgggcttctggcagttacctcccccggctacacagaatacattcggcaactctaccctggcgctcgggcccggagagagtcttcctcatcgcctgtcatgtctgggacaacagcagcaggagcccccacttgcgatgggcactgttagcctcggtcagctgcccctcccaccaatccctcatgtcttttcggctggaacgggctctgccattttaccgcattttcatcacgcctttcgctag

SEQ ID NO: 199824 - DNA, 1236 bp, Artificial Sequence
  Description of Artificial Sequence: Synthetic coding sequence
atggccacccacagcccccagaagagccaccagtgcgcccactgcgaaaagacttttaaccggaaggaccacttgaaaaatcatctccagacccacgatcctaataaaatggcatttggttgcgaggaatgtgggaagaagtacaatacaatgctcggctacaaaaggcaccttgccctgcatgcagcttccagtggggacctcacctgtggtgtgtgcgcactggaattaggttccacagaagtcctgctagatcatctgaaggcccacgcagaagaaaaacccccctcaggcaccaaggagaagaagcaccagtgcgaccactgcgagcgatgcttttatacacgcaaggacgtccggcgccatttggtcgtgcacacaggttgcaaggatttcctttgccaattctgtgcccagagatttggccggaaggatcatctcacgcgacacaccaagaaaacccactctcaagagctgatgaaggagtccttacagaccggagatctgctcagcactttccataccatctccccctctttccagctcaaggcagctgctctgcctccattccccttgggcgcgagcgcccaaaacggactcgcctcctcactgcccgctgaggtccattctcttaccctcagtcctccagagcaggccgcccaacccatgcaacctctgcccgagtctctggcctccctccacccatcagtttcgccaggttctcctccccccccattgcccaatcacaagtataacaccaccagcacaagctatagtccgcttgcttcccttccactgaaagccgataccaagggtttttgtaatatcagtttgttcgaagacctgcccttgcaggagccacagtctccccagaaactgaatcctggtttcgacctggccaagggcaacgccggtaaggtgaatcttcccaaagaattgcccgcggacgcagtcaaccttaccatcccggcgagcctggatttgagccccttgctcgggttctggcaacttcctccacccgcaacccagaacaccttcggtaactcaacccttgctttaggacctggtgaatcactcccgcatcgtctgagttgcctgggacagcagcagcaggaaccccccctggcgatgggcacagtgagcctcggtcagctgcctctgcctcccatcccacacgtattctcggctggcacgggcagcgctattctgccacatttccaccacgcctttaggtag

SEQ ID NO: 199825 - DNA, 1392 bp, Artificial Sequence
  Description of Artificial Sequence: Synthetic coding sequence
atggccaccttcccctgccagctgtgcggcaagaccttcctgaccctggagaaattcaccatacacaactatagccacagccgggaaagaccatacaagtgtgtgcagcccgattgtgggaaagccttcgtgtctcgatataaactgatgcgacacatggccactcactctccccaaaaaagccatcaatgtgcccactgtgagaagacttttaaccggaaggaccacttaaaaaaccatctgcagactcacgaccctaacaagatggccttcgggtgcgaagagtgcggaaagaagtataacacgatgcttgggtacaagagacatctggcccttcatgccgcctcatctggggacctgacctgtggggtctgtgccctggaactgggctctactgaggttttgcttgaccatctgaaggcccatgctgaagaaaagcccccatccggcactaaagaaaaaaagcatcagtgcgaccattgtgaaaggtgtttttatacccgcaaagacgttaggcgacatctcgtggtacatacgggctgcaaagattttctgtgtcagttttgtgctcagcgcttcggacgcaaagaccacctcactagacataccaaaaaaactcattctcaggagctgatgaaggaaagcctgcagaccggtgacctgttatccacttttcatacaatcagcccctcctttcagttaaaggcagccgccctccctccattccccctgggcgcttctgcccagaacgggttagctagctccctgcccgctgaggtgcacagcttaaccctctccccccctgagcaggctgcccagccgatgcagcctctgcctgagtccttggcttccctgcacccttccgtgtctccgggaagccctccgccgcccttacctaaccacaaatataacacaacctcaactagctactcacccctcgcctcactgcccctgaaggcagatacaaaagggttttgtaacatctctctgttcgaggatctccccctgcaggagcctcagagtccacagaaactaaatcccggctttgacctcgccaaggggaacgcgggcaaagttaacttgccaaaagagttaccagccgacgccgtcaatctgactatccccgctagccttgacctgtctccactgcttggcttttggcagctgcccccccctgctacacagaataccttcggaaacagcacactggcactgggtccaggagaatctcttcctcaccgattgtcgtgcctcggtcagcagcaacaggaaccgccgctggcgatgggaacagtctctctggggcagcttcctctaccacctattcctcatgtcttctcggcgggcacaggctccgccatccttcctcactttcatcacgcgtttcgctag

SEQ ID NO: 199826 - DNA, 1392 bp, Artificial Sequence
  Description of Artificial Sequence: Synthetic coding sequence
atggccaccttcccctgccagctgtgcggcaagaccttcctgacccttgaaaagtttacaattcataattatagtcatagccgggagaggccatacaagtgcgttcagcccgattgcgggaaggcatttgtgagccgatacaaactcatgcggcacatggctacacatagcccgcagaaaagtcaccagtgcgctcattgcgaaaagacgttcaacaggaaggatcacttgaagaatcatttgcagacccacgatccaaacaagatggcatttggctgcgaggagtgcggtaagaagtataacacaatgctcggttacaagcggcaccttgcactgcatgctgcatcctcaggagacctgacatgtggagtctgcgctctcgagctcggatcaaccgaggttttactggaccatctgaaagcacacgccgaggagaagcctccctccggaacgaaagaaaaaaagcaccagtgtgaccactgtgagcggtgcttttatacccggaaagacgtgaggaggcacttagtcgtacacacaggctgcaaagatttcctgtgtcagttctgcgcgcagaggtttggcagaaaggatcacctcacacggcacacaaagaaaacgcactcacaggagctaatgaaggagtcattgcagacgggagatttgttgtcgaccttccatactatctctcctagtttccagctcaaagctgccgccctgccacctttcccgcttggggcctccgcgcagaacgggctggctagctctttacccgccgaggttcattctctgacactttctcccccggagcaggccgcccagcccatgcagcccctcccagagagcctggcttccctgcacccgagcgtgagccctggaagtccacctccaccccttccgaaccacaagtacaataccacatcaacttcatattctccgctggcttctttaccattgaaagctgatacaaaggggttttgcaacattagtctcttcgaggacctgcctctccaggaacctcagagtcctcaaaaattgaaccccggcttcgacttagccaaaggaaatgcaggcaaagtaaatcttcctaaggagctgcctgcagatgccgtgaacctgacaatccctgcatcccttgatttgtcccctcttttagggttttggcagttaccccctcccgctactcaaaatactttcgggaattccactttggcactgggcccaggcgaaagcctgccccatcgcctatcctgcctcggacagcagcagcaagagccccctttggccatgggcactgtatcactcggccagctccccctgcctccaatcccacacgtgttcagcgccgggaccgggtctgccatcctgccccattttcatcacgcttttaggtag

SEQ ID NO: 199827 - DNA, 531 bp, Artificial Sequence
  Description of Artificial Sequence: Synthetic coding sequence
atggccacccacagcccccagaagagccaccagtgcgcccactgcgagaaaacctttaaccgtaaggaccacttaaagaatcaccttcagacccatgatccaaataaaatggctttcgggtgtgaggagtgtggcaaaaagtacaacacgatgctggggtacaagcggcatctggccttgcatgctgcttcatctggagacctcacctgtggggtttgtgctctagagctggggagcacggaggtgctactggatcatcttaaggcccacgctgaagagaagcccccgtctggcaccaaggagaaaaagcaccagtgcgaccactgtgagcgctgtttctatacacgcaaggacgtgcgaagacacctggtggtccacactggttgtaaagactttttgtgccagttctgtgcccaacgcttcggtaggaaagatcatttgacccgccacacaaagaaaacccacagtcaggaactgatgaaagaatcactccagacgggggatcttttgtctacattccacaccatctag

SEQ ID NO: 199828 - DNA, 1392 bp, Artificial Sequence
  Description of Artificial Sequence: Synthetic coding sequence
atggccaccttcccctgccagctgtgcggcaagaccttcctgaccctggaaaagttcaccatccacaactactctcatagccgagagcgcccctacaagtgcgtccagcccgactgtggcaaggcgttcgtgagccgctataagttgatgaggcatatggccacgcatagcccccagaagtctcaccagtgcgcacactgcgagaaaactttcaacagaaaagaccatcttaagaatcacctgcagacacacgatccgaataaaatggcattcggatgcgaggaatgtggaaaaaagtacaacacgatgctaggctataaaaggcatttagcactccacgctgcctcctctggcgatctgacatgtggagtgtgtgccttagagttgggctctaccgaggttttgttagaccacctgaaggcccacgccgaggagaaacccccgtcaggaacaaaggagaaaaaacatcaatgcgatcactgcgaaagatgcttttacactaggaaggatgtcagacgccacctggtagttcataccggttgcaaagacttcctgtgccagttctgcgctcagcgctttggacggaaggatcacctaaccaggcacaccaagaagacccacagtcaggagctcatgaaagagtcactccaaaccggggacctgctgtctacgttccacaccatttcgccatccttccagttgaaggccgccgcactgcctcctttccccctcggagctagtgcccagaatggactggcatcaagcctccctgccgaggtgcatagcctgactctgtccccacccgaacaggctgcgcagcccatgcaaccccttccagaaagcctggcaagcctccatccctctgtatctcctggcagtccccccccacctctcccgaatcacaaatataatactacctctactagttattctccgctggcctcgctccctctcaaggccgacacaaaggggttttgcaatatttcgctgtttgaggatctgcccttgcaggagccccagtccccacagaagctgaacccgggatttgacctggcaaaaggcaacgccggcaaggtaaatctgccaaaggagctgccagcagacgccgtaaatcttacaatccctgccagccttgatttgagcccattgctcggcttttggcagctgcccccacccgctacacagaacacctttggcaattcaacactcgctctcggacccggcgagagcctgccacacagactcagttgccttggacaacaacagcaggagccacccctggccatggggactgtgagtctcggacagctgcccctgccgccgattccacatgtattctcagccgggacaggaagtgccattctgcctcattttcatcacgcattcagatag

SEQ ID NO: 199829 - DNA, 1236 bp, Artificial Sequence
  Description of Artificial Sequence: Synthetic coding sequence
atggccacccacagcccccagaagagccaccagtgcgcccactgcgagaagacctttaaccgcaaagatcatttaaagaaccacctccagacccacgatcctaacaagatggcttttggctgtgaggaatgcggcaagaagtataataccatgttgggctacaaacgtcatctcgctctgcacgctgcctcttcgggagatcttacctgtggggtctgcgccctggagctgggtagcactgaggtgttgttggatcatctgaaagcccacgctgaggaaaaacctccgtccggcaccaaagaaaaaaagcaccagtgtgatcactgtgagcggtgtttctacactcgaaaggatgtgcgccgccacctggtggtccacacaggatgcaaagatttcctttgccagttttgtgcacaacggttcggacgtaaagatcatcttacccgtcacacaaagaagacccacagccaggagctcatgaaagaatccctccagactggcgacctcctgagcacattccatacaatctcaccgagtttccagttaaaagccgccgcactgccccctttccccctcggggcgtcggcacaaaacgggctggcttcttcacttccggcagaggtgcactcattaacattaagcccacccgagcaggcggcccagccaatgcaacccctgccagaatccctcgcttctcttcatccttctgtgagtcctggcagccccccccctcctttacccaaccataaatataacaccacaagcacgagctattcacctttagcctccctgcccctgaaggccgacactaagggcttctgcaatatcagcctatttgaggatttgccattgcaggagccacagtctcctcagaaacttaatcccggcttcgacttagcaaaaggcaatgcggggaaggtaaaccttccgaaggagctgccagcagatgctgtgaatctcaccatccccgcttcccttgatctttcaccactgctggggttctggcaattgcctccacctgccacccagaatacctttggcaatagcactctggctctagggcccggcgaatccctgccgcaccgcctttcctgtcttggtcaacagcagcaggagcctccactagcaatggggaccgtcagcctgggacaacttcctctccctcccataccgcacgtgttcagcgcaggtaccggcagtgcgatactgccacacttccatcacgcttttagatag

SEQ ID NO: 199830 - DNA, 1392 bp, Artificial Sequence
  Description of Artificial Sequence: Synthetic coding sequence
atggccaccttcccctgccagctgtgcggcaagaccttcctgaccctggaaaaattcacaatacataattactcacacagtcgcgaaaggccatacaagtgcgtgcagcccgactgtggaaaagctttcgtttcacgctataagctcatgagacacatggccacacacagccctcagaaaagccatcagtgcgctcattgcgaaaaaacctttaaccgaaaggatcatttgaaaaatcacctccagactcacgatcccaacaagatggctttcggatgtgaggaatgcggcaaaaagtacaataccatgttgggctacaaaaggcacttggccctgcatgccgcatcgagtggcgaccttacatgtggagtatgtgctctcgagctgggctctacggaagtgctgctggaccacctgaaggcccacgcggaggaaaagccccccagtggcactaaggaaaaaaaacaccagtgcgatcactgcgagcggtgcttctacacacggaaggacgtgcgccgacacctagtggtgcatacaggctgcaaggatttcctgtgccaattttgcgcccagaggttcgggcgtaaggaccacttaactcgccataccaagaagacacacagccaggagctgatgaaggaatcattgcagaccggcgatctgctgtccacatttcatacaatctcccctagttttcagttgaaagccgccgccctacccccttttccactgggtgcaagcgcccagaatgggctggcctcatcactgcctgccgaggtgcattccctaaccctgagcccccctgagcaagccgcccagccgatgcagccactgccagaaagcctggcaagcctacaccctagcgtgtcacctgggagccccccaccaccgctaccaaatcataagtataacaccaccagcaccagctactcaccactagcatctctgcctttaaaagcagatactaaaggtttttgcaacatatccctcttcgaggatctgccgctgcaggagcctcagtcacctcagaaacttaacccgggctttgatctagccaaagggaatgccgggaaggtgaatctgcccaaggaactaccagctgatgcagtgaatttgacaatccctgcctcactggatctgagccctctcctgggattttggcaactgccacctcccgctacgcagaacaccttcgggaattcaaccctagcgcttggacctggagagtccctgccccataggctgagttgcctcggtcagcagcaacaagaacctcctttggctatgggcactgtctcactgggccaattgcccttgcctcctattcctcacgtgttctctgccggaaccggctctgctatccttccacactttcaccacgccttcaggtag

SEQ ID NO: 199831 - DNA, 759 bp, Artificial Sequence
  Description of Artificial Sequence: Synthetic coding sequence
atgaaggagagcctgcagaccggcgacctgctgagcaccttccacaccatttcccccagttttcagctgaaggcagctgccctcccccccttcccacttggtgcgtccgcacagaacggcctggcatctagtctccccgcggaagtgcactccctcaccctgagtcctcccgagcaagccgctcagcctatgcagcccctcccagaaagcctggcctccttgcacccctctgtgagtcctggctcaccgccccccccacttccaaaccataagtacaacacaaccagcaccagctactcccccctggcttctttgccacttaaagctgataccaagggcttctgcaacattagtctattcgaagacctgcccctccaggaacctcagtctccccaaaagcttaaccccggcttcgacctggccaagggcaacgctggtaaggtcaacctgcccaaggaactccctgcagacgcagttaacctgaccattcctgctagccttgatctcagccctctcctcgggttttggcagctgccacccccagccacacaaaatacatttggcaactccacgctggctcttggtcctggtgagtcactgcctcaccgtctgagttgcttagggcaacagcagcaggagccccccctggcgatggggaccgtcagccttgggcagctcccactgccaccaatcccacacgtttttagcgcaggaaccggttctgctatcctacctcactttcaccacgctttccgttag

SEQ ID NO: 199832 - DNA, 1491 bp, Artificial Sequence
  Description of Artificial Sequence: Synthetic coding sequence
atgaccaccttcttcaccagcgtgcccccctggatccaggacgccaagcaggaagaggaggtgggctggaagctcgtgcccagacctcgaggcagagaggccgagagtcaagtcaaatgccagtgcgagatttccggcacacctttctctaatggagagaaactgcgacctcactccctgccccagccagagcagaggccctacagctgtccccagctgcattgcgggaaggcttttgccagtaagtacaagctgtatcgccacatggccacgcactccgcacagaagccacaccaatgtatgtactgtgataagatgtttcacagaaaggatcacctgcgcaaccacctgcagactcatgatcccaacaaggaagcgttgcactgttctgaatgtggcaagaactataatacgaaactgggatacaggcggcatctggccatgcacgctgcatcttctggagatctgagctgtaaagtttgcctccagacatttgaatcaactcaagctctgcttgagcacctgaaggcccatagtaggagagttgcaggaggtgcaaaggaaaagaaacacccatgcgaccactgcgaccggcgcttctatacgcggaaagacgtgcgtagacatttggtagtccataccggccggaaggacttcctctgtcagtattgcgcccagcgcttcgggcgcaaagatcacctgacgcgtcatgtgaagaaatctcatagccaggaattgttaaagattaagactgagcccgtggatatgctgggtctgctgtcatgctcctcaacggtatctgtaaaggaagaactcagccccgtgttatgtatggcttctcgcgatgtgatgggcaccaaagcgtttcccggtatgctgcctatgggaatgtatggggcccacattccaactatgccgtccaccggggtgccacactctctggttcataacacactgcctatgggaatgtcatatcctctggaatccagtcctatctcatctccggctcagctccccccaaagtaccagctaggttcaacttcttatttgcctgataaactgcccaaagtggaagtggattcgtttcttgccgaactacccgggtctctgtcactctcttccgcagaacctcagcccgccagccctcagcctgcggccgctgccgcactgctggatgaggccctgctggccaagagcccggcaaatctgtccgaggctttgtgcgccgctaatgtagacttctcacacctcctcggattcctgccactcaatctgccaccttgcaacccacctggcgcaaccggtgggcttgtaatgggatactcccaggcagaagcacagcctctgctgaccactctccaggcccagcctcaggatagccctggagcaggtggccccctcaacttcggcccgctccatagtcttccccctgtatttactagcggactgtccagtaccactctgcctcgctttcaccaggcgttccagtag

SEQ ID NO: 199833 - DNA, 507 bp, Artificial Sequence
  Description of Artificial Sequence: Synthetic coding sequence
atgcaggcccagcagtaccagcagcagcggcggaagttcgccgccgcctttttagcctttattttcattcttgcagccgtcgacactgctgaggccggaaaaaaggaaaagccagagaagaaggtaaagaagagtgactgtggggagtggcagtggtcagtttgcgtgccgacaagtggggattgtggcctgggaactcgcgagggcacacgtacaggggccgaatgcaaacaaaccatgaaaactcaaaggtgtaagattccttgcaattggaagaagcagttcggcgcagaatgtaaatatcagtttcaggcctggggagaatgtgaccttaacacagctcttaaaacccgaaccggcagcctgaaacgggccctccataacgctgagtgtcagaagacagttacaatttccaagccctgtggcaaattgacaaaacctaaaccacaggcagagtcaaaaaagaagaagaaggagggtaaaaagcaggagaagatgctcgattag

SEQ ID NO: 199834 - DNA, 1518 bp, Artificial Sequence
  Description of Artificial Sequence: Synthetic coding sequence
atggtggaggaggtgcagaagcacagcgtgcacaccctggtgttccgatctctgaaacgtactcacgacatgtttgttgctgacaatggcaagcctgtgcctctggacgaggaatcacacaagagaaaaatggcgatcaaactgaggaatgaatatgggccagtgttacacatgccaaccagcaaagagaatctaaaagaaaagggccctcagaatgcgactgactcttacgtgcataagcaatacccagccaatcaaggccaagaggtggagtattttgtcgcaggagtggccctgaccgcagacaccaaaatacagcgcatgcccagtgagagtgcagcccagagcctggccgtcgccctgccccttcagaccaaggcagacgccaaccggacggccccaagcgggtccgaatacaggcatcccggggcaagtgatcgaccacaacccactgccatgaacagcattgtaatggagacgggcaacactaagaatagtgcactcatggcaaagaaggctcccacgatgcctaaacctcagtggcatccaccctggaagttgtaccgagtaatcagcggccaccttggctgggtccgctgtatcgcggtggaaccgggcaaccagtggtttgtaacgggctcagcggaccgaaccatcaaaatctgggatctggccagtggaaaactgaaactgtcattgacgggccacataagcactgtccggggcgtgattgtgtccacccggtcaccatatttattttcctgcggagaagataagcaagtaaagtgttgggatctcgaatacaataaggtcatcaggcactatcacggacatctcagtgcagtgtatggtctggacctacaccctactatcgacgtgctcgttacctgcagccgtgactctacggcccgcatctgggatgtccgaaccaaggcttccgtgcacaccctgtcaggccacaccaatgccgtggctaccgtgcgctgtcaggctgcagaacctcagataattaccgggtcccatgatacgaccattcggctttgggatctggtggccggcaagacccgggtgactctcacgaaccacaagaagagtgttagagccgtcgtcctgcatcccagacactacacctttgcttcaggctctcctgataatatcaagcagtggaagtttcctgatggatctttcattcagaacttgtcgggacataatgccattatcaacactttgacagtgaattccgacggtgtcctggtgtctggggcagacaatgggacaatgcacttgtgggactggcggaccggctacaatttccagcgggtccatgctgcagtgcagccgggaagtctggattccgaatccggcatctttgcctgtgcgttcgatcagtccgaaagcaggctgctgacagctgaagccgacaagaccattaaggtatacagagaagatgacactgcaactgaagaaacccacccagtctcctggaagcctgaaatcattaagcggaagcgcttctag

SEQ ID NO: 199835 - DNA, 1545 bp, Artificial Sequence
  Description of Artificial Sequence: Synthetic coding sequence
atgatctgcgaggtgcagaagcacagcgtgcacaccctggtgttcagatcactgaagaggacccatgatatgtttgtggcggacaacgggaagccagtgcctctcgacgaggagtctcacaagcgcaagatggccataaagctccgaaatgagtatggccctgtgctgcatatgcccacttctaaggaaaacttaaaggagaagggaccgcagaatgccactgactcctacgtacataaacagtatcccgccaatcagggccaagaggtggaatactttgtggccgggacccatccttacccaccaggcccaggggtggctttgaccgctgacaccaagatccagcggatgccttccgagtctgccgcacagagccttgcagtcgccttgcccctgcagaccaaggctgacgcgaatcgaactgctcctagcggctccgagtacaggcatcccggagcaagcgacaggccacaaccaactgccatgaattccatcgtgatggagactggaaatactaagaactcagccttgatggccaaaaaagccccaactatgccaaagccccaatggcaccctccctggaagctgtatcgggttatcagcggccacctaggatgggtccggtgtatagccgtcgaaccgggcaaccagtggtttgtcactggttccgccgacaggactataaaaatctgggatctggccagtggtaaactcaagttatctctgactggccacatctctactgtgcgaggcgtgatcgtgtcaacgcggtctccctacctattttcatgtggtgaggacaaacaggtcaagtgctgggatctcgaatataataaggttattcgccactatcatggacatctgtctgccgtctacggtctggatctgcaccccactattgatgtcctcgtgacttgctctcgggactctactgcacgaatttgggatgtacggacgaaggcctctgtccatacgctgtctggacacactaatgctgtggcaacagtacggtgccaggctgccgagccccagataattactggctcccacgacactaccatccggctgtgggatttggtagcaggaaagacaagggtgactttaaccaatcacaaaaaaagcgtgagagctgttgtgcttcatccacgccactacactttcgcatcaggctctcccgacaacatcaaacaatggaagttccctgatggtagcttcattcagaacctcagtggacacaatgctataatcaacacgctcactgtgaacagcgacggcgtactcgtgagcggcgccgataacggcaccatgcatctgtgggattggcgcaccggctataattttcagagagtccatgccgcagtacaacccggctccctggacagtgagagtggaatattcgcttgcgcattcgaccagtccgaaagtaggttgctcactgctgaggcggacaagactatcaaggtttatcgggaggatgacacagccacagaagaaacacatcccgtctcttggaaacccgaaatcatcaagcgcaaaaggttctag

SEQ ID NO: 199836 - DNA, 1545 bp, Artificial Sequence
  Description of Artificial Sequence: Synthetic coding sequence
atggtggaggaggtgcagaagcacagcgtgcacaccctggtgttccgcagtctaaagcggacccacgacatgtttgttgctgataacggcaaaccggtgccactggatgaggagtcacacaagcgtaagatggctatcaagttgaggaacgaatacggtcctgtattgcacatgccaacgagcaaggaaaacttgaaagaaaaggggccacagaacgcaacagactcttacgtacataaacaatacccggccaaccagggtcaggaagtggagtactttgttgccggaacccatccgtaccctcccggtcctggagtggcgctgacagccgacaccaaaattcagcggatgccatccgaatctgctgctcagtcactggccgtggctctgcctttacagacaaaggccgatgcaaacaggaccgcacccagcggctctgagtacaggcaccctggagcgtcagacagaccccagcctactgctatgaacagcatcgtcatggagacaggcaacacaaaaaatagcgccttaatggccaagaaggccccaaccatgccaaagcctcagtggcatccaccctggaaattatacagagtgataagtggtcatttgggatgggtgcgctgtatcgcagttgagccaggaaatcagtggtttgtgaccggctctgcggatcgcacgattaagatatgggacctcgccagcggtaaactgaagctgtctctgacaggacacatctctaccgttaggggcgttattgtgagcacacgatctccatacctgtttagctgtggtgaggataagcaagtgaagtgctgggacctggaatataacaaggtcatccggcattaccacggccatctatctgctgtctatggcttagatttacaccccacaattgatgtgctggtcacctgttccagagattccactgctcgaatctgggacgtgaggacaaaggcttcggttcacaccctctctgggcataccaatgccgtggcaacagtgagatgtcaggccgccgagccccagatcataacagggagtcatgataccaccataaggttatgggatctggtcgccgggaaaacccgtgtaacactgaccaatcacaaaaagagtgtcagggccgtggttctccatccaaggcactatacatttgcttcaggctcacccgataatatcaaacagtggaaattcccagacgggtccttcatccaaaacctctcgggtcacaatgcaatcattaatacactcaccgttaacagtgacggcgttctggtttccggcgctgacaacggcacaatgcacttgtgggattggaggacaggatacaactttcagagggttcacgctgccgttcagcctgggagcctggatagcgaaagtgggatcttcgcctgcgcctttgatcagagcgagtcccggctgcttactgccgaagctgacaaaacgattaaagtctaccgggaggatgacacggctaccgaggaaacccaccctgtctcttggaagcctgaaattattaagagaaaacgattctag

SEQ ID NO: 199837 - DNA, 5622 bp, Artificial Sequence
  Description of Artificial Sequence: Synthetic coding sequence
atgtgggccgaggccggcctgccccgggccggcggcggcagccagcctccctttagaacttttagcgcatcagactggggactgacgcatctggttgttcacgagcagaccggcgaggtgtatgtgggcgctgtgaatcgaatttacaaactgtccggaaatttgaccttgctgcgcgctcacgtgaccgggcccgtggaagacaacgagaaatgctaccctcccccttccgttcagagctgtcctcacggactgggttcgaccgataacgtgaacaaattgttactgcttgattacgccgctaacaggctcctagcctgtggcagcgcaagtcagggcatatgccagtttttgcggctggatgacctctttaagttgggcgagccacaccacagaaaggaacactacctgtcatcagtgcaggaggccggtagtatggcaggggtactgattgcggggcctccaggccagggccaggctaagctgttcgtggggacaccgatcgacggtaagtcagagtacttccccactctctcctcaaggcggctaatggccaacgaggaggacgctgacatgttcggtttcgtctaccaggatgaatttgtcagctcacagctgaagattccttccgacaccctgtcaaaattccctgctttcgatatttactacgtctattcgttcagatccgaacaattcgtttattatttgacactgcagctggacacccaactgacatctcctgatgccgccggtgaacacttctttactagtaagattgtccgattgtgtgtggatgacccaaagttttactcctacgtcgaattccccattgggtgtgaacaggctggagtggagtatcggctggtccaggacgcttatcttagccgccccggtcgggcactggcccatcagttaggcctggctgaagacgaagacgttcttttcactgtatttgctcagggtcagaaaaaccgcgttaaaccacccaaagagtccgcactctgcctattcactctcagggccatcaaagagaagatcaaagaacggattcagtcatgctaccgcggtgaggggaagctttcactgccctggctgctgaacaaggagctgggttgtataaattcccccctgcagatagatgacgatttctgcggtcaggatttcaaccagcctctcggcggcacagttacgatcgagggcacacccttgtttgtcgataaagacgatggattgaccgccgtcgccgcgtacgattacaggggacggacggttgtctttgccggcactagaagcggccgcataagaaaaattcttgtagacctgtctaatccagggggccgccccgcgctcgcttatgaaagcgtcgtggcccaggaggggtcccctatactacgtgacctcgtgctgtcgccaaaccaccaatatctatatgccatgaccgagaaacaggtgaccagagtgcctgtagagagttgtgtccagtatacctcctgcgagctgtgcctggggagccgagacccacactgtgggtggtgcgtgctccacagtatctgtagtcgccgggacgcctgcgaacgggctgacgagccacagcgctttgcagccgacctcctgcagtgtgtgcagttgactgtgcagcctagaaatgtttcagtaactatgtcccaggttccacttgtgttgcaggcgtggaatgtgcctgatctgagcgcaggtgtaaattgcagctttgaggactttactgagtcggaatctgtactggaggacggcaggattcactgtcgaagtccatcagccagagaggtggccccgattaccagggggcagggcgatcagagggtcgttaaactttacttgaagtccaaggaaacagggaagaagtttgcatcggtagatttcgtgttctataattgttccgtgcaccagtcttgcctgagctgtgtaaacggatcattcccttgtcattggtgtaaatatcgtcatgtgtgcactcacaacgtcgctgattgcgcttttttggagggcagggtgaacgtgtccgaggattgtccccagatactgccaagcacacaaatctatgtgccagtcggcgtagtaaagcccatcactctcgccgctcggaaccttcctcagccacagtccggacagcgggggtatgaatgcctcttccacattccggggtccccagcccgagtgactgctctgcggttcaactcgtcttccctgcaatgccaaaattcctcgtactcctacgaagggaacgatgtaagcgacctgcccgtcaacctctccgtggtttggaacggaaactttgtgatcgataacccccaaaacatccaggctcatctgtacaagtgtccggctttgcgggagagttgtgggctatgcttaaaggcggatccacggtttgaatgtggatggtgtgtagctgaacggaggtgctccctgaggcaccattgtgccgcagatacacctgcttcatggatgcacgctcggcatggcagctctaggtgtacagaccctaaaatactgaaactaagcccggaaaccggccctcgccagggagggactcggctcaccattacgggagaaaatttaggccttcggttcgaggatgtcagattgggtgttcgggtggggaaggtcctctgcagcccagtggagtccgaatacatcagcgccgagcagatcgtgtgcgagatcggggacgcatcgagtgttcgcgcccatgacgctctcgtggaggtatgcgtccgggattgctcccctcattatagagccctctctcccaaacggtttacatttgttactcccacgttttatcgcgtgagcccctcacgaggccccctgtccggagggacctggatcggcatagaggggtctcatctgaatgccgggagcgacgtggctgtgtctgtggggggccgcccctgttccttctcctggagaaactctcgcgaaattcggtgcttgaccccccctggccagagccccggatccgcgccaatcattattaatatcaacagagcccagttgactaaccccgaggttaagtacaattacactgaagacccaacgatccttcgtattgatcccgaatggtctatcaacagcggcggaaccctactgaccgttactggtactaatttggcgacagttagggagcccagaatacgcgcgaagtacggaggtatcgaaagggagaatggttgtctggtatacaacgacactaccatggtgtgccgagcaccctccgttgctaaccctgtgagaagtcctcccgagctgggcgaacgtccagatgagttggggttcgtaatggataacgtgcgctctttactggtgttgaattctacttcgttcctgtactaccccgaccccgtgctggagccactgagcccaaccgggctgttggaacttaagcccagttcacctctgattctgaaaggaagaaacctgctcccacccgctccagggaatagcagactgaattatactgtgctcattggctcaaccccctgtaccctgaccgtttcagagactcaactcctctgtgaggccccaaacctgacgggccaacataaagtgaccgtgcgagctggaggattcgagttctccccaggcaccctgcaggtctactccgactcccttctcacccttcccgcgattgtaggtattggagggggcggaggactgctgctattggtcattgtagcggttctgatcgcctataagcggaagtctcgggatgccgacagaactctgaagaggttacagcttcagatggataacttggaaagccgcgttgcgttggagtgtaaagaggcttttgctgaattacaaacagatattcacgagctgactaacgatctggacggagcaggcatcccattcctggattatagaacgtacgccatgagggtcctgttccctggcatcgaagatcaccctgtcttgaaggagatggaggtgcaggctaatgtcgagaagtctcttactctctttggccagctcttgacgaagaaacacttcctactcaccttcattagaacccttgaagcacagcggtcattttccatgcgtgatagggggaacgtggcttctttgattatgaccgcattacagggagagatggagtacgcgacaggcgtgcttaaacagcttttatctgacctcatcgagaaaaacctggagagcaagaaccatcccaagctgctactgagacggaccgaatcagtggcagagaagatgctaacaaattggtttacttttctgctatacaaattcctgaaggaatgtgccggagaacccctgtttatgctgtactgcgccattaagcaacagatggagaaaggtccaatcgacgccatcaccggggaagctcggtactctttgagcgaggacaagctcatccggcaacagatcgattacaaaaccctgacgctgaactgtgtgaatccagaaaacgagaacgcccctgaggtgcccgtgaaagggttagattgtgataccgttacacaggcaaaagaaaagttgttagacgccgcttataaaggggtcccctacagccaaaggccaaaggctgccgatatggatctcgaatggaggcagggtaggatggcgcgcatcattctccaggatgaggatgtgaccaccaagatcgacaatgactggaagcgcttgaacactcttgcccattaccaggtgactgatgggtccagtgtcgcactcgtcccgaagcagacatcagcttataacatctctaattccagcacattcaccaaatcgcttagcagatacgagtctatgctccgaacggcctctagccctgacagtctaaggagccgaacacccatgatcactccggacctcgagtccggcaccaagctatggcatcttgtgaaaaaccacgatcacctcgatcagcgggagggggaccgcggcagtaagatggtgtccgaaatatacctcactcgactgctggccacaaaggggacactgcagaaatttgtggacgatcttttcgagaccatattctccacggcccaccggggcagtgccctgccactggccattaagtacatgtttgatttcctggatgagcaggcagataaacaccagattcatgatgcagatgtccgtcacacatggaaaagcaattgcttgcccttgagattttgggtcaatgtcatcaaaaacccgcagtttgttttcgatattcacaaaaactccattactgatgcatgcttgtcagtggttgctcagacgttcatggactcctgctctactagcgaacacaaattggggaaggatagcccctccaataagctcctctatgccaaggacatccccaactataaatcctgggtggagcgttattatgccgatatagccaaaatgccagccatatctgatcaggatatgtcagcctatttggcagagcaaagtcgcttgcacctgtcccagtttaattcaatgtcagccttacacgaaatttatagctatatcacaaaatacaaggatgaaattctcgccgctctggagaaggatgagcaggcccgaaggcaacggttgcggtcaaaactagagcaggttgtggatactatggccctgtcctcatag

SEQ ID NO: 199838 - DNA, 5691 bp, Artificial Sequence
  Description of Artificial Sequence: Synthetic coding sequence
atgcccctgcccccccggagcctgcaggtgctgctgctgctgctgttacttttactgttactcccagggatgtgggctgaagctggccttccccgcgctggagggggctcccagcctcctttcagaaccttcagtgccagtgattggggactgacacacctggtggtgcacgaacagacgggcgaagtgtacgtgggcgccgtaaatagaatttacaagctttctggcaatttgaccttgcttcgagcacacgtcaccggccccgtcgaagacaacgagaaatgttacccaccaccaagcgtgcagtcctgtccacatggccttggatctaccgataacgttaacaagctgttgctcctggactatgcggccaatagactcttggcttgcggatctgcttctcaaggaatttgccagttcttacgcctggatgatctgttcaagctgggcgagcctcaccacagaaaggaacactacctgtcaagtgtacaggaggccggttccatggccggagtgctcattgcaggcccccccggccaaggtcaggcaaaactatttgtgggcacacctatagatggcaaatctgaatattttcctaccctgtctagtcggcgattgatggctaacgaggaagacgccgacatgtttggttttgtgtaccaggatgaattcgtgtcatctcagttgaagataccgtccgacaccctaagtaagtttcctgcctttgacatttactacgtgtattctttcagatccgagcagttcgtgtactaccttacccttcagttggatactcagctcacctcacctgacgcagccggggaacacttctttaccagcaaaattgtgcgcctttgtgtggacgatccaaaattttattcctatgtagagtttcccattggatgtgagcaggccggggtggagtacaggctggttcaagacgcgtacctctcacgccctggccgggctctggcccaccaactgggcctggctgaagacgaggatgttctttttacggtgtttgcccagggtcagaaaaatcgcgtgaaaccaccaaaagagtcggccctctgcttattcaccctgagggcaataaaggaaaaaataaaggaacggattcaatcctgctaccgcggagagggaaagctgagcctaccttggctgctgaacaaggaactgggctgtatcaactcccctctgcagatcgacgacgacttctgcggtcaggacttcaatcagcctctagggggcaccgtaaccatagaaggcacccccctgttcgtcgacaaagatgatggactgaccgcggtcgcagcctacgactatagagggcgcaccgtggtctttgcggggactcggtcaggaagaattcgcaaaatactggtggacctgagcaatcctggcggacgacctgctctggcctatgaatctgtggtggcccaggagggttctcccattctccgcgacttagtgctgtcacccaaccaccagtatctttacgccatgactgaaaagcaagtgactagggtccctgtcgagtcatgcgttcagtatacatcctgcgaattgtgtctgggctctagggatccccattgcggctggtgcgttcttcattctatctgctcgagaagagacgcatgtgagagagccgatgagccccagcgcttcgctgccgatctgctgcagtgtgtgcagctcacagtgcagcctcgaaacgtttccgtcaccatgtctcaagtcccactggttctgcaggcatggaacgtgcccgacctttcagcaggagtcaactgctcctttgaggatttcacggagtctgaaagtgtactggaggacggacggatacactgccgaagtccgagcgcgagagaggtggcacctattactagaggccagggagaccagcgggtggtgaagctctacttaaaatctaaggaaactggtaaaaaatttgcttcagtggacttcgtgttctataattgtagcgttcaccagtcatgcttatcttgcgtgaacgggtctttcccatgtcactggtgtaaataccgccacgtctgtacccataacgtcgccgactgcgcattcttggaaggtcgggtaaacgtgagcgaggactgtccccagatcctaccctcaacacagatctatgtgcctgtgggcgtcgtgaagcctattacactggccgcccgtaatctgccacagccccaatcaggccagagagggtacgagtgcctttttcacatccccggctcccccgcgagggtgactgcattgaggttcaatagctctagtcttcagtgtcagaactccagttattcctacgaagggaatgatgtgagtgatctgccggtgaacctgagtgtggtttggaacgggaactttgtcatcgacaatcctcagaacatccaagcccacttgtacaagtgtcccgccctcagggagagctgtggcttgtgcctaaaggctgatcccagattcgagtgtggctggtgtgttgcagagcgtaggtgtagcttacgtcaccactgcgcagcagatactccggcgagctggatgcatgcccgtcatgggagttctcgttgcacagatccgaaaatcctgaagctgtctccggaaacgggcccaaggcaggggggcactcggctcactatcacgggcgagaatctgggcctacgatttgaagacgtgcgcctgggagttcgagtcggtaaggtcctgtgctcacctgtggagagcgagtacatctctgccgaacaaattgtgtgcgagatcggcgatgcatccagcgtcagagcccacgacgctcttgtcgaggtttgcgttagggactgcagcccccattatcgcgccctttctcctaaacgattcacatttgtgacccctacattttatagggtcagtcctagccgcggtcccttgtcagggggcacctggattgggattgaaggctcccacctgaacgctgggagtgacgtcgctgtttccgttgggggacgaccctgcagctttagctggcgcaattcccgagagattcggtgcttaaccccaccagggcagagtcccggaagcgcaccaatcattatcaacattaatcgtgcgcagctgactaacccggaggtcaagtataactacacagaagatcccactatattacgtattgaccccgagtggagtatcaacagcgggggcaccttattgacagttaccggaaccaatctggctacggtccgcgaaccgagaatccgtgcgaagtatggagggattgagcgagaaaacggctgtttggtttacaacgatacgaccatggtttgtcgggctccgagtgtggcaaaccccgtaagaagccccccagaactgggtgagaggcctgacgagcttggctttgtgatggacaacgttcggtccctcctggtgctgaactcaacgtccttcctttactaccctgaccctgtgctcgagccccttagccccactgggctgttggagttaaagccatcatcccctctgatcctcaagggtcgaaacctgctgcctccagcgcctggcaatagccggcttaactatactgtcctgatcgggtcgactccgtgcactctgactgtcagcgaaacgcaactgctctgtgaggcccctaacctcacgggacagcataaagttactgtgagagcaggaggtttcgagttcagtccagggactctgcaagtgtacagtgatagcctgttaacactgcccgctattgtcggtatcggtggtggcggcggcctgttactccttgttatcgtggccgtcttaatcgcttataagaggaagagtcgcgatgcagatcggaccctgaagcggctccagctgcagatggataacttagagtcccgcgttgccctcgaatgtaaagaggcttttgccgagctgcagactgatatccacgagcttacaaacgacttggatggcgctgggatccccttccttgactaccggacctatgcgatgcgtgtcctcttccccggtattgaggatcatccggtgctgaaagagatggaggtgcaggcaaacgttgagaagtcgttgaccttattcggccagcttttaacaaaaaagcattttctactaactttcattaggacgctagaggcgcagcggtccttttcgatgagggataggggaaatgtggccagcctgatcatgaccgcactgcagggggagatggagtatgctaccggtgtcctcaagcaactcctgtcagatctcatcgagaaaaacctagaaagcaagaaccaccctaagttacttctgcggcgaaccgaatcagtcgcagagaaaatgctcactaactggttcactttccttctctacaaatttctcaaggagtgcgctggagagcccttatttatgctgtactgtgcaattaagcagcagatggagaagggaccaatcgacgcaataaccggtgaagcacggtattcactctcggaggataagcttattcggcagcaaatcgactataaaacactaacgctgaactgcgttaacccagagaacgaaaatgcgccagaagtgcccgtgaagggattggactgtgatacagtgacccaagcgaaggagaaactcctcgacgctgcatacaaaggcgtaccatattcccaacgacccaaggccgctgacatggatcttgaatggagacagggccgcatggcccgtatcattctgcaggacgaagatgtgaccaccaagatcgacaatgactggaaacgcctcaatacacttgcacattaccaggtcacggatggcagttccgtcgcacttgtccctaaacagactagcgcctataatatttccaatagcagtacatttaccaaaagcctgagccggtacgagtctatgttacgaacagccagttcccccgactctctgcgatccagaactccaatgatcaccccagacctcgagtcagggacaaaactctggcatctggtaaaaaatcatgatcacttagatcagcgagagggagaccgtgggtcaaagatggtgagcgagatctacctaactcgattgcttgcgacgaagggtaccctgcagaagtttgtagatgacttgtttgaaactattttttcaactgcgcacaggggctctgcactgcccttggcaatcaagtatatgttcgatttcctcgatgaacaggctgacaagcaccagatccatgacgccgatgtgcggcatacttggaagtctaactgtctgcccttgcgattttgggtgaatgtcatcaaaaatcctcaattcgtgtttgacattcataagaacagtattaccgatgcctgtctcagtgtagtggcccagacttttatggatagttgttccacctctgaacacaaactaggaaaggactccccctctaataagctgttgtatgccaaggacattcccaattacaagagctgggtcgagaggtattacgcagatattgccaagatgcccgcgattagcgaccaggatatgtccgcctacctggccgaacagagtcgactccatctttcccagttcaacagcatgtcagctctccacgagatctattcctatataactaagtacaaagacgagattcttgctgctctggagaaagacgagcaagccaggcggcagcgcttgaggagcaaactggaacaagtggtagatacgatggcactgtcatcctag

SEQ ID NO: 199839 - DNA, 5685 bp, Artificial Sequence
  Description of Artificial Sequence: Synthetic coding sequence
atggagcagcggcggccctggccccgggccctggaggtggacagccggagtgttgtactgctatctgtagtgtgggtcctcttagccccacccgctgctggaatgccccagttctccaccttccacagcgaaaatagagactggactttcaaccaccttacagtgcaccaaggaaccggtgctgtatacgttggtgcgattaatcgtgtatataagcttaccgggaaccttactatccaggtggcccacaagaccggtcccgaggaagacaacaagagttgttatcctccactaattgtgcaaccatgttctgaggtgttgactcttaccaataacgtcaacaaactgctgattatcgactattccgagaaccgattgcttgcctgcggatccctgtatcagggtgtgtgcaagcttttgagattggatgaccttttcatactggttgagccttcccacaagaaggaacactatcttagttccgttaataaaactggcacaatgtacggagtgatcgtgcgttccgagggagaggatggaaagctgtttatcggcacagccgtcgatggtaagcaagattactttcctactctcagcagcaggaagctcccccgcgaccccgagtcaagcgctatgcttgattatgagctgcactccgattttgttagctctttaatcaaaattccaagcgacacgctggctctcgtgtcccatttcgatatcttttacatttatggctttgcatccgggggctttgtgtactttctgacagtgcaaccagaaacccctgagggcgtcgctattaatagcgccggcgacttattctatacaagtaggattgttcgcctctgtaaggacgaccccaaattccatagctacgtgtctctgccttttggatgtacacgagctggagtggaatatcggttgttgcaggccgcttatctagccaaacccggagactctctggcccaggccttcaacattacctcgcaggacgacgtcctgttcgccatctttagtaagggccagaaacaatatcatcaccccccagacgactcagcactgtgcgccttcccaattagagctatcaacctgcaaatcaaggagaggctgcagagctgctaccagggcgagggcaacctcgagctgaactggctcctcggaaaagatgtccagtgcacgaaggctcccgtcccaatcgacgacaatttctgcgggctggatattaatcaaccccttggcgggagcacccccgtagaaggtcttacactgtacacaactagtcgcgacaggatgacgtctgtggcctcatatgtttataatggctatagtgttgtgttcgtgggaaccaagtccggcaagctaaagaagattcgagccgacggcccaccacacgggggcgtccagtatgagatggtgtctgtgcttaaggacgggagcccaatactgcgggacatggcgtttagtatcgaccagagatacttgtacgtcatgagtgaacgccaagttactagagtgccggttgaaagctgcgaacagtataccacttgcggggagtgtctgtcgtccggagatccccactgtggctggtgcgcccttcacaatatgtgttcaaggagagataaatgccagcaagcatgggagccaaacagattcgccgcctctatctcccaatgtgtttctctcgcagtgcatcctagttctatcagcgttagcgagcatagccgcctcctgtccttagttgtctccgatgcccccgatctgtctgccggcatcgcatgcgcatttggcaacctgacagaggtggagggccaggtgagcgggagtcaagtgatatgcatttctcctgggcctaaagacgtcccagtcattcccctcgatcaggattggttcggtctcgagctgcagctgagaagtaaggagactggaaaaatctttgtgtctactgagttcaagttctacaactgttccgctcaccaattgtgcttaagttgtgttaactccgcctttagatgccattggtgcaagtatagaaacctgtgcacacacgaccccacaacctgtagcttccaggagggacgaatcaatatttcggaggactgcccccaactcgtcccgaccgaggaaattttaattcccgttggcgaggttaagcctatcaccctgaaagcccggaacctgccgcagccccagagcggacaaaggggatacgagtgcgtgctgaatatacagggagccattcaccgcgtgccggcgcttcggtttaattcctccagcgtgcagtgccagaacagttcctaccagtatgatggaatggatatttcaaacctggctgtggatttcgctgtggtctggaacgggaatttcattattgataatccgcaggatttgaaagtccatctgtacaaatgcgccgcgcagagggagagttgtgggctctgcctcaaagccgaccgtaagttcgagtgtgggtggtgctccggcgaaagacgctgcacattgcatcagcactgcactagccctagttcaccctggctggactggagctctcataacgtgaaatgttccaacccgcagatcactgaaatcttaacagttagcggccctccagagggagggacgcgggtgactatacacggcgtgaaccttgggttagattttagtgagatcgcgcaccacgtgcaagttgccggcgtgccatgcacccccctgcctggggaatatataatcgccgagcagattgtgtgtgagatggggcatgccctggtcggaaccacttccgggcccgtgaggctgtgcattggcgaatgcaagccagaattcatgactaagagccatcagcagtatactttcgtgaatccatctgtcttgtctttgaatccaatccgagggccagagagtggaggcaccatggtgaccataacaggtcactacttgggagcagggtcctccgtggcagtttatttggggaatcagacttgtgagttctatgggcgctctatgtccgaaattgtatgcgtgagccctccatcctcaaatggcctgggcccggttcccgtcagcgtgtccgtggaccgcgcccacgtagactcgaatctgcagtttgagtacatcgacgatcctagagtacaaaggattgagccagaatggtctatcgcctcaggccacacccctcttacaattacaggtttcaatctggatgttatccaggagccccgaattcgagtcaaatttaatgggaaggagagcgtcaacgtctgcaaagttgtgaatactaccacgttgacatgccttgcgccttctctgacaaccgactacaggccaggactcgatacagttgaacggcccgatgagtttggttttgtgttcaacaacgtgcagtctctgctgatctacaacgataccaaattcatttattaccccaatcctacatttgagttgttatcgcccaccggagtgcttgatcagaagccagggtccccgatcattctcaaaggaaagaatctctgccctccagcatccggaggagcgaaactgaattatactgttctgataggtgagactccctgcgctgtaaccgtgtcggagacccagctgctttgcgaacctccaaaccttacaggccagcataaagtcatggtgcatgtggggggcatggtgttctcgccagggtcagtttcagtgattagcgactcattactgactctgccagccatagtcagcattgcagccggcggcagtttgctgctgatcattgttattatcgtactgatagcttataagagaaaaagtagagagaatgatcttactctgaagagactgcagatgcagatggacaatctagaatctcgggttgcattagaatgcaaggaggcattcgctgagctgcagacagatattaacgaattgacctcagaccttgaccgttccgggatcccatacctggattaccgcacctacgcaatgcgcgtgctcttcccgggaatcgaagaccatcctgtcctccgggagttggaggttcagggcaacggtcagcagcatgtggagaaagcactgaagctatttgcgcagctcatcaacaataaggtgtttctgctcacatttatccggacccttgaactgcagcgaagtttcagcatgcgagacaggggcaatgtcgcttcattgataatgactggtttgcaaggcagactggaatatgccactgacgtgctgaaacaactgctgtccgacctgatcgacaaaaacctcgaaaataagaaccacccaaaactgctgctgagacgaacagaaagcgtggcggagaagatgctgaccaattggtttgcttttctgctgcacaagttcttgaaggagtgcgctggagagcccctctttatgttgtactgtgcaatcaagcaacagatggagaaggggccaatcgatgccatcaccggagaagctcggtacagtctgagtgaagacaagcttatcaggcagcaaatcgaatacaagacattaatcctgaactgtgtcaaccctgataatgagaacagtccagaaattccggtgaaagtgctcaactgcgatacaatcactcaggttaaggaaaaaatcctcgatgccgtctataaaaatgtgccatactcccagaggccaagagcagtggacatggacttggagtggaggcaggggaggattgcacgcgtggtgctccaggacgaagatattaccactaagattgaaggtgactggaaaaggctcaatacgctgatgcactaccaggtgagtgacaggagtgtggttgcgctggtaccaaaacagacctctagttacaatattcccgcgagcgcctctatatcccgaacatctatttctcggtacgattcctcattccgctatacgggaagccccgatagcctgaggagccgtgctcctatgatcacacctgatctcgaatccggtgtgaaggtgtggcatctggtgaaaaatcacgaccacggagaccagaaggagggggatcgtggcagtaagatggtgagcgaaatataccttacccgactgctggctaccaagggaaccctgcagaaatttgttgatgatctgttcgagacccttttcagcaccgtacaccgtgggagtgccctgccacttgccatcaaatacatgtttgacttcctggatgaacaagctgaccgccattctattcatgacactgacgtgagacacacctggaaatcaaactgtcttcccctgcgattttgggtgaatgttataaaaaacccacagtttgtgtttgacatccataaggggagcataacggatgcatgccttagcgtggtggcccaaaccttcatggattcatgctcaaccagtgagcacagactgggtaaagactcaccctccaataagctgctttacgccaaggatatcccttcttataagtcctgggttgaaagatattacgctgatatcgccaaacttcccgccattagtgatcaggatatgaatgcgtacctcgcagaacagagtagactgcatgcagtcgaatttaacatgttgtcagctcttaacgaaatctattcttacgtgtccaagtactccgaggagttaatcggtgcccttgaacaggacgagcaagcacggcgccagcggttggcgtacaaagtggagcagctgatcaatgccatgtcaatcgaatcttag

SEQ ID NO: 199840 - DNA, 5685 bp, Artificial Sequence
  Description of Artificial Sequence: Synthetic coding sequence
atgaaggccatgccctggaactggacctgcctgctgagccacctgttgatggtgggcatgggctcctcaaccctgcttactcgccaacccgctcctctttcccaaaaacaaagaagcttcgtcacctttagaggcgaaccagccgaaggtttcaaccacctggtagtggatgagcgcaccggccatatctatctgggtgcagtcaaccgaatttataagctctcctccgatcttaaagttcttgtaacacacgagaccgggccagacgaagataacccgaaatgctacccgccccggattgtccagacctgtaatgagcctctcactaccacaaacaacgtcaacaaaatgttactcatcgactataaggagaatcgcctgatcgcctgcgggagcctttatcaaggtatttgtaagctcttgaggttagaggatttgtttaagctaggtgagccttatcataagaaagaacattatctgtccggtgttaacgaatctggtagcgttttcggcgtgattgtctcatactcaaaccttgacgataagctctttatcgcgacagccgtcgacgggaagcctgaatacttccctaccattagctcacgcaagctgaccaaaaactccgaagcggacggcatgttcgcttacgtcttccacgacgaatttgtggcctccatgattaagatcccatccgacaccttcaccattatcccggactttgatatctactatgtgtacggattttcttccggaaacttcgtgtatttcctcactctgcagccagaaatggtcagcccaccaggatccacaacaaaagagcaggtgtatacatccaagctggtgcggctatgcaaggaggataccgccttcaactcctacgtggaggtgcctattgggtgtgaaagatctggggtggaatatcgtctcttacaggccgcgtatttgtcaaaggctggcgccgttcttgggaggacgttaggagtacacccggatgatgatctcctgtttacagtgtttagtaaaggccagaagaggaagatgaagtcgttggatgagagtgctctctgcatttttatcctgaagcaaatcaatgaccgaatcaaagagagattgcagtcttgctatcggggtgaaggcactctggatctcgcctggcttaaggttaaagacattccgtgtagctcagccctgctgaccattgatgacaacttttgtggcctcgatatgaacgcccccttgggcgtgagcgacatggtacgtggcatcccagtatttacagaagatcgcgatagaatgacttcagtgatcgcttacgtgtacaagaatcattctctcgccttcgttgggaccaaaagtggaaagttgaaaaaaatcagggtggatggcccaagaggcaatgcgctccaatatgaaactgtgcaggtcgtggacccggggccagtcctgcgagatatggcctttagtaaggaccatgagcaattgtacatcatgtctgagagacaacttacccgagttccggtcgaatcgtgcgggcagtatcagagttgtggtgagtgcttaggctctggggatccccactgtgggtggtgcgtcttgcacaacacatgtacccgtaaggagcgctgcgagcgtagtaaggaaccccgcaggttcgcatcggaaatgaaacaatgtgtccgtttgaccgttcatcctaacaacatctcagtgagccagtacaatgtcctattggttctagaaacatacaatgtgcctgagctatccgctggggtcaattgtacctttgaggacctgtctgaaatggatggactggtcgttgggaatcaaattcagtgttactctccagccgctaaggaagtgccaaggatcattacagagaacggagatcaccatgtggtccagttacagttaaaaagcaaagagactggaatgacatttgcctctacctcattcgtgttctacaactgctcagtgcataattcatgcctgtcctgcgttgagagtccataccggtgccactggtgtaagtatcgccatgtgtgcacccatgatcccaaaacgtgctcctttcaggagggacgcgtgaagcttccagaagattgccctcagctactccgtgtggacaaaattctggtgcctgtcgaagttattaaacctatcactctcaaggctaagaacttaccacagccacagtcagggcagcgcggttatgaatgcatcctaaatattcaaggttcagagcagagggtgcctgccctgagatttaattcttcgtccgtgcagtgccagaataccagttacagctacgaggggatggagatcaacaatttaccagttgagctgacggttgtctggaatgggcactttaacattgacaatcccgctcagaataaggtgcatttatataaatgtggggccatgagagaaagctgtggattatgtctgaaggccgaccctgattttgcctgcggatggtgtcagggtcccggccaatgtaccttaaggcagcactgtcctgcacaggaatcacagtggttagaattgtctggagcaaaaagcaaatgcacgaaccctagaatcacggaaattatccctgtgactggcccaagagagggaggtacaaaggtcaccattaggggagagaacctcgggttggaatttagagacattgcctcacacgtcaaagtggctggggtggaatgctccccgctagtcgatggatatatcccagccgaacagatcgtctgcgagatgggagaagccaaaccatctcagcacgctggctttgtcgagatctgtgtggctgtttgccgacccgagttcatggcccgctctagccagctgtattatttcatgaccctcactctgtcagatctgaagccttccagggggcctatgtcaggggggacacaggtcacgattacaggaactaacctgaatgctggcagcaacgtagttgtgatgttcggaaaacagccttgtctgtttcaccggcgcagtccaagttacatcgtatgtaataccacatcctccgacgaggtgctggaaatgaaggtgtcagtccaggtggaccgggctaaaattcatcaggatctggttttccagtatgttgaagatcccaccatagtgaggatcgagccggaatggagcatcgtgtccgggaacacgcctatcgccgtgtggggcacccatctagatctaattcagaatccccagatccgtgccaagcatggggggaaggagcacattaacatatgtgaagtcctgaatgctaccgagatgacctgtcaggctccagccttggctctcggacccgatcaccagtccgacctcactgagagaccagaagagttcggtttcatactggacaacgtgcaaagccttctcatcctgaataaaaccaactttacatactaccccaacccggtcttcgaggccttcgggcctagtggcatcctggaactaaagcctggtactccaataattctgaaaggaaaaaacctcattcccccagtcgcagggggaaatgtgaaacttaattacactgtcctggtgggtgagaagccttgcacagtaactgtgtctgacgtgcagctgctttgcgaatcacctaacctgattggtcggcataaagtgatggctcgggtcggcggtatggagtactcgccagggatggtgtatattgcgcctgactcaccgctgtcgctccccgccatcgtgtccatagctgtggcaggaggcttgctgataatcttcatcgtggccgtcctgattgcctacaaacgcaaatcaagagagtctgacctgacactgaagcgtctccagatgcagatggataatttggagtcccgggttgcgttagaatgcaaagaagcctttgcagaactgcaaacagatatccatgaactgacttccgatctggatggcgcaggcatccccttcctggactacaggacctacactatgcgtgttttgtttcccggtattgaggaccacccagtgctgcgcgatcttgaggtccccggctacagacaagaaagggtggagaaaggattgaaactattcgctcagcttatcaataacaaggtgttcctgctctctttcatcagaaccttagagtctcagcgctccttttcaatgcgtgatcgcggcaacgtcgccagcctaatcatgaccgtgctgcaatcaaagttggagtacgccaccgatgtactgaaacagctgctcgccgatctgattgataaaaatctcgagtctaagaaccacccaaagctcttgctcaggcgcacggagagcgtggctgaaaagatgctgacaaattggtttaccttcttgctttataagttcttaaaagaatgtgcaggggaacccctctttagcctattttgtgccattaaacagcagatggagaaggggccgatcgacgccatcaccggcgaagcacgatattctctgtctgaggacaagctgattcgacaacagatcgattacaaaaccctagtactaagctgcgtgagccctgataacgctaattcccctgaggtgccggtaaaaattctgaactgtgacaccataacacaggtcaaagaaaaaatcctcgacgcaatcttcaagaacgtcccttgctcccatcgtcccaaggcagctgatatggacctcgaatggagacaggggagcggtgcgagaatgattctgcaggacgaagatatcaccaccaagattgagaatgattggaaacggctgaataccctcgcacactaccaagtgccagacgggtccgtggtggctcttgtttctaaacaagtgaccgcctataacgcagttaataactcaaccgtgtctcgtacctcagcctcaaaatatgagaatatgattcgatacaccgggtccccagactccctccgttcccggacgcccatgatcacacccgatctcgagtctggcgtgaagatgtggcatctcgtgaagaaccacgaacatggggaccagaaggagggagatcggggttccaaaatggtgtcggagatctatttaacacgactgctggcaaccaagggcactctacagaagttcgtggatgacctttttgagaccattttttccacagcacatagaggatccgccttgcctctggcaatcaagtatatgttcgactttctggacgagcaagccgacaaacacggcatccatgatcctcatgtacgacacacctggaaaagcaattgcctccctctaaggttttgggtaaatatgataaagaacccccagttcgtgttcgatatacataagaatagtattaccgacgcttgcttgagtgtggttgctcagacctttatggatagctgctcaacgtctgaacaccgactcggtaaggacagtccatcaaataagctcctctacgcaaaggatatccctagctataagaactgggtcgaacgatattattccgacatcggaaaaatgcccgcgataagcgatcaggatatgaacgcctatttggccgagcagagtcgcatgcatatgaacgagtttaacactatgagtgccttatcagagatttttagttacgtcggcaaatacagcgaggagatcttaggtcccctggatcacgacgaccagtgcgggaaacaaaagcttgcctataagttggagcaggtcatcacactgatgagcctggatagttag

SEQ ID NO: 199841 - DNA, 5685 bp, Artificial Sequence
  Description of Artificial Sequence: Synthetic coding sequence
atgaaggccatgccctggaactggacctgcctgctgagccacctgctcatggtcggaatggggagcagcactttgctgactcgacaacccgcccctctgtctcagaagcagcgctcttttgtgactttcagaggagaacctgcagaaggattcaaccacctcgtcgtcgatgaaaggacaggccacatctatctcggtgctgttaatagaatttacaaactcagctctgatctgaaggtgctggtcacacatgagacaggacctgacgaagacaacccaaagtgctacccaccgcgtatcgtgcaaacttgcaacgaaccgctgactaccactaacaacgtcaataagatgttgctgattgattacaaggagaaccgccttattgcttgtggatccttataccagggaatctgcaaattattgcgattggaagatttgttcaaactaggagagccttaccacaagaaagagcattacttgtctggagtgaatgaatccggctctgtgttcggagtcatagtatcttacagcaacctggatgacaagcttttcatcgctactgccgttgacggcaaaccagaatatttccctactatctcctcacggaagcttaccaagaactcagaggccgatgggatgtttgcttatgttttccacgacgaatttgtggctagcatgatcaagatcccctcggatacctttactattataccagactttgacatctactacgtgtatggattctctagtggtaactttgtatatttcttgacgttgcagcccgagatggtgagccccccgggcagcacaaccaaggagcaggtgtacacctccaaactggttaggttgtgtaaggaggataccgctttcaatagctacgtcgaggtgcctatcgggtgtgagaggagcggagtcgagtaccgccttttacaggccgcttaccttagtaaggcgggggcggtcctgggacgcacactcggagttcaccctgatgatgacctgctcttcacagtgttcagcaaaggacagaaacggaaaatgaagtccctagacgagtcagctttgtgcatcttcattctaaagcagataaatgatagaatcaaggaacggcttcagtcctgctatcggggcgagggaacgcttgacctggcttggttaaaggtaaaagatatcccctgttcttctgcattgctcaccatagatgataacttttgtggcttggacatgaacgcgcctctcggtgtatccgacatggtgcgaggtatcccagtgttcaccgaggaccgcgataggatgactagtgtcattgcctatgtgtataagaaccacagcctggcgttcgtgggaacgaagagtggcaagttaaaaaagatcagggtcgacggacctaggggtaacgctctgcagtatgagaccgtacaagtggtcgatcccggcccggttctccgtgatatggcattttcaaaagaccacgagcagttatacatcatgagcgaacggcagctcacgagagttcctgtggagtcttgcggccagtaccagagctgcggtgagtgcctcggatccggagatccacattgtggctggtgcgtgttacacaacacttgtaccaggaaagaacggtgcgagcgctccaaagagccgcgtcgttttgctagtgaaatgaaacagtgtgttagactaaccgttcatcccaataatattagtgtttcacagtacaacgtactcctggtgctggaaacgtataatgttcctgagcttagcgcaggcgtgaattgtacctttgaggatttaagcgaaatggatggtttggttgtgggtaatcagatccagtgttatagccccgcagccaaagaagtaccgagaatcatcacagaaaacggcgaccaccatgtcgtgcagttgcagctgaaatccaaggaaacaggaatgactttcgcgagcacgagcttcgtcttttataattgttcagtgcacaatagctgtctgtcttgtgtcgaatcaccatacaggtgtcattggtgtaaatatcgtcacgtctgtacccatgaccccaagacttgctccttccaggagggcagagttaagctaccagaagattgcccccaacttttacgcgtcgacaagatcctagtgcccgttgaagtcatcaagcccattactctgaaagcgaaaaacttgccgcaaccccaatcaggtcagcgcggatatgagtgtatattgaacatccaggggtctgaacagagggtcccagctcttagatttaactcctccagcgtgcaatgccaaaatacctcgtacagctacgagggaatggagatcaataacctgccggttgaattgaccgtagtctggaacggtcatttcaacatagacaacccagcgcaaaataaggtccacctatacaaatgtggcgccatgagggagtcttgcggattgtgtctcaaggcagatcctgacttcgcctgcggttggtgtcagggcccaggacagtgtacactgagacagcactgtccagcccaagagtcacaatggctggagctttccggcgccaagagtaagtgcaccaatccccgaattaccgaaataataccagttaccggtccccgggaaggagggaccaaggttactattagaggagagaatttggggctggagttcagagacattgcatctcacgtgaaggtggccggagtggaatgctccccgcttgtggacggctatatccctgctgaacagatagtgtgtgagatgggagaggccaaaccatctcagcacgcagggtttgtggaaatttgtgtggcggtgtgtcgacccgagttcatggcccggtcctcccagctctattacttcatgaccctcaccctttctgatctgaagccatctagagggcccatgagtggtgggacccaggtcaccattacaggaactaacttgaacgctggatccaatgtggtggtgatgttcggcaagcaaccttgcctgtttcaccggaggagcccatcctatatcgtttgtaataccacttctagtgacgaagttttggagatgaaggtgagtgttcaggtcgacagagccaaaattcaccaggacctggtgtttcagtatgtcgaagatcctaccattgtgcgaattgagcccgagtggagcattgtgagcggtaatacgcctattgcggtttggggcacacatctagatttaatccaaaatccacagattagagcaaagcatggagggaaagaacacatcaacatctgtgaagtcttgaatgctaccgaaatgacctgccaagcgccagccctggccctgggccccgaccaccagtccgatctcactgagaggccagaggagttcgggtttatcctggacaatgtgcagagtcttcttatactgaacaaaacaaacttcacttattatcctaaccctgtttttgaagcctttgggccttcagggatactggagctgaaacctggcacccctatcatcctcaaaggaaagaaccttatccccccagtggcgggtggaaatgttaaactcaattacacggtccttgtgggcgaaaagccatgtacagtgaccgtctcagacgtgcaactgctttgcgaatccccaaacctcatcggcaggcataaggtcatggctcgtgtgggtggaatggagtattctcctggaatggtgtatattgcacccgactcccctctttctttacccgccattgtctctatagccgtggccggcggactgctgatcatctttattgtcgcagtgcttatcgcgtacaaacggaagagccgtgagtcagaccttacccttaagcggttacagatgcagatggacaacttggaatcccgggtggctctcgagtgtaaggaagcctttgctgaactccagactgacattcatgagctgactagtgaccttgacggtgcagggatacccttcctggactatcggacatataccatgagggtcctttttccaggaattgaggatcacccagtcttgagggacttggaggtgccggggtatcgacaagagagggttgagaagggacttaaactgtttgcgcaactgattaacaacaaagtttttctccttagctttataagaaccctggagagtcaacgttccttcagtatgagggaccggggcaacgtggcgtctcttataatgacagtgttgcaaagtaagctggaatatgcaacggatgtcctaaagcagctcctggcggatctgattgacaaaaatctggaatctaaaaaccatcctaagctcctgcttcgccgcaccgaatctgtggccgaaaaaatgctgacaaattggtttaccttcctcctgtataagttcctcaaggaatgtgcaggcgaaccgctctttagcctgttctgtgccataaaacaacagatggagaagggcccaattgatgccattacaggggaggcgcgatacagtctttcagaagataaactcatccgtcagcagatagactacaaaactcttgtcttaagttgtgtgagtcccgacaatgcaaattcacctgaagttccagtcaaaattcttaactgcgatacaatcacacaagtaaaggaaaaaatcttggatgccattttcaagaacgtcccttgttctcaccgacccaaagcggccgacatggatctggagtggaggcagggttctggcgcgcgcatgattcttcaggatgaagacatcaccacaaaaattgagaatgactggaagcgattaaataccctggcccactaccaggtgcccgacggatctgtcgtggcattagtatctaaacaagtgacagcttacaacgcagtcaacaactcaactgtctcgcggacaagcgcatccaaatacgaaaacatgatcagatataccggctcgccagactcacttcggagcagaacccctatgattacccccgacctggaatctggagtgaaaatgtggcacttggtgaaaaatcacgagcacggtgaccagaaggagggcgatcgtggctcaaagatggtgtccgagatctatctgacgcgcctgttagctacgaagggtaccctacaaaaatttgtcgacgatttatttgaaacaatcttctctaccgcgcatcgtggttctgcgctgccactggcaattaaatacatgtttgattttctcgacgagcaagcagataaacacggcattcacgaccctcacgtgaggcacacctggaagtctaattgcctacctctccgtttctgggtcaatatgattaagaatccccaatttgtatttgatatccacaaaaattccatcactgatgcttgcttgagcgtggtggcccagaccttcatggactcctgtagtacttcagaacacaggctgggaaaagatagcccatcaaacaagctactctacgctaaagacatcccttcttataagaactgggtggagcgatattactcagatatcggaaaaatgcctgccataagcgaccaagacatgaatgcataccttgccgaacaaagccgcatgcacatgaatgaattcaatactatgtcagcccttagcgagatcttcagctatgtgggcaagtatagcgaagagattcttggtcccctcgaccatgatgaccaatgtgggaaacagaaactggcttacaagttggaacaggtcattacactgatgtccctcgattcgtag

SEQ ID NO: 199842 - DNA, 1569 bp, Artificial Sequence
  Description of Artificial Sequence: Synthetic coding sequence
atgaaggccatgccctggaactggacctgcctgctgagccacctgctaatggtcggtatgggttcctctacattgctgacccggcagccagccccgttgagccagaagcagcgctctttcgttactttccgtggggaaccagctgaaggttttaatcacctcgtggtcgacgagagaacaggtcacatctacctcggcgccgtgaaccggatttataaactgtcttccgacttgaaggtgctcgtcactcatgagaccggccctgacgaagacaatcctaaatgctatccacctcggatcgtgcagacatgcaatgaaccacttactaccacgaataatgtaaacaagatgttgttaatcgactacaaggagaaccgtttaatcgcttgcggaagcctctatcagggcatctgtaaactcttgcgcttagaggatcttttcaaactgggcgaaccttaccacaagaaggagcactacctcagcggggtgaacgagagcggcagcgtgtttggtgtgattgtttcatacagcaatttggatgataaactgtttatcgctacggctgtcgatggaaagcctgagtattttcccacgatctcctcaaggaaactcaccaagaattcagaagccgacggaatgttcgcctacgtgtttcacgacgaattcgttgcttccatgattaagatcccgtctgacacctttaccatcatccctgatttcgatatctattacgtatacggattttcttccggaaacttcgtttattttttgacactgcaacccgagatggtgagtccccccgggagtaccaccaaggagcaggtttatacctccaagctggtccgtctttgcaaggaagatactgccttcaatagttacgtggaagttccaattggatgcgaacggtccggggtggaatatcggttgctgcaggcagcttatctgtccaaagccggtgctgttctgggccgtactctaggagtccacccagacgacgatctcctttttacagtcttttcaaaaggccagaaaaggaagatgaagagcttggacgaatcagcactttgcatatttatactgaagcagatcaacgataggatcaaagagcgccttcaatcctgttaccgtggcgaggggacattggatttggcctggctcaaagtgaaggatatcccctgttcctctgccctgttgacaatcgacgataacttctgtggactggacatgaacgcgccacttggcgttagtgacatggtacgcggcatccccgtgtttactgaggatcgggacaggatgacttccgtaatcgcttacgtgtacaaaaatcattctctagccttcgtaggcactaaatctggtaaactaaaaaagagttttggtactggaccccagggcggcattacccaggaatggattggcgtggagggggaccctccaggcgccaatatcgcctcccaagagcagatgctctgcgtgtacctgcagtgctcttcccataaggccatttccgaccaaagggtgcagccactcctctgttgctttcttaacgtccccggtaactctagttag

SEQ ID NO: 199843 - DNA, 1479 bp, Artificial Sequence
  Description of Artificial Sequence: Synthetic coding sequence
atgaaggccatgccctggaactggacctgcctgctgagccacctgctaatggtgggtatgggatcttccactctgctgacacgacagcctgcccctctatcacagaaacaacgctctttcgtgacctttcgaggcgagccagctgaggggtttaatcacctggtcgtggacgagagaactgggcacatttacctcggagccgtcaataggatctacaaactatcttcagatttgaaagtcctcgtcacacatgagacgggcccagatgaagacaacccaaaatgttatccccctcgtatcgtccagacttgcaatgagccgctcaccactacgaataatgtgaataaaatgttactgattgactataaggagaatcggttaatcgcctgcggcagtctgtatcaggggatatgtaagcttttacgcctggaagatctgttcaagctgggggagccttatcataagaaggagcattacctgtcgggcgtgaatgagtccggttccgtgtttggagtgattgtgtcgtactctaacctcgacgacaaattatttatcgccactgccgtcgacgggaaacccgagtattttccgacaatctcttctaggaagctgaccaaaaattccgaagcagacggcatgtttgcctatgtgttccacgacgaatttgtggccagtatgattaaaattccgtctgacacattcaccatcatcccagactttgacatctattatgtctatggattctcttcaggaaactttgtgtattttttaacactccagcctgagatggtgtccccacccggaagcaccacaaaggaacaggtctacacttccaaactggttagactctgcaaagaggatacggccttcaacagctacgtcgaagttcctatcggctgcgagagatccggcgtggaataccgtcttcttcaggcagcgtacctgagcaaggcaggtgccgtgctgggacggactctcggggtgcaccctgatgacgacctgctgtttacagtgtttagtaagggtcagaagcgcaaaatgaagagtcttgatgagtctgctttgtgcatcttcattctgaagcagattaacgataggatcaaagagcgactgcagagctgttaccgcggcgagggcactctggatctggcatggttaaaggtgaaggacattccctgctcatccgctctattaactattgacgacaatttttgcggcctggatatgaacgccccattgggcgtgagtgatatggtgagggggattcctgtgtttaccgaagaccgcgaccgcatgaccagtgttattgcctacgtatataaaaatcactcgcttgccttcgtggggacaaaaagcggcaaactgaaaaagatgcctggtacttctctgtgccctactttggagttacagaccggacccaggtcccacagggctactgttacactggaactgctgttctctagctgtagttccaactag

SEQ ID NO: 199844 - DNA, 5517 bp, Artificial Sequence
  Description of Artificial Sequence: Synthetic coding sequence
atggccctgcagctgtgggccctgaccctgctgggcctgctgggcgccggagcttccttgcggcctcggaagttggacttttttagatcggagaaggagctgaatcatctcgccgtcgacgaagccagcggtgttgtctatctcggagccgtgaatgccctgtaccagctggatgccaagttacaactcgagcagcaggtcgcaactggaccagccctcgacaacaagaaatgtacaccgcctatcgaggcatcccagtgccacgaggctgagatgaccgataacgtcaaccaactgctcctactcgaccccccccgaaagcgtctagtggagtgcggatctctgttcaaaggtatctgcgccctcagggcactcagcaacatttctctgcggctgttctacgaagatggttcgggggagaaaagcttcgtcgcctcgaatgacgaaggtgtggctaccgtgggtctggttagttccaccggtcccggaggcgatagagtactgttcgttggtaaaggtaacggccctcatgacaacggaataatagtgtccaccaggcttctagatagaacagacagtagggaagcgtttgaagcctacactgatcacgccacctacaaagccgggtatctgtctactaatactcagcagtttgtcgcagcttttgaggacgggccctatgttttcttcgtgtttaaccagcaggacaagcatcctgcccgcaacagaaccctgttggccagaatgtgcagagaggacccaaactattattcctatctggaaatggatctccagtgcagggacccagatattcacgcagctgcatttggaacatgtctggccgcgtctgtggccgccccaggatcgggaagagtcctgtatgcggtgtttagccgagactctagatcttccggcgggcccggagccgggctatgtctttttcccctggataaagtgcacgctaagatggaagcaaaccggaatgcctgctatacaggcacaagagaagcccgggatattttctacaagcctttccatggcgatatacagtgcgggggccatgcacccggatctagtaagtccttcccgtgtgggtccgagcatctgccctatccactagggtctagagatggactaagaggcaccgcagtcctgcagaggggtggattgaatctaaccgccgtcacggtcgcggcggagaataatcacacagtagccttcctgggcacatccgacggaagaattttgaaggtgtacctcacacccgacggtacctcttctgaatatgactccattctggtcgaaattaacaagagggttaaacgggacctggtgttgagtggcgatttaggcagtctctacgccatgacgcaagacaaagtgttccgcctacctgtacaggaatgcctgtcttatccaacttgtactcaatgccgcgactcccaggacccctactgcggatggtgcgtcgttgaaggaaggtgcactcgtaaggctgagtgtcctcgagcggaagaggcatcccattggttgtggtcccgaagcaagtcctgcgtggccgtaacgtcagcgcaacctcagaacatgtcaagacgcgctcaaggagaagtgcagctgacggtgagtcctctgcctgccttgagcgaggaggacgaactgctttgcctttttggggaatccccgccgcaccctgccagggtggagggagaggcggtgatttgcaattcacctagctctatccctgttactccccccggtcaagaccatgttgcagtgaccatccaattgcttctccggcgcggaaacatatttctgaccagttaccagtaccccttttacgactgccggcaggctatgagtcttgaggagaatctgccgtgtatctcatgcgtgtccaataggtggacctgtcagtgggacctcagatatcatgagtgccgcgaggcctctccaaatcctgaggatggaattgtacgggcccacatggaagactcctgtccccagttcctcggtccatctcctctagtgatccctatgaatcatgaaaccgacgtcaacttccaaggcaagaacctagataccgttaagggctcaagtttacatgtcggcagtgacttgctgaaatttatggaacccgtaacaatgcaggagagtggaacttttgcgtttcgcacccctaaactttctcatgacgctaacgagacactacccctgcacctttacgtgaagtcatacggcaagaacattgactctaaactccacgtgactctgtataactgcagctttggccgctctgattgcagtctgtgccgggccgctaatcccgactacagatgtgcatggtgtggcgggcagtcccggtgtgtttacgaggccttgtgcaacaccacatcggagtgcccacctcctgtgatcacaaggatccaaccagagactggtcctctcggaggcgggattagaatcaccatacttgggtccaatttgggcgtccaggccggtgatattcaacggatcagcgtggccggtaggaactgcagcttccagcccgagcgatattcagtaagtacaaggatcgtatgcgttatcgaagcggctgaaacacctttcaccggaggagtggaggtggatgtcttcggcaagctcggccgttccccaccaaacgtacagttcacctttcagcagccaaaacctctatcagtggagccccagcaggggccacaagccgggggtaccaccctaaccatccacggaactcacttggacaccggtagccaagaagacgtaagagtcacactgaacggtgtgccatgcaaagtgacaaagtttggcgctcagttgcagtgtgttacggggcctcaagcgactagggggcaaatgcttctggaggtgagctacggagggtcccccgttccgaaccctgggatcttcttcacatatcgggaaaatcccgtgctcagagctttcgaaccgcttagatctttcgcctccggtggacgctctatcaatgtaacagggcagggatttagtctgatccagcggttcgccatggtagtgatcgcagaacctttgcagtcttggcaacctccaagagaggcagaaagcctccagccaatgacagtggtgggaaccgactacgtgttccacaatgataccaaagtcgtcttcctatcacccgccgtgccggaggaacccgaagcctataaccttactgtgcttatcgaaatggacggccaccgcgccctattgcgaaccgaggcgggcgcttttgaatacgtgcccgatcccacttttgagaattttaccggcggagtcaaaaagcaggtgaacaagctgattcatgctcgcggaacaaacctgaataaggccatgaccctgcaggaggccgaggccttcgtcggcgctgagagatgcacgatgaaaacccttacagaaacggatctctattgcgaacctccagaggtgcagccacccccaaaacggagacagaagcgggacaccacacataacctgccagaatttattgtgaagtttgggtccagggagtgggtgctcggaagggttgaatatgatacaagggtatcagatgtcccactaagcctcatacttccactagtgatcgtgcctatggtcgtggtgatagctgtgtccgtgtattgctattggcggaaatcccagcaagcagagcgggagtatgagaagatcaaaagccagcttgaaggactggaggagagtgtccgggataggtgcaaaaaggaattcacggacctgatgattgagatggaggaccaaacaaacgacgtgcacgaggccggaatcccagtcctggattataagacatacacagatcgagtttttttccttcccagcaaggacggagataaggatgtgatgatcacggggaaattagacatcccagagcctagaaggcctgtggtggagcaggctctctaccaattttctaatttattgaactctaagagcttcctgataaattttatccacaccctggaaaaccagcgcgagttcagcgcaagagctaaagtgtatttcgcgtctctgctgactgtcgcattgcatggcaaattggagtattatactgatataatgcataccctgttcctggagctgctcgagcagtatgtggttgctaagaatcctaagctgatgctacgccgatccgagactgtggtggagagaatgcttagcaattggatgtcgatctgcctgtaccagtacctgaaagactctgcaggagaaccattatataagctgtttaaagcaatcaaacaccaggtggagaaggggcccgtggacgcggtgcagaagaaagctaagtacacactcaatgataccgggcttctaggggacgatgtagaatatgcccctctgaccgttagcgtaatcgtgcaagatgaaggggttgacgccatcccggttaaagtgctcaattgtgataccatatcgcaggtaaaagaaaaaatcatcgaccaagtctatagggggcaaccctgcagctgctggccacggcccgactccgtggtgcttgagtggcgcccgggctccacggcccaaattctgagtgaccttgatcttacctcacagcgggagggtagatggaagcgcgtgaatacgctcatgcattataacgtgcgggacggagccaccctcatactgtcaaaggtgggcgtctctcagcaaccggaggacagccagcaggacctgccgggggagaggcatgccctgctggaagaggaaaaccgcgtgtggcatctcgtgcgccctaccgacgaagtggacgaaggcaaaagcaaaaggggctcagtgaaggaaaaggagcgaaccaaggctatcactgaaatatacttgacccggttactgtctgtcaagggaacactgcaacagttcgtggataacttcttccaaagcgtgttagctccaggacatgccgtgcccccagcggtcaaatacttcttcgattttctcgacgaacaagccgagaaacataatatccaagacgaagacactatccacatctggaagacgaattctctgcccctcagattttgggtcaacatccttaagaatccccacttcatttttgatgttcacgtccatgaagtcgtggatgccagtctcagcgtgatcgcacaaacgttcatggacgcatgcactcgcactgagcataaactcagccgtgatagcccgagcaacaaactgctttatgccaaggagatttcgacctacaagaagatggtcgaggattattacaaaggcataagacagatggtgcaagttagcgatcaggacatgaatacacatcttgccgagattagccgggcccacacagacagtcttaacaccctagtggccctgcatcagctgtaccagtacacacagaagtactatgacgaaatcatcaacgccctggaggaggacccagcagctcagaagatgcagttagccttccgtctccaacagattgccgctgcactggagaacaaggtaaccgatctctag

SEQ ID NO: 199845 - DNA, 1044 bp, Artificial Sequence
  Description of Artificial Sequence: Synthetic coding sequence
atgcacaccctgttcctggagctgctggagcagtacgtggtggccaagaaccctaaactgatgctgcgtcggtccgaaacagtggtggagcggatgttgtctaactggatgtccatttgcctctaccaatacttgaaggatagtgccggtgagccgctttataagctgttcaaggctattaagcatcaggtagaaaagggacctgtagatgcggtgcagaaaaaagccaagtacactctcaacgacacaggtctcctgggggacgatgtggaatatgcccccctgaccgtgtccgtgatcgtccaggacgaaggagttgacgccatcccagtgaaggtgctgaactgcgatacaatcagtcaagttaaagagaaaattatcgaccaggtctacaggggacaaccctgcagctgtgggcccggccaaacggcctggtcatggtctggagttagggcacctcagcggagatctgtaggcccggggcctgatgtgacagcaggcggccctgtcgaagcccgacaacacccatatgcgcttcagtgtcccggatggagccatccacaccccgtacagggaggcggcctcccggccgcaggcggccaaccagccggtcccgcctggtccgctatgcctccggggggaggagagccaggcgtcgctcccggagctgccgacagaagaggtgggcggggacaggtgcaggagcgacaaagggaaagggaaggagcggatgagggccaccacagggacctacctgatgcagcggcgctctcccagggtcacacggccgccgtgtgcggccaactgctgccggagcgcgctggcgcttggcatgctgtcccacctgccgtaaagtatttcttcgattttctcgacgagcaagctgagaaacataatatacaggacgaagatacaatccatatctggaaaacaaatagtctccccttgaggttctgggtgaacatactgaagaaccctcatttcatttttgacgtgcacgtgactagatggtggacccctagatgccaatcatcaagacgctag

SEQ ID NO: 199846 - DNA, 483 bp, Artificial Sequence
  Description of Artificial Sequence: Synthetic coding sequence
ggccccgacgtgaccgccggcggccccgtggaggcccggcagcacccgtacgctctccaatgcccgggttggtcacaccctcaccctgtgcaaggggggggcttgcccgccgcgggtgggcaacccgccggtcccgcgtggggggcaccttgcccccctggagggggagagcccggagtcgctcccggagcggctgacaggagaggaggacgtggtcaggttcaggaacggcagcgcgaacgggaaggagccgacgagggacatcatagggacctaccagatgctgcagccctctcccagggtcataccgccgcggtgtgtgggcagctcctgcctgaaagggccggcctgggaactagatgtcatctacaatctagtacttcatcaaccagctggaccagccgtcagagatcaaccacttcacgcatgaagacaccctcaacctctggaaggcgcacagcctatcggtccggcagtggatag

SEQ ID NO: 199847 - DNA, 1569 bp, Artificial Sequence
  Description of Artificial Sequence: Synthetic coding sequence
atggccctgcagctgtgggccctgaccctgctgggcctgctgggcgcaggcgcctccctgcgaccgagaaaactggatttctttcggtctgaaaaggagctgaatcacttggccgttgacgaggcgagcggtgtggtgtatctcggcgctgttaacgccctgtatcagctggacgccaagctgcagctggaacagcaggtcgccaccggccctgctctcgataataagaaatgtacgcctcccatcgaggccagccagtgccatgaagctgagatgacagacaacgtgaaccagcttttattactggacccacccagaaaaagattagtagaatgcggcagcctgttcaaaggaatctgcgccctaagggccttatctaatatctctctacgcttgttttatgaagatggcagtggcgagaaaagtttcgtagcctcaaatgatgagggggttgcaactgtcgggctggtgtcatcgacgggccctggtggtgacagggtcctgtttgtaggaaaggggaacggccctcacgataacggaattatagtttctacgcgactgctggaccgcaccgattctcgcgaagccttcgaggcatatactgaccatgccacctacaaagccggttatctgtccacgaacactcagcagttcgtggctgctttcgaggacgggccttatgtatttttcgtcttcaatcagcaagacaaacaccctgcgagaaaccgcaccctgctggccagaatgtgtcgggaagatcctaattactactcttacctggagatggatctacagtgccgtgaccccgatattcatgcagcagcatttggaacatgtttggcagccagcgtcgccgcccctggatccggacgggtgttatatgctgtgttttctcgggatagtcgctcttccggcgggcccggagctgggctctgcctttttccgctggataaggtccatgcaaaaatggaagccaatcgcaacgcatgttacacagggactcgtgaagctcgagacatcttctacaaaccatttcatggcgacattcagtgcggcggccacgccccgggatcaagtaaaagtttcccatgtggctctgaacatctgccctacccccttgggtcaagggacggcctgaggggaacagccgtgctacagaggggcggcctgaacttaacggccgtaaccgtggccgcagaaaataatcacaccgttgctttcctaggtactagcgacggaagaattttaaaggtgtatttgacaccagacggcaccagctccgagtacgatagtatcctcgtcgaaatcaataagagggtgaaaagagacttggtcctttctggggatcttggatccctgtatgcgatgacacaggataaagtctttcggctgcctgtgcaggaatgcttgtcataccccacctgtactcagttaccaccagcagccgagcccgcctctggagttcattgcagagtgtcctccgatctgaagatgtgcttaaccctgccccgctgggggcagctggcttcagcatcagcacacgcccccgcagcagcttcaatgccctag

SEQ ID NO: 199848 - DNA, 489 bp, Artificial Sequence
  Description of Artificial Sequence: Synthetic coding sequence
atggccctgcagctgtgggccctgaccctgctgggcctgctgggcgccggagctagtttacgcccccgtaagttggacttcttccgaagtgaaaaggaactgaaccatcttgccgtagacgaagcctctggagttgtgtatctcggagcagttaacgcgctctatcagctggacgctaagctccagctggagcagcaggtggccacaggtccggcccttgacaacaaaaagtgcaccccaccgatcgaagcaagccaatgccatgaggcagaaatgacagataatgtcaatcagcttctcttacttgaccctcctcggaaaagactcgtggaatgtggttcactctttaaaggaatttgcgccctgagagccctgagcaacatttctctccgtcttttttacgaggacggttctggcgaaaagtcctttgtcgcctctaacgacgagggggtggccacggtcggtttggtctcatctaccggcccatag

SEQ ID NO: 199849 - DNA, 1434 bp, Artificial Sequence
  Description of Artificial Sequence: Synthetic coding sequence
atggccctgcagctgtgggccctgaccctgctgggcctgctgggcgccggtgcctctctgcgacctaggaagctggattttttcagaagcgaaaaagagctgaaccatctcgcagtggatgaggcctccggggtcgtgtatctcggagctgtcaacgctctttatcaattggatgcaaagctccagcttgagcaacaagtagcgacaggacccgccctcgacaacaaaaaatgcacacctccaattgaagccagccagtgccacgaagctgagatgaccgacaatgtcaaccagctattgctgttagacccgccccgaaaaaggcttgtggaatgtgggtcattgttcaaaggaatttgcgcactcagagcacttagcaatatatcgttacgcctgttctacgaggacgggtccggtgagaagtcgtttgtggcgtccaacgacgagggagtcgctaccgtgggtctcgtgagctctaccggccccggaggcgacagggtattgttcgtgggcaaaggcaacggcccacacgataatggtataattgtttcaacgcgcctactcgacagaaccgatagtcgagaagcctttgaagcctatactgatcatgctacctataaggcaggctatctgtccacaaacacgcagcaattcgtggccgctttcgaagatgggccctacgtcttcttcgtgttcaaccagcaagataagcaccctgctaggaatcgtaccttgcttgccagaatgtgtcgggaagaccccaactattattcgtaccttgagatggacctgcagtgccgggaccccgacattcacgccgcggcctttggtacatgtctggctgcctctgtcgcagcgcccgggagtgggagagtactttacgccgtcttttctcgcgacagtcgatcttctggaggcccgggagccggtctgtgcctctttcccctcgacaaggtacacgcaaagatggaggccaacagaaacgcatgttatactggaacccgtgaagcccgcgatattttttataaacctttccatggagatatccagtgtgggggccacgcccccggcagctctaagtcttttccatgcggatctgagcacctgccataccccctcggctcacgtgatggactgcgtggaacggccgtgttgcagagagggggcctcaacttgacggccgttaccgtcgccgcggaaaataatcacactgtggctttcctaggcaccagtgacgggaggatcctgaaggtgtacttgactcccgacgggacctctagtgagtacgacagtattctggtggaaatcaataaaagagtgaaacgcgacttggtgctgtctggggatcttggcagtctatacgccatgactcaagacaaagttttcaggttgcctgttcaggagtgtctgtcttaccccacttgcacccaatag

SEQ ID NO: 199850 - DNA, 5517 bp, Artificial Sequence
  Description of Artificial Sequence: Synthetic coding sequence
atggccctgcagctgtgggccctgaccctgctgggcctgctgggcgctggcgccagcctaagacctaggaaactagattttttccgaagtgagaaggagctgaatcacctggctgtggatgaagccagcggggtcgtatacctgggcgcagtgaatgccctctaccagttggacgcaaagttgcagctggagcagcaggttgccacggggcctgccctcgataacaagaagtgtactccccccatcgaagcgtctcagtgccacgaggccgagatgaccgacaacgtgaatcagttactcttgctagaccccccaagaaaaaggttggtagaatgtggaagcctgttcaaagggatttgcgccctgcgggctctctctaacatctctctgcggctgttttacgaagatggatccggagagaagagcttcgtggctagcaatgacgaaggcgtggcgaccgtgggccttgtgtccagtaccgggcccggaggcgatcgcgttctcttcgtgggaaaaggcaacggacctcacgacaacggaatcattgtatccactagactactggatagaacagatagtcgcgaagcctttgaggcctacacggatcacgccacgtataaagcagggtatctttctactaacactcagcagtttgtggctgcatttgaagacggcccttatgtcttctttgtcttcaatcagcaggataagcatccagccaggaatagaactttattggctcgcatgtgccgggaagaccccaattattactcctacctggagatggacctgcagtgtagggacccggatatccatgccgcagccttcggcacttgcctggcagccagcgtggccgcccctggtagcgggcgcgtcctttatgctgtgttctcccgtgatagcaggagttcgggaggccccggggctggcttgtgtttatttccattggacaaagtgcatgccaagatggaggctaaccgaaacgcctgctacaccggtactagggaggcacgagatatcttttataaacccttccacggggatattcagtgcggtgggcatgcccctggtagttcaaaatcatttccttgcggctccgagcacttgccatatcccttaggtagtcgtgatgggctgcgtgggactgcggtcctccagagagggggcctcaacctgacagctgtgaccgtggcagccgagaataaccacactgttgccttccttgggacctcagatggacggatcctgaaggtctatctgactcccgatggtacttccagcgagtatgactccatcctcgtcgaaatcaataaaagggtgaaacgggacctggtgctgtctggcgacctcgggagcctgtacgcgatgacacaggataaagtgttcagacttccagtccaggaatgtctttcttatcctacatgtactcaatgtagagatagccaggatccatactgtggctggtgtgtcgtggagggtaggtgtacaagaaaggctgaatgcccacgcgccgaagaggccagccactggctttggagccgatcgaagtcctgcgtcgcagttactagcgcacaaccccagaatatgagcaggcgcgcacagggcgaggtccagctgacagtctcccccctaccggccttaagcgaggaagacgagttgctctgccttttcggcgagtccccacctcacccagcacgtgttgagggggaggccgtcatttgcaactcaccctccagtatcccagtgaccccaccagggcaggaccatgtcgccgtcacaatacagctccttctacgaagagggaatatatttctcacatcttatcaatatccgttttacgattgccggcaggcgatgtcccttgaggagaatctcccatgtatttcttgcgtgtccaatcgctggacttgccagtgggacttacgataccatgaatgccgggaggctagcccgaaccccgaagacgggatagttagggctcacatggaagactcatgtcctcagtttctcggaccgagcccactggtaattcctatgaaccacgagactgacgttaactttcaggggaaaaatctggacacagtgaaaggcagctcacttcacgttgggtctgacttgctaaagttcatggagccggtcaccatgcaggaatctggtacttttgcttttcgcacgcccaaattaagccatgacgcgaacgagacactccccctgcatctgtatgtcaaatcttatgggaaaaatattgactccaagctgcacgtgacactctataactgctcatttgggcgctccgattgctctctgtgcagagccgctaatcccgattaccgatgcgcatggtgcgggggccagagtcgttgcgtgtacgaggccctctgtaacaccactagcgaatgcccacctccagtgattaccagaatacagccagaaaccggcccgctgggcggtggcattcgtattactattttagggagtaacctaggggtccaggctggtgatatccagcgcatctcagtggccggccggaactgttctttccaacccgaacgatacagcgtgtctacaaggattgtgtgcgtgatagaggctgccgaaacaccattcacaggcggagtcgaggtggacgtgtttggaaaattgggacgtagccctccaaacgtgcaattcaccttccaacaacccaaacctctgtctgttgaacctcaacaaggcccccaggctggcggaaccacgttgacaattcacgggacacatctggataccgggagtcaggaagatgttcgggttacccttaatggagtaccatgcaaggtcaccaagttcggtgctcagctgcagtgcgtgacaggccctcaggctacgcgagggcagatgctcctagaggtatcctacgggggttcaccggtcccaaacccaggaatttttttcacgtacagagagaatcccgtactgagggctttcgaacctctgagatcgttcgcttccgggggtcggtccattaacgtgaccggccagggcttcagcctcatccaacgcttcgccatggttgtgatcgcagagcccttacagtcatggcagccccctagagaggcagaaagtttacagcccatgacagtcgtcggaacagattatgttttccataacgacactaaggtcgtcttcctatctccagctgttccagaagaacctgaagcttacaatttgaccgtcctcatagaaatggacggccatagggcactactgcgcacagaggcgggtgctttcgagtatgtaccagatcccactttcgagaattttactgggggcgtcaagaaacaggtcaacaagctaatacacgcccgggggaccaacctaaacaaggcaatgaccttgcaagaagccgaggcattcgtgggtgccgaacgctgcaccatgaagacccttacagaaaccgatctgtattgtgagccccccgaggttcaaccacccccaaaacgccggcagaagagagacaccacacacaatctccccgaatttatcgtcaagtttggctctcgcgagtgggttctgggtagggtggaatatgatactcgggtctctgacgtaccactgagcttgatcctgcccctcgtaatagttcccatggtggtggtaatagccgtctcagtctactgttactggaggaaaagccaacaggccgaacgggagtatgaaaagatcaagtcccagctggagggcctcgaggagtctgtgagagacagatgtaagaaagaattcacagatctcatgattgaaatggaggatcagacgaatgatgtccatgaagccgggatcccagtgttagattacaagacatacacagacagagtgttctttctgccctcgaaggacggagacaaggacgtgatgatcacgggaaagctggacatcccggagcctcgccgcccagtggtggaacaggccctctaccagttctccaatctgttgaacagcaagagttttctgatcaacttcattcatacattggagaatcagagggagttcagcgcccgggccaaggtttacttcgcttccctgctgactgtcgctctccatggtaaattggagtactatactgacattatgcacaccctgttcctggagttattggagcaatacgttgtggctaagaatcctaaactgatgttacggaggtccgaaaccgtggtggagcgtatgctctctaactggatgtctatttgcctctatcagtacttaaaggacagcgccggcgagccactgtataaactattcaaagccattaaacaccaagtggagaaaggcccggtcgacgccgtgcagaagaaggcaaaatatacactgaatgataccggcctgctcggcgatgacgtggaatatgctcctcttactgtaagcgtaatagtccaggacgagggcgtagacgccattccagttaaggtcctgaactgtgatacaatctctcaggttaaggagaaaatcatcgatcaagtctatcgcggccagccttgttcttgttggcctcgtcccgattccgtggttcttgaatggagacctgggtctacagcacaaatcctatctgatctagacttgacctctcagagggagggccgatggaagcgggttaataccctgatgcattacaatgtaagggatggggctacgctgatcctgtctaaggtgggagtctcccagcagccagaggactctcagcaggatcttcccggagaacggcacgcgcttctcgaagaggaaaaccgcgtctggcacctcgtgcggccaaccgacgaagtggacgaaggaaagtctaagcggggcagcgtaaaggagaaggagcgcacgaaagcaatcaccgaaatttatctgaccaggcttctgtcagtaaagggcactctccagcagtttgttgacaatttcttccagtccgtgctcgcaccaggacatgccgtgccgcccgctgttaagtattttttcgactttttggacgagcaagctgagaagcacaatattcaggatgaggacactattcatatttggaaaacaaactctttaccacttcggttctgggtgaatatcctcaagaacccccacttcatctttgatgtgcacgttcacgaagtcgtcgacgcgtcactgtcagtcattgcccagacctttatggacgcttgcacccgcacagaacacaaattgtcacgagatagccccagcaataagctgctttatgcaaaggaaatctccacttataagaagatggtggaagactattataaggggatacgacagatggttcaagtgagcgaccaggacatgaacactcacctcgccgaaatttctagggcgcacactgatagtctgaatactttggtggccctgcaccaactgtaccaatacacccaaaagtactacgacgagattattaatgcgctggaggaagatccagctgcacaaaaaatgcaattggcctttcgcctccagcaaatcgccgctgctctggaaaataaagttaccgatttgtag

SEQ ID NO: 199851 - DNA, 5730 bp, Artificial Sequence
  Description of Artificial Sequence: Synthetic coding sequence
atgtgccacgccgcccaggagacccccctgctgcaccacttcatggcaccagtaatggctcggtggcctccgttcggtttgtgtctgctgctgctgctgctatcccctccccccctgcccctgaccggtgcacatcggttcagcgcacctaacacaaccctgaatcaccttgccctggctccaggaagagggacactctacgtgggcgctgtaaatcggttgtttcaactttcacctgagctgcaactggaggccgtagcagttacaggccctgtgatcgattctcccgattgcgtgccattccgtgatccagcagaatgtccccaggcccaactcactgacaacgcaaatcagctgctgctcgtgtcctcccgcgcccaggagctggtggcctgtggtcaggtacgccagggtgtgtgcgagacccgaagactaggtgacgtggcagaagtcctgtatcaggcagaggatcccggcgacgggcagtttgtggccgctaatacaccaggtgtagcaactgttggcctggttgttcctttaccagggcgtgatttgctgctggtggcaaggggcctagccgggaagctaagcgccggagtaccgcctctcgcaatcagacagctagctggctcccaacccttcagttcggaaggtctgggcagattggtcgtcggagatttttctgattacaataatagctatgtgggcgctttcgccgatgcccgcagcgcgtactttgtgtttcggagacggggcgccagagcccaggctgagtaccgcagctacgtggcacgggtctgcctgggagacacgaacttatacagttatgtggaagttccactcgcttgtcaggggcaggggcttattcaggccgcattcttagcaccaggcacattgttaggagtatttgcggccggccccagaggcacgcaggctgcactctgcgcatttccaatggtggaactaggcgcgtcaatggagcaggcccggagactgtgttacacagcagggggacgcggacctagcggggccgaggaggctaccgtggaatatggcgtcacctcccgctgtgtgacacttccgttggactctcccgaatcctacccttgtggtgacgagcatacaccatctccaatcgcagggagacagccgctggaggtgcagccgcttcttaagctgggacaacccgtctccgccgttgcagcattgcaggctgacggccatatgattgccttcttgggagacacccagggccagctctacaaggtcttcctacatggatcgcaaggtcaggtgtatcacagccaacaggtgggacctcctggaagcgccattagtccagatcttctgctcgattcctccggctctcacttgtacgtgcttactgcccaccaagtggacagaatacccgtcgcggcctgtccccaattccctgactgcgcatcgtgcctgcaggctcaggaccctctgtgtggatggtgcgtgttgcagggaaggtgtacccgaaaaggacaatgtgggcgggccggacagctgaaccagtggctgtggtcctacgaagaagacagccactgcctccacatacagtctctgctgcctggccaccatcccagacaggaacaggggcaagtcaccctgagcgtgccgcgattgccgattctggatgccgatgaatatttccactgcgcatttggcgattacgacagcttagctcatgtggaggggccgcatgttgcctgtgtcactccaccccaagaccaggtcccattgaacccacctggcacagaccatgtgactgtgcctctcgccctgatgttcgaagacgtgaccgttgctgctacgaacttctccttctacgattgtagtgctgtccaggctctggaggccgctgcaccttgccgcgcctgtgtaggctccatttggcggtgccattggtgcccacagtcgagtcattgcgtttacggtgagcattgtccggagggtgagagaacaatatattctgcgcaggaagttgacattcaagtaagaggccccggtgcttgtcctcaagtggaaggccttgcgggcccccacctggttcctgtgggatgggagtctcatctggccctcagggtcagaaacctccagcacttccgcgggctccccgcgtcctttcattgttggttagagctgcctggagagctgagaggccttcccgccacactggaagagactgcaggtgattctgggcttattcactgtcaggcacaccagttctatccttctatgagtcagagagagttaccggtgcctatttacgttactcagggcgaagctcagaggctggacaatacccatgcattatacgtcattctatacgattgtgctatggggcatcccgactgcagccactgtcaggccgccaacagatctttaggttgcctgtggtgcgcggacggccagcccgcctgccgctacggccccctgtgccctcccggcgcggtggaacttctctgccccgccccctccattgatgcagtggagcctctcacagggcctcccgagggggggctggcactgacaatactcggctcaaacctcggcagggcctttgcagatgtgcagtatgctgtttccgtggcgtcacgcccctgcaatcctgaaccctcactctaccgcacatcagctcgaattgtatgtgtgacttcacccgcaccaaatggaacgacagggccagtgagggttgccattaagagccagcctcccggaataagtagtcaacacttcacctatcaagaccctgtgctactgtccctcagcccccgctggggtcctcaggcaggagggactcaattaaccatcagaggccaacatcttcaaaccggtggcaacactagcgcgtttgttggcggccagccgtgtccaatactcgagcccgtctgcccagaagcgatcgtatgcagaactagaccacaagccgccccaggtgaggccgcagtactagttgtgtttggacacgctcagaggaccttgctagcatcccctttccggtatacagctaacccccaactggtggctgccgagccatctgcttccttcagaggaggtggaagacttattcgggttaggggcactgggttggacgtggtgcaacgccccctgctaagcgtgtggctagaggccgatgcggaagtgcaggcttcaagagcgcagccgcaggaccctcaaccacgtaggagctgcggagctccagccgccgacccccaggcttgtatccagttggggggggggctgctgcagtgctccacggtatgtagcgtcaattcttccagcttactgctgtgtcggagcccagcagtacctgaccgggcccatcctcagcgggtgttctttactctcgataatgtgcaggtggacttcgcatctgccagcggcgggcaaggcttcctctatcagcccaaccctagactggcaccgttgagtcgtgaaggaccagctaggccgtatagattgaaaccaggccatgtgctggacgtcgaaggagaaggcctcaatctcgggatcagcaaagaagaggtgcgtgtccacattggccgcggcgaatgtcttgtgaagaccctgaccagaacacacctctactgtgagcctccagcgcacgccccacaaccagctaacggttccggactcccacaatttgtcgtgcagatgggaaatgttcaacttgcattagggccagtgcagtatgaagcagagccacctctgtctgcgttccccgtggaagcgcaagccggagtgggtatgggggccgccgtcctgatagccgcagttctgctccttactttgatgtatcgccacaaatctaagcaggcccttcgggattaccagaaggtcctcgtccagttggagagtctggaaactggggtgggagatcagtgtcgtaaggagtttacagatctgatgacagagatgaccgatctctcaagcgatctagaaggtagtgggatccccttcctggattatcggacctacgcagagagggccttttttccaggtcacggcgggtgtcccctgcagccaaaacctgaggggccaggagaagatgggcattgcgccaccgtacggcaggggctcacacagttgtccaacctcttaaattcaaagctcttcctgctaaccctgattcacaccctggaggagcagccctctttttcccagagggaccggtgccatgttgcctctcttttgtccttagccttgcacggtaagctggaatacctgactgatattatgaggactttacttggcgacctcgccgcacactacgtgcatagaaaccctaagctgatgctgcgccgcactgagacgatggtggagaagcttctgaccaattggctctccatatgtctctatgccttccttcgcgaagtagccggcgagccattatatatgttatttcgcgcaatacaataccaggttgataaaggacctgtggatgccgtgacaggaaaagccaaaagaactctcaatgattcccgactgcttagggaagatgtggagttccagccgctgaccctcatggtgctggtggggccaggagctggcggggccgccggctcgtccgagatgcagcgggtaccagcacgggtccttgacaccgacaccatcacccaggtgaaggaaaaggtcttagaccaggtctacaagggcaccccctttagccagcgcccatccgtgcacgccctcgatcttgaatggagatccggtctcgctggccacttaaccctgagtgacgaggacttaaccagtgtgacacagaatcattggaaacggttaaacactctgcaacattataaggtgcccgacggtgcgactgtgggactcgtaccccaactccatcgtggcagtactattagccagagcctggctcagaggtgtcctttgggagagaacataccgacactcgaggacggagaggaagggggggtgtgtctgtggcatctcgttaaagccaccgaagaaccagagggcgcgaaggtgcggtgttccagtttacgcgagagggagcctgctcgagctaaggccattcctgagatatacctcactagactgctttctatgaagggtaccctccagaagtttgtagacgatacctttcaggccattctgtcagtgaacagacctatccccatcgctgtcaagtatctgtttgatctgctcgacgaactcgcagagaagcatgggatcgaggacccgggcactctgcatatctggaaaaccaatagcctgctgctccgattttgggtcaatgcgctgaaaaacccccagctcattttcgatgtacgggtcagcgataatgtggatgccattctcgcagtaatcgctcagaccttcatcgattcgtgcactaccagcgagcacaaggtcggccgagactctccagtgaacaagctcctttacgctagagagataccaaggtacaaacaaatggtagagcggtattacgccgatattcggcagtcttcacctgccagttaccaggaaatgaacagcgctctggctgagctcagcggcaattacacatcggcgccgcattgtctggaagcgctacaagagctgtacaaccatatccacaggtactacgaccagattatttctgcacttgaagaggaccctgtcggacagaagcttcagctggcctgtagacttcagcaggtagctgcactcgtcgagaataaagtgaccgacctctag

SEQ ID NO: 199852 - DNA, 777 bp, Artificial Sequence
  Description of Artificial Sequence: Synthetic coding sequence
tgaagcctggagaccggcgtgggcgaccagtgccggaaggagttcacagatctgatgaccgagatgacagacctgtccagcgatctggaaggttccggtataccatttctcgattacagaacatatgctgagagagccttctttcccggacatggcggctgtcccttgcaacctaaaccggagggccctggcgaggacggtcactgtgcaaccgtacggcaaggtctcacacagttatctaacctgctgaacagtaagctgtttttgctgacactgatacataccttagaggaacagccttctttctctcagcgggatcggtgtcatgtggccagtctgctttctctcgccctgcatgggaagttggagtacctgactgatatcatgcggacgttgctgggcgaccttgccgcgcactatgtgcacaggaaccctaagctcatgttgaggcggacagaaacaatggtggagaagctgctaaccaactggctcagtatctgtctctacgcttttttgagggaagtggctggcgaacccctctatatgctatttcgcgccatacagtaccaggtagacaaaggccccgtagacgcagtgaccgaatggagaagcgggctggctggccatcttactctgtccgatgaagatcttaccagtgtcacccagaaccactggaagcggttgaacacactacagcactacaaagtgcctgacggcgcgactgttggcctggtcccccaactccaccgtggaagtactatttcacagagtctgtag

SEQ ID NO: 199853 - DNA, 531 bp, Artificial Sequence
  Description of Artificial Sequence: Synthetic coding sequence
tgagccagccagggcaccctgcagaagttcgtggacgacaccttccaggccattctctctgttaatagacccatccctatcgccgttaagtatctctttgatctgctcgatgagctcgccgagaaacatgggatcgaagaccccggcaccctccacatttggaaaaccaattctctcctcttacgcttctgggtgaacgccctgaaaaacccccagctaatttttgatgtccgggttagtgacaacgtcgacgcgattctggctgtaattgcacaaactttcatcgattcctgcacaacctcagaacacaaggtcgggagagtgagggctgtgcctgccgcagccgcaggcagaggtctacgtcgcaaaggcctgtggggtaaaccgcgcggcctgtgtacagagctttgggtcggctccggatccataatgggagcgccgtctccaccttctagctgcctggccccgccccttccccccgagcaggactctcctgtcaataagctcctgtacgctcgggagattccttag

SEQ ID NO: 199854 - DNA, 492 bp, Artificial Sequence
  Description of Artificial Sequence: Synthetic coding sequence
tgaaagcggaccctgaacgacagccggctgctgcgggaggacgtggagtttcagccactgacgttgatggttctggtgggacccggagccggcggagctgccggatcctcggagatgcagagggtccctgcgagggtcttggataccgatacgatcacgcaagtaaaggaaaaagttctggatcaagtgtacaaagggacacctttcagccagaggccgagcgttcacgccttagacttagaatggagaagcggcttggcgggacacctgaccttgagcgacgaggatctcacctccgttacccaaaatcactggaagcggctgaacaccctccagcactataaagtgcctgacggcgccactgtaggccttgtgccgcaactgcaccgaggatccactattagtcagtcccttgctcagcggtgccctctgggcgaaagcgagtctctggggcctgatcttggccctctcgaaagtcgtttgggccgctag

SEQ ID NO: 199855 - DNA, 2967 bp, Artificial Sequence
  Description of Artificial Sequence: Synthetic coding sequence
atgtgccacgccgcccaggagacccccctgctgcaccacttcatggatagccccgagagttacccttgtggcgacgagcacacgccgagtccaatcgccgggagacagccactggaagtccagcctttgctgaagttagggcaaccagtgtcggctgttgctgcactgcaggccgacggccacatgatcgcctttctaggcgatacccaggggcagctgtataaagtggacagaattccagtagccgcttgcccgcagtttccagactgtgcaagctgtctacaggctcaggaccccctttgtggttggtgtgtcctccagggccgatgcacgagaaaaggccaatgcggacgggcaggtcagctcaaccagtggctgtggagttacgaggaagattcgcattgcctccatatacagtctcttctgccaggccaccatccccggcaggaacagggacaggtcactttgagcgtccctcgcctgcctatcctggatgccgatgaatacttccactgtgcttttggagactatgatagcttagcacacgtggagggcccgcacgttgcctgtgtgacccccccccaggaccaggtgccgctgaacccaccgggcacagatcacgttactgtgccgttggccttaatgtttgaagatgttactgtggctgccacgaacttctctttctacgattgttccgccgtacaagctctggaagccgctgcaccctgtcgggcatgcgttggctctatatggcgatgccattggtgcccacaaagcagtcattgcgtgtatggcgagcactgccccgaaggcgaacgcactatttatagtgcccaggaggttgatattcaggtgcgaggacctggagcgtgcccgcaggtggagggcctggcggggccgcacctggtgccagtaggctgggaaagtcacctggccctgcgagtgcggaatctccagcacttccgggggctccccgcttccttccactgttggctcgagctgcctggggagcttcgaggcctgccagcaacattagaagaaaccgctggggattccggactgatccattgtcaggctcaccagttttacccatcaatgtcacagagagaactgcccgtgccaatttatgttacacagggtgaggcccagcgcctggacaatacacacgccttatacgtgattctgtatgactgtgccatgggacaccccgattgtagtcactgccaagcagcaaataggagcctggggtgcttatggtgcgcggatggacagcctgcctgccggtacggccccctctgtccccctggcgccgtggaactgctgtgccccgcgccttctattgatgccgtcgaaccactgactggaccgccagaggggggtttggcccttaccatcttgggttcaaatctgggcagagcattcgctgatgtccaatacgccgtatctgtggcctcccggccatgtaatcctgaaccatctctgtaccggaccagcgctaggattgtatgtgtgacttcacccgcacccaatggcaccaccggtccggtgcgggtagccatcaaatcccagccgccaggtatatccagtcagcactttacttatcaggaccccgttttgctgtctttgtctcctcggtggggacctcaggcaggcgggacccagttgacaatccgtggccagcacctgcaaacaggcgggaacacttcagccttcgtcggggggcaaccctgtcccatcctggagcctgtatgtccagaagccatcgtgtgcaggaccagaccccaggcggccccaggcgaagccgcagtgctagtggtgttcggccatgctcagcggactcttctggcttccccattcaggtacacagctaatccgcagctggtggctgctgagcccagtgcctcattcaggggcggaggccgtttgatacgggtgagaggcaccggcttagatgttgttcagcgcccactgttgtctgtatggctcgaggcagatgccgaagtccaagcatcaagagcgcagccacaggaccctcagccccgtcgcagctgcggcgctcctgccgccgaccctcaggcttgcatacagttggggggcggcttgctccagtgtagcactgtctgttccgttaattctagtagtctgctcttgtgccgatccccggcagttccagaccgggcccatccacagcgggtcttttttactctggataacgttcaagtggattttgcttcagcctccggcggccaggggttcctgtaccagccgaatccgcggctggccccgctttcaagggaaggacccgcccggccctaccgcctgaagcccgggcacgtactagacgtggagggcgaggggctcaatttgggcattagtaaagaagaggtgcgcgtgcatattggcaggggcgaatgcctggtaaagactttgaccaggacccacctctactgcgagccccccgcccacgcccctcagcctgctaacggcagcggcctcccccagtttgtagtgcagatgggcaatgtgcagctggcactggggccggtccaatacgaggccgaaccccctttgtccgccttccccgtggaagcacaggctggcgtgggcatgggagcggcagtgctgatagcggctgtcctcctactgacactcatgtatagacataaatcaaagcaagcgctgagggattaccagaaggtcctggtacagcttgaaagtctggaaactggggtgggcgaccagtgtaggaaagagttcacaggcggctgcggcggcggcggaacaggatatcccagagggcttaattcgcatctcggcgccagctggccaaggagaccgcatgacggagacgatcgccctcagcagcgcccgggaggccaacgggaccccctccccgggcttccacacctccgaagagctagactgctcccgtggccgtggcgtctgccagccgccgcccaggcgtag

SEQ ID NO: 199856 - DNA, 675 bp, Artificial Sequence
  Description of Artificial Sequence: Synthetic coding sequence
atgtgccacgccgcccaggagacccccctgctgcaccacttcatggtagatagaatccccgtggcagcatgccctcagtttcccgactgcgcttcatgtttgcaagcccaggacccgctgtgcggctggtgtgtgctgcaaggacggtgtacacggaagggccaatgcggcagggcaggtcagctaaatcaatggttgtggtcttacgaggaagacagtcactgcctgcacatccagtctctactgcccggacatcacccccggcaggagcagggccaggttacactcagtgtgcctaggctccccatccttgacgcagatgaatactttcactgtgcattcggagactatgactcgctcgcccatgtagaagggccccacgtcgcctgtgtgacgcctccacaggatcaggttcctctgaacccgcctggtactgatcatgtgaccgtgcctcttgctctgatgttcgaagatgtcactgtagccgctaccaacttctccttttatgactgctctgcggtacaggctctggaagccgccgctccagcatgcctccctcccagtactgccgggtggtcatgcttggaaaatttcggggactgccgaccaccttggaggaggcaacaaggcatccaggcttctagtacagctcgccccacaaggtcaagtccctag

SEQ ID NO: 199857 - DNA, 4689 bp, Artificial Sequence
  Description of Artificial Sequence: Synthetic coding sequence
atgtgccacgccgcccaggagacccccctgctgcaccacttcatggactctcctgagtcctacccttgcggcgacgagcacaccccatcgcccatcgctggccgtcaaccgctggaggttcagcctcttctgaagctgggccagcccgtcagcgcggtggcagcgctacaagcagacggtcatatgattgcctttcttggcgacacacagggtcagctttacaaagtgtttctacacggttctcaagggcaagtgtatcattctcagcaggtcggacccccaggttccgccattagcccagacctgctcctagacagtagcggcagccatttatacgtcctcacagcacatcaggtcgatcgtataccagtcgccgcgtgtccacagtttcctgattgcgcaagctgtctgcaggcccaggatccactctgcggatggtgtgtgctgcagggacgttgtacaagaaaagggcagtgtgggcgggcggggcaactgaatcaatggctgtggagttacgaagaggattcccattgtctccacatccagtccctgctgccagggcaccacccacggcaggagcagggccaagtgacactctccgtgcctaggctccccattctggacgctgatgagtatttccactgtgcgtttggtgattatgatagtctggcccacgtggaaggccctcacgtggcttgcgtgaccccgccccaggaccaagtcccactgaacccgcccgggacagatcacgtaaccgtacccctggcactgatgtttgaggatgtgacagtcgccgcaacaaacttctctttctatgattgtagtgccgtccaggccctggaggctgcagctccctgccgcgcctgtgtgggaagcatatggcgctgccattggtgtccccaatcctcccactgcgtgtacggcgagcattgccccgaaggtgaaaggaccatttacagcgcccaggaagttgacattcaggtgaggggtcccggagcttgtcctcaagttgagggcctggcaggaccccatctcgttcccgtgggttgggagtcacacctcgcccttcgggtgaggaacctgcagcactttcgcggccttccagctagcttccactgttggttagaacttcccggcgaactgcgtggcttgcctgcaactctggaagagacggccggtgacagtggcttgattcattgtcaggcccatcagttttacccctcaatgagtcagagagagctacctgtgcccatatacgtcacccaaggtgaggcccaacggctcgacaatacccacgctctctacgtgatcttatatgattgcgcaatgggccacccggattgctctcactgtcaagccgcaaaccgaagcctaggctgcctgtggtgcgccgacggccagcctgcctgtagatacggtcccttgtgtccacccggggctgttgaactgctctgtcccgcaccctctattgacgctgtggagcctttgactggcccccctgaaggtggtctggctttgaccatcctaggatctaacctaggccgagcatttgccgacgtgcagtacgctgtgtccgtggcctcgcggccctgtaaccccgaaccctccctttaccgaacttccgctagaatcgtatgtgtaacctctcccgctccaaatggtacaaccggccctgtgcgggttgcaatcaagtcccagccccccggtatatcttcccaacattttacttaccaagacccagtgctactgtcgttgagcccgaggtgggggccacaggcaggtggaacccaattaacaattcgtggccagcacttgcagacgggcggtaacacgtccgcgtttgtggggggccaaccctgccccatattggagccagtgtgccccgaggcgatcgtgtgccgcacaagaccccaggctgcccctggagaggccgcagtgcttgtggtgtttggacatgcgcagcggaccctgctggcctcccctttccgctatactgccaacccccaactcgtggccgcggagccctcagcctctttccgcggggggggcaggctaattagagtgcgcggaaccgggctggacgtggtccagcggcctctgctgtccgtgtggctggaagccgacgctgaagtccaggcctcacgcgcccagccacaggatccgcagcctaggagaagctgcggggccccagcagccgatcctcaggcatgtatccaactcggggggggcctcctccagtgcagcaccgtttgctctgttaactccagttctctgctgttatgtcgtagccctgcagttcctgatagagcacaccctcagagagtcttctttaccctggataacgtccaggtggatttcgcatcagctagtggtggacagggctttctgtatcagcccaatcctcgcctagctccacttagtcgggaaggtcccgcccgtccctataggttgaaacccggccatgttttggacgtcgagggggaaggtctgaatctcggaatctccaaagaagaggtgcgggtgcacataggccggggcgaatgcttggtcaagactctgaccaggacccatttgtactgcgaaccaccagcgcacgcgccacagcctgctaacggcagtgggctcccccagtttgttgtgcagatggggaacgtgcagctcgcactgggccctgtgcagtatgaagccgaaccgcctttatctgcttttcctgttgaggcacaagcaggtgtgggcatgggtgccgccgtcctgattgccgccgtgcttcttctaaccctcatgtaccgacacaagtccaagcaggcactgagagactatcagaaagttctggtgcagctagaatcactcgagacaggcgtaggtgatcaatgccggaaggagttcaccgacctgatgacagagatgaccgatctatcaagcgacctggagggatcaggcatcccattcttagactataggacctatgcggagagggcattcttccctggacacggcggatgcccgttgcagccaaaacctgagggtcctggggaggatggacactgcgctacagttaggcagggcctgacacagttgagtaacctgctgaatagcaagcttttccttctaacactcattcacaccctagaggagcagccttcctttagtcaaagggacagatgccacgtggcgtcccttttaagtcttgccctccatggcaagctcgaatatctaaccgatattatgaggactctgctcggggacttggccgctcactacgttcatcgtaaccccaaactgatgctccgtcggacagaaacaatggtcgagaaacttttaacaaactggctaagcatctgcctttatgcatttttgagagaagtggccggagaacctctttacatgttgtttcgtgccatccagtaccaagtggacaagggacctgtggacgcggtgaccgggaaagctaagcggaccttgaacgacagtcggctgctccgcgaggacgtggaattccagcccctgaccttgatggttctagttggccccggcgctgggggcgcagccgggagctcagaaatgcaacgtgtaccagcccgagtcttagatactgataccattactcaggtgaaagaaaaagtgctggaccaggtctacaagggcactcccttctctcagaggccctccgttcatgccttggatctcgagtggcgaagcgggctggcagggcatctgacgttatccgacgaagacctgacctcggtgacccagaatcattggaaaaggctgaacactctgcaacattataaagtgcccgatggggccacagttggcctggtcccgcagcttcatagaggaagcacaatcagtcaatcactcgcccagcgctgccccctgggggaaaatataccaaccctcgaggacggggaggaggggggggtgtgtttatggcatctcgtgaaggccactgaagaaccggaaggggccaaagtgcggtgctctagtttaagggaacgggagccagctcgcgctaaggcaatccctgaaatatatctgacgagactgctctccatgaaggggactctgcagaaatttgttgatgacacattccaggcgattctgagtgtgaatcgaccaatcccaattgcggtcaagtaccttttcgacctactggatgagttggccgaaaaacacggaatcgaagatcctggcactctgcatatatggaagaccaatagcctgctgctgcgcttctgggtgaatgcacttaagaatccacagttaatctttgacgtcagagtatccgacaacgtggatgcaattctcgctgttatagcacagacttttatagactcttgtactacgagcgagcacaaggtggggcgagatagccctgtgaataaactcctgtacgcacgggagattccccggtacaaacagatggtcgagaggtattatgccgacatccgccagtcttcacccgctagctatcaggagatgaattccgctcttgccgaactgtcaggcaactacacttcggctccgcactgccttgaagccctgcaggagctctacaatcacatccaccgctactacgatcagattatcagtgctctggaggaggaccctgtcggccagaagctccagctcgcatgtcgcttacagcaagtagctgcccttgtggagaataaggttaccgacttgtag

SEQ ID NO: 199858 - DNA, 5799 bp, Artificial Sequence
  Description of Artificial Sequence: Synthetic coding sequence
atggagctgacccccgccagcagcctgacctgcagcctgctgagcccaaggttgccgggatcctttccccagttgcgacgcgtgcctccatgcagccgcccatggcttcctaaggccccggtgatggccagatggccccccttcgggctctgcctcctgctgctgctgctgtcaccgccccccctgcctctaactggagcccataggtttagcgcgccaaacaccacactgaaccacctggcattagcgcctggacgcgggactctctatgtgggagcagtcaaccgtctgttccagctgagtcctgaactccagctagaagccgtcgcagttacaggccctgtgattgattccccggattgcgtccccttccgggatccagctgaatgtccccaggcgcagttaacagataacgcaaatcagctacttctggtttcttccagggcccaggaattggtggcctgtgggcaggtacggcagggagtttgtgagactcgaagactgggggatgttgcggaggtactctatcaggctgaagaccccggcgacgggcagttcgtcgccgccaacacaccaggcgttgccactgttgggctggttgtgcctttgcctggacgggaccttttgctcgtggcccgcggtctcgccggcaagctgtcagcaggagtgccaccccttgctataagacagcttgcagggtctcagcctttctcttctgaaggattggggcggttggtcgttggcgacttctccgactataacaactcatacgtaggcgcttttgctgacgcacgaagtgcatattttgtcttcagaagacgaggcgcgcgtgcccaggcagaatacaggtcgtatgtggccagggtgtgtctgggagacacgaacctgtactcctatgtcgaggtccctctggcctgccagggccaggggctaatccaggctgcttttctggcaccaggtaccctgttgggagtgttcgctgcgggtccaagaggcacccaggccgcactgtgtgcctttcctatggtggaattgggcgcctccatggaacaggcgcggcgcctatgctatactgccggcggacggggaccctctggagctgaagaggctaccgtggaatacggcgttactagccggtgtgtgaccctcccactcgactcacctgaatcctatccctgtggggacgaacacacccctagcccaatcgccgggagacaaccgctggaggtgcagcctctgctcaagctgggacagccggtgtcagcagtggcggccctccaggccgatggacacatgatcgcctttctgggggatacccagggacagttatacaaagtttttctgcatgggtcccagggccaagtgtatcatagccaacaggttgggccacccggttccgcgatatcccctgatttactgcttgacagctccggcagccacttatacgtgttgaccgcgcatcaggtggatagaataccggtggcagcttgcccgcagttccccgactgcgccagctgcctccaggcacaagatcctctatgcggatggtgcgtgctccagggtaggtgtacacgtaaagggcagtgcggcagagccgggcagctgaaccagtggctttggagttatgaagaggactcacactgccttcacatccagtcattgctgcctggtcaccatccgagacaggagcagggccaagtgacgctctctgtcccacggttgcctattctcgacgcagacgagtactttcactgcgctttcggggactacgattcacttgctcacgttgagggcccccatgtggcctgtgtcaccccgccccaggatcaggtgcccctcaacccaccaggcactgatcatgtgactgtccccctggcgttgatgtttgaggacgtgacagtagcagctaccaatttttccttttatgattgctccgctgtgcaggccctcgaggctgcagccccatgccgggcctgtgtcgggtcgatctggcgctgtcattggtgcccccagtccagtcactgcgtgtacggcgagcactgtcccgagggcgagcgaacaatctactctgctcaggaggttgacatacaggtgagagggcccggggcctgccctcaggtggagggactggcaggcccccacctcgtgccagtgggctgggagagccatcttgcgttgcgggtgcggaatctgcagcactttagaggcctgccagctagcttccactgctggctagagctccctggcgagctacggggattgcctgctaccctggaagagaccgcgggcgattctggtctaatccactgccaggcccatcagttttatccatccatgtcccagagggagctgcccgtgccaatatacgttacccaaggggaagctcagcgccttgataatacccatgccctttatgttatcttgtacgactgcgcaatgggacaccctgattgttcacattgtcaggcagcaaaccgcagcctgggatgcctgtggtgtgcagacggccaaccggcctgcaggtatggccccctgtgcccccctggggcagttgagctactgtgtcctgcaccttccattgacgccgtcgaacccctcaccggtccacccgaaggcggtctggctctgacaatactgggatcaaacctgggccgtgcttttgccgacgtgcagtacgccgtcagtgtggccagtcgcccctgtaaccccgagccaagtctgtatagaacaagtgcacgcatagtatgcgtcacaagcccggccccgaatggtaccacgggtcccgtgcgcgtggctatcaaatcccaacctccaggcatttcttctcagcatttcacctatcaggaccccgtactgctctccctgtccccacgttggggcccgcaggccgggggtacacagttgactatccggggtcaacatctacaaaccggcggaaataccagcgccttcgtcgggggtcagccctgtcccattctggaaccagtgtgtcctgaggctattgtatgtcggacgcggccacaggctgcccccggagaggctgcagtgctggtggtgttcggccacgcccagaggacacttctcgcgagtcccttccgttacacggcaaacccgcaattggttgctgcagaaccaagcgcctcgttccgtggcggaggacgtctgatacgcgttcgcggcaccggactggatgtggtacagcggcccctgctgtcagtgtggctggaggcagacgccgaagtccaagcatctcgcgcgcaacctcaggacccacagccacgccggtcttgtggcgctccagctgctgatccccaggcttgtatccagctgggagggggcttactgcagtgttcgacagtgtgtagcgtcaattcttcctcactgctgttatgcaggtccccagcagttcccgaccgtgctcatccccagcgagtgtttttcacattggataacgtccaagttgacttcgcaagcgctagtggtggccagggattcctgtaccaacccaatccacgcctggcgccactgagccgtgagggtcccgctagaccctacaggcttaaacctggtcatgttctggatgtggagggtgaagggctcaatctgggtatcagcaaggaggaggtgagggtgcacatcggcagaggagagtgtttggtcaagaccctcaccagaactcacctgtattgcgagcccccggctcacgcacctcagcccgccaacggcagcggcctgccgcaatttgtggttcaaatgggaaacgtccagctcgccttaggcccagtgcaatacgaagccgagcctcccctttccgccttccctgtggaagctcaagcaggtgtagggatgggagccgcggtgttgattgccgccgtacttcttctcactctgatgtaccgtcacaagtcaaaacaggcactgcgggactatcagaaagtgctagtccagctggagagcctcgagactggagtgggcgatcagtgcagaaaggagttcacagacctcatgacagagatgaccgacttgtcatccgatctggaaggtagcgggatcccgttcctcgactatcggacttacgccgaaagggccttctttcctggacacggtggatgcccgctgcagcccaaacccgagggacccggtgaggacggacactgcgccactgttcggcagggcctcacacagctgtctaacctgctaaattccaaattattcctgcttactctgatccatacactcgaggagcagccaagttttagccagagagacaggtgtcacgttgcctcccttctttcgctcgccctccacggaaaactggaatatctcacggatatcatgcggaccctcttgggtgatctcgcggctcactacgtgcataggaacccaaagctcatgctgaggagaaccgaaacaatggttgaaaagctcctgacgaattggttgtctatatgtctatatgccttcttgcgagaagtggcgggcgagcctctttacatgctgttccgcgctatccagtaccaggttgataagggccccgtagatgcggtgactggcaaggccaaaagaacactaaacgattccagacttttacgagaggatgtggaatttcaacctctgaccttgatggtgttggttgggccaggagccggcggggccgccggcagcagtgaaatgcagcgggtccctgcgagggtgctcgatactgacacaatcacccaggtgaaggagaaagtcctagaccaggtttacaagggtacacctttttcacaacggccttctgtacatgcactggacttggagtggagatcgggcctggctggtcatctcaccctctctgacgaagacctgacttcagtgacccaaaatcattggaagcgtttaaacacattacagcattacaaagtgcccgatggcgcgacagtgggcctcgtgcctcagctgcatcgtgggtccacaataagtcagagtcttgcacaacgttgtcctcttggagagaacatacctacgctcgaagatggggaagagggtggtgtgtgcctatggcacctggtaaaagctaccgaggaaccggagggggcgaaggtgcggtgctcctctttgagagaacgagagcctgcacgcgccaaagcaatccctgagatctaccttacacggctactttcgatgaaagggacgttgcaaaaattcgtggatgacacttttcaggccatcctcagcgtgaaccggcccatacctatcgcagtgaagtatttgtttgatctgcttgacgaactggccgagaaacacggaatcgaggaccccgggaccttgcacatttggaagactaactctctgcttttacggttttgggtcaatgcacttaaaaaccctcagttaatctttgatgttcgggtgtccgataatgttgacgcgatccttgcggtgatagcacaaacattcatagactcctgcacaacatctgaacacaaagtggggcgggactcccctgtgaataagctgttgtacgcccgagaaattcctagatacaagcagatggtagagagatactacgccgatatccgacaaagcagccctgcatcctatcaggagatgaactcagctttagcagagttgtccggtaactatacttccgcaccgcactgcctcgaggctctgcaagaactgtacaatcatatccatcggtactatgaccaaattatttcggctttagaggaagatcccgtgggccagaagctccaattagcatgtaggctgcaacaggttgccgctctcgttgagaataaagtcaccgacctgtag

SEQ ID NO: 199859 - DNA, 5778 bp, Artificial Sequence
  Description of Artificial Sequence: Synthetic coding sequence
atggccccccgggccgccggcggcgcccccctgagcgcccgggccgctgctgcgagtccccctccgttccaaaccccacctaggtgtccggtccctctgctcctgctgcttctccttggtgctgcaagagcgggggcgttggagattcaacggaggtttccatcaccgacccctacaaataatttcgccttggatggagccgcggggacagtatatcttgccgcagttaatcgcctttaccagctgtccggcgctaatctctccctggaagcggaggctgcagtcggacccgtcccagattccccattgtgtcacgctccccagttgccacaggcctcttgtgagcatccaagaagactgacagacaattataacaaaattctacagttagatcccggccaaggtctggtagtagtgtgcggaagcatataccaagggttttgtcagctgcgacgaagaggaaacatttccgccgtagccgtcagatttccaccagcagcgcctccggctgaaccagtaacggtgttcccttccatgttgaatgttgctgccaaccatccgaacgccagtaccgtgggtctcgtgctgcctcctgccgctggtgcaggtggaagtcgcttattagtcggagcgacctacactggatacggcagctctttctttcccaggaatcgcagtctggaggaccacagattcgaaaacacccccgaaatcgccatccgttccctggacacaagaggagacttagccaagctctttacgttcgatctgaacccttcggacgataacatcctcaagatcaagcagggagccaaagaacagcataagttaggctttgtgtcagccttcctgcatccgtctgaccccccccccggagcacagtcttacgcatacctcgccctaaactcggaggcgagagcgggagataaagagtcccaggcaagatctctgttagcaagaatttgcctcccacatggcgccggaggagacgcaaaaaaactgaccgaatcttatatccagctgggactgcagtgcgccggaggagctggccgaggtgacctgtactcaaggttggtctctgtgtttccggctagagaaaggctgtttgccgtgtttgagcggccacagggctccccggctgcaagagcagcacccgctgcactgtgcgccttcaggttcgccgacgttcgggcagcaattagagcagcacgcaccgcctgtttcgtggagcccgccccagacgtggtcgcagtcctggactccgtagttcagggtaccggccccgcctgtgaacggaagctgaacatacagttgcaacccgaacagctagattgtggcgcagcacacctgcagcatcccctgtctatactgcagccactgaaagccacgcctgtatttagagctcccggattgacatccgtcgctgtggcctccgtgaacaattatacggctgtctttcttggcactgtgaacggtcgactgttgaaaatcaatctgaacgagagtatgcaggtggtgtcccgtcgggtcgtgaccgtggcatatggagagcccgtgcaccacgtcatgcagtttgatcccgcggacagcggatatctatacctcatgactagtcaccagatggcccgggtgaaagtcgctgcatgcaatgtgcattcaacctgcggagactgtgtcggcgctgctgacgcctactgtggttggtgtgcactggaaacccgatgtacccttcagcaagactgcactaattctagccagcagcatttctggacgtcagctagcgagggaccttcccgctgccccgccatgaccgtgctgccttccgagattgatgttcgtcaagagtaccccgggatgatactgcagatcagcggatctcttcccagcctgtcgggcatggaaatggcttgtgactacggaaacaatatccgcactgtcgcccgtgtccctggtcctgcatttggacaccagatcgcatattgcaatctacttccacgcgaccagtttccaccattcccccccaatcaggaccatgttactgtcgaaatgtctgtgcgcgtcaacggacgcaatatagttaaagctaacttcacgatctatgattgcagccggaccgcacaggtgtacccccacaccgcctgcacctcttgtctttcagcccagtggccatgcttctggtgttcccagcagcactcctgtgtttccaaccaaagtcgatgcgaggcatctcccaaccccacttctccgcaagactgccctcgaactcttttatcgccgctcgcccctgtgccgacagggggctcccagaacattctggttcctctcgcgaacaccgccttctttcaaggggccgcgctggaatgctccttcggattggaagaaatctttgaagccgtctgggtaaatgagagcgtcgtgcgctgcgaccaagtggtgctgcatacaacacggaagtcacaggtttttccgctgagtttacaactcaagggtcggcctgctagatttctggactcacccgagcccatgaccgtaatggtgtacaactgtgccatgggttctcctgactgcagtcagtgtctgggccgtgaagacttggggcatctttgcatgtggagcgacggctgtaggctccgcggcccattacagccaatggcgggtacgtgccctgctccggaaatccacgcaatcgagcctttgtctgggcctttggacggaggaacactcttaactataaggggccgtaacctgggccggagactttctgacgtggcacacggagtgtggatcgggggagtcgcctgtgaaccgctgcccgacaggtataccgtctccgaggagatcgtctgcgtgacagggcccgctccaggtcctctttcaggcgttgttaccgttaatgcctcaaaagagggaaagtccagggatagattctcgtacgtcctgccccttgttcactctttggagccaactatgggccccaaagcaggcgggactcggatcacaatccacgggaacgacctgcacgtggggagcgagcttcaagtgctggttaacgacaccgacccatgcacagagctcatgcgcaccgacacttccattgcctgcaccatgccagagggcgcgttgcccgcccccgtgcccgtgtgtgtaagatttgagagaagaggctgcgtgcacgggaatttaactttctggtacatgcagaatcccgtcatcactgcgatcagcccaaggcgatctccggtgtccggaggccggactatcactgttgcaggcgagagatttcatatggtgcaaaacgtctcgatggccgtacatcatattggccgcgagcccacgttgtgtaaggtcctgaatagtacgctcataacttgtccgtcccccggtgcactgtcgaacgcctcggccccagtagacttttttatcaatgggagagcctatgctgacgaggttgcagtagcagaggaactgctcgatcccgaggaagctcaacggggatctagatttaggttagattatctccctaatcctcagttcagcactgcgaaacgggagaaatggatcaagcaccatcctggggagcccttgaccctggtgatacacaaggagcaggactctttaggcctgcagagccatgagtaccgcgtgaaaatcggccaggtgtcttgtgacattcagatagtctctgataggattatccactgttcggtgaacgaaagcctcggagcagcggtgggacagttgccaatcacaatccaggtcggcaatttcaaccagaccatcgcaactctgcagttgggtgggtctgaaactgccatcatcgtatctattgtgatttgttccgtattactgcttctgtcagtcgtggccctgtttgtgttctgcactaaatctcggcgcgcagagcgctactggcagaaaactctgttgcaaatggaggaaatggaaagccagattcgtgaagagattagaaagggcttcgccgagctgcagaccgatatgaccgatttgaccaaggagctgaatcgctcccaaggcattccgtttcttgagtataagcatttcgtaactagaactttcttcccaaaatgttcctcgctttatgaggagaggtacgttctacctagtcagaccctgaattcacagggcagttcccaggcccaagagacgcatcccctcctcggggagtggaaaatcccggagtcgtgccgccctaacatggaagagggcatatccctattcagctccctactcaacaacaagcactttctcatagtctttgtccatgccctggagcaacagaaagacttcgcagtaagagacaggtgtagtctagcttccctgctgactatcgcgctgcacggcaaattggagtactacacgagcataatgaaagagcttctggtggacctgatcgatgcctccgccgctaaaaatcctaaactcatgctacgaaggaccgaaagcgtagtcgaaaaaatgttaaccaattggatgtccatttgcatgtatagttgtttaagggagaccgtaggagagcccttctttctgttgttatgcgccatcaaacaacagataaacaaaggctctatcgatgccatcaccggtaaagccaggtacacgctttccgaagagtggctgcttcgggaaaatattgaggctaagcctcgaaacctcaatgtctcttttcagggatgtggcatggacagtttgagcgtaagagcaatggatacagacacgctaacgcaggtcaaagagaagattctggaagccttctgtaaaaacgttccatacagccagtggcctagagccgaggatgtggatctggagtggtttgcgtcctcaactcagtcttacattctgagggatttggatgacacctccgttgtggaagacggccgtaaaaagttaaacacactggcacactataagatccctgagggggcaagcctagccatgtctctgatcgataaaaaagataatacgcttggaagggttaaagatctcgacactgagaagtattttcaccttgttctgcccacggatgagcttgcagaacccaaaaagagtcacagacagtcccatagaaagaaggtcctgccagagatctatctgactcgcctgctctctactaaaggtacgttacaaaagtttttagatgacctcttcaaggctatattgtcaatacgggaagataagccaccactcgcagtgaaatatttctttgatttcttggaggaacaagccgagaagcgagggatatctgatcctgacacgctccacatatggaaaaccaattctttacctttgcggttttgggtgaacatactaaaaaacccacaattcgtgtttgacatcgataaaacagatcatatcgatgcctgtctgtctgtaattgcccaggcgttcatcgacgcttgctcaatatccgaccttcagctggggaaggacagcccaacaaacaagcttctatacgctaaggagatccccgaataccgcaaaatcgtgcagcggtattacaagcagattcaggacatgactcccttatctgaacaggagatgaacgcacaccttgctgaagagagccgcaagtaccagaatgaattcaatacaaatgtggctatggctgagatctataaatatgccaagcgttatcgaccccagataatggccgccttggaagctaacccgaccgcccggcgcacacagctccagcataagttcgagcaagtggtggcattaatggaggataatatatatgagtgctactcagaggcctag

SEQ ID NO: 199860 - DNA, 5358 bp, Artificial Sequence
  Description of Artificial Sequence: Synthetic coding sequence
atggccccccgggccgccggcggcgcccccctgagcgcccgggccgccgccgcctcacctcccccttttcaaacacccccaaggtgccctgtgcccctgctgctattgttgctcctgggagccgccagggccggggctttggagatccagcggaggtttccttcacccacaccgacaaacaatttcgccttagacggggctgctggcacagtgtacctggccgccgtcaatcgactctatcaacttagcggagctaatctatcccttgaggccgaagccgccgtggggcctgtaccagatagccccctgtgtcatgctccccagctgccacaagctagctgtgaacatccgaggcggttgaccgataattataacaagatcttacagctggaccccgggcagggcctcgtggttgtatgtggcagtatttaccagggcttttgccagctcaggaggagaggtaatatatcagccgtggccgtgaggttccccccagcggccccgcctgcggagcccgtcactgtgttcccttcaatgctcaacgtggccgccaaccaccctaatgcgtccacagtgggccttgtgttacccccagccgccggggccggcggctccagattactggtaggagcaacctatacgggatatggaagctccttctttcccagaaaccggtctttggaggaccacagatttgaaaatactcccgagattgctattcggagcctcgatacccggggcgatctggcaaagctgtttacttttgatctgaacccttctgacgacaacatcctcaagatcaaacagggagccaaggaacagcacaaattgggcttcgtttccgctttcttgcatccaagcgacccacctccgggtgcccagtcttacgcttacctggctctcaattccgaagcaagggcaggggataaagagtctcaagcccggtcactgctagcaagaatctgtctgccgcatggggctggcggcgatgctaaaaagctaactgaaagttatatccaactcgggctgcagtgtgccgggggcgccggtcgcggtgacctctattccaggctggtgtcagtcttccctgctagggagcgcctttttgcagtatttgaacgccctcagggttctcctgctgccagggcagccccagccgccctctgcgcattccggtttgcagatgtcagagccgctattagagcagcccggactgcttgcttcgtggagcctgccccagacgtggtggccgttctcgacagcgttgttcagggcacaggccccgcgtgcgaaagaaaactgaacatccagctgcagccagagcagttggactgtggggcagcccacctgcagcatcccctgagcattctgcagcccctcaaggcaactccagtgttcagggcgcctggactgacctcagtggcagtggccagcgtgaacaattatacagccgtgttcctgggtactgtgaacggacgactgctcaagataaatctcaatgaatcaatgcaggtcgtgagcaggagggtggtaactgttgcatacggagaaccagttcatcatgttatgcaattcgatcccgccgattctggctatctgtatctcatgacaagtcatcagatggcacgtgtgaaggtggccgcctgtaacgtacatagcacttgtggtgattgtgtcggcgccgcagatgcgtactgtggatggtgtgctctggagacgaggtgcacactgcaacaggattgcactaatagctcccagcaacatttttggacctcagcatctgaaggtccatcaagatgccctgccatgaccgtcctgcctagtgagatcgacgtgcggcaggagtaccctggtatgatcctgcaaatcagcggatccttgccaagcctgtccgggatggagatggcatgcgattacgggaacaatattaggaccgtggcaagagtccctggccctgccttcggccaccaaatcgcctactgcaacctgttgcctcgcgaccaatttccgcccttccctccaaaccaggatcatgtgaccgtggagatgagtgtccgggtgaatggcagaaatatcgtgaaagccaactttaccatctacgattgtagccggactgcccaggtctacccacataccgcatgtacatcatgcctgagcgcacaatggccatgcttttggtgttcgcagcagcactcatgcgtgagcaaccagtccaggtgcgaggccagccccaacccaacttcgccacaggactgcccaagaaccctgctgagccctctggcacccgttcccactgggggctcccagaacattctggtgccactggcgaatacagccttcttccagggtgctgcactcgaatgctcctttggcctggaggagatattcgaggctgtgtgggttaatgagtcagtagtcaggtgtgaccaagtggttcttcataccacacggaaaagccaggtgttccctctaagcctacaactgaaggggaggcccgctaggttccttgatagtccagaaccaatgacagtaatggtgtacaactgtgcaatggggtccccagactgcagccagtgtctcggacgtgaggatttagggcatctgtgtatgtggtcagatggatgtcggctgagaggacccctgcagcccatggcaggaacgtgccctgcccccgaaattcatgctattgagcccctgagcggacccctagatggcggcacactcctaacaatccgaggcagaaaccttggacggcggctgtccgatgtggcccacggtgtctggatagggggagttgcatgcgagccactgccagatcggtatacagtctcagaggagattgtttgcgtaacaggaccagccccgggacctcttagcggagtagtcaccgtgaatgcgagcaaggagggcaagtcccgagaccgctttagctacgtgctgccattagtgcacagccttgagcccaccatggggccaaaggcgggcggtacccggataacgatccacggtaatgacctccatgtaggctccgagttgcaagtattggtaaacgataccgatccttgtactgagctgatgcggactgatacatcaattgcatgcactatgccagagggtgccctgcctgcccccgtccctgtgtgtgttcgtttcgagcgacgcggatgtgtacacggcaatctgaccttctggtacatgcagaatccagtgatcactgctatcagtccaaggcggtccccagtgtctggaggcaggactatcacagttgctggtgaaagattccacatggtgcagaatgtgtcaatggcggtccatcacatcgggagagagccgaccctctgcaaggtgctgaacagtacactaattacctgtccaagtcccggcgctttgtcgaatgcttcggctcctgttgacttcttcattaatggcagggcttacgccgatgaagtagcggtggcagaggaactgctcgaccccgaagaggcacagcgggggagcaggttcagactagactatcttcccaacccccagttcagtactgctaagcgcgagaaatggataaaacaccaccctggcgaaccgctaactctggtgatacataaagagcaggactcactgggcctgcagtcccatgaatacagagtgaaaattggacaggtctcttgtgacatccagatcgttagtgaccgtataatccattgttccgtcaacgagagtctgggtgctgcagtgggacagctacctataacaattcaggtaggcaatttcaaccagacaatcgccacgctgcagctcggcggatcagagactgcaataatcgttagcattgtgatatgtagcgtgctcttgctgcttagtgtcgttgccctttttgtcttttgtaccaagagccgacgcgccgagagatattggcagaagacgctgctgcagatggaagagatggaatcccagatccgcgaggagatcagaaagggtttcgcagagctacagactgacatgaccgacctgactaaggaattgaatcgcagccagggcattccctttctggaatataaacactttgtaacgcgaacattcttcccaaaatgcagttccctgtacgaggaaaggtacgtgctccctagccagacattgaactcccaaggttcttcccaggcacaagagacgcaccctctattgggcgaatggaaaattcccgaatcttgtaggcccaatatggaggaggggatttcactgtttagcagcctgcttaacaacaagcactttctcattgtctttgtgcacgcgctcgaacagcagaaagacttcgccgtgagagacaggtgtagcctagccagccttctcacaatcgccttacatggcaaacttgaatattatacatctataatgaaggagttgctggtggaccttattgatgctagcgcggctaagaaccctaaactcatgctgcgccgcaccgagtccgttgttgaaaaaatgttgactaactggatgtctatttgtatgtatagttgcctgcgagagactgtcggagagccattttttctcttgctgtgcgcgatcaaacagcagatcaataagggatctatagacgctattacagggaaggcgaggtacaccctcagcgaagaatggttactccgtgagaatattgaggctaagcccagaaatctgaatgtgtcctttcaggggtgcggaatggactctctgagtgtgcgggcgatggacacagacactctcacccaagtaaaggaaaagatcctcgaggccttttgcaagaacgtgccgtacagtcagtggccccgcgcagaagatgttgaccttgaatggttcgcctcttcaacacaatcctatattctccgtgatttggatgacactagcgtcgttgaggacgggcgcaagaagctgaataccctggcacactataaaatccccgaaggggccagcctggccatgagtctgatcgacaagaaagataataccctcggcagggtgaaagacctggatacagagaagtactttcaccttgttctacctactgatgagttggctgaaccaaagaagtcccacaggcaatctcacagaaaaaaagtcctacctgagatttacctgactcgcctcctctccacaaagggtacgctgcagaagttcctggacgacctgttcaaagcaatcttgagcattagagaagacaagccccctctggctgtaaagtacttcttcgacttcctggaagagcaggccgagaagcggggaataagcgaccccgatacactacacatctggaagactaatagatggcgcccttcaagccctgttttgggggagcaccctgaggagccccctgtttgtctgtag

SEQ ID NO: 199861 - DNA, 1503 bp, Artificial Sequence
  Description of Artificial Sequence: Synthetic coding sequence
atgcggggcgagctgtggctgctggtgctggtgctgcgggaggccgctagagccctgagtccccaaccaggggccggccacgacgagggccccggctctggttgggcggccaaaggtactgtgcgtggatggaacagaagagccagagaatctccgggacacgtctcagaacccgacagaacacaactctctcaggatctggggggaggcaccttggccatggatacactgcctgacaatcgaacacgcgtggttgaggataatcacagttactatgtgtcacggctctacggaccatccgaaccccatagccgcgaactctgggtggatgttgccgaagcaaataggtctcaggttaaaattcacaccattctgagcaacacacacaggcaggcctccagagtcgtcttaagtttcgattttcccttctacgggcaccccctgcgtcagattaccatagccacagggggatttatttttatgggagatgtgattcaccggatgctgacagctactcaatatgttgcaccactgatggccaactttaatcccggatatagtgacaatagcactgttgtctactttgacaacggaacggtgttcgtagtgcagtgggaccatgtttacctccagggctgggaagacaaagggtctttcacgtttcaggctgccttgcatcacgacgggagaatcgtttttgcttacaaagagattcccatgtcggttcccgagatatcctcctctcagcaccctgtgaaaacagggttgtcagacgccttcatgatcttaaaccctagcccagatgtccccgagtcccgtaggcgatccattttcgagtaccaccggatcgagctagacccttctaaggtcacttccatgagtgccgtcgagttcactccccttcctacctgcctacagcataggtcttgtgacgcttgtatgtcttccgacctaacctttaattgtagttggtgccatgttctgcagaggtgttctagcgggttcgatcggtatcgccaggagtggatggattacggatgcgctcaagaggcagagggaaggatgtgcgaggattttcaggacgaagatcacgacagcgccagcccagacaccagcttctctccctacgacggcgatctgacgacaacctcgagcagcttgtttatcgatagtctgacaactgaagacgacactaagctcaacccatatgctggtggagatggactgcagaacaacctttcgcctaagaccaagggcactccggtgcacctcggaactattgttggaatcgtgcttgcagtgctgctggtcgctgccattatccttgccgggatctacattaatggccatcctacttcgaacgctgctctgtttttcatcgagagaagacctcaccattggcctgccatgaagtttagatctcatccggatcactcaacatacgccgaagtggaaccttccggccacgagaaagaaggctttatggaagctgagcaatgttag

SEQ ID NO: 199862 - DNA, 1014 bp, Artificial Sequence
  Description of Artificial Sequence: Synthetic coding sequence
atgcggggcgagctgtggctgctggtgctggtgctgcgggaggccgctagagcattgagccctcaacctggtgccggccacgacgaaggtccgggttcaggctgggccgccaaaggaactgttagggggtggaacaggcgcgcgagggagtcgcctgggcacgtaagcgagcccgatagaactcagctttcacaggatctcggaggaggcactcttgccatggatacattgcccgacaatcgcacgcgtgtagtcgaagataatcacagttattatgtctcccggctctacgggccaagcgaaccccacagtagggaactgtgggtggatgtggcagaggccaaccgttctcaggtgaagatccacacaatcctctccaatacacaccggcaggccagccgggtcgtcctgtcattcgactttcctttttatggccatcctctacgccaaattacgatcgcgactggcggttttatcttcatgggagacgtaattcatcgcatgctgactgcaacccagtatgtggcgccactcatggcgaacttcaatcccggatactctgataactccacagtggtgtacttcgacaacggcactgtgttcgttgtccagtgggatcacgtttacttgcagggctgggaggacaaaggaagttttacatttcaggctgcacttcatcacgatgggagaatagtctttgcttacaaggaaattcctatgtcagtgccagagataagttcgtcccagcaccccgtcaaaactggtctgtccgatgcttttatgattttaaatcccagcccggatgtgccagagtcccgcaggcgctctatctttgagtaccaccgtattgagctggacccctccaaggtaaccagtatgtccgctgttgaattcactccactgcccacatgcttacagcatcgttcctgcgacgcttgtatgtcgtccgacctgacttttaactgcagttggtgccacgtcttgcagagccgtgatgaggttagcccatgttag

SEQ ID NO: 199863 - DNA, 1284 bp, Artificial Sequence
  Description of Artificial Sequence: Synthetic coding sequence
atggacaccctgcccgacaaccggacccgggtggtggaggacaaccatagttattatgttagcaggttgtatggtccttcagagccgcattccagagaactttgggtggatgtagccgaagctaacagatctcaggttaagattcatacgatcctctctaacacccatagacaggcttctcgagtcgtgttgtcattcgattttcccttttatggccaccccctgcgccagattactattgccactggcggatttatcttcatgggcgacgtgatccaccggatgctgacagcaacgcagtacgtggcgcctttgatggctaatttcaatcccgggtacagcgacaactctaccgtcgtgtatttcgacaacggcaccgtgtttgtggtgcaatgggatcacgtgtatctccagggatgggaggataagggctctttcacatttcaggccgcactccaccacgatggtcgcatcgtgtttgcttataaagaaatcccaatgagcgttcccgagatctccagctcccagcacccagtgaaaacaggtctttctgacgctttcatgatcttgaatcctagccctgacgttccagaaagccgaaggaggtcaatttttgagtaccataggatagagctggacccgtctaaagtgacctccatgtcagccgtcgagttcacgccactgccaacctgtctgcaacatagatcttgtgatgcctgtatgtcaagtgatctgacattcaactgctcatggtgccatgtcttgcaacgtagccttaataatcaggacgaaaacacctacgtgaattgtctggactctcagcagtgccacggctctagtgagagtcggcgcccattccaagacgaagaccatgacagcgcgtcacccgacacgagcttctctccatacgatggagatctgacgaccaccagctcttctctgttcatcgatagccttacaacagaggatgatactaaactgaatccgtacgctgggggcgatggcttgcagaacaacctgtctcccaagaccaaaggcacccccgtacacctcggcactattgtcggcatcgtgttggccgttttgctggtggccgccatcatcctcgccggtatttacattaatgggcaccccactagcaatgcagctctgttcttcattgaaaggaggcctcatcactggcctgctatgaagttcaggagccaccccgaccacagcacatatgccgaagttgaaccgagcggtcacgagaaggaaggatttatggaagcagagcagtgttag

SEQ ID NO: 199864 - DNA, 375 bp, Artificial Sequence
  Description of Artificial Sequence: Synthetic coding sequence
atggacaccctgcccgacaaccggacccgggtggtggaggacaaccacagttattacgtctcacggctgtacggccccagtgagcctcattctcgtgagctgtgggtggacgtggcggaagccaatagatcccaggtaaagatccatacaattctatccaatacacacaggcaagcttcccgcgtggtgcttagctttgactttcccttttacggacatccattgaggcagatcaccattgccacaggtggctttatcttcatgggggacgtgatacataggatgctgacggctacacagtatgtggcaccattgatggcaaactttaatcctgggtactctgataactccactgtggtgtactttgataactag

SEQ ID NO: 199865 - DNA, 669 bp, Artificial Sequence
  Description of Artificial Sequence: Synthetic coding sequence
atggacaccctgcccgacaaccggacccgggtggtggaggacaaccacagctactacgtctcacggctgtacggcccaagcgaaccacacagtagagagctctgggttgacgtcgccgaagccaatcgcagccaggtaaagatccacacaatactttctaacacacatcgtcaggcatctcgggtggtactaagcttcgatttccccttctacggtcacccccttcgccaaatcactatcgccacagggggctttatctttatgggagatgttattcatagaatgcttaccgccacccaatatgttgcccccctcatggccaacttcaaccccgggtacagcgataattcaacagtcgtctactttgataatgggactgtgttcgtggtgcagtgggaccacgtgtaccttcaaggctgggaagataaaggtagctttacttttcaggctgctttacaccacgacggccgaatagtcttcgcttacaaagaaataccaatgagtgtgccagagataagtagttcccagcaccccgtgaaaactggactctccgatgcgttcatgatactgaacccatcccctgatgtgccagagagcaggcggcgtagcattttcgagtaccaccgaatcgagcttgatccgtccaaagttacgagcatgtccgcttag

SEQ ID NO: 199866 - DNA, 198 bp, Artificial Sequence
  Description of Artificial Sequence: Synthetic coding sequence
tgaagcttcaccttccaggccgccctgcaccacgacggccggatcgtgtttgcctacaaggagatccccatgtccgtgcccgagatctctagcagtcagcaccctgtcaagacaggactgtccgacgcctttatgatactgaacccaagcccagatgtgcccggattctccgcagaatccgcgaaacatctgtggtag

SEQ ID NO: 199867 - DNA, 1383 bp, Artificial Sequence
  Description of Artificial Sequence: Synthetic coding sequence
atggccctgagcgtgcggaccctgcccctgcggggcttcctggtgccacggccccagcctacgcgcagccaggatgcaccaagccctcgactcccattgtcatccgctcccgctccctgccggcataagaatgaagaagacaaccactcatattatgtatctcgactgtacggccccagcgagccccactccagagaactgtgggtcgacgtagctgaggctaatcgctcacaggttaagattcatactattctgagtaacactcatagacaggccagccgcgtggtcctaagttttgacttccccttctacgggcatccactgcgccaaattaccatcgcaacgggcggtttcatctttatgggcgatgtgattcatcggatgcttaccgccacacagtatgtagcgcccctgatggcaaactttaaccctggctactcggataattccacagtggtctacttcgacaatggcaccgtgttcgtggttcagtgggatcacgtatacctacagggatgggaggacaaaggtagttttacttttcaggcagctctgcaccatgacggtaggatcgtgtttgcctacaaagaaattccaatgtccgttcctgagattagttcgagccagcacccagtcaaaacaggactgtctgatgcatttatgatcctcaatccatctccggatgtcccagaaagtcgtagacgtagtatctttgagtaccaccgaatcgagctcgacccctccaaagtgacctccatgtcggcagtggaattcactcccctgcccacttgcctgcagcatcggtcttgtgacgcatgtatgtcctccgatttaacatttaactgttcatggtgccacgttctgcagagatgcagcagcggtttcgatcgttatcggcaggaatggatggattacggttgcgcccaggaggccgagggtaggatgtgcgaggattttcaggatgaagaccatgactctgcctccccagacaccagcttcagcccttatgatggggacctgacaactaccagttccagtctttttatagattccctgacaactgaagacgacacaaaactgaacccttacgcagggggagatggattgcagaataacttgtccccgaaaacaaagggcacccctgtacacttgggcaccatagtggggatcgttctggccgtgcttctagtggcagctattatcctcgccgggatctacattaatggtcaccccaccagcaatgccgcattatttttcattgaacggcgacctcaccattggcccgccatgaaattccgatctcaccctgatcactccacgtatgcagaagtggagccctctggacatgaaaaggaaggatttatggaagcagagcagtgctag

SEQ ID NO: 199868 - DNA, 723 bp, Artificial Sequence
  Description of Artificial Sequence: Synthetic coding sequence
atggacaccctgcccgacaaccggacccgggtggtggaggacaaccattcttattatgtgtcacggctctacgggccgagcgagccccactcccgggagttgtgggtggacgtcgccgaagcaaatcgcagtcaggttaagatccacaccatcctgtccaatacacacagacaggctagcagagtggtgctgagctttgactttccgttttacggccatcctttgcgccaaatcactattgctactggagggttcatcttcatgggtgatgtgatccataggatgctgactgccacacaatacgtggctccactgatggctaattttaaccctggctattcggataatagcacggtggtatacttcgataacggtactgtttttgttgtccagtgggatcatgtgtatcttcagggctgggaggataaaggaagctttactttccaagctgcgctccatcatgacggccggattgtgtttgcatacaaagaaatccccatgtcagtgccagaaatttccagttcacagcatccagtgaagaccggcctttctgacgcattcatgatcctgaatcctagccccgacgtgccagagagtaggcggcggtcaatcttcgagtatcacaggatcgagctggatccctcgaaggtaacctccatgtcagccgtagagttcacccctctgcctagtcccagtactaccaggatgaagacacgcatgtag

SEQ ID NO: 199869 - DNA, 1179 bp, Artificial Sequence
  Description of Artificial Sequence: Synthetic coding sequence
atggagaaggacaaggtgaagatccacggcatcctgagcaacacccacaggcaagccgcaagggtcaatctaagcttcgatttccctttctacgggcattttctgcgggagattacggttgccactggcggctttatttatacaggcgaggtggtgcaccggatgctcacagctactcagtacattgctccactgatggcaaacttcgatccttccgtgtccaggaactccactgtgcggtatttcgataatggcaccgccttagtggtccaatgggatcacgttcatctccaggataactacaatctgggaagtttcacgttccaagcaacactgctgatggacgggaggattatcttcggatacaaggagatacccgtattagttactcagatatctagcactaaccaccccgtcaaagtggggctgagcgacgcgttcgtggtcgtgcaccgtatccagcagatcccgaacgttcggagacgtacaatctatgagtatcatagggtcgaacttcagatgagcaagatcacaaacatcagcgctgttgagatgacccctttgccaacatgtctccagtttaatagatgcggcccgtgcgtgtcttctcagatcggcttcaactgcagctggtgtagtaagttgcagcggtgttcgagcggctttgacagacacagacaggattgggtggactcaggatgtcctgaggagtccaaggaaaaaatgtgcgaaaatactgaacctgtggaaacatcctctaggactaccacaaccgtgggagctaccactacacagttcagagtgctgacaaccacccgcagggctgttacctcccagtttccaacaagcctgccgacagaagatgacacgaaaatagctctgcatctaaaggacaatggagcatccaccgatgactcagccgccgagaaaaaaggggggactctacacgctggactgatcatcggcatattgattctcgttctcatcgttgctacagccatcctggtcacagtgtacatgtaccaccatcccacgtctgctgctagcattttcttcatcgagagaaggccctcccgctggcctgccatgaaatttcgacgaggcagcgggcatcctgcctatgccgaagttgagcctgtgggcgagaaggaaggcttcattgtgtcagaacagtgttag

SEQ ID NO: 199870 - DNA, 1443 bp, Artificial Sequence
  Description of Artificial Sequence: Synthetic coding sequence
atggcccggttccccaaggccgacctggccgccgccggcgtgatgctcttatgtcactttttcaccgaccagtttcagttcgccgacgggaagccgggggatcagatactcgattggcaatatggggttacgcaagccttcccccacaccgaggaagaggttgaggttgactctcatgcctactcccatagatggaagcgtaaccttgatttcctgaaagctgtggatacaaacagagcttctgtcggacaagactccccagagccccggtcattcacagatctgctgctggacgacggacaggacaataatacccagatagaaagagtcaatctcagttttgatttccctttctatggtcacttcctgcgggaaatcactgtcgctacgggtggattcatctatacgggcgaggtggtacaccgtatgctgacagccacccagtacattgcaccactcatggctaacttcgatccctcagtgtcaaggaattccacagtgcgctacttcgataacgggacagctttggtggtccagtgggaccacgtacacctccaagacaattataacctcggctccttcactttccaagctactctgctgatggatgggcgaattatttttggatacaaggaaatcccagttctcgtcacccagatttcttccactaatcaccccgtgaaggtcgggctatctgacgcatttgtggtggtgcatcggattcaacagatcccaaacgttcgccgccgtaccatttacgagtatcatcgagtggagcttcagatgtccaagattactaatataagcgctgtagagatgacgcctttgccgacatgccttcaattcaatcggtgcggaccctgcgtgtcgtcccagattgggttcaattgttcatggtgttccaagctccagcgttgctccagcggctttgatcgtcataggcaggattgggtcgacagcggatgtccagaggaatctaaggagaaaatgtgcgaaaataccgagccagtggaaacttcaagtagaactactacgactgtaggggccacaaccactcagtttcgcgtcctgaccaccactcgtcgcgcagtcacatcgcagtttcctactagtctccctaccgaggatgatacaaagatcgcactacatctgaaggataacggagcttctactgatgatagtgccgctgaaaagaagggggggacactgcatgccggtctcatcattggcatattgatcctggtactcatcgtggctaccgccatcctagtgactgtgtacatgtatcaccatcccacatccgccgcaagtattttctttatcgagcgtcgaccaagccgttggccggctatgaaattccgcagggggtccgggcatcccgcatacgctgaggtggagccggttggtgaaaaggaagggtttatagtatcggagcagtgttag

SEQ ID NO: 199871 - DNA, 1590 bp, Artificial Sequence
  Description of Artificial Sequence: Synthetic coding sequence
atggcccggttccccaaggccgacctggccgccgccggcgtgatgttgctatgccacttttttactgatcaattccaattcgcggacggtaagcctggcgaccaaattctagattggcagtacggcgtgactcaggcttttccacataccgaggaggaagttgaagtagactcccacgcgtactctcacaggtggaagcgcaacttggacttcctcaaagccgtcgatacaaacagggcgagcgtcgggcaggactccccggaaccaagatcattcaccgatttgctgctggatgatggacaggataacaacacccagatagaagaggacacggaccacaattattatattagccgcatatacggtcctagcgatagcgcctcccgcgacctgtgggtgaacatagatcagatggaaaaggataaggtcaaaatccacggaattctttctaacacccatagacaggcggcccgagtgaacctctcattcgattttccattttatggccattttcttagagagataacagttgcgacaggggggtttatctatacgggcgaagttgtgcaccggatgctgaccgcgacacagtacattgcacctctgatggctaattttgacccatctgtatccaggaacagcacagtgcgctactttgacaacggcacagctctagttgtccagtgggaccacgtgcacctccaagataactacaatctgggcagttttacattccaggctacactgctgatggacggcagaataatattcggctataaggagattccagtactggttacccagatttcaagcaccaatcaccctgtcaaagtgggactctctgatgcctttgttgtggtgcatcgcattcaacagatccccaatgtgcgcagaagaaccatctatgagtatcatagagtcgagctgcagatgtcaaagattacaaatattagtgctgtcgaaatgaccccactgccaacttgcctgcaattcaataggtgtgggccttgtgtgagtagccagatcggctttaattgcagctggtgctctaagctccagcggtgttcaagcggattcgaccgccatcggcaggattgggtcgattcaggatgccctgaggagagtaaggaaaaaatgtgcgagaacaccgaacccgtggagacttcatcacggaccacaaccaccgtgggcgcaactaccactcagttccgggtcctgacaaccacacgacgcgcggtgacctcacagtttcccacaagtttgcctactgaggacgacacaaagatcgccctgcacctaaaagataatggagcgtcaacggatgacagcgccgctgagaagaagggtggcaccctgcatgctggcttgatcattggaattctgattctggtgctcatcgtcgccacagccattttagtgaccgtatacatgtaccaccaccctacaagcgccgccagcatcttcttcattgaaaggaggccatcaagatggccagcgatgaagtttagaaggggctccggacacccagcctacgccgaagttgagccagtcggggaaaaagaaggtttcattgtgagtgagcaatgctag

SEQ ID NO: 199872 - DNA, 1548 bp, Artificial Sequence
  Description of Artificial Sequence: Synthetic coding sequence
atgctgctgtgccacttcttcaccgaccagttccagttcgccgacggcaagccgggtgaccagatcctggactggcagtatggggtaactcaggcctttcctcatacagaagaggaagtcgaagtcgacagccatgcctacagtcaccgctggaaaagaaatcttgatttcctgaaagcagtcgacacaaatcgcgcctcagtcggtcaggactctcccgagccacgtagcttcaccgacctcctgcttgacgatggacaagataacaacacccaaatcgaagaggataccgaccacaactactatatcagccgtatctatggcccatccgacagtgcatcacgagacctatgggtgaacattgaccagatggagaaggataaggtgaagatacacggtattttaagcaatacccataggcaggcagccagagtcaatctttccttcgatttcccattctatggacatttcttacgggaaatcaccgtggctactggcggctttatatatactggcgaggtggtgcatcgcatgctgactgccacacagtatatcgcacctctgatggctaatttcgatccatccgttagccggaatagcacagtccgttacttcgacaatggcactgccctggtggtccagtgggatcatgtgcatctacaggataactacaatctgggctcatttacatttcaggccaccctgctgatggatggccgcatcatctttgggtacaaagaaatcccagttctagtgacgcaaatttcgtccactaatcatcccgtcaaggttgggctttcggatgccttcgtcgtagtacatcggattcaacaaatcccgaacgttcggaggcggaccatctatgaataccacagagtggagcttcagatgtccaaaatcacaaacatttctgcagtggagatgactcctctccctacgtgtctgcagttcaaccggtgcggtccctgtgtcagcagccagattggtttcaactgctcttggtgctcaaaactccagagatgctcgtctgggttcgaccgccaccgacaagactgggtggacagtggttgccctgaggagtccaaagaaaagatgtgcgagaataccgaacctgtggagacatccagcaggacaacgacaaccgtgggcgccaccaccacgcaattccgcgtccttactaccactcgccgggccgtaacgtcccagtttccaacatctctgccaactgaagacgatactaaaatagccctccacttaaaagataatggcgcatcaaccgacgattcagccgcagagaagaagggaggaactctacacgcggggcttatcatcgggatcctgatcctggtgcttatcgttgcgaccgctatcttagttaccgtgtatatgtaccaccaccccacaagcgccgcaagcatatttttcatcgaacgtcgacccagtcgatggcctgccatgaagtttaggaggggtagtggccaccctgcctacgcggaagtggaacctgtgggcgaaaaggaggggtttatagtgtctgagcagtgttag

SEQ ID NO: 199873 - DNA, 1581 bp, Artificial Sequence
  Description of Artificial Sequence: Synthetic coding sequence
atgcggtgcgccctggccctgagcgccctgctgctgctgctgagcactccccctttattgccgagcagtccttcaccaagcccttctccctcacagaatgccacccagaccacaaccgattccagcaacaagacagccccaactcctgcatcttccgtgaccatcatggctacagatacagcacagcagagtactgtacccacttccaaagcgaatgagattctagcatctgtgaaagccactacattaggagtcagttctgatagcccaggaacgaccactctggctcagcaggtgtccggacctgttaatacaacagtggccaggggtggaggtagtgggaatcccacgaccaccatagagagtccaaaatccactaaaagcgccgatacaacaaccgtcgccacttcaactgcaacggccaagcctaacactacctcttcccaaaacggtgccgaggatacgacaaactcagggggcaaaagcagccactccgtcactaccgacctgacttctacaaaggctgaacacctgaccacaccccatcctacctcaccgctctcaccccggcagcccacatcaacgcatccggttgccaccccgacgagcagtggtcacgatcatctaatgaaaatttcatcctcctcctccactgtggcaataccaggatacaccttcacttccccaggcatgacaactacactgccctcatccgttatcagccagcgcactcagcagacatcctcccagatgccagcttcaagcacagcaccaagcagtcaagagaccgttcaacctactagcccggccacggcgctcagaacaccaaccctgccagagaccatgtcatccagcccgaccgccgcctccaccacacatcgctaccccaagacgccctccccgactgtagcccatgaaagcaactgggccaagtgtgaggatttagagacacagactcagagcgagaagcagctcgtactaaacctgaccggaaacactctctgcgctggaggggcctctgacgagaaactgattagtctgatatgccgcgcagtaaaagccacattcaaccccgcccaggacaagtgtgggataaggctggcaagtgtgcccggaagccaaaccgtggtagtaaaggagattactatacacaccaagctcccagccaaggacgtgtacgagaggctcaaagacaaatgggatgaactgaaggaggccggcgtgtccgatatgaagttgggcgaccaaggacctcctgaggaggccgaggatcgatttagtatgccgctcataatcacaatcgtgtgcatggccagcttcctcttactagtggctgcactctatggttgctgtcaccagcgcctctcccaacgcaaagatcagcagcgtcttacagaggagctgcagacagtggagaacggatatcatgacaatcctactctcgaggtgatggaaactagtagtgaaatgcaggagaaaaaggtcgtttcgcttaatggagaacttggtgactcatggatagttcctctcgacaacctgaccaaggatgatttggatgaagaagaagatactcacctgtag

SEQ ID NO: 199874 - DNA, 1677 bp, Artificial Sequence
  Description of Artificial Sequence: Synthetic coding sequence
atgcggtgcgccctggccctgagcgccctgctgctgctgctgagcacgccccctctattgccttcaagtccaagccctagcccatcacccagtcagaacgccactcagacaaccacggattccagtaacaaaacggctccaacgcctgcctcctctgtgacaataatggccaccgacacggctcagcaatccactgtcccaaccagtaaggccaatgagatattagcctcagtgaaagctaccaccctgggggtgtcaagcgatagcccaggaacaaccactctggcgcagcaggtgtccggcccggtcaatacaaccgtagctcgagggggggggagtggaaatccaacgactacaatagaatcacctaagtcaacaaagtcagcagataccaccacagtcgctacaagtactgcgacagcgaaacccaacaccacctccagtcagaacggtgctgaagataccaccaattcaggcgggaaaagtagccactcagtaacaacagatcttaccagtaccaaagctgagcacttgacaactccacacccgaccagccccctgagccctcgccagcccactagcactcatcccgtggcaacccccacaagtagtggacacgaccatcttatgaagatttcttcatcatccagcacagttgcgatccccggatacacttttacatcaccagggatgaccaccactctactggagaccgtttttcaccatgtaagtcaggccggactcgaactgctgacatcaggcgacctacctacccttgcttcccagtcagcaggtatcacagcgagctctgtgatcagtcagcgcactcaacaaactagctcgcagatgccagcctcctccacagccccaagttctcaggagactgttcagccgaccagccctgcaacagccctcaggacccccactcttcctgaaaccatgagttcgtcaccgacagctgcctcgacaactcatcggtaccccaaaacaccttcacctaccgtagcacatgagtccaactgggccaagtgtgaagacctggaaactcagacacagtcggagaagcagttagttctgaatctcacaggaaacacactctgcgctggcggggcaagcgatgaaaaactgatctcactaatttgccgtgccgtcaaggctactttcaatccagcccaagacaagtgtggaatccggctggcctccgtgccgggatcccagacggtcgttgtaaaagagataacaatccacacaaagctcccagctaaggacgtctacgaacgattgaaagataagtgggatgagctgaaagaggccggggtgtcagatatgaaactgggggaccagggccctcctgaggaggccgaagacagatttagcatgcctttgatcatcaccattgtttgcatggccagttttctgctcttagtggctgccctttacggctgctgccatcagagactgagccagcggaaagaccagcagagattgaccgaggaactgcagactgtggagaatggatatcatgataatcccacgctggaggtgatggagactagcagcgaaatgcaggagaaaaaagtcgtgtcgttgaacggggaacttggggacagctggatcgtcccgctagacaatctgactaaggatgatctggacgaggaggaagacactcatctgtag

SEQ ID NO: 199875 - DNA, 1581 bp, Artificial Sequence
  Description of Artificial Sequence: Synthetic coding sequence
atgcggtgcgccctggccctgagcgccctgctgctgctgctgagcacacctccccttctgccctccagcccaagtccaagtccttccccctcgcaaaatgcgacccagactacaaccgatagcagtaacaagaccgcgcctaccccggccagttccgtgacaatcatggcaaccgacacagcacaacagtctacagtgccaacctcaaaggccaacgagatactggcttcagtaaaggcaaccactctgggggtgagttccgatagcccaggaactacgactctggctcagcaggtctctgggccggttaatacgaccgtcgcaagggggggaggttcaggtaacccgactacgactattgagtccccaaaatcaaccaagtctgcggacactaccacagttgctactagtaccgctaccgcaaagccaaacacaacgtcgagccagaacggcgctgaggacactactaattccggcggtaaatcttctcattcagtgacaacggacctgacttcgaccaaggcagagcaccttacaaccccacaccccacctcaccgctctcaccaagacaaccaacatccacgcacccagtggcgacacccaccagctctgggcacgatcaccttatgaaaatctcctcgtccagcagcacagtcgctatcccaggctatactttcacaagccctgggatgactactactttgccgtcatctgtcatttcccagcgaacacaacaaaccagctctcaaatgcccgcgagtagtactgccccgtctagccaggagaccgtgcaacccacaagtcctgctactgccctacgcacgcccacgctgcccgaaaccatgagtagcagccccactgcggcaagcaccactcaccgctaccctaaaactcctagccctacagtcgcacatgaaagcaattgggtgaccccagcgggcgttggcacccagaccagggttgaggaggccctacggcaggctcttacacattccctcctgcccgcaggtggggcaagcgacgagaagctcatcagtttaatctgtcgggctgttaaagctaccttcaaccccgcccaggacaagtgcggcatccgactcgcctccgtgccgggatcacagacagttgtggtgaaggagattacgattcacaccaaactgccggctaaggacgtctacgaaaggctgaaggataaatgggatgaactgaaggaggctggggtcagtgacatgaaactaggagatcaaggtccacctgaggaggcagaagatagattctctatgccgctcattataacaattgtgtgcatggcctcgttcctgctgctggtggctgcactatatgggtgctgccaccagaggctcagtcaaagaaaggaccagcaaaggctgacagaggagctccaaactgtagaaaacgggtaccacgataatcctacattagaagtgatggaaacgagttccgaaatgcaggaaaagaaagtggtcagcctgaatggcgagctgggggattcatggattgtgccactagacaatcttaccaaagacgaccttgacgaggaagaggacacccacttatag

SEQ ID NO: 199876 - DNA, 1683 bp, Artificial Sequence
  Description of Artificial Sequence: Synthetic coding sequence
atgcggtgcgccctggccctgagcgccctgctgctgctgctgagcacacctccattactgccttcttcaccctctccaagcccttcacctagccagaacgagactgcgacccagactaccaccgactcttccaataaaacagcccccactccagcctcaagtgtgacaattatggctaccgacacagctcagcagagtacggtcccgacttcaaaagccaatgaaatcctagcctccgtaaaagcgacgacccttggtgtatcctctgattctcccggcaccaccaccctggctcagcaggtcagtggccctgtaaacacaaccgtggctcgtgggggcggctccgggaaccctactaccacaatcgagagtcccaaatcaacaaagagtgcagatacgactactgtggccacctctaccgctaccgctaaaccaaatacgacaagttcccagaacggagcagaggacaccaccaatagcggagggaagtccagccactctgtaactaccgacctgacttctaccaaggccgaacatttgacaacccctcaccccaccagcccactgagccctaggcagcccacttcaactcatccagttgctacaccaacttcctccggccacgaccaccttatgaaaattagttctagttccagcactgtggcaattcccggctataccttcacctcacccggaatgacaactacgttacttgaaacagtttttcaccacgtgagccaagcgggactcgaactgttaactagcggggacctgccaactttggcgagtcagtctgccgggataaccgcgtcctctgtgattagtcagcggacacagcagacttcctctcagatgcctgcttcttcaacggctcccagctcccaggagaccgtgcaaccaacctctcctgccaccgccctccggacccccaccctccctgaaacaatgtcctctagcccaaccgctgcttccacaacccaccgctacccaaagactccctccccgactgtagcgcatgaaagtaattgggccaagtgcgaggacttggagacacagacacaaagtgaaaaacagctagtgctaaatttaacaggcaacacactctgcgcggggggcgcatccgacgaaaagctgatcagtcttatctgccgcgccgtgaaagcgaccttcaaccctgcacaggataaatgcggcattagactcgcatctgtgccagggagtcagaccgtagtagtgaaggagatcaccatccacaccaaactgccggccaaggacgtttacgagcgtctgaaagacaaatgggatgaactcaaggaggcaggcgtttccgatatgaagttaggtgaccaggggccccctgaagaagcggaggatcggttttctatgcctctaattataacgatcgtgtgcatggcttcttttctactgcttgtcgctgctctctacgggtgttgccaccaaaggttaagccagagaaaggaccagcagcgcttgacagaggaactgcaaacggtcgagaacggttaccacgacaatccaacactcgaagtgatggaaacgtcttctgaaatgcaggagaagaaggtcgtaagcctgaatggagaattgggtgatagctggatcgtgcctttagataatctgactaaggatgatcttgatgaggaagaagatacacatctttag

SEQ ID NO: 199877 - DNA, 1551 bp, Artificial Sequence
  Description of Artificial Sequence: Synthetic coding sequence
atgcggtgcgccctggccctgagcgccctgctgctgctgctgagcactagcccttccccctcccaaaacgcgacccagactacaacagattctagcaataagacagcacctacccccgcctccagcgtgacaattatggctaccgacactgcccagcagtccactgtaccaacgtcgaaagcaaacgagatacttgcctccgtcaaggccaccacactgggagtatcaagcgattcacccggtactactaccctcgctcagcaagtatcaggcccagttaatactactgttgccagaggaggaggcagcggcaatcctactacaactattgagtcacccaaaagtacgaaaagcgccgatactactactgtagcaacgtccaccgcaaccgctaaaccgaacacaacctcctcacagaacggggcggaggacacgaccaacagcggcggaaaatcctcacattcggtcactaccgatctgaccagcaccaaagccgaacacctcaccacgcctcaccccacatctccgctgtcccccaggcagccaaccagtactcacccagttgctactcctacttcatctggacacgatcaccttatgaagatatcaagctcctcgtcaacagtggcgattcccggctatacctttaccagccccggaatgaccacgacactgccatcttccgttatttcccagcgcacacaacagacctcaagccagatgcccgccagttccaccgctccatcctcccaagaaacggtccagccaactagtcccgccaccgcgctccgcactcctactctccctgaaaccatgagctcaagcccaactgccgcaagtactacccatagatacccaaagactccaagcccgacagtcgcccacgagtcaaactgggccaagtgtgaagacctggagacccagacccaatcagagaagcagctggttttgaaccttactggaaatacattgtgtgcaggcggggcatcagatgagaagctgatttctctcatttgcagggccgtcaaggccactttcaaccctgcccaggataagtgcgggattcggttggctagtgtgcctggctcccagaccgtggtagtgaaagagataacaatacatacgaagttacccgccaaggatgtctatgagcggctgaaggataagtgggacgagctcaaggaggctggagtgagcgacatgaaactgggggatcaggggcctccagaggaggcggaggatcggttttccatgcctctgatcataacgattgtgtgtatggccagcttcctcctgctggtggcagccctctacggctgttgtcatcaacgattatctcagaggaaagatcagcagaggctgacagaggagctgcagacagtggagaatgggtaccatgacaatccaacactggaggttatggagacttcgtccgaaatgcaggaaaagaaagtcgtctccctgaatggggaacttggtgactcttggattgtgcccttggataacctcacaaaggatgatctcgatgaggaagaagatacccacctctag

SEQ ID NO: 199878 - DNA, 1986 bp, Artificial Sequence
  Description of Artificial Sequence: Synthetic coding sequence
atggagggcgcccgggcccggggcgcccagctgcggctgggcgagcgggtaagaccagttggacgtagaagtgcccccggacgcagccgcttccggcagccctggcgcccgggagctagcgatagcgcgccacctgcggggaccatggcccaatcacgggtgcttctgcttctgctcctgctgccaccccagttacacctcggcccagtgctcgccgtgcgtgctccaggctttggtagatctggagggcattcactctctcccgaagaaaatgagttcgccgaagaggaaccagtattggtgctgtcaccagaggagcccggacccgggcctgccgccgtctcctgccctcgggattgtgcctgctcccaggaaggggttgtagattgcgggggaattgacctgcgcgaattccccggcgacctgcccgaacatacgaatcacctgtcattgcagaataaccagctcgagaagatttacccagaggagctatcgaggctacatcggctagagacgctcaacctgcaaaataataggctgacctctaggggactccccgaaaaagcgttcgaacatctgactaatctgaattacctatatctggccaacaataagcttacactggctccccgctttctacccaatgcgttaatcagtgtggattttgctgcgaattacctgacaaaaatctacggactcacttttggccagaagccaaacctgcgctccgtttacctccacaataataagttagcggacgctgggttgcctgacaatatgttcaacggcagctccaacgtggaggttttaattctgagtagcaactttctgcgacacgtcccaaaacatctgccacccgccttatacaagcttcatttaaagaacaataagctcgagaaaatccctcctggggctttctcagaattgagctctctgcgggagctctatctacagaacaattacctcactgatgaagggttggacaatgagaccttttggaaactttcaagcctcgaatatctcgatctttctagcaacaacttatcaagagtgccagcaggattgccgcgcagcttggtgttgcttcatttagaaaagaacgctatacggtccgtggacgctaatgtcctgacgcccattaggagtctcgaatatctgctgttgcatagtaatcaattgagagagcaggggatccacccgttagccttccaggggctaaaaaggctgcacactgtccacctttacaataacgcattggagagagtaccaagcggcctgcccaggcgcgtccgtactctgatgattctacataatcaaatcaccgggatcggtagagaggatttcgcgacgacttattttttggaagaattgaatttgtcctacaaccgcatcacgagcccccaggtacaccgagatgcctttcggaagctccgcctgcttcggtcactggatctcagtggcaatagactgcataccttacctccagggctccccagaaatgtccatgtgctcaaggtgaagcggaatgaactggccgccctggcaaggggtgccctggtgggcatggcccaactccgcgagctctaccttaccagcaatcggctgaggagccgcgctctgggacccagggcttgggtcgatctcgcccacctgcagctcttggatatcgcgggcaaccagctgactgagatacctgagggcctccccgaatctctagagtacctttatctgcagaacaacaaaattagtgccgtaccagcaaacgctttcgattccacgcctaaccttaagggtatattcctgcggtttaataaactggcagtagggagcgtggtagactcagcttttcgccgactgaagcaccttcaggttctggatatcgaaggcaatctggaattcggggacatctccaaagatcgaggcagactcggtaaagagaaggaagaagaggaggaggaagaagaggaagaggaagagacccggtag

SEQ ID NO: 199879 - DNA, 1929 bp, Artificial Sequence
  Description of Artificial Sequence: Synthetic coding sequence
atggagggcgaggaggccgagcagcccgcctggttccggcagccctggcggccgggagcttcagatagtgctccacctgcaggaacgatggcccaatcgcgggtgcttctgctgctactgctgttgccccctcagcttcatctaggccctgttttggccgttcgggcgccaggttttgggcggtccgggggccactccctgtctcctgaggagaatgagttcgctgaggaggaacccgtactggttttaagccctgaagagccgggccctggccccgccgctgtttcttgtccccgtgactgtgcctgttctcaagaaggagtggtagattgtggcggaattgatctgcgtgagtttccaggtgacctgcctgaacacaccaatcatttatccctgcagaataaccagctggagaaaatctatcccgaagaactgtcacgccttcacaggctcgaaaccttgaatcttcagaacaatcgtcttacaagccggggcttacccgaaaaggcgttcgagcacttgaccaatctgaattacctatacctcgccaataataaactgacgctagctccaagatttttgcctaatgccctgatctccgtggattttgctgctaactacctgaccaaaatctatgggttgactttcgggcagaaacccaacctgcgatctgtatatttacacaataacaagcttgccgacgccgggctgccggacaatatgttcaacggcagtagtaatgtcgaagttctgattctgagctccaattttctccgccatgtacctaagcacctgccccctgccctctacaagctgcatctgaagaataataaactggagaagattccccctggagctttctcagagctgagctctctgcgcgagctgtaccttcaaaacaattacctcaccgatgaaggcttggacaatgagacattctggaagttatcatctttggagtacctcgacctgtcctccaacaacctttcgcgggtgccagcagggttgcctaggagcctggttctactgcacttggagaaaaatgccatccggtctgttgacgccaatgtgctgaccccgatccgcagcctcgagtacttacttctgcattcaaaccagctccgcgaacagggcatccacccattggctttccagggactgaagaggttacacaccgtccacctctacaataatgccctggagcgagttccgtccgggttgcccaggcgggtccgcactctcatgatcctgcacaaccaaatcaccggtatcggaagagaggacttcgcaacaacttacttcttagaggaacttaacctctcatataatagaatcacttccccgcaggtgcaccgcgatgccttccgcaaattgaggctgctgagaagccttgacctgagcggcaatcggctccatactctacccccagggctcccgagaaacgtccacgtgttgaaagtcaagagaaatgaactcgctgctctggcacggggtgctctcgtggggatggcacagctccgagagctgtacctgacctccaaccggctccgctcccgcgccctgggccctagggcctgggttgatctggcacatctccagctactggacatagccggtaatcaactgactgagattccagaggggctgccagagtccctggaatacctctatctgcaaaacaataagatctcggccgtcccagctaacgccttcgattccactccaaatcttaaaggaattttcctcaggttcaataagttggctgtgggcagcgtagtggatagcgcctttcggcgcctgaagcatctgcaagtgctggacatcgaggggaacctcgagtttggtgatatttccaaggatcggggccgcctgggaaaagaaaaggaggaagaggaggaggaagaggaggaggaggaagagacgcgttag

SEQ ID NO: 199880 - DNA, 1560 bp, Artificial Sequence
  Description of Artificial Sequence: Synthetic coding sequence
atggagggcgcccgggcccggggcgcccagctgcggctgggcgagagggtgcgcccagtgggcaggcgctctgctcccggccgatccagatttcgccagccttggagaccgggtgcctccgattctgccccgcccgcaggaacaatggctcagtcgcgagttcttctgctgctccttttattaccacctcagctgcaccttgggccagtactcgcagtgcgtgctcctggcttcggcaggtccggcggtcattcgttgtctccagaagaaaacgaattcgccgaggaagaacctgtgcttgttctgagcccggaggagcccggacctggccccgcggcggtaagctgcccaagggactgcgcttgcagccaggaaggagtagtagactgtggcggcattgatctgcgagagtttccgggggatttgcccgagcatacaaaccacctgtcattacagaataacaaactggagaaaatcccaccaggcgccttttcggaactgagctctctacgggaactgtacctccagaataactacctcaccgacgagggacttgacaatgagactttctggaagctgagttctcttgaatacctcgacttgagttccaacaacttatctcgcgtgcctgcagggttgcctcgtagcttagtcctgctgcacttagagaagaacgcaatccgctccgtggatgccaacgttctgacccccatacgctcactggagtatctcctactacacagtaatcagctgagggagcagggcatacatcctctcgcttttcaggggctgaaaagactgcacactgtgcacctgtataacaatgctctagaacgtgttcctagcggactgcccagaagagtgagaactctcatgattttgcataatcagattaccggcatcgggagagaagattttgcaacgacttattttctcgaggaactcaacttgagttacaaccggataacctctcctcaagtgcatcgggatgccttccggaagctacggctcctgaggtcactggatctctccggcaataggctccatactctgccacccggcttgcccagaaatgttcatgttctcaaggtgaagcgcaatgagttggctgcccttgcacggggcgcattggttggaatggcgcagctgagagagctttatttaacctcaaacaggctgcggtcgcgcgctctgggcccccgagcctgggttgacctggcccatctgcagctgcttgatatcgcgggcaaccagctgacagaaataccagagggtctgcctgaatctctggagtacctatatcttcaaaacaataagatatcagcagttccagcgaacgcatttgattctaccccgaaccttaaaggtattttcctgcggtttaacaaattggcagtcgggtctgtggtcgatagtgcctttaggcgcctcaaacacctgcaagtgctagatatcgaaggtaatttggagtttggagatatatctaaggaccgggggcggctcggaaaagaaaaggaggaggaagaagaagaagaggaagaagaggaagagacgcggtag

SEQ ID NO: 199881 - DNA, 1095 bp, Artificial Sequence
  Description of Artificial Sequence: Synthetic coding sequence
atggcccgggccatggccgccgcctggcccctgctgctggtggccttgttagtactttcctggcctccacccggcacaggagacgttgtcgtgcaggcccccacccaggtgcccggtttcctgggggactccgtgactctgccatgttacctccaggtccccaatatggaggtgactcacgtgagtcagcttacatgggcccgacacggggagtctggcagcatggcagtcttccaccagacgcaaggcccgtcgtatagtgagagtaagcgcctagaatttgtcgcagcccgcttgggcgctgaattgcggaacgcttcccttagaatgtttggcttgcgtgttgaagacgaagggaattacacttgtctgttcgttacattcccacaggggtctagaagcgtcgatatatggttgagggtccttgctaagccgcagaatactgccgaggtacagaaagtccagttaaccggcgagccagtgcccatggcgagatgtgtcagcaccgggggcagacccccggcccagatcacctggcacagtgatctgggcggcatgccaaatacttcccaggtccccggtttccttagcggaaccgtgaccgtcacctcactgtggattctggtgccttctagccaggtcgacggcaaaaacgtgacgtgtaaagtggaacacgagtccttcgaaaaaccccaactccttaccgtgaacctgaccgtgtattatccacccgaggtgtctatttctggctatgataacaactggtacctgggccaaaatgaggcaactttaacatgtgacgcccggtctaaccctgagcctacaggttataattggagtactaccatgggcccactgccgccattcgcagtcgcccaaggggcacagctcctgataagacccgtagacaagcctattaatacaaccctaatttgtaatgtcactaatgccctgggcgcacgacaggctgaattaaccgtccaagttaaaggaaccgagcacgcctcagcctctgcaaatggtcacgtgtcatatagtgctgttagcagagaaaattcttcttcacaagatccccagactgaaggtacacgatag

SEQ ID NO: 199882 - DNA, 1119 bp, Artificial Sequence
  Description of Artificial Sequence: Synthetic coding sequence
atggcccgggccatggccgccgcctggcccctgctgctggtggccctgctcgtgcttagctggcccccccccggaacgggtgatgtcgtggtccaggcccccacccaagtccccggattcctaggcgattctgtcaccttgccctgttatctgcaggtcccgaatatggaagtgacacatgtatctcagttgacttgggccagacacggagagagtgggagtatggccgtgtttcatcagacccagggaccctcgtattccgaaagcaaaaggctcgaattcgtggccgctaggctgggtgcagagctgcgtaacgcttctctgcgtatgttcggcctacgcgtagaggatgaaggcaactatacatgtctgtttgtgaccttcccacagggcagcaggtccgttgatatctggttgcgcgtgctcgccaaaccacaaaataccgccgaggtgcagaaagtgcagctaactggtgaaccagtgcctatggccaggtgtgtgtccaccggtggccggccaccagcacaaattacatggcactccgacctgggaggcatgcccaatacaagccaggtccccggcttcctgtcaggaacagttaccgtaacctctctgtggatcctagtgcctagctcccaagttgatggaaagaacgtcacctgcaaggtcgagcacgagtcatttgagaaaccccaactgctcaccgtgaatttgaccgtgtattacccgcccgaggtcagtatcagcggatacgacaacaactggtacctaggccagaacgaagcaacacttacatgcgacgctagatccaacccggaacccacagggtataactggagcacaacgatgggccctctgccaccgttcgccgttgcccagggtgcccagctgttgatcagacctgtggataagccaatcaacaccacgctcatttgcaacgtcaccaatgctctgggggcccgccaagccgagttgacagtacaggtcaaggaagggcctccatcagaacattccgggaccgagcacgcttcggccagcgccaacgggcatgtctcatacagtgctgtgagtagagaaaattctagctctcaagatccccagactgaaggaaccagatag

SEQ ID NO: 199883 - DNA, 1179 bp, Artificial Sequence
  Description of Artificial Sequence: Synthetic coding sequence
atggcccgggccatggccgccgcctggcccctgctgctggtggccctcttggtgttaagttggccaccaccggggaccggggacgtagttgtacaggctcctacccaagtgcctggctttcttggggacagcgtaaccctcccctgctacctgcaagttcccaatatggaagttacacacgtttcacagctcacatgggcgcgtcacggcgagtctggcagcatggccgtctttcaccagacccaggggccatcatattctgaatcaaagcggctagagtttgttgcagcccgactgggcgcagagctgagaaatgccagtttgcgcatgtttggcctccgagtggaagacgaaggaaattacacatgtctctttgtcacttttcctcaggggagtcgtagtgtggacatttggctgcgtgttctagccaagccacagaacacagcagaagtacagaaggtacagctgactggcgaacctgtccctatggcccgatgcgtgagcacgggagggcgtcccccagcccaaataacatggcactcagacctcgggggaatgcccaacacttcccaggtgcctggatttctgtcagggacagttaccgtgacttccttgtggatcctggtgccttcctcacaggtggatggtaaaaacgtaacctgcaaagtggagcatgagtccttcgagaaacctcaattacttaccgtgaatttaacagtttattacccgccagaagtgtctatttcaggttatgacaacaattggtatctgggccagaacgaagccactcttacttgcgacgcaagatccaatccagagcccacaggatacaactggtccacaaccatgggacctctccccccatttgcggtcgctcagggcgcccagcttctgattcgacccgtcgataaacccataaataccacactgatttgtaatgtgactaacgcgttaggcgcccgacaggccgagttaaccgtacaggtgaaggaaggcccccctagtgaacacagcgggatcagcaggaatgctatcattttcctggtactaggcatcctggtctttctgatcctgttgggcatcgggatttatttctactggtcaaaatgcagccgtgaagtcctctggcattgtcatctgtgccctagctctgagcaccaccagagctgtcgaaattag

SEQ ID NO: 199884 - DNA, 1254 bp, Artificial Sequence
  Description of Artificial Sequence: Synthetic coding sequence
atggcccgggccatggccgccgcctggcccctgctgctggtggccctcctggtgctttcatggccaccccccggcacaggggatgtcgtcgtgcaagcaccgacccaggttcctggatttctcggggacagcgtgacattgccctgttaccttcaggttccaaatatggaggtcactcatgtatctcagcttacgtgggccaggcacggcgaatctggtagcatggctgtgttccaccaaacacaggggccttcatactccgaatccaaacgcctagagtttgttgctgcaaggctgggagccgagctgagaaacgcctccctccggatgtttggactgcgggtggaggatgagggaaactatacttgcctgttcgtaaccttccctcaaggtagccgaagcgtggacatttggctgagggtgttggcaaaaccccagaacaccgcagaagtccagaaagtacaacttacaggggaacccgtgcctatggccaggtgcgtgtccaccggaggaagaccacccgctcaaattacttggcactcggaccttggcgggatgcctaatactagtcaggttcctggctttttaagcggcaccgttaccgtgacgtccctctggatcttggtgccatcctcacaggtcgatggaaagaacgtgacttgtaaggtggaacacgaatccttcgagaagccacagctgctgacggtgaacctgacagtttactaccctcctgaagtgagtatttctggttacgacaataactggtacctcggccagaatgaagccaccctcacgtgcgatgctcggtctaatcctgagcctactggctataactggtccactacaatgggtcctcttcccccattcgctgtggcacaaggggcacagctgttgatacgtcctgtggataagccaattaatacaactctaatatgtaacgtcaccaatgccctgggggctcgccaggccgaactcactgtgcaggtcaaggagggccctccctcagaacactctggcatctcacgtaatgccattatcttcttggtcctgggcattcttgtctttctgatcctgctcggaatcggtatctatttttactggtccaagtgttctcgggaggttctgtggcactgccacctttgcccttcctcaaccgaacatgcctccgcctctgccaatgggcacgtgtcttattctgccgtgtcacgtgagaacagtagctcccaggacccacagacggaaggaacacgctag

SEQ ID NO: 199885 - DNA, 1554 bp, Artificial Sequence
  Description of Artificial Sequence: Synthetic coding sequence
atggcccggatgggcctggccggcgccgccggccggtggtggggcttagctctgggcttaactgctttcttcctgccgggagtgcactcgcaggtggttcaagtcaacgactccatgtatggattcattggcactgacgtggtgctccactgcagcttcgcaaaccccctgccctccgtaaaaatcactcaggtgacctggcagaagtcaactaatgggtcaaagcagaatgttgctatctacaacccgtccatgggcgtttccgtcttagctccataccgggagagagttgagttcttacgccctagttttaccgacggaacgatcagactgtctcggctcgagctcgaggacgaaggagtctacatttgcgagtttgccacatttccaaccggaaatcgcgagagccaacttaacctgactgtgatggccaagcccacaaactggatagagggcacacaagccgtactccgggccaaaaaaggccaagatgataaggtgctagtcgcaacttgcaccagtgctaatggaaagccaccatccgtagtcagttgggagactcgcctcaagggagaggctgaataccaggagattaggaatcccaacggcacagtaacggtgatatcccgttatcggttggtcccttcccgcgaagcccaccagcaaagcctcgcctgtatcgtgaattaccacatggataggttcaaagagtccttgaccctgaatgtccaatacgagccagaggtaacaatcgaaggatttgatggcaattggtacctccagaggatggatgtgaaactgacctgcaaggctgacgctaaccctcccgccactgagtatcattggactacacttaacggcagcctgcccaagggagttgaagcccaaaataggactctgttcttcaaaggtccaatcaattactccctggcagggacctatatttgcgaagccaccaatcctatcggcacccgtagcggtcaggttgaagtaaacataacagagttcccgtataccccatcacccccagagcacgggcgacgagctggccccgtgcctactgcgataatcggcggcgtcgctgggagcatcctgctcgtcctcatcgtcgtgggggggatcgttgtagccctcaggaggcgaaggcataccttcaagggggactattctacaaaaaaacacgtatatggcaatggctacagcaaagctggtataccacagcatcaccccccgatggcccaaaatttacagtatccggacgattcagatgatgaaaagaaagcaggtcccctcgggggctctagttacgaggaagaagaagaagaagaggaagggggcggaggcggggagagaaaggtgggtggccctcaccctaaatatgacgaggatgcgaagcgcccatattttacagttgacgaggccgaagcacgtcaagatggttacggagaccggacgctgggctaccagtacgaccccgagcaacttgacctggcagaaaacatggtctcccagaacgatgggtcctttattagcaaaaaagaatggtacgtatag

SEQ ID NO: 199886 - DNA, 1059 bp, Artificial Sequence
  Description of Artificial Sequence: Synthetic coding sequence
atggcccggatgggcctggccggcgccgccggccggtggtggggcctggctctggggttgacggctttttttttgccaggagtgcatagccaggtcgtgcaggtaaatgatagtatgtatggcttcattggcacggacgtagtgttgcattgcagctttgcaaatccactcccatccgtcaagattactcaggtcacctggcaaaagagcaccaacgggtcgaaacagaacgtggctatttacaacccaagcatgggtgtttccgtgttggccccatacagggagagggtggaattcctgcgtccgtcttttaccgacggtactatcaggctgtcaagattagaactcgaagacgagggagtgtatatctgcgagtttgccaccttccctactgggaacagagagtcacagctgaatttgacagtaatggccaagccaactaattggatcgaggggacacaagccgtcttaagggcgaaaaagggccaagatgacaaggtcttagtggcaacctgcacttcggcaaacggaaaaccgccatccgttgtttcctgggagactcgcttgaaaggggaagccgaatatcaggaaatcagaaaccctaatggcaccgtcacagtgatatcaaggtatcgcctggtgccaagtcgggaagcccaccagcaaagcctagcctgcatcgtgaactaccacatggaccggtttaaagagtccctaactttaaatgttcaatacgaacctgaagtgacaatcgaagggttcgacgggaactggtatctgcagagaatggatgtcaaattaacttgtaaagcggacgctaatcccccagccactgagtaccactggaccaccttaaatggttcacttcccaaaggcgtcgaggcccagaacaggacattatttttcaagggcccgatcaactatagcctggctggcacctacatttgtgaagctaccaacccaatcggaaccagaagtggccaggtggaagtgaacattacagctttctgccaactcatttatcctggtaaaggacggactcgagctaggatgttctag

SEQ ID NO: 199887 - DNA, 1377 bp, Artificial Sequence
  Description of Artificial Sequence: Synthetic coding sequence
atggcccggatgggcctggccggcgccgccggccggtggtggggcctggctctgggcttgacagcttttttcctgccgggcgtccatagtcaagtagtccaagttaatgatagcatgtacgggtttatcggaacagacgtcgtgcttcattgttctttcgcgaatcctctgccctccgtgaagatcactcaggtgacttggcagaagtcgactaacggatcaaagcagaacgtcgccatctacaacccatcgatgggggtgagcgtgctcgcaccctatagggagcgggtcgaattccttcggcctagcttcaccgatggcacaatcaggctgtcccgcctcgagcttgaggacgagggggtgtatatttgtgaattcgctaccttccccactggaaaccgcgaaagccagctaaaccttaccgtgatggctaagccgacaaactggatcgagggaacacaggccgtcctgagggcgaaaaaaggacaggacgacaaagtactggtcgcgacctgcacgtcagctaacgggaaaccgccttcagtagttagttgggaaacccgcctgaagggtgaggcagaataccaggagatccgcaaccctaacggtacggtgaccgtgatcagcagatacagattggtaccttcaagagaagcacaccagcagtccctggcatgtatcgtgaactatcacatggaccgctttaaggagagtctgaccttgaacgtccagtacgaacccgaagtgaccatcgagggttttgatgggaactggtacctgcaaaggatggacgtgaaactgacctgtaaagctgatgccaatccccccgctacagaataccactggactactcttaatggctccttaccgaaaggggtggaggcgcagaaccggacgctcttttttaagggacccataaattactcattggccggaacatatatttgcgaggccaccaatccgattgggacccggagtggtcaggtcgaggtgaatattaccgaaaagccacgcccacagcggggcctcgggagcgccgccaggttgctggctggaacggtggccgtgtttcttattctggtggcggtgctgaccgtgttttttctgtataaccggcagcagaaatcacccccagaaaccgatggcgcgggcactgatcaaccactgtcacagaaacccgaaccttcaccctcccgacagtcttccctagtcccggaagacattcaggtggttcacctagatcccgggcgccaacagcagcaggaggaggaggacttacagaagttatccctgcaacctccatattacgacctcggagttagcccctcataccatccctcagtgaggacaacagagccgcgtggcgaatgcccttag

SEQ ID NO: 199888 - DNA, 1617 bp, Artificial Sequence
  Description of Artificial Sequence: Synthetic coding sequence
atggcccgggccgccgccctgctgcccagccggagcccccccacccctctcctttggcccctattattgttgctgctgctcgaaactggcgcccaggatgtcagggtgcaggtactgccagaagtccgcggccaactcggtggtactgtggagttgccctgccatcttttaccaccagtccccgggctctatatatcccttgtcacatggcagagacctgacgctcccgcaaaccaccaaaacgtagctgccttccacccaaagatggggccctcgtttccgtcacctaaaccaggtagtgaaaggttgtcctttgtgagcgctaagcagagcaccggccaggacaccgaggccgagctgcaagacgccacacttgctctacacggattgacagtagaagacgaaggcaactatacctgcgaatttgccacatttccgaagggcagtgtacgcggcatgacctggttaagggtaattgctaagccaaagaatcaggcagaagcacagaaagtaacattttcccaggatcccaccacagtggctctctgcatctccaaggaaggtcgcccccctgcaagaattagctggctgagctctttagattgggaggctaaggagactcaggtctccgggacgctggctggaacagtcacagtgacctctaggtttacactcgtgccttcaggacgcgccgatggagttaccgtgacatgtaaggtggaacacgagtcttttgaagagccagcccttatccctgttaccctatctgtgcggtaccccccagaggtgagcatctctggctatgatgataattggtaccttggaagaacagatgcgacattgtcctgcgacgttcgctccaatcctgagccaaccggttacgactggtccacaacgtcaggcacatttcccacaagcgctgtggcccagggaagtcaactagtaatccatgccgtggattcactgtttaatactacgttcgtatgtactgtgaccaatgccgtaggcatgggcagagccgaacaagtgattttcgtgcgggagacccccaatactgcaggcgctggcgctaccggcggtattataggggggattatcgcagcgattattgccaccgctgtggccgcaacggggattcttatatgtcgccagcagagaaaagagcagacactccagggggccgaagaggacgaagatcttgagggccctcctagctataagccccccactccaaaggccaagctggaggctcaagagatgccctctcaactgtttactctcggtgcatccgagcacagtcccctgaaaacgccatattttgacgctggggcttcctgcaccgagcaagaaatgccgagataccatgagctgcccacccttgaggaacgctcagggcccctccacccaggggctacctcactgggaagtcccatcccagtacctccggggcccccagctgtagaagacgtgtctctagatctagaagacgaggagggcgaagaggaggaagaatatttggataaaatcaacccaatttacgacgcactgagctacagtagtccctccgactcttaccagggcaagggattcgtgatgagtagggcaatgtacgtttag

SEQ ID NO: 199889 - DNA, 1440 bp, Artificial Sequence
  Description of Artificial Sequence: Synthetic coding sequence
atggcccgggccgccgccctgctgcccagccggagcccccccacccccctgttatggcctctgctactactgcttctcctggaaacaggggcccaggacgtgagagttcaggtactgcctgaggtacgagggcagttaggcgggacagtagaacttccttgtcacctgctcccacccgtccccggactctatatctctctcgttacctggcagaggcccgacgctcccgcaaatcaccaaaacgtcgcagcattccatccaaaaatggggccttccttccccagcccaaaacctggatccgagcgacttagctttgtgtccgccaaacaaagtaccggccaggacacagaggcggagctgcaggacgccaccctggcgctccacgggttgacagtggaggacgaaggcaattacacctgtgagtttgccactttccctaagggctccgttcgtgggatgacatggctgagggtcattgctaagcccaagaatcaagcagaggcgcagaaggtcaccttctcacaggaccctaccaccgttgcactgtgtatatccaaagaaggccggccacccgcacgcatctcttggttgtcatccctggattgggaagcaaaggagacacaagtcagtggcacattggccggcaccgtgactgtgacgtcccggttcaccctggttcccagcggcagagccgacggagtcaccgtcacttgtaaggttgaacacgagtctttcgaggaaccagccctgattcctgtgacactgtcagtgcggtaccctccagaggtttctatctcaggttatgacgataactggtatctgggccgcactgatgccactttgtcctgtgatgttcggtccaaccccgagcccacaggatatgactggtcaactaccagtggcacattcccaacctccgccgtggcccagggcagtcagctggtgatccatgcagtggattctctgttcaataccacatttgtgtgcacagttactaatgccgtcggcatgggccgggctgagcaggtgatatttgtgcgcgagaccccaagggcctctcctagagacgtaggtcctctcgtttggggtgccgttggaggcaccctcctggtgctccttttgctagccgggggctccttggctttcatcctgctgcgcgtgcggagaaggcgcaagtctcctggaggtgctggaggtggcgcttccggcgatggcggattctacgaccctaaagcacaggtcctgggcaacggtgacccagtgttctggactcccgttgtgccaggaccaatggagcccgacggcaaggatgaggaggaagaggaggaggaagagaaagctgagaagggtctgatgctgcctccccccccagcattagaggatgatatggagtcacagctggatggctccctgatatcccggagagctgtgtatgtttag

SEQ ID NO: 199890 - DNA, 1101 bp, Artificial Sequence
  Description of Artificial Sequence: Synthetic coding sequence
atggcccggaccctgcggcccagccccctgtgccccggcggcggcaaagcgcagctctcatccgcttccctgcttggcgctggattgctcctgcagcctccgactcctcctcctcttctgcttcttctgtttcctctgcttttgttctcccgactgtgtggcgccctggccggcccaatcattgtcgagccacatgtgaccgcagtttggggaaagaacgttagcttaaagtgcttgatcgaggtgaacgagactattacacagatatcctgggagaagatccatggcaagtcttcccagacagtggccgtgcatcacccacagtacgggttcagcgtgcagggcgaataccagggccgggtgctgttcaagaattattctctcaacgacgccacaatcacactgcacaatatcggcttctccgattccggtaagtatatctgtaaggcagtgacgtttcctctgggcaacgctcaaagcagcactaccgtgacggtattagtggagcctacagtttctcttattaaagggcctgattccctcatcgacggagggaatgaaactgtcgcggcgatttgtatcgccgctacagggaagccggtcgcccatattgactgggagggtgatctaggagagatggagtcaactacaacctctttcccaaatgagacggccacaatcatttcccagtacaagctcttccccacgcgatttgccagaggccgaaggatcacctgcgtagtgaaacatcccgctctcgagaaagatatacggtattcgttcatactagatattcaatacgccccagaggttagcgtgactggttacgacggcaattggttcgtaggaagaaagggtgtgaatttgaagtgcaacgcagacgccaatccacctcctttcaaaagcgtgtggagtcggctggacggacagtggcctgatggtctcctggcctccgataatacgcttcactttgtccaccccctgacatttaactactcaggggtatacatctgtaaggttaccaattcccttggtcagcgcagtgaccagaaggtgatttacatcagcgcgtataactccgtcgctagccttaactgctag

SEQ ID NO: 199891 - DNA, 1650 bp, Artificial Sequence
  Description of Artificial Sequence: Synthetic coding sequence
atggcccggaccctgcggcccagccccctgtgccccggcggcggcaaggcacagcttagcagcgcttccctgttgggcgctggacttctcctccaaccccctacacctccacccctgctcctccttctttttcccctgctcttattttctaggctgtgtggcgcgctggctgggccaattatcgttgaaccacacgtaaccgcagtctggggcaaaaacgtgtccctgaagtgcctgattgaggtgaatgagaccattacacagatcagctgggaaaagatccatggcaaatcctcacagactgtagccgtccaccacccacagtatgggtttagcgtgcagggcgaataccagggacgcgtacttttcaagaactattctttaaacgatgccactatcaccctccacaacatcggattcagtgattctggcaagtatatttgcaaagccgtcacctttcctctgggaaacgcgcagtcctcaactacagtgacagtgcttgttgagcctacagtgtcactgatcaaaggacctgatagcctcattgacggaggtaacgagactgttgccgctatctgcatagcggcaaccggaaaaccggtggctcacattgattgggagggggatttgggcgagatggagtctacaaccacaagttttccaaacgaaacagctaccatcatttcccaatataaactgtttcctaccagatttgcccggggacgaaggatcacctgtgtggtcaagcaccctgcgctggagaaggacatccgttatagctttatcctggacattcaatacgcacccgaggtttctgtgacgggctatgatggaaactggtttgtaggacgaaagggggttaacttgaagtgtaatgccgacgcaaacccccctccattcaaaagtgtgtggtctcggctcgacggccagtggcctgatggcctgctggcgagtgataatacgttgcacttcgtgcatcctcttacctttaactactctggggtgtacatttgcaaagtcactaattcccttggtcagcggagtgatcagaaagtgatttatattagtgatccgcctactacaacaaccttgcaacccacaatccagtggcatccctccacagcagacatcgaggacttggccacagaacccaaaaaactgccttttcctctctctactctggctactataaaggacgatacaatagccaccattatcgcatcagtggtgggaggtgcactgtttatcgtgctggtcagcgtgttggctggcatcttctgttaccggcgaagacgcacattccgaggggattatttcgcaaaaaactacatccccccgagcgacatgcagaaggaatcgcagatagatgtgttgcaacaggacgaactggatagttaccccgatagcgttaagaaggagaacaagaacccagttaataatctgatacgcaaagactatcttgaggaacctgagaagacccagtggaacaatgttgagaatttgaaccgattcgagcgccccatggattactatgaagacctgaaaatgggtatgaaatttgtgtcagatgagcactatgatgagaatgaggatgacttagtgtcccacgtcgatggatccgtgattagtcgtagagaatggtacgtgtag

SEQ ID NO: 199892 - DNA, 1464 bp, Artificial Sequence
  Description of Artificial Sequence: Synthetic coding sequence
atggccgagggctggcggtggtgcttcgtgcggcggacccccggcctgctaagaggccctctgctgccacggagttttagcgggaacccccgcgccttagcaggccctatcatcgtggaacctcatgtgacagcggtttggggcaagaatgtttccttgaagtgcctgattgaagtgaatgagactatcacccagatctcatgggaaaaaattcatggaaaaagtagtcagactgtggcggtccatcatcctcagtatggattttctgtacagggcgagtaccagggccgggtcctgtttaaaaactacagcctaaacgacgccactatcactctccacaacatcgggttttcagacagcggaaaatacatatgcaaggccgtgacattcccgctcggcaacgctcaaagcagtaccacggtcactgtcttggttgaacccactgtttcactcataaaaggccctgatagcctgatagacgggggaaatgaaaccgtcgccgccatttgtatcgctgccacagggaaacccgtggcccacatagactgggaaggggacctgggagagatggagtccaccactactagtttccccaacgagacagctaccattatctcgcaatacaagctgttcccaacacgcttcgcgcgtggccgaaggatcacatgtgtggtcaagcaccccgcacttgaaaaggatataagatattctttcattctggacatacagtacgcaccggaggtgtccgttaccggttacgatgggaattggttcgtggggaggaaaggagtcaatttgaagtgcaatgcggatgctaacccgccccccttcaaatccgtgtggagcaggctggacggacagtggccagatggactgctggctagcgacaatactctgcattttgtacaccctctcacctttaactattcgggtgtttacatttgtaaggtcactaattcactcggccagcgcagtgaccaaaaggtcatttatatctcagatgtcccattcaagcagacatcctcaatcgcagtggcaggggctgtaatcggcgctgtcctagctcttttcattatcgcgatcttcgttacagtgctcctcacccccagaaaaaagcggccaagctacctcgacaaagttatcgacctgccgccaacccataaaccccctccactgtacgaagaacgcagcccgccccttccacaaaaagacctctttcagccagagcacctcccattacaaacacagttcaaagagagggaggtgggcaatctgcagcacagcaacggacttaactctagaagcttcgattatgaggatgaaaatcccgtgggcgaggacggaatacagcagatgtatcccctatacaaccagatgtgctatcaggaccggtccccaggcaagcaccatcagaacaacgacccaaagcgagtctatatcgaccctagggagcattatgtctag

SEQ ID NO: 199893 - DNA, 1533 bp, Artificial Sequence
  Description of Artificial Sequence: Synthetic coding sequence
atgcccctgagcctgggcgccgagatgtggggccccgaggcctggctccttttattgctattgctcgcatcgttcaccggaagatgtcctgccggcgaacttgagacgtcagacgtagtgacggtggtactgggccaggatgccaagcttccctgcttctacagaggtgactcgggtgagcaggtgggacaggtggcctgggccagggtggatgccggcgaaggcgcacaggaactcgcccttctccattccaaatatggactccatgtgagtcctgcttatgagggccgggtggagcaaccgccccccccacgcaacccactggatggctcagtgcttctgcggaatgctgtacaggccgacgagggcgagtatgaatgccgagtgagtacctttcccgcagggagtttccaggcccgactgcgcctgagagtgctggtgcccccactgccttcattaaaccctggtcccgcgctggaagaagggcagggcctgactctcgccgctagctgcaccgctgaaggatcccctgctccttctgtgacctgggatactgaagtgaaggggaccacgtcgagtcgctcattcaagcactccaggagtgccgcggtaacttcagagtttcacctggttccgagcagatcaatgaacgggcagccactcacctgcgtcgtatctcacccaggcctcctgcaggatcagcgcataacacatattctgcatgttagttttctggcagaggccagtgtgcgagggctagaggaccaaaacctctggcacataggcagagagggagcgatgctgaagtgccttagcgagggccagcccccaccctcttataactggaccaggttggatggacccctgccgagtggggtgcgcgtggatggcgataccttggggtttccccctctaaccactgagcattcaggaatctatgtatgccatgtaagcaatgagttctcttctcgagattctcaggtgactgttgacgtgctggaccctcaggaggacagtggtaaacaggtggatttagtgtccgcctctgtggtggtcgtcggggtcatagcagccctgctgttctgcctcctggtggtcgtggttgtgttaatgagtcgttatcacaggcggaaggcccaacaaatgacacagaagtacgaagaagagctaaccctcactagagaaaacagcattaggcggcttcacagccaccacaccgatcccaggtctcaacctgaagagtcagtgggtctaagagccgaaggtcatcccgactccctgaaagacaacagctcatgtagcgtgatgtccgaggagcccgagggacgcagttactcaacacttactaccgtccgcgagatcgaaactcagaccgagctgctgtctccaggttcgggcagagcggaagaggaggaagaccaggatgaaggtatcaaacaggcgatgaaccacttcgtgcaggaaaacggaaccctacgtgctaagcccaccggcaatggcatttacatcaatggtcgaggccacctggtctag

SEQ ID NO: 199894 - DNA, 660 bp, Artificial Sequence
  Description of Artificial Sequence: Synthetic coding sequence
atgctgaagtgcctgagcgagggccagcccccccccagctacaactggacaaggctggatgggccattgccctccggggtccgcgttgatggagatacattggggtttccacccctgaccacagagcattcggggatctacgtgtgccacgtttccaacgagttttcgtctcgggactcacaggtgaccgtagacgtacttgatccacaggaggactctggaaaacaggtggaccttgtgtcggcgtccgtggttgttgtgggggtaatcgctgcactcctgttttgcctcctagtggtagtggtggtcctgatgagtagataccaccgtaggaaggcccagcagatgacacagaaatacgaggaagagcttaccctgacccgtgagaactccatccggcggctgcactcacaccataccgaccccaggagccaaagcgaggagcccgaaggaaggtcgtactctaccttgactactgtgcgagaaatcgaaactcagaccgagctgctcagtcccgggagtggccgagcagaggaggaagaagatcaggacgagggcattaaacaggccatgaaccatttcgtacaggaaaacgggaccctgcgggcgaagcccacaggcaacgggatttacatcaacggccgcggtcaccttgtctag

SEQ ID NO: 199895 - DNA, 2058 bp, Artificial Sequence
  Description of Artificial Sequence: Synthetic coding sequence
atggagctgctgcggaccatcacctaccagcccgccgccagcaccaaaatgtgcgaacaggcactgggtaaaggatgtggcgctgattccaagaagaagcgccctccccagccaccagaagagagccagcctccccagagccaagctcaagtacctccagccgcgccccaccaccaccatcaccacagccacagcggtccagagatttcgaggataatagtcgaccctactacgggaaaaaggtactgtcgcggtaaggtcctgggcaagggaggctttgctaaatgctacgagatgactgatcttaccaataataaggtttacgccgccaagatcattcctcacagtagggtggccaagccccaccagagagagaagattgataaggagattgaactccatcgaatcttgcatcacaagcacgtagtgcagttctatcactattttgaggacaaggagaacatatacatcctcttggaatactgtagcagacgaagcatggctcatatccttaaagctcgcaaagtgctgaccgaacctgaagttcgctattacctccgccagattgtgtctgggctcaagtacctgcatgagcaggaaatcctgcaccgggatttaaagctgggaaattttttcataaatgaagccatggaacttaaggtgggagacttcgggcttgctgcccgcttggaacctctggaacacaggcgcaggacgatatgtggtacgccaaactacctgagccctgaagttcttaacaaacaaggccacgggtgcgaatccgatatttgggcccttgggtgcgtcatgtacaccatgttgcttgggcgccccccgtttgaaaccacaaacctcaaagagacctatcgctgtataagggaagccagatatactatgccttcttccctcctggcacctgcaaaacaccttattgcctccatgctttccaaaaatcctgaggaccggccgtccctcgacgacatcataagacatgattttttcctccaaggttttacacccgaccgcttgtcttcctcctgttgccacacagttcccgactttcacctctccagcccggcaaagaattttttcaaaaaagcagcagccgccttattcggtggaaaaaaggataaggccagatatatagacacccataatcgggtaagcaaggaggacgaggacatatataagctgagacatgatctgaagaaaacctccataacccaacagccaagcaagcaccgcactgacgaggagttacaaccccctacgaccacagtggcccgctccggcacccctgccgtcgagaacaaacagcagattggggatgcaattcggatgattgtgaggggcactctggggagctgcagcagtagctccgaatgcctggaagacagcactatgggttctgttgcggatactgtggctcgggtcctgagggggtgtctcgagaacatgccagaggccgattgtatccctaaggaacagctgtcaacttctttccagtgggtgaccaaatgggtcgactattccaacaaatacgggtttggctatcaactatccgaccatactgtcggcgtcctttttaacaacggcgctcatatgtctctcctacccgataaaaagacagtgcactattacgcagaactggggcaatgcagcgtttttcccgcaactgacgcacccgagcagttcatctcacaggtcacagtgctgaaatattttagtcactacatggaagaaaacctgatggacgggggcgatcttccctccgtgacagatattcggcgtccacggctttatctcctccagtggcttaagtcggataaggctttaatgatgctgttcaacgacggaaccttccaggtcaacttctaccatgaccatacaaagattatcatttgctcccagaatgaagagtacctactgacatatatcaacgaagacagaatcagtacgacattcaggctaacaacattgctgatgagtggttgcagctcagagctcaaaaatagaatggagtatgccctaaacatgctgctgcaacgctgtaactag

SEQ ID NO: 199896 - DNA, 1164 bp, Artificial Sequence
  Description of Artificial Sequence: Synthetic coding sequence
atggagctgctgcggaccatcacctaccagcccgccgccagcaccaagatgtgcgaacaggctctgggaaaagggtgcggcgccgatagcaagaaaaaacgtcctccacaacctcccgaagagtcacaaccgccccagtctcaggcccaggtgcccccagagattagcagaattattgtagaccccaccacagggaagcgctattgcagaggcaaggtattgggcaagggcggattcgcgaagtgctacgaaatgacagatctcacaaataataaggtgtacgctgctaagataatcccacattcgagggtcgccaagccccaccaacgagaaaaaattgacaaagagattgagctccatcgcattctccatcataagcatgttgtgcaattttatcattacttcgaggacaaggaaaatatatacattttattggagtattgctcccgcagatctatggctcatatcctcaaggcacgcaaagtgcttactgagcctgaggtccgctactatcttcgccagattgtaagtggactgaagtatttgcacgaacaggagatactgcaccgtgatctaaagttgggaaacttcttcattaacgaggcaatggaacttaaggtgggcgattttgggctcgcagctagattagagcccctcgagcaccgacgtcggaccatatgtggaactccgaattacctatccccagaggtgcttaacaaacaagggcatggatgtgaatcagacatctgggctcttggatgtgttatgtataccatgttgttggggcgccccccatttgaaacgaccaatctgaaggagacttacagatgtatcagggaagcccgatacactatgccaagcagcctgctcgctcccgctaagcacctaattgcctcaatgctgagcaagaatcctgaggatcggccatccctggacgatatcatccgccatgacttcttctgtcgcgccagtttgagaaccgactgtctgctggccgtggtgatccagtttcagatcagcacataccaagcgcagctcaggatttctctccggaagcagctcctcctgtttttagtggccaagaaaactaaacaggacatcctgacccacatcattgagtgcttgaagaagatgaagacgtcaacctccctcggcatgatttag

SEQ ID NO: 199897 - DNA, 1140 bp, Artificial Sequence
  Description of Artificial Sequence: Synthetic coding sequence
atggagctgctgcggaccatcacctaccagcccgccgccagcaccaagatgtgtgaacaagcccttggtaagggttgcggtgccgactctaagaaaaaacggccccctcagcccccggaggaatcgcagccaccccagagccaggcacaggtgcctcctgctgcacctcatcatcatcatcaccacagccattctggaccagagatttctcgtataatagtagaccccacgacagggaagcggtactgcagagggaaggttttagggaaaggaggtttcgcgaagtgttatgagatgaccgatctcaccaataataaggtatatgccgccaaaataattccacatagtagagtcgccaagccccaccagcgagaaaagattgacaaggaaatcgagctccacagaatcttacaccataaacacgtcgtgcagttttatcactactttgaagacaaagagaacatctacattctgctggaatattgtagtcggcgttccatggctcacatcctgaaggctcgaaaagtgctcaccgaaccagaagtgcggtactacctgagacagatcgtatccgggctgaagtaccttcatgagcaggaaatactgcacagagatctgaaactggggaacttctttataaacgaggccatggagttgaaagtcggcgatttcggactggccgctcggctggaaccgttggagcacaggcgccgcacaatttgtggtactcctaactatctcagccctgaggtactgaataagcagggccacgggtgtgaatccgacatatgggccctcggctgcgtgatgtacactatgctgcttggacgcccccctttcgagacaacgaatttgaaagagacgtacaggtgcatcagagaagcccggtacacaatgccctcatcactcttggcgccagccaaacacttaatcgcgtccatgctcagcaagaatcccgaagatagaccgtctctggacgacatcattaggcacgacttcttcctacagggatttacaccagatcggttgtccagcagctgttgccacactgtccccgactttcatcttagctccccagctaagaatttctttaaacgggccgcggaacatatcatatcagtgggccatcagatggggtag

SEQ ID NO: 199898 - DNA, 1476 bp, Artificial Sequence
  Description of Artificial Sequence: Synthetic coding sequence
gtggacctgctgcgggccggcgaggtgcccaagcccttccccacccattataaagatctctgggataacaagcatgtgaagatgccgtgcagtgagcagaacctgtacccagttgaggatgagaatggcgaaagaacagccggcagtcgctgggagttaattcagaccgcgctgttgaacaagttcacacggcctcaaaatcttaaggatgcaatcttaaaatacaatgtcgcctattcgaaaaaatgggatttcacagccctgatcgatttctgggacaaggtgctggaagaggcagaggcccaacacctgtaccagtcgattttgcctgatatggttaaaatagcactgtgtctaccaaatatttgtactcaacctattcctctcctcaaacagaagatgaatcactcaattacgatgagccaagagcagatagctagcctgctggcaaatgcgttcttctgtacttttccacgaaggaacgctaagatgaaaagcgagtactcatcttatcccgacatcaatttcaatcggctgtttgaaggccgctcatcacgtaagcctgagaagttgaagactctcttttgttattttaggagagtcaccgagaagaaacccaccgggctcgtaacgtttactcgccaaagcttggaggactttcccgaatgggagcggtgcgagaagcctcttacgcggctgcacgttacctacgaaggcacgattgaggagaacggacagggcatgttgcaggtggactttgctaatcggttcgtaggaggcggcgttaccagtgctggactggtccaggaagagattcggttcttgattaaccctgagctgattattagtaggctattcaccgaggtgcttgaccataatgagtgcctgattattaccgggaccgagcaatacagcgaatacaccgggtatgcagaaacatacagatggagccggagccacgaggacggatccgagagagatgattggcagcggagatgtacagaaatagttgccatcgacgccctccatttcagaagatatttggatcagttcgtgcccgaaaagatgaggagggagctgaacaaggcctactgcgggttcctaagacctggagtcagctccgaaaatctctcagccgtggcgacgggcaattgggggtgcggcgcctttggaggggacgcccgactgaaggccttgatacagatcttagccgctgcggcagccgagcgagacgttgtctacttcacgtttggtgattctgagctgatgagagatatctatagtatgcatatctttctgacagagcgcaagctaactgttggggatgtgtacaagctcctgttgaggtactacaacgaggagtgcagaaattgttccactcctggtcctgatataaagttgtaccctttcatctaccacgccgttgagtcctgtgccgagaccgcagatcatagcggtcaacgaactggaacttag

SEQ ID NO: 199899 - DNA, 579 bp, Artificial Sequence
  Description of Artificial Sequence: Synthetic coding sequence
tgaaccgagcagtacagcgagtacaccggctacgccgagacctaccgctggtccagaagccacgaagatggcagcgagagagacgactggcagcgcaggtgcacagagattgtagccatcgatgctctccattttaggaggtatcttgaccagtttgtgccagaaaaaatgagaagagagctcaacaaggcgtattgtggattcctgaggcccggagtcagcagtgagaacctgtccgccgtcgccactggaaattggggttgtggggcttttggcggcgatgctcggcttaaagctttgatccagatcctggctgctgccgccgccgaacgagatgttgtttactttacctttggagactccgaactgatgcgcgacatatactcaatgcacattttcttaaccgagcggaaactgaccgtgggagatgtgtataagctcctgttgcgctattacaatgaagagtgccgcaattgctcaacccccggtccagacatcaaactgtaccccttcatctaccacgccgttgaatcctgtgcggaaaccgcagaccatagcggacagcggactggaacttag

SEQ ID NO: 199900 - DNA, 468 bp, Artificial Sequence
  Description of Artificial Sequence: Synthetic coding sequence
atggccgagagcagcgacaagctgtaccgggtggagtacgccaagagtggccgcgccagttgtaaaaaatgcagcgaaagcatccctaaagattcactccgcatggctatcatggtccaaagtcctatgttcgacggcaaagtgccacactggtatcacttttcctgcttttggaaggtgggccattctattaggcatcctgatgtcgaagtagatggattttccgagctccgctgggacgatcagcagaaagtgaaaaagacagctgaagccgggggagtgaccggggtctacatactgggccagcacggtcattcggcccctactctgaaactgcccggaggtcctagactcagagaacagtcaaagcccccgcccgcttgccctctgcctcacgtccagattaaacgcatggtacctatgctgttccagcagcaccttcttgacagcgcctcttctgtggcctag

SEQ ID NO: 199901 - DNA, 327 bp, Artificial Sequence
  Description of Artificial Sequence: Synthetic coding sequence
atggccgagagcagcgacaagctgtaccgggtggagtacgccaagagcggccgcgcctcttgcaagaagtgttccgagtccataccaaaggactccctcagaatggctattatggtccagagccccatgttcgatgggaaagtcccccactggtaccatttcagctgcttctggaaggttggccacagcatcagacacccggacgtcgaagttgacggcttctccgaacttagatgggatgatcagcaaaaggttaagaagactgccgaagcaggcggcgtgaccgaacctccaattccatgtggaatagaggttatgggtcgatag

SEQ ID NO: 199902 - DNA, 327 bp, Artificial Sequence
  Description of Artificial Sequence: Synthetic coding sequence
atggccgagagcagcgacaagctgtaccgggtggagtacgccaagtcggggagagccagttgtaaaaaatgcagtgagagtataccgaaagattccttgcggatggcgattatggtgcagtcaccgatgttcgacggcaaggttccacattggtatcacttcagctgtttctggaaggtgggacattcaatccgacatccagatgttgaggtggatggtttttccgaactgagatgggacgatcagcagaaagtcaaaaagacagcggaggcaggcggagttacagagccccccattccctgtggcattgaggtgatgggtagatag

SEQ ID NO: 199903 - DNA, 3045 bp, Artificial Sequence
  Description of Artificial Sequence: Synthetic coding sequence
atggccgagagcagcgacaagctgtaccgggtggagtacgccaagtcaggccgagcctcctgcaaaaagtgctcagaatctatacctaaggactctctgcggatggccattatggtgcagagtccaatgttcgacgggaaggtgccacattggtatcatttctcttgcttttggaaagtgggacattccatccgccatcccgacgtagaggtagatggtttctcggagctaagatgggacgatcaacagaaggtgaagaaaacggccgaagctggtggcgttactgggaaagggcaggatgggataggatccaaggcagagaaaacactgggggacttcgccgcagagtacgcaaagtctaatagaagcacttgcaagggatgcatggagaaaattgagaagggtcaggtgcggctctctaaaaagatggtggacccagagaagccacagctgggcatgatcgacagatggtatcaccccggctgcttcgtcaagaacagagaggaactcggctttcgtccagagtattccgctagtcagctgaagggctttagtctgctggccacagaagacaaggaagctctgaagaagcagctccccggggttaagtccgagggaaaacgcaagggtgatgaggtagacggagtggatgaagtagccaagaagaaaagcaagaaggaaaaagataaggattcaaagctggagaaggctcttaaggcccagaacgatctcatttggaacataaaagatgaactgaagaaggtgtgtagcaccaatgacctcaaggaattgttaatattcaacaaacaacaggtaccaagtggagagtctgcgatcctggacagggtggccgacgggatggtcttcggagctctcttgccatgtgaggagtgtagtggacagctcgtttttaagagtgacgcatattattgcacaggcgacgtgacggcatggaccaaatgcatggtgaagacccaaactccaaacaggaaggagtgggtaactcccaaggaattccgggagatttcctacctgaaaaagctgaaagtaaagaaacaggacagaatcttcccgcctgagacttctgcctccgttgcagctacccctccaccaagcaccgcttctgccccagcagctgtcaactcttccgccagcgcagataaacctctcagcaacatgaagattctcaccctcggcaaattatctcgaaataaagatgaggtgaaagctatgattgagaagctgggaggcaagctcacggggaccgccaacaaagcttcactgtgtatatccacaaagaaagaggtagagaagatgaacaagaagatggaggaggtgaaagaggctaacattcgcgtggtctccgaagacttcctgcaagatgtgtctgcttcgactaagagtctgcaggagctgttcctggcacatatcttatccccgtggggcgctgaggtcaaagctgaacccgtagaggtagtggcacctcggggcaaatcaggtgccgccctgagcaagaaatcaaaaggccaggttaaagaggagggcattaataagtctgagaaacgcatgaagctgacgttaaaaggcggggctgccgtggatccagactcaggcctagaacactcagcccatgtgcttgaaaaaggcggcaaggtgttcagcgccacactgggccttgtcgacattgtcaagggcacaaatagttactacaagttgcagctactcgaggacgacaaggaaaaccgttactggatctttcggagttggggcagggttggaacagtgataggctcgaacaagctggaacagatgccctctaaggaagacgccattgagcatttcatgaagctgtacgaggaaaagacaggaaacgcgtggcacagtaagaatttcaccaagtacccaaagaaattctatcccctggaaattgactacggacaagacgaagaggctgtgaaaaagctgacggttaaccccggaacgaagtctaaacttcctaaaccagtacaggatctgattaaaatgatattcgatgtagagtctatgaagaaagccatggtggaatatgagatcgacctccaaaagatgccactggggaaactctccaaacggcagatccaggctgcatattctatcctctcagaggtccagcaagccgtgtcacaaggctcatccgactcgcagattctggatttgagcaatcggttttacactcttattccacacgacttcggaatgaagaagccgcctcttttaaacaacgctgattcggtacaggcaaaagttgagatgctcgataacctgctggacattgaagtagcctatagtctgctgcgaggtggatccgacgacagcagtaaagatccgattgatgtcaactacgagaaacttaaaaccgacataaaagtggtcgacagggattccgaggaagctgagataatcaggaagtatgtaaaaaatactcatgctaccacacacaacgcatacgacctggaagtgatcgatatctttaagatcgagcgggaaggagaatgccagcggtacaagcccttcaaacaactgcacaatcgccgactgctctggcatggcagtcgcaccactaatttcgccggcatcctgagtcagggcttacgcattgcccccccagaggcacccgttaccggttatatgttcggtaagggcatttactttgccgacatggtgagcaagtcggctaattattgccacacttcacaaggggatcccataggcttaatcctcctgggtgaagtagccttgggaaatatgtatgagcttaagcatgcgtcccatatatccaagctgcctaagggcaaacattctgtgaaaggtttagggaaaacgacccccgacccctcagccaatatttccctggatggggtggatgtgccattaggcaccgggatttccagcggcgtgaacgatacaagcttgctatacaacgagtacatcgtgtacgacattgcgcaggtcaatctgaagtatctcctaaaattgaagttcaactttaaaactagcctatggtag

SEQ ID NO: 199904 - DNA, 753 bp, Artificial Sequence
  Description of Artificial Sequence: Synthetic coding sequence
atggccgagagcagcgacaagctgtaccgggtggagtacgccaagtcggggagggctagctgcaaaaagtgttccgagtcaatccccaaagactcactccggatggccatcatggtgcagtctcctatgttcgatgggaaagtgcctcactggtatcatttctcctgcttttggaaggtcggccactcaataaggcatcccgacgtggaggtggacggctttagcgaattgcgctgggacgaccagcagaaagtcaaaaaaaccgcagaggccggaggggttaccggcaaaggtcaggacggaattggatccaaagcggaaaagacgctcggcgattttgccgccgaatacgcaaaatctaatagaagtacatgcaaggggtgcatggagaaaattgaaaaaggccaggtacggctctctaagaagatggtggaccccgaaaagccacagttaggcatgattgatcgttggtatcatcccggctgtttcgtcaagaacagagaagagctcggcttccggccagagtacagcgcgtcccaacttaagggcttttcactcttagccacagaggacaaggaggctcttaaaaaacagctgcctggtgtgaagtcagagggaaaacgcaaaggggacgaagtggatggtgttgacgaagtagccaagaagaagtccaaaaaggagaaggataagaagaaaaaaaagaaaaagaaaaaggaaagaaagaagaagaagaaaaagagaaagaaaaagtag

SEQ ID NO: 199905 - DNA, 2133 bp, Artificial Sequence
  Description of Artificial Sequence: Synthetic coding sequence
atggacttcagcatggtggccggcgccgccgcctacaacgagaagagcgagaccggagctctgggagagaactatagttggcaaataccaataaatcataatgatttcaagattcttaagaacaatgaaagacagctatgcgaagtgctccagaacaaattcgggtgtattagcacactggtgagtccagtgcaggagggcaacagcaaaagcctgcaagtgttccgcaaaatgttgactccgcgaatagagctctcggtatggaaggatgatctgaccacccacgccgttgatgccgtggtgaatgccgccaatgaggacttgctgcacgggggtggtctcgccttggctctagttaaggcgggaggtttcgagattcaagaagaaagcaaacagttcgtcgcccggtacggcaaggtttctgcgggcgagattgcagtcactggggccggcaggctgccatgtaaacagatcatccatgccgtgggtccaagatggatggaatgggacaagcagggctgcaccggcaaactccaacgggcaatcgtctcaatcctgaactatgttatttacaagaatacccatatcaagaccgtggcaataccagccctgtcctccgggatcttccagttccccttgaatctttgtaccaagactatagtcgaaacgatccgtgtgtctcttcagggaaagccaatgatgagcaacctaaaagagatccacctagtgagcaacgaggacccgactgtggccgcctttaaagcagcttctgagttcatactggggaagagcgaactaggccaggaaacgacaccgagttttaacgctatggtggttaacaacctgacccttcagatcgttcaggggcatattgagtggcagacagcagatgtcattgtgaactcagtgaatccccacgacattactgtagggcctgtggccaaatccatattgcagcaggctggggttgagatgaaatccgagttccttgcgacaaaagccaaacagttccagagatcgcaactggtgctcgtgactaagggctttaacctgttttgtaagtatatttatcacgtcctgtggcactccgaattccctaaaccccaaatcttgaaacatgccatgaaagagtgtctggagaagtgcatcgagcagaatataaccagcattagtttccctgccttgggaacggggaacatggagatcaaaaaagagacagccgctgagattttattcgacgaggtgcttacatttgcaaaagaccacgtgaaacatcaactcaccgtcaagttcgtaatcttccccacagacctggaaatctataaggctttcagcagcgagatggccaaacgctcaaaaatgctctcactcaacaattactcagtgccgcagtccacgagagaggagaaacgggaaaatggccttgaagcccgcagtcccgcaatcaatctaatgggttttaacgtggaagaaatgtatgaagcacacgcatggattcaacggatcttatcccttcagaaccaccatattattgagaacaatcacattctgtatttaggtcgaaaagaacacgacatcttatcacagctgcagaagacttcatctgtttctatcacagaaatcatctctccaggcagaactgagctggagatcgaaggcgcccgtgcagatctgattgaagtggtgatgaatattgaggacatgttgtgtaaagtgcaagaagaaatggccagaaaaaaggagaggggcttgtggagatccctcggccaatggaccatccaacagcagaagacccaggacgagatgaaggagaacatcatcttcctcaagtgccctgtgccaccaacacaggaactactggaccagaagaagcagttcgaaaaatgtggcctgcaggtcctgaaagttgaaaagatcgataatgaggtactgatggcagcatttcaacggaagaagaaaatgatggaagagaaactccacagacagcctgtgtcacaccgtctgtttcagcaggtaccgtatcagttttgcaatgtcgtttgccgagtcggatttcagcggatgtacagtactccttgtggacgatgtcagtgcctgattatcggcgcgaccctgtggaacctggtgagttag

SEQ ID NO: 199906 - DNA, 2460 bp, Artificial Sequence
  Description of Artificial Sequence: Synthetic coding sequence
atggacttcagcatggtggccggcgccgccgcctacaacgagaagagcgagacaggcgctctcggtgaaaactattcttggcagatccctatcaaccacaatgatttcaagatcctgaaaaataacgaacgacagctgtgtgaagtgctccaaaataagttcgggtgcataagtacgcttgtttctccagtacaggaggggaactcgaaatcgctgcaagtttttcggaagatgctgacccctcggattgagctgtccgtctggaaagatgacctcactacacacgccgttgacgcggtggtcaatgcggctaatgaggacctgctgcacggcgggggtctggcacttgccctcgtcaaagcgggaggattcgagattcaggaggagtccaagcagttcgtagctcgctacggcaaagtttccgccggggaaattgccgtgaccggggcagggcgcttaccttgtaagcaaattatccatgccgtgggtcctcggtggatggagtgggacaaacaagggtgtacgggaaaacttcagagagccattgtgagcatacttaattacgtgatttacaaaaatacgcatatcaaaaccgttgccatcccagcattaagctccggcattttccaattcccactcaacctttgcaccaaaaccatagtggaaacgatccgcgtgagcctccaggggaagccgatgatgtctaatcttaaggaaattcatttggtgtctaacgaagaccctaccgtcgcggcctttaaagccgcatctgaattcatcctgggcaagtccgaactcggacaggagacaacacccagctttaacgccatggtcgtgaataacctgactctgcagatcgtccagggacatattgaatggcagaccgcagacgtgatcgtcaatagtgtcaacccccacgacatcactgttggtcctgtggctaaatccattttgcaacaggcaggggtggaaatgaagtctgagtttctggccaccaaagctaagcagttccagcgttcccagcttgtactggttaccaaaggcttcaatttgttttgtaagtatatataccacgtcctttggcatagtgagttccctaagccccagattctgaagcacgctatgaaagagtgtctggagaaatgtattgagcagaacatcacttcaatcagtttccctgccttaggcacaggcaacatggaaataaagaaagaaacagccgcggagatcctgttcgatgaggtcctcacattcgccaaggatcatgtaaagcaccagctgaccgtcaaattcgttatttttccaaccgatctggagatctataaagccttcagtagtgaaatggcgaagcgcagtaaaatgttgagcttgaataactactctgtcccacagtcaacaagagaagagaaaagggaaaatggtctcgaagctcgttctcctgccatcaatctgatgggcttcaatgtagaagagatgtacgaggcacacgcatggattcaacggatcttgagtctacaaaaccatcacattatcgagaacaaccatatcctgtatctcgggagaaaagaacatgatatcctgtctcaactccaaaagacatcctccgtctctattacggagattattagccccggacggacagagcttgaaatcgaaggtgcgagggcagatctgatcgaggtggtgatgaatatcgaggacatgttatgcaaagtgcaagaggaaatggccagaaaaaaagagcgcgggttatggagaagcctcggccaatggacaatccaacagcaaaagacccaggacgagatgaaagaaaacataattttcctgaaatgtccggtgccacccactcaggaattgctggaccaaaagaagcaatttgaaaagtgcggcttacaggttctgaaagtggaaaaaatcgacaacgaggtattgatggcggccttccagcggaaaaagaaaatgatggaagaaaagctgcataggcaacctgtctctcacagactgtttcaacaagtgccctaccagttctgcaacgtcgtctgtcgtgttggatttcagagaatgtacagcactccctgtgaccccaagtacggcgcaggaatttatttcacgaagaacctgaaaaatctggccgagaaagcaaagaagatttctgcggctgataagctcatatatgtctttgaagccgaagtcctgaccggcttcttttgtcaagggcaccctcttaacatcgtgcccccacctctgtccccaggggctattgatggtcatgatagcgtggtagataacgtctccagtcctgaaacctttgtgatcttctctgggatgcaagccatcccacagtatctctggacgtgcacacaggagtacgtgcagtcccaggactactccagtggaccaatgcgtccctttgcgcagcacccctggagaggatttgccagtgggagcccagtagactag

SEQ ID NO: 199907 - DNA, 2106 bp, Artificial Sequence
  Description of Artificial Sequence: Synthetic coding sequence
atggcccaggccggcgtggtgggcgaggtgacccaggtgctgtgcgccgctggaggcgcactcgaattaccagagcttaggagacggcttagaatgggactctccgctgacgccctggagcgcttactgagacagcgtggccggtttgtggtcgccgtgcgcgcaggtggcgccgcagctgctcctgagcgcgtcgtgttggccgcgtcccccctccgcctttgcagggcccaccaagggtcaaagcctggttgtgtcggcctgtgcgcacagctccatctatgccggtttatggtttatggcgcctgtaaatttctccgggccggtaagaactgccgcaattctcatagcctcactaccgaacacaacctgtcagttctccgaacccatggagtcgatcatctatcatacaatgagttatgccagttactcttccagaacgacccctggttgctaccggaaatatgtcaacattataataagggcgatggtccgcacgggtcatgcgcgtttcaaaagcagtgtatcaaattgcatatttgccagtatttcttgcagggcgaatgtaagttcggcacctcatgcaagagatctcacgatttcagcaactcagaaaatttggaaaagctcgagaaacttggtatgtcaagcgatctggtctcacgtcttcccactatctatcgtaacgcccatgatatcaagaataagtcatctgctccgtctcgggtgccacccctctttgtcccccaaggcactagtgaaaggaaggactcctccggtagcgtgtcaccgaacactctcagccaggaggagggggaccagatctgtctgtatcatatccggaagagctgttcatttcaggataagtgccatcgggtgcactttcacctgccctaccggtggcagttccttgacagagggaaatgggaggacctcgacaatatggaactcatcgaagaggcctactgtaatcccaaaatcgagaggatcctatgttctgagagtgcctctacattccattcacattgcttaaattttaacgccatgacctatggcgctacacaggccaggagactcagcactgcctcatccgtcacaaagcccccacacttcatcctgacgacagactggatttggtattggtctgacgaatttggcagttggcaagagtatgggcggcaggggaccgtgcacccagtgacaactgttagttctagcgacgtggaaaaggcatatctggcctattgcacacccgggtctgatgggcaggcagcaactctgaaattccaggccggtaagcataattacgaactggattttaaagcctttgtgcaaaagaatttggtctacggcaccactaagaaggtgtgtaggcgtcctaagtacgttagtccccaggacgtgacaaccatgcagacgtgcaacacaaagtttcccggaccaaaatcaataccagattactgggattcatctgccctccccgatcctggctttcaaaaaattacgttgtcttcaagtagcgaagaatatcagaaagtctggaatctattcaacagaaccctgcccttctattttgtgcaaaagattgagagagtgcagaacttggcgctgtgggaagtctaccaatggcagaagggtcagatgcagaagcagaacggaggcaaagccgtggacgagaggcagctttttcacggaacctccgctatctttgtggacgccatttgtcagcaaaattttgattggcgagtgtgtggcgtacatggaactagctacggaaaaggctcatattttgccagggacgccgcgtattcacatcattacagcaagagcgacacccagacccacaccatgttcctggcccgggtattagttggagagtttgtccgcgggaacgcttctttcgttagaccgccagcaaaagagggatggtctaatgcattttacgattcatgcgtgaacagtgtaagtgacccttccatctttgtcatctttgaaaaacatcaggtctatcccgagtacgtaattcagtataccaccagttcaaaaccatccgtgacacctagtatcctgctggcactcggctccctcttctcatctaggcagtag

SEQ ID NO: 199908 - DNA, 393 bp, Artificial Sequence
  Description of Artificial Sequence: Synthetic coding sequence
atgttcctggcccgggtgctggtgggcgagttcgtgcggggcaacgcatcattcgttcggccgcctgccaaagaaggctggtcaaacgccttctacgactcctgcgtaaacagcgtgtcagacccgagcatattcgtcattttcgaaaaaacacgcagtacccagtctatgagcagtagcactcctccaccccccagccctcggagccatcctccatcatgctggccctgggcaccatgttcagccgcagactcagaaagaactggggtgtttcaggcctttcatctcctgtgcctcgaaatggcaatatgggccttcccctttcttttcaagcagaaactgctgatgaattgttctcttaatatcgacttgtcaatgaaattatgttcatag

SEQ ID NO: 199909 - DNA, 849 bp, Artificial Sequence
  Description of Artificial Sequence: Synthetic coding sequence
atgagcaagctggccagcttcctgggcttcagcaagcagagcccccagaagaaaaatcacctggtgttggagaagaaaaccgagtcagcaacattcagagtttgcggcgaaaatgtgacttgtgtggaatatgcaatatcttggctccaggatttgatcgaaaaagagcaatgtccttacacgagtgaagacgagtgtatcaaggacttcgacgagaaggaataccaggagctcaatgagctgcagaaaaagctgaatatcaatatctcattagatcacaagcggcccctgatcaaggtgctggggatctcgcgggatgtgatgcaagcgagagatgagatcgaggcaatgatcaagagagtgagactcgcaaaagagcaggaaagtagggccgactgcatttccgagttcatcgagtggcagtataacgataataatacctctcattgcttcaataaaatgacgaatcttaaattagaggacgccaggagggagaaaaaaaaaaccgttgatgtgaaaataaatcaccggcactataccgttaacctgaacacatataccgcgactgataccaagggacatagtcttagcgtacaacgccttacaaagagtaaagttgatatccctgcccattggagcgacatgaaacagcagaacttctgtgttgttgaactgctgcccagcgaccctgaatacaacaccgtagcctcaaagttcaatcagacatgcagccattttcggatagagaaagtcaatgtgatgatccgtgcatgtagtccttcttactgggaggccgaggtggagggactccacgagcctagatctcttaccccggtgtgggtcacttag

SEQ ID NO: 199910 - DNA, 2394 bp, Artificial Sequence
  Description of Artificial Sequence: Synthetic coding sequence
atgtacctgcggcggctgctgcggcccctgcagatgctgctggtgaaggagggcgtgcagaacgcaaaaacggacgtggttgtgaattcagtccctctggatctggtccttagcagaggcccactctctaagagtctgctggagaaggccggccccgagcttcaggaggagttagatacagtggggcagggagttgccgtgagcatgggaactgttctcaagacttcttcttggaatctcgactgtagatacgttttgcatgtagtcgctccagagtggcgtaacggatctacaagctctctcaagatcatggaagacatcattcgcgaatgtatggaaattactgagtccctatctctaaagtccattgcatttccagctattgggacaggaaatctgggcttccctaagaacatctttgcggaactgattatctctgaggtgtttaagttttcaagcaagaaccagttaaaaacactgcaagaggtgcactttttgctccacccttccgaccatgaaaatattcaagccttttctgatgagtttgccaggcgtgcaaacggaaatctggtttcggacaaaatccctaaagcaaaggatactcaggggttttatgggactgtgagttcaccagatagcggtgtgtacgagatgaagatcggaagtatcatatttcaggtcgcatcgggcgatattaccaaagaggaagccgacgtaattgtgaattcgacatctaactccttcaaccttaaggcgggcgtttccaaggccattctggagtgcgccggccagaatgtggaacgcgaatgctcacagcaggcccagcaaagaaagaacgactatataatcactggtggtggatttctccggtgcaagaatataattcatgtgattggcggaaatgatgttaagtcaagtgtgagcagcgtcctgcaggaatgcgagaaaaagaattattcgagtatctgtctcccagccattggcaccggcaacgcaaagcagcaccccgacaaggtcgcggaggctataatagatgcaatcgaggacttcgtgcagaagggttctgcacagtctgtgaaaaaggtcaaggtcgtcatatttctccctcaggtccttgacgtattttatgcaaatatgaagaagagggaggggacgcagttgtccagccagcagtcggtgatgtcgaagcttgcctcttttctgggatttagcaaacagtcgccgcagaagaaaaatcacctggtgctggaaaagaaaacagagagcgcaaccttccgggtttgtggagaaaatgtgacttgtgtcgagtatgccatcagctggttgcaggacttaattgagaaggaacaatgcccatacacgtcagaagatgagtgcattaaggatttcgatgagaaggagtatcaggagttaaatgagctgcagaagaaactgaatatcaatatttctttggatcacaaaagacctttgatcaaggtgcttggcatctcacgggatgtgatgcaggctcgagatgagattgaggccatgataaaaagagttcgcctcgccaaagagcaagagagtagggccgattgtatcagcgagttcattgagtggcaatacaatgacaacaatacaagtcactgtttcaataaaatgacaaacctgaaactggaggacgcccgccgtgaaaagaagaaaaccgtggacgtcaagatcaaccataggcattacacagtaaacctgaacacatacacagccacggacacaaagggacacagtctgtctgtgcaaaggctgacaaagtccaaagtcgacatacctgcccactggagtgacatgaagcagcagaatttctgcgtggtggaattactgccaagcgacccagaatataatactgtggccagtaaattcaatcagacatgctctcattttcggatcgaaaagatcgagcgaatccagaacccagacctgtggaactcatatcaagctaagaagaaaactatggacgccaagaatggccaaacaatgaacgaaaaacagctgtttcatggaactgatgccggttccgtacctcacgtcaaccgcaatggctttaataggtcctatgctggtaagaatgccgtggcgtacggaaagggaacgtactttgctgtgaacgctaactattcagccaacgacacctactcccggcctgacgccaatgggcggaaacacgtgtactatgttagggttctgaccggcatctacacgcacggtaaccactctctcattgtgcctccgtcaaagaacccccaaaatcctaccgacttgtacgataccgtgacagacaatgtccatcacccaagccttttcgtggcgttctacgattaccaggcctatcccgagtacctgattactttcagaaaatag

SEQ ID NO: 199911 - DNA, 5163 bp, Artificial Sequence
  Description of Artificial Sequence: Synthetic coding sequence
atggccgtgcccggcagcttccccctgctggtggagggcagctggggtcctgatccccccaagaacttgaacactaagctgcagatgtatttccagtcccccaagaggagcggcggcggtgaatgtgaggtgcggcaagatcctcggtcaccgtctcgatttttggtgttcttctatcccgaggacgtccggcagaaagtgcttgaacggaagaaccacgagctagtgtggcaaggcaagggaacctttaaactgaccgtccagcttcctgcgaccccagatgagatcgaccatgtgttcgaggaggaactgctgacaaaggagagtaagactaaggaggacgttaaggaacctgatactatccggttcgtggacgactgtaccaaacatcacagtataaagcagctacaactcagcccgcggctgcttgaagtgaccaataccataagagttgaaaatttgccacctggcgcagatgactatagccttaagctctttttcgaaaatccgtataatggcggggggagagtcgctaacgtcgaatacttcccagaagagtccagtgcattgattgagtttttcgatagaaaagttctcgacacaattatggccaccaaactcgatttcaataagatgcccctctctgtgtttccttactatgccagcttgggaaccgctctctatggtaaggaaaagccgttaataaaattacccgccccatttgaggagagtctggatcttcctctttggaaattcctccagaaaaagaatcatctcattgaagaaatcaatgatgagatgaggcgttgccactgtgaattaacttggtcacagttatcagggaaagtaactattcggccggccgctacactggttaacgaaggcagacctcgtatcaagacctggcaagctgacactagtacgactctgagttctatcagaagtaaatacaaggtaaatcccattaaggtagatccgactatgtgggacacaatcaagaacgatgtgaaagatgatcggattctgattgaattcgacacacttaaggaaatggtgatccttgccgggaagtccgaggacgtgcagtctatcgaggtccaggtgagggaactcatcgaaagcaccacccaaaagattaaaagggaggagcagtcactaaaggaaaaaatgatcatctctccaggacgctatttcctgctctgtcactcgtcactcttggatcacctgttgactgaatgccctgagatcgaaatctgctatgatagagtgacccaacatctgtgcttgaagggcccctcggcagatgtgtataaagctaagtgtgagattcaggagaaggtatacactatggcccagaaaaacatccaggtgtccccagagatcttccaattcctgcagcaagtgaactggaaggaattctctaaatgcctttttatcgctcaaaagatcctggctctctatgaattggaaggcacaaccgtgctacttacctcttgcagttctgaggccctcctagaggcggaaaagcagatgctgtccgcgctgaactacaaacgcatagaggtcgagaacaaggaggtgctacatggtaagaaatggaaaggcctgacacacaacttactgaagaagcagaacagttcccctaataccgtcatcatcaatgagctcacgagcgagaccactgccgaggtgattattaccggatgtgtgaaggaggtaaacgaaacttacaagttgctattcaattttgttgagcaaaatatgaaaattgaaaggctggtggaagtgaagccttcactcgttatagactacttgaagacagaaaaaaagctgttttggccgaaaattaagaaggtgaacgtgcaggtctcctttaaccccgagaataaacagaaaggaattctcctgaccggctcaaagacggaggtcctgaaagcagttgatattgtgaaacaagtgtgggactctgtgtgcgtgaagtccgtccatacagataaaccaggtgccaaacagttttttcaggataaggctagattttaccaaagtgaaattaagcgactgtttggttgctatatcgagctacaggaaaatgaagttatgaaagaaggtggatcgcctgcaggacagaagtgcttttctaggacagtgctcgctccaggggtggtccttatcgtacagcaaggcgatctagctaggctcccagttgacgtggtcgtgaacgcttcaaatgaggacctcaagcactatggcggtctcgccgccgcgttgtccaaggctgccggccctgagctacaagccgactgtgatcagatcgtgaagagagaaggtagactgctccctgggaatgccacaatcagcaaggcggggaagcttccataccaccacgtaatccatgcggtcggaccaagatggtctggttacgaggctccaaggtgcgtctacttgctcaggagagctgtgcagttgagcttgtgcttggccgagaaatataaatatcgctccattgcgatacccgccatttcctctggcgtgttcggcttccctctcggaagatgtgtcgagactattgtgtctgctatcaaggagaatttccaattcaagaaggatggtcactgccttaaggagatctatttggtcgatgtaagcgagaagactgtcgaggctttcgctgaggctgtcaagacggtgttcaaagccactctaccagataccgccgcccccccggggctgccacccgccgcagccggaccagggaagactagctgggagaaggggtcattggtgagtcctggcggactgcaaatgctgttggtcaaagagggggtgcagaatgcaaagaccgacgtcgttgttaacagtgtaccccttgatctagttctgtcccgtgggccactgtcgaaaagcctgctggagaaggccggaccagaactgcaggaagaactcgatacagtgggacagggcgtggccgtgtccatgggaacagtattaaaaacttctagttggaacttggactgccgctacgttctgcatgtcgtggcccctgaatggagaaatggcagcacatccagtctcaaaattatggaagatattattagggaatgtatggagatcactgaaagcctcagtctaaaaagcatcgcattccctgccattggcacaggaaatttggggtttcctaagaacattttcgccgagttgatcatctccgaggtgttcaaattttccagcaagaatcagctaaagacattgcaggaggtgcacttcctactccaccccagcgatcacgaaaacatccaggctttctccgacgaatttgcgcgacgcgctaacggcaacctcgtatcagataagattccaaaggcaaaggatacgcagggattctacgggactgtctcatcacccgatagtggagtgtacgagatgaaaattggtagtataatatttcaagtggctagcggagacattaccaaagaggaggccgatgtaatcgttaactccaccagtaattcgttcaaccttaaggtgggagtatcaaaagcgatcttggaatgtgctggacagaatgttgaaagagaatgttcgcagcaggctcagcagagaaagaatgactacattattactgggggcggcttcctcaggtgcaagaacattatccacgttattggcgggaacgacgtcaaatcctctgtgtcgtctgtcctccaagagtgcgagaagaagaattatagctccatttgtttaccagccattggcaccgggaacgccaagcagcacccagataaagttgccgaagctatcatagatgcaatcgaagactttgttcagaaagggtcagcacaaagtgttaaaaaggtgaaggtggttattttcctccctcaggttctcgacgttttttatgccaatatgaagaagagagagggtacacagctctcctctcagcagtctgtgatgagcaaacttgcctcttttcttggtttcagcaaacagtctccacaaaagaaaaatcaccttgtcctcgaaaaaaagaccgaaagtgccaccttccgcgtctgcggagagaatgtcacttgcgtcgaatatgctatatcatggttgcaagacctgatcgagaaagaacagtgcccctatacctctgaagatgaatgtataaaggattttgatgagaaagaataccaggagctcaacgagctgcaaaagaagttgaatataaatatttccctcgaccacaagcggccactgatcaaggtccttggaatatcccgagacgtgatgcaggccagagacgagatcgaagcgatgattaaaagggtccgcctggctaaagagcaggagtctcgcgcagattgcatctcggagtttatcgaatggcaatataacgacaacaacacttcccattgtttcaataaaatgacaaaccttaagctcgaggatgcccgtagggagaaaaagaaaaccgttgatgtcaaaataaaccacagacattataccgtcaacctgaatacctacacggctacggacacgaagggtcactccctgagcgtacagagactgactaaatccaaggtggatatccccgcccattggagtgacatgaagcagcagaacttctgtgtagtagaactgttaccttccgatcctgagtacaacacggtggcatccaagtttaaccagacatgctctcatttcaggatcgagaagattgagcgcatacaaaatcctgacctttggaattcctaccaggcaaaaaaaaaaactatggatgccaaaaacggtcagacgatgaacgagaaacagctgtttcacggtaccgatgctggttccgtcccccacgtcaataggaacggttttaacaggtcctacgctggaaagaatgcagtggcatacggaaagggcacctattttgccgttaacgctaactactcagctaatgacacatattcccgacccgacgccaacggtcgcaagcacgtctattatgttcgagtcctcactggcatttatacccacggtaaccacagcctcatagtgccaccctcaaagaatccacagaaccccaccgacctttacgacacagtgaccgacaatgtacatcatccttctcttttcgtagcattctatgactaccaagcctaccccgagtacctaatcacattcagaaaatag

SEQ ID NO: 199912 - DNA, 5406 bp, Artificial Sequence
  Description of Artificial Sequence: Synthetic coding sequence
atggccgtgcccggcagcttccccctgctggtggagggcagctggggcccagatcctcccaagaacctgaatacaaagctgcagatgtactttcaaagccctaagagatccggtggaggcgagtgtgaagtgaggcaggaccccaggtcgcccagccgcttcttggtcttcttttacccagaagatgtgcggcagaaagtcttagagcggaagaaccatgagctagtctggcaaggtaaaggcacctttaagctgacagtgcagctccccgctacgcctgacgagatcgaccacgtgtttgaagaagagctcctcaccaaggagtcgaaaacaaaggaagatgtgaaagagcctgacgtgagtgaagagctggatacaaagctcccactggatggcgggctggataaaatggaggacatccccgaggaatgtgagaatattagctctctggtcgcgtttgagaacctgaaggccaacgttacagacattatgctaattttgctcgtggaaaacatctccggcctcagcaacgacgatttccaggttgaaattataagggactttgacgtggctgtcgtgacattccagaagcacattgatacgataagattcgttgatgattgtacaaagcaccattctatcaaacaactgcagctatcaccaagactgctggaggttacaaacacaatccgggtcgagaatctgcccccgggtgcagacgactactctctcaaattatttttcgaaaatccatataatggaggcgggagagtggctaacgtggagtactttcccgaggaaagctccgcgcttatagagttctttgatagaaaggtgttggatacgatcatggccactaagttagattttaacaaaatgcctctgtccgtctttccctactatgcgtctcttggaacggcactgtatggcaaggaaaagcccctgatcaaactcccggcaccctttgaagaaagcctcgaccttcccttgtggaagttcctgcaaaaaaaaaatcacctcatagaagaaataaacgacgaaatgcgtcgatgccactgtgagttaacttggtcccagctttcaggcaaagtgactatccgccccgcggcaaccctggtgaatgagggtcgaccaagaatcaaaacttggcaagccgatacctccactacgctttcttctattaggtccaagtataaggtgaaccctatcaaagtagatcctaccatgtgggacacaattaagaatgacgttaaagatgaccgtattcttattgaatttgacactcttaaagagatggtgatccttgctggcaaatcagaagacgttcagagtatcgaagtccaggtgagagaattgatagagtcaactacacagaaaattaaaagggaggaacagtcgctgaaagagaaaatgattatttcgcccggacggtatttcctcctctgtcattcttccctactggaccatcttcttacggagtgccctgagatagaaatttgctatgaccgagtcacccaacacttgtgcctcaaagggccttccgcagatgtttacaaggcaaagtgtgagatccaagagaaagtgtacacgatggcccagaagaatatccaagtgtcacccgagatcttccagttcctgcaacaggtgaattggaaagaattctcgaagtgtttgtttattgcccagaaaatactggccctgtacgaactcgagggaaccaccgtgctgcttactagctgctcctctgaggcccttttagaagcagagaaacagatgctctccgcacttaactataagcgcattgaggtggaaaacaaggaagttctgcacggcaagaagtggaagggccttacccacaacctgttgaagaaacagaatagctcacccaacactgtgattattaatgagctcacctctgaaacgaccgcagaagtaatcatcaccggttgtgttaaagaagttaacgaaacatataaactcctctttaacttcgtagagcagaatatgaagattgaacggctggtcgaagtgaagccctcccttgttatcgattatctgaaaacggaaaagaaactgttttggcctaaaatcaaaaaggtcaacgttcaagtgagctttaacccagagaacaaacagaagggaatcctcctaactgggagcaaaacagaggtgttgaaggccgtggacatcgtgaaacaggtttgggacagcgtgtgtgttaaatccgtgcacactgacaagcccggagcaaagcagttcttccaggataaagcacgattttatcagagcgagattaaacggctgtttggctgctacatcgaacttcaagagaatgaggtgatgaaggaaggcgggagccccgctggccagaaatgtttcagccggactgttttagcaccaggcgttgttctgatcgtgcagcaaggggatctggcccggctgcctgtggacgtcgtagtgaacgcatcaaacgaagacctgaagcactatggtggcctcgcggccgccctgtcaaaggcagctggcccagaactgcaggcagattgtgaccagatagtgaagcgtgaggggcgtctcctgcccggaaatgccacgatctcaaaagcgggcaaattaccataccatcatgttattcacgctgtcggccctcgctggtcaggttatgaggcccccaggtgcgtgtatttacttaggagagcagtccagctcagcctctgccttgccgaaaaatataaatacaggtccatcgctatccctgctatttcaagcggagtcttcggcttcccgctggggcgatgcgtggaaaccatagtttcagccatcaaggagaactttcagttcaaaaaggatgggcactgcctcaaggagatttatctggtagatgtgtctgagaaaacagtagaggcctttgcagaggccgttaagacggtgtttaaagccactctcccagatactgcggcgcctccgggactcccgccagcggctgctggccctgggaagacctcatgggaaaaagggtcactagtgtctccgggtggcctccagatgctgcttgtcaaggagggtgtgcagaatgcaaaaacggatgtggtcgttaacagtgttccactggatctggtgttgtctagagggcccctgagtaaatccttgttggagaaggcgggacctgaactgcaagaagaactggacactgtgggccaaggtgttgcagtgagcatgggtaccgtactgaagacatcatcatggaacctcgactgcaggtatgtactacacgtcgtggcgcctgagtggcgcaatggctccacctcttcattgaagatcatggaagacataatccgcgagtgtatggagatcacagagagcctgtcattgaaaagtattgctttccctgcaatcggcactgggaatctgggcttcccaaaaaacatctttgctgaactcataatatctgaggtcttcaagttttcttcaaagaaccagttaaaaaccctccaggaagtgcattttcttcttcaccccagtgaccatgaaaatattcaggcatttagtgacgagtttgctcggcgggcaaatggcaacctcgtgagtgacaaaatccctaaggcgaaggatacccaggggttttatggcactgtgtcttccccggattccggcgtttacgaaatgaagatagggtcaatcattttccaagtcgccagcggggatattacaaaagaggaggccgacgtgattgtcaactctacgagtaatagctttaacctcaaggctggtgtttcaaaagccatcctggagtgcgccggccagaatgtggaaagggaatgctcacaacaggctcagcagcggaaaaatgactacatcattacaggggggggcttcctgaggtgtaaaaacatcattcatgtgatcggcgggaacgacgtgaaatcttccgtctcctcggttctgcaagaatgcgagaaaaaaaactactcttcaatctgtttaccggccatcggaacaggcaatgccaagcagcatccagataaagtcgctgaggccatcattgatgccatcgaggacttcgtgcaaaagggttccgcacagtctgtgaagaaagttaaggtagtaatttttctgccccaagtcctggacgtattttacgctaacatgaaaaagagggaaggaacccagctctcaagtcaacaatccgttatgagcaaacttgcatcttttctgggtttctctaagcagtctccccaaaagaagaatcatctggtactcgaaaaaaaaaccgaaagtgcaaccttcagagtatgtggggagaacgtgacctgcgtcgagtacgctatctcttggctccaggatctcatcgaaaaagaacagtgcccgtacaccagcgaggacgagtgtattaaggactttgatgagaaggagtatcaggaactgaacgagctgcaaaagaagctgaacattaatattagcctggaccataagagacccctgataaaggtgttgggtatctctagggatgtgatgcaggcccgggacgagattgaagccatgatcaagagggtccggcttgctaaggaacaggaaagtcgggcagattgcattagcgaatttatcgagtggcagtacaatgataacaatacatctcattgctttaacaagatgacgaacttgaaacttgaagacgcccgaagagagaaaaagaaaacggtcgatgtcaagatcaaccatagacattatacggttaaccttaacacatacaccgccaccgacaccaagggtcacagtttatcagttcagaggctcaccaaaagcaaagtagatatcccggctcactggtcagatatgaaacaacagaacttttgtgttgtggagctgctgccgtccgatcctgagtataatacagtggcatctaagtttaatcaaacttgtagccatttccgcattgaaaagatagaaagaatacagaacccggacctgtggaatagctaccaggctaagaaaaagacaatggacgccaaaaacgggcaaacaatgaacgaaaaacaactgttccacgggacagacgcaggctccgtccctcacgtcaatcgaaacgggtttaacaggtcctatgctggcaagaacgcagtcgcatatgggaaaggcacttacttcgctgtaaacgcaaactactctgccaatgatacttacagccgccccgacgcgaacggaaggaaacacgtatactatgttcgcgtactcacagggatctacacccacggaaaccactccctgattgtgcctccatctaagaaccctcagaaccccaccgatttatacgacaccgtcacagacaatgtgcatcaccccagcttatttgtcgctttttacgattatcaggcctaccccgaatacctgattacttttaggaaatag

SEQ ID NO: 199913 - DNA, 585 bp, Artificial Sequence
  Description of Artificial Sequence: Synthetic coding sequence
tgagtgcggcggcgggccgagctgcggatggccgtgcccggcagctttcctcttcttgtggaaggctcttgggggcccgatcccccaaaaaatctgaacaccaagctgcagatgtactttcaaagccctaagagatccgggggaggggagtgcgaggtgcgccaggatccccggagtccctcgcggtttctcgttttcttctaccccgaggacgtgcgtcaaaaagtgctagagagaaagaatcacgaactcgtgtggcagggtaaaggcacattcaagctgaccgttcagttgcccgccacacccgacgagatcgaccacgtgttcgaagaggagctcctaacaaaagagtctaagaccaaggaggatgtaaaggagcctgatacaattaggttcgtggacgactgtacaaagcaccatagcattaagcagcttcagctgagcccaagactcctggaggtaactaacacaatccgagtggagaacctgccaccaggggcagatgattactcactgaagttgttttttgagaacccttataatgggggtggccgtgtggctaacgtggagtatttcccggagtag

SEQ ID NO: 199914 - DNA, 1335 bp, Artificial Sequence
  Description of Artificial Sequence: Synthetic coding sequence
atgctgcagcggatcggcctgatcttcctgcacaacatcgtggtggttagcaattgtttctattttcaggccttccttgacgagtttacaaattggtcacggatcaatcctaataaggcccgaattcccatggcaggcgacactcagggcgtagtcgggacagtgagcaagccgtgtttcacagcctatgaaatgaagatcggggcgattacctttcaggtcgcaaccggggacatagcaactgagcaagttgatgtcattgttaactctacagcccggacctttaacagaaagtctggtgtgagtagggccattctggagggcgccggccaggcagtggagagtgagtgcgcagttctggccgcccagccgcatcgcgacttcatcataacaccaggtggatgtttaaaatgcaaaataatcattcacgtccctggagggaaggacgtccggaaaactgtgacaagtgtgctggaggaatgcgagcaaagaaaatatacgtcagtttccttgccagccattggtaccggcaatgcaggtaagaacccgattactgttgccgataacattatagatgccattgtggatttctccagccagcactctaccccttcactgaagaccgttaaggtcgtgatatttcagccggaacttttgaatatattttacgactctatgaaaaaaagagacttgtcagccagcctgaactttcagtctacgtttagtatgaccacttgcaaccttcccgaacattggacagatatgaaccaccaactcttttgtatggtgcagctagagcccggccagagcgagtacaacaccatcaaagacaagttcacacgcacctgcagctcttacgcaatagagaagattgagaggattcagaatgctttcctctggcaaagctatcaggtaaagaagcgtcagatggacattaagaacgaccacaagaataacgaacgactcctgtttcacgggacagacgccgattctgtaccttatgtgaatcaacacggatttaatagatcctgcgccggaaaaaacgcagtaagttacggcaagggtacgtatttcgccgttgatgcctcttatagcgccaaggatacgtactctaagcccgacagtaacggccggaagcacatgtatgttgtaagagttctgaccggggttttcacgaaggggcgcgctgggttggtcacccctccccctaaaaatcctcacaatccgaccgacctgtttgattccgttacaaataataccaggtcccccaagctcttcgtagtgtttttcgataatcaggcatatcctgagtacctcattacattcacagcctag

SEQ ID NO: 199915 - DNA, 2037 bp, Artificial Sequence
  Description of Artificial Sequence: Synthetic coding sequence
atggccgcccccggccccctgcccgccgccgccctgagccccggcgccccaacacccagagaactgatgcacggcgtagctggggtgacgagtagagccggtcgagatcgtgaagccggttcagttctgcctgctggcaaccgcggagcacggaaggctagccgacgcagttcatccagatctatgagccgggacaataaattttccaagaaagactgcctctctattagaaatgtggtggcttcaatccagacgaaagaaggcctgaatctcaaactcatctccggggatgtcttatatatttgggccgatgttattgtgaacagtgtgcccatgaatctccagctggggggtggtccgctgagcagggctttcctgcagaaggctggccctatgctgcaaaaagagcttgacgatcgaaggcgagaaactgaagaaaaagttggaaatattttcatgactagtggttgcaacctagattgtaaagcagtcctccatgccgttgccccttactggaacaacggggctgagacctcatggcagataatggccaatattattaagaaatgcctgacaactgtggaggtgttatcttttagttctattacttttccgatgatcggcaccggaagcttacagtttcctaaggctgtcttcgccaagctcatcctgtctgaggtcttcgaatattccagcagcactcgccctatcacttcacctctgcaagaagtacattttctagtgtacacaaatgatgacgaaggttgtcaggctttcctggacgagtttactaactggagccgaatcaatcctaataaggccagaatccctatggccggtgacacacagggcgtggttgggaccgtgagcaaaccttgcttcacagcttacgaaatgaagattggggctatcaccttccaggtcgccacaggcgacatagcaactgaacaggtggacgtgattgtgaactctactgcacgcacctttaatcgcaaatctggagtcagcagggcgattcttgagggtgcaggacaagcggttgagagcgagtgtgctgtgcttgcagctcagcctcatcgggactttattatcacccccggcggctgtctgaagtgcaagatcataattcacgttccaggggggaaggacgtgcgcaagacagtcacatccgtgctggaggagtgcgagcaaagaaaatacactagcgttagcctacccgccataggaactggcaatgctggcaagaaccccataaccgtcgctgacaatattatagacgccattgtggatttttccagtcagcacagcacaccatcgctgaagacagtgaaagtcgttatctttcagcctgaactgctgaacatcttttatgactcaatgaaaaagagagatctgtctgcaagtttgaatttccagtcaacatttagcatgaccacctgcaacctgcctgaacattggactgatatgaatcaccagctcttttgtatggtacagctggagcccggccagtcagaatataacacaatcaaagacaagtttacgcgaacttgtagctcctacgcaatcgaaaaaatcgaaagaattcagaacgcctttctttggcagtcctatcaggtgaagaagcgccagatggatatcaagaacgaccacaaaaataacgagagactgctttttcacgggactgacgctgatagtgtgccatatgtcaatcagcacggtttcaaccggtcttgtgctggtaaaaatgctgtttcttacggcaaaggcacatacttcgctgtagacgccagctacagtgctaaggacacgtatagcaagcccgactcgaacggtaggaagcacatgtacgtggtcagagtgttaactggcgtgttcaccaaaggaagagctggcttggtcaccccccctccaaagaaccctcataatcccacggacttgttcgactccgtcacaaacaacacccgaagccccaagttgttcgtggtgttcttcgacaatcaggcataccctgagtacctaatcacatttaccgcatag

SEQ ID NO: 199916 - DNA, 1278 bp, Artificial Sequence
  Description of Artificial Sequence: Synthetic coding sequence
atgaagcacaccgccttcctggacgagttcaccaactggagccggatcaacccgaacaaggcccggatccccatggcaggagacacccaaggagtggtgggaactgtctctaaaccctgttttactgcctacgagatgaagatcggcgcaattacctttcaagtggccacaggagatattgctaccgagcaggtggacgtgatcgtgaacagcactgctcgaaccttcaatcgaaagtccggtgtgagccgcgctatactcgagggggccggacaggctgtggagagcgaatgtgcagtgctcgcagctcagccgcacagggatttcatcatcacgcctggcggctgccttaagtgtaaaatcatcatccacgtaccagggggaaaggacgtacgtaagactgtgacatcggtactggaagaatgcgaacaaagaaagtacacctccgtttcactcccagccattgggaccggtaatgccgggaagaatcctatcactgttgctgacaatataattgacgccatcgttgacttctctagccagcattccacacctagtcttaagacagtgaaggttgtcatattccagccagagctgcttaatatcttttatgatagcatgaagaagagggatctttcagcctcccttaacttccagagcacattttctatgaccacgtgtaatctgccagagcactggaccgatatgaaccatcagctcttctgcatggtgcaattagagccgggccaaagcgaatataacacgatcaaagataaattcacaagaacctgttcctcttacgccattgagaaaatcgagcgcattcaaaatgctttcctctggcagagctatcaggttaagaagagacagatggatattaagaacgatcataaaaacaatgaacgccttttgttccacggaaccgacgctgactccgtgccctatgttaaccagcacggatttaatcgatcttgcgcaggtaaaaacgcagtgtcatatggaaaggggacttacttcgctgtcgatgccagctattccgcaaaagatacatatagcaagcctgacagcaatgggcggaaacacatgtatgtcgtgagggtccttactggagtttttacaaaggggcgggcaggactcgtaactcccccacccaagaatccacataatccaaccgacctcttcgatagcgtcaccaataatacaagatcacctaagctattcgtggtgtttttcgataatcaagcttaccctgagtatttgattacctttactgcctag

SEQ ID NO: 199917 - DNA, 2565 bp, Artificial Sequence
  Description of Artificial Sequence: Synthetic coding sequence
atggacttcagcatggtggccggcgccgccgcctacaacgagaagtctggaagaatcacgtcgctgtcgctcctgttccaaaaagtgtttgcccagattttcccacagtggaggaaaggaaacactgaagagtgcctcccttacaagtgttccgagaccggtgctctaggcgagaattactcctggcagatacctattaatcacaacgattttaagatacttaaaaacaacgaaagacaattgtgcgaagttcttcaaaacaaatttggttgtatctctaccttagttagtcccgtgcaagagggtaatagcaaatccttgcaggtcttccggaagatgctgactccacgtattgaactaagcgtctggaaagatgacctcacaacccacgcagtggacgctgtggtgaatgccgcaaacgaggacttgttacacggcggcggactggccttggcactagtcaaagcgggtggctttgagatacaagaagaatcgaagcagtttgtcgcgcgctatggaaaagtatcagccggggaaattgcggttacgggtgcaggaaggttaccttgtaagcagattatacacgccgttggtccgcggtggatggagtgggacaagcagggatgtaccggcaaactgcagagagcgatagtcagcattctcaactacgttatctataagaatacacatatcaaaacagtcgccatacctgctttgagctccggaatcttccaattcccgctgaatctctgcactaagaccattgtagaaaccattcgcgtgtccctgcaggggaagcccatgatgtccaatcttaaggagatccacctcgtgtcaaacgaggacccgactgtagctgcctttaaggccgcatccgagttcatcctcggaaagagcgaattgggacaggaaactaccccatcctttaatgctatggtggtcaacaacttgacactgcaaatcgttcagggccacattgagtggcaaaccgctgatgttatagtgaatagcgtcaatccacacgatatcacagtgggccctgtggctaagtcaattctgcaacaggcaggcgtcgaaatgaaatccgaattcttagccaccaaagccaaacagtttcagcgatctcagctagtgctcgtaacaaaagggttcaatctgttctgcaagtacatttaccatgtgttgtggcactccgagtttccaaaaccacaaattctgaagcacgccatgaaagaatgccttgaaaagtgcatcgaacagaacatcaccagtatttcgtttcccgccttgggcactggaaatatggaaattaagaaggagacagcagctgaaatattgttcgacgaagtcctgaccttcgcaaaggatcacgtgaagcaccaacttactgtcaaattcgtgatcttcccaacagacttggaaatttataaggcattttcttcggaaatggctaaacgtagcaaaatgctgtcactcaataattacagtgtcccacagtcaactagggaggaaaagagagagaatgggttggaagccagaagtccagcgatcaacctaatggggtttaacgtggaggagatgtacgaggcacacgcctggatacaacggattctttcgctgcagaatcaccacattattgagaacaaccacatcctctacttgggccggaaagagcatgatatactgagccagcttcaaaaaaccagtagcgtatcaattactgagataatctctcccggtagaactgaactagagatcgagggagctagagctgacctcatcgaagtggtgatgaatatcgaggacatgctctgtaaggtacaggaggagatggcgcggaagaaggagaggggattgtggagatctctgggacagtggaccatacaacagcagaaaacacaagacgaaatgaaagaaaacatcatctttctcaaatgtcctgtccccccgacgcaagaactgctcgaccagaagaagcagtttgagaagtgcggcctccaggtccttaaggttgagaagattgataatgaggtgctcatggccgcgtttcaacgtaaaaagaagatgatggaagaaaaactgcatagacagccagtgtcgcaccgccttttccagcaggtcccgtatcagttctgtaatgtcgtgtgtcgagtgggattccagagaatgtacagcaccccttgtgaccccaaatatggtgcaggcatttactttactaaaaacctgaagaatctagccgaaaaggccaaaaagatttctgcagcagataagttaatctatgtgttcgaagccgaggtgctgaccggattcttctgtcagggacatccactcaacatcgtgcctccacctctcagccctggagccatcgacggacacgactctgtggtcgataacgtgagttcaccagaaacttttgtgattttctctggaatgcaagccattccacagtacctgtggacctgcacccaggagtatgttcagagccaggattattccagtggtcccatgcgaccatttgctcagcatccttggagaggatttgcctccggctcgcctgtcgactag

SEQ ID NO: 199918 - DNA, 2334 bp, Artificial Sequence
  Description of Artificial Sequence: Synthetic coding sequence
atgagcgtgagctgcgtgaagagcagccggatcagcctggccgtgtctctgccgtggtcgctgcaatttcgcaaagccaccgctaatttatgcgtttttaggaaaatgctgacccctaggattgagctgagtgtgtggaaggatgaccttactacgcacgcagtggatgctgtggtgaacgcagctaacgaagacctcctccatggggggggacttgccttggccttagtaaaagcaggcggctttgagatccaggaggagtccaagcagtttgttgctcgttacggaaaagtttccgccggagagatagccgtgacaggagcaggtcgactcccctgtaaacagatcatacacgcagttggacctagatggatggagtgggataaacagggctgcacaggaaaattgcagcgcgctatcgtgagcatactgaactacgtgatatacaaaaacacgcacatcaaaaccgtcgcaattcctgctctgagcagcggcattttccaatttcccctgaatctgtgtaccaagacaattgtagaaaccatccgggtgagcctgcagggcaaaccaatgatgtccaacttgaaagaaattcaccttgtctccaacgaggacccgacagtggccgcgttcaaggccgcgagcgaatttatcttgggcaaaagtgaactggggcaagagacgactccatcattcaatgccatggtggtgaacaatcttaccttgcaaattgtccagggacacatagagtggcagactgccgacgttatcgtcaattcagttaatccacacgatatcacagtaggaccagtggccaagtctattctgcagcaggccggggttgaaatgaagtcagaatttctggcaacgaaagcaaagcagtttcagagaagccagcttgttctagtcactaagggcttcaatctattttgcaagtacatctaccatgtcttatggcactccgaatttccgaaacctcaaatcctaaaacatgcgatgaaagagtgtctggaaaaatgtattgagcagaatataacctctatttccttccccgctctgggaacaggaaatatggaaattaaaaaagagactgctgcagagattctcttcgacgaagtgcttaccttcgccaaggaccatgtgaagcatcagctgacagtgaagtttgtgatatttcctactgacctagaaatctataaagcttttagcagcgaaatggctaagcgatctaagatgctgtccctcaataactactctgtgccccagtcaacccgcgaagagaagcgagaaaatgggctagaagctaggagccctgcgattaatctgatgggctttaatgtagaggagatgtatgaggctcatgcctggatccaacgaatcctcagtctccaaaatcaccacattatcgagaacaaccatatcttgtatctgggccggaaagaacacgacatcttgtcgcagctccagaaaacctcaagcgtgagcatcactgagattatatctcctggacgcactgagctggagattgagggagctcgagcggatctcattgaggtggtcatgaacatagaggacatgctgtgtaaagtgcaggaggagatggcgagaaaaaaggagcgtggcctgtggcgaagcctaggccagtggacgattcagcaacaaaagactcaggatgaaatgaaagaaaacattatctttcttaaatgtcctgtcccacccacccaggagctgctagatcagaaaaaacaatttgagaaatgtggcctgcaggtgctgaaggtggaaaaaatcgacaatgaagttctcatggccgcttttcagcgcaaaaagaaaatgatggaggaaaagctccacaggcagcctgtttcacaccggctcttccagcaggtgccctaccagttttgtaacgtggtctgccgcgtgggctttcagagaatgtattcaacgccatgcgaccccaagtatggggccggcatctatttcaccaagaatcttaagaatctcgcagaaaaggccaaaaagatttccgctgccgataaattaatttacgtcttcgaagccgaggttctaaccggcttcttttgccaaggacacccccttaacatagtgccacctccactgagccctggggccatcgatgggcacgactccgtcgtggataatgtgtcatctcctgaaacttttgttatcttttcagggatgcaggctatcccccagtacttgtggacttgcacgcaggagtacgtgcagagccaggattattccagcggccccatgcgaccctttgcacaacatccatggcggggttttgcatccggttcacccgtggactag

SEQ ID NO: 199919 - DNA, 2460 bp, Artificial Sequence
  Description of Artificial Sequence: Synthetic coding sequence
atggacttcagcatggtggccggcgccgccgcctacaacgagaagagcgaaaccggggccttgggtgagaactactcttggcaaatccccataaaccataatgactttaagatactgaagaataacgaacggcagctctgtgaagttctgcagaataagtttggctgcatctctactctggtgagtccagtgcaggaaggcaactcaaaatcgctgcaggttttccgcaaaatgctgaccccacggatcgagttgagcgtgtggaaggacgaccttaccactcatgccgtagatgccgtcgtgaacgccgctaacgaagacttacttcatggagggggcctagctcttgcgcttgtgaaagctggcggatttgagatccaggaagagagcaaacaatttgtagcccgctacgggaaggtgagcgctggtgaaatcgccgtcacgggagccggtagactgccgtgcaagcaaattatccatgccgtgggaccacgatggatggagtgggacaagcagggttgtacgggtaagctgcagcgggctatcgtctccatcctaaactacgtaatttacaagaatacgcatataaagacggtggcaattcctgccctcagcagtggcatctttcaattccctttgaacctctgcaccaaaaccatcgtggaaacaatacgagtatcactgcagggaaaacctatgatgtcaaatttgaaggagatccatctagtgtcaaatgaagatccaacagtggcagccttcaaggcagccagcgaattcatcttgggcaaatccgaactaggacaggaaaccacacccagtttcaatgccatggttgtgaacaatctgacgttacagatagtccaaggccatatcgaatggcagacagccgacgttatcgttaattccgtcaatccccacgatattactgtgggtccagtggccaagagtattctgcagcaggccggcgtggagatgaagtcagaattcttagctaccaaggccaagcagtttcagaggtcgcaactggtcctcgttaccaaaggcttcaacctgttttgtaagtatatataccacgttctgtggcattcggagtttcccaagccacagatcctgaagcacgcaatgaaagaatgcttggagaagtgcatagagcagaacatcacctctatctcatttccagcactggggactgggaatatggaaattaaaaaagagaccgctgctgaaatcctgttcgatgaggtgttgactttcgcaaaagaccatgtgaagcaccagctgacagtcaagtttgtgatattcccaacagatcttgagatctacaaagcattctcaagtgagatggccaagcggagtaagatgctctccctgaacaattattcagttccacagtctacaagagaggagaagagggagaacggcctcgaagcccgaagtccagctatcaacctcatgggattcaatgtcgaagagatgtacgaagcccatgcctggattcagcgtatcctctccttacagaatcaccatatcattgaaaacaatcatatcctgtatctgggccgtaaggagcacgacatactttcccagttgcagaaaacctctagtgttagcatcactgaaattatctcccccggacgaaccgaactggagatagaaggagctcgggccgaccttatcgaagtggtcatgaacatcgaggatatgctgtgtaaagttcaggaagaaatggctagaaaaaaagaaagaggtctgtggcgctccctgggccaatggaccatccagcaacagaagacccaggatgagatgaaggagaacattatttttctcaaatgccctgttccaccaacacaagagctgcttgatcagaagaagcagttcgagaaatgtggcctgcaggttctcaaggtagagaagattgacaatgaggtcctcatggccgccttccagcgaaagaagaaaatgatggaggagaaactgcacagacagcctgtgtctcaccgcctctttcaacaagttccgtaccagttttgcaatgttgtgtgtcgagttggctttcagcgcatgtacagcacaccctgcgaccccaaatacggcgccggaatttatttcacaaaaaacttgaagaacctagcagagaaggctaaaaaaatctcagccgcagacaaactcatctatgtgttcgaagctgaggtgttgaccggattcttctgtcagggacacccactgaatatcgtgccacccccactaagccccggagcaatcgacggccacgattcagtggtggacaacgtgtcgagccccgaaactttcgtgatcttctcaggcatgcaagccattccacagtacctctggacctgtacccaggagtatgtgcagtctcaggactacagctccgggccaatgcgtccattcgcccaacacccttggcgaggctttgcatcaggatcgccagtggactag

SEQ ID NO: 199920 - DNA, 1440 bp, Artificial Sequence
  Description of Artificial Sequence: Synthetic coding sequence
atgagcgacggcttcgaccgggcccccggcgccggccggggccggtctcgcggactgggaaggggtggcggcggccccgagggaggcggcttcccaaatggggccgggccggcggaacgcgccagacaccagccgccgcagccaaaggcgcccggcttcctccagcccccacccctcaggcaaccaaggacaacgccgcctcccggcgcacagtgcgaagtcccagcaagcccccagcggccctctagaccgggcgccctgcccgaacaaacccggcctctgcgggcgccaccttcatcccaggataagatccctcagcaaaacagcgaaagcgccatggcgaaacctcaggttgtggttgccccggtactgatgtccaagctctcagtgaacgctcctgaattttaccccagtggttactcttcctcctacacagaaagctacgaggacggatgcgaggactatccgacactgtctgagtacgtgcaagatttcctgaatcacctgacagagcagcccggtagttttgaaaccgagatcgagcagttcgcggaaacgctgaatgggtgtgtaacaactgatgacgccctccaagagttggtagaacttatttaccagcaagctacatccatcccaaacttctcatatatgggtgcgagactgtgtaactatctctcacatcaccttacaatttcaccccagagtggaaatttccggcagcttctcttgcaacgttgccggaccgagtatgaagttaaagaccaagccgccaaaggtgatgaggttacccggaagcggttccacgcttttgttctctttctaggcgaattgtacctgaacttagagataaagggtaccaacgggcaggtcactagggcagacatactccaggtgggtctacgcgagctgcttaatgcattatttagcaacccgatggatgacaacctgatctgtgccgtgaagctgttgaagcttacaggaagtgtgctggaagatgcctggaaagagaaaggcaagatggacatggaggagataattcaaagaattgagaacgtggtgctggacgccaactgttcacgagatgtcaagcaaatgctgctgaaactggtggaactgagatcctccaattgggggagagtccatgccacgtcaacctatagggaggctaccccggagaacgatcctaattactttatgaatgagccgacattctacacaagcgacggcgtcccattcaccgctgccgacccggattatcaggaaaaatatcaggagctgctcgaaagagaggacttctttccagattacgaagaaaatgggacagatctgtctggagcaggagacccatacctagatgacatcgatgacgaaatggacccagagatcgaggaagcttacgagaaattctgcctcgaatctgaacggaaacgcaagcagtag

SEQ ID NO: 199921 - DNA, 1104 bp, Artificial Sequence
  Description of Artificial Sequence: Synthetic coding sequence
atggccaagccccaggtggtggtggcccccgtgctgatgagcaagctcagcgtcaatgcccccgagttctatccgagcggatactcgtctagctacaccgaatcttatgaggatggttgcgaggactatcctacactgtctgagtatgttcaggatttcttaaaccatttgactgagcagccaggatcctttgaaactgaaatcgagcaatttgcggaaactttgaatggctgcgtgacaacagatgacgccctacaggaattagtggaacttatataccagcaggccacctcaatacccaatttttcctacatgggtgccagattgtgcaattatttgagccaccatttgactatctccccccagagtgggaactttcgccagttgctcctacagcggtgccgtactgaatacgaagtgaaagatcaggcagccaagggggacgaggtgacgcgcaagcgcttccacgcctttgtactgttcctaggagaactgtacctgaacctggagattaaaggcaccaatggccaagtgaccagagccgatattctgcaagtgggactacgggaactcctgaatgccctgttctcgaatcccatggatgacaatctcatctgtgctgtgaagctacttaagctaaccggaagtgtgctagaagatgcgtggaaagaaaaaggcaaaatggacatggaggagattatacagcggatcgaaaatgtagttcttgatgctaactgctcacgggacgtgaaacaaatgctgctcaagctagtggagctgcgctcctccaattgggggagggtccacgccacctcaacctaccgcgaggccactcctgaaaatgaccctaattactttatgaatgagcctaccttctacacttccgatggtgtgccgttcacagccgcagaccctgactaccaggagaaataccaagaactcttggagcgggaagattttttccccgattacgaagaaaatggtaccgacctctccggagccggggacccttacctggacgacattgatgacgagatggatccggaaattgaggaagcatacgaaaagttctgtctagagtcagaaagaaagcggaaacagtag

SEQ ID NO: 199922 - DNA, 1203 bp, Artificial Sequence
  Description of Artificial Sequence: Synthetic coding sequence
atgagcgacggcttcgaccgggcccccgagcagacccggcccctgcgggctccccctagttctcaggacaagatcccacagcagaattccgagtctgctatggccaagccacaagtggttgttgcccctgtgctcatgtccaaacttagcgtgaatgcccctgagttttacccgagtggctattctagttcctacactgagtcgtacgaggatggctgcgaagattatcctacactaagcgagtacgtgcaggatttcctaaatcatttgacagaacaaccaggaagcttcgagacagaaattgagcagtttgccgagaccctgaatggctgcgtcaccacagacgacgccctccaggagctggttgagctgatatatcagcaagccaccagcatccctaattttagctacatgggagctcgtctttgcaactatctatcacatcatttaaccatctccccacagagcgggaattttaggcagctgttgctccagcgatgtaggaccgaatacgaggttaaagatcaggctgcgaagggtgatgaggtgacaaggaaacgatttcacgcgtttgtgctattcctgggtgagctctacctaaacctggagataaagggcacgaatggccaggtgactagggctgacatcctccaggtcggattgagggaactgctaaatgcattgttctcaaatccgatggacgacaacctgatttgcgctgtgaagttgctcaagctcaccggcagcgtgctggaggatgcttggaaggagaaagggaagatggacatggaggagattattcaaagaattgagaacgttgtgctggacgcaaattgttccagggacgttaaacagatgctgctgaaattagtcgaacttcgctcttcgaactgggggcgcgttcacgccactagtacctacagggaggcaacccccgagaacgatccaaattattttatgaatgaacccactttttataccagcgacggtgttccttttactgccgcagaccctgattaccaggaaaagtaccaggaactcctggagcgggaggattttttccccgactatgaagagaacggcactgatttaagcggagccggcgatccatatttggatgatatagatgacgaaatggaccccgagatcgaagaagcctacgaaaaattctgcctggagtccgagaggaagaggaaacagtag

SEQ ID NO: 199923 - DNA, 507 bp, Artificial Sequence
  Description of Artificial Sequence: Synthetic coding sequence
atggccaagccccaggtggtggtggcccccgtgctgatgagcaagctttccgtgaacgccccagagttctatccctcaggctatagctcttcttacaccgaatcatatgaggacggctgtgaggattatcccacgttgtcggagtatgtgcaggattttcttaaccacctgaccgagcagccagggagtttcgagactgaaatcgaacagttcgccgaaacactgaacgggtgtgtcacgacagatgacgccttacaggagctcgtggagttaatttatcagcaggcgaccagcatccccaacttcagttacatgggcgccaggctgtgcaactatctctcccaccacctgactatatcaccacagagcggcaacttccgccaactcctgctgcagcggtgcagaactgaatatgaagtcaaagatcaggcagccaagggcgacgaagtcactaggaaaagatttcatgccttcgtgctctttcttggggaactgtatcttaactag

SEQ ID NO: 199924 - DNA, 603 bp, Artificial Sequence
  Description of Artificial Sequence: Synthetic coding sequence
atggccaagccccaggtggtggtggcccccgtgctgatgagcaagctctccgtgaatgcccctgaattttatccaagcggctatagtagcagttacaccgagtcctacgaggacggctgcgaggactaccctaccctgtccgagtacgttcaggactttcttaatcatctgaccgaacagccggggagttttgaaactgagattgagcaattcgccgagactttgaacggctgcgtgactacggatgatgccctacaagagctcgtggagctcatttatcaacaggcaacaagcatacccaatttttcctacatgggtgctaggttgtgtaactacctgtcgcaccatcttaccatctctccccagagtggcaactttcgtcagctcctcctgcagcgatgtcgcactgagtatgaagtgaaggatcaggcagctaaaggcgacgaggtcacccgtaaaagatttcacgccttcgtgctgttcttaggggaactttatctcaatcttgaaatcaagggtacaaatggccaggtcaccagggccgacattttacaggttggcctgcgagaactgctgaacgccctgttcagtaacccgatgtag

SEQ ID NO: 199925 - DNA, 1056 bp, Artificial Sequence
  Description of Artificial Sequence: Synthetic coding sequence
atgagcgacggcttcgaccgggcccccgagcagacccggcccctgagggctccaccttccagccaagataaaattcctcagcagaactccgaaagcgcaatggcaaagcctcaggtggtcgttgctccagtgctcatgtccaagcttagcgtgaatgcccctgaattttatccatctggttatagttcttcttataccgagtcttacgaggacggttgtgaagactacccaactctcagtgagtatgtgcaggatttcctgaatcatctcacagagcagcccgggagttttgagaccgaaatcgaacagtttgccgaaactctcaacggatgtgttacaacagatgatgctttgcaggaattggttgagctcatatatcaacaggcgacttctatcccaaatttctcctacatgggagcacggctgtgcaactatctcagccaccacttaacgatctccccacaatcgggtaatttccgccagctgctgctgcaaaggtgtcgtacagaatatgaagttaaggaccaagcagcaaagggggacgaagtcacccgcaagaggtttcacgcctttgttttattcttaggggaattatacctaaacctcgaaattaagggcaccaacggacaggttacccgcgccgatatcctacaggtgggcctgagagagctgcttaatgccctgttctccaatccgatggacgataacctgatttgtgccgtaaagctgctgaaactaaccggcagcgtgctggaagacgcgtggaaggagaaagggaagatggacatggaggaaatcatccagagaatcgagaatgtggtgctcgatgcgaattgcagccgcgacgtcaaacagatgctattaaagctggtggaactgaggtccagcaactggggacgggtgcacgctacgtctacttacagagaggcaaccccagaaaatgacccgaactattttatgaatgaacccactttctacacttctgatggggttcctttcactgcagctgaccctgacacgtggatgattctgatgatgaggtggacccagcgttag

SEQ ID NO: 199926 - DNA, 288 bp, Artificial Sequence
  Description of Artificial Sequence: Synthetic coding sequence
atggccaagccccaggtggtggtggcccccgtgctgatgagcaagctatccgtgaacgcccccgagttttacccctccggctactccagtagctacaccgagagctatgaggatggttgtgaagactaccccacactctcagagtacgtccaggattttctgaatcatctcaccgagcagccgggtagtttcgagacagagatcgaacagtttgccgagacactgaatggctgcgtaacaaccgatgacgccctccaagagttagtagaactgatatatcagcagtag

SEQ ID NO: 199927 - DNA, 384 bp, Artificial Sequence
  Description of Artificial Sequence: Synthetic coding sequence
atgaaggaccccagccggagcagcaccagccccagcatcatcaacgaagatgtgattattaacggtcacagtcacgaggatgataaccccttcgctgagtacatgtggatggagaacgaggaggagtttaataggcaaatagaggaagagctctgggaggaggagttcattgaacggtgttttcaagagatgctagaggaagaagaggagcacgagtggttcataccagctagggacttgccgcaaacaatggatcaaattcaggaccaattcaacgatctagtcataagtgatggttcatcactagaagacctggtggtgaagtcaaacctaaacccaaacgctaaagagtttgtgcccggggttaagtacggcaatatctag

SEQ ID NO: 199928 - DNA, 384 bp, Artificial Sequence
  Description of Artificial Sequence: Synthetic coding sequence
atgaaggaccccagccggagcagcaccagccccagcatcatcaacgaggatgtgattatcaatggacactctcatgaggatgataatccgttcgccgaatatatgtggatggagaacgaggaggaatttaaccggcagattgaggaggaattgtgggaggaagaattcatagaacgctgctttcaggagatgttggaggaggaggaggaacacgagtggtttatccccgcacgggatctcccccagactatggaccagatacaggaccaattcaatgacttagtgattagcgacggatcaagtctagaggatcttgttgtaaagagcaacctgaacccgaacgcaaaagagttcgtcccaggggtgaaatacggaaatatctag

SEQ ID NO: 199929 - DNA, 282 bp, Artificial Sequence
  Description of Artificial Sequence: Synthetic coding sequence
atgaaggaccccagccggagcagcaccagccccagcatcatcaacgaggacgtgatcatcaacggccactcacacgaggatgataatcctttcgccgagtatatgtggatggaaaacgaagaggagttcaacaggcaaattgaggaagagctgtgggaagaggagtttattgaacgatgctttcaagagatgctggaggaagaagaagagcacgagtggttcataccagcccgagatctgccccagacaatggatcagattcaggatcagtttaatgattag

SEQ ID NO: 199930 - DNA, 384 bp, Artificial Sequence
  Description of Artificial Sequence: Synthetic coding sequence
atgaaggaccccagccggagcagcaccagccccagcatcatcaacgaggatgtgatcattaatggtcactctcatgaggacgataacccttttgccgagtatatgtggatggagaacgaggaggaattcaatcgccagatagaagaggaactgtgggaagaagaattcatagaacgatgttttcaggaaatgctggaagaggaagaggagcatgagtggttcattcctgctcgggatctcccacagaccatggaccaaatacaagaccagtttaacgatctcgtgattagcgatggcagcagcttggaggacctagttgtgaaatcaaatttgaatcctaatgcaaaggaatttgtcccgggtgtgaagtacgggaatatctag

SEQ ID NO: 199931 - DNA, 372 bp, Artificial Sequence
  Description of Artificial Sequence: Synthetic coding sequence
atgaacggcagcaacatggccaacaccagccccagcgtgaagagcaaagaagatcagggactcagtggccacgacgaaaaggagaatccgtttgccgagtatatgtggatggaaaatgaggaagatttcaatcgacaggtcgaggaggagttacaggagcaggactttcttgaccggtgtttccaggaaatgcttgatgaggaggatcaggactggttcattccgtcacgagacctgccccaagctatgggacaactccaacagcaattaaatgggctgtctgtgtctgaagggcacgatagtgaagatatcttaagcaaaagtaacctgaatcccgacgccaaagaattcatcccaggggagaagtactag

SEQ ID NO: 199932 - DNA, 1896 bp, Artificial Sequence
  Description of Artificial Sequence: Synthetic coding sequence
atgaaccccagcacccccagctaccccaccgccagcctgtacgtgggagatctgcaccctgacgtgaccgaggccatgctatatgagaaattcagcccagctggcccaattctttctattcgcatctgtagggaccttattacaagcggctcatcgaattatgcgtatgttaacttccagcacactaaggatgccgaacatgccttggatactatgaattttgacgtcataaaggggaaacccgttaggattatgtggagccagcgggacccaagtcttcggaaaagcggcgtgggcaatatcttcgtgaagaacctcgataagtctatcaacaacaaggcgctctacgacacagtgagtgccttcggaaacatcctgtcatgtaacgtcgtctgcgatgagaacggttccaaagggtacggattcgtacactttgagacacatgaagcagccgaacgagcaatcaaaaagatgaatggtatgttattaaatggtagaaaagtgtttgtgggtcagtttaaatctaggaaagaaagagaggctgaattgggagccagagccaaggagttccccaacgtgtatataaagaatttcggagaggacatggacgatgaaagacttaaggacctgttcgggaaatttggcccggccctttctgttaaagtgatgactgatgaatctgggaagagcaagggcttcggctttgtatctttcgagagacacgaagatgcccagaaggccgtcgacgagatgaatgggaaggagctgaatggaaagcagatatacgtgggccgggctcagaaaaaggtcgaaagacaaaccgaattgaagagaacctttgagcagatgaagcaggacaggatcacaaggtaccaggttgtgaatctctacgtgaagaatctcgacgatggaatcgacgatgagcgacttcgcaaagccttttcaccttttgggacaattacttccgcaaaggttatgatggaggggggcaggtctaaagggttcggctttgtatgcttctcatctcctgaggaggccacaaaggcagtgacagaaatgaatgggcgtatcgttgctaccaagcctctgtatgtggcgcttgctcagcgaaaggaagaaagacaagcttacttgaccaacgagtacatgcagcggatggcgagtgtgcgggccgtgcctaatcagcgcgcccccccatctggttactttatgactgccgtgccacaaacacaaaaccatgctgcttattaccccccatcacagattgctaggcttaggcccagcccacggtggacagctcagggcgcaaggcctcatccatttcagaacaaaccaagcgctattcgccccggggcgcctcgagtcccattttcaaccatgcggcccgcctcctcacaggtgcctagagtaatgtccacccagcgggtggccaacacgtctacccagacagtcgggccccgcccagcagcagccgctgccgccgccgccacgccagcagtacgcactgtccctcgctataagtatgccgcgggcgtgaggaacccccagcagcaccgtaacgctcagccacaagtgacaatgcaacagctcgctgtgcacgtgcagggacaggaaacgctgactgcgtccaggttggcctcggcgccaccacagaagcaaaagcagatgctcggggagagactctttcccctgatccaggcaatgcatcccaccctggccgggaagatcaccggaatgctactcgagattgacaactcagaactcctgtacatgctggagtcacctgaatcactgcgatccaaggtcgacgaggcggtggctgtgctccaagctcaccaggcaaaagaggccactcagaaagccgtcaattcagccaccggggtgcctactgtgtag

SEQ ID NO: 199933 - DNA, 1896 bp, Artificial Sequence
  Description of Artificial Sequence: Synthetic coding sequence
atgaacgccgccgccagcagctaccccatggccagcctgtacgtgggcgacctacactctgatgtaaccgaggcaatgctatacgagaagttctccccagccggaccagtcctgagcattcgcgtctgtagagatatgatcactagaagatctttgggttatgcctacgtcaatttccagcagcctgcagatgcagaaagagcactggatacaatgaatttcgatgtcatcaagggcaagcctatccgcatcatgtggtcccagagggatccctcattgaggaaaagcggggttggaaacgtgttcattaaaaaccttgataaatctattgataataaagccctgtacgacaccttctccgcctttggcaatatcttgtcatgcaaagtagtgtgcgacgagaacgggtccaaaggctacgccttcgtccatttcgagacccaagaagctgccgacaaagctatcgaaaagatgaatggaatgctgctgaatgacaggaaggtgttcgtcggtcgattcaagtcaaggaaggagcgtgaagcagagctgggcgccaaagctaaggagttcacaaatgtttatatcaagaattttggcgaagaagtcgatgatgagtccttgaaggaactcttctcccagtttggcaagaccttgtctgtcaaggtgatgcgcgaccctaatggcaagtcaaaggggttcggattcgtctcgtatgaaaagcacgaagatgccaataaagctgtggaagaaatgaacgggaaagagattagtggaaaaattatctttgtcggtcgggcacagaaaaaggttgagcgccaagctgagctaaagagaaagtttgagcagctaaagcaggaacgcatctccagataccagggcgtgaatctgtatatcaagaatttggacgacacaatcgacgacgaaaagctgcgtaaagagtttagtcccttcggctctataacttccgcaaaggttatgctggaggatggcagatcaaagggcttcgggtttgtttgcttcagcagcccagaggaggcgacaaaagctgtcaccgaaatgaatggtcggatcgttgggtcaaagcccttgtacgttgctctggcacaacggaaggaggagcggaaggcccatctaacaaaccagtatatgcaaagagtagcaggcatgagggcactcccagccaatgcaatcctgaatcaattccaaccagcggctggggggtacttcgtgccagccgtccctcaagctcagggacgacctccctattacacgcccaaccaacttgcacagatgaggcccaatccgcgctggcagcaggggggacgccctcaggggttccaggggatgcccagcgccattagacaatctggaccccgccccacactccgtcacctggcaccaactggaaatgcacccgcgagccgcggactgccaacaaccactcaaagagttggagtacccaccgccgtgcaaaatcttgctccacgtgccgctgtagccgcggcggctcccagagccgtagccccatacaagtacgcatcttctgtcaggtcccctcatccagcaattcagccacttcaggctcctcagccggctgttcacgtccagggccaggaacccctcaccgcaagtatgctggcggcggccccccctcaagagcagaaacagatgttgggcgaacgcctgtttcctctcatccagaccatgcatagcaatctggccggcaaaattactggcatgcttctcgagatcgacaatagcgaactgctgcatatgctcgaatcccccgagtccctgcgatcaaaagtagacgaagcggtggctgttctgcaggcccaccatgccaagaaagaagcagcacagaaggtcggggccgtggctgccgccacgtcatag

SEQ ID NO: 199934 - DNA, 1935 bp, Artificial Sequence
  Description of Artificial Sequence: Synthetic coding sequence
atgaacgccgccgccagcagctaccccatggccagcctgtacgtgggtgatctccattcagacgtaacagaggctatgctatatgagaaattctcccccgctggtcctgtgcttagtattagggtgtgtcgggacatgatcaccagacggtccctgggttacgcatatgttaatttccagcaacccgccgacgccgagcgcgccctggatactatgaactttgatgtcatcaaaggaaagcccattagaatcatgtggtctcagcgggatccatctctgcgaaagtctggggtgggaaacgtgttcattaaaaatctggacaagagcatcgacaataaggcactctacgacacattttccgccttcggtaacatcctgagctgtaaagttgtgtgcgacgaaaacggatctaagggatatgccttcgtgcactttgagacacaggaggctgctgataaggcaatcgagaaaatgaatggaatgctgctgaatgatcgtaaagtgtttgtgggaaggtttaagtcccgtaaggagcgagaggctgagctcggcgccaaggcgaaagagtttaccaatgtgtacattaagaactttggagaggaagtggacgacgaaagtctcaaagagctgttttctcaatttggtaagacactgagtgttaaggtgatgagggaccctaatggaaagtccaaaggattcggcttcgtctcatacgagaaacacgaagacgccaacaaggcagtcgaggagatgaatggaaaagagatttccggaaagattatttttgtggggcgcgcccagaagaaagtagaaagacaggccgaacttaagagaaagtttgaacagttgaagcaggagaggattagcaggtaccagggagtcaacttgtacattaagaacctagacgacaccatagacgatgagaagttgcgaaaggagtttagccccttcggctctattactagtgctaaagtgatgctcgaggacgggaggtcaaaagggttcggatttgtgtgcttttcctccccagaggaggcaaccaaggcagtaactgagatgaacgggagaattgtcggttcgaagccactgtacgttgccttggctcagcgcaaggaagagaggaaagcccacctgaccaaccagtatatgcagcgggtggctggcatgagggctcttcccgctaacgccattttaaaccagtttcaacctgctgcaggggggtatttcgtacctgctgtgccgcaggctcaggggaggccaccttattacactccaaaccagctggcccagatgagaccgaatccccgttggcagcaagggggacgaccacagggttttcagggtatgcccagtgccatccggcagtccggcccgaggcctacactgcgtcatctcgctccaactggcagcgagtgtcctgatcggctggctatggatttcggaggggctggtgcggcccagcagggactgaccgatagctgtcaaagtggtggcgtgccaaccgcggttcagaacctggcaccccgagcagctgtggccgccgctgcacctcgcgcagtggctccgtacaaatatgcctcctccgtgcgtagcccacaccctgccattcagcctcttcaggccccccagccggccgttcacgtacagggccaagaacccttgacagcgagcatgctcgcagctgctcctcctcaggaacaaaaacagatgttgggggaaaggttatttcctctcatccagacaatgcactccaacctcgcaggtaagatcaccggcatgctgctggaaatcgataactctgaattgctgcacatgctggaaagcccagagagcctgcggtcaaaggttgatgaagctgtggcagtgttacaagctcaccacgccaaaaaagaggcagctcaaaaggtgggcgctgtggcggctgcaacctcctag

SEQ ID NO: 199935 - DNA, 1983 bp, Artificial Sequence
  Description of Artificial Sequence: Synthetic coding sequence
atgaacgccgccgccagcagctaccccatggccagcctgtacgtgggtgatctgcacagcgatgttacagaggcgatgctgtatgaaaagttctctcctgctggccccgtgctaagcattagggtgtgccgcgatatgatcacgagacggtcactggggtatgcatatgtgaacttccagcagcccgcagacgccgagagggcccttgacactatgaacttcgatgtcatcaaaggcaaacccattagaattatgtggtctcagcgcgatccttctctaagaaagtcaggggtaggtaacgtgtttattaaaaacttagacaaatctatcgacaataaggccttatatgatacgttctcagcattcggaaatattttgagctgcaaggtagtgtgtgacgaaaatggaagtaaggggtatgcctttgtccattttgagacgcaggaagctgccgataaggccattgagaagatgaatgggatgctcttaaatgatcgcaaggtgttcgtgggtcggttcaagtcacgcaaagagcgggaggcagagctgggagccaaagcaaaggagtttaccaatgtttacattaagaacttcggtgaagaggtcgacgacgagtctcttaaggaattgttttcccagttcggcaagaccttgtcggtcaaagtcatgcgcgacccaaacggcaaaagcaagggcttcgggttcgtttcctacgagaaacacgaagacgccaataaagctgtcgaagagatgaatggaaaggaaatcagcggcaaaattatcttcgtgggccgagcccagaaaaaagtggagaggcaggctgaactcaaaagaaagttcgagcagctgaaacaagaacgcatttctagatatcagggcgtgaacctgtacataaagaaccttgacgacaccatcgatgatgaaaaactgagaaaggaattctcccctttcggctccatcaccagtgcgaaagtcatgctcgaagatggccgttcaaaaggttttggatttgtttgtttcagtagccccgaggaggccactaaagccgttacggagatgaacggaaggatcgtggggagcaagccactttatgtagccttggcccagagaaaagaggagcggaaggcacatctcacgaatcaatatatgcagcgagttgcggggatgcgcgctttgccggcgaacgccattctcaatcagttccagcctgcggctggcgggtactttgtaccagctgttccacaagcgcagggccgacccccttattataccccaaatcagctggcccaaatgagacccaatccaaggtggcaacagggtggccggccacagggctttcaaggcatgccatcggcaatccgtcagtccggcccgcgccctactctgcgccatcttgccccaacagggaacgcccccgcctcccgaggcctcccgacgaccacacagcgggttggttctgaatgtcccgaccgactagccatggattttggaggggccggggctgcccagcagggccttacagacagctgccagagcggtggtgttcccacagccgtccaaaacttagcgccccgcgcagccgttgctgctgctgccccccgcgctgtggctccatacaagtatgcatcttcagtgcgaagcccgcatcccgccattcagccccttcaggcaccccagccagccgttcatgtgcagggtcaggagcctctcaccgctagtatgttggcggccgctccccctcaggaacagaaacagatgttgggcgaaagactcttcccattgatccagaccatgcattctaacctcgctgggaaaattactgggatgctcctagagatagataactctgaacttctgcatatgctcgaatccccagagagtctgagatctaaagtggacgaggcagtcgccgtccttcaagcccatcacgcgaaaaaagaagcagcacaaaaagtgggagcagtcgctgccgctactagctag

SEQ ID NO: 199936 - DNA, 390 bp, Artificial Sequence
  Description of Artificial Sequence: Synthetic coding sequence
atgaacgccgccgccagcagctaccccatggccagcctgtacgtgggcgacctccactctgatgtgacagaggcaatgctgtatgaaaaattttctcctgcaggcccagtgctgagcatcagggtatgccgggatatgataacgaggaggtctctagggtatgcctatgtgaacttccaacagcccgctgacgccgagagggccttagatactatgaatttcgatgtcataaagggaaaacccatcagaatcatgtggtctcagagagatcccagcctgcgcaagtcgggcgtcgggaatgtcttcataaaaaaccttgataaatctatcgacaacaaggcactgtacgacaccttcagtgcctttggtaatattctgagctgtaaatag

SEQ ID NO: 199937 - DNA, 207 bp, Artificial Sequence
  Description of Artificial Sequence: Synthetic coding sequence
tgactgatccagaccatgcacagcaacctggccggcaagatcaccggtatgctacttgagattgacaactcagaacttctgcacatgctggagtctcccgaatcgcttcgttcaaaggtcgatgaggcggtggctgtgcttcaggcacatcatgctaagaaggaagctgcacagaaggtgggagccgttgcagctgctacaagttag

SEQ ID NO: 199938 - DNA, 120 bp, Artificial Sequence
  Description of Artificial Sequence: Synthetic coding sequence
atgaacgccgccgccagcagctaccccatggccagcctgtacgtgggggacctgcattcggacgtaacggaggcaatgttatatgaaaagttcagcccagcgggacccgtgttatcatag

SEQ ID NO: 199939 - DNA, 1149 bp, Artificial Sequence
  Description of Artificial Sequence: Synthetic coding sequence
atgggcagcggcgagcccaaccccgccggcaagaagaagaagtacctgaaagccgcgctctatgtgggtgaccttgaccctgacgtcacagaagacatgctatacaaaaagtttcggccagccggtcctcttcgatttacaagaatctgccgcgacccagttactagaagccctctgggatatgggtacgttaacttcaggttccccgcggatgccgaatgggccctcaataccatgaacttcgacctgatcaatggaaagcccttcaggcttatgtggtcccagccggacgatcgcctgcgcaagtcaggagtgggaaatatattcataaagaatcttgataaatctattgataatcgagcactcttttacttgttcagcgcctttggtaatatactgtcatgtaaggtggtttgtgacgacaacggcagtaagggctacgcctatgtacacttcgattcactggctgccgctaatcgggccatatggcacatgaacggggtaagactgaataaccgccaggtgtacgtaggtaggttcaagttcccggaagaaagggccgctgaggttcggaccagggatcgcgcaacatttacgaatgtgtttgtaaagaatatcggtgacgatatagatgacgagaaactaaaagaacttttctgtgagtacggacctacggaatctgttaaggtgatcagagacgcctctggaaagagtaagggtttcggtttcgtgaggtatgaaacccacgaggcggcccaaaaggccgtcctcgatctgcatgggaaatccatagatggaaaggtgctctacgtgggcagagcacagaagaagatagagaggcttgccgagctgaggcgccggtttgaaagactcagactgaaagaaaaatcccggcccccaggggtgcctatttacattaaaaatctggacgagacgatcaatgatgagaagttgaaagaagaatttagctctttcgggtccattagtcgcgctaaggttatgatggaggtgggccagggaaagggatttggtgtcgtgtgcttctcctcctttgaggaggctacaaaagcagttgatgagatgaatggccgcatagttgggagcaaaccacttcacgtgaccttggggcaggcccggcgacgatgttag

SEQ ID NO: 199940 - DNA, 657 bp, Artificial Sequence
  Description of Artificial Sequence: Synthetic coding sequence
atgaacggcgtgcggctgaacaaccggcaggtgtacgtgggccggttcaaattcccagaagagagggctgccgaggtccggacccgggatagggctaccttcactaacgtatttgtaaaaaacatcggagacgatattgatgacgaaaagctgaaggagctgttttgcgagtacgggcccaccgagagcgttaaggtcatacgagacgccagcggaaagtcaaaaggcttcggatttgtcaggtatgagacccatgaagcagctcagaaggctgtcctggacctccacggtaagagtattgacggaaaagtgctctatgtggggcgcgcacagaaaaaaatagaacgcctggccgagctgaggagaaggttcgagaggctccggctgaaagaaaagagccggccccctggagttcctatctacattaagaacttagatgagactatcaacgacgaaaaacttaaggaggaatttagtagcttcggaagtatctcacgggctaaagtcatgatggaagttggacaaggcaaagggtttggggtggtgtgcttttcaagctttgaggaagctaccaaggccgtcgacgagatgaacggacgtattgtcggctcgaagcccctccacgtcacactaggtcaggcccgcagacgctgctag

SEQ ID NO: 199941 - DNA, 1053 bp, Artificial Sequence
  Description of Artificial Sequence: Synthetic coding sequence
atgctgtacaagaagttccggcccgccggccccctgcggttcaccagaatctgtagggaccctgtgacacggtctcctttgggatacggctacgtgaattttagattccctgcagacgcagagtgggctctcaatactatgaattttgacttgataaacggcaagccttttcgactgatgtggagccagccagacgataggctgcgcaaatctggcgtgggtaacatcttcataaaaaatctggacaagagtatcgataatcgcgcgctgttctacctcttcagtgcttttgggaatatcctgtcttgcaaggttgtctgcgacgacaacggctcaaaaggctatgcctatgtacatttcgacagtctggccgcagcaaatcgggccatatggcacatgaatggcgtgaggttgaacaatcgccaggtttacgtcggtcgctttaagtttccagaggagcgagccgcagaagtgagaaccagagatagggctaccttcactaatgtcttcgtgaaaaatattggagatgacatcgacgacgaaaaactcaaggaactgttttgcgagtacggccctaccgagtctgttaaggttatacgagatgctagtggcaagagcaaaggcttcggttttgttcgatacgaaacacacgaagccgcccagaaagctgtgctggacttgcacggcaagagcattgatgggaaagtcctgtatgtgggcagagcccagaaaaagattgaacgcctcgccgaacttagacgcagattcgaaaggctgagattgaaagaaaagtctcgccccccaggcgtgcctatatacatcaagaatcttgacgaaaccatcaacgatgaaaaactaaaggaggagttcagttctttcgggagcatctcgcgggctaaagttatgatggaagtcggccaaggtaagggcttcggagtggtttgcttcagcagctttgaggaggcaaccaaggccgtcgacgaaatgaatgggcgcatcgtaggctccaagccccttcacgtaaccctgggacaagcaaggcgacgttgttag

SEQ ID NO: 199942 - DNA, 957 bp, Artificial Sequence
  Description of Artificial Sequence: Synthetic coding sequence
atgcccaagcggggcaagaagggcgccgtggccgaggacggcgacgagctacggactgagccagaagccaaaaagagcaaaacagctgccaagaaaaatgacaaagaagctgcaggcgagggccccgcactttatgaagatccccctgatcagaagacctccccaagcgggaaacctgcgacgcttaagatctgtagctggaatgttgatggactgagagcatggataaagaaaaaaggtctcgattgggtgaaggaggaagcacccgacattctttgcctccaggagacgaagtgctcagagaacaaattacctgcagagctgcaggaattaccgggcctctcccatcaatattggtccgcaccctcagataaagaagggtacagtggggtcggtctattatcacgtcagtgtcctttgaaggttagttacggaatcggtgacgaggagcacgatcaggaggggcgagtcatagtggctgagttcgattcctttgtgttggtgaccgcctacgtacctaatgccggcagagggctggtgagacttgagtaccggcagaggtgggatgaagcgttccgaaagttcctaaaaggactggcgtcgcgaaaaccacttgtgctgtgtggagacctaaatgtggcccacgaggagatcgatctgcgaaatccgaagggcaacaaaaagaatgccggatttactcctcaggagcgccagggctttggggaactgctccaggccgttccactggctgacagttttcgtcacctgtaccctaataccccttatgcatatacgttttggacctacatgatgaacgcgagatcgaagaacgtcggctggagactcgattactttctgctttcccactcactgctgcccgccctctgcgacagcaaaattcgcagtaaagccctcggatccgaccattgtcctatcacgctctacctggccctgtag

SEQ ID NO: 199943 - DNA, 891 bp, Artificial Sequence
  Description of Artificial Sequence: Synthetic coding sequence
atggccgccgccgccgccgccgccgccgccgccggcgccgccggcggccggggcagcggccctggaagacgccgccacttggtccccggggctggaggggaagcaggagaaggcgctccaggcggtgctggtgactatggcaatggtctcgaaagcgaagagctggaacccgaggaactactgttagagccagagccagagccagagccggaggaggagcctccacggccaagggccccccccggagcaccgggaccaggccctggatctggggccccgggatctcaggaagaagaagaggaacccggtctcgtggaaggagaccctggtgatggagccatagaagaccccgagctcgaggccatcaaagcgagagtgcgggaaatggaagaggaagcggagaaactaaaggagctgcaaaacgaggtagagaagcaaatgaacatgtctcctcctcctggtaatgccggccccgtcatcatgtctattgaagaaaagatggaggccgacgcaaggtcaatctacgtgggcaacgtggattacggagcaacagcagaagaactggaggctcactttcacggctgtggcagcgtgaaccgagttactatcctgtgtgataagttttctggacaccccaagggcttcgcctatatcgagttcagtgataaggaaagcgttagaacctcactcgcactagacgaatctttatttaggggaaggcagatcaaagtaatccctaaaaggaccaatagacccggaatcagcaccactgacagagggtttcctcgggctaggtatcgagctcgtacgactaattacaacagctcccgctcacgattttactcaggatttaattcgcgccctcgaggacgtgtttaccgatcaggatag

SEQ ID NO: 199944 - DNA, 1557 bp, Artificial Sequence
  Description of Artificial Sequence: Synthetic coding sequence
atgagctgcgtgaagctgtggcccagcggcgcccccgcccccctggtgagcattgaggaattggagaaccaggaactcgtaggcaagggtggcttcggcacggtcttccgggcacagcatcggaagtgggggtatgatgtcgccgtgaagattgtgaattccaaggcaatctctagggaggtcaaagcaatggcttcacttgacaatgagttcgttcttaggctggagggggtgatcgagaaggtcaactgggaccaggaccccaagccggcacttgtaacgaagttcatggagaatggaagcctctctggacttctccagtcacagtgccccaggccttggccgctgctttgccgtttgctcaaagaagtggtccttggtatgttctatctccacgatcaaaacccagtgttgctccaccgagatctgaagccttccaatgtgctgttagatcccgagctgcatgttaaacttgccgactttggtctgtccacatttcaaggaggctcacagtctggcacaggatcaggtgaacccggaggaaccctaggctatcttgctcccgagctgttcgtgaatgtgaatcgcaaagcaagcactgctagtgatgtttacagctttggaattctcatgtgggctgtacttgctgggcgcgaggtggagctccccactgaaccgtcacttgtgtacgaagccgtctgcaaccgtcaaaacaggcccagtctagccgagctgccgcaagcaggcccagaaactcctggactggaaggtctgaaggagctgatgcaactatgttggagcagcgaacccaaggaccgtcccagttttcaagagtgcctcccgaagacagatgaagtgtttcaaatggtagaaaacaacatgaacgccgccgtaagcactgtgaaggacttccttagtcaactgcggagctctaaccgccggttttcaattcctgagtcggggcagggtggcaccgagatggacggattccgccgaactatcgaaaaccagcattcgcgtaacgatgtaatggtatctgagtggctcaacaaactgaatctggaggagccccctagtagcgtccctaaaaaatgccccagcctgactaaacgaagccgcgctcaggaagaacaggtaccacaagcttggactgctgggacctccagtgactctatggcacaaccacctcagacacccgagacctccactttccgcaatcagatgccctcccccacatcaacaggaaccccctcacctgggccccgcgggaaccagggggcagagaggcagggaatgaactggtcttgcaggactcctgaacctaatccggtcacgggccgccctctagtgaacatatataactgctcgggcgtccaggtgggcgacaacaactatctgacaatgcaacagacgaccgctctgccaacatggggactggcaccgtcggggaaaggccgggggctccagcatcctccccccgtgggatctcaagaggggcctaaggatcccgaagcgtggtcccggccgcaaggttggtataaccacagcggaaaatag

SEQ ID NO: 199945 - DNA, 2223 bp, Artificial Sequence
  Description of Artificial Sequence: Synthetic coding sequence
atgctgggccggcggggcagcgactgggccgtgcccgcccccgagacaatgccgtttcctgtcactacgcaagggtcacagcaaacgcaacccccccaaaaacattatggaattacttctccgataagcttggcggcaccaaaagagaccgactgtgttttgacgcagaagctgattgagaccctgaagccattcggcgtgttcgaagaagaggaggagctgcaacgtcgcattttaatcctggggaagctgaataacctagttaaagagtggatccgggagatttcagaatccaaaaacctgcctcagtctgtcatcgagaacgtggggggcaagatcttcacctttggtagctatcggcttggcgttcacactaaaggagctgacattgatgccctgtgtgttgcacccaggcacgtcgacagaagcgatttctttaccagcttttatgacaaactgaaactccaggaggaggttaaagaccttcgggccgttgaggaggccttcgtgccagttattaagctgtgctttgacgggattgagattgatatcctctttgctcggctcgccctgcaaaccattcctgaggacctcgatctgcgggacgattcactgctcaaaaacctagacattcgctgcatccggtctctcaacgggtgccgagtgacagacgaaattctgcacttggtccccaatattgataatttccggctgacccttagagctatcaagctgtgggcaaagagacataatatatatagcaacatcctggggtttcttggaggtgtgtcgtgggctatgctggtggccagaacttgtcagctgtacccgaacgccatagcatccacactggtccacaaattctttctggtcttttccaagtgggagtggcccaatccagtattactgaaacagcctgaagagtgtaacctcaacctgccggtgtgggatccccgggtgaacccttccgatcgttatcacctaatgccgattattacccccgcttatccacagcagaatagcacctacaacgtctcagtttccactcggatggtaatggtcgaagagttcaaacagggtctggcgatcacagacgagattctgctgagcaaggctgagtggtccaagctgtttgaggcccctaattttttccagaagtacaagcactacatcgtgcttctggcaagtgccccgacagagaagcagagactcgaatgggtcggcttggttgaatctaagattagaattctggtcggatctctcgagaagaatgagttcatcactctggctcacgtgaacccacagagctttcccgcacctaaagaaaatccagacaaggaggagtttcggaccatgtgggtcattggtctggtctttaagaagacggaaaacagtgaaaacctgagcgtcgatcttacctacgacatccagagcttcacggatacagtctaccgtcaggcaataaatagcaaaatgttcgaagtggatatgaagatcgctgctatgcacgtgaaacgcaaacaattgcaccagttactgcccaatcatgttctgcagaagaaaaagaagcactctaccgaaggagtgaagctgactgcactgaacgattcctccttagatctctccatggattcagataacagtatgagcgtgccatctccaacatctgccacaaaaacctctccattgaactccagtggctccagccaggggagaaactcacctgcccccgctgttacagctgcaagcgtgacaaatattcaggctactgaggtcagtgttccccaggtgaactccagcgaatcaagtggtggaacctcatctgaatccatcccacagaccgccacccagcccgcgattagcccacccccaaaaccgaccgtcagccgtgtggtcagcagtaccagattagtcaatccccccccacgatcttcgggcaacgccgcgacgtccggcaatgctgctacaaaaatcccaacacctatagttggagtcaaacggacctcctctccccataaggaagagagccctaagaaaaccaagacggaggaggaacagctcgatactgaaacgtctaccacgcaatcagaaacgattcagactgcggcttctctcctggcctcacaaaaaaccagctctactgatctgtctgatatacccgccctccccgcaaacccaattcccgtaattaagaattcaattaaactgcgtctgaatagatag

SEQ ID NO: 199946 - DNA, 858 bp, Artificial Sequence
  Description of Artificial Sequence: Synthetic coding sequence
atgcccttccccgtgaccacccagggcagccagcagacccagccccctcagaagcattacgggatcacaagtcctatctccctggcggcgccaaaggaaaccgactgcgtactgactcagaagttgatcgagactcttaagccctttggagtctttgaagaggaagaagaactccagaggcgtattttgatccttggtaaactcaataatcttgttaaggaatggattagagaaatatctgaaagtaaaaacctcccccagtccgtcattgagaacgtggggggaaaaatttttaccttcggctcctatcgcttaggggtccatactaagggagcagatattgacgcgctatgcgtggcaccgcgccacgtcgaccgctccgacttctttacttccttttacgataagttaaaactgcaagaggaagtgaaggatctgagggccgttgaggaagccttcgtgcctgtaatcaagttgtgtttcgatggcattgagatcgatattcttttcgctcgacttgccttacagacaatcccagaggatctggaccttagggatgactcactgttaaaaaacttagacatccgatgtatccgatcactgaacggctgcagggttacagatgagatcctgcatttggtgcccaatatcgacaacttccgcctgaccctccgggctatcaagctgtgggctaaaaggcacaacatctatagcaatatcttgggctttctcggcggcgtgtcatgggccatgcttgttgccagaacctgtcagctatacccaaacgcaatcgccagcacccttgttcataagttttttcttgtattttccaaatggtatgtcttcagactgtattag

SEQ ID NO: 199947 - DNA, 1911 bp, Artificial Sequence
  Description of Artificial Sequence: Synthetic coding sequence
atgcccttccccgtgaccacccagggccccccccagcccgccccccctccaaatagatatggcgtctcctctcccattagtctcgccgttcctaaggaaaccgactgtctcctgactcagcgtctgatcgagaccttaagacccttcggagtatttgaagaggaggaagagctgcagcggagaatcctggtgcttgagaagcttaacaatctggtgaaggaatggatccgtgagatctcagaatcaaagtctctgccacagtctgtgatagaaaacgttggtgggaagatctttacttttgggtcttatcggctgggtgtgcacaccaagggtgctgatatcgacgccctttgtgttgcgccaagtcacgttgaccgatccgatttctttactagcttttatgcaaaactcaagttgcaggaagaggtcaaggaccttagagctgtggaggaggccttcgtgcctgtgatcaagctgtgttttgatggcattgagatcgacatcctattcgccaggctggccttgcagaccatccccgaagacctcgacctccgagatgattccctgttgaagaatctagatatcagatgtatccgatcactgaatggttgccgcgttacagacgagattctgcacctcgtgcccaatatcgacaatttccggctgaccttacgagcaatcaagctctgggcaaaatgtcacaacatatattccaatatcctcgggtttctggggggggtaagctgggcaatgctggtagcccggacatgccagctctatcccaacgccgtggctagtactctagtcaggaaatttttcctggtgttctcagagtgggagtggccaaatccggtgctgctcaaggagccagaagagagaaatctgaacctacccgtgtgggacccaagagtgaatccgtcggaccgttatcacctcatgcccatcattactcccgcttatccacagcagaactccacttataatgtgtcgatctctacacggatggtgatgattgaggaattcaaacaaggtcttgctattacacatgagatcctcttgtcgaaagccgagtggtcaaagctgttcgaggctcctagctttttccagaagtataagcactacattgtactgttggcaagtgcctctacagagaaacagcatctagagtgggtaggacttgtggagtctaagatacggatcctagtgggctccttggaaaaaaacgaatttataacgctcgcgcacgtaaatcctcagtctttccctgctccaaaggagaatcccgacatggaggaattcaggacaatgtgggtgattgggttgggacttaaaaagccggacaatagcgagatcctctccattgatctcacatatgatatccagtcttttaccgatactgtatacagacaggccgtgaacagtaaaatgtttgagatgggaatgaaaatcacagctatgcatctgcgcaggaaagaactgcatcagctgcttccacaccacgtgttgcaggataagaaggctcactctacagaaggccgccgcttgaccgacctcaatgactctagttttgacctctctgcaggatgtgaaaactccatgagtgtgccatcatccactagcacaatgaaaactggccccctgatttcgtctagccaaggtcggaacagtccggctctagcagtaatgaccgcttcggttgccaatatccaagcgactgaattttctttgcagcaggtgaacactaacgagtcatctggagtggctctaaacgagtcaatcccgcacgcagtgagccagccagccatcagccccagcccaaaggccatggtagcacgtgtggtgagcagcacctgcttgatcagtcaccccgatttgcaggagacccagcagcagacttatctgatcctttag

SEQ ID NO: 199948 - DNA, 1737 bp, Artificial Sequence
  Description of Artificial Sequence: Synthetic coding sequence
atggacttcctgctgttccagttcggcctgtgcaccttcaagtacgattacacggatagtaagtacatcactaagagcttcaatttttatgtgtttcctaagcctttcaatcgctcgtccccagacgtgaaatttgtgtgtcagagtagctctattgacttcctggcctcacagggttttgacttcaacaaggtgtttcgtaacggtatcccctacctgaatcaggaggaagagagacaactccgggaacagtacgacgaaaaacgcagccaggccaacggagccggcgctctgagttatgtttcacctaatacaagtaagtgccccgtgacaatccctgaagaccagaaaaagttcattgatcaagttgtcgagaaaattgaagacttactgcaaagcgaagaaaacaaaaatctggatctggagccttgtacaggattccaaaggaagttaatttatcagactctgagctggaaataccccaagggaatccatgtcgaaacactggaaactgagaaaaaggaaagatacattgtcataagcaaagtggatgaagaagagcgtaagaggcgagagcagcaaaaacacgcaaaggagcaggaagagctcaacgacgccgtaggctttagtcgcgtgatacacgcaatcgctaactccggtaaacttgtgataggacataacatgttactggatgttatgcacacggtccaccagttctactgcccactgcccgcagacctgtcagaattcaaggaaatgactacgtgcgtcttccctaggctgctggacaccaaactaatggcttctacccaaccattcaaggacattatcaataatacaagcttggctgaactggaaaagaggctcaaggagacccctttcaatccacccaaggtcgagagcgcggagggatttccttcttatgatacagccagcgagcagctgcatgaggctggctatgatgcatacattaccggactgtgcttcatttcaatggctaactacttgggatctttcctctcaccaccgaaaatccacgtgtccgcgcgaagcaagctgattgaacctttcttcaacaaacttttcctgatgcgggtcatggatattccttacctgaacctggagggtccagatttacaaccaaaacgggaccacgtccttcatgtgactttccctaaagagtggaaaacctctgacctctaccagctgtttagcgcgtttggcaatatacagatatcgtggatcgacgacacctccgcattcgtatccctctctcagccagagcaggttaagatagctgtcaacacatccaagtatgctgagagttaccgcatccagacatatgccgaatacatgggacgcaagcaggaggagaagcagatcaaacggaagtggaccgaggactcatggaaggaggccgacagcaagaggctgaacccccagtgtatcccatatacgttgcagaaccactattatcggaacaattcatttacagcaccatcaaccgttgggaagcgcaacctgagtccaagtcaggaagaagcagggctggaggacggcgtgtctggcgagatcagcgacacggagctggagcagaccgattcctgtgctgaacctctgtctgaaggccgaaagaaagctaagaagctgaagcgcatgaagaaggagttatctcctgcaggcagcatctcaaaaaatagtccagccactctatttgaggtacctgatacttggtag

SEQ ID NO: 199949 - DNA, 1782 bp, Artificial Sequence
  Description of Artificial Sequence: Synthetic coding sequence
atggagatcatccggagcaacttcaagagcaacctgcacaaggtgtaccaagcaattgaagaagctgacttctttgctattgacggtgagtttagcggcattagcgacggaccttctgtctcggccctgactaatggatttgatacaccagaggaaagatcatccccagatgtgaaattcgtgtgtcaaagctcatccatcgactttttggccagccagggctttgatttcaacaaagtgtttagaaatggcattccctacctgaatcaggaagaggaacggcaactgcgcgagcaatacgacgagaagaggtcccaggcaaacggggcgggggcactgagctatgtctcccctaataccagcaaatgccccgtcacaatcccggaggatcagaagaaatttatcgaccaggtagtcgaaaaaatcgaagatctgcttcaaagcgaggagaacaaaaacttagatctggaaccctgtacaggtttccaaaggaaattaatatatcagacgttgtcctggaagtaccctaagggcatacatgtggaaaccctggagacggagaaaaaggagcggtatattgtgatctccaaggtggacgaagaggaacgaaagaggagagaacaacagaaacatgcgaaagaacaagaggagctaaatgacgccgtgggcttctctagagttattcacgcgatcgcgaactcagggaaattggtcattggtcacaacatgctcctggatgtcatgcacaccgtgcatcagttctactgcccactgcccgcagacctgtcagagtttaaggagatgactacctgcgtgtttcctcgcctattggatactaagctcatggcatcaacccagccatttaaagacataatcaacaacacatctctggctgagttagagaaacgcctgaaagagacgcctttcaatccccctaaagttgaatccgcggagggctttccatcttacgatactgccagtgagcaacttcacgaggcgggttatgatgcttacatcacgggcttgtgtttcatcagcatggccaattatctgggcagtttcctgagcccgcctaagattcatgtgtcggcccggtctaagcttatcgagccgttcttcaataagctgttcttgatgcgagtcatggacattccatacttaaacctggaagggcccgacctacagcccaagagggatcatgtgctgcatgttaccttcccgaaggaatggaagacctccgatctgtatcagcttttttccgcattcggcaacatccagatctcatggattgatgacacgagcgcctttgtctcacttagccagcccgaacaggtaaagattgccgttaacacttcgaaatacgccgagtcttacagaatccagacctacgctgaatacatgggacgtaaacaagaggaaaagcaaatcaagcgaaagtggaccgaagattcctggaaggaagctgatagcaagaggcttaacccacagtgtataccctacacactgcaaaaccattactaccggaataactcttttactgctcccagcaccgtggggaagcggaatctctccccgtcgcaggaagaggctggcctcgaggacggggtgtccggagagatcagcgatacggagctggagcaaaccgactcatgcgccgaaccgctctctgagggtcggaagaaagctaagaaactaaaacgaatgaaaaaggagctgtcacctgccggcagcattagcaaaaattctcctgccacactgttcgaggtgcctgacacttggtag

SEQ ID NO: 199950 - DNA, 1920 bp, Artificial Sequence
  Description of Artificial Sequence: Synthetic coding sequence
atggagatcatccggagcaacttcaagagcaacctgcacaaggtgtaccaggcgattgaggaagccgactttttcgccatcgatggtgagttttctggtattagtgatgggccctctgtgtccgctctgaccaatggctttgatactcccgaggagcggtaccagaagctgaagaaacatagtatggactttctgctgtttcagttcgggctgtgtacctttaagtacgattatacggacagcaagtacataactaagtcatttaacttttatgtgttcccaaaacctttcaatcgcagctcccccgatgttaagttcgtgtgtcagtcatcctctatagacttcctggccagtcagggtttcgacttcaataaagtgtttcgaaacggtatcccctaccttaatcaagaagaggagcggcaactgcgtgagcagtatgacgaaaagcgaagtcaggcgaatggcgccggcgcactgtcttatgttagtcccaataccagcaagtgcccagtcactattcccgaggaccagaaaaaatttatagaccaggtggtagagaagattgaggatttactgcagagtgaggagaacaagaacctggaccttgagccatgtactggattccagaggaaacttatataccagaccctgagctggaaatatcccaagggtatccacgtggaaactctggagactgagaagaaggaacgctacatcgtcatcagcaaggttgacgaggaagagagaaaacggcgggagcaacagaagcatgctaaggaacaagaggagctgaacgacgcggtaggcttctccagggtgattcatgccatagccaatagcggcaaattggtaatcggacacaatatgctgttggacgtgatgcacaccgtacaccaattttactgccctctccctgccgacttgagtgagtttaaggaaatgactacctgtgtcttccctcgtctcctcgacaccaagcttatggcaagcacccagccttttaaagacatcataaataatacctctttagccgagctcgagaaacggctgaaggagactcctttcaacccccctaaagtggagagcgccgaaggatttccaagctatgacaccgccagtgagcagctgcacgaggcgggctacgacgcctacattactggactttgtttcatctccatggccaactacctggggtcgtttctatccccacccaagattcatgtttcagcacgttccaaactgatcgagccttttttcaacaaactgttcctgatgcgggtgatggatattccgtatctgaatctggagggaccagacctacagcccaaaagggaccatgtgctgcacgtgacctttcccaaggaatggaagaccagtgacctatatcagctgttctccgctttcggtaatatccagatcagctggattgacgatacctccgccttcgtctccctatctcagcccgagcaggtgaagattgctgtgaacacatcgaaatacgctgagtcttacagaatacaaacttacgctgaatatatggggagaaagcaggaggagaagcaaataaagcgcaaatggacagaggactcttggaaggaggcggattcgaagaggctcaatccgcagtgcatcccctacaccctgcagaaccattactaccgtaataacagctttacagctccctctacggttggtaagcggaatctgagtccgagccaggaggaggcggggctagaggacggcgtttccggcgaaatcagtgacactgaacttgagcagacggactcatgcgccgagcctctttccgagggacggaaaaaggccaagaaacttaaacggatgaagaaagagctcagtccggcgggatctatctccaagaatagtccagcgaccctgtttgaggtgccagatacatggtag

SEQ ID NO: 199951 - DNA, 624 bp, Artificial Sequence
  Description of Artificial Sequence: Synthetic coding sequence
atggagatcatccggagcaacttcaagagcaacctgcacaaggtgtaccaggcaattgaagaggcagacttttttgcaatagatggagagttcagtggaatttcggacggccccagcgtaagcgccctgactaacggattcgatactcccgaggaaaggtatcagaagctcaaaaagcactcaatggactttctgctgtttcagtttggcctgtgtaccttcaagtacgattacactgattccaaatcatcaccagacgtgaagttcgtttgccagtcctcctcaatcgactttctcgccagccaaggctttgacttcaataaggtgtttcgcaacggaattccatatttgaatcaggaagaggagcgccagctccgggagcagtatgatgagaaacgttctcaggcgaacggcgctggtgcactatcatacgtgagccccaatacttccaagtgtccagtcactattcccgaagaccagaaaaaattcattgaccaggtcgtggaaaaaattgaggatctgttgcagagcgaggagaacaagaacttggatctggagccctgcacaggtttccagaggaagttgatttatcagaccttaagctggaaacgatccgacatatag

SEQ ID NO: 199952 - DNA, 1395 bp, Artificial Sequence
  Description of Artificial Sequence: Synthetic coding sequence
atggagatcatccggagcaacttcaagagcaacctgcacaaggtgtaccaggccattgaggaggcagactttttcgccatcgacggggaattctctggaatcagcgacgggccatcagttagtgctctaacaaacgggtttgacacgcccgaggagcggtatcaaaaactgaagaagaaggagcgatacatcgtcatcagcaaagtggacgaagaggaacgaaagaggcgtgaacagcaaaaacacgctaaggaacaagaggaattgaacgacgccgtcgggttctcccgggtcatccacgcaattgctaacagcggtaagttggttattggacataacatgctgctagacgttatgcatactgtgcaccagttctattgtccattgcctgcagatctgtcagaattcaaggagatgactacatgtgtgttcccacggttgctcgacaccaagttgatggcaagcacacagcctttcaaagacatcatcaacaacacatccttggctgaactggagaagcgactgaaagagacacccttcaaccctcctaaggtggagtccgccgaaggcttcccatcttacgacacagcctctgagcagctccacgaggccggatacgatgcttacattaccggtctctgttttatatccatggccaactacctggggagcttcctgtcaccgcctaaaatacacgtgagtgcaagatccaagttgatagagcctttcttcaataagctgtttctgatgcgtgtcatggatataccttatctcaatcttgagggcccagatctgcagcctaaacgggatcatgttctgcacgttacattcccaaaggagtggaagacctctgatctgtaccagctcttctcagcctttggcaacatccaaatcagttggatcgatgacaccagcgcttttgtgtctctgagccagccggagcaggtcaaaattgctgtcaataccagcaaatatgctgaaagttaccgcatccaaacctatgccgagtacatggggcggaaacaggaggagaagcaaataaaaagaaagtggaccgaagactcctggaaagaagccgactctaagcgcctgaacccccagtgcatcccttacacactgcagaaccactattatagaaacaatagttttactgctccaagtacagtaggcaaaagaaatctatccccaagccaggaagaggccggcctagaggatggggtctccggcgaaatttctgacaccgaactggaacagacggattcctgtgccgagcccttatccgaaggacgcaagaaagctaagaaattaaagcggatgaaaaaagagctatctccagctggtagcatctccaagaatagtcccgcaactctgtttgaggtgcccgacacctggtag

SEQ ID NO: 199953 - DNA, 1071 bp, Artificial Sequence
  Description of Artificial Sequence: Synthetic coding sequence
atggacgccggcgtgaccgagagcggcctgaacgtgaccctgaccatccggctcctcatgcatggaaaagaggtagggagtattataggtaagaagggagagagtgtcaagcgcataagggaagagtccggcgcgcgcatcaacatttccgagggcaattgtcctgaacgaataataacgctcacgggccccactaatgccatcttcaaggcctttgccatgattatcgacaagcttgaggaggatattaactcttcaatgaccaattcaaccgcagccagtaggcctcctgtgacattgagactcgtcgtcccagccactcagtgcggcagtttaattgggaaggggggatgtaaaatcaaggaaattcgcgaatccacaggtgcccaggtccaggttgcaggagacatgttgccgaactctacagagagagccatcactatagctggagtcccccagtcagtaactgagtgcgttaagcagatatgcttggtgatgctagaaaccctgagtcagagccctcaggggagggtaatgaccatcccctatcaacccatgccagcgtcttcccccgtgatatgcgcaggcggacaggataggtgtagcgacgccgcgggatatccgcacgctacccatgacctcgaaggacccccccttgacgcctacagcatccaaggccaacacacaatttcacctttggacctagcaaagctcaatcaggtggccagacaacaatcgcatttcgcaatgatgcatggggggacaggcttcgcagggatagattcgagcagccccgaggtcaagggttactgggcctcactggacgcctcgacgcaaacaacacacgagctgaccatcccaaacaacttaataggttgtattatcggacggcagggggctaatatcaatgagatcaggcagatgagcggcgcgcaaataaagatagccaaccccgtcgagggtagcagtgggcgacaggtgacaattaccgggtctgccgccagcattagcttggcccagtatctgataaatgcacggctgtcctctgaaaagggcatgggatgcagttag

SEQ ID NO: 199954 - DNA, 957 bp, Artificial Sequence
  Description of Artificial Sequence: Synthetic coding sequence
atggacaccggcgtgatcgagggcggcctgaacgtgaccctgaccattcggttgctgatgcacggcaaggaggtgggctctataatcggaaaaaagggtgagtccgtcaaaaaaatgagagaagaatccggcgcccgcattaacatcagcgaaggcaactgccctgagcggatcatcacccttgctggaccgaccaatgccatctttaaggctttcgctatgattatcgacaaactggaggaggacatctcttcaagtatgaccaacagcactgccgcctcccgtccccctgtaaccttgcgcttggtggtccctgccagccagtgcggatccctgattggaaaaggtggctgcaaaatcaaggagatccgggagagcacaggcgcccaggtgcaggtcgcaggggacatgttgccaaactccacggaaagggccatcacaattgcaggaattccacaatccataatcgagtgcgtcaaacagatctgtgtggtgatgcttgagagcccccccaaaggagtgacgattccctacagacctaaaccttcttcaagcccagttatctttgccgggggccaggcatacacgatccagggccaatacgctatccctcagcccgatctaaccaagctccaccaattggccatgcaacagtcacactttccaatgactcacgggaacacaggcttctcggcaggcctcgacgctagcgcacaaaccacgagtcacgagctgactattcccaacgatctaatcggatgtattatcggccgccagggtgcgaaaattaacgaaattcgtcagatgtctggcgcccaaataaaaattgccaaccccgtcgaggggagcacagacagacaggtgacaatcacaggatcggcagccagcatttcactcgcccaatatctgattaacgtcagactgtccagcgaaacaggaggcatggggagcagttag

SEQ ID NO: 199955 - DNA, 1098 bp, Artificial Sequence
  Description of Artificial Sequence: Synthetic coding sequence
atggacaccggcgtgatcgagggcggcctgaacgtgaccctgaccattagactcctcatgcacgggaaagaagtgggcagcatcattgggaaaaagggggagagtgttaaaaagatgcgggaagaatccggcgctcgcattaacataagcgaaggaaactgcccagagaggatcatcacgctggctggtcctaccaacgcaatctttaaggcattcgctatgatcattgataagctggaggaggatatatccagcagcatgactaactccaccgctgcttctcgaccgcccgtgacattacggcttgttgtgcctgcgtcacagtgcggttccttgattggcaaaggcggctgtaagattaaggagatccgcgaatctaccggtgcgcaagtgcaggttgcaggcgacatgctgccaaattcaactgaacgggcaatcaccattgccgggattccacagtcaatcatcgaatgtgtaaagcaaatttgcgtggtgatgttggagactctctctcaatctccccctaagggcgtgaccattccatacaggccgaagccctcgtcatccccggtgatcttcgccggcggccaggacaggtacagtaccggctcagacagtgcgtctttcccccatactacaccttcaatgtgtcttaacccagatttggagggaccccctctcgaagcgtataccattcagggccagtacgccatcccacaacctgatctgacaaaacttcatcagctggccatgcagcagtcccactttccaatgacccacggtaacacggggttctctggaatcgagtcaagctctccggaggtcaaaggctactgggggttggacgcttctgcccagaccacttcacatgagctcaccatcccaaatgatctgatcggctgcatcatcggaaggcaaggcgccaaaattaacgaaatccggcagatgtcgggggcccaaatcaagatcgcaaatccggttgaggggagtacagacaggcaggtcaccatcacaggttcagctgccagtatttcgttagctcaatacctgattaacgtgcgcctgtctagtgagacaggtggcatggggagttcatag

SEQ ID NO: 199956 - DNA, 1008 bp, Artificial Sequence
  Description of Artificial Sequence: Synthetic coding sequence
atggacaccggcgtgatcgagggcggcctgaacgtgaccctgaccatacggctcctcatgcatggcaaagaggtaggttctattatcggcaagaagggtgagagcgtgaagaagatgcgcgaggagtcaggtgccaggattaacatcagcgaaggaaattgccccgagcgcataattacgcttgccgggccaactaacgctatttttaaagcttttgcgatgatcatcgacaaactcgaggaggacattagttctagtatgaccaactctactgcagctagtcgcccaccggttaccctaaggctggtcgtgccagcaagccagtgcggctcactaatcggaaagggcggctgtaaaatcaaagagattcgggagtcaacaggcgctcaggtgcaggttgcgggcgatatgcttccgaatagtaccgaaagggctattacgatcgcaggtattccgcaaagcattattgaatgtgtgaaacaaatctgtgtcgtcatgctcgagaccctatcccagtccccaccgaagggggtgaccatcccttaccgcccgaagccctctagttcaccggtgatcttcgccgggggccaagcttacactattcagggccagtacgcaatcccccagccagatctgacaaagctgcaccagctagcgatgcagcaatcccatttccccatgacccacggaaacaccgggttttctgggatagagtcctcttctcccgaggttaaagggtactgggccggccttgatgcaagcgctcaaaccaccagccacgaactgacgatcccaaacgacctcattgggtgcataatcggtcgccagggggcgaagattaatgagatccgccaaatgtcaggggcccagattaagattgcgaaccccgtggaagggagcaccgacagacaggtaactattaccggttcagccgcctcaatttccttagcgcaatacctgattaatgtgcggcttagcagcgagacaggaggaatggggtcctcgtag

SEQ ID NO: 199957 - DNA, 906 bp, Artificial Sequence
  Description of Artificial Sequence: Synthetic coding sequence
atggacaccggcgtgatcgagggcggcctgaacgtgaccctgaccatccgactgttgatgcacgggaaggaagtgggcagtattatagggaagaagggcgagagcgttaaaaaaatgagggaagagagcggggcaaggattaatatcagcgaaggcaactgcccagaaagaatcatcaccctggccggacccaccaatgctatcttcaaggctttcgcaatgatcattgataaacttgaagaggacatctcttcatcgatgaccaattcaaccgccgcctcaagaccccccgtgaccctgcgcctagtagtccccgcatcacagtgtggatccctcattggaaaaggtggctgcaaaataaaagagatccgcgaatctactggagctcaggtgcaagtggccggcgatatgctacccaactctactgagagagccattactatcgccggaatcccacagagcatcattgagtgcgtcaaacagatctgcgtggtgatgctagaaagcccccctaagggagtgacaattccctaccgcccgaagccttcctcctcacccgttattttcgccggtgggcaggaccggtactcaaccgggagcgatagcgccagtttcccgcataccactccatccatgtgtcttaaccccgaccttgaaggaccaccacttgaagcgtacaccattcaagggcagtacgccataccccagcctgatctgaccaagctccaccagttagcaatgcaacaatcacatttccccatgactcacggtaatactggcttcagcggtatggacaccagcgttttcatctccgtccggtgtagcgctcgcgagcgtcctgttcctcgctcacagctcgatatttgtctgaagcagacgagcctgtcctctatccttctcgtttag

SEQ ID NO: 199958 - DNA, 1089 bp, Artificial Sequence
  Description of Artificial Sequence: Synthetic coding sequence
atggacaccggcgtgatcgagggcggcctgaacgtgaccctgaccatacggctgctcatgcacggcaaagaggttggctccatcattggcaaaaaaggagagtccgtgaaaaagatgcgcgaagagagcggggcccgcatcaacatctctgagggcaactgcccggaacgcattattactctggctggaccaaccaacgctatctttaaagccttcgctatgataatcgataagctggaggaggacatctctagttccatgacgaactctaccgccgcttcccgaccacccgtgactctgaggctggtagtccccgcctctcaatgtggatctttgattgggaagggcggctgcaagataaaggagattcgagaatcaaccggcgcacaggttcaggtggcaggggatatgctcccaaatagcactgaacgcgccattactattgccggaattccccagagtatcattgaatgtgtgaaacagatatgtgtcgtgatgctggagtccccccctaagggggtgaccattccatacagaccaaagcccagttcctcacccgtgatcttcgctggaggccaggacaggtatagtactgggagcgacagtgcttccttcccccatacgacaccaagcatgtgcctgaatcctgatctggaaggtcctcctctggaggcatatacaattcaagggcaatacgcgatacctcagcctgacctaacaaagcttcaccagcttgccatgcagcagtctcactttcctatgacccatggcaacaccggattctccggaattgagtcctcatctccagaggttaaggggtattgggctggcctcgacgcgagtgctcagactactagccacgagctaaccattccgaatgatcttattgggtgtatcatcggccgccagggagcaaagatcaatgagattcggcagatgagtggagcacagataaagatcgccaaccccgtagaaggatctacggacaggcaggtcactatcaccgggtccgcagcatccatctccttggcccagtatctgatcaatgttcgcctgagcagcgaaacaggcggtatgggcagcagctag

SEQ ID NO: 199959 - DNA, 996 bp, Artificial Sequence
  Description of Artificial Sequence: Synthetic coding sequence
atggacaccggcgtgatcgagggcggcctgaacgtgaccctgaccataagattgctaatgcatggcaaggaggtaggctccataatcggaaagaaaggtgaaagtgtgaaaaaaatgagggaggaatccggcgctagaatcaacatctccgagggcaactgccctgaaaggattattaccttggccggcccaaccaatgcaatctttaaggccttcgcaatgatcatcgataaactggaggaggatattagctctagcatgacgaacagcactgccgcttctcgccctccggtgaccctcagacttgtagttccagcttcacagtgcggctctctgattggaaaggggggctgcaaaatcaaagaaatccgtgagagcactggtgctcaagtgcaggtggccggagatatgttgccgaacagcaccgagcgagccattactatagctggcattccacaatcgatcattgaatgcgtcaaacaaatttgcgtggtgatgctggagtccccccccaaaggtgtcacaataccctatcggcccaagccgtcaagtagcccagtcattttcgcgggcggccaggcttacactattcaaggccagtatgcaattcctcagcccgacctcaccaagctccaccagctggctatgcagcagtcgcatttccctatgacccacggaaatacgggctttagcgggatcgagtcttcctctcccgaagtaaaaggatactgggcgggcctggacgctagtgctcagactacatcccacgagctgacaattcccaatgacttgataggctgtataattgggaggcagggcgcaaaaataaacgaaataaggcagatgtcaggtgcgcagatcaaaattgcgaatcccgtggagggcagcactgaccgccaggtgactatcacaggctctgctgcaagtattagcctcgcccaatatctgatcaatgtgcggctgagttcggaaacagggggcatgggttcctcgtag

SEQ ID NO: 199960 - DNA, 1101 bp, Artificial Sequence
  Description of Artificial Sequence: Synthetic coding sequence
atggacaccggcgtgatcgagggcggcctgaacgtgaccctgaccatccggctcctcatgcacggcaaggaggttggctctattataggcaaaaagggggaatcagtgaaaaagatgcgagaggagtcgggagctaggatcaacatcagcgagggcaattgcccagaaaggatcatcacattagccggtccaaccaatgcaatcttcaaggctttcgctatgatcattgacaagctagaggaagacatctcttcctccatgacaaacagtaccgctgcatctcgcccccccgtgaccttgcgcctagtcgtgcccgcttcccagtgcggaagccttatcggcaaggggggctgtaaaatcaaagaaattcgtgagagcaccggtgcgcaggtccaggttgccggcgatatgctgccgaactccactgagagagcaattaccatcgccggtatcccccagtccattatcgagtgcgtaaaacaaatctgtgtggtgatgcttgaaacattgtcccagtccccaccaaaaggtgtcacgatcccctacagacccaaaccatcatctagcccagttatcttcgcaggggggcaggacagatatagcacaggatcagactcagcgagcttcccacacaccaccccttctatgtgtctgaaccctgatttggagggtcccccgctggaggcatacaccatccagggacagtacgcaattcctcaaccagacctcaccaagcttcaccagctggccatgcagcagtcccatttccccatgactcacggcaacacaggattctccggcattgaatcatcctcacccgaagtgaaaggctattgggcagggttggacgcttctgcgcagacaaccagccacgagctaacaatacccaatgacctcatcggctgtatcatcgggcgacagggcgccaagatcaacgaaatccgccagatgagtggggctcagattaaaatcgctaaccccgttgagggaagcactgatcgtcaggtaacaataactggctccgccgctagtatctctctcgcacagtatctgatcaacgtgaggttatcttctgagactggcggcatgggatcctcctag

SEQ ID NO: 199961 - DNA, 1086 bp, Artificial Sequence
  Description of Artificial Sequence: Synthetic coding sequence
atggacaccggcgtgatcgagggcggcctgaacgtgaccctgaccattcgtttgctgatgcacggaaaagaggtggggtccatcattggaaaaaaaggcgaatcagtgaaaaaaatgcgggaagagtccggggcccggattaatatttctgaagggaactgccccgaacggataattacactggcggggcccactaatgctattttcaaggctttcgctatgatcattgacaagctcgaagaggacatctctagctcaatgacaaacagcaccgcagccagccgtccccccgttacactgagactggttgtgcctgcatcccaatgcggatccctcatcggcaagggaggatgtaagattaaagaaattcgcgagtctaccggcgcacaggtgcaggtcgccggcgatatgttgccaaattcaacggaacgggccataactattgcgggaataccgcagtcaatcattgagtgtgttaagcagatatgcgttgttatgctggagtctccaccgaaaggggtcaccatcccgtatagacccaaaccctcgtctagtccagttatcttcgccgggggtcaggatcgatattcaactggcagcgacagtgctagtttcccgcacaccactccaagcatgtgtcttaacccagatctcgagggaccccccctagaggcctacacaattcaaggtcagtatgccatcccccaacccgacttgaccaagctccaccaattagctatgcagcagtcgcactttcctatgactcacggaaataccggcttctcgggcatcgagagcagctccccggaggtgaagggctattggggtctagatgcgtctgcgcagacaacgagccatgagctaaccattcccaacgacctgattggatgtattatcggcaggcaaggagccaagatcaacgaaatacgccaaatgtccggcgctcagatcaaaatcgccaatcccgtagagggatcaaccgaccggcaagtgaccattaccgggtcagctgctagtattagcctcgctcagtacttaataaatgtgagactgtccagtgagactggcggaatgggtagcagctag

SEQ ID NO: 199962 - DNA, 1056 bp, Artificial Sequence
  Description of Artificial Sequence: Synthetic coding sequence
ctgagccccggcgacgccttctgggcccccagcgtgctgccccactctactctctcaacgctgagtcatcacccccagcctcagtttggtcgccgcatggagtcgaaagtttcggagggcggactgaacgtgacgttgaccattcgactgcttatgcacggtaaggtcagaggagcagctatagtttccaaaggagagacagtcaagaaaatgcgggaggaatcaggcgcccgcatcaatatcagtgaggggaattgtcctgagcggatagtgactatcacaggacccactgatgccattttcaaggcatttgccatgatcgcttacaaatttgaagaagacatcattaactcgatgtccaacagcccagccacgagtaaaccccccgtaaccctcaggctagtggtgcctgcttcacagtgcgggagcctgatcggaaagggagggagtaaaattaaggagattagggagagtactggggcacaagtgcaggtggccggagacatgctgcccaattcgaccgaaagagctgttaccatcagcgggactcccgatgcaatcattcaatgtgtcaaacagatatgcgtggtgatgctggagtctccgccgaagggcgccaccattccctaccgacccaaacccgcctctacccctgtgatctttgcgggggggcaggcctacactattcaggggcagtatgccataccacaccccgaccagctgacaaagcttcaccagctggctatgcagcaaactccttttcccccactgggacagacaaatcctgcttttcccggattggacgcctccccacctgcctccactcacgagttaaccatccctaacgacctgatagggtgcatcatcggccgccagggaaccaaaatcaatgagatccgccaaatgagtggtgcccagatcaagattgcgaatgctacagaaggcagttccgaaagacagatcaccatcaccgggacaccagccaacatctcactggctcagtacctgattaacgctcgcttgacaagcgaggtaaccggcatggggacactctag

SEQ ID NO: 199963 - DNA, 969 bp, Artificial Sequence
  Description of Artificial Sequence: Synthetic coding sequence
ccccagccccagttcggccggcggatggagagcaaggtgagcgagggcgggttgaacgtgacccttactatccgattattaatgcacggaaaggaggttggttcaatcatcggtaagaagggcgagaccgtgaaaaagatgagggaagagagtggagcgcgaattaatatttctgaagggaattgtcctgaacgaattgtgacgatcaccggtccaacagatgccattttcaaggcctttgcgatgatcgcctataagttcgaggaggacattataaacagcatgtctaattcacccgcgacatccaagcctcccgtgacactgcgcctggtcgtgccagcatctcaatgcgggtctttgatcggcaaaggaggttctaagattaaggagatcagggaatctactggggcacaggtgcaggtagcgggggacatgctgccaaactccacagagagggccgtgaccatcagcggcacgcccgatgcaatcattcaatgcgtgaaacagatctgtgttgttatgctcgaagcttacactattcagggacagtacgccatccctcaccccgaccagctgaccaagttgcaccagctggccatgcagcaaaccccctttcctccgctgggccaaaccaaccccgcgtttcccggggagaaactcccccttcattccagcgaagaagcacagaacttaatgggtcaatcgagcggattggatgcgtcccctcccgctagtacacacgaactgactatccccaatgacttgattgggtgcatcattggcaggcaggggacgaaaatcaacgagattaggcagatgagtggcgctcagatcaagatcgcaaacgccactgaaggaagcagcgaacggcagatcaccataacaggcactccggcaaacatctctctggcccagtacctaataaatgctagacttacaagtgaggtgactggcatggggaccctgtag

SEQ ID NO: 199964 - DNA, 1038 bp, Artificial Sequence
  Description of Artificial Sequence: Synthetic coding sequence
atgggcgagggcgacgccttctgggcccccagcgtgctgccccacagtaccctatccacactgagtcaccacccacagcctcaattcggacggaggatggaatcaaaggttagcgaagggggactaaatgttaccctgacaattagactactgatgcatggcaaagaggtaggaagtattatcggtaagaaaggagagactgtgaaaaagatgagggaggagtcaggggctcgcatcaacatttctgaaggtaattgcccagagcgcattgttaccataaccggccctacagacgctatattcaaagctttcgccatgatcgcatataaatttgaggaagatattatcaactcgatgtcaaactcccccgctacgtctaaaccacccgtgacactgagactcgtggttccagcttcccaatgcggttcactgattggtaaaggtgggtcaaaaatcaaagaaattcgtgagtcaacaggggctcaagtacaggtagccggggatatgctcccaaatagcaccgagagggccgtgactatttccggtacacccgatgcgattatccagtgcgtcaagcaaatttgtgtggtaatgcttgaagcctatacaatccagggacaatatgccattccgcatcctgatttgactaagctccaccagctggccatgcagcagacgccttttccgcctctggggcaaacaaatcctgcgtttcctggcgagaaactacccctacactcgtcagaggaggctcagaaccttatgggtcagtcatctggccttgacgccagcccacccgcctctacacatgaactcaccatccccaatgatctgatcgggtgtatcattgggcgacaagggacaaagataaacgaaatcagacagatgtctggggcacagattaaaattgccaacgccaccgaggggagttccgaaaggcagatcacgataacaggcacaccagccaacatctccctggcccagtacttaatcaatgccagactgaccagcgaggtgacagggatgggtacactctag

SEQ ID NO: 199965 - DNA, 1113 bp, Artificial Sequence
  Description of Artificial Sequence: Synthetic coding sequence
atgggcgagggcgacgccttctgggcccccagcgtgctgccccacagtactctcagtaccctgtcccaccacccccagccgcagtttggacgaaggatggagtcaaaagtaagcgagggcggactcaacgtcacgctgacaattcgactgctcatgcatggcaaagaagtcggttccataatcggcaaaaaaggcgaaaccgtgaaaaaaatgagagaggaatccggcgccagaattaacatcagcgagggcaattgcccagagcgaatcgttactataactggcccaactgacgccatattcaaagctttcgccatgatcgcctacaaatttgaagaagacattatcaactcgatgagcaattctcccgcaacctctaaaccaccagtcaccctgcggctcgtggtgccggcctcacaatgcggcagccttattggcaagggaggaagtaagatcaaggagattcgggaaagcaccggcgcacaggtccaggtcgctggagacatgctgcccaacagcaccgagagggctgttacaattagtggcactcccgatgcaatcattcaatgcgtaaaacaaatctgcgtggttatgctggagagtccccctaagggggccaccattccgtataggccgaagccggcaagtactccagtaatttttgccggcgggcaggcttatacaatccagggccaatatgccatcccgcaccccgacctgaccaagctgcaccaactggccatgcagcagacgccatttccccccctgggccaaactaatccggcattccctggcgagaaattgcctctgcacagctctgaggaggcccagaatttgatgggtcagtcatctggactggatgcatctcctccagcctctacacatgaactcactatacccaatgacctcataggatgtataatagggaggcaggggacaaagatcaatgaaatccgccagatgtcaggggcgcagattaaaattgcaaatgcaaccgaaggttccagcgagcgccaaatcacgatcactggcacacctgctaatatcagtctcgcacaatacctaattaacgctcggctaactagtgaggttaccgggatgggcaccctgtag

SEQ ID NO: 199966 - DNA, 1056 bp, Artificial Sequence
  Description of Artificial Sequence: Synthetic coding sequence
atgggcgagggcgacgccttctgggcccccagcgtgctgccccactccacactctctaccctgagccatcaccctcagccccagttcggacgtagaatggagagcaaggtgagcgaaggcggcctcaacgtcaccctgacgattcgtttgttgatgcatgggaaggaagtgggctccatcatcggtaaaaaaggcgaaaccgtcaagaaaatgcgcgaagagtctggcgctcgtattaacatttctgaagggaattgtccggagagaatcgtgacaataactgggccaactgacgcgatcttcaaagcatttgctatgatcgcatacaagttcgaggaggacatcattaactccatgtccaattcccccgctacgtcaaagccgcctgtcactctccgtttggtggtccccgcaagtcaatgtggcagcttgatcgggaagggaggttcaaaaatcaaggaaattagagaaagcactggcgcccaggtccaggtggctggtgatatgctgccgaatagtacagagagagccgtcaccatctccggcacccctgacgccataatccaatgtgtcaaacagatctgcgtcgtgatgctggagagtccccccaaaggggccaccatcccttatagacctaaaccagcctccactcctgttatattcgcaggtggccaggcctatacgatacaggggcagtatgctatccctcaccctgaccagctgactaaactgcaccagctcgcaatgcagcagactccatttccgcctctggggcagaccaatccggctttccccgggctggacgccagcccacctgcctcgacccacgaactgacgataccaaatgatctgatagggtgtatcataggccgccaagggaccaaaatcaatgaaattcgtcagatgagtggcgcacagattaaaatagccaacgccactgagggcagctccgaacggcagattactattaccggaactcccgctaacatatctcttgctcagtaccttattaacgctcggttaactagtgaagtgacgggaatggggactctatag

SEQ ID NO: 199967 - DNA, 1116 bp, Artificial Sequence
  Description of Artificial Sequence: Synthetic coding sequence
atgggcgagggcgacgccttctgggcccccagcgtgctgccccactccactctctctaccttgtcgcaccatccccaaccccaattcgggcgccggatggagtccaaagtcagtgaaggaggcctgaatgttacgctgacaattagattactaatgcacggcaaagaggtgggctcaattattggcaagaaaggggaaacagtgaaaaagatgcgcgaggagtctggcgcaagaatcaacatctccgaggggaactgccccgagaggatcgtcacaatcaccggacccacagatgccatcttcaaggccttcgctatgatcgcctacaaatttgaggaagacattatcaacagtatgtccaacagcccagctacaagcaagccacctgtcacactgaggctcgtagtacctgcctcacagtgtggctcccttatcggcaaggggggctctaaaatcaaagaaattagggagtcaacaggggcgcaggtgcaggtcgcgggtgacatgcttcccaacagcaccgaaagagctgtgacaatctcaggcactccagatgcgatcatccagtgcgtgaaacaaatttgcgtcgtgatgctcgaatcaccccccaagggcgccacaatcccttacagacccaagcccgccagcactccggtgatcttcgctggggggcaggcctatacaatccaaggccagtatgctatcccccaccctgatcagctgactaaattacaccagcttgccatgcagcagacaccattcccccctctcggtcagacaaatccagctttccccggggaaaaactacccttgcacagtagcgaggaggcccaaaacttgatggggcagtcttcagggttagatgcatctccaccggcgagtacccatgaacttacaattccaaacgacttaataggttgcataatcgggaggcagggcacaaagattaatgagatacggcagatgtccggagcccagattaaaatcgctaacgccacggaaggatcaagcgaacgccagattacaatcacagggactcctgccaatatcagccttgcgcagtacctgattaatgcccggctaacgtctgaggtcacagggatgggtaccctctag

SEQ ID NO: 199968 - DNA, 1116 bp, Artificial Sequence
  Description of Artificial Sequence: Synthetic coding sequence
atgggcgagggcgacgccttctgggcccccagcgtgctgccccactccactttaagcacactctcccaccatccccaacctcaattcggccgacgaatggagagcaaggttagcgagggcgggctaaatgtgacactgacaatcagactcctgatgcacggaaaggaggtgggaagcattatcggaaaaaaaggggagaccgttaaaaagatgagggaggagtccggcgcacgaatcaatatttccgagggcaactgtcccgagagaatcgtgaccatcactggtcccaccgatgctatcttcaaagcatttgctatgatcgcttataagtttgaagaagatataatcaacagtatgtctaatagccctgccacaagcaagccgcctgtcacactacggttagtggttccagcctctcagtgcgggagcctgataggcaaaggcggatcaaagattaaagagatccgcgagtccaccggggctcaggttcaggtcgctggcgatatgttaccaaatagtaccgaacgtgctgtgacaataagcggcaccccggacgcgatcattcagtgcgtgaaacagatctgtgttgtgatgttagagtccccgcctaagggagcaaccatcccataccggccaaaaccagcctccacccccgtcattttcgcgggtgggcaagcttacacaatacaggggcagtacgcgatcccacaccccgatcagctcactaagcttcatcagctggccatgcagcagaccccattccccccattgggacagaccaaccccgccttccccggggagaaattgccactccatagtagcgaggaagcccagaacttgatgggccagtcttccggacttgacgcaagcccaccggcatccacgcatgaactgaccattcccaacgatctgatcggatgcatcattggtaggcaaggcaccaaaattaatgagatccggcaaatgtccggcgcccagatcaagattgctaatgccacggaaggttcttcagaacggcagatcactatcaccgggactcccgccaacatctcactggcacagtatttgattaatgccaggttgacatctgaggtcacaggaatgggcaccctgtag

SEQ ID NO: 199969 - DNA, 18 bp, Artificial Sequence
  Description of Artificial Sequence: Synthetic coding sequence
atggagagcaaggtgtag

SEQ ID NO: 199970 - DNA, 5070 bp, Artificial Sequence
  Description of Artificial Sequence: Synthetic coding sequence
atgggcagcaagcggcggcgggccaccagccccagcagcagcgtgtcgggcgatttcgacgacgggcatcacagcgtatctacccccggcccctcccgcaagcggagacgactgtctaatttgcctactgtggatcccatcgctgtttgccacgaactgtacaataccatccgcgattacaaggacgagcagggacggctcctgtgcgagctcttcatccgcgctccaaagaggcgcaatcagcccgattactatgaggtcgtgtcacagccaattgacctgatgaaaattcaacagaagctgaagatggaagagtacgatgatgttaatctgctgacggccgattttcagctcctgtttaacaacgcgaagagttattataagcctgattcccctgaatacaaagccgcctgcaaactttgggacctctatcttaggacacgcaatgaattcgttcagaagggagaagcagacgacgaggacgatgacgaagacggacaggacaaccagggaactgtcaccgaaggatcttcaccagcttatttgaaggaaatcctggagcagctgctggaagcaatagtcgtagcgacaaacccgtctggaaggctcattagcgagctcttccagaagctaccaagcaaagtccagtaccccgactactacgcgataattaaagaaccaatcgatttgaaaacaattgcacaacgcattcaaaacggatcttataaatctatccacgctatggccaaagacatcgaccttctcgctaaaaacgccaaaacatataatgagccaggttcacaggtctttaaagacgctaatagcattaaaaagatcttctatatgaaaaaagccgagatcgagcatcacgaaatggccaagagttcactgagaatgcgtacaccctctaacctggccgctgcaagacttaccggtccttctcactcaaagggatcgctgggtgaagagcgcaatcctactagcaagtactaccgcaacaaaagagctgtacagggagggcgcctatctgcgatcacgatggccctgcagtatggctctgagagcgaggaggacgcagcattggcagccgcccgttatgaggagggagaatccgaagctgagtcaataacgagctttatggacgtcagcaatcctttctaccaactttacgacaccgttagatcatgccgaaacaatcagggccagttaattgcagagccattttatcacctgccgtctaaaaagaagtaccctgattattatcaacagataaagatgcccatctcactccagcagatccgcactaagctaaagaaccaagagtacgaaacattggatcacctcgaatgtgatctgaatctgatgttcgagaatgcaaagagatataatgttccaaactccgccatttataaaagggtgcttaagctccaacaagtgatgcaggcaaaaaaaaaggagctggcccgtcgggatgacatcgaggacggcgattcaatgatctctagtgctacatctgacactggcagtgccaagagaaaatccaagaagaacatcagaaagcagagaatgaagatcctttttaatgtggtgctcgaagcacgtgaaccagggtctggcaggcgactctgcgatctgttcatggtcaagcccagtaagaaagattaccctgattactataagatcattctggagcctatggatcttaaaattattgaacataacattcgcaatgataaatacgccggagaggagggaatgatcgaggatatgaagcttatgttccgcaatgcccgtcactataatgaagaaggctcacaagtgtataacgatgcccacatcctggagaagctccttaaggagaaacgcaaggagcttggcccgctgcccgatgatgacgatatggcctctccgaaactaaaactcagtcggaagagcggcatctcccccaagaaatccaaatacatgacgcccatgcaacagaaactgaacgaggtgtacgaagctgtgaagaattacaccgataaacgcgggcgaaggctgagtgccatattcttacggctcccgtcgagaagcgaattacctgactattatctgaccatcaaaaagccgatggacatggaaaagatccgttctcacatgatggcaaacaagtaccaggacattgactcgatggttgaggactttgtgatgatgttcaacaacgcgtgtacatacaatgagcctgaatctttaatttacaaggatgcactggtcttgcataaagtattactggaaacaaggcgtgacttagaaggagatgaggattcacacgtgcctaacgtgacactcttgatccaggagctgatccacaaccttttcgtgtctgtgatgtctcatcaggatgacgaaggacggtgctactccgacagcctcgccgaaatccccgcagtagatcctaacttccccaacaagcccccattaaccttcgacataatcaggaaaaatgtcgagaataatcgctatcgaagactcgatttattccaggaacacatgtttgaggtgctagagcgggcaagacggatgaataggacagacagcgaaatatatgaggatgccgttgaacttcagcagttttttatcaaaattagggacgaactctgcaaaaacggagagatccttctaagtcccgccctgtcttatacaaccaaacacctccacaatgacgtagaaaaggagcggaaggagaaactccccaaagagattgaggaagacaagcttaagcgggaggaggaaaaacgggaagccgagaagtctgaggattcaagcggggcagccggactcagcgggctgcaccgaacctactcgcaagattgcagctttaaaaacagcatgtatcatgttggggactacgtctacgtggagcccgcggaagcaaatctccagccacacatcgtgtgcatcgagcggttatgggaagacagtgccggagagaagtggctgtacggatgttggttttaccgaccaaacgagaccttccacctggcaactcggaaatttttagagaaggaagtgtttaaaagcgattactataataaggtgcccgtctccaagatccttggaaagtgcgtggtgatgtttgtgaaggaatattttaagctgtgccccgagaatttccgagacgaggatgtcttcgtttgtgagtcaaggtattctgctaaaaccaagtcattcaaaaaaattaagctatggacaatgcctattagctctgtgcggtttgtgccacgggacgttccactaccggttgttagagtcgcctctgtgtttgccaatgccgataagggagacgatgaaaagaatacggacaattcagaagattcccgtgcggaggacaattttaatctcgaaaaagagaaggaggatgtgcccgtcgagatgtctaacggagagccaggctgtcattattttgagcaactccactacaacgatatgtggttaaaagtgggcgactgcgtgtttatcaagtctcatgggctggtgcgcccccgcgtgggccgaattgagaaggtttgggtcagagacggagcagcctacttttatggcccgatttttatccatcctgaggagaccgaacatgaaccaacaaagatgttctacaaaaaagaggttttcctgagtaatcttgaggaaacctgccctatgacatgtatcctgggtaaatgtgccgtactgtcgttcaaagactttctctcctgtcggccaacagaaattcccgaaaacgatatcctactgtgtgaaagtcgttataatgaatccgataagcaaatgaagaagttcaagggactgaaaaggttctccctgtctgccaaggtcgtggacgacgaaatctattactttagaaagcctatcgttccgcagaaggaaccgtcccccctcctggagaagaaaatccaactcctggaggccaaattcgcagaactggagggaggagatgatgacatcgaggagatgggcgaagaggacagcgaggttattgaacctccctctctgcctcagctccagacaccattagcgtccgaactggatcttatgccctacacgccgccacagtctacacccaaatctgctaagggttccgcaaagaaagagggctctaagaggaagatcaacatgtcaggctacatcttgttttctagcgagatgcgcgctgtgataaaagcccagcacccggattactctttcggagaactttctcgcctcgtgggaactgagtggcgcaatctggagacagccaagaaggccgagtatgaagaacgcgccgccaaggtagccgagcagcaggagagagagcgggctgcgcagcagcagcaaccctctgcaagccctagagccggcacccccgtgggggccttgatgggcgtcgtgcccccccccacccctatgggaatgctgaaccagcagctgaccccagtggccggcatgatgggagggtacccaccagggctcccacctcttcaggggcccgtggatgggctagtgtctatgggctctatgcagcctctccatcccgggggacctccaccccaccacctcccccccggggtaccggggttgccaggaattccgccccccggcgtcatgaaccagggggtggctccaatggtcggcaccccagcccctggcggatccccctatgggcaacaggtgggagtgctcggacctcccggccaacaagcccctcccccgtacccgggcccccatccagctggcccacccgtgattcaacaaccaaccacgccgatgttcgtcgcaccacctccaaaaacccagagactgctgcattcggaagcatacctgaaatatattgagggcctcagcgcagaatcaaactccatcagtaaatgggatcagactctggcagctaggcggcgcgacgttcacctgtccaaggagcaagagtcccggttgcctagccactggctcaagagcaagggagcccatacgactatggccgatgcactgtggaggctgcgcgatctgatgctgcgagataccctgaatatcaggcaagcatataatctggaaaatgtctag

SEQ ID NO: 199971 - DNA, 4749 bp, Artificial Sequence
  Description of Artificial Sequence: Synthetic coding sequence
atgggcagcaagcggcggcgggccaccagccccagcagcagcgtgagcggtgatttcgatgacggacatcattctgtcagtacccccggaccgtcacggaaaaggcggcggttatctaacctccctactgtggacccaattgccgtctgtcatgagttgtataacacaatccgagactacaaagatgagcagggcaggctgctctgcgagctgttcattcgagcacccaagcgcaggaaccaaccagattattacgaagtcgtgagccagcctatcgatcttatgaagattcagcagaaactgaagatggaagagtacgacgatgtgaatttattaacagctgacttccagcttcttttcaacaacgctaagtcctattacaagccggattctcccgagtataaagctgcctgtaagctgtgggacctttacttaaggacccggaatgaatttgtgcagaaaggggaagctgatgatgaagacgacgacgaggacggacaggacaatcaggggaccgtgaccgaggggtcgtctccagcctatctgaaggagattctcgagcagctcctggaggctattgtggttgctactaaccctagcgggcggctgataagcgagctgtttcagaagctgccgagcaaggtgcaataccccgattactacgccattatcaaagaacctatcgatctgaaaaccatagctcagcgtatccagaacgggagctataaaagtatccatgcaatggccaaggatattgatctgctcgcaaagaatgccaagacttacaacgagcccgggagccaggtgtttaaagacgcgaattccataaaaaaaattttttacatgaaaaaggccgaaatagaacatcacgaaatggccaaaagttctttacggatgagaactccttccaacctggctgcagcgaggctcactgggcccagccacagcaagggtagcctgggcgaagaaagaaatcctacgtcaaaatactatcgcaacaagcgggccgtgcagggaggcaggctctcagctatcacaatggcattacagtatggaagtgaaagtgaggaagatgccgcgctagccgcagctcggtacgaggagggtgagagcgaagccgagagcatcacgtctttcatggatgtgagcaaccccttttaccaattgtacgatacagtgagatcctgcagaaacaatcagggccagcttatagcagagcccttttatcaccttccctctaaaaagaagtaccctgattactatcagcagattaaaatgccaatctccctccagcagattcgcacgaaattgaagaaccaggagtatgagaccctggatcacctggaatgtgatcttaatctgatgttcgagaacgctaagcggtacaacgtaccaaattccgcaatttataagcgcgtactaaaattacagcaggtgatgcaggccaaaaaaaaagaattagcacggcgagacgacattgaggacggagactccatgatctcctcagcaacaagcgataccggcagcgccaagcggaagagcaaaaaaaacattagaaagcaacgaatgaagattctgttcaacgtggtcctagaagcacgggagccaggtagcggcagaaggttgtgtgacttatttatggtgaaacctagcaagaaagactaccccgactattacaaaattatattggaacccatggatttgaaaattatcgagcataatatcagaaacgacaaatacgccggtgaggagggaatgattgaggacatgaaactcatgttcaggaacgccagacattacaatgaagaagggagccaggtctacaatgatgcccacatcttggaaaagctgttgaaagagaagcgcaaagaactgggacccctccccgacgacgacgacatggcctcaccaaagttgaaactgtcccgaaaatctggcatctcacccaagaagagcaaatacatgacacccatgcagcaaaagttgaatgaagtttatgaggcggtgaaaaattacaccgacaaaagagggaggcggctgtcggccatcttcttgcgccttccgtccaggagcgagctgcccgactactatttgacaataaagaagcctatggatatggagaaaatccgtagtcacatgatggcaaataaataccaggacatagactctatggtggaagattttgtgatgatgtttaacaacgcctgcacatacaacgaaccagagtccctcatctataaggatgctttagttttgcataaagtgctgctagaaacaaggcgcgaccttgagggtgatgaggactcccacgtgcccaacgtaacacttctgattcaggaactaatccataatcttttcgtgtccgtgatgagtcatcaggacgatgaaggcaggtgttatagcgactcgctggcggagatccccgctgtcgaccccaacttcccaaacaagcccccccttacctttgacataatccgtaagaatgtcgagaacaatagataccgtcgtctggatctctttcaagaacacatgttcgaagtgttagagcgcgccagacgcatgaaccgcacggacagcgaaatttatgaggatgcggtggaattgcaacaattctttattaagatccgggacgaactatgtaagaacggggaaatccttttgtcacccgcactgtcttatacgacaaagcacctgcacaatgacgtggagaaagaaagaaaggagaagttacccaaagagattgaagaagataagttaaaaagggaagaggagaagcgggaagcagagaagtccgaggattcgtcaggtgccgctggccttagtggcctgcacagaacttatagtcaagattgcagcttcaagaactctatgtaccacgtcggcgattacgtgtacgtagaacccgctgaggcaaatctccagccgcatattgtgtgtattgagcggctgtgggaggactctgcaggtgagaaatggctgtacggatgctggttttaccgtcccaacgagacctttcatcttgccactaggaaatttctcgagaaggaggtgtttaagtccgattattacaacaaagtgcccgtctctaagattctgggaaagtgcgttgtcatgtttgtgaaggagtatttcaaactgtgccccgaaaatttcagagatgaggatgtttttgtgtgcgagtcacgatattctgccaaaacgaagtcattcaagaagattaagctgtggactatgccaatttcctctgtacgattcgtgccccgagatgtgccactgccagttgtccgagtggcctcggtgttcgctaacgccgataaaggagacgacgaaaagaatacagataatagcgaagatagccgagctgaggataacttcaacttagagaaggaaaaagaagacgttccagtggagatgagcaatggtgagccaggatgccattacttcgaacagcttcactataacgacatgtggctcaaggtgggagattgcgtgttcattaaatctcacggtctcgtgagacccagggttgggcggatcgagaaggtatgggtacgggacggtgccgcttatttctatggtccaatttttattcaccctgaagagaccgagcacgagccaacaaaaatgttctataaaaaagaggtgttcctgtcaaatctggaggagacatgtcccatgacttgcattctcggaaagtgcgctgttcttagtttcaaagattttctgtcatgtcgacctacagagattccagaaaatgatatcctcctttgcgaaagtcgttacaatgaaagcgataaacagatgaaaaagtttaagggcctgaagaggttctccctctcggctaaggttgtggatgacgagatctattactttcgcaaaccaatcgtgccacaaaaagagccatcccccctcctggagaaaaaaattcagctcctcgaggctaagtttgccgagctggagggcggcgacgacgacatcgaggagatgggggaagaagactcagaggtcattgagcccccgtcacttcctcagttgcagaccccactggcttccgaattagacttgatgccttatactccgccacagtccacacctaagtccgccaagggctctgcaaaaaaggagggatcaaagaggaagatcaacatgagcgggtacatcctgttttcctcagagatgagagcggtcatcaaggcccagcacccagattactctttcggagagcttagccgcctggtggggaccgagtggagaaacctggaaactgccaagaaggctgaatacgaaggtgtgatgaatcagggagtggctcccatggtcggtactcctgcccccggtggcagcccgtacggacagcaagttggtgtgcttggtcctcctggccagcaggctccacccccgtaccccggcccacatcctgccggccctcctgtcatccaacagccgactactcctatgtttgtggccccccctccaaaaacacagagactcttgcactcggaggcctatcttaaatatattgagggcctcagcgccgaatctaatagtatctccaagtgggaccaaacccttgccgctcgtagaagagatgtccatcttagcaaagagcaagaatcacgcctcccgagccattggctcaagtccaagggggcccacaccacgatggctgacgcactgtggcgcctgagggacctcatgctaagagacacactaaatatccgccaggcatacaatctggaaaatgtgtag

SEQ ID NO: 199972 - DNA, 4809 bp, Artificial Sequence
  Description of Artificial Sequence: Synthetic coding sequence
atgggcagcaagcggcggcgggccaccagccccagcagcagcgtgtctggagacttcgacgatggccaccactccgtgagcacccctgggccaagtagaaagaggagaagactgagtaacttgcctactgtggacccaattgccgtgtgccatgaactgtacaatactatccgggactacaaagacgagcagggtagactgctttgcgagctctttattcgcgccccgaagcgacgtaatcagccagactactacgaggttgtctcccaacctatagacctgatgaaaattcagcagaaacttaagatggaggaatatgacgacgtgaaccttctgactgctgactttcaactgctctttaacaacgcaaaatcctattacaaacccgacagcccagagtataaagcggcctgcaaactgtgggacctgtacttgcggactcggaatgaattcgtccagaagggtgaagctgatgatgaagacgacgatgaagacggacaggacaatcaggggactgtgaccgaaggttcaagcccggcctacctgaaggagatcttggagcagctactggaggcaatcgttgtggctactaacccctccggccggcttatcagcgagcttttccagaagctacccagcaaggttcaatatcccgattactacgcaattatcaaggaaccaatcgatcttaagaccatcgctcaacgcatccagaatggcagttacaagtccattcacgccatggctaaggatatcgatttattggccaagaacgcaaagacttacaatgagccgggaagtcaagtgttcaaggatgcgaactccattaagaaaatcttctacatgaagaaggcggaaatcgagcaccacgaaatggccaaatcgtcactgagaatgagtaataaacgggctgtacagggcgggcgcctgagtgctattacaatggctcttcaatacggttcagagagcgaggaggatgccgctttagcagccgcccgctatgaggagggagaaagcgaggcggagtctatcacaagtttcatggatgtcagcaacccattctatcagctctacgacaccgtgcggagttgcagaaacaatcagggtcagctgatagccgaaccgttttaccatctccccagcaagaagaagtatcctgactattatcagcaaattaaaatgcctatcagtctgcagcaaattagaacaaagctcaagaatcaagagtacgagaccctggaccatttagaatgcgatctgaacctaatgtttgaaaacgccaagcggtataacgtgccaaatagcgcaatatacaaacgggttttaaaactgcagcaggttatgcaggcaaagaagaaagagcttgcgcggcgagacgacattgaagacggtgattccatgatttcctctgccactagcgacactggatcagctaaaaggaaatccaagaagaatatccgcaagcagaggatgaagatactgttcaatgtggtgctagaggccagagagccaggctcgggcaggagattgtgtgatcttttcatggtgaaaccatccaagaaagattaccccgattactataagatcatactggagcctatggacttgaaaatcatcgaacacaacatccggaatgataagtacgccggcgaggagggtatgatcgaggatatgaagctcatgttcaggaacgcacggcattacaatgaggaaggctcgcaggtgtataatgatgcccatatactggaaaaactcctcaaggagaagagaaaggagcttggacccctgcctgatgatgatgatatggccagccctaagctgaagctttcaaggaagtctgggataagtcctaaaaaatccaagtacatgaccccgatgcagcagaagctgaatgaagtctacgaggccgtgaaaaattatactgacaaaagggggagacggctgagcgctattttcctaagacttccttctcgctcggagctgcccgactattacctgacaatcaaaaaaccaatggatatggagaaaatacgaagccacatgatggcgaacaagtaccaggacattgatagcatggtggaggactttgttatgatgtttaataacgcctgcacctataacgaaccggagtcgcttatatacaaggacgcccttgtgctgcataaagttctcttggaaacaaggcgcgacctggaaggggacgaggactcccacgtgccgaatgtgactcttttgatacaggaactcattcacaacctgttcgtgagcgtcatgagtcatcaggacgatgagggcaggtgttattccgacagtctggccgagataccggccgtggatcccaattttcctaataaaccccctttaacttttgacatcatccgaaaaaacgttgagaacaacaggtatcgcaggctggacctctttcaggaacatatgttcgaagtcttggagcgtgcacgacggatgaatcggactgattctgaaatctatgaagatgccgtggagctccagcagttcttcattaagattcgcgatgaattgtgtaaaaacggagagatactgctgagtcctgccctgagctataccactaagcacctccacaacgatgtggagaaggaaaggaaagaaaaactgccgaaggagatcgaggaggataaactgaaaagggaggaagagaagagagaagccgagaaatctgaagactcgagcggggccgccggcctttctggcctgcacagaacatactcacaggactgctcctttaagaactcaatgtatcatgtgggagactacgtgtatgtcgagcccgccgaggccaaccttcagccccatattgtctgcattgaacgtctatgggaggattcagccggagagaagtggctctacgggtgttggttctatcggccaaatgagactttccacttggccactagaaaattcctggaaaaagaggtatttaagagtgattattacaataaagtgcctgtgagtaagatactcgggaaatgtgtggtaatgtttgtgaaggaatattttaagttgtgtcccgaaaacttccgggacgaagatgtctttgtttgcgagtctcgatattcggctaagacaaaatcatttaagaaaataaaactctggacaatgcctataagcagtgtgcgttttgtgccgcgcgatgtgccgttaccagttgtgcgcgtggcttctgtgtttgccaacgccgataagggggacgacgagaagaacaccgacaatagcgaggattcaagggctgaagacaacttcaaccttgagaaagaaaaggaggatgttccggtcgaaatgagtaatggggaacccgggtgtcattacttcgagcaactgcactataacgacatgtggctcaaggtgggagactgtgtttttatcaagagccacgggctcgtgcggccccgagtcggccgcatagagaaagtctgggtcagggacggcgccgcgtacttctatggacccattttcattcaccctgaagagactgaacacgaacccaccaaaatgttttataaaaaagaggtcttcctctcaaacctcgaggaaacgtgccctatgacctgcattctgggaaagtgcgctgtgctatctttcaaagactttttgtcctgtcgccccacagagatccccgagaacgacattctgctgtgtgaatctcggtataacgaatcagacaaacagatgaaaaagtttaaaggactgaaaagattcagtttgtcagctaaggtggtggacgatgagatttattatttccggaagcctattgtacctcagaaggaacccagccctcttctagaaaaaaaaatccagcttctagaggcaaagttcgctgaactcgaaggaggagacgatgacatcgaggaaatgggggaagaggatagtgaagtaatagagccccctagtctgccccagctgcagacaccactggcctctgaactggacctcatgccttacacccccccccagtcgacgcccaagagcgctaaggggagtgccaaaaaagagggaagcaagaggaagataaatatgtccggttacattctatttagtagcgagatgcgggctgtgattaaggcgcagcaccccgactatagctttggagagctgtccaggttggtgggcaccgagtggcgcaatctggagaccgccaaaaaagccgagtatgagggcatgatgggaggttaccctccaggcctgcctccactacagggccccgtggatggtctggtgagcatgggatcaatgcagcccttacaccccgggggtcctccgcctcatcacttaccccctggtgtgcccggtctgcccggaattcccccccccggagtaatgaaccaaggagtagcgccaatggttggtacaccagcccctgggggctcaccctacgggcagcaggtgggggtgctgggacctcccggacagcaggcacctccaccctaccccgggccccaccccgcaggacctccagtgattcaacaaccaactacaccaatgttcgtcgcgcctccccccaagacacaacgcctgctgcatagtgaagcctatttgaaatacattgagggactcagtgccgagagtaactcaattagtaaatgggaccaaaccttagccgccagacgccgggacgtgcatctgtctaaagagcaggagtcaagactcccctcccattggctcaagtccaaaggggctcacaccaccatggcggatgctctctggaggctgagagacctcatgctcagagacacactgaacattcgccaggcttacaacctggaaaatgtgtag

SEQ ID NO: 199973 - DNA, 4749 bp, Artificial Sequence
  Description of Artificial Sequence: Synthetic coding sequence
atgggcagcaagcggcggcgggccaccagccccagcagcagcgtgagtggagattttgatgacggccatcacagcgttagcaccccggggccatccagaaagcgaaggcgtttaagcaatctgccaactgtggaccccatagccgtgtgtcacgaactgtacaataccatccgggactataaggatgagcagggcaggttactgtgtgaactgtttatccgtgcccctaagaggagaaatcagcctgactactatgaggtggtgagtcaacccatcgacctgatgaaaatccagcagaaactcaaaatggaagagtatgatgatgtaaacttgttgacagctgattttcagcttctgtttaacaatgccaagagctactacaaacccgacagtccagaatataaggcagcctgcaagttgtgggatctttacctccggactagaaatgagtttgtccagaaaggcgaagcagatgatgaggacgacgacgaggacggacaggacaatcagggaacggtgactgagggtagcagccctgcatatctcaaggagatcctagagcagctactggaagcgatcgtcgtagccacaaatccttcaggccggctgatctccgaattgtttcagaaactcccctccaaggttcagtatcccgattattacgccatcatcaaagagccaattgatctgaagacaatcgctcagcgaatccaaaatgggtcttacaaatcaattcatgccatggccaaagacatagacctattagcaaagaacgctaaaacttataatgaacccggttctcaggtctttaaggacgccaattccatcaagaagatcttttacatgaagaaagcagagatcgaacaccacgagatggccaagtcatccctgcgtatgagaaccccttccaatctagcggcagctagacttacaggaccctcccattcaaaaggaagtctcggcgaggagcggaatcctacaagcaagtactacagaaataagagagccgtgcagggggggcggctgtcggcaataacaatggccctacagtatggcagcgagtccgaagaggatgctgccctggcagccgcacgatatgaagaaggagaatcggaggccgaatctattactagctttatggatgtgagtaaccccttctaccagctctacgacactgtgcgtagctgtagaaataatcaggggcagctgattgcggagcccttctaccacctacctagtaagaaaaagtatccagactattaccagcagattaagatgccaatcagtctacaacagatcagaactaaactcaagaaccaggaatacgagacacttgatcatctcgagtgcgatctcaacttaatgttcgaaaacgccaagaggtacaatgtccctaattcagctatctacaaacgggttttaaagctacagcaggttatgcaggctaagaagaaggagctggctagaagggatgatattgaggacggggatagtatgatctcctccgccacttcggataccgggagtgcgaaacgcaagtcaaaaaagaatattagaaagcagcgaatgaaaattctatttaacgtggttctagaggcacgggaacctggaagtggccgacgtctttgtgacctgttcatggtaaagccctccaaaaaggactatcctgattattataaaatcatcctggaacccatggacttgaaaattattgaacataacatacgcaacgacaaatatgccggagaggaggggatgattgaagatatgaaactgatgttcagaaatgctagacactataacgaagaaggatcccaagtgtacaacgacgcccatatcctggagaagctcctgaaggaaaagcgcaaagagcttggccccctacccgatgacgacgacatggcctctcctaagctgaagctgagtaggaagtcggggatttccccaaaaaagagtaaatatatgactcccatgcagcagaaactcaatgaggtatacgaggctgttaagaattacaccgacaagcggggacggcgactgtctgctatatttctgcgacttccatctagatctgaactgcccgattactacttgacaatcaaaaagccaatggatatggaaaagattcgatcccacatgatggctaacaaatatcaggacatcgatagtatggtggaggatttcgtaatgatgtttaacaatgcctgtacatataatgaacctgagagccttatttacaaggacgccttagtcctgcacaaggtgctgcttgaaaccagacgagacctggaaggcgacgaggactctcacgtgcccaacgtaactctgctcatacaggagctcatccataatctgttcgtgtccgtcatgagtcaccaagacgatgaggggcggtgctatagcgactccttggctgagatccctgccgtggatcctaactttccaaacaagccaccactcacattcgacattattagaaagaatgtggagaataataggtacagaaggctggacttgttccaggagcacatgttcgaggtgctcgagcgagcccgccggatgaatagaactgatagtgaaatctatgaggatgccgtggagctgcagcagtttttcatcaaaatccgagacgagctctgtaagaacggggagatcctgttgagccctgccctctcctacactacaaagcacctgcataatgatgtggagaaagagcgaaaagaaaaattgccaaaagagattgaagaggacaaactcaaaagagaagaagaaaaaagagaagctgaaaaatcagaagattcatccggagcggcagggctgagcggcttacatcgcacgtactctcaggactgctcattcaagaacagcatgtaccacgtgggggactatgtctatgtcgaacccgcagaggctaatctacagccccatatcgtgtgcattgaaagactctgggaggactcggccgagaaggaagtgttcaagtctgattactataacaaagttccggtgtcaaagatcctggggaagtgcgttgtgatgtttgtgaaggagtacttcaagctgtgtcccgagaacttccgggatgaagacgtgtttgtgtgcgaatctaggtactccgccaaaaccaagagctttaagaaaataaaattatggacaatgcccatcagctccgtacgattcgtaccccgagatgtaccgcttcccgttgttagagtggctagcgtcttcgcaaacgccgacaagggtgacgatgagaaaaataccgataactccgaagactctagagcggaggacaatttcaacctggagaaagaaaaggaggacgtcccagtggagatgtccaatggagagcccggctgccattatttcgaacagctccattataatgacatgtggttgaaagtgggggattgtgtctttattaaatcgcacgggctggttagacctagggtggggcggatagagaaagtttgggtgcgcgatggagcagcctacttttatggccctatttttattcatccagaggaaactgaacatgagcctactaagatgttctacaaaaaagaggtctttctcagcaacctggaagagacctgcccgatgacttgtattcttggtaaatgcgccgtcttatcgttcaaggacttcctgtcttgccgccccaccgagataccagaaaacgacattcttctgtgcgaaagtaggtataacgagtccgacaagcagatgaagaaattcaaaggtctgaagcggtttagtctgtccgctaaagtggtggacgatgaaatttattattttcggaagcctattgtgccacagaaggagccctctcctttattggagaagaagatccagttacttgaggccaagtttgccgagttggagggaggagatgacgacattgaggaaatgggggaagaggattcagaaagtaccccaaaaagcgctaagggaagtgctaaaaaggaggggtcaaaaaggaagatcaatatgtcaggctatattctgttcagctctgaaatgagggcagtgatcaaggctcagcaccctgattactcgttcggggaattgtcacgactcgtcggaactgaatggcgcaacctggagactgccaagaaagctgaatatgagggaatgatgggcggctacccccctggtttaccacctcttcagggacctgtcgacggactagtttccatgggatcaatgcagccccttcatcccggaggccctccaccccaccatctgccacccggtgtgccaggactacccggaatccctccccccggagtcatgaaccagggtgtcgcaccaatggtcggtaccccggcccctggcggtagcccatacggtcagcaagtgggcgtgcttggcccccctggccagcaggcaccccctccttatccgggaccgcatccggcaggaccaccggtcattcagcagcctacaacacctatgttcgtagctcctcctccaaaaacccaaagactgctccatagcgaggcctaccttaagtacatagagggactctctgcagagtctaattctatctcaaaatgggatcagactctagccgcccggcgaagggatgtgcacctatccaaagaacaggaaagcagactgcctagccactggctcaagtccaagggcgcccatactacgatggctgatgccttatggcgacttagggatctaatgctccgcgatacactgaatatcagacaggcgtacaatctcgagaatgtgtag

SEQ ID NO: 199974 - DNA, 4905 bp, Artificial Sequence
  Description of Artificial Sequence: Synthetic coding sequence
atgggcagcaagcggcggcgggccaccagccccagcagcagcgtgtctggggactttgatgatggtcaccacagcgtgtctacacccggcccctctaggaagcgacggagattaagcaacctgcctacagttgatccaatcgctgtgtgccacgagttgtacaataccattcgcgattacaaggatgagcagggaaggcttctatgtgagctgttcatccgggcccctaagcgcaggaatcagcctgactactacgaggttgtttctcagcccatcgatttaatgaagatccaacaaaaattgaagatggaagaatatgatgacgtcaacttactgactgctgacttccagctgttattcaataatgcaaaatcctactacaagccagactctcccgagtataaagccgcatgtaagctgtgggatctttacctgcggactagaaatgaatttgtgcaaaagggcgaagccgacgatgaggacgatgacgaggacgggcaagataaccaaggtaccgtcacagagggctcatcccccgcataccttaaggaaattcttgaacagcttctggaagcgattgtcgttgccactaacccgtctggccgccttatttctgagctgtttcagaagcttccctcaaaggtccagtatccagattattatgctatcatcaaggaaccaatcgacctgaagactatcgcgcagcgcattcaaaacgggtcatataagtctatccatgccatggctaaggacatcgaccttctcgcgaaaaacgcaaaaacctacaacgagcccggatcccaggtgtttaaagatgccaattctatcaagaaaatcttttatatgaaaaaggccgaaattgagcatcacgaaatggctaagagcagcctgcggatgagaaccccaagtaacctggcagcagcacggctaacaggaccctctcattcaaaagggtcactgggtgaagagcgaaacccaacctcgaagtactataggaataaaagggccgttcaggggggcagattatctgcaatcaccatggccctgcagtacgggtcagagtctgaggaggacgcagccttggcagccgcgaggtatgaggaaggcgagtctgaagcagagtccataacctcctttatggacgtgagcaaccctttctaccagctttacgacaccgtccgctcctgcaggaacaatcaagggcagctgatcgctgaaccattctatcatctgccctccaaaaaaaagtaccccgattactatcagcagatcaagatgcccatttcccttcaacagatacggaccaagctgaaaaatcaagagtacgagacgttggatcacctggaatgtgatctgaacttaatgttcgagaacgccaaacggtacaacgttcctaactccgcaatttataaaagggtgctgaaactgcagcaggttatgcaggcaaaaaaaaaagaactggcacgtcgagatgacatcgaagatggggactctatgatctcctctgcaacctccgacactggatccgctaagcgcaagtccaagaagaacatcaggaagcaaaggatgaaaattctattcaatgtcgtcctagaagcaagagagcctggcagcggtcgaaggctgtgcgatctgtttatggtgaaaccaagcaagaaggactatccggactactataaaatcatattggaacctatggatctgaagattatagagcacaatatcagaaacgataagtacgccggagaggagggaatgatcgaagacatgaaactaatgtttaggaacgctaggcattacaacgaagagggtagccaggtatacaacgatgcccacatactcgagaaactgctcaaggagaaacggaaagagttgggacctttgccggatgatgacgatatggcctctccgaaactgaagctgagccgcaagagcggaattagcccgaaaaaatctaagtacatgacccccatgcagcagaaactgaacgaagtatacgaagccgttaagaattacactgacaaacgcggcagaagactgtcggccatattcctgagactgccaagcaggtccgagctccccgattactacctgaccatcaaaaaacccatggatatggagaagattcgcagccatatgatggccaacaagtatcaagacatagactctatggtagaggatttcgtcatgatgtttaataatgcctgtacatacaacgagccagagtctctgatttataaagatgccctggtgttgcataaagttctattggagacccgtagagacctcgaaggcgatgaggactcacacgtccccaacgttaccctgctgatccaagaactgatccataatctgttcgtatccgtgatgagccaccaggatgacgagggccgttgctattcagattcattggccgagatacctgcagtcgaccccaattttcccaacaaaccaccactcacgtttgatatcattcgaaagaatgtggaaaacaaccgctatcgcagacttgatctgtttcaggagcacatgttcgaggttctggaaagggcccgacgaatgaaccgaaccgactccgaaatttatgaagacgctgtggagctgcagcagttcttcataaaaatccgagatgagctgtgtaagaacggggaaatactgctgtcaccagccctaagctataccaccaagcatctgcacaacgatgtggagaaggagcggaaagagaagctcccaaaggaaatagaagaggacaaactgaaaagagaggaagagaagcgcgaagctgagaagtccgaggacagttccggcgcggccgggcttagtggcttgcatcggacctacagtcaagattgctcattcaaaaatagcatgtatcacgtgggagattatgtgtatgtggaaccggccgaggcaaacctgcagcctcatatagtgtgcatcgaacggctctgggaggacagcgcaggggaaaagtggctctacggatgttggttctatagacctaacgaaacattccatctcgcgacaagaaaattccttgagaaggaagtgtttaaatcggactactacaacaaggtgccggtcagcaaaatcttgggaaagtgtgtggttatgttcgtgaaagagtacttcaagctgtgtcccgagaacttccgcgacgaggacgtgttcgtctgcgaaagccgctatagcgctaagactaagtcattcaagaagataaagctgtggacgatgcccatctctagtgtaagatttgttcccagggatgttcctctgccagtggtgagggtcgcttctgtattcgcaaacgcggacaaaggagatgacgagaagaatacagacaattccgaggactcacgggccgaagataacttcaacctcgaaaaggaaaaggaagacgtgcctgtcgagatgtccaacggggagcccggctgccattattttgagcagctgcattataatgatatgtggttaaaagtgggcgactgcgtgtttattaagtcccacggtctggtgcggcctcgggtcggacggatcgagaaggtctgggttcgggacggtgctgcttatttttacggccctatattcattcatcccgaagaaacagaacatgagcccactaaaatgttctataaaaaagaagtgttcctgagcaatctggaggaaacctgtccaatgacttgcatactgggaaagtgtgccgttctctcttttaaggattttcttagctgtagacctacagagattcctgaaaatgatattctcctgtgcgaaagtcggtacaacgagagcgataagcagatgaagaaatttaagggattaaagcgctttagtttaagcgccaaagtggtggacgacgaaatctactacttcaggaaacccatcgttccacagaaggagccatccccgttactggaaaagaagatccagctgttggaagcaaagtttgcggaactcgagggaggggacgacgacatcgaagagatgggcgaggaggattccgaggtcatcgagccccctagtctgccccagttacaaactcccttggcaagtgaactggacctcatgccatacactccaccacaaagcactcctaagagtgctaagggatctgccaaaaaagagggatccaagcgaaagattaatatgtcagggtacatattattctcgtccgaaatgagagccgtgattaaggcgcagcatccagactacagttttggggagctctccaggttggtcggcaccgagtggcgaaatctagagaccgccaagaaggcggaatacgaaggcatgatgggcggatacccaccagggcttcccccactccaagggcctgtcgacggtttggtgtccatgggatcaatgcaacccctgcaccccgggggtccacctccccaccatctcccccccggtgtccccggtttgcccggtattccaccccccggggtaatgaatcagggcgtagccccgatggttggcacacctgctcctggcggcagtccatacggacagcaggtgggggtcttagggccacctggccaacaagctcctcctccttacccagggcctcaccccgcagggcccccagtaattcaacagccaactacgccgatgttcgtggccccccccccaaagactcagcgcttactgcactccgaggcatatctcaagtacatcgaagggctaagcgccgaatcgaattctatctctaaatgggatcaaaccctcgccgcgagacgccgcgacgtgcatctgagtaaagaacaggagtccagactgccgtctcattggctgaaatctaaaggcgcccacactacaatggccgacgccctttggaggcttcgggacttaatgctgagggacaccctaaacatccggcaggcgtataatttggagaacgtttag

SEQ ID NO: 199975 - DNA, 459 bp, Artificial Sequence
  Description of Artificial Sequence: Synthetic coding sequence
atgggcagcaagcggcggcgggccaccagccccagcagcagcgtgagcggtgatttcgacgacgggcatcactcagtctccacacccggtccttctaggaagaggaggcgcttgtcaaatctgccaacagtcgaccccattgccgtgtgccatgagttgtacaatactattcgcgattacaaggacgaacaggggcggctgttgtgtgagctgttcattagggcaccgaaaaggcgtaaccagccagactattatgaggttgtgagtcaacctatcgacctgatgaaaatccagcagaaattgaaaatggaagaatacgatgatgtgaacctgctcacagccgattttcaactcctatttaataatgccaaatcctactataagcccgacagcccggagtacaaggccgcatgcaaattgtgggatttgtaccttcggacaagaaatgaattcgtatag

SEQ ID NO: 199976 - DNA, 81 bp, Artificial Sequence
  Description of Artificial Sequence: Synthetic coding sequence
atgggcagcaagcggcggcgggccaccagccccagcagcagcgtgtccggagattttgatgatggccaccactcggtgtag

SEQ ID NO: 199977 - DNA, 693 bp, Artificial Sequence
  Description of Artificial Sequence: Synthetic coding sequence
atgggcagcaagcggcggcgggccaccagccccagcagcagcgtgagcggagactttgacgatggccatcacagcgtatctacacctgggccatcaagaaagcggaggagacttagcaatcttcccactgtcgatcctatcgccgtatgtcacgagctctacaacactatacgagactataaagatgaacaaggtcgcctcctctgcgagctgttcatccgtgcccccaagaggaggaatcaaccagactattatgaggtcgtgagtcagcccattgatcttatgaaaattcagcagaagctaaaaatggaagagtacgacgatgtgaatctgctgaccgcagacttccagttgttatttaataatgcaaaatcatactataaaccagactctcctgagtataaagcagcttgcaagctctgggatctctatctgcgaactcggaacgaattcgtacagaagggagaagctgacgacgaagacgatgatgaggacggtcaggacaaccaggggaccgtgaccgaggggagttccccagcatatctcaaagaaatcctggagcagttactagaggctatcgttgtggccaccaaccccagcgggcggctgatctctgaactgtttcagaaactccctagcaaggttcagtatcctgattactatgcaattattaaggaacccattgatctgtag

SEQ ID NO: 199978 - DNA, 132 bp, Artificial Sequence
  Description of Artificial Sequence: Synthetic coding sequence
atgggcagcaagcggcggcgggccaccagccccagcagcagcgtgtcaggcgattttgacgatggccaccactccgtgtcaacccctgggccctcacggaagcgcaggcggctctcaaacctgcccacatag

SEQ ID NO: 199979 - DNA, 357 bp, Artificial Sequence
  Description of Artificial Sequence: Synthetic coding sequence
atgggcagcaagcggcggcgggccaccagccccagcagcagcgtgagtggggactttgacgacggacaccactctgtgagtacgcctgggcctagccgcaaacgacgtagactttcaaatctgccaaccgtagatccaatcgccgtgtgtcacgaactgtacaacaccatacgtgactacaaggatgagcagggtcgactcctgtgcgagctgtttatcagagctccaaaacgaaggaaccaacctgactattatgaagtcgtgtcacagccaattgacctaatgaaaatacaacagaagctcaaaatggaggaatacgatgatgttaatttgcttaccgcggatttccagttatag

SEQ ID NO: 199980 - DNA, 264 bp, Artificial Sequence
  Description of Artificial Sequence: Synthetic coding sequence
atgggcagcaagcggcggcgggccaccagccccagcagcagcgtgagcggtgatttcgacgatgggcatcactccgtctccacacccggtcccagtagaaaacggcgccggctctcaaatctgcccactgtggacccaattgctgtgtgccacgaactctacaacacaatccgggactacaaggacgagcaagggaggctactgtgtgagctctttatccgagctcccaaaaggagaaatcaaccagactactacgaagtgtag

SEQ ID NO: 199981 - DNA, 132 bp, Artificial Sequence
  Description of Artificial Sequence: Synthetic coding sequence
atgggcagcaagcggcggcgggccaccagccccagcagcagcgtgtctggtgatttcgatgatggacatcactcggtctctacccccgggccttctcggaaaaggagacgactgtccaacttgccgacatag

SEQ ID NO: 199982 - DNA, 828 bp, Artificial Sequence
  Description of Artificial Sequence: Synthetic coding sequence
atggagggcgtggccgtggtgaccgccggcagcgtgggcgccgccaaaactgaaggcgccgcagccctccctcctccaccaccggtatcacctcctgccctgaccccagcgcctgcggccggtgaagagggtccagccccactgtctgaaaccggcgcgcccgggtgttccggatctcgaccgccagagctggaaccagaacgcagcctcggacggttccgcggtagatttgaagacgaggacgaggaattggaggaagaggaggaactcgaagaggaagaggaggaggaggaggaggatatgtcccacttctctctccgactagaggggggtaggcaagattctgaggacgaagaggaaaggctcattaacctatctgagcttacaccctacatcttgtgcagtatatgcaaaggctacctgatagatgccaccaccatcacagagtgcctgcacacattttgtaaaagttgtatcgtaaggcacttttactactcaaaccgctgtccaaaatgtaacattgtggtgcatcagacccagcctctgtacaacatcagcgcgaatgagggcaccggtcacttcaagcctttggaaaagaagtttgtgcgggtcagcggagaagcaactatcggccacgttgaaaaatttttgcgcaggaagatgggactggaccctgcttgccaagtcgatatcatctgtggtgaccatctgctggaacagtaccagaccctgagggagattcggcgggcaatcggcgatgctgctatgcaggacggacttctggtgctgcactatgggctggtcgtgtccccactgaagatcacctag

SEQ ID NO: 199983 - DNA, 1053 bp, Artificial Sequence
  Description of Artificial Sequence: Synthetic coding sequence
atggagggcgtggccgtggtgaccgccggcagcgtgggcgccgccaagaccgaaggagcagcagctctgccaccccctccacccgtctcccctccagcacttactcccgcccccgcagcgggagaagagggccccgccccactttccgagaccggcgcgccaggctgcagcgggtcccggccacctgagctggagcccgaacggtccttgggtcgattcagagggcgtttcgaggatgaagatgaggaactggaggaagaggaggaactggaagaggaagaagaggaggaggaggaggatatgagccactttagcctgcgtttagaaggagggaggcaggattcagaggatgaggaggaacgccttattaacctgagtgagctcacaccctacattctctgcagtatttgtaaaggctacttaattgacgctacaacaattactgagtgtctgcacacgttctgtaagtcgtgcattgtccgccacttttactatagcaacagatgccctaaatgtaacattgttgtccatcagacgcaaccgctctacaacatccgcctggatcggcagctgcaggacattgtgtacaagttagtgattaacttggaagagagagagaagaaacagatgcacgacttctataaagagagggggctggaagtcccgaagcctgcagtgccccagcctgttccttcctccaagggtagatccaagaaggtcctggaatccgtgtttcgcattccccctgagctggacatgtccttgctgttagaatttataggagctaacgaaggaacaggacactttaagcccctcgagaagaagttcgtgcgggtgagcggggaggccaccattggccacgtggaaaagtttttgcgcaggaaaatggggctggacccggcttgccaggttgacataatttgtggagaccatttgcttgaacagtaccagactctccgcgaaattaggcgggccattggtgatgcagcaatgcaggacggattactggtactccactacggtctggtcgtctccccccttaagatcacctag

SEQ ID NO: 199984 - DNA, 10191 bp, Artificial Sequence
  Description of Artificial Sequence: Synthetic coding sequence
atgaccgcctggctgatcagcctgatgagcatcgaggtgctgctgctggcggtccggcatctctccctccatattgaaccagaagaaggctctcttgcagggggcacctggatcacggtgatctttgacgggttggagttgggggtgctctaccctaataacggctcccaactggaaatacatttggtgaacgtgaacatggtcgtgcccgcactgcggtccgtgccgtgcgatgtgttcccagtcttcctcgacctgcccgtggtgacctgccgcacccggtccgtactttcagaggcgcatgaagggctgtatttcctcgaagcgtacttcggaggacaactggtgagctcacctaatcctggacctcgtgactcctgtacatttaaattctccaaagcccagacgccaattgtgcaccaagtgtatcccccaagtggtgtgcctggaaaattgatacacgtttacggatggatcatcactggaaggctggagactttcgatttcgatgcagagtacattgacagtcctgtgattcttgaggcccagggtgacaaatgggtgaccccttgtagcttgatcaatcgacagatgggaagctgctaccccatccaggaagaccacggcctgggcaccctgcagtgtcacgtggaaggtgactatattggctcccagaacgtgtcattttcggtattcaacaagggtaaatccatggtgcacaagaaggcctggctcatttccgccaaacaggatctgttcctgtaccaaacccactccgaaatcttatccgtgttccccgaaactggctccctgggcggacgaaccaatatcactatcacaggcgatttctttgacaattctgcccaggtaactatagcggggatcccttgcgatatccgtcacgtgtccccaagaaaaatcgaatgtaccactagggcaccgggcaaagatgtgcgcctgaccaccccccagcccgggaatcgcggcctgctttttgaagtgggtgacgctgtggaaggactcgagcttaccgaagctacccctggttatagatggcaaattgtgccaaacgctagctcccccttcggcttctggtctcaggaaggtcagcccttcagggcccggctcagtggcttttttgtggccccagaaactaataactacaccttttggatccaagccgacagccaagctagcctccactttagctggtcggaggaacctagaacaaaagtgaaagtcgcgtctatttccgtcgggacggcagactggtttgatagctgggagcaaaaccgcgatgaaggtacatggcagcagaagaccccaaagctggaattactgggcggcgcgatgtactatttggaagcagaacatcatggaattgcaccctcccgcgggatgagaatcggcgtccagattcacaacacctggctgaaccccgatgtcgtgaccacataccttcgcgaaaagcaccagatccgggtccgggctcaaaggctgcctgaagtgcaagtgcttaatgtgtccggacgcggtaacttttttcttacttgggataacgtgtcatcgcaacctattccagcaaacgccaccgctcacctaatccagaccaccatcgaagagctgctcgcggttaaatgcaaactggaacccctttggagcaacatcttgttgcggttgggcttcgagcgcggacccgaagtttctaattctgacggggaccttactagcggaaccgaacctttttgcgggcggtttagtctaaggcagccacggcacttggttctcacacctccagcggcccagaagggctatcggctggaccagtacacccacctttgcctggcatacaagggtcacatgaataaaatactcaaaatgatcgtgtcattcacaatcggttttcagaacatggtcaagaatactacctgtgattggtcactgacccggacttctcccgagtcatggcagtttgattgcacagatctgtgggagacctgcgtcagatgttttggcgacttacagccgccccccgctaactcccctgtgttggtccaccagataaatctgctgcccctggcccaggagaccggactgttttatgtggatgaaattataattgccgatacgaatgtcactgtatctcaggctgattctgggacggctcgaccaggaggcaatctggtggaaagtgtctctgtcgttgggagcccacccgtgtactctgtgacctcttggctggcaggttgtggcaccgaactccctctcataaccgctcggtctgtgcccaccgaagggacagaggaggggtctggactggtcctcgttaccactcagcggaggcaaagaacgtctcctcctcttggagggcactttcgtatacagctgccgaataccgtcatctcagacgttcctgtgcagatcagtgcccatcacctgcatcagcttcttcagaacaatgcagacgacttcacatctaggtacctgaatgcctccgatttcactgtgaaagaggacctgtacacctgctacgaacacgtgtggaccttaagttggtcaacacaaattggtgacttacctaatttcattcgggtgtccgacgagaatcttaccggcgtcaacccagctgccgctaccagagtggtatatgatggaggggtgtttctgggcccgatttttggtgacatgctggctaccgccaaccaacatacccaggtcgttgtcagagtaaatgatgtaccagctcactgtcccggaagttgctctttccagtacctgcagggcagcactccctgcgtccacagcgtgtggtatagcatcgacggcgatattaacctcatgatttatataacaggtacgggcttttctggggacagccagtttttacaagtgacagtcaataaaaccagttgcaaggtcatctttagtaatcagacaaacgtcgtttgccaaacagacctcctacccgtaggaatgcatagaattctgatgctggtcagacccagtggactagccatcagcgccactggcgaggacctctttctcaatgtgaaacccaggttagacatggtggaaccttctcgcgctgccgatatcggcggactatgggcgacaattaggggtagctcactggaaggagtatccctgattttgtttggctcctacagttgcgcaatcaacgtggccaccagtaatagctcccgcatccaatgcaaggtcccgcctagaggaaaagacggccgcatagtgaacgtgacggtgatccgtggggactactccgctgttctgccccgggcttttacctacgtgagcagcctgaatcccgtgattgtgaccttaagtcgtaatatctccaatatcgcggggggggagactcttgtgataggcgtcgcccgcctgatgaactacaccgacctggatgttgaggttcacgttcaagatgccctggctccagtacacactcagtcggcctggggattagaggtggcactgccccctctccctgcaggcctgcaccggatttcagtttccattaatggggtgtccatacatagccagggcgttgaccttcatattcaatacctgacggaggtcttctctattgagccctgctgcggctctctgctgggcggcacaattctttcaattagcgggataggtttttccagagaccccgctctggtctgggtgctcgtgggcaaccggtcctgcgacattgtgaatcttactgaggcaagcatctggtgtgagacgctgcccgctccccaaattcccgacgccggcgcaccaacagtgcctgcagcagtagaggtctgggcaggtaaccgatttttcgccaggggcccatctccctcgctggtggggaaaggctttacgtttatgtacgaagccgctgcgacgcctgtcgttaccgccatgcagggggagatcacaaatagtagtctctcactgcatgtaggagggagtaatctgtccaattcagtgattctattgggcaaccttaactgcgacgttgagactcagtctttccaggggaatgtgtcgctctccggttgctcaatccccctccatagccttgaagcggggatatacccactccaggtgagacagaaacagatgggattcgccaatatgtccgtggtgttacaacagttcgccgtgatgccgcggattatggctatcttcccatctcagggcagtgcctgtggcgggactatcctcactgtcaggggcctgctcttgaattcccgacgaagatcagtgcgagtagatctttcaggcccattcacttgcgtaattctctcgctgggggatcacacgatcctttgccaggtcagtttggagggtgatcctctccccggtgcctcgttcagtttaaacgtcactgttctagttaatggcctcacttccgaatgtcaagggaactgtacactttttatacgagaggaggccagccctgtgatggatgcactgtctaccaatacgtcaggctcactgacgacggttctgatcagggggcaacgacttgcaactaccgccgacgagcccatggttttcgttgatgatcagctgccttgtaacgtgacctttttcaatgcgagccacgtagtgtgtcagacacgggaccttgcccccgggccccactacctgagtgtgttttatactcgcaatggatacgcctgctcagggaacgtgagcaggcacttctacatcatgcctcaggtgtttcactacttccctaagaactttagccttcacggaggttcacttcttacaatagagggcactggcctgagaggccaaaatacgacaagcgtgtatattgatcagcaaacctgcctcaccgtgaatatcggggcagagctgattcgctgcatcgtcccgaccggtaacggatccgtggcactggagattgaggtggacgggctctggtatcatatcggcgtgattggttacaacaaggcttttacgcctgagctgattagcatctctcaaagcgacgatatcctgaccttcgctgtggcgcagatcagcggcgccgctaatattgacattttcattggtatgtctccatgcgtgggcgtttcaggtaatcacaccgtgctgcagtgtgttgtaccatccctgcccgcaggtgagtatcatgtgagggggtatgactgtatccgcggttgggcatcctcagcactggttttcactagtcgagtcatcatcaccgctgtaacagagaattttgggtgccttggaggaaggctcgtgcacgtgtttggggccggcttctccccaggcaatgtgtcagctgccgtgtgtggagctccttgccgcgtgttggcaaatgctactgtaagcgcgttcagctgcttagttctgcccctggatgtctctctcgcttttctctgcggtctgaagcgcgaagaggatagctgcgaagcagccagacatacctatgtgcaatgcgacctgactgtggccatggccacagagcaattgctggagagttggccttacttgtacatctgcgaggaatctagtcagtgcctcttcgtgccagaccattgggcagagtcgatgttccccagcttcagtggcctatttatctctcctaagctggaacgtgatgaagtcctaatatacaattcttcttgcaacattacgatggaaacagaggcagaaatggaatgtgagacccccaaccagcctatcaccgtgaagatcacggagatacggaaacgctggggccaaaacactcaaggaaatttctcactgcagttttgccggagatggtcaagaacacactcatggtttcccgagaggctcccgcaagacggcgacaacgtgaccgtggagaacggccagctcttgctgttggacaccaacacaagcatcctaaacctgctgcatatcaagggaggaaaacttatatttatggcccccggaccgatcgaacttagggctcacgccatccttgtttcagatggcggagagttgcgcatagggtccgaagataaacccttccaagggcgagctcagattaccctgtatgggagcagttactcaaccccattctttccttacggcgtgaaattcttggccgtgagaaatggtaccctgtcactgcacggcagcttacctgaggtcattgtgacctgtctgcgggctacagcccacgcgttggacactgtgttggccctcgaagacgccgtggactggaacccaggcgatgaggtggtcatcatcagcggcacaggcgttaagggggccaaacctatggaggaaatcgtgacagtcgagacggtccaggacaccgatctatacttgaagtcccccctgcgatatagtcataacttcacggaaaattgggtcgcaggagagcaccacatcctgaaggccaccgtggcgctgctctcaaggagcatcacaatacaggggaacctcaccaacgaacgagagaaattattggttagttgtcaggaggccaacgcccctgaagggaatttgcagcattgcctgtactctatgtccgaaaaaatgctcggatccagagatatgggagctcgcgttattgtccagtcctttcccgaggagccaagtcaggtgcagctgaaaggcgtgcaattccaggtgctggggcaggcgttccacaagcacctgagctcattgacattggtgggggcgatgcgagagagttttatccaaggatgtaccgtcagaaacagctttagccgtgggctcagcatgtgcggtactctggggctgaaggtggattctaatgtgttttacaacatcctcggccacgccctgctagttggcacctgtacggaaatgcgctatatcagttgggaggctatacacgggcggaaggacgattggtccggtcacggcaacatcattaggaacaacgtcatcattcaagtgtccggcgctgaaggattgagtaatccagagatgctcaccccttccggtatttatatatgttcacccacgaatgtcatcgaaggcaatagagtgtgcggggccggctacggttattttttccatctgatgaccaaccagactagtcaagcgccactgttgtctttcacccagaacatcgctcattcttgtaccagatacgggctgtttgtctaccccaagttccagcctccttgggataacgtcacaggcactaccctgttccagtctttcacagtttgggagagtgctggcggggcgcaaatatttcgcagttccaatcttcgtttaaaaaattttaaagtatactcctgccgggactttggcattgacgttttggagagtgatgctaatacgtccgtgacagactccctgcttctggggcactttgctcacaaagggtccctctgtatgagctcgggcatcaagacccctaagaggtgggaactgatggtttcaaacaccaccttcgttaactttgatttaatcaactgtgttgccatacggacctgttccgattgctcccaaggccagggtgggtttacagtgaagacgtcacagctgaagttcaccaattcatctaacctcgtggctttccccttcccccatgccgccattctcgaagacctggatggctctctcagtggcaagaataggtctcatatcctggcctctatggagacgttgagtgcctcttgcctcgtgaactccagcttcggcagagtcgtgcacggaagtgcctgcggtggtggggtccttttccatagaatgtcaatcggattggcaaacactcctgaggtaagctacgacctgacaatgacggattcacgtaataagaccaccacagtgaattatgtgagagatacactgtccaatcctcgcgggtggatggctttgctgctcgatcaggaaacctattctctgcagtccgagaacctgtggatcaatagaagccttcagtattcagcaacatttgacaacttcgcacccggcaactatttgctcctcgtgcacactgatctgcctccgtatcccgatattctgctgcgctgcggctccagggtgggactgtcgtttcctttccttcctagccctggccagaatcagggctgtgactggttcttcaatagccaattgcgccagctgacctatctagtctcgggagaagggcaggtgcaggtcatcctgagggtgaaagaagggatgccacccacgatcagcgcatctacatccgcacctgagagcgcattgaaatggagcctgccagagacttggcagggcgtggaggaaggttggggtggatacaacaacacaataccaggaccaggagatgacgtcctgatcctgccaaaccggaccgtcttagtggacactgatctgcccttcttcaagggactgtatgtcatgggaaccctcgattttcccgtcgaccgttcaaacgtgctaagcgtggcttgcatggtgatagctgggggggagctcaaggtggggactctagagaacccattggagaaggagcaaaagctgctaatcctcctacgggcctctgaaggcgtcttttgtgaccgcatgaatggtatccacattgatcctggaacaatcggggtctatggaaaggtccacctatactctgcctatccaaagaattcgtggacccatctgggcgccgatattgcatctggaaatgagagaatcattgtcgaggatgctgtggactggaggcctcacgataagatcgtactgagctctagcagctacgagccccacgaagctgaggtacttaccgtgaaggaggtgaagggtcaccatgtgaggatctatgaaaggcttaaacacaggcacattggtagcgtccacgtcaccgaggatggcaggcatattcggctcgcagcggaggtaggcctattgacacgcaatatacagatccagccagatgtttcatgccgcggcagactctttgtggggtcattccggaagagttcccgggaagaattctcgggagtgctgcagctgcttaacgtggagatacagaattttggaagccccctttactcaagcgtagaattctccaatgtgagtgccggctcttggatcatctcctcaaccttacaccagtcatgtggtggtgggatccacgcagccgcctctcacggggttctgctgaacgacaacatcgttttcggcacagccggccatggcatagatttagagggccaggcgtacactgtgactaacaacctcgtagtccttatgactcaacccgcctggagcacaatctgggtggctgggataaaggtaaaccaggtaaaggatatcaacttgcacggaaacgtggttgctggcagtgagcgcctggggttccacattcgcggccataaatgttcgagttgcgagttattgtggtcggacaacgtggcccactcaagtctccatggcctacatctctacaaggagagcggtctcgacaactgcacccgaatatctggctttcttgccttcaaaaatttcgattatggggctatgttacatgtggagaactcggtggagatcgagaacatcactcttgtggacaacacaattggtctgctggccgtcgtatatgtattctcagctccgcaaaacagcgtcaagaaggtgcaaattgtgttgaggaactccgttattgtagccacatcatcttccttcgattgcattcaggacaaggtcaagccccacagtgccaacctgactagcaccgatagggccccatccaatccccgaggggggcgtataggcattctctggcccgtcttcacaagtgaacccaatcaatggcctcaagaaccatggcacaaagtgagaaacgatcactcgatcagcggaatcatgaagttgcaggacgtcacattcagtagcttcgtgaaatcctgctattcggatgacctggacgtgtgcatcctcccaaatgcggagaattctgggattatgcacccaatcacagctgaacggacacggatgctcaagataaaagataagaacaagttctatttccctagtctgcagcctagaaaagatctgggcaaggtcgtgtgccccgaactcgactgcgcgtctcccagaaaatacttatttaaagacctcgacggccgtgcactgggacttccgcctccagtttcggtgttccccaagacagaagccgaatggacagcctcattctttaatgccgttacgactgaacaggctttaaagatttccgagtag

SEQ ID NO: 199985 - DNA, 12225 bp, Artificial Sequence
  Description of Artificial Sequence: Synthetic coding sequence
atgaccgcctggctgatcagcctgatgagcatcgaggtgctgctgcttgctgtgaggcatcttagtctccatatcgagcccgaagaggggtctctcgcgggcgggacatggatcaccgtcatatttgatgggctggaactcggggttctatatccgaataatggatcacagttggaaattcacctggtaaacgtgaatatggtcgtccccgcactgcggagcgtgccatgtgatgtgttccccgtgttcttagatctccctgttgtgacttgccgtacccgctctgtgctgagcgaggcacatgagggcctctatttccttgaagcctacttcggtggccagcttgtttctagcccaaacccaggtccccgggattcctgcacctttaaatttagtaaagcccagacacctattgttcatcaggtgtaccctccgagcggggtccctgggaagttgattcacgtgtacggctggattatcacgggcagactggagacctttgacttcgatgccgaatatattgacagtcctgtgatccttgaggctcagggcgacaaatgggtgacaccctgctcactcattaaccgccagatgggctcctgctaccccatccaggaggatcacggcctgggcaccttacagtgtcatgtagaaggcgactacataggctcccagaacgtttcctttagcgtgttcaataagggcaagtctatggttcataaaaaggcgtggctcatatccgcgaagcaagacctcttcctctaccagacccacagcgagattctgtctgtgttcccggaaacaggaagcctgggcggacgtacaaatattactattacaggtgactttttcgacaatagcgctcaagtcacgatagctggtattccatgtgatattcgtcatgtctctccacggaagattgaatgtactaccagagcccccgggaaggacgtccgcctgacaactccgcagcccggcaaccgcggcctgttgttcgaggtgggggacgcggtggaaggcctggaactcacagaggcgacccccgggtacagatggcagattgtgcccaacgcatcgagtccgtttggcttttggagtcaggaaggacagccctttagagcacgactcagcggattttttgttgccccagaaaccaataactacacattttggatccaggctgattcccaggcttcactccacttttcttggtccgaggagccccggaccaaggtcaaggtcgcctccatttctgtcggtaccgccgactggtttgattcatgggagcagaaccgagacgagggaacgtggcagcagaaaacccccaagctcgaattgctgggtggcgcgatgtactatttggaagctgagcaccacggcatcgcgccctcaaggggtatgcgaatcggggtacagatccataacacatggctgaatccagatgtggtgacgacctatttacgagaaaaacatcagataagagtgagagcccagcggcttccagaggtgcaagtgcttaatgtcagtggaagagggaatttctttctcacctgggacaatgtgtccagtcaaccaatccctgctaatgcaaccgcccacctgattcagacaactattgaggaactgctcgccgtcaagtgtaagctggagcccctttggtcaaatatacttctgcgcttgggattcgagagaggacctgaagtgagcaatagtgatggcgatttgacatccggcaccgagcctttctgcggaagattttccctgcgtcagcctaggcacctggtgctgacgcctcctgcagcccagaaaggctacaggttggatcaatacacacacctgtgcctcgcatataaaggccacatgaacaaaatcttaaaaatgatagtgtcttttactatcggcttccagaacatggtgaagaacactacttgcgattggagcttaactcgaacttcacctgaatcctggcagttcgattgcacagatctgtgggaaacctgtgtgagatgtttcggcgatcttcagcctccaccagccaacagcccagtgctcgtgcatcagatcaaccttctgccacttgcccaggaaactggcctgttttatgtggatgaaattattatcgcagacactaacgtgacagtgtcccaagctgatagcggtactgcccggcccgggggaaaccttgtcgagtccgtttcagttgttggctctccccccgtgtactcagtgacttcttggctcgccgggtgtggaacggaacttcctctgattaccgcgaggtcggtgcccacggaaggtaccgaagagggctccggactagttcttgtcactacccaacgaaggcagaggacgagtccccccctgggcggtcacttcagaattcagctcccaaacacagtaatttccgacgtacccgttcagatctcagcgcatcacctgcatcaattgcttcagaacaacgctgatgatttcacgtcccggtacttgaatgcttctgacttcaccgtgaaggaggacttgtacacttgttacgagcatgtgtggacactttcatggtctacgcaaattggtgacctgccaaattttataagagtcagcgatgaaaatctgactggggtcaaccccgcagctgcaaccagggtcgtatacgatgggggggtgttcttaggtcctatattcggggacatgctggcaacagccaaccagcacacccaggtggtcgtgcgcgtcaatgacgtccccgcccattgccccgggtcgtgctcctttcagtatttacagggcagcacaccctgcgtccactccgtttggtactctattgacggagacattaatctgatgatttacattacaggaacagggttctctggggacagccagtttctgcaggtgactgtgaataagacttcttgtaaggtgatcttctccaaccaaaccaacgtcgtctgccagactgatcttttgcccgtaggaatgcaccggatacttatgctggtgaggccaagtggactggctatctctgccacaggtgaggacctgttcttaaacgtaaagccccgcctggacatggtggaaccatccagggcagccgacatcggcgggctctgggctaccatcaggggaagctccctggagggagtgtcccttatcctgttcggctcctatagttgcgcaataaatgtggccacaagcaacagctcccggattcagtgtaaggtaccaccccgcggtaaagacggtagaatagtgaacgtcaccgtgatacgaggcgattattcggccgtgctgcctagggccttcacttatgtgtcttctttgaatccagttattgtgacactgtctcgaaacatttcgaacattgccggcggagagaccctagttataggtgttgcccgcttgatgaattataccgacttggatgttgaggttcatgttcaagacgcccttgccccagtgcatacccaatcagcctggggactcgaggtggcgttgccacccctcccagcgggtctgcatcggataagcgtctccatcaacggcgtgtctatccactcccagggagttgacctgcacatccaatacctgaccgaggtcttttcgatagagccatgttgcggttccctgctgggagggactatcctctccatctccggcattgggttttctagagacccagccctggtatgggtgctagtgggcaatagaagctgcgatatcgtcaatcttacagaagcaagcatttggtgtgagacactgcccgccccccagattcccgatgcaggggcccctaccgtgccagccgccgtggaggtgtgggccggaaacaggtttttcgctcgcggcccatcgccatccttagtcggcaagggttttacgtttatgtatgaagctgcggccaccccggtcgtgactgccatgcaaggagagatcaccaatagttcactctcactgcatgtgggcggatctaatctctcgaactcagtcatcctactgggaaacttgaattgcgacgtagagacccagtcattccaaggcaacgtgagtctgtccggctgctccattccgttgcactctctggaggcggggatctaccccctacaggtgcgacagaaacaaatggggttcgccaatatgagcgtggtgttacagcagttcgccgtgatgcccaggatcatggccatcttcccctctcagggaagtgcctgtggtggaacaatcctcaccgtccgcggcctgcttctgaacagtagacgaaggtctgtgcgagtagacctttccggaccctttacatgtgtcatcctgagcctcggcgaccataccattctgtgtcaggtgtccctcgaaggggacccgttgccaggcgcttccttctcactcaacgtcacagtgcttgtgaacggactcacctcagagtgccaggggaactgcacgctgttcatccgggaagaggcatcgccagttatggatgctttgagtacaaacacaagcgggagcctgactaccgtcctgatcagggggcagcggctcgcaacaactgctgacgagccaatggtattcgtggacgatcaattgccgtgcaatgtgacgttcttcaacgcttcccatgtggtgtgccagactcgggacctcgcgccgggaccccattacctaagcgtgttctacactaggaacgggtacgcttgcagtgggaatgtgagccggcatttctacatcatgccgcaagttttccattatttcccaaagaatttctccctccacgggggctcgttgctaactatcgagggcacagggcttcgtgggcaaaacaccacttccgtctacattgatcagcagacgtgccttacggtgaatataggcgccgagcttatccggtgcattgtgcccacaggaaacggctctgtcgcacttgagattgaggtagatggtttgtggtaccatattggcgtgatcggatacaataaggccttcaccccggagctgatatcaatctctcagtctgacgacattctgactttcgccgtcgcccagatcagcggggccgccaatattgacatcttcatcggaatgagtccatgtgtcggagtttcagggaaccacactgtgctccagtgtgtagtgccctcgctgcccgccggagagtaccacgtgcggggctacgattgcatcaggggttgggcctcgtcagcactggtgtttacatccagggtgattattaccgctgtgaccgaaaacttcgggtgtctgggcggccggcttgtgcacgtgtttggcgccggttttagccctgggaatgtatcagccgcagtctgtggtgccccctgccgcgtattagcaaacgccaccgtatccgcattttcctgtctcgtgttgcctttagacgtgtcactcgccttcctttgtggtctgaaacgcgaggaggatagctgtgaagccgctagacatacttacgtgcaatgcgatctcaccgtcgctatggcaaccgaacagcttctggagtcctggccgtatctttacatctgtgaggaatcttcgcagtgtctgtttgtgcccgaccattgggctgagtcaatgttcccaagtttctccggtctgtttatcagccccaagctggagagggatgaggtgttgatctataatagctcctgcaacattacaatggagacagaggcggagatggagtgcgagactccgaatcagccaattactgtgaagatcaccgaaatccgaaaaaggtgggggcaaaatactcaggggaattttagcctccagttttgccgtcgatggtctcgcacgcattcctggttcccagagaggctccctcaagatggcgataacgttacggtggaaaacgggcagttgttgctcctggacacaaacacgtccatcctgaatctgctacatattaagggtggaaagttaatctttatggcccctggtcctatcgagttgcgggctcatgccatactggtctctgacggcggcgagttgcgaattggaagcgaggataaaccttttcagggcagagcccagatcacactgtatggttcttcttattctaccccttttttcccttacggggtaaaatttttagctgtgaggaatggcacacttagcttgcatggcagtctacccgaggtcatcgtgacttgccttcgcgccaccgctcacgccctggatacagtgcttgccttggaagacgcagttgactggaaccccggtgatgaggtggtcattatttccggcaccggggtgaagggcgcaaaaccgatggaggaaatcgtgactgtggagaccgtgcaggacaccgatctctatttaaaatccccattaagatattcccacaattttactgaaaactgggtggctggagaacatcatatcctcaaagctactgtggctctgctgtcaaggtccatcacaatacagggcaatctgaccaacgagagagaaaaactgctagtgagttgtcaggaggctaacgccccagagggtaatttgcagcactgcctgtatagcatgtctgagaagatgcttggatccagggatatgggcgctagggtgattgtgcagagtttccctgaggagccttctcaagtgcagctgaagggagtccaatttcaggtgctggggcaggcattccataaacacctctcatccctcactctggtgggggcgatgcgggaatcattcatccagggctgcactgtgagaaattcattctccagaggtctttctatgtgtggcactctgggtctcaaggtcgactcaaatgttttctataatatcctcggccacgctctcctcgtcggtacatgcactgaaatgaggtatatttcctgggaggccatccatgggaggaaggacgattggtctggacacgggaatatcattcgaaacaacgtgatcattcaagtgagtggagccgaaggactcagcaaccccgagatgcttacaccaagcggcatttacatctgttcgccaacaaatgtgatagagggaaaccgcgtttgcggagccggttacggctactttttccatttgatgacaaatcagacctcacaggcaccactgctgtccttcacccagaatatcgcgcatagctgcacgaggtacggacttttcgtttacccgaagttccagcccccttgggacaacgtcactggaacaaccctctttcagagcttcacagtgtgggagtctgcgggaggggctcaaatttttcgtagtagcaacttgaggttgaagaacttcaaggtgtactcatgtcgcgacttcggtatcgacgtcttggagtctgatgctaatacctcagtcactgattccctgttgctgggtcatttcgctcataagggctccttatgcatgtcctccggaatcaagaccccgaagaggtgggagctgatggtgagcaatacaacctttgtcaattttgacttaatcaactgtgtggctattagaacgtgcagtgattgttcacagggacagggagggtttactgtgaagacatcccagctgaaatttacaaattctagcaacttagtggccttcccatttccacatgcggccatactggaagacttggacggcagcctgtctggcaaaaatcgctcccacatcttagcttctatggaaacgctgtccgcttcctgtttagtcaacagcagtttcggcagagtcgttcatgggagcgcatgcggaggaggggtactattccatcggatgagcatcggccttgccaatacgcctgaagttagctatgatctgacaatgactgattcgcgaaacaaaaccaccacagttaactacgtgcgagacacactttctaatcctcgtggatggatggctctcctgctggaccaggaaacttacagcctccagagcgagaatctttggattaacaggtctctccagtattctgctacatttgacaatttcgcacccggtaattacctgctgctggtccacactgacctacccccctatccagatatcctgctaaggtgcgggagtagagtgggtctgtcttttccttttctcccttctcccggtcagaatcaaggctgcgattggttcttcaactcacagctgcggcaactcacttacctggtctcaggagagggtcaggttcaagtgatcctaagggttaaggagggcatgcctccgactatcagcgcatctacctcagcccctgagtcagccctcaagtggtctctgcccgagacatggcagggagtcgaggaggggtggggcggttacaacaacaccattccaggacctggtgacgacgtgctgattctcccaaacagaactgtgctggtcgacaccgacctccccttcttcaaagggctttatgtcatgggtacgctcgattttcctgtagaccgaagtaacgttttgtctgttgcatgtatggtaatcgctggcggcgaattgaaggtggggactctggaaaacccacttgaaaaagaacagaaattgctaatcctcctgagggctagtgagggcgtcttctgtgaccgcatgaacggcattcacatcgatccgggcactataggagtgtacgggaaggtacatctttactcagcataccctaaaaattcctggacccaccttggcgccgatattgcttctggcaatgaaagaatcattgtcgaggacgccgtggattggagacctcatgacaaaatcgttctctccagcagctcctatgaaccccacgaggctgaggtgctgaccgtgaaggaggtcaaaggacatcacgtccgcatctatgaacgcttgaagcacagacacatcggtagcgttcacgtaacagaagatggtaggcatattcgattggcagccgaggtggggttgctcactcgcaatattcagatccagcctgacgtgtcgtgtcgcggacggttgtttgtgggcagcttccgcaaatcctcaagggaagaatttagcggagtcctacagctgcttaatgtggagatacagaacttcggatccccgctgtactcctcagtggagttctctaacgtctccgctgggagctggattatatctagcactctgcatcagtcctgcggtggcggaatccacgcggctgccagtcacggcgtgctgttgaatgataatatcgtgttcggtacggcaggccacggcatcgacctggaggggcaggcttacaccgtaactaacaatctggttgtgttaatgacccaaccagcgtggtcaacgatctgggtggctgggatcaaggtaaaccaggtgaaggacatcaatctgcacggtaacgtggtggccggatccgagagactgggctttcatataaggggacataaatgctcatcatgtgaattgctgtggtccgacaacgtagcacacagcagtttacatggcctgcatctgtataaggagagtggcctggacaactgcaccaggatctctggtttcctggcattcaaaaactttgattatggtgccatgctccacgtagagaatagtgtggagatcgagaatataactttggtggacaataccatcgggctgttagccgttgtttacgtgtttagtgctccccaaaacagtgtgaaaaaggttcaaattgtgcttagaaactcagtcatcgtcgccaccagcagctctttcgactgcatacaggataaggtgaagccacactccgcaaacctgactagcacagacagagctccgtcaaaccctcgggggggccgcattgggatcctctggcctgttttcacatcggagcccaaccagtggccgcaggaaccctggcacaaggtgcgcaatgatcattccatctccggtattatgaagctccaggatgtgaccttttcaagcttcgtaaagtcctgttatagtgatgatttggacgtatgtattctgcccaatgcagaaaactcaggcatcatgcatccaataacagctgagagaacccgcatgctcaaaattaaggacaaaaacaaattctattttccctctctgcagccccgtaaggacttagggaaggtggtatgccctgagttggattgtgccagcccgaggaaatatttgtttaaagacctagacgggagggctctgggtctcccaccaccagtctccgtatttccaaagactgaagcagagtggacagcctcattctttaacgccggcacattcagggaggagcagaagtgtacctaccagttcctcatgcaggggttcatctgcaagcagacagaccaggtcgtcctaatcctggacagcgccgacgccatctgggccatccagaagctctaccctgtggtgtctgtgactagcggctttgtcgacgtcttctctagcgtcaatgccaatattccatgttccaccagcgggtccgtttctactttttactccattctccccatccggcagatcaccaaggtttgttttatggatcagaccccccaggttctgagattttttctactcggaaacaaaagcacttcaaagctcctactcgctgtgttttatcatgaacttcagagccctcacgtgtttttgggtgagtcttttatcccgccaacattagtgcaaagcgctagcctcctcctgaatgaatctatcggagccaattatttcaacattatggacaacctgctgtacgttgtgctccaaggggaggaacctatcgagattcgatcgggggtttccatccatctcgcgttgactgtgatggtgtccgtgctcgaaaagggctgggagatcgtgattctggagcggctgactaacttcttacagattggtcagaaccagattagatttatacatgagatgcccggacacgaggaaaccctgaaagcaatcgctgattctcgggcaaaacggaagcgcaattgcccgactgtgacttgcacgagccactaccggagggtcggccagagacggccactgatgatggagatgaattcccaccgtgccagcccgccaatgaccgtggagactataagtaaagtgatcgtcatcgaaattggggacagccctactgtgcggtcaactggtatgatatcatccttgtctagtaataagttacagaacctggcacatcgcgtcatcaccgcccagcagacaggagtgctagaaaacgtgctcaacatgactattggggccttgctggttacccagtccaaaggagtaattggttacggaaacacctcatctttcaaaaccggaaatctcatctacatcagaccgtacgctctcagcatcctggtgcagccaagcgatggtgaagtgggaaacgaactgccggtacagccacagcttgtctttctggacgagcagaaccggagggtggagtctttaggcccccctagtgagccttggaccatcagtgcctctcttgagggagcttctgactcagtactcaaaggttgcactcaagccgaaactcaagacgggtacgtttcgttttataatcttgccgttctcattagcggatccaactggcacttcatctttacagtgacctcaccgcccggcgtgaatttcactgcacggtctaagccattcgccgtgcttcctgtgacacgtaaggagaaatctactattattctggctgcaagtcttagttctgttgcctcttggctggccctaagctgtctggtctgttgctggctgaagcggagcaaaagccgtaagacgaaacctgaggaaattccggagtcacagaccaacaatcaaaacattcacatccacattagctctaaaaggagagagtcacaagggccaaagaaggaggacactgtggttggggaggacatgcggatgaaggtaatgttgggcaaggtcaaccaatgcccccaccaacttatgaatggcgtcagccgccgtaaggtaagccgtcacatcgtccgggaggaagaggccgctgtgccagccccgggcaccacgggaatcacttcccacggccatatttgtgctccaggagcacctgctcagcaggtctatctccaagagacaggaaattggaaggagggtcaggagcagcttctcaggtaccagctcgccggccagaatcagctcttactattatgccctgactttaggcaggagagacagcaactccccggtcagagcaggttgagcaaacaaagcggatccctgggcctatcacaggagaagaaagcttcatgcggagcaaccgaggccttttgcctgcattccgtgcaccctgaaaccatacaggaacagctgtag

SEQ ID NO: 199986 - DNA, 10191 bp, Artificial Sequence
  Description of Artificial Sequence: Synthetic coding sequence
atgaccgcctggctgatcagcctgatgagcatcgaggtgctgctgcttgccgtcaggcacctctctctgcatatagagccagaggagggatccctcgcagggggcacctggatcaccgtcattttcgacggactggaactcggcgtcctgtaccccaataatggctcgcaacttgagatacacctcgtcaacgttaacatggttgtcccagcgctgagatcagtgccctgcgatgtgtttccggtgttcctcgatctcccagtggtaacctgccggaccagatctgtgctctccgaggcccacgagggtctctattttctggaggcctattttgggggtcaactggtgtcaagccctaaccccggtcctcgggattcttgtactttcaaattctccaaagcgcagacacccattgtgcaccaagtgtacccaccaagcggtgtccccggaaaactcattcacgtgtatggatggattatcaccgggcgcctcgagacatttgattttgatgcagaatatattgactcaccggtaattctggaagcccaaggcgacaagtgggtcactccctgctcactaattaatcggcaaatgggcagctgctatcccatccaggaggatcatggactggggacactccagtgccatgtggagggagattacatcggctcacagaatgtgagtttttcagtcttcaataagggcaaatccatggtgcacaagaaggcttggctcatatctgctaagcaagaccttttcctgtatcagacacactcagagatcttgagtgtgttcccggagacaggaagccttggagggagaaccaacataacgataacaggtgacttttttgacaattccgcccaggtgaccattgctggtatcccctgcgacattcgacacgtgtcccctcgcaaaattgagtgcacaactcgcgctcctggaaaggatgttcggctgactactccccagcccggcaatcgcggcctgctttttgaggtgggcgacgcagtagaaggcctcgagttaaccgaagccaccccgggctaccgctggcaaatcgtccctaatgcttcctcaccctttgggttctggtctcaagaagggcagccttttcgcgcgagactgtctgggttttttgtggctccagagacaaataactacacgttttggatacaggccgatagccaagctagtctccactttagctggtccgaagaacctaggacaaaggtgaaggtggcaagcatctctgtcggcacggctgattggtttgatagctgggagcaaaacagagacgaaggcacttggcagcaaaaaacccccaaattagagttgctgggaggcgcaatgtactacctagaagccgaacatcacgggattgccccctctcgcggaatgagaataggcgtgcagatccacaatacctggctgaaccctgacgtcgtgaccacttacctacgagagaaacatcagataagagttcgggcccagcggctgccggaagtccaggtcctcaatgtgagcggccgcgggaacttcttcctgacctgggacaatgttagctctcagccaattcccgcgaacgccaccgctcacctaatacaaacaactatcgaggagctgctagcagtgaaatgcaagcttgaacctttgtggtctaacattctgcttagactgggctttgagcgcggacctgaggtgagcaattcagacggggacctcacaagcggcaccgaacctttttgcggaaggttctccctccgacagccacggcatctcgttctgaccccacccgccgcacaaaaaggctaccggttggatcaatatacacatctgtgtttggcctacaagggccacatgaacaagatcttaaagatgatcgtgagtttcactattgggttccagaatatggtgaagaatacgacgtgcgattggagtttgactcggacgtctcccgagtcttggcagttcgattgcacggatctgtgggaaacgtgtgttcgttgttttggggatttgcagcctccccccgccaactccccggtgctcgtgcatcaaattaatctgctacccctggcccaggaaactggactgttttacgtggacgaaatcatcatcgccgacactaacgtgacagtgagtcaggccgatagtggcacagcgcggcctggtggcaatttggtagaatccgtttccgttgttggatccccaccggtgtattctgttacctcctggctggcgggctgcggcacagagctgccgttaatcacagctaggagcgtgccaactgagggcacggaagagggaagtggcctagtactggtgactacacagcggcggcagagaacatcgccccccctgggaggacacttcagaatacagctcccaaatactgtgattagtgacgtaccagtgcagatttccgcccatcatctccaccagctgctccagaacaacgcagacgacttcaccagccgttacctgaacgcatctgacttcaccgtgaaggaggacctgtacacctgctatgaacacgtgtggacactgtcatggtctacccagatcggagatctccccaattttattcgggtgtccgacgaaaaccttacaggcgtaaaccccgctgccgcgacccgcgtggtatacgacggtggagtatttcttgggccgatctttggagacatgctcgccacagccaaccaacatactcaggtcgtcgtgagggtcaatgacgtgcctgcacattgtccaggctcttgtagcttccagtacctccaggggagtactccctgcgtccacagtgtatggtactctatcgacggagacataaacctgatgatctatattacaggcacaggattcagcggcgattcccagttcctacaagttacggtaaataagacctcttgtaaggttatctttagcaatcagacgaacgtcgtatgccagaccgatctcctgcctgtagggatgcaccggattctaatgcttgtccgaccctctggccttgctatctccgccaccggggaggacctgttcctcaatgtaaaaccaagactggatatggtggagccctccagagctgccgatatcggcggactgtgggcaacaataagaggttcaagcctggagggcgtcagcctgatcctgttcggctcatactcttgtgctattaatgtggcgacatccaacagtagtcggattcagtgcaaggttcctccacgaggcaaggatggacgcatagtaaatgttactgtaatccgtggagattactctgcagtgctaccacgggccttcacatatgtgtcttcactgaaccctgtgattgtgaccctgtccagaaacatctctaacatagctggcggagaaacccttgtcatcggcgtagctaggcttatgaattatacagacttagacgtggaggttcacgtgcaggacgccctggcgccagtccacacgcaatcagcttggggtttagaagtcgcattaccacctttgcccgccggcctgcatagaatcagtgtaagcatcaatggggtgagcatccatagccagggcgtcgatcttcatatccagtatttgactgaggtcttcagtattgagccctgttgtggctcactacttggggggaccattttgtcaatttctgggatcggattcagtagggatcccgctctcgtgtgggtgcttgtcggaaatcggagttgcgatattgttaatctcacagaggcgtctatttggtgcgaaacccttccggccccccagatcccagatgccggcgcgccgacggtgccagccgccgtggaggtctgggcaggtaacaggttttttgctagggggccgtcccctagtctcgttggtaagggtttcaccttcatgtacgaggcagctgccactcctgttgtgactgcaatgcaaggcgagatcacgaactcctccctgtcactccatgttggagggtcgaacctaagcaactctgtcatcctgttaggaaacctgaactgtgacgtcgagacccagtcattccaaggcaatgtctccctgtcaggctgttctatccccctccatagtctcgaagccggcatatatcctctgcaagtccgccaaaaacagatgggctttgcaaatatgtctgtcgtgctgcagcaattcgctgtgatgccaagaattatggccatcttcccctctcagggctccgcatgcgggggcaccattcttaccgtgaggggcctcctcctgaatagccgtcgccgcagcgtacgggtggacttaagcgggccatttacttgcgtgattctctcactaggcgatcacaccatactgtgccaagtcagtcttgagggcgatccacttcctggcgcctccttttccctgaacgtgactgtgctcgttaatggattgacctctgagtgtcagggtaactgtacactgttcatccgagaggaggcaagtcctgtgatggacgccctgtccaccaatacgagtggtagcctgacgacagtgctgatcagaggtcagaggctcgccactactgccgatgagccaatggtctttgttgatgatcaactgccttgcaatgttacatttttcaacgccagtcacgtcgtgtgtcaaactcgcgatctggcccctgggccccactatctctcggtcttctacacacgcaacggctatgcttgcagcgggaacgtctcgaggcatttttacattatgccacaggtttttcattacttccccaagaatttcagtctccacgggggatcgctactaaccatagagggtactgggctgcggggacagaacacaactagtgtctacatcgaccaacagacctgcctgacagtgaatatcggggctgagctgattcgctgcattgttccaactgggaacggctccgtcgctttggagatcgaagtcgacggtctgtggtatcacattggcgtgataggttataataaggccttcacccctgaattaatctccatctcgcagagcgacgacatcctgacttttgcagttgcccaaatatctggggcagccaacattgatattttcattggaatgagcccctgtgtcggggtctcgggaaatcacacagtgctacagtgtgtggtgccatctttacctgccggcgagtaccatgtcaggggatatgattgcataaggggatgggctagctccgccctggtcttcacctccagggtgattataacagctgtgaccgaaaatttcgggtgcttgggaggccgcctcgttcacgtctttggcgccgggttctcgccagggaacgtttcagcggcagtttgcggggctccctgcagagtcctcgcgaacgctaccgttagcgcattttcctgcctagtattaccactcgacgtcagtctcgcgtttctctgcgggcttaaacgggaagaggacagctgtgaggctgcacggcatacctacgtgcagtgtgatctcacagtggctatggctacggaacagctattagagtcatggccatatctgtatatttgtgaggagagctctcagtgccttttcgtcccggaccactgggcagagtccatgtttccctctttctccgggctgtttattagtcccaaattggagagggatgaggtcctgatctacaattcttcctgcaacatcacaatggaaacggaggcagaaatggaatgcgaaactccaaatcagcccatcactgtgaagatcaccgaaatccgaaaaaggtggggacagaatacccagggaaacttttccctgcaattctgcagacgttggagccgcacacattcctggtttcccgaacgcctaccccaagatggggacaatgtgactgtggagaacggacagctcctcctgctggacaccaatactagcatcctgaatctcctgcacataaaaggaggcaaacttatttttatggccccagggcccatcgaacttagggctcacgcaatcctagtttctgacggaggggagctcaggatcgggagcgaagacaaacccttccaaggaagagcacagataactctgtacgggagtagttatagcactccgttttttccgtatggggtgaagttcttggccgttcgcaacgggacgctaagtttacacgggtcacttcctgaggtcattgtgacctgtctgcgggccacagcgcacgcactggacactgttctggcattagaagacgccgtcgattggaaccccggcgatgaagttgttattatttcagggaccggcgtaaaaggtgctaagcctatggaggagatcgtgacggtggaaaccgtccaggacactgacctgtacctgaagtccccactgcggtattcgcacaattttactgaaaattgggtggcgggcgaacaccacattctgaaagctaccgtggcgctgctgtcccgttccattactattcaagggaacctgactaatgaacgagagaagctcctagtctcgtgtcaggaggctaatgcacctgaggggaatttacagcactgcctttactcgatgagtgaaaagatgctcggatcacgggatatgggtgcaagagttatagtgcagtcttttcctgaagagccaagccaggtgcagttaaaaggtgtgcagtttcaagtcctgggtcaagcttttcataagcatctcagcagcctaaccctggtgggagctatgcgagagtcattcatacagggctgtacagtgagaaattctttctctaggggactgagcatgtgtgggacacttggtctgaaagttgatagtaatgtattctacaatattctggggcatgccctcctcgtgggaacgtgcactgaaatgcgatatattagttgggaagcaatccatgggagaaaggacgattggagcggccacggcaacatcattaggaacaacgtcatcatccaagtctcaggggcagaagggctgtctaaccccgaaatgctgacaccaagtggaatatacatatgctctcccacaaatgtaatcgagggtaaccgcgtttgcggagcaggatacgggtactttttccatctcatgaccaaccagacatcacaagctcctctgctgagtttcacacagaatattgcccacagctgtacacggtacggactattcgtttatcccaagtttcaacctccctgggacaatgtcacagggacaacgctgttccagagtttcaccgtctgggaaagtgccggaggagctcagatattcagatcaagcaacttgcgactgaagaactttaaagtttactcgtgcagagattttgggatcgacgttctggagtcagacgctaacaccagtgttaccgattcacttctgcttggccactttgctcacaaggggtcattatgcatgtcttccggcattaagacgcctaagcggtgggagttgatggtctctaatactacgttcgtcaattttgatctcattaactgtgtggcaattcgaacctgctcagactgtagccagggccaaggaggttttaccgtcaaaacttcccagcttaagttcactaattcatccaacctggtggcctttcctttcccccatgccgccatactggaagacctcgacggttccctgtctggcaagaaccgatcacatatcttagccagtatggaaacactgtccgcgagctgtttggttaatagcagttttggccgagttgtgcacggcagtgcctgcggagggggggttctgtttcaccgcatgtcaatagggctggcaaacacccctgaggtgagctatgatttgacgatgactgattcaagaaacaaaacaaccactgtgaattatgtacgagacacgcttagcaacccgagaggctggatggcactgctcctggaccaggagacttatagtttacagagcgagaacctgtggattaacagaagcctgcagtatagtgctacctttgacaactttgcgcctggaaattacctgctgctagtgcacacggacctgccaccttatccagacatcctccttaggtgcggatcacgagtcggcctctcttttccctttcttcccagccccggccagaaccaagggtgcgactggtttttcaatagccagctgaggcaactcacctatctcgtctccggggaaggtcaggtgcaggtcatattacgggtcaaggagggaatgccccccaccattagtgcttccacttctgctccagagtcagcactaaaatggtccttgcccgaaacttggcagggcgttgaagaggggtggggcggctataacaacacaatacccggtccgggagacgacgtgctgattttaccgaatcggaccgtcttagtagacaccgacctgccatttttcaaaggactatacgtaatgggaacgctggacttcccagtggacagatctaacgttctaagtgttgcctgtatggtcatagccggcggggagttgaaggtgggtactctggaaaatcctttagaaaaagagcaaaagctgctgattctcctccgggcatccgaaggggttttctgtgatagaatgaacggaatacatattgatcccgggaccataggggtttatgggaaagtgcatctgtattccgcttatcctaaaaacagttggacgcacctgggagccgacattgcttccgggaatgaacggattattgtggaagacgccgtggactggcgcccacacgacaagattgtgctttcctcatcatcctacgagccacatgaggctgaagtgcttaccgtgaaggaggtcaaggggcaccatgtccgcatctatgaaaggttaaagcataggcacatcgggtcagtacacgtcaccgaagacggcagacacattcgtctggcggcagaagtgggcttgctgactagaaatatccagatccagccagacgtgtcttgcagaggaagactctttgtaggttcctttcgaaagtccagccgggaggagttctcgggagtgctccagctgctgaatgtggaaatacagaatttcgggtctcccttgtattcaagcgtcgagttctcaaacgtatccgcggggagctggattatcagttccactctgcatcagtcctgtgggggggggatacatgctgcagcatcacatggtgtcttgttgaacgataatatcgtattcggtactgccgggcacgggatcgatctcgagggccaggcgtataccgttaccaacaatctggtggtgctcatgacccagccagcctggtcaactatctgggtcgctgggatcaaagtcaatcaggttaaggatattaacctgcatggaaacgtcgtggctgggagtgaacggctcggcttccatatcagggggcataagtgttccagttgtgagctgttgtggtcagacaacgtggcccactcaagcctccatgggctgcacctgtataaagagtcaggtctggataattgtacccgtatcagcggcttcctcgctttcaagaacttcgactacggagccatgctccacgtggaaaactcggtcgaaatcgagaatattacccttgtcgacaacaccatcgggctgctcgctgtggtctacgtcttttcggcaccacagaacagcgtgaaaaaagtgcaaatcgttttgcgcaacagcgtgatcgttgctacttcctccagctttgactgtattcaggacaaggtcaagccccacagtgccaatctgaccagtacagatagggcaccctcaaacccacgcgggggtagaataggcatactgtggcctgtttttacgtccgagcctaatcagtggccccaggaaccctggcataaagttcgtaatgatcactccatttcgggcataatgaaactccaggatgtgaccttcagctctttcgttaagagctgctatagtgatgatttggacgtctgtatcctgcccaacgccgagaactcaggaatcatgcacccaatcacggccgagcggacacgtatgctcaagatcaaggataaaaacaaattttattttccatcactgcagcccaggaaagatctcggcaaggtcgtgtgccccgagttggattgcgcaagccccagaaaatatctgtttaaagatctggacgggcgagcgctcggtctgccacccccggtgagcgttttccctaaaactgaggcagaatggactgctagtttctttaacgccggtactaaagaacagagtattgagattaacgtatag

SEQ ID NO: 199987 - DNA, 12732 bp, Artificial Sequence
  Description of Artificial Sequence: Synthetic coding sequence
atgggccacctgtggctgctgggcatctggggcctgtgcggcctgctgctttgtgccgcggatcctagtacagatgggtctcagattatacctaaggtgactgaaattattcccaaatatggatcaatcaatggggccaccagactgaccatcaggggagaaggatttagtcaggctaaccagtttaactacggcgttgacaatgccgaactgggaaatagcgtgcagcttatcagttcgttccagtctattacttgcgatgtcgagaaggatgcttcacatagtacccagattacctgctacacccgtgctatgccggaagactcctacactgtacgtgtgagcgtcgacggcgtaccagttacagagaataacacatgcaagggtcacatcaattcttgggagtgtacttttaacgcaaagagtttccggacaccgaccatcaggtctatcacaccactgtccggtacacccggcactctgattaccatccaaggcaggatcttcacggatgtgtatggcagtaatatcgccctatccagtaatggcaagaatgtgcgcatcctccgcgtgtacattggaggcatgccctgtgagctgctgatcccccaatccgacaacctctatggcttgaagttggaccacccaaacggagacatgggcagtatggtttgcaagacgactggcacgtttattggtcatcacaatgtgtcctttatcttagataatgactacggacgatcctttccgcagaagatggcctattttgtctcttctctgaataaaattgcaatgtttcaaacttatgcagaggtgaccatgatctttcccagccagggctcaatccgcggcggcacgacattgacaatttccggacggttcttcgaccagaccgattttcctgtacgtgtactggtggggggcgaaccttgtgatatactgaatgtcaccgagaattccatttgctgcaaaactcctcccaaaccgcacattcttaagactgtctatcccggtggccggggcctgaaactggaagtttggaataattcccgaccaatccgcttggaagagatcctggaatacaatgagaagacccccgggtacatgggagccagctgggtggactctgcgagctatatttggttgatggagcaggatacattcgttgcgcggttcagtggatttttagtggccccagacagcgacgtgtaccggttttacattaaaggtgatgatcgctatgccatctacttcagccagaccggattacccgaggacaaggtgcgaatcgcttatcattctgccaacgctaactcttatttttcaagccccacgcaaaggtccgatgacatacacctccagaagggcaaggaatactatatcgaaatcttgcttcaggagtataggctaagcgccttcgtagacgtgggtctctaccaataccggaatgtctacaccgaacagcagacaggagatgccgtgaatgaagagcaggtcattaagtcacagagcactatattacaggaggtgcaagtgatcactctggagaactgggaaacgacaaatgcgattaatgaggtccagaaaatcaaggtgaccagcccctgcgtcgaggcgaacagttgtagcctctaccagtataggctcatttacaatatggagaagaccgtattcttaccggccgatgctagtgaattcatcttgcagagcgccctcaacgacctatggagtatcaagccagataccgtgcaagtaatccgtacacaaaatcctcagtcctatgtctatatggtcacctttatctccaccaggggggattttgacctgttaggttacgaggtagtggaaggcaacaacgtcactttggacataaccgaacagacaaagggcaaacccaacctcgagacttttacccttaactgggacggcattgcatcaaagccgcttacgctctggtctagcgaagctgagtttcaaggtgcggtggaagaaatggtgtccactaaatgtccaccccagatcgccaactttgaggagggtttcgtcgttaaatactttcgcgactatgaaacggactttaacctagagcatataaatcgcggacagaaaactgctgagacagatgcctactgtggcaggtatagcctgaagaaccctgccgtgctcttcgacagtgctgacgtcaagccaaaccggcgaccgtacggcgacatcctgctgtttccatataatcagctatgccttgcatacaagggatttttagcaaattacattggacttaagtttcagtaccaggacaacagcaagatcacacgcagtacggacacacagttcacctacaacttcgcatatggtaataattggacctatacatgtatagaccttttggatctcgtgaggacgaagtacaccgggacaaatgttagcctgcagaggatttctctgcacaaggcctctgagtctcaatcattttacgtcgacgtagtgtatattgggcacacatccacaatttccacactggatgaaatgccaaaacgaaggctgccagcacttgccaacaaggggatctttttggagcacttccaggttaaccaaactaaaaccaacggtcctacaatgaccaatcaatactctgtcacaatgactagctacaactgctcttacaacatacctatgatggccgtctcctttggccagatcatcacacacgaaacagagaacgagtttgtttacagaggtaacaattggccaggcgaaagcaagattcacattcagaggattcaggccgccagccctcctctttcaggctcttttgatatccaggcctatggccacattttaaaagggctcccggcggcagtgagtgccgctgacttacagtttgcactacagtcgctggaagggatggggaggatatctgttacccgtgagggcacttgtgcaggctacgcctggaacatcaaatggcggtccacgtgtggcaaacagaacctgctacaaattaacgacagtaatatcattggggagaaagcaaacatgacagttacacgcattaaggagggtggtctctttagacagcacgtgcttggagacttactgcggactccctcccagcagccccaggtggaagtctatgtgaatggcatccccgctaaatgtagtggagactgcggctttacatgggacagtaatataacacctctggttctcgccatatctccgagccagggctcatacgaggagggtacgatcttgactattgtgggatcaggattttcgccctccagcgctgtgacggtgtccgtcggccccgtggggtgcagcctcctgtccgtggacgaaaaagagctgaagtgccagattctgaacggctcagccggacacgctcccgtggccgtcagcatggctgatgtaggattagctcagaatgtgggcggagaagaattttactttgtctatcagtcacagataagtcacatctggccggattctgggtccattgccggcggaacccttttgaccctgtcaggattcggatttaatgaaaatagtaaggtgctggtggggaatgagacttgtaacgtgattgagggagatttgaatcggatcacctgtcgcacaccgaagaagaccgagggcacagtggacatctccgtcacaacgaatgggtttcaggcaacagctcgtgacgctttctcgtataactgtctacagactccaatcatcactgacttttcgcccaaggtccgcaccatcctgggagaagtgaatctcactatcaaggggtataatttcggaaacgagctgactcaaaatatggcagtttatgtaggcgggaaaacctgccaaatcctccactggaacttcaccgacattagatgcctacttcctaagcttagcccgggcaagcacgatatttatgttgaagttcgaaactggggctttgcgagtaccagggataagttgaactcttctatacagtatgtgctcgaagtcacttcaatgtttccgcaaaggggaagtttgttcggcggaactgaaataactatcagggggtttggcttcagcaccatacctgcagagaacacagttcttttgggatctatcccgtgcaatgtgacttcctcatctgagaatgtgattaagtgcatcctccattccacgggaaacatcttccgtatcactaataacggcaaggacagcgtacatggtttgggttatgcatggagcccccccgttctcaacgtgagcgtgggcgataccgtggcttggcactggcagacacatccctttttgcggggtataggctatagaattttcagcgtgtcctctccaggcagcgtcatctacgacgggaaagggtttacgtcagggcgtcagaaatcaacatcaggatccttcagctaccaattcaccagtcccggcatccattactactcctcgggttacgtagacgaggcccacagtatcttcctgcagggtgtgatcaatgtgctgcctgcggaaactcgccacattccattacacctgtttgtcggacgctctgaagctacctatgcgtatggtggacctgagaatctgcacctgggatcatccgtagccggttgtctcgccaccgagcctttatgttcactgaataatacaagagtgaaaaactctaagagattactctttgaggtgtctagctgcttcagtccttccatatctaacattaccccctctactgggactgtcaacgaactgattacaattatcggccacggcttcagcaatcttccctgggcaaataaggtgacaataggaagttatccctgtgttgtggaggagtcctccgaagattccattacctgtcatattgacccccagaatagtatggacgtcgggattcgtgagaccgtgacccttacggtctacaaccttggaacagctattaatacactttccaatgagtttgatagacgcttcgtcctgcttcccaatatcgatttagtcttgcccaatgccggctcaaccacagggatgacgtcggttactattaaaggctcagggtttgcagtttcttctgctggcgtgaaagtcctgatggggcactttccctgcaaggtcctctctgtgaactataccgcaatcgagtgtgaaacaagccccgccgctcagcagctcgtggatgttgaccttctgatacacggcgtccccgcgcaatgtcagggaaactgcacgttcagttatttagagtctattactccgtatatcactggcgtgtttccaaattctgttatcggatctgtcaaagtgctcatagaaggcgaaggtcttggcactgtactggaggatattgccgtgttcattggcaaccagcaatttagagccattgaagtcaacgagaataacattactgccctcgtgacccccctgcccgtgggccatcacagcgtgagtgtggtggtgggatcgaagggtctcgcccttgggaatcttactgtcagtagtccccccgtcgcctcactgtctcccacttccggcagcatcggcggcggtacaactttggtgataacaggcaacgggttctacccgggcaacactaccgtgactattggcgatgagccttgtcagataatctctatcaaccctaacgaggtctactgccgaactccagccggcactaccggaatggtggacgttaagatcttcgtgaacaccatcgcctacccaccactgctcttcacttatgctctcgaagacaccccattccttaggggcattattccaagtcgaggccctcctggaaccgagatcgagattaccggcagcaatttcggatttgagattcttgaaatctccgttatgattaacaacatccaatgcaatgtcactatggctaacgattctgtggtccagtgtatcgtgggtgatcacgcaggcggcacttttcccgtgatgatgcaccacaagacgaaaggctcagccatgtcaacagtcgtgttcgagtaccctctcaatatccagaatatcaatccctctcagggctctttcggtggcgggcagaccatgactgtgaccgggaccggcttcaatccccagaactctattatcctggtctgcggctctgagtgtgcaattgacagactccggtctgattataccacgctactctgtgagatcccatctaataacggcacaggagctgaacaggcctgcgaggtgagcgtcgttaacggcaaggatctgagccagtcgatgacacccttcacatacgctgtttcgttaactccactgatcaccgctgtgagcccaaaacggggctcgactgctggaggtacacgcttgaccgtagttggctcagggttttcagaaaatatggaagacgtgcacatcaccatcgcagaagcaaagtgcgacgtggagtactctaataaaactcatatcatttgcatgacggatgcccacactctctcaggatgggcccccgtctgcgtgcacattcgcggagtagggatggcaaagctggacaacgccgatttcctgtacgtggatgcctggtcatccaatttttcttgggggggcaagtcgcctcccgaggaaggcagtcttgtcgttatcacgaaagggcaaactattttgcttgatcagagcaccccgatcctcaaaatgctgttaatccagggcggaacactaattttcgacgaggcagacattgaattgcaggcggaaaatatcctcatcaccgacgggggggtgctgcagatcggtacagagacatcccccttccagcacaaagctgtaatcaccttgcacgggcacttacgcagccctgagttacccgtgtatggggctaagactctagccgttagggagggaatccttgatcttcatggagttccagtgcctgtgacatggacaaggttagcccatacagcaaaagcgggcgagcggattcttattctgcaagaagcagttacctggaagcctggggataatatagttatagccagcacaggacatagacatagtcaaggtgaaaacgagaaaatgaccattgcatctgtttccgccgacggcatcaatattactctgagcaatcctctgaactacactcacctggggatcaccgtgactctcccagatgggactctgttcgaggcacgcgccgaggtgggaatcctcactcgaaacatcctcatacggggctctgataacgtcgaatggaacaacaagataccagcttgcccagacggcttcgacaccggggagtttgctacccaaacatgccttcaaggaaaatttggtgaggaaattgggagcgatcagtttggagggtgtgtgatgtttcacgctcccgtcccaggcgccaacatggtgaccgggcggatagagtatgtcgaagtttttcacgctgggcaggcattccgtctgggacggtaccctatacactggcacttattgggggatctgcagtttaagagttatgtgcgcggttgtgccatccaccaagcctacaatcgcgctgtgaccattcataacacgcatcacttacttgtcgagcggaatatcatttacgatattaaagggggcgccttttttattgaggatggcattgagcacggcaacattctgcagtataacttagccgtttttgtccagcagtccacaagcctgctcaatgacgacgtaacccccgctgcattttgggtgacaaatcccaacaataccatccgacacaacgccgtcgccgggggcacccactttgggttctggtaccggatgaataaccatcccgacggcccatcctatgaccgcaatatctgccagaaaagggtgcccctcggcgagttcttcaacaacacggtgcattcacaggggtggtttgggatgtggatctttgaagaatactttcctatgcagactggttcatgtacaagtactgtacccgcaccggccatcttcaatagtctgactacatggaattgtcagaagggggctgaatgggtcaacggaggcgccctgcagttccacaactttgttatggtcaacaattacgaggctggcattgaaaccaaacgcatcctggccccctacgtggggggctggggggaaaccaacggtgccgtgataaagaacgctaagattgtgggtcatctagatgaattaggtatgggcagcgccttttgtaccgccaaagggctggtccttccctttagcgagggcctcactgtttcctccgtgcattttatgaattttgataggccgaactgtgtggccctgggagtgacatccatctcgggagtctgtaatgacagatgtgggggctggtccgcaaagttcgttgacgtgcagtattcgcatactcccaataaagcgggtttccggtgggagcacgagatggttatgatagacgttgatggctctctgacgggacataaaggccataccgtcattcctcactctagcctacttgatccctctcattgcacacaggaggccgagtggtccattggctttcccgggagcgtgtgcgatgcgagtgtaagttttcaccgacttgctttcaatcagccctctcccgtatctctcttagaaaaagacgtggtgctatccgactccttcggcacttcaatcattccattccagaagaagcggctcactcatatgtcggggtggatggccctaatacccaatgctaatcatataaattggtacttcaaaggagtcgaccacattaccaacatatcctatacatccacgttttatggattcaaagaggaagactatgtgatcatcagtcacaactttactcagaatccagacatgttcaacataattgacatgcgcaacgggtcgtcgaatccactgaactggaacacatccaagaacggagactggcacctagaggctaatacgagcactctctactacctggtgagcggaaggaacgatctccaccagtcccaactgattagcggcaacctggaccctgatgtaaaagatgtggttattaatttccaggcctattgttgcattctgcaggactgctttcccgtgcatccgccatcacgtaagcctatacccaagaagcggcctgcaacatacaacctttggtcgaacgacagtttctggcagtcaagtagagagaataattatactgttccacatcccggcgcgaatgtcatcatacccgaaggcacatggattgtggccgacatcgatatgccctccatggagaggttaatcatctggggtgtgctggagttggaggacaaatacaatgtgggagccgccgagtcttcgtatagagaagttgttcttaacgcgacgtacatctccctccaaggtggtcgactgataggcgggtgggaggataacccgtttaaaggcgacttgaagatcgtcctgagaggcaaccacacgacacaggactgggctctacccgagggacctaaccaaggggcgaaggtgctcggggtttttggtgaactggatttgcatggaattccccattctatctataaaaccaaactgtctgagactgctttcgcaggctcaaaggtcttgagtctaatggatgccgtcgactggcaggagggggaggagatcgtcattactacaacctcttacgacttccatcagactgagacaaggtccattgttaagatcctgcatgatcataagatcctgatcctgaacgactctctctcttacactcactttgcggagaagtatcatgttccaggcaccggggaaagttataccctcgcagcagacgttggtattctttcccgcaacatcaaaattgtgggcgaggattatcctggctggtctgaggattcctttggtgcccgcgtgctggtgggctcctttacagagaatatgatgacattcaagggaaatgctcggattagcaatgttgaattttaccacagtggccaagagggctttcgagactccaccgacccgcgctacgccgtgacttttctcaacttgggacagattcaagagcacgggtcttcttacatacggggttgtgcatttcatcacggattctcacccgctattggcgtcttcgggacagatggcttggacatcgatgacaacatcatccacttcactgtcggcgagggcatcaggatctggggaaacgccaatcgcgttcgtggaaaccttatcgctctgtctgtgtggccaggcacttatcagaacaggaaagaccttagcagcactttgtggcatgccgctatagaaatcaatagagggacaaacacagtcctgcagaacaacgtggtagcgggtttcggaagggcaggctacagaatcgacggggagccttgtccgggacaatttaaccctgtcgagaaatggtttgataatgaggcccacggcgggctttatggcatctatatgaatcaggacgggttgcccggctgtagcctgatccagggattcacaatctggacctgttgggattatgggatctattttcagactaccgaaagcgtgcacatctataatgttacactggtggacaacgggatggccatctttcctatgatttatatgcccgcagcaatttcccacaagatcagcagtaagaatgtccaaattaagtcttcattgatcgtgggctccagccccggatttaactgcagtgatgtcctgacaaatgacgatccaaatatcgaattaaccgcggctcaccggagcccacgttcaccctctggtgggcggtctggaatctgctggccgaccttcgcaagcgcacataacatggccccgagaaagccacatgcgggcatcatgtcttacaatgccatttccggcctgctggatattagtggaagcacctttgtgggatttaagaacgtttgttcgggggagactaatgtgatctttattactaaccccctgaatgaagatcttcagcatccaatacacgtgaagaatataaagttggtggacactacagagcaatcaaagatcttcatacatcgccctgacatttccaaagtgaacccctcagattgcgtagacatggtgtgcgacgccaagcggaaaagctttctcagggatattgatggctcctttttgggcaacgccggctccgtgatacctcaggccgaatacgagtgggacggtaactcccaggtcggtattggggattatcgaattcctaaggcaatgttaacatttctgaacggcagtcgaatcccagtgacagagaaagcaccccacaaaggaatcattcgggattctacatgtaaatacctaccagagtggcagagctaccagtgctttggaatggagtacgccatgatggtcatcgaaagccttgatcccgacacagaaactcggcgtttaagccccgtcgcgatcatgggtaatggctacgtggaccttataaatgggcctcaggaccacggctggtgcgccggttatacctgtcagagacggttgtctttattccactcaatagtggcacttaacaaaagctatgaggtctactttaccggcacctctcctcagaacctacgtctgatgcttcttaatgtggatcataataaagctgtcttggtcggcattttcttttccacattacagcgccttgatgtctatgtgaacaatcttctggtgtgtcccaaaaccaccatatggaatgcccaacaaaagcactgcgaactcaacaatcacttgtataaagaccaatttctgcctaatctggactctaccgttcttggagagaactactttgatggcacttatcagatgctctatttgctggttaaaggaaccatccccgtagaaatccacaccgccactgtaatctttgtgtcgttccagctctccgtcgccaccgaggatgacttttacacatcccacaatctggtgaagaatcttgccctgtttctcaagataccgagcgacaagatcagaatcagcaagatccggggaaaatcactgaggagaaagcgctcaatgggtttcatcattgagattgaaatcggcgacccccctattcaattcatatcaaatgggacaacaggccaaatgcaactgtccgaactacaggaaattgccggctctcttggtcaggccgtcattctgggcaacatttcaagcattctcggctttaacataagctcgatgagcattactaatcccctgccgagtccatcagactctggctggattaaggtgaccgctcaacccgtagaaagatccgcattcccagttcaccacgtagcctttgtgagcagccttctggtcatcacacaaccagtcgccgcacagcccggccagcctttcccacaacagccctcagtaaaggctactgactccgacggcaactgcgtctccgtgggcattactgcattgacccttcgggctatcctcaaggactcgaataataaccaagtaaatgggctgagtggaaacaccacaatacctttctccagctgctgggctaactatactgatctgactccgctcaggaccgggaagaactataagattgagttcattctggataatgtggtgggggtggagtcccgaacctttagcttgctggccgagagcgtttctagctccgggtctagctcttccagcaactccaaggccagcactgtgggaacttacgctcaaattatgacagtggtgatttcctgccttgtgggccgcatgtggctcctcgaaattttcatggcagccgtgtccacgttgaacataaccctccgcagttattag

SEQ ID NO: 199988 - DNA, 6762 bp, Artificial Sequence
  Description of Artificial Sequence: Synthetic coding sequence
atgcggcccggccccgccctgctgctgctgggcgtgggcctgagcctaagcgtgggaagactacctctgcccccagtgccccgcggtgctcaggccgcagtatccggcgctcccggcggcttgttacggggcgcgcccggtcttggggtgaggggaggacgggccctgctgtcgctacggccgtcagccgtcagagctgggggggcagttctaagcggacggggttcactgtgtttcccccacggcgggacaggccggagatggtactgcctcgacttgagagtgcttctgtcagcgcagcggctcccatggccagctgccccagcgctggcccttgtcgacctgcagctatccgcaagaggggggcgcttaagccttacttggagcgttagactccctcggtctccaggacgcctcgcatgggcctttcgcctgaggctactgggtccaggggcggctcggccggcttctccggccgccagggttagtccgcgcagcgccgcccccggaccaagaccacagcaggggtttgtggcccggactgagtgccccaccgatggtcccgcacgggtcatgctccaagctgttaattcaagcagtcatcgagcagtggagagctctgtctcttgccagattaatgcatgcgtgatccagcgcgtgaggatcaacaccgatcagaagggtgcaccagtgcgcttatcaatgcaggctgaggctacaattaacgcttcagtgcagctggactgccccgccgctcgcgctatcgcccagtattggcaagtgttctctgtgccagccgttgggcaggcaccagattggacccagcctctcgatctgccgcagttggagataagaaacagccctctatttatccatatacccaacaattccctacagtggggggtgtatgtcttcaacttcaccgtttccatcacaacaggtaaccctaaaatgccagaagtcaaggacagcgacgccgtatatgtatggatcgtgcggagttctttacaggctgttatgctcggtgacgccaatatcactgccaacttcaccgaacagctgattcttgacggaagcacgagcagtgaccctgacgcggattcaccgctgcaggggttgcaattcttttggtattgcacaaccgacccgcgaaactatggtggagaccgaatcattcttggtagcaaagaagtgtgtcaccctgaacaggctaacctcaaatggccttgggcctccggacccgtactcaccctcctgcccgagactctcaaaggggaccatgtgtacttttttcggatggtgatacggaaagactccaggacagccttctctgataaaagggtgcatgtgctgcaggggcctaaggccatcgcccacatcacgtgtatcgaaaattgcgagcgcaactttatcgttagcgataggttcagtcttttcctgaactgtacaaattgcgcttctcgtgacttttataagtggtccatcctgtctagttcgggcggagagatgttgttcgactggatgggggagacagtcacggggcggaacggtgcctacctgtccattaaggcttttgcctttagacattttctggaggcggagttttccatcagcttgtacctggcctgctggtccggcgtgacaagcgtctttcgtcactctttcattattaatcatggcccacagataggggagtgtaaaataaatccggccaagggcatcgcgctgatcacgaaattcgtcgtgcagtgcagcaattttagggacaagcatgtccctctcacatataaaataatcgtgagtgacctgcactccgtgggagagatcagttccgtgaaggaaaacacactgggcaccattttgtacctggggccgcagagcaccgtgcctcccagtttcctacctgtgggtatgctagcgtcacagtatggcttgaagatttacgcacaagtttatgactcactgggtgccttcagtcaagtgacacttcacgcaactgctcaggcccctaccgacaaaaacagttctaaaacagtcctgaaccaactcctttccttcacggttgggcctagttccctcctatccacgctcatccagaagaaagacttcctccctgcgggctatctgctctacatcgtagctagcgtgctaaacaatatgaagacagaattgccactgagagacgacagggtcaacctgagaaagcacctaatcgaccaatcatttctcctcccagtttccacgctcgtggagattggccaggtagttatgaccatcacaaaactgacacagaagccttcagagttcacctgggacgcccagaagagggcaacaatgcgtgtatggcaggccaaccaggcacttcaagaatatcagcagaaggacaagagatttcgcagcgagcagatcgagatcgtgagcactggaattcttatgagtctttctaacattctcaaaatgaccagcccacaccaagtagtgaaggaccccttctatgtcatcgagtccttatctgataccattctggccaataaggtgccagggaacaagaccacttccatgaggacgcctaatttcaatatgtacgttaaaaaggtggaaaagtggggcattaaccaactgtttagaaatgaaaagcactgccgaaactgtttctaccctaccctgaatgtaagctctgtgcccggcttgtctgcaaacgggcccatcagcactatgttctgtgattttacaaatgatctcttcccctggttaaacgaccaagaaaacacatccgtggaagtttctgggtttagaatgacgggagtggccgataacggctctgtgctggaaattacacctgacgtcgccgaagtgtacctggtaagaaaaaacctcaccttcgccgctttcaatctgaccgtaggccccaatagcgaagttgatgggagtctaaaaaagacaacaggaggtttcagctttcaggtcgacagtacagtgctgcgggaggtgctcgttcacatagttacagaggtgatggtactgttcacagtccttgtgtatacaggaagccaaattactcccacggccctagtggccaccttcctcgtcccacacgacattcctccgtttgcgagtcagtctgctttgttcgaccccgcttgcacagtgaagaaagcccgcgtcgtgtgcttacctgtatccctgctacagctcatcgctcagcactctcattctccccactgcacagtgagcatcgtgctccaggccccacggtttgtgatgaagctgaatgataagcttgttagaatctccatcttctccgtgcaatgcctcgacatgtacggtatacagtccgagtggagggaggggtactgtatccttggggagaaaacttcctggtacgaggtgcattgcatttgtaagaatgtcgttcgagcaagacgccagctggggaccattggtttaacaggaattcacctgcacactcactacgttatggctaaagtaatcgtgattcccaatccggtggacctccgcctcaacattatcaagagcctgcatcagaaccctgtcaccctgtttactgtactgttcataatactgctttacgttggcctcgccttctgggccttgtatagggatgagatggaccagcatcttaggggacacgtgattgtactcccagataacgatccttatgacaatctgtgctatctggttaccatcttcacaggcagccggtgggggagcggaaccagggccaatgtgtttgtacagctccgtggcacagtttccacgagcgatgtccactgtctgtcccatcctcatttcacaactttgtaccgcgggagcatcaataccttcttattaacaactaaatccgaccttggtgacatacattcgatccgggtctggcacaataatgaagggaggtcaccttcttggtatcttagtagaattaaagtggaaaacctgttctcgcgccacatctggctattcatctgccagaaatggttgtcggtggatacgacacttgacagaacgttccacgtaacacatcctgacgagcggcttactaggaaagactttttcttcatagacgtctccagtaacctacggaagaaccacatgtggttctctatctttgctagcgtggtggccaagacattcaaccgtctgcagaggctcagctgttgtctagctatgctcttgagctcactgctttgcaatattatgttctttaaccttaacagacaggagcagactgaatcacgggagaggaaatatatgcggtccatgatgatcggcatcgaaagtgtgcttattactatccccgtacagctgctgatcacgtttctgttcacgtgctctcagagaaaacctcaggctgatcttaaagaggtaagtccacagaagcatccactcatgtctgaggcctccgagcattgggaagagtatctgcgtaagtggcatgcgtacgagaccgcaaaagtgcaccctagggaggtggccaagcccgcttccaaggggaaacctagactgcccaaggcctctccaaaggcgacttccaagcccaagcaccggcaccgaaaggcgcagatcaaaacccccgagacactcggccccaatactaattccaataacaatatcgaggacgatcaagacgttcacagtgaacagcacccatcacagaaggacctccagcagctcaagaagaaacctaggattgtgctaccgtggtggtgcgtgtatgtcgcctggtttctcgtgttcgctacctcgtcgatctccagctttttcatcgtgttctatgggctgacgtacggctacgataagagtatcgaatggctttttgctagcttttgctccttttgccagagcgtgctgttggtgcagccttcaaaaatcatattactgtctggtttcaggacgaataaacctaagtattgcaagaatctgtcatggtcaaccaagtataagtatacagaaatcagactcgacggcatgaggatgcatcctgaggagatgcaacgaatacatgatcagatcgtcaggatacgaggcaccagaatgtaccagcccctaaccgaggacgaaattaggatatttaagaggaagaaacggatcaagagacgggcgctgctgtttctaagctatatactgacccatttcatctttctcgccctcctcctgatcctgatcgtgctactgcgccacacggattgcttttactacaaccaattcattcgtgatcgattcagcatggacctagccacggtaactaagcttgaagatatttatcgctggctaaatagcgtcttgctgcccttgctgcataacgacctgaaccctacctttctaccggaatcttcatctaagatcctgggattgccattaatgagacaggtgagggctaagtcgtccgagaagatgtgcctgcccgccgaaaagttcgttcagaactcaatccgtcgggagatccattgtcaccccaaatatgggattgatcccgaggacaccaaaaattactccgggttctggaacgaggtcgacaagcaggcaattgatgagtcaaccaacggattcacctacaaaccgcagggcacccagtggttgtattactcctacggcctgcttcatacctacgggtcaggcggctacgcactgtatttttttccagagcagcaacggtttaatagtacactacgtctgaaagaactccaggaatctaattggttagatgagaaaacatgggctgtggtgctggagcttaccaccttcaatccagatattaaccttttctgttctatctcagtcattttcgaggtcagtcaactcggagttgtcaatacatcaatatcactgcacagtttttcactcgcagatttcgaccgaaaagcttccgcggaaatctacctgtatgtcgcaatccttatttttttcctggcctatgtggtcgacgagggctgcatcattatgcaggaacgcgcctcctacgtccgaagcgtctataacctgctgaattttgcactgaagtgcatcttcaccgttctgatcgtcctgttcctccgaaaacacttcctcgccacaggcatcattagattctacctgtcgaaccccgaggattttattcccttccatgccgtgagccaggttgaccacattatgagaatcatactgggcttcctgttgttcctgaccatcttgaaaactcttcgatattcacggtttttctacgatgtgcggttggcacaacgggcgatccaggctgccctcccaggtatttgtcatatggccttcgtggtatcagtatattttttcgtatacatggccttcggatacctggtgttcggtcagcacgagtggaactactctaatctgatccactccacgcagaccgtgttttcatactgcgtcagcgcatttcagaacacggaattctccaataacagaatcttaggagtgttgtttctgtccagttttatgttggtgatgatctgtgtgctaataaacctgtttcaggctgttattctaagtgcttatgaggaaatgaagcagcctgtctatgaggagcccagtgatgaggtggaggcgatgacttacctatgtcgcaaactccgcacaatgttttcgtttctgacttctcaatcgaaagccaaggacgagcctgaatttttcatcgatatgctgtacggccagccagagaaaaacagccaccgatatctcgggctgaagacccgcaatattaatggaaaaaaaatggtatacctggtcgtgtag

SEQ ID NO: 199989 - DNA, 12912 bp, Artificial Sequence
  Description of Artificial Sequence: Synthetic coding sequence
atgccccccgccgcccccgcccggctggccctggccctgggcctggggctctggctaggcgcattggctggcgggcctggcaggggatgcggcccttgtgagcccccatgcttatgtggaccagctcctggcgccgcctgtcgagtcaactgttctggacgaggtctccgcactttagggcccgctctccgtatccccgcggacgccactgctctcgatgtgtctcacaacttactgagagccctggacgtcggcctgctagcgaacctaagcgctctggctgagctggacattagtaacaacaaaatttctacacttgaggaggggatattcgccaacctgttcaacctctctgagattaacctgagcggcaatcccttcgagtgtgactgcggactggcttggttgccccgctgggcggaagagcagcaggtaagagtggtgcagccggaagctgccacctgcgcaggccccggtagcctggccggacagcccctgctgggcatccccctgctcgattcgggctgcggtgaagaatacgttgcttgcctgcccgataactcctctgggactgtggcagccgttagttttagcgctgcgcacgaaggattactccagccagaggcctgctctgctttctgcttctcaactggacagggtctcgctgctctgtctgagcagggatggtgtctttgcggggccgcacagccgtctagtgcctcttttgcctgcctgtccctttgctcaggcccaccacctcctccagcccccacatgtcgcggccccacacttctgcagcatgtgtttcccgcgtccccaggagcgaccctggttggccctcacggccctctcgcttctggtcagctggccgcttttcacatcgctgcaccactgcctgtgaccgccacgcgatgggacttcggtgatggaagtgcagaagtggacgccgcagggcctgccgcatcccataggtatgtgctgcccggtcggtaccacgtgacggcagtcttggccctgggagcgggatccgccttgctgggcaccgacgtgcaggtggaggccgctccagccgccttggagctggtttgtcccagctccgtgcaaagcgatgaatccctggacctctccatccagaacagaggaggaagcgggctggaggcagcatacagcattgttgctctcggtgaagagcccgctagggcagtgcaccccctgtgcccttccgacacagagatctttccaggtaatggccattgttaccggctggtggttgagaaagcagcttggctgcaggcccaagagcagtgccaggcgtgggccggcgctgccttggccatggtggacagccccgccgtacagcgctttctggtgtctcgggtaacaaggagtcttgacgtgtggataggattctcaacggtgcagggtgttgaggtggggcccgccccccagggcgaggccttcagcttggaatcttgtcaaaactggctaccgggcgagccccatcctgctaccgccgagcactgtgtgcggctcgggccaactggctggtgcaatactgacttgtgttccgctccccacagttatgtgtgtgaactccagcccggagggcccgtgcaagacgctgaaaatttgctcgtaggggctccgtccggtgacctccaagggcccctgacacccttggcacagcaggatggcctgagtgctccacacgagccagtcgaggtcatggtttttccaggccttcgactttcccgtgaggccttcttgactactgcagagtttgggacacaagaactgagacgccccgcccagctgagactccaggtctatagattattaagtactgctggcactcccgaaaatggctccgaacccgagtctaggtctcccgataaccgtacacaactggcccccgcctgcatgcctggtgggaggtggtgcccgggcgccaacatatgccttcctttagacgcgagctgtcatccacaggcctgtgccaatggatgcacttctggacccggcctgcccggagcaccttatgcactgtggagagagtttctgttttcggtacccgccggacctcccgcccagtattccgtaactctccacgggcaggatgtgctcatgctgcccggcgacctggtcggcctgcagcatgacgcgggtcctggggccttattgcactgttcaccagcacccggccatcccggaccacgagctccttacctgagtgccaatgcaagctcctggctgccccacctacctgcccaactagaaggaacatgggcttgccccgcttgtgccttgcggcttctggccgccacggaacagttgacagtgcttctgggccttcgccctaaccccggactgaggctgcccggacgctatgaggtgagggccgaagtgggcaatggagtgagtcggcacaacctgtcatgctcctttgacgtggtgtcacctgtagccggtctgcgggtgatttaccccgccccccgtgacggccgcctctacgtgcctactaacggcagcgcgctcgtcctgcaggtggactctggagccaacgcaactgccaccgcacgctggccgggggggtccgtctccgccagattcgaaaatgtgtgtcctgcactggtggctacattcgtaccaggctgcccatgggaaaccaacgacacgcttttttcagttgttgctctcccgtggctcagtgagggcgaacatgtggtggatgtggtggtggagaattcggcctctcgagctaatctcagcctgagagtaacggcagaggagcccatctgtggcttacgcgctacaccaagccctgaggccagagtattacagggggtgttggtgcggtattctcccgtcgtggaagcgggatctgacatggtgtttaggtggaccattaatgataaacaatcacttacctttcagaatgtggtgtttaacgtgatctaccagtccgccgctgttttcaagctctccctcactgcctcgaaccacgtgagtaatgtgaccgttaactataatgtgacagtggaacggatgaaccgcatgcagggccttcaggttagcacggttccggccgtgctgagcccaaacgccacgctcgctctgaccgcaggcgttttagttgactctgccgtggaggtcgcttttctgtggacctttggggacggagagcaggccctgcaccagttccagcctccttacaatgagagctttcctgtgcctgacccctctgtggcacaggttcttgttgaacacaatgtgatgcacacttacgctgcccctggagaatacttgctcacagtccttgccagcaacgcctttgagaatttgacgcagcaggtcccggtgtctgtgagggcatcccttcccagtgtggcagttggtgtgagcgacggtgtcttggtcgctggccgacccgttaccttctacccccatccattgccttcaccgggaggcgttctgtacacatgggactttggtgatgggtctcctgtgctcacgcagtcccagcccgcagcgaaccacacctacgcttccagaggcacctatcacgtgcggttagaggtgaacaatacagtatctggcgcagccgcccaggcagatgtgagagtctttgaggaattaagaggtctgtccgtcgacatgtccttagctgtcgaacagggcgcccccgtggtggtaagcgctgccgtgcaaacaggggataatattacctggacattcgacatgggagacggcacagtactgagcggccctgaggctactgtggaacatgtgtacttgagggcacagaactgtactgtgacagtgggagctgcctcccctgctgggcaccttgctcggagtctgcatgtgctggtgtttgttcttgaggtgcttagggtcgagccagccgcatgtatcccgactcagcctgatgcacggttaactgcctatgttactggtaatcctgcccactacctgttcgactggacttttggcgacggatcgtccaatacaacagtgagagggtgcccaacagtcacccacaacttcacccgaagcggcacttttccgctcgctttggtgctgagctccagggtcaacagggctcattacttcacatctatctgcgtggagcccgaagtggggaacgttaccttgcaacccgagcggcaatttgttcagctcggagatgaggcttggctggtggcctgcgcatggccccccttcccctaccgctacacatgggacttcggcaccgaagaagctgcacccactagagctcgagggccagaggtgaccttcatctacagagacccagggagctatttggtgactgtcaccgccagtaacaatatctcagccgcgaacgactccgccttagtggaagtgcaggagcccgtccttgtgacatccatcaaggtgaatggctcactgggcttagagcttcagcagccttatctcttcagcgctgttgggaggggccggcccgcctcttacttgtgggatctcggagatggagggtggctcgaaggtcccgaagtgacacatgcatataattccactggcgatttcactgtgcgggtggctggatggaatgaggtgagccgctcagaagcatggctgaacgttaccgtaaagcgcagagttaggggattggtggtgaacgcatcccggactgttgttccactgaacggatcggtgtcattctctaccagtttggaagcgggtagcgacgtacgctatagctgggtgctctgtgataggtgcacacctatccccggaggccccacaatttcatacacctttaggagcgtcgggacgttcaacatcatcgtcacagccgagaacgaggtcggcagtgctcaagactccattttcgtgtacgtactacagctgatcgagggactgcaggtggtgggaggcggccggtactttccgacaaatcataccgtccagctgcaggcagtcgtgagggatggaactaatgtcagttatagttggaccgcttggagagaccgaggccctgccttggccggaagcggaaagggattttcactcacagtcctcgaagccgggacctatcacgtccaactgagagctaccaacatgctggggtcagcatgggctgattgcactatggatttcgtcgagcccgttgggtggctaatggtggctgccagtcccaatcccgccgctgtgaatacctccgtaacactgtccgccgagctggctggaggtagcggcgtggtctatacctggagtttggaggaaggcttgtcttgggagacaagcgagccgttcaccacacattcttttcccactcccgggcttcatctggtgacgatgaccgcggggaacccgctgggctctgctaatgctacggtcgaagtcgatgtgcaggtccctgtgagtggactgtccatcagggcttcagagccaggcggttcgttcgtagccgccggatcctctgtgccgttctggggtcagcttgcaacggggacaaatgtgtcctggtgttgggcagtgcccggcggatccagcaaaagaggcccccacgtcaccatggtgttccccgacgccgggactttttctatcaggctgaatgcttctaatgctgttagctgggtgagcgccacttacaatctgaccgctgaagaacctatcgtcggcttggtgctgtgggcctcgtccaaggtcgtggctcctgggcagctcgtgcactttcagatcttacttgccgcagggtccgctgttacctttcgactgcaggtaggcggagctaacccggaagtgcttccagggccgaggttcagtcattctttcccacgtgttggcgaccacgtggtctccgtgcgggggaagaaccacgtctcttgggctcaggctcaagtgaggattgtggttctcgaggcagtgagcggccttcaggtgcctaattgttgtgaacctggcattgcgacaggcaccgagagaaacttcactgctcgcgtccagcgcggttcacgcgttgcgtatgcctggtacttctctctgcagaaggttcagggcgattctctcgtgatcttgtctggccgcgacgtaacttacactccagtggcagctggactgttagaaatccaagttcgcgcattcaatgcactaggcagcgagaatagaaccctggtcctcgaagtgcaggacgcagtccagtacgttgccctgcagtctgggccgtgtttcacaaataggagtgcccaatttgaagccgccacaagtccctctccaagaagagtggcataccattgggatttcggagacggtagtcctggtcaggataccgacgagccacgcgcggagcactcatacctgagacctggggattatcgggttcaagtcaacgcgagcaatcttgtgagcttcttcgtggcccaggctactgtgacggtccaagttctggcttgccgggagcccgaggtggacgtggtgttaccactccaggtcctgatgagacgctctcagcgaaactacttggaagcccatgttgacttgcgggattgcgtgacttaccagaccgagtacaggtgggaggtatacaggacggccagttgtcagcgacctgggcgtccagctcgtgttgccctcccaggtgtggatgtgtccagacccagactggtcctgcctcggctagccctgcctgtcgggcactactgttttgtttttgtggtatcgttcggagacacccccctcacccagtcaatccaggccaacgtgaccgtggccccagaacgtctagtgccaatcattgagggaggtagctatagggtctggtcagatactcgcgacctggtcttagatggcagtgagtcttacgaccccaacctcgaagacggcgaccagacaccactgtccttccactgggcttgtgtggcatccactcagagggaagccggaggctgcgccctgaacttcgggcctagagggtcatcaacagtgaccatcccacgggaaagattagccgctggagtcgagtacaccttctccttaaccgtgtggaaagccggcaggaaggaggaagccaccaatcagaccgtgttgattcgctccgggcgtgtccccatcgtctcacttgagtgcgtctcctgtaaggcccaggcggtttatgaagtgtcacgctcgagttatgtgtatctcgagggtaggtgtctcaattgttcctctggtagtaagcgagggcggtgggccgcccggaccttttcaaataagacattggtgttggacgagacaaccacatccacaggctctgcaggtatgcgactggtcctgaggagaggagtgctgcgagacggcgaagggtacacattcacactgacggttcttgggaggagcggcgaggaggagggatgcgcatccatccgtttgagccctaaccggcctcctttggggggctcatgtcgcctctttccactgggcgccgtgcacgcgctgacaactaaagtgcactttgagtgcactggctggcatgacgccgaggacgcgggtgccccacttgtatacgccctcttactgcgacggtgtagacaaggccactgcgaggagttctgcgtctataaagggtctctgtcatcttatggagctgttcttccacctgggttcaggcctcacttcgaggtcggcttagccgttgtggtccaggaccagctgggcgcagccgtcgtggccctgaataggtctttggcaatcaccctgccagaacctaatggctctgcaactggcctgactgtgtggctgcacggtttgaccgccagcgtgctgccaggcttacttcgtcaggcggaccctcagcatgttatagaatattcactggccctggtaaccgtcctcaacgaatacgaaagagcactcgacgtagccgccgaacccaagcatgagcgccagcatagagctcagatacggaaaaatatcacagagacattggtgtcactgcgcgtgcacactgtcgacgatattcagcagattgcagctgctttagctcagtgcatgggcccgagccgcgaactggtgtgtcggtcttgtctgaagcagaccttgcacaaacttgaagctatgatgctgattctgcaggcagagacgaccgctgggactgtcacacccaccgctattggagatagtattctcaacattaccggcgatctgattcacctcgcaagcagtgatgtacgggctccccaacccagcgagctgggagctgaatccccatccaggatggtggctagccaagcatacaatctgacttcggcactcatgcggatcctaatgagaagcagagtgctcaacgaagaacccctcactttagctggtgaggagattgtggcgcagggcaagaggtctgacccccggtctctgttatgctatggtggggcacccgggcccgggtgtcatttttccattcccgaggcgttcagtggggccctggcgaatctttctgacgttgtgcagctcatctttctggttgatagcaacccgtttccttttggatatatctcgaactatacggtcagtaccaaggttgcatccatggcatttcagacacaggccggcgcccaaatccccatcgaacggcttgcctcagagagggcaatcaccgtcaaggtccccaacaattccgactgggctgctcgcggacaccggtccagcgctaatagcgcaaacagcgtggtcgtccagccgcaagcatctgtgggtgccgtggtgacgctcgacagttctaatcccgccgcaggtctgcacctccaactgaactacaccctcctggacggccactacctttctgaggagcccgagccctatctggctgtctacctccattctgagccaagacctaatgagcacaattgctctgcctcccgacggatccggcctgaaagcctgcaaggagctgaccatcggccatatactttctttatatccccagggagcagggatccagccgggtcctatcacctgaatctgtcctcccactttcggtggtctgctttgcaggtgtcggttggactgtatacgtccctctgccagtacttctccgaggaggacatggtatggaggacggagggcctgctgcctctcgaggaaactagcccacgtcaggcagtgtgtctgacaaggcatctgacggcctttggcgcgagtttattcgtacccccctcccatgtccggtttgtgttccctgagcctacggccgacgtgaactacatagtgatgctcacatgcgcagtctgcctggtgacctatatggtgatggcagccatcctgcacaaactggaccaactggacgccagtaggggtcgcgcaattccattttgcggtcagcgcggcaggttcaaatatgagattctggtgaagactgggtggggtcgcggatctggaaccaccgctcacgtgggtataatgctgtatggcgtcgattctaggtctgggcatcggcatctggatggagatcgtgccttccataggaattccttggatattttccgcatagccactccccacagtctggggagcgtgtggaaaattagggtgtggcacgacaataaaggtctaagtcccgcgtggttcctgcagcacgtaatcgtgagagatcttcagacagcccgctctgcctttttccttgtgaatgactggctcagtgtggagaccgaagctaacggaggtctggttgaaaaggaagttcttgccgcctcagatgctgcattgctccgtttccgacggcttcttgttgctgaactgcagaggggattcttcgacaaacacatctggctcagcatttgggaccggccccctcgctccaggtttacccgaattcagagagccacgtgctgtgtcttattaatctgtctgttcctgggtgctaatgctgtgtggtatggtgctgttggcgattccgcttactcaactggccatgtgtctcggttgtcccccctgagcgtggacaccgtggcggtgggcttggtctctagtgtggtcgtgtaccccgtgtatctggccatcctttttttgttccgcatgtctcgttccaaggtcgctggaagcccatcccccacgcccgcaggacagcaggtcctggacattgacagctgcctagatagctcagtcctggactctagctttctaactttcagcggactgcatgccgagcaggccttcgtaggtcagatgaagtccgatctgtttcttgacgattctaaatccctggtgtgttggccctccggggaagggacgctttcgtggcctgatcttctgtctgatccctctatcgtcggctccaacctgagacaattggcccgtggtcaggccggtcacgggctgggacccgaagaagatgggttttctctagcatccccctatagccctgccaagtctttctccgcctctgacgaggatttaatccaacaggttctggccgagggggtttcctcccccgccccgacccaagacacgcatatggagactgatctcttgagcagcctgtcctcgactcctggtgagaagaccgaaacactggccttgcaacgcctaggtgagctcggcccaccatcccccggactgaactgggagcagccccaggctgcccgcctttcccgcacgggccttgtggagggattaaggaaacgccttctccccgcctggtgcgcctctctggcgcatgggttgtctctgctgctggtggctgtggctgttgcagttagtgggtgggttggtgccagcttccctccaggcgtatctgttgcatggcttttgtccagctcagcctcttttctcgcttcctttctaggctgggagcccctgaaggttcttctcgaggccctgtattttagcttggtggcaaaaaggctgcatccagatgaggatgatactctcgtggaatcccctgccgttaccccagtaagtgctcgcgtcccccgggtgcgtccaccacacgggttcgctttgttcctggccaaggaagaggctcgaaaagtgaaacggctacacgggatgctgcggtccttgctggtatatatgctgttcctgctggtaacattacttgcgtcctatggtgacgccagttgccatggccacgcatatcggctgcagtccgccatcaagcaagaattacactcacgagcatttctggcgataactcgttcagaggaactgtggccatggatggcacatgtcctactcccatacgtgcatgggaatcagtcgagccctgagttgggtcctcctaggctgagacaggtcagactgcaggaggcgttgtatccagatccgcccggccctcgggtccatacctgctccgccgcaggggggttcagtacgagtgactatgatgtgggatgggaaagcccccataacggaagtggcacatgggcgtactccgcacctgacttgttgggtgcttggtcttggggctcctgcgctgtgtacgactcaggcggctacgtgcaggaactcgggctgtctttagaggagtctagggataggcttagattcttacagctccacaactggctcgacaacagaagcagagccgtgtttttggaactgacccgctacagccccgccgtaggcttacatgccgcagtgaccttgaggctagaatttcctgccgctgggagagcgctggccgcactttcagtgcgcccgttcgccctgagacggctctccgcaggtttgtcgcttcccctactcacatctgtttgcttactgctcttcgctgtgcattttgccgtggcagaggcgaggacttggcatagagagggccgttggagggtgctgcgtttaggcgcctgggcgcggtggctcctagtggccttaaccgctgctacggcgctggttcgcttagcccagttgggagcagccgaccgtcagtggacaaggttcgtccgtggtcggcctcgacgatttacatcttttgaccaggtagcgcagctgagctcagccgccagaggactcgcggcaagcctgctttttcttttgctggttaaggccgcccagcagctgcggttcgtgcgtcagtggtccgtgtttggcaaaactctctgtcgtgcactccccgagctcttgggggttactctagggttggtggtgctgggagtagcttatgcgcagctcgccattctattagtgagttcgtgcgtggacagcctttggagtgttgcacaggctctactcgtcctgtgccccggcacaggccttagcactctgtgccccgctgagagctggcacttgtccccactgctgtgtgtgggattgtgggcactcagattatggggagccttgagactcggtgccgtgattctcagatggcggtatcacgctctgaggggagagctgtatcgcccagcatgggaacctcaggactacgagatggttgagttgttccttcgacgtctcaggttgtggatgggattgtcaaaggtgaaggagttcaggcataaggtcagatttgaggggatggagcctctgccgagcagaagttccagggggtccaaagtgagtcccgatgttcccccacccagcgccggaagcgatgccagtcatccttcaacgtcgtctagtcaactggacggcctgagtgtgtctctgggcaggttaggtaccaggtgtgagccagagccctctcgactgcaagccgtatttgaggctctcctgacacagtttgatcgcctgaatcaagccaccgaggacgtgtaccagctcgaacagcaacttcacagcctgcagggcagacggtcatcaagagcccccgccggctcatcccgtgggcccagccctgggctaagacccgccttgcctagccgcctggcccgcgcaagccgcggagtagacttggccaccggaccaagccgcacaccactgcgtgcaaagaacaaagtccatccttcaagcacgtag

SEQ ID NO: 199990 - DNA, 10914 bp, Artificial Sequence
  Description of Artificial Sequence: Synthetic coding sequence
atgccccccgccgcccccgcccggctggccctggccctgggcctgggtttatggctcggcgccctggcgggagggccagggcgcggctgcggcccgtgcgaacctccctgcttatgcggaccggcacccggcgctgcatgtagagtcaactgtagtggtcgagggctccggacacttggacccgctctgagaatccctgccgatgcaactgccctaacagccatggctaaggccgacggagacgtgaaaaagtatggcagtaaacgcggggcgttggcccttacccacggtcactctttgttgcgggacgtgtcgcacaatctccttcgggctctagacgtaggtctgctcgcaaatctctccgccctggctgagctcgatatatccaacaataagatctctactttagaggaagggatctttgcaaatctgttcaatctttcagagattaatctgtccgggaatccattcgagtgtgattgcgggctagcctggctgccccggtgggcggaggagcagcaggtacgggtggtgcagcccgaggccgctacttgcgcaggccccggttcactcgctggacagccactgctaggaatcccacttctggacagtgggtgtggtgcaactcttgtgggcccgcacggtcccttagctagcggccagctcgctgctttccatatagccgcacctctgccggtgacagccacacgatgggacttcggggacggatctgccgaggtcgacgccgccggaccagcagctagccatcggtatgttctgccaggacggtatcatgttaccgcagttctggccctgggggctggcagcgcactgctggggacagatgtgcaggttgaagctgctcccgccgcgctggaactggtgtgcccgagctcagtgcagtctgatgagtccttagatctctctatccagaatcgggggggctccgggttggaagcggcttactccatcgtcgctctgggcgaggagcctgctagagcagtgcacccactttgcccgtcagacactgaaatttttcctggaaatggtcattgctacagactggttgtggagaaagctgcctggctacaggcccaggaacagtgccaggcctgggccggggcggccttagctatggtcgattcaccagccgtccaaaggttcctggtctcaagggttacgaggtcccttgacgtgtggatcggattttcaactgtgcagggggtggaggttggaccggctccgcagggagaggcattctctttagaaagctgtcagaattggctgcctggggaaccacacccagctacagcagagcattgcgttcgactaggaccaacgggatggtgtaacacggacctatgtagtgcaccgcattcttatgtctgtgagttgcagccaggcgggccggtgcaggatgctgagaatctgttggtgggtgcacccagcggggacctccaggggcccctcaccccccttgcccaacaagatggcttgtctgcaccacacgaacccgttgaagctggtatgggttccgttgaattgagaaggccacctgcccaccaggtcatggttttccctggcctgaggctctcgagggaagctttcctgacaaccgccgaattcggaactcaggagctccggaggcctgctcagcttcgtcttcaggtgtacagactgctgtccactgccggtacccctgagaacggaagcgaaccagaatcgaggtctccagacaatcgcacccagttggcgcctgcgtgtatgcccggcggccgatggtgtcccggggccaatatctgcctacctttagacgcctcttgccaccctcaagcatgtgccaatggctgtaccgagggggagcacgtcgtggatgtcgtggtcgaaaattcagcctccagggcaaatctatcccttcgcgtcacggcagaagagcccatatgtggcctgagggctacaccctccccggaggcgagagtgttgcagggcgtgcttgtccgttactcccctgttgtcgaagctggtagtgatatggtgtttcgatggacaatcaatgataagcagtcgctcacattccagaacgtggtcttcaacgtcatctaccaatccgccgctgtatttaagttatccctcaccgcctcgaaccacgtatccaacgtcacggtcaactacaatgtgactgtggagcggatgaatcgcatgcaggggttgcaggtgagcactgtgcccgccgtgctgagtcccaacgccacccttgcccttacagcaggagtgctcgtggactctgccgttgaggtcgccttcctgtggacgtttggcgacggcgagcaggcgctgcaccagttccagccaccatacaacgaatcgttcccagttcccgaccctagcgtcgctcaggtactggtcgaacataacgtgatgcatacatacgccgcaccaggagagtatctgctaaccgtactggcctcaaacgcgtttgagaatctgacacagcaggtccctgtttccgttagagcctcgctgccttctgtcgctgtcggtgtatcagatggtgtgctttctcaacctgccgccaatcacacatacgcgagccgcgggacctatcacgtgaggctcgaagtgaacaataccgtgtcgggcgccgcggcacaagctgacgtgcgggtgttcgaagaactgagaggccttagtgtcgacatgagcctggccgtcgagcagggtgcccccgtggtcgtgtctgcggctgtgcagacgggcgacaatattacgtggactttcgatatgggggatggcactgtgctctccggcccagaagccaccgtggagcatgtctacctgcgggcccagaattgcactgtgactgtgggagccgctagccccgcaggacacctagctagatcgcttcacgtcctcgttttcgtattggaagttctgcgcgtagaacccgctgcctgtatacccacccagccagacgctagactgacagcgtacgtgaccggcaaccccgcgcattacctctttgactggactttcggggatggctcatcaaatactaccgttagagggtgtcccaccgttacccacaatttcaccagatcaggaactttcccactggcactggtgctatccagtcgagtcaaccgggcccattattttacctccatttgtgtagaacctgaggtcggtaacgtgacgctgcagccagagcggcagttcgtccaactcggcgacgaggcctggctagtggcatgcgcctggcctccttttccttataggtacacctgggactttggcacagaagaggccgctcctacccgggcgaggggacctgaggtgacctttatctacagagatcccggtagttacttagtgaccgtgacagcatctaataatatttctgccgccaacgattctgctttggtggaagtgcaggagcccgtgctagttactagcattaaggtgaacggctcgttaggactcgaactccagcagccgtatctgttctctgctgtcggccgcggacgtccagcgtcatacctttgggatcttggagatggtggatggctggagggcccggaggtcactcatgcctataatagcactggagacttcacaggacccggccctggtaggcagcggcagcgcttactggctcatcgtgaagctgggacttatcatgtgcaacttcgggccacaaacatgctgggttcagcttgggccgattgtactatggattttgtagaacctgtggggtggcttatggtagctgcttctcccaatcccgccgctgtgaacacatccgtcaccctaagcgcggagctggccggagggagcggagtggtgtacacgtggtcgctggaggagggcctgtcctgggagacctctgaaccttttaccactcattctttccctacccctggcctccacctggttacaatgactgcggggaacccactgggctccgccaatgccacagtggaggttgacgttcaggtgcccgtctccggcctgtctattcgggcttctgaaccaggcggatccttcgttgcagccggctcatcggtgcccttctggggacagttagcaacaggcacaaacgtctcttggtgttgggcagttccaggaggctctagtaagcggggcccccacgtaaccatggtgttcccggacgcgggaacattcagcatacgcttaaacgcgagcaatgctgtgagctgggtgtcagctacatataacctgactgccgaggaacctatcgtgggactcgttctctgggcctctagtaaggtggtcgcccccgggcagttggtacacttccagatcttgttggccgctgggagcgccgtgactttccgactgcaggacaccgatgagcccagagcagagcacagctatctgaggcccggggactacagggttcaggtgaacgccagtaacctcgtaagctttttcgttgcccaagccacagtaacagtgcaagtgcttgcatgtcgagaacctgaagtagatgtggttctgccactgcaggtccttatgcgacggagtcagcggaactatctggaagcacacgtggatcttagggattgtgtaacctatcagacagaatacaggtgggaggtgtatagaaccgccagctgtcagcggcctggtagacctgcacgtgttgccctccctggcgtggacgtaagtaggccacgcttagttttgcccaggctagcactgccggtcggccactattgctttgtttttgtggtgtctttcggagacacacctcttacacaatccatacaggctaatgtgaccgtggccccagaacgactcgtgcctatcattgagggagggagctatcgggtatggtccgacacgcgggatctagtgctcgacggctcagaatcctacgatccgaaccttgaggacggggatcagactcctctgtccttccactgggcctgtgttgcctctactcaacgggaggccggtggctgtgcactcaatttcggcccccgcggatcttccacagttacaattcctcgggagcgcctcgccgcaggcgttgagtatacttttagtctgaccgtgtggaaagccggccgaaaggaggaagcaaccaatcagactgttctcattagaagcgggagggtccccatagtgtccctggagtgtgtttcctgcaaagctcaggcagtgtacgaagtgagtcgatcctcctatgtgtatttagaggggcggtgcctgaactgttctagcggaagtaagcggggaaggtgggccgcaaggaccttttccaacaagaccttagtcttggacgaaaccaccacaagtaccgggagtgccggtatgcgtctcgtactgaggaggggagtcctaagagatggtgaagggtacaccttcaccctgaccgttctagggagatccggcgaagaagagggatgcgctagtattaggctgagcccaaatcggccgcctctgggtggatcctgccggctgttccccctgggagccgttcatgcgctcaccaccaaggttcactttgaatgtactggatggcatgacgcagaggacgcaggggcccctctggtatacgcgctgttgctgcggcggtgtcggcagggacattgcgaggagttttgcgtgtacaaggggagcctttcttcctatggggcggtactgccacctggcttccggcctcacttcgaagtaggactcgcggtggtcgttcaagaccagttgggcgccgccgtcgtggcccttaatcgctctcttgccatcacgctcccagaaccgaatgggtccgccacagggctcaccgtgtggcttcatggcttaacagcctccgttctgccgggactcctgagacaggccgatccccagcatgtgatcgaatattctttggcactggttactgtcttgaacgagcacagggctcagattcgcaagaacatcaccgagacattggtgtcgcttcgggtgcacacagtggatgacatacaacaaattgctgcggcccttgcccagtgtatgggtccctccagagagctggtatgtcgctcttgtctgaaacagacactgcacaagcttgaagcaatgatgctgattttacaggctgagaccactgccggtaccgtgacacctacagcgatcggcgactccatcctgaacattaccggcgatctgatccacctcgccagctccgacgttcgcgctccgcagcctagcgagctgggagctgagtctccttcacgaatggtggcttcccaagcatacaatttgacgtcagctctgatgcgaattcttatgcgatcaagagtgctaaatgaggagcccctgactctcgcaggcgaggagattgtcgctcagggaaaacggtctgaccccaggtcactgctctgttatgggggagcaccgggtcctggatgccacttctccatacctgaagccttctctggggctctcgcgaacctgagtgatgtggttcagcttatctttctggtagatagtaacccttttccctttggctacatatccaattacaccgtctcaactaaagtggcttcaatggcattccaaacgcaggctggagcccagattcccatagagcgcttggcttcagaacgagctataactgtcaaagtgccaaataacagtgattgggcggccagaggacatcggagtagcgcgaacagcgcgaattctgttgtcgtgcagccacaggctagcgtgggggccgttgtgactcttgattctagcaaccccgccgctgggctccacctgcagctgaattacactctgctggatggccattatcttagcgaggaaccagagccttacctagcagtctaccttcactcagaaccgaggccaaacgaacacaactgcagtgcctcccgtagaatcagacctgaatcattgcagggggccgaccacagaccttacaccttttttatctcaccgggcagccgggatcctgccgggtcttatcatctgaatctgagttcccacttcagatggagcgctttgcaggtctctgttggcctttacacttccctgtgtcagtacttctccgaggaagacatggtgtggaggactgagggcctccttccactcgaagagacaagtcctaggcaggctgtctgcctaaccagacacttgaccgccttcggggcctccctgttcgtgccacccagccacgtgaggttcgttttcccggagcctacagccgatgtcaattatatcgtgatgctgacatgcgccgtctgtttagtgacctatatggttatggctgctatcctgcataaacttgaccaattagatgcctctaggggccgggcaattcccttttgcggccagcggggtagatttaagtatgaaatcctcgtcaagactggctgggggcgggggtcaggcaccacagcccacgtcggtatcatgctgtacggtgtggacagccgctccggccatcgacacctggatggggacagagcatttcacagaaattcattggacatcttccgtatcgctacaccacattcattagggtctgtgtggaaaatcagggtctggcatgataataagggactcagccccgcttggttcctgcagcatgtcatcgtcagggacctgcagaccgctagaagtgccttttttttggtcaacgactggctgtcagtagagaccgaagccaacggtgggctcgtggaaaaggaggtcctggccgcctccgacgctgccttgcttagatttcggagactgctggtagcagagctgcagcgcggatttttcgacaagcacatttggctgagcatttgggatcgccccccacggtctcgcttcactcggattcagcgcgccacctgctgtgtgcttcttatctgcctattcttgggagctaacgctgtgtggtatggtgctgtgggtgattcggcatactcaacagggcacgttagccgattgtcacccctgtccgtcgacaccgtggcagtaggtctggtgtcaagcgttgtggtctatcctgtgtatctcgccatcttgttcctgttccgcatgtcccggagcaaggtcgccggcagccccagccccacgcccgctggccagcaggtcctggacatcgacagctgccttgattcatcggttctggatagctcatttttaactttttcgggcctccacgcagaggcatttgtaggacagatgaaaagcgatttgttcctggatgacagcaagtccctagtgtgttggcccagcggggagggcacgcttagctggcctgatcttctatcagaccccagcattgtaggaagcaacttgagacagctggcacggggacaggctggccacgggctgggcccagaagaggacggattcagtcttgcctctccatacagccctgccaaatcattcagcgccagcgacgaagacctgatccagcaagtgctggcagaaggagtgtcaagtccagccccaacacaggacacacacatggagaccgacttattaagctccctgtcctccactcctggtgagaagacagaaacgctggctctgcagagactgggagagctgggcccaccctcaccagggcttaactgggagcagccacaggccgcgcgcctctcgagaacagggttggtcgagggcttgcgcaaaagactcctaccagcatggtgcgccagcctggcacatggactctcactgttgctggttgctgttgcggtggcagtttctggttgggtgggcgccagtttcccccccggagtatccgtggcctggctgctgtccagcagcgcttcatttctggcctctttcctggggtgggagcccttgaaagtactgctcgaggccctgtattttagtctggtggcaaagagattgcaccccgacgaggatgatacattggtggaaagcccagcggtaactcctgtgagcgccagggtgcctcgtgttagacccccacacgggttcgccctgtttctcgcaaaggaagaagccagaaaagtcaaacggttacatggcatgttaaggagcctcctcgtctacatgttattcctgctcgtgacgctccttgcaagctatggcgatgcctcctgccatgggcacgcctatcgtctgcagagtgctatcaaacaagaactccattctcgggccttcctcgcaattacacgatccgaagagctttggccatggatggcccatgtgttactcccatatgtgcatggcaatcagtcttcacctgaactcgggccccctcgactcagacaagtgcgtttacaggaggccctctatccagacccacctggacccagggtccatacctgtagcgccgcaggagggttctccacaagtgattatgatgttggatgggaatccccacacaatggctctggtacttgggcctacagcgcacctgatttgcttggagcctggtcctggggcagttgtgccgtgtacgactcaggagggtatgtccaggagctcggcctttctctcgaggaatcccgcgatcggcttagattccttcagcttcataattggctcgataatcggtctcgggctgtctttctcgaactgacgcgctactcgcccgcggttggcctgcacgcagctgtgactctacgcctggagttccccgcggccgggcgggccctggcagctctatccgtgcggccatttgcactgcgccgtttgtcagccggactgtcactacctcttctgacttctgtctgcctgctattgtttgctgtgcactttgccgtggcagaagcaaggacatggcaccgcgagggcagatggcgagtgttaaggctcggggcctgggccaggtggctcctggtcgccctcacggccgctacagccctggtgagactggcccaactgggcgccgcagaccgacaatggactaggttcgtccgggggaggccaaggcgtttcacatcattcgatcaagtcgcccagcttagctctgcagccaggggcttggcggcaagtttgttatttcttctcctagtgaaagccgcccaacaactgcggttcgtgcggcagtggtcagtttttggcaaaactctgtgtagagcccttcccgaactccttggtgtgacactgggtttggttgtgctcggcgtggcttacgcccagctggcaatactactggtctcgagctgtgtggactctctttggtccgtcgcccaggccctgctcgtcctgtgtcccggcacgggtctctcaactctgtgtccagccgaatcttggcacctaagccctctgttgtgtgttggcctgtgggcactaagactctggggagccctgcgtctgggagcagttattctgcgatggcggtaccatgcgctgcgtggagaactgtacagaccagcatgggaaccccaagattatgaaatggtggagttgttcctccgcaggttacggttgtggatgggcctaagcaaggttaaggagtttcgccacaaagtacggtttgagggaatggagccgttaccatctcgctccagccggggcagcaaagttagccccgacgttcccccccccagtgctggttcagatgcatcccaccccagcacatcaagttcccagctcgacggcctatcagtgtcattaggcaggctgggaactcggtgcgagcctgaaccatcgcgactccaggctgttttcgaggcactgctgacgcagtttgatcggctgaaccaggctactgaagatgtctatcagttggaacaacaactgcattccctccaggggcgaaggtccagtcgtgctcccgccggtagctcgaggggaccttctcctggtctacgccccgctctgccaagccggctggcccgagcctcaagaggtgtagatctggctacagggccctctagaaccccgttaagagccaagaataaagtgcaccctagcagtacctag

SEQ ID NO: 199991 - DNA, 3693 bp, Artificial Sequence
  Description of Artificial Sequence: Synthetic coding sequence
atggtggccgccagccccaaccccgccgccgtgaacaccagcgtgaccctcagcgctgaacttgccggaggatcaggcgtggtttatacttggagcctggaggaggggctctcatgggagacgtctgagccctttactacgcactcttttccaacaccgggcctgcacctcgtcacgatgactgcagggaaccctctaggatcagcaaatgcaacagtggaagttgacgtccaggtcccagtcagtgggctctcaattagagcctccgaacccggggggagtttcgtggcggcaggttcctcagtgcccttttggggccagttggcgacagggacaaacgtgagctggtgttgggcggtgccggggggcagctcaaagcgaggaccacacgtgaccatggtgttcccggacgcaggcactttttcaattaggctgaatgcttcgaatgctgtttcttgggtgagtgctacctataacctgaccgctgaagaacctatcgtgggtctggtgctatgggcgtccagcaaagtggtggccccaggtcagctcgttcacttccagatactgctggccgccgggtccgccgtgacttttcgcttgcaggtgggcggagccaatccagaagttttgcccggcccacggttcagccactcattccctagggttggtgaccacgttgtgtcagtcaggggcaagaaccatgtgagctgggcccaggctcaggtccgcatcgtggtgctggaggctgtaagtggcctgcaggttccaaactgttgcgaaccaggaattgccacaggcacggaaaggaatttcaccgcacgagtgcaacgtggatctagggtcgcttacgcgtggtactttagcctgcaaaaggtacaaggcgattcactggttatcctttcgggaagggacgtgacttataccccggtggctgcaggactgctcgagatccaggtccgggcttttaacgctctgggatcagaaaaccggactctggttctggaagttcaggatgctgtccagtacgtggccctgcagtccggtccctgttttacaaaccgaagtgcgcagttcgaggcagccacatccccgagtcccagacgcgttgcataccattgggattttggagacgggtcacccggccaggacacagacgagccgcgggccgagcactcatacttgcgacccggagattatagggttcaagtcaacgcctcaaatttggtatcttttttcgtagcccaagctaccgtaaccgtgcaggtgctggcctgtcgtgagcctgaagtagacgtggtgttacctttgcaggtgctgatgcgtcgaagccagcgtaactacctggaggcacatgttgacctgagggattgtgtcacgtaccagacagagtatcgctgggaagtgtacaggacagcaagctgtcagcgtcctggaaggcccgcccgcgtcgccctgcccggagtggatgtctctaggccccgtctagttttaccccgacttgctctgcctgtgggtcattattgcttcgtcttcgtagtgtcttttggcgacacaccacttacacagagtatccaagcaaacgtgacggtggcccccgagaggctggtgccaatcatagagggggggtcctatcgggtttggagcgataccagggaccttgttctggacgggagcgaaagctacgacccgaatctggaagatggcgatcagactcccttatccttccactgggcttgtgtggcctcgacacagcgtgaggccggagggtgcgccctgaactttggacccagggggagctccacggtgactatccctagagagagactggcagcaggcgtggagtatacattctctctcactgtatggaaggccggtcgtaaagaagaggcgacaaatcagacagtcttgattagaagtggcagggtgcccatagtgtctctcgaatgcgtctcttgcaaagcccaggctgtctacgaggtttcgcgcagcagctatgtttatctggaaggtcggtgcctaaattgctccagcgggtcaaagcgtgggcgctgggccgctcgcacttttagtaataagacgttggtcttagatgagactaccacttccaccggctctgctggcatgcggttggttctgagacgcggcgtgctcagagacggagagggctacaccttcacactcacagttttagggaggagcggggaagaggagggctgcgcgtcaatcagattgtcccctaaccgtcctccactcggtggcagctgtaggctcttccctctgggcgccgttcatgctctgacgacgaaagtacacttcgaatgtacaggatggcacgatgcagaagacgccggagctccacttgtgtatgcccttttgcttcgacgctgtcgccagggccactgtgaagagttttgcgtgtacaagggtagcctatccagctacggcgcagttctgccccccggctttcgaccccacttcgaagtaggcttagccgtcgtcgtgcaggaccaactcggcgcagccgtggtcgctttaaatcgatccctggcaatcaccctgccggagccaaacggtagtgccaccggattgacagtctggctccatggactgacagcatctgtgttgcccggactgttgcggcaggccgacccacagcatgtgatcgagtactcgttggccttagtaacggttctgaacgagtatgagagggctcttgatgtcgccgccgagcctaagcatgagcggcaacaccgggcgcagatcaggaagaatattaccgagactttggtgagtttgagggtacacacagtggatgatatccagcaaattgcagcagcgctggcccagtgcatggggcctagccgggagctggtgtgccgcagctgtttgaagcaaacgctgcataagctcgaggccatgatgttgatcctccaagcggagaccaccgccgggacggtgaccccaactgcaataggggatagcattttgaatataacgggggatctgatccacctcgccagttctgacgttagagccccgcaacctagcgaattaggtgcagagtcaccgtctagaatggtcgcctctcaggcttataacctgacgtcggcgctgatgcggattctgatgcgtagtagagttctgaacgaggagcctttgacactggctggggaagagatcgtggcccagggaaagcggagcgacccccggtctcttctctgctacggaggcgcccctggtcccggatgtcacttcagtattccagaagccttttccggcgccctggctaacctctctgatgtcgtacaactaatttttcttgtggactccaacccttttccatttggatacatcagtaattacaccgtgagtacaaaagcgccgccaaccccccccacacctctgtggagctctccccgtccaccttctgtgctatggtcaccatggaccgccgcaacgctgagacccggctgcatctgttccagcacgatccgctgttggaccgccactacctgtttaagaaacctctcacctacctggcagagcacttacacacggtccccagggccaatgtccacaaccgcccgactcgccggcggcagcgcccagagtcactccagggttcttactactgggcctactccttcttcttttccacgaggcgcagaaacccagcggggagtcacaatttag

SEQ ID NO: 199992 - DNA, 12909 bp, Artificial Sequence
  Description of Artificial Sequence: Synthetic coding sequence
atgccccccgccgcccccgcccggctggccctggccctgggcctgggtctctggctcggggccctggccggaggcccagggcgcggttgcggaccatgcgaaccaccctgcctgtgtggcccagctccaggcgccgcttgcagggtgaactgttctggccgcgggctgcgtactctgggaccagccctgcgcatcccagcggacgccacagcgctggacgtttcccacaacctgctacgcgcccttgacgtggggctgctggccaacctcagtgccctggccgaactggatatatcaaacaataaaatctcaacactggaagagggaatcttcgcaaacctgtttaatctttcagagatcaatctgtcaggcaacccatttgaatgtgactgcgggctggcatggctccccaggtgggccgaggagcagcaagtcagagtggtgcagcccgaggccgcaacgtgcgccggaccaggctctctggccggccagccgttgctgggaatccccctcctcgactcaggctgtggtgaagaatatgtggcgtgtcttccagacaatagctctggaacagtggccgccgtgagtttttccgcggctcacgaaggactgcttcaaccggaagcatgctcagctttttgtttctcaacgggccagggactagctgcactgtctgagcaggggtggtgtttatgcggcgctgctcagcccagcagtgcctcctttgcctgcctgtctctgtgttctggaccacccccgccacctgcacctacttgcagaggtccaactctgctgcagcatgtgttccccgcaagtcctggtgccacgctggtgggtccacacgggcctctcgcctccggtcagctggccgctttccacattgccgcccctctgcctgtgactgcgaccaggtgggactttggggatggatctgcggaagtcgatgccgcaggacctgcggctagccatcgatatgtgctcccggggcggtaccacgtcactgccgtgcttgcgcttggtgcaggctcagccctgcttggcaccgatgtgcaagtggaggctgctcccgccgccctggaactggtgtgtccgagctcagtgcagagcgacgaaagcctggacctttccatccagaacaggggcggatcaggactggaggcagcttacagcattgttgctctcggggaagaacccgccagagccgttcatcctttgtgcccatccgacaccgaaattttccccgggaatggccactgctacagactggtggtggaaaaggccgcctggcttcaggctcaggaacagtgtcaagcctgggccggggccgctcttgcgatggtggatagccccgctgttcagagattccttgtgagccgggtgaccaggtcactcgacgtgtggataggattttccaccgtccagggagttgaagtgggccctgccccacagggggaggccttctcactggaatcgtgtcagaactggctccctggtgaacctcatcctgccaccgcggagcactgtgtcaggctgggccccactggctggtgcaataccgacctgtgcagcgcaccacacagttacgtgtgtgagctgcagcccggcggccctgtgcaggacgccgaaaacctactcgtaggtgcaccctcaggagatctgcaaggccccttaacgccattggctcaacaggatggcctcagcgccccgcatgagcctgtcgaagtgatggtattccctggccttagactcagtcgggaagcttttttgaccacagcagaattcggtactcaagagttgcgccgtccagcccaactgcgtctgcaagtatacaggttgttatccacagccggtacgcccgagaatgggtctgaacctgagtcacgtagcccagataatcggacccaattggcccctgcttgcatgcctgggggcaggtggtgcccaggggccaacatatgtctgcccctcgatgccagctgtcacccccaggcatgcgccaacggctgcacctctggccccggcctgccaggagctccctacgctctgtggcgagaattccttttttccgtgccggcaggtccgcctgcacagtatagtgtcacccttcacgggcaagatgttctgatgttgccaggggatttggtgggattgcagcacgacgccggtccgggcgctcttttgcattgttctcccgctcccggtcatccgggaccaagggcgccttatctaagcgccaatgcctcctcatggttgcctcatctgccggctcagctcgagggcacctgggcttgtcctgcttgtgctctgcggctcttggctgcaacggagcagctgactgtactgttgggtcttagacctaaccccggcctgaggctacctggtcgctatgaagttagagctgaagtcggaaacggagtgtctcgacataatctgtcgtgtagttttgacgtggtgtccccggtggccggcctgagggtgatttaccctgcaccacgtgacggcaggttgtacgttcccacaaacggttctgcccttgtgctacaggttgattcaggcgccaacgccacagccactgctcgatggccggggggatcagtgagtgccagatttgagaacgtttgtccggcactcgtggccacatttgtgccaggatgtccctgggagacaaacgataccttgttttcagttgttgctctgccttggctaagcgaaggcgaacacgtcgtggatgttgtagtggaaaattccgcttctagagcaaatctctcccttcgcgtcacagcggaggagcccatctgcggtcttcgtgccacaccttcaccggaggcccgggttttacagggcgtgcttgtacgctactcgcctgttgtggaggctggttcggacatggtgttccgatggacaatcaatgacaaacagtctctaacttttcagaacgttgtattcaatgtgatataccagtcagccgccgtattcaagctgtccttaacggcatcaaaccacgtgtctaacgtaactgttaactataatgttaccgtggagcggatgaatcgcatgcaaggccttcaggtgtccacagtacctgccgtgttatcacccaatgctacactcgccctcactgccggcgtactggtggactccgctgtggaggtcgcattcctttggacatttggagacggcgagcaggcgcttcatcagtttcagccaccctataacgaatctttccctgtcccggatccgtccgtggcccaggtgctggtcgagcataatgtaatgcacacatacgcagcacccggcgagtatctgctcaccgttctggcaagcaacgcgttcgaaaatttgacacagcaagtccctgtgtcggtgcgagcatctttgccaagcgtggccgtcggggtgtcagacggtgtgctcgtcgctggacggcctgtgactttttacccgcacccacttccaagcccaggaggggtcctgtatacttgggatttcggagacggcagtccggtgctgacgcaatcacagccagcagccaatcatacatacgccagtaggggcacctatcatgttcgcctagaggtgaataatacagtctctggggctgcagcacaggcagacgtgagggtttttgaagagttgagggggttaagtgtggatatgtcactggcagtggagcagggcgccccagtggtggtgagcgccgccgtgcagaccggcgacaacatcacatggacatttgatatgggggacggaacagttctgtcagggcccgaggcaactgtagaacacgtgtacctccgagcgcagaactgtaccgtcaccgtaggggccgcttcccctgcaggacacctggccaggtctctgcacgtcttggtattcgtgctggaagtcctgcgggtggagcccgctgcttgtatccctacccagcccgacgcaaggctgaccgcttacgtcacgggaaatcctgctcattatttgttcgactggacatttggagatggctcatctaacactaccgtccgcggctgcccaaccgtgacacataacttcacaaggagcggcacattccctctggcactggttctgtcgtcccgcgtaaaccgcgcacattattttactagtatctgcgtggaaccggaagtcggcaacgtaaccctccaacccgaacggcagtttgtccagttgggcgacgaagcttggcttgttgcctgtgcgtggccacctttcccgtaccggtacacctgggatttcgggacagaggaagccgcacccactagggccagaggaccagaggtgacatttatctaccgcgatcctggctcttatctcgtaaccgtgacggcttccaacaatatttctgccgccaacgactctgctctggtggaagttcaagagccagttctcgtgacctccattaaagtcaacgggtctttagggctggagctccaacagccataccttttctccgcagtgggccgtggaaggccagcttcctatctttgggacttaggcgacgggggctggctggagggccctgaggtcacacacgcctataactcaactggagacttcactgtccgggtcgccgggtggaacgaggtgtcacggagtgaggcatggctcaatgtgaccgtgaaacggcgcgtcagggggctggtggtgaacgcaagcagaaccgttgtgcctcttaacggatccgtgagcttctcaacctccctggaggcaggatctgatgtgcgatacagctgggttctctgcgaccggtgtacgcctattcctggaggtcccaccatcagctatacattccgaagtgtagggacatttaacatcattgtgaccgccgagaatgaggtcggttcagcccaggatagcatctttgtctacgtgctgcaactgatcgaaggtctgcaggttgttggtggtggccggtacttccctactaaccataccgtccagctacaggccgttgtgcgagacggcactaatgtgagctattcttggaccgcatggagagatcgggggcctgctctagctggatccgggaaaggattctctctcactgttctcgaagccggcacatatcacgtgcaactgagagcgaccaacatgctgggtagtgcttgggctgattgcacgatggactttgtcgagcccgtggggtggttaatggttgcggccagtccaaatcccgcggctgtcaatacctctgtaacactaagtgctgagttagctggaggcagcggcgtcgtttacacttggtctcttgaggaagggctgagttgggagacatccgagccttttaccacccatagtttccccactccgggactccatctggtgactatgacggctggcaatccactgggatcggctaatgcaacggtggaagtggatgtgcaagtgccggtgagtggcctttcaatcagggcctcggagccaggcggcagctttgttgccgctggatcttcagtccccttctggggccagctggcaactggaactaacgtttcctggtgttgggctgtcccagggggaagtagtaaaaggggcccacatgttacaatggtttttccggatgccggaactttctctatccgtctgaatgcaagcaatgcggtcagctgggttagcgccacgtacaatctgactgccgaagaaccgatcgtcgggctggtgctttgggcatcgagcaaggtagtcgcccccgggcagctggttcattttcagatcctgctggccgcaggctccgccgtgaccttccggctccaagtgggtggagctaaccccgaggtgttacctggaccccgattctctcactcatttcccagagtgggcgatcatgtcgtcagcgtgcgcggtaagaaccacgtgagctgggcacaggcacaggtgagaattgtggtgttggaggcagtgtccggactgcaggtgcctaattgctgcgagcccggtatcgctaccggaacagagcgaaatttcacggctcgagtccagaggggcagcagggtggcctacgcttggtatttttccctccagaaggttcagggcgactccctggtcatcctgagtggccgggacgtcacttatacacctgtggcagcgggccttctggaaatccaggtgagagctttcaacgcactgggatcagagaatcgcacattagtactggaggtgcaggacgcggtacagtatgtggcactgcagtccggcccttgcttcactaataggagcgcgcagttcgaggcggccacaagcccctcccctagacgggtggcttaccactgggacttcggcgatggaagtcctgggcaggacactgacgagccccgggctgagcactcatatcttcgtccaggcgattaccgcgtgcaggtgaatgcatccaacctcgtgagcttctttgtcgcccaggctactgtgacagtccaggtgctagcctgcagggaacccgaggtggatgtcgtcctgccgctgcaggtccttatgagaaggtctcagcggaattaccttgaggcccacgtagatcttcgggattgcgtgacctaccagaccgagtataggtgggaggtgtatcgcactgcctcatgtcagagacccggaagacctgcccgtgtggccctcccgggcgttgatgtgtctcgcccacgtctggttttaccaaggctcgccttgccagtcggtcactactgcttcgtttttgttgtgagcttcggggatacgccactcacgcagtctatccaagcaaatgttacagttgcgccagagaggctggtacctataatagaaggcggctcataccgggtgtggagtgatacgcgcgatctcgtgcttgacggttctgagtcctacgatccaaatctggaggacggagatcagacccctctgagctttcactgggcctgcgtcgcctctactcagagggaggccggaggttgcgcgctcaatttcggacctcgcgggagcagtacagtgaccatcccccgtgagcgactggccgcgggagtcgagtacacattctccctaactgtttggaaagctggacgcaaagaggaagcaacaaatcagaccgtgctcattcggtctggccgtgtccccatcgtctcactggagtgcgtgtcctgcaaggctcaggcagtctacgaagtgtccagatcatcttacgtgtatctggagggtaggtgcttaaactgttcctcgggttctaaaagagggagatgggccgccagaactttttccaacaaaacgttggtgctcgacgaaactaccacctctactggctcagcaggtatgcgactcgtgcttcgtcgaggcgtgttacgcgacggcgaggggtatacattcacactcaccgttcttgggagatccggcgaagaagaagggtgcgcttccattaggctgagtccaaacagaccacccctgggaggatcttgtcggttatttcctctgggcgctgtgcatgccctcacaacaaaggttcactttgagtgcacggggtggcacgatgctgaggatgctggcgcccccctggtttatgccctgcttctgcgacggtgtcggcaagggcattgcgaagagttctgcgtgtataagggctcgttgagctcttatggagccgtactgccacccggatttagaccacacttcgaagtggggctagctgtcgtagttcaagaccagctgggggcagccgtggttgcgctaaaccgatccctggcaatcacgctcccagagcccaacggcagcgctaccggcttgactgtgtggttacatgggcttactgcatccgttctgcctgggttgttacgccaggctgacccccaacatgtaattgagtactctcttgctctcgttactgtgctaaacgagtatgagcgggctctagatgtcgcagctgaacccaaacatgaaaggcagcacagagcacagataaggaagaatataactgagaccctggttagcctgcgggtccacacagtcgacgacatccaacagattgctgcagccctggcccagtgcatgggaccatccagagaacttgtttgcaggagctgcttaaagcagacccttcataagctggaggctatgatgctgatccttcaggcagagactaccgcaggtaccgtcaccccaacagctatcggagactctatcctgaatattacgggggatctgatacaccttgccagttcagacgtccgggcgccacagcctagtgagcttggcgctgagtccccgagcagaatggtagcgagccaggcctacaatttaacatctgccctcatgaggattcttatgcgtagccgtgttctaaatgaagagccattaacgctcgcaggagaggaaatagtggctcagggtaaaagatcggatcccagaagcctcctttgctacggaggcgctccggggccgggatgtcacttcagcattcccgaagcttttagcggggcgctggccaacttgagcgacgttgtacagctgatatttctggtcgattctaacccatttccgttcggctacatttccaactacaccgtcagtacgaaagtagccagcatggcctttcagacacaggccggcgcccagatcccgatagagcggttagctagcgagcgggccataaccgtgaaagtgcctaataacagtgactgggcagctcggggccacaggtcttccgcaaatagcgccaattcggtggtggttcagccccaggcatccgtgggggccgtcgttacactggactcttccaaccccgcagctggcctgcaccttcaactgaattatacactgctggacggtcattatctctccgaggagcctgaaccttacctggccgtgtacctgcactccgagcctcgaccaaacgagcataattgtagcgccagccgccgaattcgaccagaaagcctacagggggccgaccatcgcccctacacttttttcattagcccaggcagcagagatcctgccggatcttaccaccttaacttatctagtcatttccgctggtccgcccttcaggtttcagtgggactgtatacctccctttgccaatatttttcggaggaggatatggtgtggagaactgaaggtctgctgcccttagaggaaacaagccctcgacaggctgtctgtctcacccgacacctcacggcatttggagcatcgctttttgtccctcccagccacgttcgatttgtattcccagaacccactgccgacgtaaactatatcgttatgctgacatgcgcagtgtgcctcgtgacttatatggtgatggccgccatcctgcacaagctggaccaattggacgccagccgaggtagggctattcccttttgtggccaacgggggcgattcaagtacgaaattctggtgaaaacaggatgggggcgcggctccggaaccactgcgcacgttggcattatgctgtacggagtcgattcaaggtcgggccaccgtcatctcgatggagacagggcgttccacaggaattccctggacatttttaggatagccacccctcacagcctgggcagcgtgtggaagattcgtgtgtggcacgacaacaaaggcctatcacctgcatggttcctgcagcatgttatcgtgcgcgatctccagaccgcgcgatccgccttcttcctggtgaatgactggttaagcgtcgagacagaggctaatggaggactcgtcgaaaaagaagtgctcgcagcctccgatgcagctttactgagattccgccgactcctcgtggcagagttgcagcggggctttttcgataagcacatctggctatccatttgggaccgccctccaaggtctcgattcacacgcattcagagggcgacttgttgtgtcttgctcatttgtcttttcttgggcgcaaatgcagtctggtatggagctgtgggagactccgcatactccaccggccatgtaagtcggctctctcctctgagcgtggacactgtggctgtgggacttgtgagcagcgttgtcgtttatccagtgtacttggcaattctatttcttttcagaatgtccaggtccaaagttgccggaagcccttcgcccacaccggctggacagcaagtgttagatatagacagctgtctggatagttcagtcctcgactctagctttctgactttctcaggcctgcatgccgaggcctttgtcggccagatgaaaagtgacctttttttggacgactctaaatctctcgtatgttggccctcaggggaagggactttgtcctggcctgacttgcttagcgacccaagcatagtgggctcaaacctgaggcaactcgcccgggggcaggcagggcacggactgggtccagaagaggatgggttcagtttggcttcaccttattcaccagcaaagagtttctcagcttctgacgaagaccttatccagcaggtgctcgccgaaggcgtctccagtccggcccctactcaagacacacatatggagactgatctgctgtcttccctctccagcacgcctggcgaaaaaacagagacgctggcgctgcaacggcttggcgaattgggaccaccctctcccggattaaactgggagcagccccaggccgctcggttatccagaaccggactggtggagggactgcgaaagaggctgctacccgcctggtgcgcttcacttgctcacggcctcagtctcctcctagtagcagtggccgtggctgttagcggttgggtcggcgcctcatttcctcccggagtctcagttgcatggttgctcagctcttcagccagctttcttgcctctttcctgggctgggagccactgaaagtgctcttagaggcgctttacttcagtctggtggcgaagcggctgcaccccgacgaggacgataccctggtcgaatctccagcagtgacgccagtcagtgccagggtgcctagggttaggccccctcacggctttgccttattcctagccaaagaggaggcgaggaaggttaagcggctccatggaatgcttcggagcctgctagtttatatgttattcctgctggtgaccttattggcctcctatggcgacgcctcctgccacggccatgcttaccgccttcagtctgcaatcaaacaggaactgcatagtcgcgctttcttagccataacacgctcagaagaactttggccctggatggcccatgtccttctcccctatgtacatggcaaccagtcttctcccgagcttggaccacctcggctgcgtcaggtaagactgcaggaggccctgtacccagatcctccaggtcccagggtgcatacctgctcggcggccggaggcttttcaacatctgactatgacgtgggctgggaatctccccataacggatccgggacttgggcttattccgcacccgacctgcttggggcctggtcctggggaagttgcgccgtgtatgactcggggggctacgtgcaggagctaggactgtctctggaggagagtcgcgacaggctccgctttctgcaactccataactggctggataatcgaagccgggctgtgttcctggaactgacaaggtactctccagctgttggactgcatgctgcagttaccctgaggttagaatttccagccgcaggcagagccttggcagcattatctgtgagacctttcgcattgcgacgcttgtctgccgggctctctcttccgcttctgacctctgtctgcctgctgctttttgccgtgcattttgccgtagcggaggcccgaacatggcatagggaggggcggtggagagtgctgagactcggcgcatgggctagatggctccttgtggccctgactgctgccaccgcactggtccggctggcccagctcggagcggccgacagacaatggacacggttcgtgcggggccgcccccggcgttttacgtctttcgaccaggtggctcagctgagctccgccgctcgggggctcgctgcatctctcctcttcttgttgctggtgaaggctgctcaacagcttcgattcgtgcgtcagtggagtgtgtttggtaagactctgtgccgcgctcttccagagctgctgggcgttaccctcggactggttgttctcggcgtggcctatgcgcagctcgccatcctactggtgtcctcatgcgtggatagcctttggtctgtggcccaagctttgctggtcctctgtccagggaccgggctcagtacactgtgcccggctgaaagctggcacctatctcccctactgtgcgttgggctatgggcccttcgcctctggggtgctctgaggttaggagcagtcatcctgaggtggcgatatcatgcactacggggtgaactgtatcgacctgcctgggagccccaggactatgagatggtggagctctttctcaggcgactacgcttatggatgggactttccaaggtgaaggaattcaggcacaaggtgcgtttcgaggggatggagcctttaccaagtcggtcgagcagggggagcaaggtctctcctgatgtaccgccacccagcgcgggttctgatgccagtcacccgagtacttcttcatcgcagctcgacggactctcagtgagtctgggccggcttggtaccaggtgtgagccagaaccgtccaggttacaggcagttttcgaagctttgctgacccaatttgatagactgaatcaggcaacagaagatgtgtatcaactggaacagcagctgcactccttgcaaggtagaaggtccagccgagcacccgctggcagttcaagaggcccttcccccggactgcgcccggccctcccttcacggctggccagggcctctcgcggtgtagatttggccacaggaccctctagaacccccctgagggccaagaacaaggtgcacccctccagcacctag

SEQ ID NO: 199993 - DNA, 8550 bp, Artificial Sequence
  Description of Artificial Sequence: Synthetic coding sequence
atggccgaggaggccgcccagaacatcagcgacgaccaggagcggtgcctgcaggccgcgtgctgcctaagttttggaggcgaattaagcgtaagcaccgataaaagctggggcttgcacctctgttcctgctcacccccgggtggtggcttgtgggtggaggtgtacgcaaatcacgtgcttctgatgagcgacgggaaatgcggctgcccttggtgcgccctgaatggaaaggctgaagacagagaaagccagtctcccagttcgagtgctagtcggcaaaagaacatctggaaaacgacttctgaagccgctctatccgtggttaatgaaaaaacacaagccgtcgtgaatgaaaaaacccaggctccactagactgtgacaatagcgcagaccggatccctcacaagccctttatcattatcgctagggcctggtcctctggggggcctaggttccatcatcgcagactgtgcgcaacggggaccgccgattcgaccttctccgccctgctacagctgcagggcacgacttcagcggcagccccatgtagtctgaagatggaggcctcttgttgcgtgctacgcctcctttgctgcgctgaagatgttgctactggattgttgcccgggacagtgactatggaaacgccgaccaaggtggcacgtcctactcaaacgtcatcccagagagtcccactctggcctatcagtcattttcccacatccccccgcagtagccatggactccctcccggcatccctcgcaccccttcattcaccgccagtcaaagtggatctgagattctgtacccacccactcaacatccccccgtcgcaatcttggctcggaattcagacaatttcatgaaccccgtactgaattgctccttagaggttgaagcccgcgcgcctcccaatctgggcttccgagtccacatggccagcggagaggcactgtgcctgatgatggatttcggggattcatccggagtggagatgaggctccataacatgtctgaggccatggcggttacagcgtaccaccagtacagcaagggaatttttttccatctcttacactttcaactcgatatgagcacctataaagaggccgagacccagaatactaccttgaatgtgtacctgtgccaatcagagaattcctgcctggaggatagcgacccctccaacttaggttacgagcttatatcagctttcgtgacgaagggcgtatacatgctgaaagccgtcatctacaatgaattccacggtacagaggtcgagctcggcccttactatgtggagatcggtcacgaggcagtctccgctttcatgaactcctcatctgtgcacgaagatgaggtcctggtgttcgctgacagccaggtgaaccagaagagcaccgtggtcattcatcacttcccctctatcccttcctacaacgtgtctttcatctctcagacacaagtcggcgattcgcaggcttggcacagtatgaccgtctggtataagatgcagtccgtgtctgtgtatactaacgggaccgtgtttgccaccgacaccgacattaccttcaccgctgtgactaaagaaactatcccactggagttcgagtggtactttggtgaggaccctccagtgcgaaccacctctcgctctattaagaagcggctctctatcccccagtggtaccgggtcatggtcaaagcttcaaatagaatgtccagcgttgtgtccgagccccacgtgattagggtccagaaaaagattgtggcaaaccggcttacctctccgtcatccgccttagtgaatgccagtgtggctttcgagtgttggattaattttggaaccgacgtggcctacctgtgggactttggggacgggacggtgtcattggggagctcctcaagctctcatgtgtattcccgggaaggagagttcactgtggaggtgctggctttcaacaatgtatcagcctctactctccgtcaacagctctttattgtgtgtgagccctgccagccaccactcgtgaagaatatgggacctggaaaggtccagatttggcggagccagcccgttaggttaggagtcacatttgaggccgcagtcttttgtgacatttcacaaggcctttcatatacctggaatttaatggattctgagggcttgccggtttctttacccgctgccgtcgacacacaccgacagacattaatcctaccttcccacaccctggaatacggtaactataccgcattggcgaaggtccaaatcgagggcagcgttgtgtatagcaactactgcgtgggactcgaagttagagcccaggcacctgtctctgttatatccgaagggacccaccttttcttttctcgcacaacatcctcacctatcgtgttgagggggacccagagctttgatccagacgatcccggtgccactctgcgataccactgggaatgcgccactgctggctcacccgcccacccctgtttcgattctagcacagcccatcagctggatgctgccgccccaactgtctcatttgaggcacagtggctgagtgattcttatgaccagttcttggtgatgctacgggtgagctcgggagggcgaaatagcagtgagacacgggttttcttaagcccctatccagatagcgctttccgcttcgttcacatttcttgggtttctttcaaggataccttcgtgaactggaatgatgaactgagtctccaagccatgtgcgaggactgttccgagatcccaaatctgtcatattcttgggatctgtttttggtcaacgcgaccgagaaaaataggatagaggtgccgttttgcagagtcgtggggttgctcggtagccttggcctaggggctatttcagagtccagtcagctaaatttactgcccaccgagcccggtacagctgatccggacgcaactaccacacctttctccagggagcccagtccagtcacgcttgggcagcccgcaacctcagccccacgcggaaccccgacggagccaatgactggggtttattggatccctccagctggagattccgctgttctcggggaggccccagaggagggatcccttgacttagaaccgggtccccagtccaagggttctttaatgacagggcgtagcgagcggagccagcctacacactcacctgatccacacctttctgacttcgaggcatattactccgatatccaggaggcaatcccgtccgggggccggcagccagctaaggatacaagtttcccaggttctggcccatctctgagtgcagaggagagccctggggacggcgacaatctggttgatccctcactgtcagccggacgcgctgaacctgtgctgatgatagattggcctaaggcactcctgggtagggccgtattccaagggtatagtagcagcggcatcactgagcagaccgttaccattaaaccctacagcctgagttccggtgaaacgtacgtcctgcaggtgtccgtcgcatcaaaacatggactgcttggcaaagcccagctatacttgacagttaatcctgcaccgcgcgatatggcctgccaggtgcagccccatcatggcctggaggcacatacagtgttttcagtcttctgtatgtccgggaagcccgacttccactacgagttctcctaccagatagggaacacgagcaagcataccttgtatcatggtcgcgatacccagtactattttgtcctacccgccggggagcatttagacaattataaagtaatggtgtctaccgagatcacagacggaaaggggagcaaggtgcagccttgtactgtcgtggtgaccgtactgccaagatatcacggaaacgattgcctgggggaggacttgtacaatagctccctcaaaaacttgtccacattgcaattgatggggtcatataccgagatcaggaattatatcactgtgataacccgaattttgtcacggctgtccaaggaagacaagacggcatcttgcaaccagtggagtaggatccaggatgcgctgattagcagcgtgtgccggcttgcttttgttgaccaggaggaaatgattggcagcgtgctgatgctcagggatctcgtgtcctttagcaataaactgggatttatgtcagcggtactcatacttaaatacactcgcgctttgctagctcaggggcaattcagcggtcctttcgtaatcgacaagggtgttagactcgaactgatcgggttgataagcagggtatgggaagtcagtgagcaggagaactcgaaggaggaggtctaccggcacgaggagggaatcactgtaatctcggacctcctcttaggctgtctgagcctgaatcatgtgagtacggggcagatggagttcaggaccctgttacactataacttgcaatcctccgtgcagtctttaggttccgtccaggttcacctgccgggggacttggccggtcattcgccagctggcgcagagacacagtcgccttgctacattagccaactcattttgtttaaaaaaaacccttatccgggcagccaggcacctggccagattgggggggtggtggggctcaacctctatacatgtagtagtaggcgccccattaatcgccagtggttgcgcaagcccgtgatggtcgaattcggcgaggaagacggactcgacaaccgacgaaacaagacaacttttgtcttactcagagacaaagtcaatctgcaccagtttacagaactctctgaaaatccacaagagagcttgcagatcgaaatagagttttcaaaaccagttacgagggcgtttccagtcatgcttttggttcgcttcagtgaaaagcccactccatcagacttcctggtcaaacagatttacttttgggacgagagtattgtccagatttacatccctgccgcaagtcaaaaggatgcctcggttggataccttagtttactggatgccgactacgaccgtaagccccccaaccggtacctggcaaaagctgtcaattataccgtgcactttcaatggattagatgtcttttctgggacaagcgagagtggaagtccgagcgattcagtccacagcccgggacgtctcctgagaaggtaaattgctcataccaccgtttagcggcgtttgctctgttgcggcggaaactcaaggcaagctttgaagtttctgacatttctaagctacagtctcatcccgaaaacctcttgcctagcatctttatcatggggagtgttattctgtacggctttctggtcgctaaaagccgccaagtggatcaccacgaaaagaaaaaggccgggtatattttcctccaagaagctagtcttccaggtcaccagctgtatgcggtcgtcatcgatactggattcagggctccagctcgcctgaccagcaaagtgtacatagtgctctgcggtgataacggtctgtcagaaactaaagagctgtcctgtcccgaaaagcctctgtttgagcggaatagtcgacacacttttatcttaagcgcaccagctcagctgggactattgcgaaagattcgactgtggcatgacagtaggggacccagccctggctggtttatctctcacgtcatggtgaaggagctccacaccggccagggctggttcttccctgctcagtgttggctgtccgccggccgccacgacgggagagtggaacgggagctgacctgtttgcagggaggacttggttttagaaagctattttattgtaagttcacagagtacctcgaggattttcatgtgtggttaagcgtgtactcccgaccctcaagttcccgctacctgcatacaccgcgattgacggtgtccttctcattactgtgtgtctatgcctgcttaacggctttggtcgcagcaggtggccaagaacagccccatctcgacgtatcccctaccctcggttcgtttcgtgtcggactgctgtgtacactcctggcgtcccccggtgcacagcttctgtccctcctgttcagactctccaaggaagcgcccgggtctgctagggtcgaaccgcactcacctcttagaggtggagcccagaccgaagcccctcacggtcccaattcatggggacggatcccagatgcccaagagcctagaaagcagcccgctagtgctatcctgagcggctcaggaagggcacagcgtaaggccgcttcggataacgggactgcctgcccagcccccaagctgcaagtacacggggctgaccactccagaacctcattgatgggtaagtcccattgttgccccccccatacacaggcgccgtcctcaggactggagggattaatgccgcagtggtcgagggccctgcagccctggtggagcagcgcagtctgggcaatttgtggcaccgcttctcttgcctgttctctgggcacgggattcctcgcttatcgatttggacaagaacagtgtgtgcagtggctacatctgctgagcctgtcagttgtgtgttgcatctttattacccaacctttgatggtctgcctaatggcactgggctttgcttggaaacggagggctgataaccactttttcaccgagtccttatgcgaagcgacgcgtgaccttgacagtgagctcgccgagcgcagttggacaaggctgccattctcaagcagctgcagcatccctgattgcgccggggaggtggagaaggtgctggcagcacgccagcaggcaaggcacctacgctgggcacacccaccctcaaaagcacaattgcgcggaactcggcaaaggatgcggcgcgaatctcggaccagggcggccctgcgggacataagtatggatatcctcatgctgctgttgcttctttgtgtgatttatggtcggttttcccaggacgagtactctctcaaccaggcaatccgaaaagagtttactagaaatgccaggaattgtctaggtggtcttagaaatatcgctgattggtgggactggagtttgaccacactccttgacggtctgtatcctggagggactccttctgcccgtgttccaggagctcaacccggggccctcggagggaaatgttacctcatagggtcctccgtgatcagacaacttaaagtgttccctcggcacttgtgcaaacccccacggcctttttcagctctgatcgaggacagcattccaacatgctccccagaagttggaggacccgagaacccttatctcattgatcccgagaaccagaatgtgacccttaacggcccgggcggttgcggtacaagagaggactgcgtactgagtctgggtcgcacgcggacagaggcccacacagccttgtcacgtttaagggcttccatgtggatcgacagatccacgcgcgctgtcagtgttcacttcacactttataatccgcccacacaactctttacaagcgtgagccttagagtggaaatcttacccactgggtctctggtgccatcatctctggtagaaagcttttcaattttcagatcagactcagccttgcagtaccacctcatgttaccccagttagtgtttctcgctctgtcgctgattcatctttgtgtgcagctctatagaatgatggacaagggcgtgctgtcctattggcgtaagccgcgaaattggttagagctttccgtggtaggagtcagtctgacctactacgccgtgagcggacacctggtgaccctcgccggcgatgtcaccaatcagtttcatcgcggactctgtagggcattcatggacttaaccctcatggcctcctggaaccagcgggcccggtggctgcgggggatcctcctgttcttgtttacgttaaagtgcgtgtatttgccgggcattcaaaataccatggcatcctgctcttcaatgatgaggcattcactgccctccatcttcgtggcaggattagtcggggctctgatgctcgccgccctgagccatctgcatcgtttccttctgtcaatgtgggtgctcccccctgggacttttactgacgccttccctggcttgctcttccacttccccagacgctctcagaaagactgcctgttggggctaagcaagtccgaccagcgcgcaatggcgtgctatttcggaatcctccttattgtgtcagctaccctgtgctttggaatgctgcgagggttcctgatgactttgccgcagaaaagaaagtccttccagtcgaagagcttcgtgagactcaaagacgtgacagcctatatgtgggagaaagtcctgaccttcctccggctggaaactcccaagctggaagaggccgagatggtcgaaaatcacaactattacctcgacgaattcgccaatctgctcgatgaactccttatgaaaattaacggactgagtgattctctccaactgccattactggagaagaccagcaataatacaggtgaggcgcgcaccgaggaatctccactcgtagatattagttcctaccaagctgctgagcccgctgacattaaagacttttag

SEQ ID NO: 199994 - DNA, 495 bp, Artificial Sequence
  Description of Artificial Sequence: Synthetic coding sequence
tgagtgggcggccccgagaacccctacctgatcgaccccgagaaccagaacgtcactctgaatggtcccggcgggtgcggtacaagggaggactgcgtgctgagcctgggtcgtactcgaaccgaagcccataccgctctatcccggctgagggccagcatgtggattgaccgaagcacccgagctgtctcagtgcatttcactctgtataatcccccgactcagttgttcacatctgtgagccttcgcgtggaaatactacctaccggttcattggtgccaagctcccttgtggaatctttcagcatattccggagcgactccgctctccagtatcatttgatgctgccacagttggtgttcctggcgctgagtctcattcacctgtgtgtgcaactgtacagaatgatggacaaaggagtgctgagctactggcgcaagccaaggaattggctcgaagttgcctcccttgtgtccttctcgttcgagaaatag

SEQ ID NO: 199995 - DNA, 2907 bp, Artificial Sequence
  Description of Artificial Sequence: Synthetic coding sequence
atggtgaacagcagccgggtgcagccccagcagcccggcgacgccaagcgaccccccgcgccacgcgctcccgacccaggccgtttaatggcgggctgcgcagctgtgggtgcaagcttggccgcacctggagggctgtgtgagcaaaggggattagagattgagatgcagaggattcgccaggccgcggcgagagaccctcctgctggagctgctgcctcacccagcccccctctctcttcctgctcaagacaggcctggagtagggataaccctggcttcgaggcagaagaagaagaagaagaggtcgaaggcgaagagggcggaatggtcgtagagatggacgtggagtggcggcccgggagccggcgctccgcagctagcagtgccgtaagcagcgtaggggcaaggtctcggggactggggggctaccacggggccgggcatccttcagggcgccgcaggagacgcgaggaccaggggcccccatgtccttcacctgtcggagggggtgatcccctccaccggcaccttcccctggaaggtcaaccccccagggtggcctgggccgagcgcttggtacgcggccttcggggcctgtggggcacacgactgatggaagaatcatcaacaaaccgcgagaagtatctaaaatctgtcctgagagagttggtgacatacctgctgttcttaatcgtgttgtgcatcctgacctacggtatgatgtccagcaatgtatactattatacgcgaatgatgagccagctgttccttgatacaccagtgagcaagacggagaagacaaatttcaagacgctcagctcaatggaagacttctggaaatttacagagggctccctcctggatggtctgtattggaaaatgcagcccagcaaccagaccgaagcagataataggagtttcatcttctacgagaatctcctacttggagtgccgcgaattcggcaactgagggttagaaacggttcttgcagtattccacaggacctccgcgatgagatcaaggaatgctatgatgtctacagcgtgtcctccgaggatagggcacccttcggccctagaaatggaacggcctggatctacaccagcgagaaggacctgaacggatccagtcactggggcatcattgcgacctattccggcgctgggtattatctggatttatcccgaacccgcgaggaaaccgccgctcaggtcgcgagtctaaagaagaatgtctggctcgataggggcacacgggcgacttttatagatttctcagtctataacgccaatataaaccttttctgcgtcgttaggcttctcgtggagttccccgctaccggtggggtcattccctcttggcagttccaacccctcaagctgatccggtacgtgaccacctttgactttttcctagctgcctgtgagattatcttctgcttcttcattttctactacgtcgtggaggagatactggaaatcaggatacacaagctccattactttcggtcattttggaactgtcttgatgtggtgatcgttgtgctttccgtggtagccataggcattaacatttacaggacctctaatgtggaggtgcttctacagtttctggaggaccagaatacattcccaaacttcgagcatctagcttattggcagatccaatttaataatattgctgcagtgacagtgttcttcgtctggataaagctcttcaaattcatcaattttaacaggacgatgtcacagctgtctaccaccatgagcagatgtgctaaagacttgtttggcttcgccattatgtttttcatcatcttcctcgcttatgcccaactggcttatctggtctttggcacccaagtcgatgatttctccacatttcaggagtgcatttttacgcagtttagaatcattcttggcgacataaactttgcagaaattgaagaagctaatcgcgtgctgggaccaatatactttacaacttttgtcttcttcatgtttttcatcctgctcaatatgtttctggccataattaatgacacctattctgaggtgaaaagtgacttggctcagcagaaagcggaaatggaacttagcgatctgatcagaaagggctatcataaagccttggtaaagcttaaattgaaaaaaaatacggtagatgatatctctgagtctctgaggcagggggggggcaagcttaactttgatgagctgagacaagacctgaaaggaaaaggacacacggacgcagagattgaagccatttttacaaaatacgatcaggacggtgatcaggagctcacagaacacgaacaccaacagatgcgcgacgacctcgaaaaggagcgagaggatctcgatctggatcactctagcctgcctaggccgatgtcttccaggagcttcccacggtctctcgacgatagtgaggaggacgacgatgaagatagtggccactcaagtcgtaggcgggggtccatctcctccggcgtgagttacgaagaattccaggtgctcgtgcgtcgcgtggatcggatggagcactcaattggcagcatcgtgagcaaaattgacgctgtgattgtaaagttagagatcatggaacgagccaagttaaaaaggcgcgaggttctgggaaggttgctcgatggcgtggcagaggacgaaaggctgggaagagattccgagattcaccgagagcagatggagcggctcgtgagagaagagctggagaggtgggaatccgacgacgcggcatctcagatttcccatggcctgggaactcctgtgggcttgaatggccagcccaggcctagatcctctcgaccgtcctcttcacagtctactgagggcatggagggagctggggggaacgggagctcgaacgttcatgtttag

SEQ ID NO: 199996 - DNA, 1161 bp, Artificial Sequence
  Description of Artificial Sequence: Synthetic coding sequence
atgagccagctgagcaccaccatgagccggtgcgccaaggacctgtttgggtttgcaattatgtttttcatcatctttttagcctacgcacaactggcttacctggttttcggaacccaagtggatgatttttctacattccaagaatgcattttcactcagttccggataattttaggcgacattaattttgcagaaatcgaagaggcgaaccgcgtgttgggccccatctattttactacatttgtattcttcatgttttttatcctgctgaacatgttcctagccattatcaacgacacatactctgaagtaaagtccgatctggctcagcagaaagcagaaatggagctatctgacttaatccgaaagggttaccataaagcgctggtgaaactgaaacttaaaaagaatacagtggacgacatttcagaatcactacggcagggcggtggaaaactgaatttcgatgagcttaggcaggaccttaagggaaaaggacacacagacgcagagatagaggcaatcttcacaaagtacgaccaagacggggaccaggaattgacagagcacgagcaccagcagatgagggacgatctggagaaggagcgggaagatctggacctggaccattcctccttacccagaccgatgagcagccgatctttccctagatccttggacgacagcgaggaagacgatgacgaagatagtggccactcctctcgacggagaggcagcatctctagcggagtgtcatatgaggagttccaggtccttgtacggagggtcgaccgcatggaacactctatcggaagcatcgtgtccaagatcgatgccgtgatcgtgaagctcgagattatggaaagggccaagcttaagcggagggaggttctgggcaggctgctggacggggtggccgaggacgagcgacttgggagggactccgagatacaccgtgaacagatggaaaggctggtgcgggaggaactggaacggtgggaatcagatgatgccgcgtcccagatttcccatgggctcggaacccccgtggggctcaatggacaaccgcgcccgagaagctctcgtccctccagctcgcaatctaccgaggggatggagggtgcaggagggaacggaagttccaatgtgcacgtatag

SEQ ID NO: 199997 - DNA, 1161 bp, Artificial Sequence
  Description of Artificial Sequence: Synthetic coding sequence
atgagccagctgagcaccaccatgagccggtgcgccaaggacctgtttgggtttgcgattatgtttttcatcattttcctcgcctacgctcaactggcgtatctggttttcggaacccaggttgatgacttctccactttccaggaatgtattttcacccaattccgcatcatactgggggacatcaacttcgctgagattgaagaagccaacagggtactagggcccatctactttaccacctttgtgttttttatgtttttcattctactgaatatgttcctcgccattatcaacgatacatacagtgaagttaagtcagatcttgcacagcaaaaagccgaaatggagctcagcgacctgatccggaaaggataccataaagccctcgtgaagctgaagcttaaaaaaaatacagtcgacgatatatccgagtctctgcgccagggaggcggcaagctgaacttcgacgagttgaggcaggatctgaaaggcaaaggccacaccgacgccgaaatagaggcaattttcaccaagtatgaccaggacggcgaccaagagctcacagagcacgaacaccagcagatgcgcgacgacctcgaaaaagagcgtgaggatttagacctggaccactccagcctcccgcgcccgatgagctccaggagtttcccacgttcccttgatgactcggaagaggacgatgacgaagactctggtcactcttcgcggagacgcggaagcatttcttccggcgtgtcctatgaagagttccaggtcctcgtcaggagggtggacagaatggagcactcaattggatccatcgtatcaaagatcgacgcagttatcgttaaattggagatcatggaaagggcaaagcttaaacgtcgggaagttctgggccggctgctcgatggcgtcgcagaagacgagaggctggggagagatagtgaaattcatcgtgaacagatggaacgcctcgtgcgggaggagttggagaggtgggagtccgacgacgcggcctcccagatttcccacgggttggggaccccagtgggcttgaacgggcagcctagaccgcggtcctcaaggcccagctcatctcaatctacggagggtatggagggcgccggagggaatggatcctcaaatgtgcacgtctag

SEQ ID NO: 199998 - DNA, 2418 bp, Artificial Sequence
  Description of Artificial Sequence: Synthetic coding sequence
atgaacgccgtgggcagccccgagggccaggagctgcagaagctgggctctggcgcctgggataaccccgcttattcgggaccccccagtcctcacggcacgcttcgcgtatgcactatctcatctacaggccccttgcagcctcagcccaaaaagccggaagacgaaccacaggaaacggcttaccgcacacaggtatcctcttgctgcctgcacatctgccagggcattcgaggattgtggggaacgactctcactgaaaataccgccgagaatagagaactgtacatcaagactaccctccgcgaactactggtctatattgttttcttggtggacatatgcctcttgacttacggcatgacgagtagttcagcgtattattatacaaaagtgatgtctgagctctttttacacacccctagcgacacgggagtctccttccaagccatctcctccatggccgacttttgggatttcgctcagggcccactgttggattctctgtactggaccaagtggtacaacaaccagtcgctgggccacggaagccattcctttatctactatgagaatatgctcctgggagtgccccggctgaggcagcttaaggtccgcaatgatagctgtgtcgtgcatgaggatttcagggaggacatcttgtcgtgttacgacgtttatagtcccgacaaagaagagcaacttccattcggaccctttaacggaaccgcttggacgtaccactcacaggacgagttggggggtttcagtcactggggcaggttaaccagttacagtggaggtggctactatctagacctgcccgggagccgacagggatctgccgaggcgttgcgtgcattgcaggagggactctggctggacaggggcaccagggtcgttttcatagactttagtgtatacaacgcaaatataaacttattctgtgttctgcgactcgtcgtcgaatttccagctactggcggcgcaattccatcctggcagatcaggaccgtcaagctgatccgctatgtttccaactgggattttttcatagtgggatgcgaagtgatcttttgtgtgttcatcttctactacgtcgtcgaggaaatcttagaactgcatattcaccgactgcgatacctgtcatctatttggaatatactggacctcgtggtcatactcctgtctatcgtagcagtgggtttccacattttcaggaccctcgaagtgaacagacttatgggaaaactgctccagcaaccaaacacctatgctgatttcgagttcctggctttctggcaaacacagtacaacaatatgaacgctgtcaacctgttctttgcttggatcaagatttttaagtacatcagctttaacaagacgatgacacagttatccagcaccctggcccgttgtgcgaaggacattctgggattcgcagttatgttctttatcgtctttttcgcatacgcccagctagggtacctgctctttggaacacaggtggagaacttctcaacattcataaaatgtatttttactcagttccggattatcctgggggatttcgactacaacgctatcgacaacgcgaaccgtatccttggccctgcttactttgttacctatgtcttcttcgtattcttcgtccttctcaacatgtttctggctattataaatgatacttatagcgaggtaaaagaagagcttgctggacagaaggacgagctgcagctgtcggacctgttgaagcagggatacaataaaacgctgctgcgtcttcggctcagaaaggagcgggtttcagatgtgcagaaggttctgcaggggggcgagcaggagatacagtttgaggacttcacaaacaccctgcgggagctgggccatgccgaacacgagattaccgagctgacggcaacctttaccaagtttgacagggatggtaatcggattctcgatgagaaggaacaagagaagatgcgccaggatctggaggaagagcgcgtggccttaaacactgaaatcgaaaagctgggtcgctcaatcgtgtcttcacctcagggcaaatccggacccgaagcagcaagggctggcggctgggtttctggcgaggagttctatatgttgacaagaagggtgctacagttagagaccgtgctggaaggcgtagtatcacagatcgacgcagtgggcagcaaacttaagatgctcgagagaaagggctggttagctcctagcccaggggtgaaggagcaggctatatggaaacaccctcagcccgcccctgctgtgactcctgatccctggggagtccagggcggccaggagtccgaggttccttacaaacgagaggaggaggccctcgaggaacgcaggctgtctagaggcgaaatcccaactctgcagagaagttag

SEQ ID NO: 199999 - DNA, 2193 bp, Artificial Sequence
  Description of Artificial Sequence: Synthetic coding sequence
atgaacgccgtgggcagccccgagggccaggagctgcagaagctgggcagtggcgcttgggataatcccgcctatagcggccctccttccccgcacggaacactgagggtgtgcactatctccagcacaggcccacttcagccccagcccaagaagccagaggacgaaccccaggagaccgcataccgaacccaggtgtcttcctgttgcctccacatatgccaagggatccggggcctctggggtacaacactaacagagaatacagccgaaaatagagagctatatatcaagaccacacttagagagttgctcgtgtatatcgtattcctggttgatatttgcctgctcacttatgggatgaccagcagctccgcctattactatacgaaagtgatgagtgaactattcctccacacaccctctgacaccggagtttcctttcaagcaatttcttccatggccgacttctgggacttcgcacaggggccccttttggatagcttgtattggaccaaatggtacaacaaccagtctctgggtcatgggagccattcatttatctactacgagaatatgctgctcggtgtgccgaggttacgtcagcttaaagtcaggaacgacagctgtgtggtgcatgaggactttagagaagacatcttgtcatgctatgatgtgtatagcccagacaaggaagagcagctcccctttgggcctttcaatgggactgcactcgtcgtcgagttcccagccactggaggggcaatcccttcctggcagattcggacggtaaagctgatcagatatgttagtaactgggattttttcatagttgggtgcgaggtcatcttttgtgtgtttattttctactacgtcgtcgaggagatcttggaacttcacatacataggctgagatacctgagtagcatctggaacattttagaccttgtggttatcctcctgtcaatcgtggcagtgggatttcatatcttcaggacattagaggtgaatcgcctcatgggtaaattacttcagcaacctaacacatacgccgattttgaatttctggccttctggcaaactcaatataacaatatgaacgcggtcaacttattcttcgcttggattaagatctttaaatacatcagcttcaacaagaccatgacacaattgtccagcactttggccaggtgcgctaaagacattttgggtttcgctgtcatgttcttcatcgtgttttttgcatatgcccagttgggatatctccttttcgggacacaggtggagaatttctccacttttatcaaatgcatatttactcaattcaggattatactgggagattttgactataatgctatcgataacgcgaaccgcattctggggccagcatactttgtgacgtatgtgttttttgtgttttttgtgctgcttaatatgttcctggccattatcaatgacacctacagtgaggtgaaagaagagctcgcgggccagaaagatgaactacagctatctgacctgttaaagcaaggttataataagactttactgagattgcgcctacgaaaggaaagggtgtccgatgtgcaaaaggtcctacagggtggtgaacaggagattcagttcgaggactttaccaatacactccgcgagttggggcatgccgagcacgagatcactgagttaaccgctactttcactaagttcgatcgggatggtaatcggattcttgacgaaaaggagcaggagaagatgcgtcaggacttggaggaggagcgtgtggccttaaacacagaaatcgagaaactgggccggagcattgtgtcttcaccacagggaaagtcggggcctgaggccgcccgggcaggaggctgggtcagcggggaggaattctatatgctcacgaggcgcgtgcttcagctcgagaccgtactagagggcgtcgtgagccagattgatgccgtgggcagtaagttgaagatgttggagcgtaagggctggttagcaccttcccccggcgtcaaggagcaagcgatttggaaacaccctcaaccagcacctgccgtaacccccgacccatggggggttcagggcggtcaggaatcagaggtgccatacaaacgcgaggaggaagccctggaagagaggcggttgagccggggagaaatcccaaccctgcaaagatcttag

SEQ ID NO: 200000 - DNA, 2328 bp, Artificial Sequence
  Description of Artificial Sequence: Synthetic coding sequence
atgaacgccgtgggcagccccgagggccaggagctgcagaagctgggttctggcgcgtgggataatcctgcctactccggtccccccagcccccacgggaccttaagagtgtgcactatttccagcactggacccctgcaacctcagccaaagaagcccgaagacgaaccacaggaaaccgcgtatagaacccaggttagctcctgctgcctgcacatttgccagggtatacgcggactctgggggaccacactgaccgagaataccgcagagaacagagagctgtacattaagactacactgcgtgagctgctggtctatatcgtgtttctcgttgatatctgcctgctcacgtacggaatgaccagttcaagtgcgtactactataccaaagtgatgtcggagttgttcctccataccccatctgatacaggagtgtcatttcaggccatttctagcatggcggatttctgggacttcgcccagggccctttattagacagcttgtactggaccaagtggtacaataaccagtctctgggccacggttctcattctttcatctactatgaaaatatgctattaggtgtgccaaggctgcgacagctgaaggtgcgaaacgattcctgcgttgtccatgaggactttcgcgaagacatactgtcctgctatgatgtgtattcacccgataaagaagaacagttgccgtttgggcccttcaacggaaccgcatggacctaccacagccaagatgagctgggcggtttttctcattggggaaggctgacttcttattccggagggggttattatctggatctccccggaagcagacagggcagtgccgaggcattacgggcgctgcaggagggtctatggcttgatcgtgggacccgcgtcgtgttcatagacttcagtgtatacaacgctaacattaacctcttttgcgttctaagactagtcgttgagttcccggctcggcgctgtcaccccatcctggctaacccgcacagccaggccgaccccctctgccagcaactctttttcatcgttggatgcgaagtcatcttctgcgtcttcattttttattacgtggtggaggagatcctggagttgcacatccatcggctgcgttacctcagtagcatctggaacattctggacctcgtggtgatactactcagcatcgtggccgtgggcttccatattttcagaaccttagaggtaaaccgactgatgggcaagctgctgcaacagcccaacacatacgctgacttcgaatttcttgctttctggcagacccaatataataacatgaacgcagttaatctctttttcgcgtggatcaaaatctttaaatacataagtttcaacaagaccatgacgcagttgtcctccacattggctagatgtgccaaggatatcctcggattcgctgtgatgttctttattgtctttttcgcgtatgctcagcttgggtatcttcttttcggaacccaggtggaaaatttctcaacgtttatcaaatgtatctttacccagtttaggatcattctgggggactttgactataacgccattgataatgctaaccgcattctgggacctgcttattttgtgacttacgtgtttttcgtgttcttcgtgctgctcaacatgttcctggcaattatcaatgatacctactcagaagtcaaagaagagctggccgggcagaaggacgaactgcagctctctgatctcctgaagcagggctacaataagaccctgctcagactccgactgaggaaggaacgggtctcggacgtgcagaaggtcctgcagggcggggaacaagagatccagttcgaagacttcacaaacaccttaagagaactaggtcatgccgagcatgaaatcacagaactgacagcaacgtttaccaagttcgatagggatggcaacagaatcctggacgaaaaggaacaggaaaagatgcgacaggatctggaagaggagagagtggctctgaatacagaaattgaaaaacttggaagatcaatcgtgagttcccctcagggaaaatccgggccagaagctgcccgggctggcggctgggtgagcggtgaggagttttatatgctgactcgaagggtgctacagctggagacagtcctggaaggtgttgtgtctcagatcgatgccgtcggatccaagctgaaaatgcttgagcgaaagggttggctggccccttcacctggagtgaaggagcaggctatctggaaacacccccagcccgcgcccgccgtgaccccggatccatggggccctggttgggctggggaatag

SEQ ID NO: 200001 - DNA, 2283 bp, Artificial Sequence
  Description of Artificial Sequence: Synthetic coding sequence
atgaacgccgtgggcagccccgagggccaggagctgcagaagctgggttcaggggcatgggataatcccgcatactccggacccccctcgccacatggtacgctgagagtctgcacaattagcagtaccgggccactgcagccccagcctaaaaaacccgaagacgagcctcaggaaactgcatacagaacccaggtatcttcttgctgtctccacatctgccaaggtatacgcggcctctgggggaccacgctcactgaaaacaccgccgagaatagagaactatatattaaaacaacactcagggagttgcttgtgtacatagtttttctggttgatatctgtttgctcacttatggaatgactagcagctcagcctactattatacaaaggtgatgtccgaactttttctccacacgcctagtgatactggagtgagcttccaggccatttcgagcatggccgatttttgggactttgcacagggacctctactcgattccctgtactggacaaaatggtataacaaccagtcccttggacatggatcccactccttcatttattacgaaaatatgctgttgggtgtccctcgcttacgacagctgaaagtgcgcaacgactcctgcgtcgtgcacgaggattttagggaggatatcctcagctgctatgatgtctactcccccgataaagaagagcagcttccgtttgggccattcaacgggacagcctggacatatcattcacaggacgagctgggcggcttctctcactggggtaggctcacatcgtattccggcggggggtattatctcgatctgcccggcagcaggcagggaagtgcagaggctctgcgggctttgcaggaaggcttgtggctggatcgcggtacacgagtggttttcatcgatttctccgtgtataacgccaatataaacctgttttgtgttctgaggctcgtcgtggaatttcccgccactggcggagccatcccttcatggcaaattcgtactgtgaagctcatcaggtacgtgtctaactgggatttttttatcgtgggttgcgaagtcattttctgcgtctttatcttttactatgtggtcgaagaaatcctggagctccatatccatcgactgcgatatctttcatcaatctggaatatcctagacttggtggtgattctattgtccattgtggctgtagggttccacatcttcagaactttggaagtaaaccggctgatgggtaagttattgcaacaaccgaatacttatgcagatttcgaattcctagcgttttggcagacccagtataataatatgaacgctgtcaacctattctttgcttggatcaagatcttcaaatacatatcctttaacaaaactatgacacagctctcatccaccctcgcccggtgcgccaaagacatcttggggtttgcggtcatgttcttcattgtttttttcgcctatgcgcaactgggctaccttctatttgggactcaagtggagaatttcagcacatttataaagtgcatctttacccagtttagaatcattctcggagacttcgattataatgcaatcgacaatgccaacaggattctggggcccgcttatttcgtcacctacgtgttctttgtctttttcgtgctgctgaacatgttcctagcgatcataaatgatacatactccgaggtgaaagaggagctggccgggcagaaagatgaactgcagctctctgatttgttgaagcaggggtacaataaaacgctcctgcgcttgcgactccgcaaggaacgtgtgagtgacgtgcagaaggtgttacaaggaggggaacaggaaatccagttcgaagactttactaatactctgcgggaactgggacacgctgagcacgagatcactgaactgacggccacatttaccaaatttgatcgggacggaaacagaatactggacgagaaagaacaggagaagatgcgccaggaccttgaagaagagagagtcgcccttaatactgaaatcgaaaagcttggcagaagtattgtgtcttctcctcaagggaagtccggccctgaggctgctcgggccggcgggtgggtttctggagaagagttctatatgttaacccgcagggtgcttcaactggagacggtactggagggggttgtctcacagattgatgcggtgggaagtaaactcaagatgcttgagaggaaggggtggctcgccccaagccccggtgtccggttcccaattaaagaaaagcgcaagccctag

SEQ ID NO: 200002 - DNA, 1842 bp, Artificial Sequence
  Description of Artificial Sequence: Synthetic coding sequence
atggccgaggccagccggtggcaccggggcggcgccagcaagcacaagcttcattaccgcaaagaggttgagattaccacaaccctgcaagaactcctcctctacttcattttcctgatcaacctgtgcatactgaccttcgggatggtgaatcctcatatgtattatctcaataaggtaatgtcttctttgtttctagatacatccgtacccggcgaagagcgtactaacttcaagagcatcagaagcatcactgacttctggaagtttatggaaggcccgctcttagagggcctgtattgggacagttggtacaataaccagcaactgtacaatctgaaaaactcatccagaatctattatgaaaacattttattaggcgttccacgggtccggcagctcaaggtacggaacaacacgtgtaaagtgtacagttcgtttcagtctctgatgagtgagtgctatggcaagtatacctccgctaacgaggatctgtctaattttggcctgcaaatcaacaccgaatggcgttactccaccagtaacactaacagtccatggcattggggctttttgggagtctaccggaatggcggatatattttcacgctttccaaaagcaagtctgaaactaaaaacaagttcatcgatttgcgcttgaactcttggatcacaagaggtacacgggtgattttcattgatttctcactttataatgcaaacgtgaacctcttctgcattatcagactggtggctgaatttcctgcaacgggaggtatattgacttcgtggcagttttactccgttaagctcttacgatacgtttcatactatgactacttcattgcaagctgtgagatcacgttctgtatctttcttttcgtgtttactacccaggaagtgaaaaaaatcaaagaatttaagtccgcgtacttcaaaagtatatggaattggctggaattactgctcctgctcctttgcttcgtcgcagtgagcttcaacacttattacaatgtccagatctttctgctgttgggacagctgctcaaatccacagagaaatacagcgacttctattttctcgcctgttggcatatctactacaacaacatcatcgccatcacgatattctttgcttggatcaaaatctttaagtttatcagctttaataaaacaatgtcacagctgtcgtcaacactatcccgttgtgtcaaggacatcgtcggattcgccataatgttctttatcatttttttcgcctacgctcagctgggtttcctggttttcggatcccaggtcgacgattttagcaccttccagaattccattttcgcccagtttcgcatcgttctgggcgacttcaatttcgccgggatccagcaggcgaaccctattctggggcctatttactttataacctttatctttttcgtttttttcgtcttgctgaatatgtttctagcaatcattaatgacacgtactcagaagtcaaagctgactacagtattgggcgcagactggacttcgaactagggaagatgattaagcagtcgtacaagaatgtgctggaaaagttcagactgaagaaggcccagaaagacgaggacaagaagacaaagggctcaggtgatctggcggagcaggcacggcgagaaggattcgatgaaaatgaaatccagaacgcagaacagatgaagaaatggaaagagagactggagaaaaagtactattctatggaaattcaggacgattatcagccagtgactcaggaagagtttcgggacgggactaccactaagtacaaaatgagattcagtgaatgcctgaccaagcggatttag

SEQ ID NO: 200003 - DNA, 1773 bp, Artificial Sequence
  Description of Artificial Sequence: Synthetic coding sequence
atggccgaggccagccggtggcaccggggcgtgaccttcggcatggtaaatcctcatatgtactatttaaataaagtgatgtcatccctatttctcgacaccagtgttcccggggaggagaggacgaattttaaatcgatccggtccattaccgatttctggaagttcatggagggccctctgctggagggcctctattgggattcttggtataataatcagcagctttataacctgaaaaattcttcacggatttactacgaaaatattctgctgggggtccctcgagtgagacagctcaaagttcggaacaacacatgtaaagtgtacagtagctttcagagcctgatgtccgagtgttatggaaagtacacctccgctaacgaagacctgtccaatttcgggctgcagataaacacagagtggcggtatagcactagtaacacaaacagtccttggcattggggcttcctcggtgtttacaggaatgggggatatatttttacactcagcaagtctaaatcagagacgaaaaacaaattcattgatctcagactgaactcgtggatcacccgaggaacacgagtgatttttattgatttttctctttacaacgccaacgtgaacctgttttgcatcattagacttgtcgccgaatttcctgccacaggtggaattttaacctcctggcagttttactccgtaaagctgttgcgctatgtgtcttactacgattatttcatcgcgtcgtgcgagatcacattctgcatctttctatttgtgttcaccacccaggaggtgaaaaaaattaaagagttcaaatctgcgtacttcaaatccatctggaattggcttgaactgctgttgctcttgctctgcttcgttgccgtctcctttaatacttactacaatgttcagattttcctgcttctaggacaactgctgaaatccactgagaagtattccgacttttactttttagcttgctggcacatatactataacaatattatcgcgattaccatattctttgcttggatcaaaatctttaaattcattagcttcaacaaaacgatgtctcagctgtccagcacactctcgcggtgtgtcaaagatatcgtaggatttgcgatcatgttcttcataatcttttttgcttacgctcagctcgggtttctggtgttcggcagccaggtcgatgacttcagcacctttcagaacagcattttcgcacaatttcgcatagttctgggggatttcaatttcgccggcatccagcaagccaatccaattttaggtccgatctactttataacctttatattttttgtgttcttcgtactgttgaacatgttccttgcaatcataaatgacacgtattcggaagtcaaagctgactacagcattggaagacgcctcgactttgaattaggcaaaatgattaagcagtcctacaagaacgtcctcgagaaatttcgcctgaaaaaagcgcagaaagatgaagataagaaaacaaagggctctggagacctggctgaacaagcacgacgcgagggtttcgacgaaaacgaaattcagaacgccgaacagatgaagaaatggaaagagcggttagagaagaagtactattccatggaaatccaggacgactaccagcccgtaacccaggaagagttcagagagctgtttctgtatgcagtcgagctagagaaggagcttcactacataaatttaaagctgaaccaggtggtcaggaaggtatccgcactgtag

SEQ ID NO: 200004 - DNA, 1875 bp, Artificial Sequence
  Description of Artificial Sequence: Synthetic coding sequence
atggccgaggccagccggtggcaccggggcggcgccagcaagcacaaactacattacaggaaagaggttgagattaccacaacgctacaggaattgctcctctattttatctttttgattaatctttgcatcttgactttcggcatggttaatccccatatgtactacctgaataaagtgatgtccagcctatttttagacacatccgtccccggtgaggaaaggacgaactttaaatccatccggagtatcaccgatttctggaagtttatggagggaccgctactggaggggctctactgggacagttggtataacaaccaacagctgtacaacctcaaaaatagctcccgcatttactacgagaatatacttctgggagtgcctcgggtccgccagcttaaggtgcgcaataacacatgcaaagtatatagctcattccagtcgctgatgagtgaatgttacggtaaatataccagcgccaacgaggacctttctaatttcggactgcagattaatacggaatggagatactcaacttctaatacaaactccccctggcattgggggttccttggagtttaccgcaatggaggatatatattcaccctttctaaatccaagagcgagaccaaaaacaagttcattgatcttcgactgaactcgtggattacacgagggacgcgggtgattttcatcgacttttctctgtacaacgccaacgtgaatctgttttgtatcattaggctcgtggccgagtttccggcaaccggaggaatactaacatcgtggcagttttatagtgttaaactcctccgatatgttagttactatgactacttcattgctagctgtgagatcacgttttgcatttttctattcgtgtttaccacccaggaagttaaaaaaatcaaagaattcaagagcgcctactttaagtctatctggaactggttggaacttttattactactgctgtgttttgtcgccgttagcttcaacacatactacaatgtccagatttttttgttactgggacagctcttaaaatctaccgagaagtactccgacttctactttctcgcctgctggcacatctactacaataacatcatcgccatcaccatcttttttgcatggatcaagattttcaagttcatcagcttcaacaaaacaatgtcccagctgtcaagcacgctcagccgctgtgtgaaggacattgttggatttgctattatgttttttatcatcttttttgcctatgcccagctgggattcctcgtgttcggctcccaggtcgatgatttcagtaccttccagaattccattttcgcacaatttcgcatagtacttggcgactttaactttgctggtattcagcaggcgaacccaatcctgggaccgatttatttcataaccttcatattctttgttttcttcgtcctactcaatatgttccttgccataatcaacgacacatattctgaagtgaaagcagactattcaatcggcaggaggttggatttcgaactaggcaaaatgatcaagcagagttataagaatgtgctggagaagttccgcctgaaaaaggctcagaaggatgaagacaagaagaccaaaggctcaggcgaccttgccgagcaggctagacgcgagggattcgacgagaacgagatccagaacgctgaacaaatgaaaaaatggaaagagcggctagagaagaagtactatagcatggaaattcaggacgactaccaacctgtgacacaagaagaattccgtgaactctttctgtacgcggtcgaactggaaaaagagctgcactatattaacttaaagctcaaccaggtagtcagaaaagtctccgccttgtag

SEQ ID NO: 200005 - DNA, 1809 bp, Artificial Sequence
  Description of Artificial Sequence: Synthetic coding sequence
atggccgaggccagccggtggcaccggggcggcgccagcaagcacaaacttcactaccgaaaagaggttgagattacaactaccctgcaagagctgctcttgtactttatcttcttgatcaatctttgcatcctcaccttcggcatggtcaacccacatatgtactatcttaacaaggtgatgtcttctctattcctggacacaagcgtaccaggagaggagagaaccaacttcaaaagcattaggtcgattaccgatttctggaagttcatggagggcccactgctggaaggtctgtactgggacagctggtataacaatcagcagctttacaacctcaagaactctagcaggatctactacgagaacatcttgctcggggtacctagagtgcggcagctcaaagttcggaacaacacctgcaaggtttatagctcatttcagagtctgatgagtgagtgctacgggaagtacacgagcgccaacgaagacttgtctaacttcggtctccagattaatactgagtggcgctactccacgtccaatactaacagtccgtggcactggggctttcttggggtttacagaaatggtggctatatctttacactctccaagtccaagtccgagaccaaaaataaattcattgaccttcggcttaattcttggataactagaggcacaagggttatatttatcgacttctccctgtataacgctaatgtgaatctcttctgtattatccggcttgtggcagaattcccagcgacaggtggcatcctgactagctggcaattttattctgtgaaactcctgcgatacgtttcttattatgactattttatagcctcatgtgaaattaccttttgcatctttctgttcgtctttacgacccaggaagtcaaaaagataaaagagttcaagagtgcctactttaagtctatctggaactggctcgagctgctcctacttcttctgctgaagagcaccgagaagtattctgatttctactttcttgcatgttggcacatatactataacaacatcattgccatcacaatatttttcgcgtggatcaagatattcaagtttatcagctttaataaaacaatgtcccagctaagcagtactctgtctcggtgtgttaaggatatcgttggattcgccataatgtttttcatcatctttttcgcgtatgcccagctgggtttcctcgtgttcggcagccaagtggatgatttttccacctttcaaaacagtatttttgctcagttccggatcgtgctcggcgatttcaattttgctgggattcagcaggctaatcctattttgggccctatttatttcattactttcatctttttcgtatttttcgtattactcaacatgttcctcgccattatcaacgacacttacagcgaggtgaaggccgattactccattggccggcgcttggactttgagctgggaaagatgatcaaacagtcttacaaaaatgtcctggaaaagtttcgactcaaaaaagctcagaaagatgaagacaagaaaaccaaagggtccggtgacctggctgagcaggctagaagagagggattcgatgaaaacgaaatccaaaacgccgagcagatgaaaaaatggaaagagagattagagaaaaagtactactctatggaaattcaggatgattaccagcctgtgacccaggaggaattccgggaactcttcctatacgctgtagaactggagaaagaactgcattacattaatctcaaactcaaccaggttgtcaggaaggtttcagctttgtag

SEQ ID NO: 200006 - DNA, 1572 bp, Artificial Sequence
  Description of Artificial Sequence: Synthetic coding sequence
atggccgaggccagccggtggcaccggggcggcgccagcaagcacaagctgcactaccgaaaagaggtcgagattacaactacactccaggagctgctcctgtactttatttttctgatcaatctttgcatcctaacgttcggcatggttaatccccatatgtactatcttaataaggtcatgtctagtcttttcctggatactagtgtaccgggtgaagagaggaccaactttaaatcaatcaggtctataacagatttctggaaattcatggaaggtcctctgcttgagggactctactgggacagttggtacaataatcagcagctttataatctgaaaaatagtagcaggatttactacgaaaatatcttactgggcgtgccgcgggtcagacaactgaaggtacgaaataatacttgcaaggtttactctagttttcagagcctgatgagtgagtgctatggtaaatacactagtgccaacgaagacctgagcaatttcgggctgcagatcaatactgaatggagatatagcacatctaacacaaactccccctggcactggggatttttgggggtctatcgcaatggcggttacatcttcactttatcaaagtccaaatccgaaacaaaaaacaagtttattgacctgcggttgaatagctggatcaccagaggcacccgagtgatctttatcgatttctcgctctacaacgcaaatgtaaacctcttctgcatcatccgcctggtggctgagttcccagcgacaggaggtattctcacctcgtggcagttctatagtgtgaaactgctgaggtacgtatcttactacgattattttatcgcctcctgcgaaatcaccttctgcatattcttgttcgtgttcaccactcaggaggtgaagaagatcaaggaattcaagtcagcttacttcaagagcatttggaactggcttgagctgctgctgcttttgctgtgtttcgtcgcggtgagcttcaacacctattacaacgtccagatcttcctcctcctcggacagctgctgaaatcaacagagaaatattccgatttttatttcttggcttgctggcacatctattacaacaacataattgctatcactatattcttcgcgtggatcaaaaatatgttcctggccatcatcaatgatacctactcagaagttaaagcagattattccatcggaagacgtttggacttcgagcttggcaaaatgattaagcaaagttataaaaatgtgcttgagaagtttcgcctgaaaaaggctcagaaggatgaagataagaagaccaagggctccggagatttggcggaacaggcacggagggagggatttgacgaaaatgagattcaaaatgcagaacagatgaagaaatggaaagagcggttggaaaagaaatactacagtatggagattcaggatgactaccagccagtaactcaggaggaattcagagagctttttctctacgccgtcgaattggagaaggagttgcattatatcaacttgaagttgaaccaagttgtcagaaaggtctctgccctgtag

SEQ ID NO: 200007 - DNA, 1836 bp, Artificial Sequence
  Description of Artificial Sequence: Synthetic coding sequence
atggaggagctggtggtggaggtgcggggcagcaacggcgccttctataaagcttttgtgaaagatgtacacgaagacagtatcaccgttgccttcgaaaataactggcagcccgaccggcagattcctttccatgacgtgagattcccaccccctgtaggttataacaaggatatcaacgaatccgatgaggtggaggtttatagtcgcgctaatgagaaagaaccctgttgctggtggctggcaaaggtacggatgattaaaggggaattctacgtgatcgagtatgccgcctgcgatgccacctacaatgagatcgtaaccattgagcgcctgcgctctgtgaaccctaataaaccggcgactaaagataccttccataagattaaacttgacgtgcccgaggacctcaggcagatgtgtgccaaagaggctgcacacaaagatttcaagaaagcagtcggtgcgttttcagtaacctatgaccctgaaaattatcagctggttatactgtccatcaacgaagtaacaagtaaaagagcgcatatgttgattgacatgcactttcgctctctgcggacaaaactgagcctgatcatgcgaaatgaggaggcctctaaacagctcgagtcttcccgccaattagcaagccgctttcacgaacagtttatcgtgcgggaggacctcatggggcttgccatcgggacacacggcgccaacattcagcaggccagaaaggtccccggggtgaccgccatcgacctggacgaggacacatgtaccttccacatttatggcgaggaccaggatgccgttaagaaagcacggtccttcttagagttcgccgaggacgtcatccaggtgcctcggaacttagttggcaaagttataggtaaaaatggtaagcttattcaggaaatcgttgacaagtccggggtggtgcgagtgcgcatcgaagcagagaacgaaaaaaacgtgccccaggaggaggagataatgccccctaacagcctgcctagtaacaactcacgtgtcggaccgaatgcaccggaggagaaaaaacatctggacatcaaggagaactccacccacttcagccagcctaatagcactaaggtacagagaggtatggtccccttcgtcttcgtgggaactaaagactcaatcgcaaacgccaccgtgctgctggattaccatttgaactaccttaaagaagtggatcagctaaggctcgaacgactccagattgacgagcagctgaggcaaatcggcgcctccagcaggccacctcctaatcgcactgacaaggaaaaaagttacgtgaccgacgatgggcagggcatggggcggggatctcgaccttatcgcaatcgggggcatgggagaaggggccccggatataccagtggaacaaacagtgaggcatccaacgcttcagaaaccgagtccgatcacagggatgaactgtccgattggagcctcgctccaaccgaagaggagcgcgagtcctttcttaggcgtggggacgggaggagacggggcggcggcgggcgggggcagggcggcaggggacgaggcggaggtttcaaaggaaacgacgaccattcccgcaccgataacaggccaaggaacccgcgggaagccaaaggacggaccaccgacggtagccttcagataagagtggactgcaataatgaaaggtcagtgcacactaagacattgcagaacaccagcagcgagggcagcagacttcgtactgggaaagaccggaaccagaagaaagagaagcccgactcagttgatgggcagcaaccactggtgaacggcgtcccatag

SEQ ID NO: 200008 - DNA, 513 bp, Artificial Sequence
  Description of Artificial Sequence: Synthetic coding sequence
atgcccctgcccgtggccctgcagacccggctggccaagcggggcatcctcaagcatctcgaacctgaacccgaagaggaaattatagctgaggactacgacgatgacccagttgattacgaggcgacacggctggagggcctcccgccctcctggtataaggtgtttgatccctcttgcggactaccctattattggaacgccgatacagacctcgtttcctggctgagtccacacgatccaaattctgtcgtaactaagtcggctaaaaaactaagatccagcaacgctgcagtgtccaggaaggatgaagaacttgacccaatggatccatcttcttattcagacgccccaagggggacttggtctaccggtctgccaaagcgtaacgaggctaaaacaggggccgataccaccgctgccggccccctgttccaacagaggccataccctagtccaggcgcagtgctgcgcgccaatgccgaggcttctcggactaagcagcaggactag

SEQ ID NO: 200009 - DNA, 204 bp, Artificial Sequence
  Description of Artificial Sequence: Synthetic coding sequence
atgcccctgcccgtggccctgcagacccggctggccaagcggggcatcctcaagcacttggagccagagccggaagaagagatcatcgccgaggactatgatgatgatccagtggactatgaagccacacgcctggaaggtttgcccccttcctggtataaagtgttcgatccctcctgccctggatggtctgccatggtgtag

SEQ ID NO: 200010 - DNA, 798 bp, Artificial Sequence
  Description of Artificial Sequence: Synthetic coding sequence
atgcccctgcccgtggccctgcagacccggctggccaagcggggcatactgaagcacctggagcccgaacctgaggaggaaattatagcggaagattatgatgacgacccggtggactacgaagccactaggctggaaggtctcccaccttcctggtacaaggtgtttgacccctcatgcggtctcccttactattggaatgccgataccgatcttgtcagttggctgagtccacacgaccctaactcagtagttacgaagtctgctaagaaactgcggtcaagcaacgcagacgccgaagagaaactggatcgttctcatgacaaaagcgacagagggcatgacaagtctgaccggtcacacgaaaagctcgacaggggtcacgacaagtcagacagggggcacgacaaaagtgatagagatcgagaacgaggatacgacaaggttgaccgcgagcgcgaacgtgatagagagagggacagagacagaggatatgataaggccgaccgggaagagggcaaggaacggagacaccatcgcagggaggaactggccccttaccccaagtccaagaaggctgtgtcaagaaaggatgaggagttagatcccatggatccaagctcctacagcgatgctccaagaggcacgtggagtaccggattacccaaacggaacgaggctaaaaccggtgctgacacaacagctgccggacccctgttccagcagagaccctacccctccccaggagcagtactgagagcaaatgccgaagctagccgcaccaagcaacaagattag

SEQ ID NO: 200011 - DNA, 513 bp, Artificial Sequence
  Description of Artificial Sequence: Synthetic coding sequence
atgcccctgcccgtggccctgcagacccggctggccaagcggggcattcttaaacatctcgaacctgagccggaagaggaaatcatagccgaggattatgatgacgatcctgttgattacgaggccacacgcctggaggggcttcctcccagttggtacaaagtctttgatccctcctgtggactcccttattactggaacgcagatacggatcttgtctcttggctgtccccacatgatcctaacagcgtggtgacaaaaagcgcaaaaaagctccgcagctccaatgccgctgtcagccgaaaggacgaggagttggaccccatggatcccagctcgtactcggatgcaccaagggggacttggtccactgggctgcctaagagaaacgaagccaagacaggggctgataccaccgccgccggtccgttgtttcaacaacgtccctatcccagccccggtgcagttctgagagctaacgctgaagcttcccgaactaaacagcaggattag

SEQ ID NO: 200012 - DNA, 798 bp, Artificial Sequence
  Description of Artificial Sequence: Synthetic coding sequence
atgcccctgcccgtggccctgcagacccggctggccaagcggggcattctgaaacacctggagccagaacctgaagaagagataatagccgaagactatgacgacgacccagtggactacgaggctaccaggttagaaggactgccgccttcttggtataaggtgttcgacccgtcatgtggtctgccctattattggaacgcggatacagacctcgtgtcctggttgagcccccacgaccctaactcagtagtcactaaaagcgctaaaaaactgcgatcgagcaatgcagatgctgaagagaaactggataggagccacgacaaaagcgatcgcggacatgacaagtctgaccggtctcacgagaaactcgaccgcggacacgataaatctgatcggggacatgacaaatccgatcgggatcgagaacgaggctatgataaagtagatcgggagagggaacgcgaccgcgagcgggaccgtgaccggggctatgacaaggcggatagggaggaaggaaaagaaagacggcatcacagaagggaggaactggccccctacccgaagtctaaaaaggccgtgtcgcggaaagacgaggaactggacccgatggacccatcaagttactccgacgcaccccgcggcacatggtccactgggttgcctaaaagaaatgaagcaaagaccggagccgacaccaccgcggccggccccttgttccagcagcgtccttacccttcgccgggagcagtgttgagggccaacgcagaggcctcacggaccaagcagcaagactag

SEQ ID NO: 200013 - DNA, 642 bp, Artificial Sequence
  Description of Artificial Sequence: Synthetic coding sequence
atgcccctgcccgtggccctgcagacccggctggccaagcggggcatcctgaagcaccttgagcctgaacctgaggaggaaatcatagcggaggactatgacgatgatccagtcgactacgaagctacacggctggaaggtttgccaccgtcttggtacaaagtctttgatcccagctgcggactgccctattattggaacgccgacacagatctcgtgtcctggctctccccgcatgacccgaatagcgtcgtaactaagtctgcaaaaaaactgaggtcctcaaacgcagatgcagaggagaagttggacagatcacatgataaaagcgatcggggccacgataaaagcgatagatcccacgaaaagctggaccggggccacgataagtcagacaggggacatgataaaagcgatagggaccgggagcgcggctacgacaaagtagatcgggagcgggagcgcgatcgcgagagagaccgagacagagggtacgataaggctgatagagaggagggaaaggagcgcaggcaccaccgcagagaggagctggccccatatcctaaatctaaaaaagctgtttcaagaaaagatgaagaattggatcctatggacccttcaagctattcggacgctccctag

SEQ ID NO: 200014 - DNA, 798 bp, Artificial Sequence
  Description of Artificial Sequence: Synthetic coding sequence
atgcccctgcccgtggccctgcagacccggctggccaagcggggcattctcaagcacctggaaccggaacctgaagaagaaatcattgcagaggattacgacgatgaccccgtggattacgaagccacaagattggaaggcctgccccccagctggtataaggtctttgacccaagctgtgggctcccctactactggaacgcagatacagacctagttagttggctctccccacacgaccctaattcagtggtgaccaaaagcgcaaaaaagctccgtagctccaacgctgacgccgaagaaaagctcgacaggtcccacgacaaaagtgacagagggcacgacaaaagcgaccgttcacacgagaagctagatcgcggacacgacaaatcagatcgaggccacgacaagtccgaccgcgatagggagaggggctacgataaagtcgacagagagagggaacgtgacagagagcgcgacagggatagaggctacgataaggctgatagagaggaggggaaagagaggagacatcataggcgagaagagcttgcgccctatcccaagagcaagaaagctgtgagtcggaaagacgaggaactcgaccctatggacccttcatcttactcggatgccccacgcggaacatggtccacaggcctgccaaagagaaacgaggctaagacaggggcagataccactgcagccggtcctctttttcagcagcggccatatccctcccccggggcagtccttagagctaacgccgaggcttcccgcacgaaacagcaagactag

SEQ ID NO: 200015 - DNA, 453 bp, Artificial Sequence
  Description of Artificial Sequence: Synthetic coding sequence
tgaatcgccacctacctgctgcacctgctggtgcagcccgaggaggagattattgccgaagactatgacgacgacccagtcgactacgaggccactcggctcgaaggcctcccaccatcctggtacaaggtatttgacccgtcttgcgggctcccctattactggaacgcggacaccgacctggtttcatggctcagtccccatgacccgaactctgtagtcactaaatccgccaagaaactccgaagcagcaatgccgctgtttcgcgcaaagatgaggagctggacccaatggacccaagtagctattctgatgcaccaaggggaacctggagcactggactgccaaaaaggaatgaagctaagaccggcgctgacacgacggccgcaggcccactctttcaacaaagaccttaccctagccctggagccgtcctacgggcgaatgcttag

SEQ ID NO: 200016 - DNA, 699 bp, Artificial Sequence
  Description of Artificial Sequence: Synthetic coding sequence
atgggcagcgtgctgagcaccgacagcggcaagagcgcccccgccagcgccacagccagggctctggagagacgccgcgaccccgaactgccggtgaccagctttgattgtgccgtctgtttggaagtgctccaccagccggtgagaactcgctgcggacacgttttctgcaggagctgcatagccaccagcttaaagaacaataaatggacctgcccttattgtagggcctacctgccatctgagggtgtgcctgccaccgatgtggcaaaacgcatgaagagtgagtacaagaattgtgctgagtgtgacacactggtttgtctgtccgaaatgcgggctcatataaggacgtgtcagaagtacattgacaagtacggccccctgcaagaactggaagagacagccgccagatgcgtctgtccattctgccagcgtgagctatatgaagattcgctgctggatcactgtattacgcaccacagatccgaacggcggcctgtgttttgcccactgtgtcgtctcattccggacgaaaaccccagctcattctcggggtccttgataaggcacctgcaggtgtcgcacacccttttctatgacgacttcattgattttaatatcatcgaagaagccctcattcggcgcgtactggatagatccttgctggagtacgttaatcattccaacacaacctag

SEQ ID NO: 200017 - DNA, 1986 bp, Artificial Sequence
  Description of Artificial Sequence: Synthetic coding sequence
atggagaagctgggcgtggagcccgaggaggagggcggcggcgacgacgacgaagaagatgccgaggcttgggcgatggagcttgctgatgtgggcgcagccgcctcgtcacaaggcgtacatgatcaggtccttccgacccctaatgcctctagccgtgtcatcgtgcacgttgatctggactgcttctacgctcaggtggagatgatatccaacccagaacttaaggataagccccttggagtgcagcagaaatacctggttgtgacatgcaattacgaagccagaaagctcggagtgaagaagcttatgaatgtccgtgatgccaaggaaaagtgcccccagctggttctggtcaacggagaagatctcacccgatacagggagatgagctacaaagtaaccgaactactcgaggagttctcacctgtggtagaacgcttaggctttgacgaaaattttgtggacctaacagagatggtcgagaaaaggctgcagcaactgcagtctgatgaactcagcgctgtcaccgtttctggacacgtgtataataaccagtgtatcgggtacaagactgctaagtgcctggaagctttgggcatcaatagcgtccgggatcttcagactttttctcctaagatcctggaaaaagagctgggcatcagcgtggcccagagaatccagaaactgagctttggggaagacaacagcccggtcatattgtcaggaccaccacagtccttttcagaagaagactcattcaaaaagtgcagttccgaagtggaggctaagaataagatcgaggagctattagccagcctactgaatcgtgtatgtcaagacggtaggaagccccatactgtgcgcctgattatcagacgatattccagcgagaaacactacgggcgcgagtctcgccagtgtcccatcccctctcacgtcattcagaaactcggtaccggcaactacgatgtgatgacccctatggtggatattctcatgaagttattccgcaacatggtgaatgtgaagatgccttttcatctgaccctgctgagcgtatgtttctgtaacctcaaggctctgaataccgcaaaaaaagggctcattgattattacctaatgcccagtctgtcaaccacgtctcgaagcggcaaacacagcttcaagatgaaagacactcacatggaggactttcccaaggacaaggaaacaaatagagacttcttaccctccggtaggatcgaatccacacgtacgcgcgagagccccctggacactactaatttttccaaggaaaaggacatcaacgagttccccttgtgcagcctgccagagggcgttgaccaagaagtgttcaaacagctgcctgtggatatccaggaagaaatcctcagtggtaaatcacgagagaagtttcaagggaaaggatccgtatcgtgtcctttacatgcctccagaggtgttctgtctttcttttctaaaaaacagatgcaggacatccccatcaaccctagagatcacctctcctcctcaaagcaggtcagcagcgtaagtccttgcgagcccggaacatcgggcttcaattcctctagtagcagctacatgtcgtctcagaaagattacagctattaccttgataatagactgaaagatgagagaatcagccagggccctaaggagccacagggttttcacttcaccaatagcaaccccgcagtttctgccttccattcatttcccaatctgcagtctgagcagctgttttcccgaaatcataccaccgactctcacaaacagaccgtggctactgactctcacgaggggcttaccgaaaatagagagccagacagcgtggatgagaagatcacattcccctctgatatcgatccacaggtgttctacgaactgccagaggccgtgcagaaggagctgctggcagagtggaaaagggctgggtccgactttcatataggccacaaatag

SEQ ID NO: 200018 - DNA, 2223 bp, Artificial Sequence
  Description of Artificial Sequence: Synthetic coding sequence
atggagaagctgggcgtggagcccgaggaggagggcggcggcgacgacgacgaggaggatgcagaggcgtgggccatggaattagccgacgtcggcgctgctgcctcctcgcagggggtgcacgatcaggttttaccaacacccaatgctagctcacgcgttattgttcacgtggacctggattgcttttacgcgcaggtggagatgatctcaaaccccgagttaaaggacaagcctttaggcgtgcaacaaaaatatctggtcgtcacctgtaactatgaagcccgcaaactgggggtaaagaaactgatgaatgtgcgtgacgcaaaggaaaaatgccctcagctggtgctggttaacggcgaggacctgacaaggtaccgagaaatgtcttataaggtgacagagttgctcgaagaatttagccccgttgtggagcgcctgggctttgatgaaaatttcgttgatcttactgagatggtggaaaagaggttgcagcagctgcagtccgacgaactgtccgcggtcactgttagcgggcacgtctataacaaccagagcattaatcttctggatgtgttacacatacgtctgctggttgggtcccaaatcgccgccgagatgcgcgaggcgatgtataaccagcttgggcttactggatgtgccggcgtggctagcaataagctcctcgccaagcttgtttctggggtgttcaagcccaaccagcagacggtgttgctcccagaatcatgtcagcacttgatccacagcctcaaccacataaaggagatcccaggcattgggtacaaaacagccaagtgcttagaagcactgggaataaactccgtgcgagatctgcagacattctctcccaagatcctggaaaaggagctcgggataagcgtggcccagcgaattcagaagctgagcttcggggaggacaattctcctgttattctatccggtccgcctcagagtttttccgaggaggactccttcaaaaagtgtagcagtgaggtagaggcgaaaaacaagattgaggaattactggcttcgttgttgaatagggtgtgtcaggacggacgtaagcctcacactgttcgcctgatcatcaggaggtattcttctgaaaagcactatgggcgtgagtctcggcaatgccccataccctcccacgttatccagaagctggggaccggaaattacgacgtcatgacaccgatggttgacatcctgatgaagcttttccggaatatggtgaacgtcaaaatgccttttcatttgaccctactttccgtgtgtttctgtaacctgaaggcattgaatactgccaagaagggtctgatcgactattatcttatgcctagcctgagtaccacaagcaggtctggtaagcactcctttaagatgaaagacactcatatggaggacttcccaaaagataaagaaaccaatagggatttcctgccttctgggcggatcgagagtacccgcacacgagagtcaccgctggatacgacaaactttagcaaggaaaaggacattaatgaattccccctctgttcgctgcccgaaggcgtggaccaggaagtattcaagcagctgcccgttgatatccaagaagaaatactgagtgggaagtcacgcgaaaaatttcaaggaaagggtagcgtcagttgtccacttcatgcctccaggggcgtcttatcattttttagcaaaaaacagatgcaagacattcctattaatcctagagaccatctttccagctcaaagcaggtgagcagtgtgagcccctgcgaacccggaacttccggtttcaactccagttctagctcctatatgtcatcacagaaagactattcctactacttggacaatcgtctgaaggatgagcgaataagtcaggggcccaaggaaccccagggattccattttacgaattctaatccagctgtcagtgcatttcattcgttcccaaatctgcaatccgaacagctgtttagccggaatcacactacagactcacacaagcagactgttgctacagatagccatgaaggcttgactgaaaatagggagcccgactccgtcgacgagaagataacattccctagcgacatcgatcctcaggtattttatgagttgcccgaggccgtacagaaggagttactggcggaatggaagcgggccgggtctgacttccacatcgggcataaatag

SEQ ID NO: 200019 - DNA, 2613 bp, Artificial Sequence
  Description of Artificial Sequence: Synthetic coding sequence
atggacagcaccaaggagaagtgcgacagctacaaggacgacctgcttctgagaatgggccttaatgataataaagctggaatggagggtctggataaagaaaagatcaataagattatcatggaggctacaaagggatctcgcttttacgggaatgaactgaaaaaagagaagcaggttaaccagagaatcgagaacatgatgcaacagaaggcccagataaccagtcaacaattgagaaaggcacagctccaggtcgaccggtttgcgatggagctggaacagagtcggaacttaagtaatactattgtccacatagacatggacgccttctacgcggcggtggaaatgagagataatcccgagctcaaagacaagcctatcgccgtcggctcaatgtcaatgctgagcacatccaactaccatgctaggaggtttggcgtgcgggcagccatgcccgggttcattgcaaaaaggctttgtcctcaattgatcatcgtccctccaaactttgataaataccgcgccgtatcaaaggaagtgaaggaaatattggccgattacgatcctaacttcatggcaatgagtctggatgaggcctacttgaatattacgaaacatttggaggaaaggcagaattggccagaggacaaacgccggtactttattaagatggggagcagtgtggagaatgataacccaggcaaagaggtgaataagctttctgaacacgagcggtcgatttctcctttgttatttgaagagtcaccctctgacgtgcagccgcccggtgatccattccaagtaaattttgaagagcagaataatccccaaattctccagaattccgtggtgtttggcacatcagcccaagaggttgtaaaggaaattcgtttcagaatcgagcaaaaaactaccctcacagcctcagctgggatcgccccgaacaccatgctggctaaagtttgtagtgacaaaaacaagcccaacggccagtaccagatcctacccaataggcaggcggtcatggatttcattaaagacctgcccattcgaaaggtgagcggaattggcaaagtgactgaaaaaatgctcaaggcgctggggatcattacatgcaccgaactttaccaacagcgagcactgctgtccctgctgttttctgaaacctcatggcattattttttgcacatttctctggggctgggctctacccacctgactcgtgatggcgaacgtaagtccatgtccgtggagcggacgttttccgagattaacaaagcagaggaacaatattctttgtgccaggagctctgtagcgagctggcccaggatctgcaaaaagaacgcttgaagggtcgtacagtaaccatcaagctaaagaacgtaaattttgaagttaaaactcgggccagcaccgtgtcctccgtggtgtctacagctgaagagatatttgctatcgcgaaggagctgttaaaaactgagatagacgcagactttccacatccactcaggctgagactgatgggcgtacgcatatcgtcattccccaatgaagaggacaggaagcaccagcagagatcaatcataggattcctccaggctggaaaccaggccctgtctgctacagaatgtactttagagaagactgataaagataagttcgtaaagccattagaaatgagccataagaaatccttcttcgataagaagcgctcagagaggaagtggtcgcatcaggacaccttcaagtgtgaggccgtgaataaacaaagcttccagacatcacagccattccaggtgctgaagaagaaaatgaacgagaatttagagatttcagaaaactcagatgactgccagatcctgacctgcccggtgtgtttccgagcacagggttgcatttctctagaggccttgaataagcatgtggacgaatgccttgatggaccttccatcagcgagaactttaaaatgttctcttgctctcatgtgagcgcgaccaaggtgaacaagaaagaaaatgttccagcctcctctctgtgtgagaagcaagattacgaggctcatcccaagataaaggagatttctagtgtggactgcatcgccttggtggacaccatagataactcaagtaaagccgagagcattgacgcattgtcaaataagcactcgaaagaagaatgtagctcattgccgtctaaaagtttcaatatcgaacattgccaccaaaattctagttccactgtctccctcgagaacgaagacgtgggatcattccgtcaggagtacaggcagccctatctgtgcgaagttaagactggtcaagccctcgtgtgtccagtctgcaatgtagagcaaaagaccagcgacttaacactgttcaacgttcatgtggatgtatgtctgaataagtcctttattcaagagttacggaaggataagttcaacccagttaaccagcccaaggaatcatcgcggtcaacaggctcctccagcggggtccaaaaagcagtcacccggactaagagaccaggtctgatgactaaatactctacttctaaaaaaattaagcctaacaatcctaaacataccctcgacatattttttaagtag

SEQ ID NO: 200020 - DNA, 2019 bp, Artificial Sequence
  Description of Artificial Sequence: Synthetic coding sequence
atggacagcaccaaggagaagtgcgacagctacaaggacgacctgctgcttcggatggggctcaatgacaacaaggccgggatggagggcctggataaggagaagatcaacaaaataatcatggaggccactaagggatccaggttctatggtaatgagttgaagaaggaaaagcaggtcaaccagcgaatcgaaaatatgatgcagcagaaggctcagatcaccagccaacagcttcggaaagcccagttacaggtggatcggttcgcgatggagctggagcagtcccggaatctgtccaataccatcgtgcacattgatatggacgctttttacgccgcagtggagatgagagacaacccggagctgaaggacaaacctattgccgtggggagtatgagtatgctgagcaccagcaactaccatgccaggaggtttggggtccgtgccgccatgcctggcttcatcgccaagcgcctatgtccacagctgataatcgttccgcctaattttgataagtatcgcgctgtcagtaaagaggtgaaggaaatcctagctgactacgaccctaattttatggcaatgtcactggacgaagcatacctcaacatcaccaaacacttggaggagagacagaattggcctgaagataaacgcagatacttcatcaagatgggctcgagcgtggagaacgataatcccggaaaggaagtgaataaactgtcagaacacgaaagatcaattagccctctactctttgaagagtccccctctgacgtacagccaccaggtgaccctttccaggtcaactttgaggagcagaacaatccccagattcttcagaacagcgtcgtgttcggaacttccgcacaagaggtggtgaaggagatccggtttaggatcgagcaaaagactacccttacagcaagcgccggtgtacgaatttcatccttcccaaatgaggaggatagaaagcaccagcagcggagtattatcgggttcctccaggcagggaaccaggcactgagcgccaccgagtgcacgctggagaagaccgataaagacaaatttgtcaaaccccttgagatgtcccacaagaagagcttctttgataaaaaacggagtgaacgtaagtggagccaccaggatacattcaagtgtgaggccgtcaataagcagtccttccaaacaagccagccatttcaagttctgaaaaaaaaaatgaatgaaaatctcgagatctctgagaactcagacgattgtcagatcctaacgtgcccagtctgctttcgagctcaggggtgtatatctttggaggcattaaataaacatgtggacgagtgcctcgacgggccaagtatatcggaaaacttcaaaatgttcagttgcagtcacgtgtcagctactaaagtgaacaagaaggaaaatgttcctgcgagctcactgtgtgagaagcaggattacgaagcacaccccaagatcaaggaaattagttctgtcgactgcatcgcgctggtagatactatagataacagtagtaaggctgagagtatagatgccctgagcaataagcattcgaaagaggagtgttcctctcttccctccaagtcgttcaatatcgagcactgccatcagaattcctcttcaactgtttccctggaaaacgaggatgtcggctcttttaggcaggaataccggcagccctacctgtgtgaagttaagaccggacaagctttagtttgtcccgtgtgcaatgtggagcagaaaaccagcgacttgaccctgtttaatgttcatgtcgatgtctgtctaaataaaagcttcatccaggaactacggaaagacaagtttaatccagtgaatcaaccaaaagagtcctcaaggtccacagggtcgtcaagcggggtgcagaaggccgtgacaagaacgaagcggccgggtctgatgacgaaatacagcaccagtaagaaaataaaaccaaacaatccaaagcacaccctcgatatattttttaagtag

SEQ ID NO: 200021 - DNA, 2343 bp, Artificial Sequence
  Description of Artificial Sequence: Synthetic coding sequence
atggagctggagcagagccggaacctgagcaacaccatcgtgcacatcgacatggacgccttctatgctgctgtcgagatgcgcgacaaccccgagctgaaagacaagccgattgccgtggggtctatgagtatgttatccacctccaactatcatgcccgcagattcggagttcgcgccgccatgcccggattcatcgcaaaaagactgtgccctcagcttatcatcgtgccaccaaacttcgacaagtaccgagcggtctccaaggaggtgaaggagattcttgccgactacgacccaaacttcatggcaatgtcattagacgaggcctatttgaacatcacaaagcacctcgaagaacgtcagaattggcctgaggacaagagacggtattttatcaagatgggctcatcagttgaaaacgacaaccctggaaaggaagtaaacaaactgtccgaacacgagcggagcatcagccctctgctgttcgaagagtcccccagtgacgttcaacctcctggagatcctttccaggtgaatttcgaggaacagaacaatccacagatcctgcagaactccgttgtttttggcacctctgcccaggaagtggtgaaggagattcgattcagaatcgaacaaaaaaccacgcttacggcatccgctggcattgcccccaacacaatgctggccaaagtgtgtagtgacaagaataaacctaacggccaataccaaatactgcctaaccgccaggcagttatggatttcatcaaggacctgcccatcaggaaggtgagcggcatcggtaaggtgacggagaaaatgctgaaggccctggggatcatcacctgcacagagctgtatcagcaacgtgcattattgtcgctgctgttcagtgagacatcatggcactattttttgcatattagcctcggcttgggatcaactcacctgacaagagatggagagaggaagtcaatgtccgttgagcgtacattttctgagattaacaaggcagaggagcagtactccctgtgtcaggagctgtgtagcgagttggcacaggatttgcagaaggagaggctgaaggggcggactgtcaccatcaaactgaaaaacgtcaattttgaggtgaaaacaagggctagcactgtgtcgagcgtcgtgtctaccgccgaagaaattttcgcaatagccaaagaattgctcaagaccgagatcgatgctgactttcctcaccctttaagactccgtctaatgggagttcggatctccagtttccccaatgaagaggataggaaacaccaacagaggtctatcataggttttctgcaggcaggaaaccaggcgctttccgccactgaatgtactctcgaaaagacggataaggataagtttgtgaagcctctggagatgtctcacaagaagagtttttttgacaaaaagaggtcggaacggaaatggtctcaccaggataccttcaaatgcgaggctgtaaataagcaatcctttcagacttctcagccgtttcaggttctgaagaaaaagatgaacgaaaacctcgagatcagcgagaactctgatgactgtcagatcttaacatgccccgtgtgcttccgggcccagggctgtatcagcttggaagcactgaataagcatgtggatgagtgcctggacggaccctctatcagtgaaaattttaaaatgttttcctgcagccacgtgtctgcgacaaaggtgaataagaaggagaatgtgcctgcatccagcctctgcgaaaaacaagactatgaggctcatccgaagatcaaagaaatatcttcagtcgactgtatcgctctcgtggataccatcgacaattccagcaaggccgagtccatcgatgctctgagcaataagcactctaaggaagagtgctcttctctcccctccaaatctttcaacattgaacactgccaccaaaacagttcttccaccgtgagcctcgaaaacgaggacgttggatctttccggcaggagtatcggcagccctatctctgtgaggtgaaaaccggccaggcccttgtttgtcccgtctgcaatgttgagcagaaaacatcagatctgaccctctttaacgttcatgtggacgtctgcctaaacaaatcttttattcaagagctgcgtaaggataaattcaatcccgttaatcagcccaaagaatcatccagaagcactgggtctagctcaggagttcagaaggccgtcacccgtactaagagaccaggtcttatgactaagtactcaacctcaaaaaagattaagccgaacaatccaaagcatactctggacatcttcttcaaatag

SEQ ID NO: 200022 - DNA, 1386 bp, Artificial Sequence
  Description of Artificial Sequence: Synthetic coding sequence
atggacagcaccaaggagaagtgcgacagctacaaggacgacctgttgcttcgcatgggtctgaatgataacaaggctggcatggagggcttagacaaggaaaagataaataagatcattatggaggccactaaaggctcccgtttctacggcaatgagcttaaaaaggaaaagcaagtaaaccaaagaatcgagaatatgatgcaacagaaggcacagatcacttcacagcagctccgtaaggcccagctacaggtcgatagatttgccatggaactggaacagtctcgcaacttgagtaacacaatcgtgcatatcgatatggacgctttttacgccgctgtggagatgcgcgacaatccagagctgaaggacaagcccattgccgtcggctccatgagtatgctttctacttccaactaccacgctaggaggtttggtgtacgagctgcaatgcctgggtttattgcaaaaagattgtgccctcagctgattatcgtgcctccgaatttcgataagtatagggcagtgtccaaagaagtgaaagaaattctggcagactacgacccaaacttcatggcgatgtctttggatgaggcatatctaaatatcacgaaacacctcgaggaaagacaaaattggcctgaggataagaggcggtattttatcaagatgggatccagcgtggagaatgacaaccctgggaaagaggtcaacaaactttccgaacacgagcgatctataagcccattgctctttgaggagtctccttcagacgtgcagccacctggagatcccttccaggttaacttcgaggaacagaacaacccacagatcctgcaaaacagtgtggtgtttggaacaagcgcccaggaggtcgtgaaagaaataagattccgaatcgaacaaaagacgactctgacagctagcgcagggatcgctccaaatacaatgctagctaaagtatgttcagataaaaacaagcctaatgggcagtatcagattctccctaacagacaggctgtaatggattttatcaaagatttaccaatacgcaaggtttccgggatcggcaaggtgaccgagaagatgcttaaagctttgggtatcatcacgtgcacggagctttaccagcaacgcgccctgctttctctactcttttccgaaacaagttggcactactttcttcatattagcctggggctgggtagtactcacctcactagagacggagagaggaagagtatgagcgtcgagcgtacgttcagcgaaatcaataaggcagaggaacagtactcactatgtcaggaactctgttctgagctcgcacaggaccttcagaaggagcggcttaaagtcgcacaggttgagtataggagattgtag

SEQ ID NO: 200023 - DNA, 2019 bp, Artificial Sequence
  Description of Artificial Sequence: Synthetic coding sequence
atggacagcaccaaggagaagtgcgacagctacaaggacgacctgcttctgcggatggggctcaacgataacaaggccggaatggaaggattggataaagagaaaattaataagatcatcatggaagctacaaagggaagcagattttacggcaacgaactgaaaaaggaaaagcaagtgaatcaacggatcgagaatatgatgcagcagaaagcgcagatcactagccaacaattaagaaaggcacaactgcaggttgatcggttcgccatggaacttgagcagtcacggaatctttctaatacaattgtccatattgatatggacgcgttttacgcggcggtcgagatgcgggacaatcccgaattgaaggataaacccatcgccgtgggatccatgtctatgctatccactagcaactaccacgctaggcgtttcggagtgcgcgcggctatgccaggatttatcgccaagcgactgtgtccccagctcattattgtgccacccaattttgataagtacagggcagtatcaaaggaggttaaagaaattttggcagactacgaccccaattttatggcaatgagccttgacgaagcctatctgaatatcaccaaacatctggaagaaaggcagaactggcctgaagataagcggcggtacttcatcaaaatggggtcatccgtcgaaaatgacaacccgggaaaagaggtgaacaaactgtctgaacatgagcggagcattagtccgctactattcgaggagtcgcctagtgacgtccagcccccaggggatccctttcaggtgaacttcgaggaacaaaataatccacagattctgcagaacagcgtcgtattcgggacctctgcgcaggaagtagtgaaagaaatccggttcaggatcgagcagaaaaccacactgaccgcctcggctggcgtccgtatctctagttttcctaatgaggaagaccggaaacatcagcagaggtccatcatcggctttctccaagccggcaatcaggctttgtctgctacggagtgcaccttagaaaaaaccgataaagacaagttcgtcaaaccactggaaatgtcgcacaagaaatctttttttgacaaaaaaaggagcgagcgcaagtggtctcatcaggatacattcaaatgcgaggctgtaaataagcaatcatttcaaacttcccaaccattccaggtgttgaagaaaaaaatgaacgaaaatctagaaatctccgaaaattcagatgattgtcagatcttaacctgcccagtttgtttcagagctcaaggttgcataagtctcgaggctctcaacaaacacgtcgacgagtgtctcgatgggcccagcatctccgaaaattttaagatgttctcgtgtagtcatgtgagcgctacaaaggtgaacaagaaggagaacgttcccgcaagctccctctgtgagaaacaagattacgaggctcacccaaagataaaggagatcagttctgttgattgtatcgccctggtagacaccattgataattcctcgaaagccgagagcatagatgccttaagtaacaaacatagtaaggaggaatgctctagccttccaagtaaatcttttaacatagagcactgccaccaaaattcctcatccaccgtgtcacttgaaaacgaggatgtgggaagctttcgccaggagtaccggcagccctatttgtgcgaggtcaagactgggcaggcacttgtctgcccagtgtgcaatgtcgagcaaaagacctctgatctgacactcttcaacgtgcacgtcgacgtctgcctgaataagagctttattcaggagctgcgcaaagacaaattcaatccagttaatcagccgaaggagtcatcgcgctccaccggatccagcagcggggttcaaaaggcagtgacccggactaagaggcctggtctcatgactaagtactccacttcaaaaaagattaagccaaataaccctaagcatacgctcgatatcttcttcaagtag

SEQ ID NO: 200024 - DNA, 1470 bp, Artificial Sequence
  Description of Artificial Sequence: Synthetic coding sequence
atggacagcaccaaggagaagtgcgacagctacaaggacgacctgttgctccgcatggggctaaatgataacaaggcaggcatggaaggattggataaagaaaagataaataagatcataatggaggctaccaaggggtcacggttctatgggaacgaattaaaaaaggagaagcaggtgaaccaaagaattgaaaacatgatgcaacagaaagcacagattacgtcacaacagcttagaaaggcgcagctgcaggttgaccgattcgcgatggagctcgaacaatcccggaatctctcgaacacaatcgtccacatcgatatggatgcattctatgcagctgtcgagatgagggacaaccccgagctgaaggataaacccattgctgtgggatctatgagcatgctgagcacctctaactaccatgcacgccgtttcggcgtgagggccgccatgcctggttttatagccaagcgcctctgtccacaactgatcatcgtacctccaaattttgacaaataccgcgccgtgtccaaagaggtgaaggagattttggctgactacgaccccaattttatggccatgtctctggacgaggcctacttaaacatcactaaacatcttgaggagagacagaattggcctgaagataagagacgctacttcataaaaatgggctcctccgtggaaaatgataatcccggcaaggaagtcaataagctgtccgagcacgaaaggagtattagccctctgctgttcgaggaatccccctcggacgtgcagcccccaggggacccattccaggtgaattttgaagaacagaacaatccgcagatcctccagaactctgtggtgttcggcacttctgcacaggaagtggtgaaggagattcgtttccgcatagaacagaagacgactctgacggcctcagcgggaattgcacccaacacgatgcttgcaaaagtttgttcggataagaacaaaccaaacgggcagtaccagatcctgcctaatcgccaagccgtcatggattttatcaaagacctgcctatcagaaaggtctctggcatcggcaaggtgactgagaaaatgctgaaggcccttggaatcataacatgcacagagctttaccagcagagagccttactctctcttctcttcagcgaaacttcctggcattacttccttcatatatctctaggactgggctccacacacctaacacgcgatggggagaggaaaagcatgtctgttgagaggacatttagcgagatcaacaaggccgaggaacagtattcactatgtcaggagttgtgttcagaactggctcaggatttgcagaaagaacgattgaaagtgttcggctacctggtcttccctatgaagagaaccggcaataccaacaagggcgcattattggccttctatcgcttggagactaaaccttgtcagcccctgtcagtccactag

SEQ ID NO: 200025 - DNA, 426 bp, Artificial Sequence
  Description of Artificial Sequence: Synthetic coding sequence
atggacagcaccaaggagaagtgcgacagctacaaggacgacctgcttttaaggatgggtctgaatgacaacaaggccggaatggagggcctcgataaagaaaagattaataagattatcatggaagccacgaaagggtccagattctacggcaatgagctgaaaaaagagaagcaagtcaatcaacggatagaaaatatgatgcagcagaaggcccagatcacttcccagcaactgaggaaggcacagctgcaagttgacagatttgcaatggagcttgagcagtcccggaacctctcaaatactattgtacatattgacatggacgctttctacgcagcggtggaaatgcgcgacaatcccgaactcaaggacaagccaatcgctgtcggcagtatgtcaatgctgagtacctctaactattag

SEQ ID NO: 200026 - DNA, 1419 bp, Artificial Sequence
  Description of Artificial Sequence: Synthetic coding sequence
atggacagcaccaaggagaagtgcgacagctacaaggacgacctgctgctgaggatgggactgaacgataataaggcaggcatggagggtctagataaagagaaaatcaataagattatcatggaggccaccaaaggttcgcgattctacggcaacgaattaaagaaggaaaagcaggtgaaccaaaggatcgaaaacatgatgcagcaaaaagcacagattacgagtcagcagctgaggaaggctcagcttcaggtggataggttcgctatggaactagagcagtcacgcaacctcagcaataccatagttcacattgatatggatgcattttatgctgcagttgagatgcgggacaatcctgaattgaaggacaagcccatagcagtcggtagcatgtcaatgctcagcacttctaactaccatgctcgcaggttcggggtccgcgcggcgatgcctggattcatagctaaaagactgtgtccccagttgattatcgtccctcccaattttgacaagtacagggcggtgtctaaggaggtgaaagaaatactcgccgactacgatccaaacttcatggctatgtccctagacgaggcctatctgaacatcacaaaacatctagaggagcggcagaactggcccgaggataaacggaggtattttatcaagatgggcagctctgttgaaaatgataaccccggcaaagaggtaaataagctttcggaacacgagcgcagtatcagccccttactattcgaggaaagtcccagcgacgtccagccgcccggtgatccatttcaggtgaattttgaggaacaaaataacccccagatcttacaaaatagcgtcgtgttcggcaccagtgcacaggaagtcgtgaaagagataagatttaggatagaacagaagactacgctcacagcttcggccggcattgcccctaatacgatgcttgcaaaggtgtgctccgacaagaataaaccaaacgggcaataccaaattctcccgaacagacaggccgtcatggattttattaaggatcttcctataaggaaagtgtcaggcatcggtaaggtgaccgagaaaatgctgaaagctctgggcataatcacgtgcacggaactttatcagcagagggcccttctgtcactgttattctccgagacatcatggcactacttcctgcatatcagcctgggcctcggctctactcacctcaccagagacggagaacgcaagtcaatgagtgtggagcgtaccttcagcgagatcaataaagcagaggaacagtattccctgtgccaagagttgtgcagcgaactcgcacaagatttgcagaaagagcggctcaaggtgctctacttcgatatggtgtctttggttttcaaattctttaactcaaaaatgctgccctag

SEQ ID NO: 200027 - DNA, 1911 bp, Artificial Sequence
  Description of Artificial Sequence: Synthetic coding sequence
atgaagtgcaagtgccccgtgatctgcttcaacgccaaggacttcgtgcgcattgtactccagttttttgggaatgacggcagctggaaacacgttgccgatttcataggcttggacccacgcattgcagcctggctgatcgatccatccgacgccactccatccttcgaagatctggtggagaagtattgcgaaaaatctataacagtaaaggtcaattccacttatggaaatagctcccgcaatatagttaatcagaatgttcgcgagaacctgaaaactctgtataggctgacgatggatctgtgctctaaactaaaagattacgggctttggcagctgtttcgaacccttgagctgccactcatacccattctggctgtcatggaaagtcacgccatccaggtgaataaggaggaaatggagaagacttcagctctgttgggagccaggctaaaggagttggagcaggaagcccatttcgtggccggcgagagattcctgattacctcgaacaatcaactaagggaaatcctgttcggtaagctgaaacttcacctactgtcacagagaaactctctacctcgaaccgggctgcagaagtatcccagcactagcgaagctgttctcaacgctttacgcgaccttcaccctctaccaaagattatactcgagtaccggcaggtccataaaatcaagtcaaccttcgtcgacggactgctcgcgtgcatgaagaagggaagtatctccagcacatggaaccagacgggcaccgtaaccggaaggttgtctgcgaagcaccccaacattcagggaatctctaagcacccgatccagatcacgacccctaaaaacttcaaggggaaagaggacaaaatcctgactatcagtcctagggctatgttcgtttcctccaagggccatactttcctggctgccgatttctcgcagatcgagctgcgcatacttactcacctctcaggcgatcccgagctgctgaaactattccaggaaagtgagagagacgacgtgtttagtaccctgacttcccagtggaaggacgtgcctgtggagcaggtaacacatgcagaccgtgagcagacgaagaaggtagtgtacgccgtcgtgtacggcgcggggaaagaaagattggctgcgtgtttgggcgtacccatccaggaggcggcccagtttctcgagagctttctgcaaaaatataaaaaaataaaggactttgccagagcagccattgcccagtgtcatcaaaccggatgcgtggtttctattatgggaaggaggagacctctcccccgcatccatgcacacgatcagcagctcagagcacaggcggagcggcaggcagtgaacttcgtcgtccagggtagcgccgccgacctctgcaaactcgcgatgatccacgtgttcactgctgtggctgccagtcacacccttaccgccaggctggtcgcgcagattcacgacgagctgctgtttgaggttgaggatccacagatccctgagtgcgctgccttggtgagacgaactatggaatccctcgaacaggtcccactaaaggtctctctgagtgctggtcgttcatggggacacctagttccacttcaggaggcttggctgcgccaggctcacgttgctctttctctgcctgccacagcctggctgcctctgggccctctcccggcccccagcccccatccttgtatctttcgcctccattttgtctgctctcctaggcagcagtgggaggaacgcacggggtttcagcagtccattgtgtggccctcaccccgcagccctgctttgtacgctcccgggcgtatcaatcctctgggcctggggtggccagccatcccttggtctaaatgcttatgcaaagccctgcttatcctgtag

SEQ ID NO: 200028 - DNA, 936 bp, Artificial Sequence
  Description of Artificial Sequence: Synthetic coding sequence
atggccgtgggcagccaggactacggcctgtggcagctgttccggacgctagagcttccccttattccaatcctggcagtaatggaatcgcatgcgattcaggtcaataaggaagaaatggagaagacatctgccctacttggcgctcgtctcaaggaacttgaacaggaggcacactttgttgcaggcgaacggtttctgatcactagcaacaatcagctaagagagatcttgtttgggaagctcaagttacatctgctctcgcagcgcaattctttgcccaggaccggcctacagaagtacccaagtacttcagaggcagtgaacatacagggaatctccaaacacccaatacagatcactactcccaaaaatttcaaaggtaaggaagataaaatcctgaccatcagtcctagggcaatgttcgtgtcatcgaaaggacacaccttcctggctgcagattttagccagatcgaactgcggattctaactcacctatctggcgatccggaactgttgaagctattccaggagagtgagcgggatgatgtgttctccacattgacgagtcagtggaaagatgtgcccgtggagcaggtcacccacgccgaccgggagcagactaagaaggtggtttacgccgtagtgtacggcgccggtaaagagcgcctagcagcctgcttaggggtccctattcaggaagccgcccagtttttggagtcgttcctccagaagtataaaaagatcaaggatttcgccagggcagcaatcgcccagtgtcatcaaaccggctgtgtggtcagcattatgggccggcgccgccccttaccaaggatacatgcccacgaccagcaactccgcgcccaagccgagcggcaggccgtgaatttcgtggtgcaagcccagtcacagcacctatgcgtggaagtcccgtag

SEQ ID NO: 200029 - DNA, 2703 bp, Artificial Sequence
  Description of Artificial Sequence: Synthetic coding sequence
atggagaactacgaggccctggtgggcttcgacctgtgcaacacccccctgtctagtgtggcccagaagattatgtcagccatgcatagtggtgatctggtcgattccaagacctggggcaagtcaacagaaactatggaagtgataaacaagtcttccgttaagtactcagtacaactggaggataggaagacccagtctcctgaaaaaaaagatctcaagagcttgcgctcccaaacaagccgcggttcagctaagctttccccccagtctttttcggtgcgattgacagatcagctgtcggctgatcagaagcagaaatcgatttccagcctgacactgtcctcttgtctgatcccacaatataaccaggaggcctccgtcttgcaaaaaaaaggccacaagcggaagcactttctcatggagaacattaacaacgagaacaaggggagcattaatctaaagcgcaagcacattacatataataacctttcagagaagacaagtaaacaaatggcactggaggaggatacagacgatgccgaaggctatttgaactccggcaatagtggagcactgaaaaaacatttctgcgacatcaggcatcttgatgattgggcaaaaagtcagctgattgagatgcttaaacaagctgctgcccttgtgattactgtgatgtacacggacggctcaacccagctgggcgcagatcagactccggtttcatctgtgagaggtatagttgtcctagtgaagagacaagcggagggaggacacggctgccccgacgccccagcctgcggcccggtgctcgagggcttcgtaagtgacgatccctgcatctacatccagatcgaacattcagctatttgggatcaggaacaagaagcccatcagcagtttgcacgcaacgttctgttccaaacaatgaagtgtaaatgtcccgttatatgttttaatgccaaggatttcgttcgtatcgtactccaatttttcgggaacgatgggtcatggaaacatgtcgctgacttcataggtttggacccccgcatcgccgcctggcttattgatccctccgatgcaacgccaagctttgaggatttggtagagaaatactgtgagaaaagtatcacagtgaaagtgaattctacctatggcaattcctctcgcaatatcgtcaaccagaatgtcagagagaatttaaagactctgtataggctcacaatggatctctgcagcaaattaaaggactatggtttgtggcagctgtttcgcacccttgaattacccctgatcccaattcttgccgtaatggaatcacatgctattcaagtcaacaaggaagagatggagaaaactagcgccctccttggcgccaggttgaaggaactggagcaggaggcgcactttgtggcaggtgagcggtttctgattacatcaaacaaccagctcagagagatcttattcggcaaactcaaattacatctcctgtcccagcggaattctttgcctagaactggactccaaaaataccccagtacttccgaggctgtcctgaacgctctgagggatcttcatcccctacctaaaattattctggaataccggcaggtgcacaagattaagtcgaccttcgtagacggtctccttgcctgtatgaagaaggggagcattagcagcacctggaatcagacaggcactgtgacaggtagactaagtgctaaacaccccaacattcagggaatatcaaaacaccccatccagattactactcccaagaacttcaagggtaaggaagacaagatcttaactatcagtccccgagctatgttcgtgagcagcaaaggccacacatttctggctgctgatttctcacagatcgagctcaggatccttacacatttgagcggtgaccctgagctgctcaagttgttccaggaatctgaacgtgacgatgtcttctcaaccctcacatctcaatggaaagacgtgccagtggaacaggttacccatgccgaccgagaacagacaaaaaaggtcgtttatgccgtcgtctatggtgccggaaaggagcgccttgctgcctgcctgggggttccaatacaggaggccgcacagtttctggagagtttcctccagaaatataagaaaatcaaggattttgctcgagctgccattgcacagtgtcatcaaaccggctgcgtcgtgtccataatgggacgccgtaggcccctccctcggattcatgcgcatgatcagcaattgcgagcacaggctgaacgacaagcagtgaatttcgtggttcagggcagcgccgccgatctttgtaaactcgccatgatccatgtctttaccgccgtggcggcaagtcacacattgactgctaggctggtggcacaaatccacgacgaactgctgtttgaagttgaggatcctcagatccccgaatgtgcagcgctggtacgcaggaccatggagagcctcgaacaggtgcaggctcttgagctgcaactgcaagtgccgcttaaagttagcctttcagcaggcaggtcgtgggggcacttggtgcccctgcaggaagcgtggggtccaccccctggaccttgcaggactgaaagccccagcaattcactcgcagcaccaggttctccagctagcactcagccccctcccctgcacttttccccctccttttgcttgtag

SEQ ID NO: 200030 - DNA, 2703 bp, Artificial Sequence
  Description of Artificial Sequence: Synthetic coding sequence
atggagaactacgaggccctggtgggcttcgacctgtgcaacaccccccttagctccgtggctcagaaaattatgtctgccatgcactcgggagacctggtcgacagcaagacatggggtaagtccacagaaactatggaggttattaataagtcctccgttaagtatagcgtccaactggaggataggaaaacacaaagccccgaaaagaaggacttgaagtccctgagatcgcagacctctagggggtctgcaaagctgtcacctcagtctttttccgtgcgactgacggaccagctcagcgcagatcagaagcagaaatctatctccagcctcaccctaagcagctgcctgattccccaatacaaccaggaggcatctgttctccagaagaagggacacaaacggaagcactttttgatggagaacattaataacgagaataagggctctatcaacttgaagaggaagcacataacatataacaatctatcagagaaaacgtctaagcagatggctctggaggaggacactgatgacgccgaggggtatctgaattcaggaaattccggagctcttaaaaagcatttctgcgatatcagacaccttgatgactgggccaaatctcagcttattgaaatgctgaaacaggctgctgctctggtgataactgtaatgtacaccgacggctcaactcagctcggtgccgaccagactccagtttcctccgtgagaggcatcgtggtcttggtaaaaagacaggccgaaggcggtcacggatgcccagacgcaccagcgtgtgggcccgttctggaggggttcgtgtcggatgacccttgtatctatatccagatcgagcattcggcgatctgggatcaagaacaggaggcccatcagcagtttgccaggaatgttttgttccaaacgatgaaatgtaagtgcccagtgatctgctttaacgccaaggatttcgtgcgtatcgtgctacaattttttggaaacgacggctcttggaaacatgtggccgacttcatcggtctagatccccggattgccgcctggttgatagaccccagcgacgcaacccctagttttgaggatctcgtcgagaaatactgtgagaaaagtatcaccgtgaaggtcaattccacatacggaaattcaagcaggaacatcgtcaatcaaaatgtgcgagaaaacctcaaaacgctgtatcgcttgacaatggatctctgttcgaagctgaaagattatggactgtggcagctctttaggactctcgagcttccattaattccaattttggcagtgatggagagtcatgctatacaggttaataaggaggagatggaaaagacctcagccctgctgggcgccagacttaaggaactggaacaagaggcccactttgttgccggcgaaagattcttgattaccagtaacaaccagctgcgtgagattttgtttggaaagctcaagctgcacctgctgagccagagaaattcactgcctaggacaggtctgcaaaaatacccatcaacaagcgaagccgtcttgaacgctctaagggacctgcaccccctgcctaagattatattggagtatcggcaggtgcacaaaatcaagagtacctttgtggacggccttctggcttgcatgaaaaaagggtctatctcctccacctggaatcagacaggcaccgtgaccggccggctaagtgcaaagcatccgaacatccaaggaattagtaagcatccaattcagattactacccccaaaaacttcaaagggaaggaggataaaatcctgacaatctctcccagagccatgttcgtgagctcaaagggccacacatttctggctgcagatttctcgcagattgagctgcggattctcactcatctcagtggcgacccagagctgctgaaactgtttcaggaaagcgagagggatgatgtgttttctaccttgacttcacaatggaaggacgtccccgtggagcaggtgactcatgccgatcgagaacagactaagaaagtcgtgtatgctgttgtatacggggccggcaaagagcgtcttgccgcatgcctgggggtcccaattcaagaagctgcccagttcttagagtcttttctccagaagtacaaaaagattaaggatttcgcccgggcagcgatcgctcagtgtcatcagaccggttgtgttgtgagcatcatgggacgtcggcgcccccttcccagaattcatgcccacgaccagcaattgcgagcacaggctgagcggcaagcagtgaacttcgtggtacaggggtcggccgcggatctttgcaaacttgccatgattcacgtcttcaccgcagtggctgcttctcatacgctgaccgcacgacttgttgcccaaattcatgacgaactactcttcgaagttgaagatccacagatacctgagtgtgcagccttggtcaggcgcaccatggagtccctagagcaggtccaggccctggagctgcagctgcaggttcctcttaaggtcagtcttagtgcaggcagaagttggggtcacttggtcccacttcaggaggcctggggacctcctcctggcccatgccgcacggagtctcccagcaattcccttgcagctcccggtagcccggctagtacacagccgccccctctgcatttcagtccatctttctgtctgtag

SEQ ID NO: 200031 - DNA, 3033 bp, Artificial Sequence
  Description of Artificial Sequence: Synthetic coding sequence
cggatggacggcaagcggcggcccggccccggccccggcgtgccccccaagagagctagaggaggtctctgggacgatgacgatgcaccaagaccctcccagtttgaggaggatctcgccctgatggaggagatggaggccgaacaccgcctgcaggaacaggaggaagaggaactgcagtcggtcctggagggcgtcgccgatggccaagtacctccgagcgctatcgatccacgttggctgcggcccacaccccctgccctggacccacagactgagccactgatcttccagcagcttgagatagaccactacgtcggaccagcccaacctgtcccgggaggcccaccaccatctcgaggttctgtccccgttcttcgcgcctttggagtaaccgatgagggcttcagcgtctgctgtcacatccacggcttcgccccgtacttctacactcctgccccgcctggcttcgggccggagcacatgggtgatttgcagagggaactgaatctcgctattagccgggactctcgagggggccgggaattgaccggccctgccgtgctggccgtggagttgtgttcccgagaatctatgtttggttaccacgggcatggcccttcccccttcctgcgtatcaccgtcgccctgcctagattggtagcacctgccagaaggctgcttgaacagggcatccgcgtggccggcctgggaactcctagctttgccccatatgaagccaacgttgactttgagatccggtttatggtggataccgacatcgtcggctgcaattggctcgaactcccagccgggaagtacgccctgaggctgaaggaaaaagcaacgcagtgccagctcgaggctgacgtactgtggagtgacgtggttagtcaccctcccgagggtccctggcagcggattgcgcctctgcgagtgttgagctttgacattgagtgcgctggccgaaaagggatctttccagaacccgagcgggatcccgtgatccagatttgcagtttaggcttgagatggggtgagcccgagcccttcctgcgcttggcactcacacttcggccatgtgccccaattttaggagcaaaagtccaatcctatgagaaggaggaggatcttttgcaggcttggagtactttcatcagaattatggaccccgatgttatcaccggatacaatatccagaatttcgatctaccctacctgatcagccgcgcccagacattaaaggtgcagactttcccctttctcggaagggttgccggactgtgtagtaacattcgggattcttcattccagtccaaacagacgggcagacgagacactaaagtggtttctatggtgggtagagtacagatggacatgctgcaggtcctactgagagaatataaactgaggagctacaccctgaacgctgtgtctttccatttcttgggtgagcagaaggaagacgtgcagcacagcatcatcaccgaccttcagaatggcaatgaccaaacgcgccgccgactcgccgtgtattgcctgaaggatgcctatctacctcttcgattgttagagaggctgatggtattggtaaatgctgtggaaatggccagagtgactggcgtacctctgtcctaccttctttcaaggggacaacaagtgaaggtggtgagtcaactcctccggcaggctatgcacgagggattgctgatgcccgtggtcaaatctgaggggggcgaggactatacaggcgcgaccgtgatagagccccttaaaggctattacgacgtgcctattgctactctggatttctcatctctgtatccttccataatgatggcccacaacctctgctacactacgctcttgcgcccaggaacggctcagaagctcggcctcactgaagatcagtttatcaggaccccaaccggcgatgagttcgtaaaaacttctgtacggaaaggcctgctgccacagattctggaaaacttgctctccgctcggaaacgtgctaaggcagagcttgccaaggaaactgacccactgcgaaggcaggtccttgacggcaggcagctggccctgaaagtctccgcaaatagcgtctacggattcaccggagctcaggtgggtaagctgccatgtctggagatttcccagagtgtcacaggtttcggccgccagatgattgagaaaactaagcagctcgtggaatccaagtatacagtggaaaacgggtactcaacttcagcgaaggtggtctacggcgacaccgacagtgtgatgtgccgcttcggcgtctcttccgtggccgaagccatggcgcttggcagagaggctgctgattgggtttctggtcatttcccgtctcctattcggctggagttcgaaaaggtatactttccctacctcctcatctcgaagaaacgatacgccggtctgctcttctccagccggcctgacgctcatgatcgaatggactgtaagggtctggaagccgtgcgccgcgataactgccctctggtggcaaatctggtaaccgcctccctccgacggctgttaattgatcgcgatccggagggagccgtggcacatgctcaggacgtgatcagcgatctgctctgcaacagaattgatatctcgcagcttgtcatcaccaaggaattaactagggccgcttcagattatgccggaaaacaggcccacgtggaactggctgagagaacgcggtgctcctgctggagcaccgcctgcccactgacacgttctacgacctggagtagtagctggcctagtccttcctgtgcctctagcagccctagctgggcaagggccgtgccacggctttgttattgtggcgggacaactcgcgccgctcgaaggtgtagtagggcgcggtgggccgcatcttggccctcacctaacgccgcgactgctgccttggccgcagcccagtgtagcgccacacgggagccttgcgtatccagcgcaagcccagggtcattatcctgtattaggcgtcggtaccctatctag

SEQ ID NO: 200032 - DNA, 3324 bp, Artificial Sequence
  Description of Artificial Sequence: Synthetic coding sequence
atggacggcaagcggcggcccggccccggccccggcgtgccccccaaacgggcccgaggagggctctgggacgacgacgacgccccacggcccagccagttcgaggaagaccttgcactgatggaggaaatggaggcagaacacagactgcaggaacaggaggaagaagagttacagagcgtactggagggcgtcgctgacggccaagtcccccccagcgcgattgacccgaggtggctaagacccacaccccctgcactggatcctcagacggagcccctgattttccagcagttagagatcgaccactacgtgggcccagcacagccagtccctggggggccaccccctagtagaggatctgtcccggtgctcagggcattcggcgttactgatgagggattctctgtctgttgtcatatccacggatttgccccatacttttatacacctgcaccgccgggctttggtccagagcacatgggcgatttgcaacgcgagcttaacctcgccataagccgggattcaagaggggggcgggagttgacgggccccgctgtgttggctgtagaactctgttcaagagaatcgatgttcggctatcacggccacggtccgtcaccttttttacgaattactgtggccttgccacggctcgtcgcacccgctcgccgactcttggaacaaggtatccgggtggccggtctcggaaccccctctttcgcaccctatgaagccaacgtagatttcgaaattaggttcatggtggatactgatatcgtgggctgtaattggctcgaactaccagcgggtaagtatgcactccggctcaaggagaaagccacacaatgccaactagaagccgacgtcttgtggtctgatgtggtctctcaccccccagagggcccctggcagcgtatagctcccttgagagttctgtctttcgacatcgagtgcgctggcagaaaagggatatttcccgaacctgaaagggaccccgtaatccaaatttgttcactggggctgaggtggggcgaaccagagccattcctgaggctggccctgacgctgcggccttgcgcgcctattttgggcgccaaagttcagtcctacgagaaagaggaggaccttttgcaggcctggtcaacttttattcggattatggacccggacgtgatcacagggtataatatccagaacttcgacttaccttatcttatctcacgagcacagacactgaaggtccagactttcccattccttgggcgtgttgctggactctgcagcaacatccgtgactcaagttttcaatccaagcagacgggccggagggataccaaagtggtttctatggtggggcgggtccagatggacatgcttcaggtgctgctgcgggagtacaagctacggagctataccctcaatgccgtgtcttttcacttcctgggtgagcagaaagaagatgtgcagcatagtattatcactgatctgcagaatgggaatgatcagacgcgccgtcggctagccgtgtactgccttaaggatgcctacctgccgctgagattgctcgaaagactgatggtgctggttaatgccgtcgaaatggcacgggtgaccggagttcccctatcctacctgctctccagggggcagcaagtcaaagtcgtgtcccaactgctccgccaggcaatgcatgaaggtctgctgatgcctgtggtcaagagcgagggcggggaagactacacaggagctacagtgatcgagccactgaaggggtattatgacgtgcctatcgccaccctggatttctcttccctgtacccctccattatgatggcacacaatctttgctacaccaccttattaaggcctggaacagcccagaagctaggtctgaccgaggatcagtttattagaacaccaactggtgacgagttcgtgaagacaagtgtgcgcaagggccttcttcctcaaatattggaaaatctcctctccgcacgaaagcgcgctaaggctgagcttgccaaggaaactgaccccctgaggagacaagtcctggacggacggcagctcgcgttgaaggtgtctgctaatagtgtgtatggctttaccggtgcacaggttggcaagttgccttgcctggaaatatctcagagcgtgaccggcttcggccgacaaatgatagagaaaactaagcagttagttgagagcaagtacacagtcgaaaatgggtattctacctcggccaaggtggtctacggcgatactgacagtgtcatgtgtaggtttggcgtgagttcagtggctgaggccatggcactgggcagagaggcggccgattgggtgagtggccacttcccatcccccatccgcctcgagttcgaaaaggtatactttccgtatttattaatttcaaaaaaacgctacgccggcctgctgttctcctcaaggccagacgctcacgatcgtatggactgtaaaggactcgaggcagttagacgggataattgccccctggtggccaacctcgtgaccgcctctttacgtcggctcctgatcgatcgcgaccctgagggcgctgtcgcacatgcacaggatgtcatttctgacctgctctgtaacagaattgatatatcccaacttgttataactaaagagttgactagggctgcttccgactatgcagggaagcaggcccacgtggagctggcggagcgcatgcgtaaaagagatcccggttccgcgccaagcctaggtgaccgggtgccgtatgtcatcattagcgctgcaaagggtgtcgccgcatacatgaagtcagaggatccactgttcgtcttagaacattctctacccatcgacacacagtattatctcgagcagcagctagcaaagccgctgcttcgcatcttcgaaccaattctgggcgagggccgcgctgaagcagtccttctgagaggggatcatacccggtgtaagaccgtgctgactggaaaggtgggcgggctgcttgcatttgcaaagaggaggaattgttgcattgggtgccggacagttctgtcacatcagggtgcggtctgcgagttttgtcaacctcgagaatccgagttataccaaaaagaggtttcacatcttaatgcgctggaggaacgcttcagtcggctgtggacgcagtgtcagaggtgccaggggagcctccatgaggacgtgatttgcacctcaagagattgtcccatcttctacatgagaaagaaggttcgaaaggacctggaggaccaggagcagctgctcaggagatttggccccccaggaccagaagcttggtag

SEQ ID NO: 200033 - DNA, 1410 bp, Artificial Sequence
  Description of Artificial Sequence: Synthetic coding sequence
atgttcagcgagcaggccgcccagcgggcccacaccctgctgagccctccttcagccaacaacgctactttcgccagagtcccggtggcaacctacacaaactcgagccagccctttcgtctcggagaaagatcattcagccggcaatacgcccacatctacgcaacccgcctgatccagatgagaccatttctggaaaatcgggcacaacagcactggggtagcggtgtgggagtgaaaaagctctgcgaattgcagcctgaggagaaatgttgtgtggttggaacgctgtttaaagcgatgcccctgcagcccagcattctgagagaggttagtgaggaacacaacctcctgccacaaccacccagatctaagtacatccatccggatgatgagctggtgctggaggacgagctgcagagaatcaaactgaagggaacaatagatgtgtcgaagcttgtaactggcacagtcctcgcggtttttgggagcgttcgggacgacgggaagttcctggtggaggactattgctttgctgaccttgctcctcagaagccagcccccccacttgacaccgatcgcttcgtactgctggtcagcgggctaggcctcggtggtggaggcggggagagtctgttaggaactcaattattggtcgacgtggtgactggacagttaggagatgagggcgaacaatgcagtgctgcgcatgtatctcgcgtcattcttgcaggcaatctgctcagccacagtacacaaagccgcgatagtattaataaggccaagtacctcactaagaagacccaggcagccagtgtggaggccgtaaaaatgttggatgagatattgcttcagctcagtgctagtgtacccgttgacgtgatgcccggtgaattcgatcccacaaattacaccctgcctcagcagccattacatccatgcatgtttcccttagcaacggcctattccaccttgcagcttgtaaccaatccataccaggctacgatcgacggggtccgctttttaggcaccagtgggcagaacgtgtccgacatctttcgttactcctccatggaggatcacctggaaattttggagtggacgctgcgtgtaagacacatatctccgacagctcctgacactttggggtgctatcccttctataaaaccgacccctttatctttccagagtgcccccatgtctacttttgcggcaatacacccagtttcggttcaaaaatcattaggggtcccgaagaccagactgtcctcctcgttaccgtgccagatttcagcgctacgcagacagcttgtttggttaatctcaggagccttgcgtgccagccaatttctttcagcggcttcggcgccgaagacgatgacttagggggtctgggcctggggccgtag

SEQ ID NO: 200034 - DNA, 447 bp, Artificial Sequence
  Description of Artificial Sequence: Synthetic coding sequence
atgttcagcgagcaggccgcccagcgggcccacaccctgctgagccccccctccgctaataacgccactttcgcaagagtgcccgtggcgacatatacgaactcctctcaaccattccgactcggcgagaggtccttcagtcgccagtatgcacatatatatgcaactcgactgatccagatgaggccgttcttagagaacagggcacaacagcactggggcagtggcgtgggggttaagaaattgtgtgagctccaacccgaggagaagtgttgcgtggttgggactctgtttaaagcaatgccactgcaaccctctattctcagggaagtgagcgaagagcataacttgctcccccaaccaccacggtccaaatatatccatccagatgacgaactagtcctggaagatgagcttcagaggatcaaactgaagggcacaatatag

SEQ ID NO: 200035 - DNA, 663 bp, Artificial Sequence
  Description of Artificial Sequence: Synthetic coding sequence
atgttcagcgagcaggccgcccagcgggcccacaccctgctgagccccccatcagccaacaatgcaacctttgcacgggtgccggttgcaacctacaccaacagctcacagcccttccgtcttggcgaacggtctttttctcggcagtatgcccacatctacgcgactcgactgatccaaatgcgccctttcctcgagaaccgcgcacagcagcattggggctctggagtgggagtgaagaagctgtgtgaattgcagcccgaggagaagtgctgtgtggttgggacactgtttaaggcaatgcctctccagccctctattctcagagaggtgtcagaagagcacaacctgctcccccagcctcccagatctaagtatatccatcccgacgacgagctagtgcttgaggacgagcttcagcgtatcaaattgaagggcactattgatgtctctaagctcgtgacaggaacggtgctggctgtatttggatcagtgcgggatgacggaaagtttttggtggaagactactgtttcgctgatctcgccccacaaaagccagccccaccgctggatacggatcgcttcgtgttgttggtctcaggacttggattgggcggaggcggcggcgagtccctgctaggcactcagctcctcgtcgattag

SEQ ID NO: 200036 - DNA, 1410 bp, Artificial Sequence
  Description of Artificial Sequence: Synthetic coding sequence
atgttcagcgagcaggccgcccagcgggcccacaccctgctgagccctccctccgccaacaatgcaacctttgctcgggttcctgtcgcgacatatactaatagtagccagcctttccggctgggagaacggagttttagtaggcagtacgcccacatttacgcaactaggttgattcagatgcgtccttttcttgagaaccgcgctcagcaacactgggggtctggagttggtgtgaaaaagctgtgcgaactgcaaccagaggagaaatgttgcgtggttgggaccctgttcaaagctatgcctctgcagccctcaatactcagagaggtttctgaggaacataatctccttccccagccccctagaagtaaatacatacatcctgatgatgaactggtgttagaggacgagctccagaggattaaactaaagggaactatcgacgtcagcaaactggtgaccggtaccgtgttggcggtgttcgggtctgtgcgagacgatgggaagttcctagtcgaagactattgcttcgctgacttagcccctcagaagcccgcgcccccgctcgacaccgaccgttttgtgctcttagttagcggccttggtctcggcggcggcggcggagagagtctgctcggcacacagctcctggtcgacgttgtcaccggtcaactgggcgacgagggagaacaatgtagcgctgcacatgtgagccgggtcatcttagcaggaaatttgctgagccattcgacccagtcgcgcgatagcatcaacaaagcaaagtatctgaccaagaagacacaggctgcttcagtagaggcagtcaagatgctcgatgagattctgttacagctctccgcatccgttcccgtggacgtgatgcccggtgaattcgaccccaccaattacaccttaccccagcagccacttcatccctgcatgttccctctggcaaccgcctactctactctgcagttagtcacgaacccttaccaggcaacaatcgacggggtccgcttcttagggaccagtggacagaacgtttccgatatttttcgctattccagcatggaggatcatttagagattcttgaatggacactccgcgtgaggcacatctccccgaccgctcctgacaccctgggttgctacccattctacaagaccgatccgtttatatttcctgagtgcccacacgtgtatttttgcggtaatactccttcttttggtagtaaaattatcagaggtcctgaagaccagacagtcctgctcgtgacagttcccgacttctctgcaacccagactgcatgtctcgtgaatcttagatccctggcttgtcaacccatctctttcagtggctttggcgccgaagacgatgacctgggtggccttggtctgggaccttag

SEQ ID NO: 200037 - DNA, 468 bp, Artificial Sequence
  Description of Artificial Sequence: Synthetic coding sequence
atgttcagcgagcaggccgcccagcgggcccacaccctgctgagcccccccagtgctaacaacgctacttttgctagggtccccgtggcaacttacaccaacagttcccagccctttagactgggtgagcggtcatttagtcggcaatacgcccacatctatgcgactaggctaatccaaatgagaccattcctggaaaaccgcgctcagcagcattggggctctggggtgggcgtgaagaagctgtgtgaacttcagccggaagagaagtgctgtgtcgtcggaactctgttcaaagccatgcctctgcaaccctctattttgagagaagtgagtgaggagcataatctgcttccacagccccctcggtccaaatacattcaccctgatgatgagctggtgctggaggacgagctccagcggataaagctgaagggcacaatcgatgtttcaaaattggttacgtag

SEQ ID NO: 200038 - DNA, 771 bp, Artificial Sequence
  Description of Artificial Sequence: Synthetic coding sequence
atgttccccgtgctgcccggcagccacctgctgctgaacaaccccgctctcgagttcattaaatatgtgtgcaaagttttgagcctggacaccaacataaccaatcaagtaaataagctgaaccgcgacctgcttcgtctcgttgacgtaggcgaattcagtgaggaggcccagtttagagacccctgtcggagttacgtccttccagaggtgatctgcaggtcttgcaacttttgccgagacctggacttgtgtaaggatagctcattctccgaggacggggccgtgttgccccagtggctgtgttcaaactgtcaagcaccatatgatagtagtgctattgagatgaccctggtagaggtgctccagaagaaactgatggctttcaccctgcaggatctgaaggaggctgacacacctaaatgcgaagaaaaggaaagacggaagcgtgagcttcacagtagcgccactggcagatcgtgtcggggggcgtcagaacaacgcctaggagatgccccttcctgcagagtagttgtgcatggtgttcaggcctgcagaatggaaggcgtctgtctgaaatgtcgcggagtgaaagagactagcatgcctgtttattgcagttgtgccggagatttcgctctgactatacacactcaggtgtttatggaacagatcgggatctttcgtaatattgctcagcactatggaatgtcctatctgctggaaaccctcgagtggttactgcagaagaatcctcaactcggacactag

SEQ ID NO: 200039 - DNA, 6861 bp, Artificial Sequence
  Description of Artificial Sequence: Synthetic coding sequence
atgagcctgcggagcggcggccggcggcgggccgaccccggcgccgacggcgaggcctctagggacgacggagctaccagttctgtgtccgctttgaaacgcctggaaaggtcccaatggactgacaaaatggacctgagattcggcttcgaacgactcaaggagcctggtgagaaaacaggatggcttattaatatgcacccaaccgaaattctcgatgaggataagaggttagggagcgccgtggactactacttcatccaggatgacggctccagatttaaagtcgctctgccttacaagccttacttctatatcgccacccgaaagggttgtgaacgtgaagtatcttctttcctcagcaagaagttccaggggaagattgccaaagttgagactgtaccaaaggaggatctcgatctgccaaatcaccttgtcggcctgaagcgcaactacatcagactctcctttcatactgtagaagacttggtcaaagtgcgcaaagagatatcaccagcggtcaaaaagaatcgagagcaggaccatgcttccgacgcttacaccgccctcctctcctcagtgttgcagcgggggggtgtgattactgatgaagaagagactagcaaaaaaatcgcagatcaactggacaatatcgtagatatgcgcgagtacgatgtcccataccatattcgattgagcattgacttgaaaatccatgtggcccactggtacaatgtgcggtatcgggggaatgctttccctgtcgaaatcaccaggcgggatgacctcgtggaacgccccgatcctgtggtgctggctttcgatatcgagacaacgaaattgccactcaaattcccagatgcagaaactgaccaaatcatgatgataagctatatgatcgacgggcagggttacctcatcacaaatagggagatcgtgtccgaggatatcgaggacttcgagttcacccctaagccagaatatgaggggccattctgcgtgttcaacgagccggatgaagcccatcttatccagaggtggttcgagcacgtccaggagactaaacccactattatggtcacctacaacggtgatttctttgactggccctttgtggaagcccgggccgccgtgcatggattgtccatgcaacaggaaattggattccaaaaagactctcagggagaatataaggcgccacaatgcatacatatggattgcctcaggtgggtgaaacgcgatagctacctgcccgtgggctcccataatctcaaagcggctgcaaaggccaagctaggctacgatcctgtggagctggatccagaggatatgtgtaggatggctaccgaacagccacagaccctggctacatacagcgtttctgacgccgtcgccacctattatctatacatgaaatatgtccatcccttcatctttgccctgtgtactataattccaatggagccagacgaagttttgcggaagggctccggcactctgtgtgaggcgctgctcatggtgcaagctttccatgccaacattattttccctaataagcaagagcaggagttcaacaaactgaccgatgacggtcacgtgctggactctgaaacctatgtgggtggtcacgtagaggccttagagtcaggagttttcaggtctgacatcccatgccgcttccggatgaacccagctgcatttgattttctgctacagcgagtggagaagaccctccgtcacgcactggaggaggaggagaaggtgcctgtggaacaagtcacgaatttcgaggaggtttgcgatgagataaaatcaaagctggcaagcctgaaggatgtaccctctcggattgagtgtcccctaatctatcatctcgacgttggagccatgtaccccaacatcatcctgacaaaccgcctgcagccctcagcaatggtggatgaggccacgtgcgccgcatgtgacttcaacaagcccggagcaaattgccagcgcaagatggcctggcagtggcgtggagagtttatgcccgcatctaggagtgagtaccaccgaattcagcaccagttggagtccgagaagttcccccccctcttccccgaagggccagctagagcatttcatgagctgtccagggaggagcaggcaaaatacgaaaaaaggagactggcggactattgtaggaaggcttataagaagatacacattacgaaggtcgaggagagactcactaccatctgccaacgcgagaattctttctatgtggataccgtacgagcatttagagacagaagatatgagttcaagggcctacacaaggtctggaagaagaagctctccgctgccgtggaagttggcgatgcggctgaagtgaagcgctgtaagaacatggaagtgctctacgacagtctccagctagcacataagtgcatccttaactccttctatggctatgtaatgaggaaaggagcccggtggtactctatggagatggccggcatcgtgtgcttcaccggggcaaacattataacgcaggccagagagctcattgagcagattggtaggccattggagctagacactgatggcatctggtgtgtgctgccaaactccttccctgaaaattttgtgttcaagacgacaaacgtcaaaaaacccaaggttacgatatcgtaccccggggctatgcttaacatcatggtgaaggagggtttcaccaatgaccagtaccaggaattggcggaaccctcctcgctcacttacgtcactagaagcgagaattctatatttttcgaggtcgacggaccctacctagccatgatcctcccggcatcaaaggaggagggaaaaaagctcaagaagcggtatgccgttttcaacgaagatggttctctggctgagctgaaggggtttgaggtgaaaagacggggtgagcttcagttaatcaagatctttcagagcagtgtctttgaagccttcctgaagggaagtacactggaggaggtttacggcagcgtcgccaaggtagccgactactggctggacgtgctctactctaaagcggccaacatgccagactccgaactctttgagcttataagcgaaaacaggtccatgagccgaaagctggaggactatggagaacagaagtccactagcatcagcactgctaaacgcttggcagagttcctcggagatcaaatggtgaaggacgccgggctctcctgccggtacatcatctctaggaagcctgaaggcagtcctgtaacagagcgagctatcccactggcaattttccaggccgagcccacagtgcggaagcacttcttgcgtaaatggttgaaatcttcatcgcttcaggacttcgacatccgcgctatcctcgactgggattattatattgagagactgggcagcgccattcaaaagataatcacaatccccgcagctctccaacaggtgaagaatccggtgccccgtgttaaacaccctgactggcttcacaagaagctgttagagaagaatgacgtgtacaaacagaagaaaattagcgagttgttcaccctcgaaggtcgcaggcaagttaccatggccgaggcctcagaggattcccccaggccgtcagccccagacatggaagattttggcctggtgaagttgcctcaccccgccgccccagtgaccgtgaagcgaaagcgtgttttgtgggagagccaggaggaatcccaggaccttacacccaccgtaccctggcaggaaattctggggcaacccccagccttgggcacttcccaggaagaatggctggtttggctgaggttccacaaaaaaaagtggcagctacaggctcggcaacgactcgcacgacgcaagagacagagactggagtctgccgagggagtacttcgtccgggtgctattcgcgacggccccgcaacgggcttggggtcatttcttaggcgtaccgctcggtctatccttgaccttccttggcagattgtgcagatttcagagacctcccaagcgggactattccggctgtgggctctggtggggagtgatctacattgtataaggctttctattcctcgggtcttctacgttaaccagagagtggctaaggctgaggaaggggcttcgtatcgaaaggttaaccgcgtactgccgcgcagtaacatggtatataatctttatgaatatagcgttcctgaagacatgtaccaagaacatatcaatgagataaatgcggagctctctgcgcctgatatcgaaggtgtctatgaaacccaagtgccgctgctgtttcgggccctcgttcacctgggatgcgtgtgcgtcgtaaataagcagcttgttcgacacctctcagggtgggaggccgagactttcgccctggaacacttggagatgagaagcttggcccagttctcctacctagaacccggcagtatccgccatatttacttgtaccaccatgcacaggcccataaggctttgttcggcatttttatcccaagccagcgacgggccagcgtatttgtcctagatacggtccgaagtaatcagatgccatcgctgggcgccctttattccgctgagcacggtttgctgttggaaaaagttggaccagaactgctgccgcccccgaagcatacctttgaagtcagggccgagactgatctcaaaacgatctgtagggccatccagagattcttgctggcttataaggaggaacgaagaggcccaacactgattgccgtccaaagctcttgggagcttaagagactggcgtcagaaattccagtcttagaggagttccctcttgtgccaatatgtgttgcagacaagataaattacggggtactggactggcagcggcatggggcccgccgaatgatccggcattacttaaatctagacacatgtctgtcccaggcattcgagatgtcccgctattttcatattcctattggcaatctcccagaggacatcagtacattcggttccgatctttttttcgcgcgacatcttcagaggcataatcaccttctatggttgagtccaaccgctagacctgacttgggtggcaaagaagctgatgacaactgtctggtgatggagttcgatgaccaggctacagtcgagattaactcatcaggatgctatagcaccgtctgtgtggagctcgacctgcagaatctggccgtgaacactattctgcagagtcaccatgtgaatgacatggagggcgcagattctatgggtatttcttttgacgtgattcagcaagcatcgctcgaagacatgattaccggtggacaggcagcctctgctcccgcttcttacgacgagacagcactgtgcagtaatactttccggatcctgaaatcaatggtggttggctgggtaaaagagattacacagtaccacaacatttatgccgataaccaggtgatgcatttttacagatggctgaggtctcctagcagtttactgcatgaccccgcgcttcatcgaacactccacaacatgatgaagaaactgtttcttcagctaattgccgaattcaagaggctgggcagttctgtgatttatgccaattttaatcggattattctatgcaccaagaagagacgggtggaggatgccattgcatacgtggagtatatcacaagctcgattcactccaaagagactttccactctttgacgattagcttttctcgctgctgggaatttctgctgtggatggatccctcaaattacggcggaatcaaaggtaaggtgtcctcaaggatccactgtgggctccaagactcgcagaaagcaggaggagccgaagacgaacaagagaatgaggacgacgaggaagaacgagacggagaggaggaggaagaagctgaggagagcaacgtggaagatttactggaaaacaactggaatatcttgcagtttcttccacaggccgcctcctgccagaattatttcctgatgatcgtcagtgcctatatcgtggcagtttaccactgtatgaaagacggcctgcgcaggtcggccccaggctcgactcccgtaaggcgccgtggtgctagccagctgtctcaggaggcagaaggggcagttggagcactgccaggaatgataacctttagtcaggattacgtagcgaatgagctgacccaaagctttttcaccattactcagaagatacagaaaaaagtaacaggttccaggaatagcacagaactatccgaaatgtttccagtgcttcctgggagccacctgctcctcaacaacccggctctggagttcattaagtacgtctgcaaagtgctaagcttggataccaacattacgaaccaggttaacaaattaaatcgcgatctgttgcggttagtagatgtgggagagttctctgaggaggcacagtttcgagacccctgcagatcgtatgtcctgccagaagtcatctgccggtcgtgcaacttctgtagggaccttgacctgtgcaaagactccagttttagcgaggatggtgccgtgctgccccagtggctgtgtagtaattgccaggcaccgtacgacagtagcgccattgagatgacattagttgaggtgctgcagaagaaactcatggccttcacactccaggacttagtgtgtctgaaatgtagaggagtgaaagagaccagtatgccagtgtattgttcgtgtgcgggtgacttcgcactaaccatacatacccaggtgttcatggagcaaataggtatattccgtaatatcgctcagcattacggcatgagttatctcctggaaaccctggagtggctcttgcagaaaaatccacagttaggccattag

SEQ ID NO: 200040 - DNA, 3330 bp, Artificial Sequence
  Description of Artificial Sequence: Synthetic coding sequence
atgcaccccaccgagatcctggacgaggacaagcggctgggcagcgcggtggattactatttcatccaggacgacggaagccgtttcaaagtggccctgccctacaaaccctacttctacatcgccacgcggaagggatgtgaacgcgaggttagcagttttctgtctaagaagttccagggcaagatagcaaaggtcgaaacagtgcccaaggaagacctggacctaccaaatcatctcgtcggcttaaaacggaactatattcgcctgtcttttcacaccgtggaggatctcgttaaggttcgcaaagaaatctccccagcggttaaaaagaatcgcgaacaggaccatgccagcgacgcctacaccgcacttttatcttccgtcctgcagcgggggggcgtcatcacggatgaggaagagacatcaaagaaaatcgcggaccagttggataacattgtagacatgcgcgagtatgacgtcccctatcatattcgcttaagcatcgacttaaaaattcacgttgcccactggtacaatgtcagatatcggggtaatgcctttcctgtcgaaatcacacggcgcgatgaccttgtagaacgcccagaccccgtcgtcctggcattcgacattgagactaccaaattgcctcttaagtttcctgatgcggaaactgatcagatcatgatgatttcatacatgatagatgggcagggatatctgatcaccaacagggaaattgtatcagaggacatcgaagactttgagtttaccccaaaacccgaatacgaaggcccattttgcgtgtttaacgagccggacgaggcccaccttatccagcggtggttcgaacacgtccaggaaacaaagcctaccattatggtgacttataacggtgactttttcgactggccttttgtcgaggctcgggctgccgtccatgggctgtccatgcagcaggagatcggcttccagaaggacagccaaggagaatataaggctccacagtgcatccacatggattgtctaagatgggttaagcgagactcttacttgcccgtgggatcccataatctgaaagctgccgcgaaggccaaactggggtacgatccagtagaattggaccccgaagatatgtgtagaatggccactgagcagccccagaccctagcgacgtacagtgtgtccgacgccgttgccacatattacttgtacatgaagtacgtgcacccttttattttcgcactgtgcactatcattcccatggaacccgacgaggtccttcgaaaggggagcggcaccctatgtgaggccctcctcatggtgcaggcattccacgcgaatatcatatttccgaataaacaggaacaggagttcaataaattgactgatgacggccacgtcttagattccgagacctacgtgggaggccacgtagaagcactagagagtggcgtgtttcggtcagatatcccctgccggttccgaatgaaccctgcagcattcgacttcttactgcagcgggtggaaaagacattgcgacatgccttagaagaggaagagaaggtccccgtggagcaggtgacaaattttgaggaggtatgtgacgaaattaagagcaagttggcctctctgaaagacgtccccagccgcatagaatgtcccttgatataccaccttgacgtaggcgccatgtatcctaacatcatcctcacaaatagactccagccttccgcgatggtagacgaagctacatgtgctgcttgcgactttaacaaaccgggcgccaactgtcagcgtaagatggcgtggcagtggcgtggagaatttatgccggcctctcgcagtgagtaccacaggattcagcaccaactcgagtccgaaaaatttccgccactcttcccagagggccctgcccgggcctttcacgaattgtccagagaagagcaggcgaagtacgaaaaaagaagactcgctgattactgccgcaaggcctacaagaagattcatatcacaaaggtcgaagaacgtttgacaacaatttgccagcgcgaaaactccttctacgtcgatacagtgcgtgctttcagggacaggagatatgaatttaaagggctacataaggtgtggaaaaagaaactgtcagctgcggttgaagtgggggatgccgccgaggttaaacggtgcaagaacatggaggttctgtacgattccttacagttggcccataagtgcatcttgaactccttctacggctacgttatgaggaaaggcgctagatggtacagcatggagatggcaggcatagtgtgtttcactggggcgaacatcattacacaggctcgcgaactaatcgagcagatcggacgtccactcgagctggatacagatggcatctggtgtgtgcttcccaactcattcccagagaattttgtctttaagactacaaacgtgaaaaaacctaaggttaccatctcttatccaggagcgatgctgaacatcatggtgaaagaggggtttactaacgaccaatatcaggaacttgctgagccaagttcactgacttatgtgactagatctgaaaattcaattttttttgaagtcgacgggccttacttagctatgatattgcccgcttccaaagaagaaggcaaaaagctgaaaaagcgttacgccgtgttcaacgaagacggtagtctggccgagctgaagggcttcgaagtgaaacgacggggagagctgcaactgatcaagatatttcagagctccgtctttgaagcattcctcaagggttcaacccttgaggaggtgtacggctccgtggcaaaagtcgccgactattggttggatgttttatactcgaaagcagccaacatgccggattcagaactgttcgaattgatttctgaaaatagatcaatgtcccgaaaattggaagactacggggagcagaagagcacatctatctctactgccaagcgcttggcagagttccttggcgaccagatggtgaaggatgctggcctgagttgccggtacatcatcagccgcaagcctgaaggatctcccgttactgagcgtgcaatacccttggccatctttcaggcggagccaaccgtccgcaaacattttttgagaaaatggctgaaaagctcatccctgcaggatttcgatattcgggcaatcctcgattgggactattatatcgagcgcctgggcagtgctatccagaaaattattacaataccagccgcactacagcaggtgaaaaacccagtgccccgtgtgaagcaccccgattggctgcacaagaccgctggcgaggaatag

SEQ ID NO: 200041 - DNA, 1491 bp, Artificial Sequence
  Description of Artificial Sequence: Synthetic coding sequence
atggagggcatcctgaagagcatggtggtgggctgggtgaaggagattacccaatatcacaacatttacgccgacaatcaggtgatgcacttttaccgctggctcagatctccgtccagtctcctgcacgacccagccctccaccgcacactacacaacatgatgaagaagttgtttctgcagttgattgctgagttcaaaaggcttggatcatctgttatatatgcgaattttaaccggatcatcctctgtactaagaaacgaagggtggaagacgcgatcgcatacgtggaatacatcacaagttcaatacactcaaaagagacattccatagcctgacaattagcttcagccgctgctgggaatttcttttgtggatggacccttcaaactacggcggaatcaagggcaaagtctcctctaggatacactgcggcctccaggattctcagaaggctggaggtgccgaggacgagcaggaaaacgaagacgacgaggaggaaagggatggagaggaggaagaagaagcagaggaatccaacgttgaagatcttctggaaaataattggaacatcctgcaattcctaccacaagccgcctcctgccagaattattttctcatgattgtgagcgcatacattgtggccgtgtatcactgcatgaaggacggcttgagacgatctgcccctgggagtactccagttcgaaggaggggcgcttcccaactttctcaagaggcagagggggcggtcggtgcattacctgggatgattacatttagccaggactacgtcgctaatgaacttacacaatctttcttcacaatcactcaaaagatccagaaaaaagttaccggctcccggaacagcactgagctgtccgaaatgttccccgtgctgccaggctcccatctcctgctcaacaatcctgcattggagtttataaagtatgtgtgcaaggtactctccctcgatacaaatatcaccaatcaggtgaataaactcaaccgcgatctcctacgcctagttgatgtgggggagtttagcgaggaagcacagtttcgagacccgtgcagatcgtacgtactgcccgaggtgatctgccgtagctgtaatttctgtagagatctggatctgtgcaaggattcctccttcagcgaagacggcgcagtgctgccgcaatggctatgcagcaactgccaggcaccgtatgactcttctgccattgaaatgaccctggtcgaagtactgcaaaaaaagcttatggccttcactctacaggacctggtctgcttgaagtgccgaggcgtcaaagagacctccatgccagtatactgtagttgcgctggagattttgccctgaccatacatacacaggtgtttatggaacagatcggtatcttcaggaatattgcccaacattacggcatgagctacctgttggaaaccctggagtggctactgcagaagaacccacagctgggccattag

SEQ ID NO: 200042 - DNA, 6894 bp, Artificial Sequence
  Description of Artificial Sequence: Synthetic coding sequence
atgagccggcccctgggcctgaagagcttcccccggcacaagcaggccccattgccccttagcctaacattccacggctgcctgcttctccgaagagacgatggcgcaacaagcagcgtttcggccttaaagaggctggagcgctcgcaatggacagacaaaatggacctgcggttcggcttcgagaggctcaaggagccaggcgagaagaccgggtggctcattaacatgcatcccaccgaaattctggatgaggacaaacgcctaggttccgccgttgattactattttatccaggacgatggtagccgcttcaaagtcgctctgccatacaagccatatttctatattgcaacccgcaagggatgcgaaagagaagtgtctagttttttatcaaagaagtttcagggtaagatcgccaaggttgaaaccgtgcccaaggaagacctcgatctgcccaatcatcttgtaggcctgaaaaggaactacatccgcctctctttccacaccgttgaggatttggtgaaagtaagaaaggagatttccccagccgttaagaaaaatcgtgaacaagatcatgcctccgacgcctacactgctctgcttagctctgtgctccagcggggaggagtgatcactgatgaagaggagacatccaagaagattgcagatcagctggacaacattgtggatatgagagagtacgacgtgccatatcacatccgcctgtcaattgatctaaaaattcacgttgcccattggtacaatgttagataccgaggcaatgcgtttccagtagagattacccggagagatgatctagtggaacgacccgaccctgtggtgttggcattcgacatagaaaccacaaagctcccccttaagtttccggatgcagagaccgatcaaataatgatgatttcttacatgatagatggccaggggtacctcatcacgaacagggaaattgtatccgaggacatcgaagatttcgaatttacccctaaacctgaatacgaagggcctttttgtgtgttcaatgaacccgacgaagcacacttgattcagagatggttcgagcacgtgcaggaaacaaagcccaccatcatggtgacctacaatggtgatttcttcgattggccattcgtcgaagccagggctgccgtgcacggtttaagtatgcagcaagagatcgggttccaaaaagattctcagggcgagtataaggccccacagtgcattcacatggattgcctccgctgggtcaagagggactcttatttgccagtcggtagtcataatctgaaagccgctgccaaggctaaactggggtacgatccagtcgaacttgaccccgaggatatgtgtcggatggcaaccgagcagcctcagaccctggcaacctatagtgtgagtgatgcagttgcgacttactacctgtatatgaaatatgtgcacccttttatcttcgctttgtgtacaatcattcctatggagcccgatgaagtgctgaggaaaggtagtggcaccctctgcgaagcccttctgatggtgcaggccttccacgctaacatcatcttccccaacaaacaggaacaggagtttaataaactgacagatgatggccacgtgctagatagcgagacctatgtaggcggtcacgtcgaagccttggagtcaggcgtattccggtccgacatcccctgccggttccggatgaacccagccgccttcgactttcttctgcagagagtggaaaaaacactccggcatgctctggaagaagaggaaaaggtccctgtggagcaagtgaccaatttcgaagaggtgtgcgatgaaattaagtccaagcttgcgtccttaaaggacgtgccgtccaggatcgaatgccctctgatatatcacctggacgtgggagctatgtatccaaatattattttgactaacagacttcaaccgtcggctatggtcgacgaggcgacatgcgccgcgtgcgactttaacaagcccggggcgaactgccaaaggaagatggcctggcagtggcgaggagaatttatgccggcgagccgctccgagtatcacaggatacagcatcaactagagtccgagaaatttcctcccctatttcccgaaggccccgcacgagccttccacgaactgtccagagaagagcaagctaaatacgaaaagcgcagactggccgattactgcagaaaggcatataaaaaaattcacattacaaaagtggaagaacgcctgaccactatctgtcaacgagagaatagtttttacgtggacacagtgcgagcctttagagatcgtcggtacgagtttaagggcctccacaaggtatggaaaaaaaagctgagcgctgccgtggaggtaggcgacgcagctgaggtgaaacgctgcaaaaatatggaggtgctttatgatagtctgcagcttgcacacaaatgcatcttaaattctttttatggttacgtgatgagaaaaggagctcggtggtattccatggagatggcaggcattgtgtgctttaccggggctaacataattacacaagcccgtgagttgattgaacagattggaaggccactggagctggacaccgatggcatctggtgtgtactgcccaactctttcccagaaaattttgtttttaaaacaaccaacgtcaagaaacccaaggtgacaatctcctaccccggcgcaatgttaaacatcatggtgaaagaagggttcacaaatgaccaatatcaagagctggccgagccctcaagcctgacctacgtcaccaggtccgagaatagtatcttcttcgaagtggatggaccttatctggccatgatcctgccagcctctaaggaggagggcaagaaacttaaaaagagatatgctgtctttaatgaggatgggagcttggcagagctgaagggcttcgaggttaaacgtcgtggagaactgcagctgataaaaatctttcaatcctccgtcttcgaggcatttctcaaaggtagtacactggaggaggtctacggcagtgtggccaaggtggccgactactggctggacgtactttactcaaaagccgctaacatgcctgacagcgaactgtttgaactgatctctgaaaataggtccatgtcccggaaactggaggattacggcgaacagaaaagtacatccatcagcaccgcaaaaagactcgccgagttcttaggcgaccagatggtgaaagatgccggactgagctgtagatacatcatctcccgtaagcctgagggatcacccgttactgaaagagcaatacccttagccatcttccaagcagaacctacagtgaggaagcatttcctgaggaagtggctgaaatcatcttcccttcaggatttcgacattcgtgcaatccttgactgggattattatatcgagcgcctgggttcagccatacaaaagattataactatccctgctgctttacagcaggtcaaaaaccctgttcccagggtaaagcacccagactggctgcataagaagttgctggaaaagaacgatgtttataaacaaaagaaaatttctgagttgttcaccctggagggccgtcgccaggtaactatggccgaggcaagtgaggactcaccccgtccttctgcacccgatatggaggactttggtctggttaagctacctcatcccgctgcccctgtgacggtcaagagaaagcgggtactttgggagagccaggaagagagtcaggatttgaccccaaccgtgccatggcaagagatcctgggtcagcctccggctttaggcacctcacaggaagagtggttggtgtggcttcggttccataaaaagaagtggcagttgcaagcaaggcaacgattagcccggcgcaaacggcagcgattggagtctgctgagggggtgctacgcccgggcgcaattcgcgatgggcctgcaactggactgggcagctttctaaggcgtaccgcacgctctatcctggatctgccatggcagattgtacaaatctctgaaacttcccaggctgggctgttcagattgtgggccctagtgggaagtgacctgcattgcatcagactgtccataccaagagtcttttacgtaaaccagcgggttgccaaagcagaagagggcgcctcctaccggaaagttaacagagtccttccaagaagcaatatggtgtacaacctgtacgagtactccgtgccagaagatatgtaccaggagcacataaacgagatcaacgctgagctctccgcgcccgacattgaaggagtgtatgaaacccaggtgccactgctttttagggcactggtgcatctcggctgcgtttgtgtagttaacaaacagctggtgaggcatctgagtgggtgggaggccgaaacctttgctttggagcatttggagatgcgctcattggcccagttttcttatctggaacctggctccatacgccatatttatctctaccatcacgcgcaggcgcataaagcattattcggaatcttcattccgtcgcagcgaagagcttctgtgtttgtgctcgacacagtgcgctcaaaccagatgccgtcattaggcgcgctatatagcgcggaacacggccttctcctcgagaaagtgggccctgaactgctgcccccaccaaagcacaccttcgaagtacgcgcggagaccgacttgaagactatttgccgggcaatccagagattcttgctggcctataaagaagaacgccggggacctacactgatcgctgtgcagagttcctgggagcttaagcggctggcctctgaaattccagtgcttgaggaattccctctagttcctatttgtgtagctgataagattaactacggggtcctggattggcagaggcacggagctcgccgcatgatccgccactaccttaatctggacacctgcctctcccaagcattcgaaatgagcagatatttccacataccaataggaaatctgcccgaggatatttccacttttgggtccgacctcttttttgcaagacacctccagcggcataatcatctgctgtggctcagccctaccgccagacccgatctgggaggaaaggaagcagatgacaattgtctagttatggagtttgacgaccaggcgacagtggaaataaactcttccgggtgttacagcacagtttgtgtcgagctggatctgcagaatttggctgtcaacacaatattacagtcacaccacgtcaatgatatggaaggcgcagacagtatgggcatctcattcgacgtgatacagcaggccagcctagaggacatgatcactggagggcaggcagcatccgcccccgccagttatgacgagaccgccttgtgctcgaacacattcaggatactgaaatcaatggtagtgggttgggtcaaagaaattacacagtatcataacatttatgcagacaatcaggtgatgcatttttaccggtggctgagatcaccttccagtctgctgcacgatcctgcactacaccggaccctgcacaatatgatgaaaaagctattcttgcaactgattgccgagttcaagcggttggggtcttccgtgatctatgctaattttaacaggattattttgtgcactaagaaaagacgggtggaagacgcaattgcttacgtagaatatataacgtcttcgatacattcaaaggagacattccactctttaacaatcagcttttctcgatgttgggagttcctgctgtggatggatcccagcaactacggcggtattaagggtaaagtgtcatcccggattcactgtggactgcaggactctcaaaaagccggcggggcagaggatgagcaagaaaatgaggatgatgaagaggagcgggacggagaggaagaggaggaagccgaagaaagtaacgtggaagatctgctggagaacaactggaacattctgcagttcctccctcaggctgcctcatgtcagaactattttctaatgattgtgtctgcgtacatcgtggcagtgtaccattgtatgaaagacgggctgcggaggtctgcccccgggagtacccccgttagacggagaggcgcatcccaattgtcccaagaggccgagggtgcagtgggagcgctgcccgggatgatcactttcagccaggattatgtcgccaatgagctgacccagtcatttttcacaatcacacagaagatccaaaagaaggtcactggctcccggaactctactgaactgtctgaaatgttccctgtcctgcctgggagtcacctacttctaaacaacccagcactcgagtttatcaaatatgtgtgcaaagttttgtctctagacactaacattaccaaccaggtcaacaagttgaacagggatcttctgcgtttggttgatgtcggagagttctcggaggaagcccagttcagggatccatgccggagttacgttcttccagaggtgatatgccgctcttgcaacttctgtagagatctggatctctgtaaggattcctcttttagcgaggatggagcagtccttccccagtggctgtgctcaaactgtcaggctccgtatgactctagtgccatagagatgacgttagtggaagtgttacagaagaagctcatggcttttaccctccaagacttagtctgtcttaaatgtagaggggttaaggagacctcgatgcctgtctactgctcttgtgctggcgatttcgctctaaccattcacacgcaggtgtttatggaacagattggcatatttagaaacattgctcagcactacggcatgtcttacctgctggaaacgttagaatggttactccagaaaaaccctcaactaggccactag

SEQ ID NO: 200043 - DNA, 6780 bp, Artificial Sequence
  Description of Artificial Sequence: Synthetic coding sequence
atgagcctgcggagcggcggccggcggcgggccgaccccggcgccgatggcgaggcttccagggacgacggcgcaactagcagtgtctcagctttgaagcggctggagcgtagtcagtggactgataaaatggacctccggtttggcttcgagaggctcaaggagccaggcgagaaaacaggctggttgatcaacatgcacccagtggcgctcccttacaagccgtacttctatatcgcaacccgcaagggctgcgagcgggaggtgtccagttttctgtccaagaagttccaaggcaaaattgcgaaggtggagaccgtgcccaaggaggacttggatctgcccaaccacttggttggactgaaacgcaactatattcgattgagttttcatacagtagaggatctcgtgaaagtaagaaaagaaatatccccagctgtaaaaaaaaaccgcgagcaagaccacgcctccgacgcatacacagctctgcttagcagcgtccttcaacgcggcggcgtcatcactgatgaggaagaaactagcaagaaaattgctgaccagctggataacattgtggatatgcgggaatatgatgtaccataccatattagactcagcatcgatcttaagatccacgtggcccactggtacaacgttcggtacagaggaaacgccttccctgttgaaatcacccggcgtgacgacttggtagagagacctgatcccgttgtgctcgccttcgacattgaaacaaccaagctgcctctgaaattcccagatgcggaaaccgatcagataatgatgatcagctatatgatcgatggccagggttacttgatcactaacagagagatagttagtgaggacatcgaagacttcgagtttaccccaaagcctgaatatgagggtcccttttgcgtattcaacgaacctgacgaagctcatctaattcagagatggtttgaacacgtgcaggagaccaaacccactataatggtgacatacaacggcgacttttttgattggccttttgtagaggctcgtgccgctgtgcacggcttatccatgcagcaggagattggcttccagaaagactctcagggcgaatacaaagcgccgcagtgtattcatatggattgtttaaggtgggtgaagcgggatagctaccttccagtaggttcccataacttgaaagcagccgcgaaggccaagttggggtacgatcctgtggagctggaccccgaagatatgtgccgaatggcaactgaacaaccccaaaccctcgccacgtacagcgtctccgacgccgtagcgacgtactacttgtatatgaagtatgtacaccctttcatttttgcgctttgtaccatcattcctatggagccagatgaagtccttcgcaagggttctgggacactgtgtgaagccttgttgatggttcaggcattccacgcgaacattatctttccgaataagcaggaacaggagtttaacaagctcactgacgatggccatgtgctggattcagagacctacgtgggcggccatgtagaggctcttgaatctggcgtctttaggtccgacattccctgtagattcaggatgaaccccgccgcttttgacttcctcctgcagcgcgtggaaaaaacgctgaggcatgcccttgaggaggaggagaaggtgcccgtagaacaagtgactaattttgaagaagtgtgcgacgaaatcaaatcgaaactggcatctctgaaggatgtcccatcgcgaatcgagtgccctctgatatatcacctcgatgtaggtgccatgtacccaaacataatcctgactaacagacttcaacccagcgcaatggtcgacgaggcgacctgcgcggcttgcgattttaacaagccaggagccaattgccaaaggaagatggcctggcaatggcgcggagagttcatgccagcatctcgctccgagtaccacaggattcagcatcagttggaatcggaaaagtttcccccactgttccctgagggccccgcccgtgccttccatgaactgagtagggaggagcaggctaaatatgagaagcgtcgtctggccgactattgccgcaaggcgtacaaaaagatacacataacaaaggtggaagagcgcctgacaacaatctgccagcgggagaatagtttttatgtggacaccgtgagagccttccgcgaccgccgctatgaatttaaaggcctccacaaagtctggaaaaaaaaactgtccgccgctgtggaagtgggcgatgcagcagaggtgaaacggtgtaagaacatggaggtgctgtacgatagcctccagctcgcccataaatgcattttgaattctttttatggctatgtaatgcggaaaggcgctcggtggtacagcatggagatggccggtatcgtgtgcttcaccggggccaacataatcacccaggcacgtgagctgatcgaacaaattggaagaccactggagttggacactgacgggatttggtgtgtgcttcccaattcatttcccgaaaactttgtctttaaaacaacaaatgtaaaaaagcccaaagttacaatttcatacccgggcgccatgctgaatattatggttaaggagggtttcaccaacgaccaatatcaggagctagccgaaccctcgtccttgacttatgttactagatctgagaattctatcttcttcgaggtagacgggccatacttggctatgatcctgccagcatccaaggaggagggtaagaaactaaagaagcggtacgccgtgttcaacgaggatgggagcctcgcggagttgaagggcttcgaggttaagcgaaggggcgaactgcagctgattaagatcttccagtcctctgtcttcgaggcgtttctgaaggggtctacactagaggaggtctatggctccgtcgccaaggtggcagactactggctagacgtcctatatagtaaggcagcaaacatgccggactctgagctattcgaactcattagcgagaatcgatcaatgagcagaaaactcgaagattacggggagcaaaagagtactagcatttcaactgcgaaaagactggccgagttcttgggggaccaaatggtgaaagacgccggtctatcctgccgctacatcatttcccgcaagccagaaggcagccctgttaccgaacgggccatcccactggcaatctttcaggccgagcctaccgtgcgaaagcatttcctcaggaaatggctgaagtctagctccctgcaggatttcgatatccgcgctatcctggactgggattactacatcgagcgcttggggagcgctattcagaagatcataactattcccgctgccctccagcaggtgaaaaaccccgtccccagagtgaaacacccggactggctccacaaaaaactcctggaaaagaatgacgtgtacaaacagaagaagatcagtgaactttttaccttggagggacgccggcaggtcaccatggccgaggcaagcgaagactctccccgcccatccgcaccagacatggaggactttggtctagtgaagttgccgcatcccgccgcacctgttacagtgaagagaaagagagttctgtgggaatctcaagaggaaagccaagacttgacaccaaccgtgccctggcaagagattctcggccagccacctgccctaggaacttcccaggaggagtggcttgtctggctccggttccataagaagaagtggcagttgcaggcacggcagagattagcgagacgcaagaggcagcggcttgagagcgccgaaggagttctccgccccggcgcaattagggatggccccgccaccggcttggggagttttcttcggcgcaccgctaggtctattctcgatctgccgtggcagatagtgcagatctctgagacgagccaagctggcctctttcgcctgtgggcactggtaggtagtgacttgcactgcatcaggctgtcaatcccgagagtgttctatgtgaaccagagagtggctaaggctgaggagggagcctcgtatcgcaaagttaatcgggtgttaccaagaagcaatatggtctacaatctgtatgagtactctgttccagaagacatgtatcaggaacatattaatgaaatcaatgccgagctgagtgcgcctgatatagagggagtttatgaaacccaggtaccattattattccgggcattggttcacttaggctgtgtgtgtgtggttaacaaacagctcgtgcgccacttgagcgggtgggaagcggagacattcgcactggaacacttagagatgcgtagcctagctcagttctcatatcttgagcctggcagcatacggcatatctatctgtatcatcatgcccaggctcacaaggcacttttcggcatcttcattcccagccaacgtagagcctccgtgttcgtcttagataccgtgcggagtaaccagatgccctctcttggcgccctgtacagtgctgagcatggacttctgctggaaaaggttggaccagaactgcttcctcccccaaagcatacattcgaggtgcgggcagagactgatctcaaaaccatctgccgtgccattcagagatttttgcttgcttacaaggaggagcgccgaggccccaccttgattgctgtacagagttcatgggagttgaagcgcctggccagtgagatcccggtgctggaggagtttccactggtgcctatctgcgtggccgacaagatcaattacggcgtactcgattggcagcgtcacggcgcccgaagaatgattaggcattacctaaatctcgatacttgcttaagccaggccttcgagatgtcccgctacttccatattcctatcgggaaccttcccgaagacatctcaactttcggaagcgacctgttcttcgcccgacatttacagagacacaatcacttactttggttgagcccgacagcccgacccgatcttggtgggaaagaggctgatgacaattgtttagtcatggaatttgacgaccaggcgactgtagagataaattccagcgggtgttattcaaccgtgtgcgttgagcttgacctccaaaacctggccgtgaacactatccttcagagtcaccatgtgaacgacatggaaggcgctgattcaatgggaatcagtttcgatgtgatccaacaggctagcttggaagacatgatcaccggaggccaggcagcctcagcgcccgcatcgtatgatgagaccgcattgtgttcaaatacatttagaatactcaagtctatggttgtgggatgggtcaaggagattacccagtaccataatatctatgccgacaatcaggtgatgcacttttaccgctggctcagaagtcccagctccctgcttcatgatcccgcattgcatagaacactccacaatatgatgaagaagttgtttctccaactaatcgctgagttcaaaaggttgggatcaagcgtgatatacgctaactttaaccgcatcatcctttgcaccaaaaagcggcgtgtggaagatgccatagcctatgtggagtatattacttcttccattcattcaaaagagacttttcattcattgacaatcagctttagtaggtgctgggaatttctgctgtggatggacccatcaaattatggcgggatcaaaggcaaagtctcgtcacggattcattgtggactgcaggattcccagaaggcgggtggcgccgaagatgagcaagagaatgaagacgacgaagaggagagggacggcgaagaagaagaagaggctgaggagagcaatgtggaggacctccttgaaaacaactggaacatcctgcagtttttgccccaggctgcttcttgtcagaactactttcttatgatcgttagcgcctacatagttgctgtgtaccattgcatgaaagacgggctcaggaggtcggcacctggatcaaccccagtcaggaggcgcggggccagtcagttgtcccaggaagctgaaggtgccgttggcgctcttcctggtatgatcacattcagccaggactacgttgcgaatgaactcacacagagcttctttaccataacccaaaaaatccagaagaaggtgaccggaagccgtaactcaacagaactttcagaaatgtttcccgtacttcccggaagtcatcttttgctgaacaatcccgccttggaatttatcaagtatgtgtgcaaggtgctgagtctggatacaaacattaccaatcaggtcaataaactcaacagggaccttttaagactggtggatgtgggggagttctccgaagaagcccagttcagggatccttgcaggtcctacgtgctgcccgaggttatttgtaggtcctgcaatttctgtagagaccttgatctgtgcaaggatagtagctttagtgaagatggtgccgtcttgccccagtggctctgttcaaattgccaggccccctacgattcatccgcgatcgagatgacccttgtggaggtcctacagaagaaactgatggcatttacgctgcaggatcttgtctgtctgaagtgtcgcggagttaaggaaacctccatgcccgtttattgcagctgcgccggggattttgccttgactattcacactcaggtgtttatggagcagattggcatattccgcaacatcgctcagcactacggaatgtcgtatctccttgaaacattggagtggctcctgcagaaaaatccacagctggggcattag

SEQ ID NO: 200044 - DNA, 480 bp, Artificial Sequence
  Description of Artificial Sequence: Synthetic coding sequence
atgatcaagttcttcctgatggtgaacaagcagggccagacccggctttctaagtactacgaacacgtagacatcaacaagagaaccctgctggagaccgaggtgattaaatcctgcttatctcgatccaacgaacagtgctcctttatcgagtataaggatttcaaactgatctaccggcagtatgctgccctcttcattgttgtgggtgtaaacgacactgagaatgaaatggccatttacgagttcattcataactttgtggaagtgctggatgagtatttttccagagtgtccgagctggacgtgtccttttttaacactgtattccattctacctggcagatgcattctggaccctaccaggagcccattgatgaactccccaaaatctgttcggccttggagccacagcagacctgtttctcccctgactccagcagcttcaagggggctgccagcaccacaccaatttattag

SEQ ID NO: 200045 - DNA, 1506 bp, Artificial Sequence
  Description of Artificial Sequence: Synthetic coding sequence
atggcccccgagcggctgcggagccgggccctgagcgccttcaagctgaggggcttgctgctcagaggcgaagcaatcaaatacctgacagaggcattacagtctatatcagagttagaactggaggacaagctggaaaagattatcaacgccgttgaaaagcagcctctcagctctaatatgattgagaggagtgtggtggaggcggcagtccaagagtgctcccagtctgttgacgaaactatattgctgatgaccaaccaccctgcacctaacctgtttggtactcctagggacaaggccgagatgtttcgtgagagatacacaatcctccaccagagaacgcaccgccatgagcttttcacacctcccgtgatcggtagccatcccgatgaatctggatctaagtttcagctgaagactattgaaacgctgctcggctctaccacaaaaatcggggatgccatagtgctgggaatgattactcagcttaaagagggaaaattctttctagaggaccctacgggaaccgtacagctagacttgagcaaagctcaattccacagcggcctttacaccgaagcatgcttcgtgctggccgagggatggtttgaagatcaggtgttccatgtcaatgcttttggttttcctccaaccgagccttcgtctactacccgcgcttattatggcaacatcaacttcttcggagggcctagtaacacgagcgtcaagaccagcgccaagctgaaacagttagaagaggagaataaagatgccatgtttgtgttcttgagcgacgtctggctcgatcaggttgaagtgctcgaaaaacttagaattatgttcgctggatactctcccgccccgcccacatgctttatcctctgtggcaatttctcctcagctccttacggtaaaaatcaggtgcaggcactcaaggactcgttaaagaccctggcagacataatttgtgaatatccagacatccaccagtcatctagattcgtcttcgtacccgggcctgaggacccgggatttggaagcattttgccacgtccacccctcgctgagagtattactaatgagtttaggcagcgtgtgcctttctccgtatttactacgaatccgtgccgtattcaatattgtacccaggagattactgtatttcgggaagatctggtcaacaagatgtgtcgtaactgtgtcagatttccatcttccaacctggccatacccaatcatttcgtcaagaccattctgagccagggccatctgacaccgttgccgctgtatgtatgtcccgtttactgggcgtacgactacgcgctccgcgtgtaccccgtccctgatctccttgtgatagccgacaagtacgacccttttaccaccactaacacagagtgcctgtgcatcaaccccggcagcttccctagatccggtttctcctttaaagtgttctatcctagcaacaagacggttgaggacagtaagttgcaaggcttttag

SEQ ID NO: 200046 - DNA, 1509 bp, Artificial Sequence
  Description of Artificial Sequence: Synthetic coding sequence
atggcccccgagcggctgcggagccgggccctgagcgccttcaagctaagaggcctgctgctccggggcgaggcaatcaagtaccttactgaggcgttacaaagcatcagtgagcttgagctggaagataaactggaaaagatcataaacgcagtcgaaaaacagccgctatccagcaatatgatcgaaaggtcggtggtcgaagccgccgtgcaggaatgctcccagtcagtggatgagacgattgagcacgtcttcaacattattggcgcattcgacattcccaggttcgtctataatagcgaacgcaagaaattcttaccccttcttatgactaatcatcccgcccccaacctctttggaacgccgagggacaaagccgaaatgtttagagagagatacaccatcttgcatcaaaggactcatcgccacgagctctttacacctccggtaattggctcacatcccgatgagtcgggtagcaagttccagttaaaaactattgagacactactcggttcaacaacgaagattggagacgctatagtgctcggcatgataacccaactaaaggagggtaagttttttctagaggatcctaccggtacagtgcagttggacctatcgaaggctcagttccactccgggttatacacagaagcttgctttgtgctggccgagggatggtttgaagaccaggtgtttcatgtgaacgcgttcggattccctccaaccgagccctcatccaccacacgagcctactatggtaatattaactttttcggtgggccctctaacacaagtgtcaagacaagcgcaaagctgaaacaactggaggaggagaataaggatgcaatgttcgtatttctgtcagatgtttggctcgaccaggtggaagtgctggagaagttgcggattatgttcgccggttactcccccgcgcctccaacttgttttatcctatgtggtaatttcagttccgcaccttatgggaagaatcaggtgcaggcacttaaagatagtctcaaaactctggctgacataatttgtgagtaccccgacatccatcagagcagccgattcgttttcgtgccggggcccgaggaccctgggttcggctctattctgccaagaccgcccctagctgagagcatcacaaatgagtttaggcagcgggttcccttttcggtgttcacaacaaatccttgcaggattcaatactgtacacaagagataactgtctttcgtgaggaccttgtcaacaagatgtgccgtaactgcgtgcgattcccctccagtaatcttgccattcctaatcacttcgtcaaaaccattctgtcgcagggacacctgacgcccctcccattgtatgtgtgcccggtgtactgggcttatgattatgctctgcgcgtatatcccgtaccagacctcctggtcattgctgacaagtacgatccttttacgacgaccaacacagagtgcctgtgcataaaccccgtcagaatgtag

SEQ ID NO: 200047 - DNA, 444 bp, Artificial Sequence
  Description of Artificial Sequence: Synthetic coding sequence
atggccgagcggcccgaggacctgaacctgcccaacgccgtgatcacaagaatcatcaaagaagccctccctgacggggtcaacatctctaaggaagctcgtagtgccatctcaagagccgcaagcgtcttcgtgttatacgctacatcatgcgctaacaacttcgccatgaaaggcaaacggaaaactctgaatgcgtctgatgttttgtcggccatggaagagatggagtttcagaggtttgttacaccactgaaggaagccctggaggcctacagaagggagcagaaagggaagaaagaagcatcggagcagaagaagaaagataaagataaaaagactgatagtgaagagcaggacaaatcccgggacgaggataatgatgaggatgaggagagattggaggaggaagaacagaacgaggaggaggaggtggataactag

SEQ ID NO: 200048 - DNA, 444 bp, Artificial Sequence
  Description of Artificial Sequence: Synthetic coding sequence
atggccgagcggcccgaggacctgaacctgcccaacgccgtgatcacgcgcataatcaaggaggctctgcctgacggcgtgaacatctcaaaggaagcacgatctgcgatcagccgtgccgcatctgttttcgttctgtacgctacctcatgcgccaataacttcgccatgaaagggaaacgtaaaaccctcaacgcctccgacgtgctcagtgcaatggaagagatggagttccaacggttcgttaccccactgaaggaggcccttgaggcctaccggcgggaacaaaaaggtaagaaggaggcctctgaacaaaaaaaaaaagacaaggacaaaaagaccgactcagaagaacaagacaagagccgagacgaggataacgacgaggacgaggaacgtctggaagaggaagaacagaacgaagaggaggaggtagacaattag

SEQ ID NO: 200049 - DNA, 1245 bp, Artificial Sequence
  Description of Artificial Sequence: Synthetic coding sequence
atggccaccggccaggaccgggtggtggccctggtggacatggactgtttcttcgtccaggtcgagcaacggcagaacccacatctccgcaacaaaccttgcgccgtagtgcaatataagtcctggaaagggggaggtataatagccgtgagttacgaagcaagggcatttggagttacaaggagcatgtgggctgatgatgccaagaagctttgtcccgatctgctgcttgcacaggtgcgcgagtcccgaggaaaggcaaatttgacaaaataccgggaggcctcagtagaggttatggagatcatgtcgcgcttcgctgtgatagaacgagcttctatcgatgaggcttacgttgaccttacatcagccgtacaggagaggttgcagaagttgcagggccagcccatctccgccgacctcctcccatccacatacatcgaaggcctgccgcagggtcctacaacagcagaagaaacagttcaaaaagagggaatgcgcaagcaaggactgtttcagtggcttgatagcctccagatcgataatctgacttcgcctgacttacaactgactgtgggagctgtgattgttgaagagatgagggccgctattgagcgggaaaccggcttccagtgttctgcaggcatctctcataacaaagtactcgcaaagctcgcctgtggacttaataagccaaacagacagacactggtaagtcatgggtctgttccccagctcttttctcagatgcccattaggaaaatcagaagtctgggtggaaagctcggggcctccgtgattgagatcttagggatagagtatatgggcgagcttacccaattcacagagtctcagctgcaatcccactttggtgagaagaatggcagctggttgtatgctatgtgccgtggaatcgaacacgatccagtcaaaccgcggcagctacctaagacaataggatgttccaaaaactttccaggcaaaacagctctcgctaccagagagcaggtgcaatggtggctgttgcagctggcccaagagttagaagagagactcaccaaagatcgtaatgataacgatagggtagccacgcagctggtggtatctatccgggtgcaaggtgataaaaggcttagctctctgcgaagatgctgcgcacttacccggtacgatgcccacaagatgtcacatgatgccttcactgtcattaagaactgtaatacctccggaatccaaacagaatag

SEQ ID NO: 200050 - DNA, 2142 bp, Artificial Sequence
  Description of Artificial Sequence: Synthetic coding sequence
atggccaccggccaggaccgggtggtggccctggtggacatggactgcttcttcgtgcaagttgaacagcgtcagaatccccatctgagaaacaagccttgtgcagttgtccagtacaagagctggaaaggtgggggtattatagctgtaagctatgaggcccgggcatttggggtgacacgtagcatgtgggccgatgacgctaaaaagctctgtccggaccttctgctcgcgcaggtcagggaatcccggggtaaggcaaaccttacaaagtatcgagaagcttctgtggaggtcatggagatcatgtccagatttgccgtgatcgaacgggcgtccattgatgaggcctatgtggatctgacttcagctgtccaggaacgcctccagaagctgcaggggcagcccattagcgcagaccttcttccctctacttatatagaagggctcccacaggggcctaccacagcggaagagacagtgcagaaagagggtatgagaaaacagggtttgttccagtggttagattctttgcagatcgataacctgacctccccggatctgcagctgactgtaggggctgtgatagtagaggaaatgcgcgctgcaatagaacgggagacaggttttcagtgttccgccggtatcagccacaataaagttttggcgaagctagcatgcggcctcaacaaaccaaacaggcaaactttagtctcacatggcagcgtcccccaactgttctcgcagatgcccatcaggaaaatccggtctctgggaggcaagttaggagccagcgtgattgaaatccttggtatcgaatatatgggcgaactgacccagttcaccgagtcgcaactgcaatcgcacttcggagaaaagaacggatcctggctgtacgcgatgtgccgaggtatcgagcacgatccagtgaaacctagacagctgcctaagaccatcggctgcagtaaaaacttcccggggaagaccgctcttgccactagagagcaagtgcagtggtggctgctacagctggcacaggagctcgaggagcgactgaccaaagaccggaatgataatgatcgggtggctacccagctcgtggttagtattcgtgtgcaaggcgataaaaggctctcaagtttgcgcagatgttgcgcactcacacgctatgatgctcataagatgtctcatgatgcctttactgttatcaaaaattgcaatacttccggcattcaaactgagtggagtccaccactgaccatgctctttctgtgtgcgaccaagttcagtgcgtccgccccgagctcatctaccgatattacttcattcctaagttcagacccctctagtttgcccaaagtccccgtaacatcctcagaagctaaaacccagggtagcgggcctgccgtgaccgccaccaagaaagctacaactagcctggagtcttttttccaaaaggcagctgagaggcagaaggtgaaggaggctagcctctcctccttgaccgccccaacccaagcacccatgtcaaatagcccatcaaaaccgagtctcccctttcagacctcccagtccactggcaccgagcctttctttaaacagaagtcattgttgctgaagcaaaaacaactaaataactcttcagtgagctcgccccagcagaatccgtggagcaactgcaaagccttgccaaactccctgcctacagagtatccagggtgcgtgcccgtgtgtgaaggggtcagcaaactcgaagagagtagcaaagcaacacccgccgaaatggacctcgcccacaattcccagtccatgcacgcgtcttccgccagcaagagcgttcttgaggtgacgcagaaggctacaccaaacccatctctccttgccgccgaggatcaggtgccctgcgaaaaatgtggcagcctggttcctgtctgggatatgcctgagcatatggattaccactttgccctggaacttcaaaaatcctttctgcagccccatagttctaacccccaggtagtgtccgctgtcagtcatcagggcaagcgtaacccgaagagccccttggcatgtacaaacaaaagaccgaggcccgagggcatgcaaaccctggagtctttttttaaacctcttacccactag

SEQ ID NO: 200051 - DNA, 219 bp, Artificial Sequence
  Description of Artificial Sequence: Synthetic coding sequence
atgtgggccgacgacgccaagaagctgtgccccgacctgctgctggctcaggtccgggaaagccgcggaaaggcaaacctcaccaaatatagggaggcctccgtggaggtgatggagataatgtcaaggttcgcggtaattgagcgagctagcatcgacgaggcatacgtagatcttacatcagctgtccaggagcgcctgcagaaactgcaagggtag

SEQ ID NO: 200052 - DNA, 1956 bp, Artificial Sequence
  Description of Artificial Sequence: Synthetic coding sequence
atgtgggccgacgacgccaagaagctgtgccccgacctgctgctggcgcaagtacgtgagtctagagggaaggcaaatctaacaaaatatcgcgaagccagcgtggaagttatggaaattatgagtcgattcgccgtaattgaacgcgccagtattgatgaagcttatgttgacctcactagcgcggtccaggaacggctgcagaaactacaggggcaaccaatatccgccgacctgctgccatcaacgtacatcgagggtctgccgcagggcccaactaccgcagaagagaccgtccaaaaagagggcatgagaaaacaagggctgttccagtggctcgactctctgcagattgataacttgacatcgccagacctgcagctgacagtgggagcggtgatagtggaggagatgcgggccgccattgaacgggagactggcttccagtgcagtgctggcataagtcataataaggtgctcgctaagctggcctgtggcttaaacaagcctaacagacagactctggtgagccatggcagcgtgccccagctctttagtcagatgcctatccggaagattcggagcttggggggtaaattgggggctagcgttatagaaatccttggcatagaatacatgggcgaactgacacagttcacagaatcgcagctgcagtcccacttcggggaaaagaatgggagctggctgtatgcaatgtgtaggggcatagaacacgatccagtgaagccgcggcaactccccaaaaccattggctgctccaagaacttcccagggaagactgccctggctacaagagaacaggttcagtggtggctgctgcaactggcacaagaactggaagagaggcttactaaggatagaaatgataacgacagggttgccactcagttggttgtcagcatcagggtccagggagacaagaggctgtcatctctcaggagatgttgtgctcttaccagatatgacgcacacaagatgtcacacgacgctttcacagtgatcaaaaattgcaacacctccggtatccagactgaatggtccccgcctttgacaatgctcttcctctgcgccactaagtttagcgcctcagcaccgagttctagcactgatatcacctcatttttgtcctccgacccctccagtttgccaaaggtgccagtgacctctagcgaggccaaaacccagggttcgggcccagccgtgactgctaccaagaaggctacaactagcctggagtctttctttcaaaaagctgccgaaaggcagaaggtaaaggaagcgagtctgtccagtctgaccgccccaactcaagccccaatgtccaactcaccatctaaaccttcacttcccttccagaccagccagtccaccggaacagagccctttttcaagcagaaatccttactgctgaaacaaaagcagctgaacaactcttcagtaagcagtccacaacagaatccttggtctaactgtaaagcactccctaactccctgccgaccgagtacccaggctgtgtgccagtctgtgagggggtgtcaaagctggaggaatcctccaaggccacacccgcggaaatggatctagctcataactcacagagcatgcacgctagctctgcgtcaaagtcagtgctggaagtgactcagaaggcaactcctaatccttcactgctggccgcagaggaccaggttccttgcgagaagtgcggctcactggtccctgtctgggacatgccagagcatatggactatcatttcgccttggaactgcaaaagtctttccttcagcctcactcgtcgaacccccaggtggtctccgccgtatcacaccagggtaagcggaacccaaagagtccattggcatgtactaacaaacgacctaggcctgaaggcatgcaaaccctcgaaagtttcttcaaaccattaacccactag

SEQ ID NO: 200053 - DNA, 3720 bp, Artificial Sequence
  Description of Artificial Sequence: Synthetic coding sequence
atgagccggctgctgtggcggaaggtggccggcgccaccgtgggccctggccctgtgccagcacctgggagatgggtcagctcatccgtgccagcctccgatccctctgatggtcagcgacgccgtcagcaacagcagcagcagcagcaacaacaacagcaacagccacagcaacctcaggtcctgtcatcagaaggcggccaattgagacataaccctctggatatccagatgctatcccgaggcctgcatgaacaaatcttcgggcagggcggcgaaatgccaggcgaagcagctgtgcgtcggtctgttgagcacttacagaaacatggtctgtggggacagccagcagttccactccctgatgtcgaactgcggctgccaccactttacggggacaacctggaccagcatttccggcttctggcacagaaacagtctctgccttacttggaagctgcgaatctcctgctccaggcgcagctccccccgaagccgccggcctgggcgtgggctgagggatggaccagatacggccctgagggtgaagctgtgccggtggctattcctgaggagagagccctcgtcttcgacgtagaggtttgtctcgccgaaggtacttgtccaaccctcgccgttgctatctcgccgtctgcttggtattcctggtgttcacaacggctggtcgaagagaggtacagttggacatcccagctcagccccgcagatcttatccctctggaggtgcctaccggagcctcctcgcccacccagcgtgactggcaggaacaattggtggtcggccataatgtgtcctttgatagagcacatatacgggagcagtacctcattcaggggagccgaatgagatttctcgataccatgtccatgcacatggcaatttccgggctgtcctccttccagaggtcactctggattgcagcgaaacagggtaagcacaaagtccagcctccaacaaaacaggggcagaagagccagcggaaagcacgccggggccccgctatctctagttgggactggctagacatcagttcagtcaactcactcgccgaagtccatcgtctgtatgtgggcggccccccactggagaaggagccacgcgaattattcgtcaaagggaccatgaaggatattcgggaaaattttcaggacctgatgcaatactgcgcacaggatgtctgggccacacatgaggtctttcagcaacaattgcctctgttcctagaacgatgcccacaccccgtgacattagccggtatgctggagatgggagtgtcatatctcccagtgaaccagaattgggagaggtatcttgctgaggcacagggtacttacgaagaactgcagagggagatgaaaaagtcactgatggatctggccaacgacgcatgtcagctgctcagtggcgaacgatataaggaggatccctggctgtgggacctagagtgggatctacaggagttcaaacaaaaaaaggcaaaaaaagtgaagaaggaacccgccaccgcgagcaagctccctattgagggggccggtgcacctggagacccaatggatcaggaagatctagggccctgctccgaggaagaagaattccagcaggatgtgatggccagggcgtgtctgcaaaaactgaaaggcactacggaactgctgccgaagagacctcaacatttgcccggacaccctggttggtacagaaagttatgcccaaggctcgatgatccagcctggactcccggcccatcgctcctgagtctgcagatgcgggtcactcccaaactgatggctttgacttgggacggattccctctccattattctgagcgacatggctggggatatctggtgcccggacgccgcgataatctggccaagctccctacaggcacgacacttgagtctgccggcgtcgtgtgtccttaccgcgccatcgagtccttgtataggaagcactgcctggagcaggggaagcagcagctgatgcctcaggaagccggactggcggaagaattcctgctcacagacaattccgctatctggcagacagtcgaggagctggactacctggaggtcgaggcagaagccaagatggaaaacttgagagcagctgtgccaggtcaacccctcgccctgacagcacgcggaggacctaaggacactcagccctcatatcaccatggtaacgggccatacaacgacgtggacattcccgggtgctggttcttcaagctgccccataaggatgggaatagttgtaatgttggatccccatttgccaaggatttcttgcctaaaatggaggacggcactttgcaggcgggccctggaggcgcctctggcccgagagccttagaaattaacaagatgatttctttctggcgtaatgcccacaagcgtatttcatctcagatggtcgtgtggttaccgagatcagcccttcctagagccgtgatccggcaccccgactatgatgaggaaggcctctacggggccattctgccacaagtggtgaccgccggcacaattacaaggagagccgtggaaccaacctggttaacagctagtaacgccaggcccgatcgggttggttccgaacttaaggctatggttcaagctccacctggatatactctggtgggggctgacgtggacagccaagagctctggatagcggcggtactgggtgacgcacatttcgctgggatgcatggctgtacggccttcggatggatgacactgcaggggcgtaaatcacgcggcacggatttgcacagtaaaactgcaaccactgtcgggatcagccgcgagcatgctaagatttttaactatgggcgcatctacggcgccgggcagccattcgccgagcggcttttaatgcagtttaaccaccggctcactcagcaggaggcagccgaaaaggcccagcagatgtatgcagccacaaaagggctgaggtggtaccgcctgtctgatgaaggcgagtggttggtgagagagttgaacctccctgttgatcgcacggaaggaggctggatttccctgcaggacctgagaaaggtccagcgcgaaactgcacgcaagagccagtggaagaagtgggaggtcgtggccgagagagcatggaagggagggacagaatctgaaatgtttaacaagctcgagagtatcgctacctctgacattcctcgcacacccgtgctcgggtgttgcatctctcgggctcttgagccctccgctgtccaggaagagttcatgaccagtagagtgaactgggtggtccaatcaagtgcagtggattatctacatctgatgctcgttgcaatgaagtggctgtttgaggagtttgctatcgatgggcgtttttgcataagtatccacgatgaggtccggtacctggtaagggaagaagacaggtatagagcagctctcgcccttcagatcaccaaccttctgacaagatgcatgttcgcgtataagctgggcctaaatgatctgccccagagcgtagcctttttttctgccgttgatatagaccgttgcctcaggaaagaggtaactatggattgcaaaacaccatccaatcctactgggatggaacggagatacggcattccgcaaggggaggccctggatatttatcagattattgaactcactaaaggatctcttgagaaacgttcacagcccggtccatag

SEQ ID NO: 200054 - DNA, 3720 bp, Artificial Sequence
  Description of Artificial Sequence: Synthetic coding sequence
atgagccggctgctgtggcggaaggtggccggcgccaccgtgggcccaggtcctgttccagccccaggaagatgggtgtcttccagcgtgcctgcaagtgacccatcagacggtcagaggaggagacagcaacaacaacagcagcagcagcagcagcaacagcaacctcagcagccacaagtgctgagctccgagggcgggcagctgagacacaacccactggatattcaaatgttgagcagggggctgcacgaacagatatttggccagggcggcgaaatgcctggcgaagctgccgtcagacggagtgtagagcacctccagaagcatggactatgggggcagccggccgtcccactgccagacgtggaactgcggctgccacccctgtacggcgacaacctggatcagcacttcagactgctggctcagaaacagtccctgccttatctggaagcggccaacttactgctgcaggcccagctgccaccgaagcctcccgcctgggcctgggctgaggggtggacacgctacgggccagagggcgaggcagtaccggtcgctattcccgaggaacgggcgctcgtgttcgacgtggaagtttgtttggccgaggggacctgccctacgctagcggtggctatctctccctccgcctggtattcctggtgctctcagaggctagtggaggagaggtatagctggacaagtcaactttctccagccgatctgattccactcgaagtgcctacaggagcttcctcaccgactcagcgcgattggcaggaacagctcgtggtgggtcacaacgtttcgtttgaccgcgcccatatacgggaacagtatctgattcaaggctctaggatgcgtttcctcgatacaatgagtatgcatatggcaatttccggtctttcctcctttcagcggtcgctgtggatcgcagctaagcaggggaaacataaagtccagccacctacgaagcagggccaaaaatctcaacggaaagccaggcgcggacctgcaatctcaagctgggattggcttgatatctcctctgtgaactcccttgccgaagtccatagactctacgtgggcggtcccccactggaaaaagaaccacgagagttgttcgttaaggggaccatgaaggatatacgcgaaaactttcaggatctgatgcagtattgcgcccaggatgtgtgggctacccacgaggtctttcagcaacagttgcccctgtttctggagcgctgcccacacccagtcaccctggcgggcatgctggagatgggggtgagctacctgcccgtcaaccaaaattgggaaaggtacctcgcggaggctcaaggaacctacgaagaattacaacgggaaatgaagaaaagcctgatggacctggctaacgacgcgtgccagctgttaagcggagaaagatacaaggaggacccctggctgtgggatttggagtgggacctgcaggagtttaaacagaagaaggccaagaaagttaagaaagaacctgccaccgcctctaagctcccaatcgagggcgccggcgccccaggggatcctatggatcaagaggacctcgggccatgttcagaagaagaggaatttcagcaagatgtaatggctcgcgcctgtctacagaaattgaaaggaaccaccgaactcctgccgaagcgaccgcaacatttgccagggcatcctggttggtacagaaaattatgtcctcggctggacgaccccgcctggacacctggcccaagcctgctgtcactgcaaatgagagtcactcccaagctgatggctctcacttgggatgggtttcctctgcactattcagagcggcatgggtgggggtatcttgtcccagggcgtagagataatctggccaagctgccaacgggcactacgctggagtcagcaggagtcgtttgcccataccgggcaatagagagcctgtatcgtaagcattgtttagagcaaggaaagcagcaacttatgccgcaagaagctgggctcgctgaagaattcctcctgacggataattcagccatctggcagactgtcgaggaacttgattatctggaggtggaggctgaggctaaaatggagaatctgagggccgccgttccgggccagcctctcgcactgaccgcgagagggggccctaaggacacccagccgagttatcaccatggaaacggaccctataacgacgtcgacattcccgggtgttggtttttcaaactaccccacaaagacggtaatagttgtaatgtcggcagcccgtttgccaaagactttctgcccaagatggaagatgggacactgcaggctggtcctgggggggcctctggtccacgcgctttggaaatcaataagatgatttccttttggcgaaatgcccataagaggatctcctcccaaatggtagtctggctgcccagatccgcactcccaagagccgtaatacgccaccccgactatgatgaagaaggcctgtatggtgcaatattgccacaggtggttacggcagggactattacacgaagagccgttgaacctacatggctcaccgcaagcaatgcccggcccgatcgcgttgggtctgaactcaaagctatggttcaagctccacctggatacaccttggtcggcgcggacgtggattcccaagagctgtggatcgcagcagttctcggcgacgcacactttgctggaatgcatggttgcaccgcttttggatggatgaccctacagggacggaaaagccgtggcaccgatttgcactctaagacagctactaccgttggaatttccagggagcacgctaaaatctttaactatggacgcatatatggcgctggccagccattcgcggaacgcttacttatgcagttcaatcatcggttgactcaacaggaggccgcagagaaagctcagcagatgtacgctgcaacgaaaggcctgcgctggtatcggctgtccgacgagggggagtggttggttagggagcttaacttacccgtcgatcggaccgagggcggctggatcagtctgcaggatctgcgtaaggttcagagagagactgccagaaaaagccaatggaaaaaatgggaggtcgtggctgagcgggcctggaagggtggcacagaatctgagatgtttaataagcttgagagtattgctacatcagacattccacggactcccgtgctgggctgttgcattagtcgagccctcgaaccaagtgcggtccaagaagaatttatgacctcgagggttaactgggtggtgcagagcagcgctgtggattacctccatctcatgctggtggccatgaagtggctgttcgaggaattcgctatagacggtagattttgtatcagcatccacgatgaagttcggtacttggtccgagaggaagacaggtatcgagctgctctggccctgcaaataaccaatttattgaccaggtgtatgtttgcgtacaagcttgggctgaatgacttacctcagtccgtcgcattcttttccgctgtcgatatcgaccgatgtctgcgcaaggaagttaccatggattgcaagacgcccagcaacccaacggggatggaaagaagatatggcattccccagggagaagccctggacatctatcagatcatcgagctaactaaaggttctcttgagaaaaggtctcagcctggtccttag

SEQ ID NO: 200055 - DNA, 1458 bp, Artificial Sequence
  Description of Artificial Sequence: Synthetic coding sequence
atgcggagccgggtggccgtgcgggcctgccacaaggtgtgccggtgcctgctgtcaggctttggcgggagagttgacgcaggccagcctgagctgctaaccgagcgaagctcccctaagggcggccacgtgaagtcccatgctgagctagagggaaatggcgaacatcctgaggcacccggaagtggagagggaagcgaggctctcctggaaatctgtcagcggcgacatttcctcagtggatcaaaacagcagctgtcaagggactcgctgctcagcgggtgccacccaggctttggtccattgggcgtggagctgcggaaaaatctcgctgctgaatggtggacaagcgtggtcgtattcagggagcaggtgttcccggtagacgcattgcaccataaacccggccctttactgccaggtgactccgccttccggctcgtgagcgctgagactctcagggagatcctgcaggacaaagagctgtcaaaggagcagctggtggcgtttttagaaaacgtgctaaagacatctgggaagctgcgcgaaaacctcttacacggggcattggaacactatgtcaattgtcttgacttggtgaacaagcgtcttccctatggactggcacaaatcggcgtatgctttcatcccgtgttcgataccaaacagataaggaacggggtcaagtccataggagaaaagaccgaagcttcactggtctggtttacccccccacgaacctctaaccagtggctggacttctggctgcggcacagactgcagtggtggagaaagtttgcaatgtcacctagcaatttcagttcaagcgattgccaggatgaggagggccggaagggtaataaactttactacaacttcccctggggaaaagagctaattgagacactctggaacctcggagaccatgagctgctccacatgtacccgggaaacgtgagtaagctgcacggccgtgacggtcgtaagaacgtcgtcccatgcgtccttagcgtgaacggtgaccttgatagaggaatgctcgcctatttgtatgatagctttcagttgacggagaattccttcactcgaaaaaagaacttgcaccgaaaggttctgaagctgcatccttgcttggcacccattaaggttgccctggacgtcgggcgcggccctaccctggagctgagacaagtctgtcagggcctgtttaatgagctgctcgagaatggaattagcgtttggcccggatatctcgaaactatgcagtcttccttagagcaactctacagcaaatatgatgagatgagtatcctgtttacggtgctcgtcacagaaaccacactggagaatggtctgatccatctgagatctagagatacgactatgaaggagatgatgcacatcagcaaacttaaggattttcttatcaaatatatttccagcgccaagaatgtatag

SEQ ID NO: 200056 - DNA, 7773 bp, Artificial Sequence
  Description of Artificial Sequence: Synthetic coding sequence
atgaacctgctgcggcggagcggcaagcggcggcggagcgagagcggctctgactctttctccgggtctggtggagattcgtcagcttcccctcagtttctgtctggaagcgtactgagtcccccccctggactggggcgttgcctaaaagctgccgccgccggggagtgtaaaccgaccgttcccgactacgagcgggacaaacttctgttggcgaactggggccttcctaaagcagtcctggagaagtaccacagctttggcgtgaaaaagatgttcgagtggcaggccgagtgcttgttgttgggccaagtgctcgagggcaagaacctggtttattcggcaccaacaagcgccggcaaaacacttgtggccgagttactcattctgaagagagtgctcgaaatgagaaagaaggcacttttcattctcccctttgttagtgtcgcaaaggagaagaaatactatctgcagagcctctttcaagaagttgggattaaagtggacggatacatgggtagtactagcccgtcccggcatttttcctcactcgacattgccgtgtgtaccatcgaacgagctaatggtctcatcaaccgcctgatcgaagaaaacaaaatggatttacttggcatggtggtggtagatgaattacacatgctcggggattctcatcgaggctacctcttggaattgctgctgacaaaaatttgctatattacgcgtaagtcagcttcttgccaagcagacctggcatccagcctgtctaatgcggtacagattgtcggaatgtctgcaacgctgcccaatctggagttggtggcaagttggctgaacgccgaattatatcacactgatttcagaccagtgcccttgcttgaatccgtgaaggttggcaattcaatctatgattcctccatgaaactcgtcagagagtttgagcccatgctgcaggtgaaaggggatgaagatcatgtggtgagcctgtgctacgaaaccatttgcgataaccattcggttcttctgttttgcccatctaaaaagtggtgcgaaaaactggccgatatcattgcacgtgagttctataaccttcaccaccaagcagaaggcctggtaaagccttccgagtgcccccctgtgattttagagcagaaagagctactggaggtcatggatcagctcaggaggctgccatccggcctggattcggtcctacagaaaacggtcccatggggtgtcgccttccaccacgccggcctcacgtttgaggagcgggacatcattgaaggcgctttccggcaagggttgatccgtgtgctcgctgcaactagtacgttgagctcgggggtgaatctcccagctaggagggttattatccgtacaccaatcttcgggggcagaccacttgacattctgacctataaacagatggtaggtagagcaggcaggaaaggcgttgacaccgtcggggagtccattctgatttgtaagaacagcgagaagtccaagggcattgccctgttgcaagggtccctgaaacccgtccgcagttgccttcagcgtcgggaaggggaggaggtcactggctctatgatccgcgcaatcctcgagataatcgttgggggcgtggcttcaactagccaggacatgcatacctacgctgcatgcacttttctggccgcttctatgaaagagggcaagcagggtattcaaaggaatcaagaatctgtccaattgggagccattgaggcgtgcgtcatgtggctgctcgagaacgaattcatccaaagcactgaggccagcgatggtacggaggggaaagtttaccaccccacccacctcggcagcgccacactgtcgagcagtctgtcccctgccgacacccttgacatattcgccgatctccagcgggccatgaaggggtttgtgctagaaaacgatttgcacatcctttacttggtgacgcccatgtttgaggactggaccacaattgactggtatcgttttttttgcctgtgggagaagctgccgacatccatgaagcgcgttgcggaactcgtcggcgttgaagagggcttccttgcgagatgcgtcaagggcaaagttgtcgcccggaccgagcggcagcatcgacagatggccatccacaaacgtttctttacgtctcttgtgctcttagacctgattagcgaggtccctctgagggagattaaccagaagtatggttgtaaccgaggccagatccagtctctgcagcagtcagcagcggtctacgccggaatgatcaccgtgttctccaaccgccttggctggcataacatggagctgctactgtcccagtttcagaaaaggcttacatttgggattcagagagaactgtgtgacctggtgagagtgtccctcctgaacgcccagcgagcccgcgtgctgtatgcgtccgggttccatacagtggccgaccttgcaagagctaatatagtggaggttgaggtgatcctgaaaaatgccgtgccctttaagtcagcccgcaaggcagtcgatgaagaagaggaggctgtggaggagcggagaaatatgaggactatttgggttaccggccggaaaggactgacggagcgagaagcggcagctcttatagtggaggaggcaagaatgattctgcagcaggatctcgttgagatgggcgtgcagtggaacccctgcgctctcctgcatagctcgacgtgctctttaacccactctgagtctgaggtcaaggagcacacgttcattagtcagaccaaatcatcttataaaaaacttaccagtaagaacaagagtaacacaattttttctgatagttacataaaacattcacctaatatcgtccaagacttaaataagtctcgcgagcatacttcctctttcaactgtaactttcagaatgggaaccaagaacatcagacctgctctatcttccgggcacgtaaacgcgcctccctggacatcaacaaggagaaacccggggcctcacagaatgagggcaagacttcagataagaaagtcgtgcagaccttcagccagaagactaaaaaggcccccctcaacttcaactctgagaagatgtctaggtccttccggagctggaagaggcggaaacacctgaaaagatcacgcgactcgtcgccgttaaaagattccggcgcctgccgtatccacctccagggtcagactctgagcaatccatccctctgcgaagatccgttcactctggacgagaaaaaaacagagttcagaaacagcggaccattcgctaagaacgtctccctcagtgggaaggagaaggataacaaaaccagtttcccactccaaatcaaacagaattgctcttggaacataactctcacgaatgataacttcgtcgagcatatcgtcactggaagccagtccaagaacgtgacctgccaggccacatcagtggtgtctgaaaagggacggggcgtggccgtggaggctgagaagattaatgaggtgctgatccagaatggatcaaagaatcagaacgtctacatgaagcaccacgatatccatccaattaatcaatacctgcgcaaacagtcccacgagcagacatccacaatcactaagcaaaagaacattattgaacggcaaatgccttgtgaggctgtctcttcttacatcaatagagattcgaatgtcaccattaattgcgagcgtataaagctcaatacagaagaaaacaagccgtctcactttcaggctcttggggacgacattagtcgcaccgtgatccccagcgaggtgttaccctccgcaggtgctttttctaagtcagagggccagcacgagaattttctgaacataagtcgccttcaggaaaagacaggaacttacactactaacaagacaaaaaataaccatgtttctgacctgggattagtgctgtgcgattttgaagatagtttttacctggacacccagagtgaaaagatcattcagcaaatggcgactgagaatgccaagctgggtgctaaggacaccaatttagccgctggtataatgcaaaaatccctggtccagcagaacagcatgaattcttttcaaaaggagtgtcatataccctttcctgcagaacaacaccctttgggcgcgacaaagattgaccacttggatctgaaaaccgtcggtacaatgaagcagagctctgacagtcatggagtggatatcctaacccccgagtcacccatctttcattcccccattctgctagaggaaaacggtctcttcttgaaaaagaacgaggtcagtgtcacagattcacagcttaattccttcctgcagggctaccaaacccaggaaacggtgaaacccgtgattctcttgatccctcaaaaaaggacgcctaccggagtggaaggagagtgcttgcccgtgcccgaaacaagtctgaacatgagcgacagtcttctgtttgattctttctctgacgactacctcgtgaaagagcagctgcccgatatgcagatgaaagaaccactcccaagtgaagtcacgtccaatcacttcagcgactccctgtgtctccaggaagatcttatcaagaaaagcaacgttaacgagaatcaggacacacatcaacagctgacttgtagcaatgacgaatccatcattttctccgagatggattccgttcagatggtcgaggccctggataatgtagacatcttcccggtgcaggagaaaaaccacaccgttgtcagtcctcgtgctttggagctgagcgatccagtgctggatgaacaccaccagggcgaccaggatggaggggatcaggatgagagggcggaaaaaagtaagctcacggggacaaggcagaatcacagttttatttggtctggtgccagctttgaccttagtccaggccttcagagaattctcgacaaagtgagtagcccactggagaatgaaaaacttaagtctatgaccattaacttttccagcttaaacagaaagaatactgagctaaatgaggagcaggaagtgatatctaatctggaaaccaagcaggtccaagggattagctttagcagcaataacgaggtgaagtcaaagatcgagatgctcgaaaataatgcgaatcacgatgagacctcaagcttactcccgcggaaagaatcaaatattgtggacgacaacggactgattccgccaacccctatcccaacatccgcctctaagctgacctttcctggaatcctcgaaacaccagttaacccatggaaaacaaataacgttctccagcccggcgaatcatacttgtttggttctcccagcgacataaaaaaccacgacctcagtcccggaagtcgaaacggattcaaagataactccccgatcagcgatacatcctttagcttgcagctaagccaggacgggttgcaactcacccctgcctcctcgtcaagtgagagtctaagcatcattgatgtggccagcgaccagaatctcttccagacatttattaaagaatggcgctgcaagaagcggttctctatctcattggcctgtgaaaaaatccgcagccttacctcatcaaaaacggctaccatcggcagccggttcaaacaagcctctagtccacaggaaatccccatccgtgatgacgggttcccaattaaagggtgcgatgacactctcgtggtgggcctggccgtgtgctggggcggtagggacgcttactacttttctctgcagaaagagcagaaacattctgaaatttcagcttcccttgtaccaccaagcctagacccctccttaacactgaaagataggatgtggtacttgcagtcctgcctccggaaggagtcagacaaagagtgcagcgtggtgatatatgatttcatacagagctacaaaatacttctcctgagttgtggaataagcctggaacagtcatatgaagatccaaaagtcgcctgttggcttctggatcctgactcacaggaaccaacgctgcacagcatcgtgacgtctttcctaccgcacgaattgcccctgctcgagggaatggaaacatcccaggggattcagtcactcggactcaatgccggcagcgagcactccgggagatatcgagcatccgtagaatccatactcatctttaacagtatgaaccaactgaactccttgctacaaaaggaaaacttacaagatgtctttagaaaggttgaaatgccctcacagtactgtcttgctttattagaactcaatggaatcgggttcagcacggcagaatgtgagtcacagaaacatatcatgcaggccaaactggacgcaattgaaacccaagcatatcagttggccggccatagcttctctttcacctcttctgacgacattgctgaggtgctctttctagaactcaaactgccccccaacagggagatgaagaaccaggggtctaaaaagaccctggggagcacgaggagagggattgacaacggtaggaagctgaggctggggcgccagttctcaacaagtaaggatgttttaaataagttaaaagcattacatcccctgccgggtctgattctcgagtggcgaagaatcaccaacgccataacaaaagtcgtgttccctctccagcgcgaaaaatgcctgaatccctttctgggaatggagcgcatttatcctgtgtcacagagtcacaccgctacagggcgaatcacattcaccgaacctaatattcagaacgtgcctagggactttgagatcaaaatgcccaccctggtaggcgaatcccctcctagccaagctgtgggcaaagggctcctgccaatgggcaggggaaaatacaaaaagggattttcggttaaccccagatgccaggcgcagatggaggagagggcagctgatcgtgggatgccctttagcatcagcatgaggcacgccttcgtcccattcccaggcggaagtattctggcagccgattattcccaacttgaattgcggatcctagcacacctatcacatgaccgacggcttattcaggtgctcaatacaggcgctgatgttttccgtagcatcgctgctgagtggaagatgatagagcccgagagtgtgggtgatgacctccgacagcaggccaagcagatttgttatggaattatctacggcatgggtgccaagtctcttggagagcagatgggcataaaggagaatgacgcagcctgctatatcgacagttttaagtctcgctacacgggcattaaccaatttatgaccgagacagtgaaaaactgcaaaagggatggcttcgtgcagactatcctgggccgccggaggtatttaccaggaattaaggacaataacccctacagaaaggcccatgccgagcgtcaggccatcaacacaattgtacaagggtctgctgccgatattgtgaaaatcgctacagtcaacatccaaaagcagctggagacattccactcaaccttcaaatcgcatgggcacagggagggcatgctacagtccgaccagacggggttgagtagaaagcgcaagttacaaggaatgttttgccccatccgtggcggcttcttcattttacagctgcacgacgagctgctttatgaggtggctgaggaagatgtggtccaggtggcccagatagttaagaacgaaatggaaagtgccgttaaactgagcgtgaagttgaaggtcaaagttaagatcggcgcttcgtggggggaactcaaggatttcgatgtatag

SEQ ID NO: 200057 - DNA, 8181 bp, Artificial Sequence
  Description of Artificial Sequence: Synthetic coding sequence
atgaacggccaccggttcaccttccggacccggagcctgctgcccctgcagaaaggacagcatcggtgtatcacaaagctgctggcacataacgacccttgggggatctttagggcaccctcatccaggcggagctatagcgtcagcggcgtctgccagcccgctattcctaattcttcactgcacatcccccataacgcttgctggctcaaatggaagctgtgtagcgagatcgccctgccttatcaccatattctcggagagcgaaggaagctgtgcagtatccggcggttcgagtttgaagattggagggaagatgtcagaagttgctgtcaggcccgagtccttccgcggggcaggacattgggactttggctagcgctgatcggtcgggaggaatttgccatgaacctgctgaggcgctccggcaaacggcggagaagtgagagcgggtctgactcttttagcggctccggaggggattccagcgcttcacctcaatttttgagcggcagcgtcctctccccaccaccgggtctgggcaggtgccttaaagcggcggctgcaggtgaatgcaagcccaccgtccccgattatgaacgcgataagctactgctcgccaactggggtctgcctaaagctgtgcttgaaaaatatcattctttcggtgttaaaaagatgttcgagtggcaggctgagtgcctgctgctgggccaagttctcgagggaaaaaatttggtctactcggctcctacctccgcagggaagacgctcgtagccgagttacttatcttgaaacgggtgctggagatgcgcaaaaaggctttgttcatcctccccttcgtcagtgtagccaaagagaagaaatattatttgcaaagcttgtttcaggaagtggggataaaggtagatggttatatggggtctacctcaccaagtaggcacttttccagccttgacattgccgtgtgtacaattgagcgggccaacggactcatcaataggctcattgaagagaataagatggatctcctgggcatggtcgttgtagatgagctccatatgctgggagacagtcaccggggatatttactcgagctgttacttaccaagatttgttatattacgaggaagtcagcctcttgccaggccgacctcgcttcttcgttatctaatgctgtacaaatagtgggtatgtctgcgacactaccaaacctggaattagtggcttcatggctgaacgcagagctgtatcacactgatttcaggcccgtgccattgctggaaagcgttaaagtcggcaactctatttacgacagctccatgaaactggtacgcgagttcgagcctatgctacaggtcaagggtgatgaagaccatgttgtatccctctgttacgagacaatctgtgacaaccatagcgtactcctcttctgcccctctaaaaaatggtgcgagaagctggccgatattatcgcccgcgaattctataatctccaccatcaggccgagggcgaagggctcgtgaagccctccgagtgtccaccagttattctagagcagaaggagcttctggaagtgatggatcagcttagaagattgccatcaggccttgattccgtcctgcagaaaactgtgccctggggcgtcgccttccaccacgccggactcacattcgaggaaagagatattattgaaggcgctttccggcagggactcatacgcgtactggccgctacaagtaccctatccagtggggtgaatctgccagcgcgccgcgtgatcatccggactcctatttttggcggcaggccattagacatcctgacctataagcagatggtaggccgggctggcaggaaaggcgtcgacacagtggaaagcatcctgatttgcaaaaatagcgaaaaatccaagggcattgccctattacaggggtcgctgaaaccagtacggtcatgcctgcagcgcagggagggcgaggaagtgacaggaagcatgatccgtgctatcctcgagattatagtgggtggagtggcgtccactagccaggacatgcacacttacgccgcatgcacattccttgcagcttcaatgaaggaaggtaaacaaggtattcagaggaatcaggaatcagtccagctgggtgctatagaggcctgtgtgatgtggttgctggagaacgaattcattcaaagcacggaagcatctgacggcacagaaggtaaagtgtatcaccctactcatctgggcagtgcaacactgtcttcctcccttagtccagcggatacccttgatatctttgcagatttgcagagagccatgaagggtttcgtcctggagaacgatctccatatcctgtatctggtaacccccatgttcgaggactggaccaccattgactggtacagattcttctgtctgtgggagaagttacccacttcaatgaaaagagtcgcggagctggtgggtgtagaggagggcttccttgccagatgtgtcaaaggaaaggttgtggcccgcacagaaagacagcacagacaaatggcaatccacaaaagatttttcactagcctcgtgctgctcgatttgatatcagaggtgcccctcagggagataaaccagaagtatggttgtaatcgcggacagattcagagtctgcagcaatccgccgcggtgtacgccggcatgattaccgtgttttccaataggctgggctggcataacatggaattgctccttagtcagttccaaaaacgcctcaccttcggaattcagagggaactgtgtgacctcgtgcgtgtctctttgctgaacgcgcaacgcgccagggtcttatatgcgagtgggttccatactgtggctgatctggcccgggcaaatattgtggaggtagaagttatactgaaaaacgctgtgccatttaagtcggcacggaaagccgtggatgaggaagaagaagctgtggaggagagacgtaacatgcgaacgatttgggtgaccggacgaaagggcctaactgaacgggaagccgctgccctgattgtggaggaggctagaatgattctgcagcaggaccttgttgagatgggtgtccagtggaatccctgcgcccttctgcacagctccacttgttctctgacccattcagagagtgaggtcaaagagcacacgttcatcagccagaccaaatcatcttataagaaactcaccagcaagaataaaagcaataccattttctctgacagctacattaagcatagcccaaacatcgtgcaggatctaaataaaagtcgggagcacacttcgtcatttaattgtaattttcagaatggcaaccaggagcaccaaacctgtagcatctttcgtgcccgtaaacgggcaagcctagacattaacaaagagaagccaggagcatcacagaatgagggcaagacgtctgacaagaaagtcgtccagactttctctcagaaaacaaagaaagcgcctctgaacttcaatagtgagaagatgtcaagatcttttaggtcgtggaagaggcgtaaacacttgaagaggtcaagagacagctctcctctgaaggacagtggcgcctgccggatccacctgcagggacagacacttagcaaccctagtctgtgtgaggacccttttacactggacgaaaagaagaccgagttccgcaattcgggaccgtttgcaaagaatgtttctttgtctggaaaggagaaagataataagaccagctttccactgcagatcaaacagaattgtagctggaacatcaccctcaccaacgataatttcgtcgaacacattgtcacgggatctcagagcaagaacgtgacctgtcaggccacatcagtggtgtccgagaagggaagaggcgtcgctgtggaagccgaaaagatcaacgaagtgctaatccagaatggttcaaaaaaccagaacgtttatatgaagcaccatgatatccaccctatcaaccagtaccttcgcaagcaatcccacgagcaaaccagcacaataaccaaacagaagaatatcatcgagagacagatgccatgcgaggcggtctcttcatacataaatagggattctaatgtaacaatcaactgcgaacggattaagcttaataccgaggaaaacaagccatcacacttccaagccttgggagacgacatatccagaactgtgattccatcggaagttctgccaagcgcaggcgcgttttcaaagagtgaggggcagcatgagaacttcctcaacatttcccgtttacaggagaaaactggaacatacactacaaacaaaaccaaaaataatcacgtgagtgatcttggtctcgtactgtgtgactttgaggattccttctacctggacacgcagtccgagaagattatacagcaaatggctactgaaaatgccaagctcggagctaaggacactaacttggccgctggaatcatgcagaagagcctggtacagcagaattcaatgaatagttttcagaaggagtgccacatcccattccctgcagaacaacacccgctcggagccacgaaaatcgaccacttggacctcaagaccgttggaaccatgaaacaatcaagtgattcgcatggggtagacatacttacccccgaatctccaatcttccattcaccgatcctgttggaggaaaacggactctttctgaagaagaacgaagtcagcgtcactgattcacagctcaattcgtttctgcaagggtatcaaacccaagagacggtcaagcctgtaatcctactgatccctcagaaaagaacaccaacaggagttgagggggaatgcctgccagtcccggaaacgtccttgaacatgtctgatagtttgctgttcgactccttctctgatgactacttagtcaaagagcagttaccagatatgcagatgaaggagcccctgccaagtgaggtgacctccaatcacttttccgacagtttatgtctacaggaggacctgataaagaagtccaatgtcaacgaaaatcaggatacccaccagcagttaacttgttctaacgacgagtctatcatcttctccgagatggatagtgttcagatggtggaagcccttgataatgtggatatcttccccgtgcaagagaagaaccatactgtcgtctcgccaagggctcttgagctatccgaccccgtccttgatgaacaccaccagggggatcaagacgggggggatcaagacgaaagagctgagaaatctaagctgaccggcacgcgtcagaaccattccttcatctggtccggtgcttcttttgacttgtctcctgggcttcagaggatcctggacaaggtgtcctcccccttagaaaacgaaaagctgaagagtatgaccatcaacttctcctccctcaatcgcaaaaacaccgagctgaacgaagagcaagaagttatctcgaatcttgagacgaagcaggtgcaggggatttcattcagcagtaacaatgaggtaaagagcaagatcgagatgttggagaacaacgccaatcatgacgaaacctccagtctactccctagaaaggaatcaaatatagtggatgataacggactgattccgcctactcctatccctacaagcgccagtaagctcacttttcccggaatactagaaactccggtaaacccttggaagaccaacaatgtgttacagcccggagagtcatatctgtttggaagtccttcagacattaagaaccacgatctgagtcccggaagtcggaacggctttaaagataatagtccgataagcgacacaagtttctcactgcaactatctcaagacggcttacagcttacaccagcatccagctcttccgaaagcctaagtattatcgacgtagcttccgatcagaacctgttccagaccttcatcaaggaatggaggtgcaagaagaggttttctattagcctggcatgcgagaagatcagatcactcacttctagcaagactgcaactatcggtagccggtttaagcaggcgagctctccccaggaaatacccatccgtgacgacggcttcccaatcaaggggtgtgacgacacactggtggtgggactggcagtctgctggggaggaagagacgcctactacttcagtctgcagaaagagcagaaacacagtgagatctccgcatcgctggttcctcccagcctcgacccatctttaaccttgaaggaccgcatgtggtatctacaaagctgtttaagaaaggaatctgacaaggaatgtagcgtcgtaatttacgactttatacaatcctacaaaattctcctgctctcctgtggtatatctctggaacagtcctacgaggatcccaaggttgcttgctggctgctggaccccgactctcaggagcccacgctgcacagcatcgtgacatcttttcttccacatgaactgccactcttagaggggatggagacttcccagggcatacaatcactgggccttaatgccgggtcagagcattccgggaggtatcgagcctcggtggagagcatcctgatcttcaattccatgaatcagctgaactcactcttacagaaagaaaatctccaagatgtgtttcgcaaagtagagatgcccagccagtactgtctcgccctgctcgaacttaacggtatcggcttttcaaccgcggagtgcgagtcccagaagcatatcatgcaggcaaagctggatgctattgagacgcaggcataccagcttgcggggcactctttctctttcacatcctcagatgacattgccgaggtgcttttcctggaattaaaactgcccccgaaccgggaaatgaagaatcagggcagcaagaagacgctgggctcaactcgccgcggtattgacaacggccgcaaattaagactgggccggcagttcagcacctctaaggatgtgctgaacaaactgaaagctttacaccctctgccagggctgattctcgaatggcggcggataacaaatgctatcactaaggtggtatttcctctgcagcgggaaaaatgccttaaccctttcctcggaatggaaagaatatatccagtgagccaatctcacaccgctactggccggattaccttcaccgaacccaacatccagaatgtcccaagggatttcgagattaagatgcctacactggtaggagagtcacccccctcacaggccgtggggaaaggccttctccccatgggcaggggtaaatacaagaaagggttttccgtgaaccctagatgtcaggcccaaatggaggagcgcgccgccgatcgaggaatgcctttctcaattagcatgagacatgcctttgtcccctttcccggtgggagcatattggccgcggattatagccagttagaactgcggatcctcgcacacctcagccatgaccgccgcctcattcaggtactgaacactggggccgacgtcttccgatcaatcgccgctgagtggaaaatgatcgaaccggaaagcgtaggtgatgatctgagacagcaggcaaaacagatatgttacgggattatttatgggatgggggctaagtctctgggagagcagatggggattaaagagaacgacgccgcatgttacatcgactcattcaaatcaaggtataccggcattaaccagttcatgacagaaactgtaaagaattgcaaacgagacggctttgtgcagacaatactcgggagacgaaggtacctgcctggaattaaagacaacaatccgtacaggaaagcacatgccgagcgccaggcgatcaacacaatagtgcaaggctctgccgcagacatagtcaagattgctaccgtgaatatacagaaacagcttgaaacctttcattctacttttaaaagtcacggtcatagggagggcatgctgcagagtgatcagaccgggctgtctaggaaaagaaagctccaggggatgttttgccctatacggggagggtttttcatcctgcagctgcacgatgaactcctgtacgaggttgccgaggaggacgtagtacaggtcgctcagatcgtgaaaaacgaaatggaatccgctgtaaagttatctgtaaagctgaaagtgaaagtcaagataggcgcgtcttggggcgagcttaaggatttcgacgtgtag

SEQ ID NO: 200058 - DNA, 6642 bp, Artificial Sequence
  Description of Artificial Sequence: Synthetic coding sequence
atgcccaccagcaacagccagaaggagctgctggaggtgatggaccaacttcgccggttaccctcgggcctggactccgtgctgcagaagaccgtgccatggggggtggctttccatcatgccggtctgaccttcgaggaaagggacatcattgaaggtgcctttcgccagggcttgatcagagtattggccgcgacaagcacactgtcctctggggttaacctgcctgctcggcgggtgattatcagaactcctatcttcggcggcaggccactggacatccttacatataagcagatggtcgggcgcgcgggacgcaagggggtcgatacggtgggcgagagtattttgatatgcaagaattctgagaagtccaaagggatcgccctgctgcaagggagcctgaagcctgtgaggagttgtctgcagaggagagaaggcgaagaggtgaccgggtctatgatccgcgccatactggaaattatcgtgggtggggtggccagtaccagtcaggacatgcacacctacgccgcatgtaccttcctggcggctagcatgaaagagggaaagcaaggcatccaaaggaatcaggaatccgtccaactgggggcgatcgaggcgtgtgttatgtggcttctggagaacgaattcattcagagcacagaggcctctgatggtactgagggaaaagtatatcatccgactcacttgggatccgctacactgtcttcctctctgtctccagctgacacccttgatatctttgcagatctccaacgcgcgatgaaggggtttgttctggaaaacgatctacatatcctttacctggtcacacccatgttcgaggactggactaccatcgactggtatcgatttttctgcctgtgggagaaacttccaacctccatgaagagagttgctgagcttgtaggtgtcgaggagggctttttagccaggtgtgtaaagggcaaggttgtggcccgtacagaaagacaacacaggcagatggctatccacaagcgcttctttacctctctcgtgctgctggacctaatctccgaagtgccactgagggaaataaaccagaagtacgggtgtaatagagggcaaattcagagcctccaacagagcgctgccgtctatgctggaatgataacagttttttccaatcgcctcggatggcacaacatggaactgcttctgtctcagttccagaaaagacttaccttcgggattcagcgggagctctgcgatctcgtcagagtaagtttactgaacgcccaacgtgcccgcgttctgtacgccagcggattccatacagtggccgacttggcgcgcgcgaacattgtggaagtggaggtgattctgaaaaacgctgtgccctttaagagcgcccgaaaggctgtcgacgaggaagaggaagccgtggaggagcgtagaaacatgagaacgatctgggtgaccgggcggaagggtctgaccgagcgggaggcggctgccttgattgttgaagaggctcgcatgattctgcagcaggatctagtggaaatgggggtccaatggaacccttgcgcccttctgcactcatctacctgttcgttaacccattccgagagtgaagtaaaagagcacaccttcatcagtcaaacaaagagcagttacaagaagttaacatctaaaaacaaatctaacactatcttttccgactcttatatcaaacactcaccaaatatagtccaggacttaaacaagtctcgtgaacatacgtcttctttcaactgtaattttcagaacgggaatcaggagcaccagacttgttcaatttttcgagctcgcaaacgggcatccctggacattaataaagagaagcctggagcatcccaaaatgagggaaagactagcgataaaaaagtcgtacagacattctcccagaagaccaaaaaagcccccctgaatttcaactctgagaagatgtcgcgatcatttcggtcatggaaacgacgaaagcacctaaagaggagtcgggactccagcccactgaaagatagcggtgcctgtcgcattcacctgcagggccagaccttaagtaatcctagcctgtgtgaggatccattcaccctcgatgaaaaaaaaacggagtttcgcaacagtgggcctttcgccaaaaatgtcagcctgtcggggaaggagaaggataacaaaaccagtttcccactgcagatcaagcaaaactgttcatggaatattacattgacaaatgacaactttgtagagcatatcgtgacagggtcacagagtaagaacgtaacatgccaagcaactagcgtcgtaagtgagaagggaagaggggtggcggtggaggccgagaagattaatgaagtcttaattcagaacggctccaagaatcaaaatgtttacatgaagcaccatgatatacatccaattaatcagtatctgagaaagcagtcacatgaacaaacctctacaattactaaacaaaagaatatcatcgagcgtcagatgccatgcgaagcagtcagcagctacattaaccgagattctaatgtaacgatcaattgtgagcgcatcaagctcaacactgaggagaataagccttcacactttcaagccttaggcgatgatatctctcgtacggtcatccccagtgaggtgcttcctagcgcaggggcattctcaaagtcggaggggcagcatgagaacttcctgaatataagtcggctgcaggaaaaaaccgggacttacacgactaacaagactaagaacaatcacgtctccgatttaggactcgtgctgtgcgacttcgaggacagcttttatctggatacccagtctgagaagattattcagcagatggctaccgaaaatgctaaactgggagctaaagacacaaatcttgcggccggtataatgcagaaatcactcgttcagcaaaacagcatgaactctttccagaaggagtgtcacataccctttccagccgagcaacacccacttggcgctacaaaaattgatcacctagacctgaaaaccgtgggcaccatgaagcaatcttcagatagtcatggggttgacattctgacacctgagtctcccatcttccatagcccgatcctgctagaagaaaatggtctcttcctgaaaaagaacgaggttagcgtgactgatagccagctcaactctttcttgcagggatatcaaacccaggaaacagtgaaaccagtgatcctcctgatccctcagaaacggaccccaacaggcgtggaaggggaatgtctgcctgtgcctgaaacttcactaaacatgtctgacagtctgctcttcgattcgtttagcgatgattacctggtgaaggaacagctgccagacatgcagatgaaggaacccctcccatcagaggtgaccagcaaccattttagtgactccctgtgtcttcaggaagatctcatcaaaaaatccaacgtcaacgagaaccaagacacccaccagcagctgacgtgcagcaatgacgaaagcattatttttagcgagatggattccgtgcagatggtggaggcgctggataacgttgacattttcccagtacaagagaagaaccatactgtagtgtctcctcgagcgctggaactgtcagaccctgtgttagatgaacatcaccaaggtgatcaggatggcggagatcaggacgagagggcagaaaagtccaagttgactggcactaggcagaaccacagctttatttggagcggcgcttccttcgatttgagcccaggtctgcagcggattctggacaaggtgtcttctcctctcgagaatgagaagttgaaatccatgaccatcaacttttcttccctcaatagaaagaatacagagctgaacgaggaacaggaagtcattagtaacctggagactaagcaagtccaggggatcagctttagcagcaacaacgaagtgaaaagcaagatcgagatgttagagaataacgcaaatcatgacgagacaagcagcttactgcctcgcaaagaaagtaatatcgtagacgataacggtttgatccccccaacccctattccgaccagcgccagtaaactgactttcccagggatcctggagacgcccgtcaacccatggaaaacaaataacgtgctgcagcctggagagagctatctgtttggcagcccgtctgacatcaagaatcacgatctttcacccggcagccggaacgggtttaaagacaacagtcctataagtgacacctctttcagcttgcagttatctcaggatggcctccagctcactcccgcaagtagctcttccgaatccctctccattattgatgtcgccagcgaccagaacctgtttcagacattcatcaaggagtggaggtgcaagaagcggttttccatatctttagcatgcgagaaaattcgctctctcacatcatcaaagacagccacaatcggctcgcgtttcaagcaggccagcagcccacaggaaatccctatcagggatgacggctttccaataaagggatgcgacgacacactcgtggtgggtctggcagtatgctggggtgggcgggacgcctactatttctcgctgcagaaagagcagaaacacagtgaaatcagcgcttccttagttcctccctctctggacccttcactcactctgaaggatcgaatgtggtatctgcagagctgcctacggaaagagtccgacaaagagtgctccgtggttatttacgactttatccagagctacaaaatcctgctgcttagttgcgggatttcactggaacagtcctatgaggatcccaaagttgcttgctggctcctggacccggatagtcaggagccaaccctgcactccatcgtaacttcgttcctgcctcacgaactgccactgctcgagggtatggagactagtcagggaatacagtcactggggcttaatgcggggagcgagcacagcggccgatacagggcttcagtggagtctattctcattttcaacagcatgaaccagcttaacagtctgctgcagaaagagaatctacaggatgtgtttagaaaggtggaaatgccttcgcagtattgcttagcattgttagagctcaatggtatcggtttcagcactgcagagtgcgagagccagaagcatattatgcaggctaagttagacgctatcgaaacacaggcttaccagctggctggacactcctttagctttacgtcgtccgacgatatcgccgaagtcctgttcctggagctcaagctcccacccaatagggagatgaagaatcagggctccaagaaaactctcggttccacccgcagagggattgataacggccgaaaattacggttaggtcgtcagttcagcacttctaaggatgtcctcaataaactgaaggccctccaccccctccccgggcttatcctcgaatggcgcaggattactaatgcaatcacaaaagtggtgttccccttgcagagagagaagtgcctgaatccgttcctgggaatggagagaatctaccccgtcagccaaagccatactgccaccggaaggatcacctttaccgagcccaacatacaaaatgtgccgcgcgacttcgagataaaaatgcctaccctcgttggcgaatctcctccaagccaggccgttggcaagggactgcttcctatgggccgcggtaaatacaagaaggggttttcagtgaaccctcggtgtcaggcacaaatggaagaacgggctgccgacagagggatgccgtttagcatctctatgaggcacgcttttgtgccattcccgggtggtagcattctggccgcggactacagccaactcgagttgcggatactggctcacctctctcacgacaggcggcttattcaggtgctcaacaccggggctgatgtgttcagatcgatcgcagcagagtggaaaatgattgagcctgaatctgtgggcgatgacctgcgccaacaggccaagcagatctgctatggcatcatttatggcatgggcgccaagtcccttggggaacagatgggaattaaggaaaatgacgccgcttgttacattgacagttttaagagtcgatacacaggaattaaccagttcatgactgagaccgtgaagaattgcaaacgagatggtttcgttcagaccatcttgggaagaaggaggtacctgcctggcattaaggacaacaatccataccggaaggctcatgctgaacgacaggccattaatactattgtgcaggggtccgcagcagatatcgtcaagatcgcaaccgtgaacatccaaaagcagctggagacctttcacagcacattcaaaagccatggacatcgggaaggcatgctacagtctgatcagacaggactcagtaggaagagaaaactgcaagggatgttctgtccaattcgtggcggcttctttattctgcagctgcatgacgagctgttgtacgaggtggccgaagaagacgtcgtgcaggtagcccaaatcgtgaagaatgaaatggagagcgcagtgaaactctctgtgaagctcaaggtcaaagtgaaaatcggagcctcgtggggtgaactgaaggattttgacgtgtag

SEQ ID NO: 200059 - DNA, 240 bp, Artificial Sequence
  Description of Artificial Sequence: Synthetic coding sequence
atgggccggaagcggctgatcaccgacagctaccccgtggtgaagcggcgagaaggcccagccgggcactctaaaggcgagttggcacccgagctgggtgaagagccccaacctcgcgacgaagaagaagccgagttggagctgttgaggcagttcgacttggcatggcagtatggaccctgcaccgtgtcaggtattagcatcccttatgaggctccacgaaaaacttcgtgtccatag

SEQ ID NO: 200060 - DNA, 324 bp, Artificial Sequence
  Description of Artificial Sequence: Synthetic coding sequence
atgggccggaagcggctgatcaccgacagctaccccgtggtgaagcgacgggaggggcccgctggacatagtaagggtgagctcgcccccgagctaggggaggagcctcagccacgcgacgaggaggaggctgagctagagctcctcaggcagttcgatctcgcttggcagtacgggccatgcactggcataaccagactacaaagatggtgtcgagcaaaacagatgggccttgaaccacctcccgaagtttggcaggtactgaagacccatccaggcgacccgcgctttcagtgctcattgtggcatctgtatccgctgtag

SEQ ID NO: 200061 - DNA, 105 bp, Artificial Sequence
  Description of Artificial Sequence: Synthetic coding sequence
atgggccggaagcggctgatcaccgacagctaccccgtggtgaagagacgtgaaggcccagccggccactcaaaaggtgagttggccccggagcttgggctgtag

SEQ ID NO: 200062 - DNA, 1266 bp, Artificial Sequence
  Description of Artificial Sequence: Synthetic coding sequence
atggccgacatcagcctggacgagctgatccggaagcggggcgccgccgccaagggcagactgaacgccagacccggagtgggtggagtgagatctagagtcgggatccagcaaggactgcttagccagtctacacgcactgcaacgttccagcagcgcttcgatgctaggcaaaagatcgggctttctgacgccagactcaagttgggggttaaagacgccagggagaagttactacagaaagatgcccgttttcggatcaagggcaaagttcaggacgccagggaaatgttaaatagcagaaaacagcaaacgaccgtgccccaaaaaccccgccaagtggccgacgcgcgcgaaaaaattagcctgaagagaagctcgcccgcggcttttataaacccccctatagggaccgtgactccagctctgaaacttacaaaaactattcaggtgcctcagcagaaggccatggcgcccctgcacccccaccctgcgggaatgagaattaacgtagtgaataatcatcaggctaagcagaacctctacgatctggacgaagacgatgacggaatagccagcgtccccactaagcagatgaagttcgccgcatctggcggctttctacatcatatggctggacttagtagctctaagctgagtatgtccaaggctctgccactgaccaaagtcgtgcagaacgatgcttataccgctccggcacttccaagcagtatcaggacgaaagcacttacaaacatgagcaggaccctggtgaacaaagaggagcccccaaaagaactgcccgccgcagaacccgtgctctcccctctagaggggactaagatgacggtcaacaaccttcacccccgggtaacagaggaggacatcgtcgagctgttctgtgtgtgcggagccctcaagagggcaagactggtgcatcccggcgtggccgaagtggtgttcgttaagaaggatgacgcaattaccgcgtacaaaaagtataacaatcgctgcttagacgggcagcccatgaagtgtaacttacatatgaacggcaacgtgatcaccagcgaccaacccatcttactccggttgagcgacagtccatcaatgaagaaggagtcagagctgccaaggcgtgttaactctgcttcctcctctaaccccccagcagaggtggaccccgacactatacttaaagcccttttcaagagctctggtgctagcgtgacaactcagcccaccgagtttaaaattaaactctag

SEQ ID NO: 200063 - DNA, 558 bp, Artificial Sequence
  Description of Artificial Sequence: Synthetic coding sequence
atggccgacatcagcctggacgagctgatccggaagcggggcgccgcagcaaaggggagattgaacgctcgaccgggtgtcgggggtgtccgttcccgggtgggaattcagcagggcttactgtcccagtctaccaggaccgcgacgttccaacagcgcttcgatgctagacagaagatcggtttgtctgacgcgcgtctcaaactgggtgtgaaagatgctcgagaaaagttgcttcagaaagatgcgcgctttcgtatcaagggcaaagtccaggatgctagggaaatgttgaactcccgaaagcagcagaccaccgtgccccagaaacctaggcaggttgctgacgctagggagaagattagcctaaagcgtagctcaccagcagcgttcatcaacccccccatcggcactgttactcctgcgctgaagctcaccaaaaccatccaagttgggcttcgagccgtgccgttgctgtgccttgtgagcggcggggcgtgggtcgggtccaggagccaagcctcttgtcctcttccgagtggctcccggccgcactag

SEQ ID NO: 200064 - DNA, 1179 bp, Artificial Sequence
  Description of Artificial Sequence: Synthetic coding sequence
atggccgacatcagcctggacgagctgatccggaagcggggcgccgccgccaaagggcgcctgaacgcccggcctggagtgggcggagtgaggagccgggtcgggatccagcagggactcctgtcgcaaagcacccgtacagcaacttttcagcagcgattcgatgcacggcaaaagattggactgtcagatgccagactcaaacttggcgtgaaggacgccagggagaaattattacagaaagacgcccgatttaggataaaaggtaaggtgcaggatgcccgcgagatgctgaactctcgtaaacagcaaaccaccgttccgcagaaacctaggcaggtcgccgacgcaagagagaagatatctctgaagaggtccagcccagctgctttcattaaccctcctatcgggacagtgactccagccctcaagctgaccaagaccatccagaacctgtatgatctcgacgaagatgatgatggtattgctagcgtgccaactaaacagatgaagttcgccgctagcggtgggttcctgcatcatatggccggtctgtcctccagtaaactgtctatgtccaaggcgctcccgctaacgaaggtggtacaaaacgacgcctataccgcacctgccctgcccagttccatccgcaccaaggctcttaccaatatgagtaggactctggtgaataaggaggagccccccaaagagctccccgctgctgagcccgtactctccccgctcgaaggaacaaagatgaccgtcaataatctgcaccctagagtgactgaagaggatattgtcgaacttttttgcgtatgcggggccctcaaaagggcgcggctcgtccacccaggtgtcgccgaggttgtgtttgtgaaaaaagacgatgccattacggcatacaagaagtacaacaataggtgcctggatggacagcccatgaagtgcaatctgcacatgaatggcaatgttattactagcgatcagcctatcctactacgcttatctgacagcccatcaatgaaaaaagagagtgagctgccccggcgtgtgaacagcgccagcagctccaaccctcctgctgaggtggaccccgacacaatcctcaaggcactgtttaagagttctggggcttcagtgactacccagccgaccgaattcaaaataaagttgtag

SEQ ID NO: 200065 - DNA, 690 bp, Artificial Sequence
  Description of Artificial Sequence: Synthetic coding sequence
atggccgacatcagcctggacgagctgatccggaagcggggcgccgcggcgaaaggccgacttaacgcccgcccaggtgtcgggggggttcgctcccgcgtggggatccaacaaggcctgctttcacaaagcacgagaacagccacgttccagcagcgctttgacgcaagacagaagatcggcttgtctgacgctagacttaaactcggggtcaaagacgcaagagagaagctgcttcaaaaagatgcccgatttcgcattaaaggcaaggtacaggatgctcgggaaatgctgaacagccggaagcaacaaacaaccgtgccccagaagcccagacaggtcgctgacgcccgcgagaaaatcagtctaaaaaggtcatcccctgcggcctttattaatccgcccatcggaaccgttacacccgctctgaagctgaccaagacgattcagaacctgtacgaccttgatgaggatgacgacggaatcgcgtccgtgcccaccaaacagatgaaattcgcagcctcaggcggatttcttcatcacatggcaggtctgagttcttccaaactgtccatgagcaaggccctgcccttaacaaaagtagtccagaatgacgcatataccgccccagccctgccctctagcatcagaacaaaagcccttcctgttctgacctcaccaggcacctag

SEQ ID NO: 200066 - DNA, 561 bp, Artificial Sequence
  Description of Artificial Sequence: Synthetic coding sequence
atggcccccctgcacccccaccccgccggcatgcggatcaacgtggttaacaatcaccaggcgaagcaaaacttatacgatctcgatgaagatgatgatggcattgcttcagttccaactaaacagatgaaatttgccgcaagcggtgggttccttcaccacatggccgggctgtcaagctccaaattgagtatgtcaaaggccctgcccctaaccaaagtagttcagaacgacgcgtataccgcgcccgctttgccaagctctatacgcacaaaggccctgacaaacatgtcgcggacactagttaataaggaggaacctcccaaagagctgccagccgcagagcctgtgctctcccctctagagggaacaaaaatgactgtcaacaacttgcacccccgggtcaccgaagaagatattgttgaactcttctgcgtgtgcggtgcactaaaacgcgcaagactggtccatcctggtgtggccgaggtcgtcttcgttaaaaaggacgatgctatcaccgcttataaaaagtacaataaccgatgtctagatggaggatag

SEQ ID NO: 200067 - DNA, 555 bp, Artificial Sequence
  Description of Artificial Sequence: Synthetic coding sequence
atggccgacatcagcctggacgagctgatccggaagcggggcgccgctgcgaagggcaggttgaatgcaaggccaggagttggaggcgttagatccagggtggggattcagcaggggctgctttcacagagtacaagaacagctacttttcagcagcggtttgatgccaggcaaaaaattgggctctccgacgctcgcctaaagttgggagttaaagatgctagagaaaagcttctgcagaaagatgccagattcagaattaaaggcaaggtgcaggacgcccgggaaatgcttaattctagaaaacagcagacaacggtgccccagaagccccggcaggtggcagatgcaagagaaaagatttctctcaaaagatccagtcctgccgcctttattaacccccccatcggtacagtcaccccggccttgaagctaactaaaacaatccaggtgccttccttcccgtgtccacgacccagcctcagcccaaaatggtttcggatgatgcacactcaactactgctaagcctacctctgttcgagcagaaaccgtag

SEQ ID NO: 200068 - DNA, 354 bp, Artificial Sequence
  Description of Artificial Sequence: Synthetic coding sequence
atggccgccgccgccgccgccggcagcggcaccccccgggaggaggaggggcccgccggggaagccgcggcatctcagccacaggccccgacgtctgttcccggcgccaggctctcgcggttgccactcgcccgggtcaaggccctggtaaaggccgaccctgatgtcactcttgccggtcaggaggccattttcatcctggcaagggccgccgaactcttcgtcgaaaccatcgccaaggatgcctattgctgtgcccagcagggaaagagaaagaccttacagagaagagatttggataatgctatcgaggccgtggatgaatttgcgttcctggaagggaccctcgattag

SEQ ID NO: 200069 - DNA, 1029 bp, Artificial Sequence
  Description of Artificial Sequence: Synthetic coding sequence
atggccgccagccaggccgtggaggagatgcggagccgggtggtgctgggagagttcggagtgcgtaacgtgcacacaacggacttcccagggaactactcgggttacgacgacgcttgggaccaagaccgattcgaaaaaaatttcagagtcgacgtggtccatatggacgagaatagcctggagttcgatatggtgggaatcgatgcagctatcgcgaatgcatttaggcgtattctgctggccgaggtgccgacaatggcggtggagaaggtcctggtgtacaacaacacctcgatagtacaggatgagatcttggctcatcggctcggactaatccccatccatgctgacccacgcctgttcgagtacagaaaccagggcgacgaggaagggacagaaatcgacacactccagttccgcctgcaagttaggtgtacccggaatcctcatgccgcaaaggattccagcgacccgaatgagctgtacgttaaccacaaggtttacacccgacatatgacatggatcccactggggaaccaagccgatttgttccccgaggggaccattagacctgtgcacgacgacatccttatagcacagctgcgccctggacaggaaatcgacctgctgatgcactgcgtgaaagggatcgggaaggatcacgccaagttcagtcctgtggcaacagccagttatcggctgttgccagatatcactctgctcgagcctgtggaaggagaggccgcagaggagctgagtaggtgcttctcccccggagtcatcgaggtgcaggaagtgcaaggcaagaaggttgcccgggtggccaaccctcggcttgacacctttagtagggaaatttttaggaacgagaagttaaagaaagtcgtcagactcgcgagggtacgggaccactatatatgtaagaaagacttgctcgccgccgtcgcacatacatgtaatcccagcaccctcggcggtcagggcgaatggattactggatctcgtgagcgtgaccacccaggctag

SEQ ID NO: 200070 - DNA, 633 bp, Artificial Sequence
  Description of Artificial Sequence: Synthetic coding sequence
atggccgtggagaaggtgctggtgtacaacaacaccagcatcgtgcaggatgaaattttggcccaccgcctcggacttatcccaatacacgctgatcccagactgtttgaatatcggaaccaaggtgacgaagaggggaccgagatagacaccctccagttcaggctgcaggtacgatgcacccgcaacccccacgccgcaaaggattctagtgatcctaatgagctctacgtgaaccacaaggtgtacactagacacatgacctggatcccactgggaaatcaggcagatttatttccagagggcacaatacgaccagtccacgatgatatcctgatcgcacagctacgcccaggacaagagattgatcttttaatgcactgtgttaaagggattggtaaaaaggttgccagggtggccaatccccggttggatacattctccagagagatatttcgcaacgaaaaactgaaaaaggtcgttcgtctagcacgggtgcgcgaccattatatcttctctgttgagtccacaggagttctgccccccgatgttctggtgtcggaggcaattaaagtcttaatgggcaaatgccggagatttcttgatgagttggacgctgtccaaatggactag

SEQ ID NO: 200071 - DNA, 1041 bp, Artificial Sequence
  Description of Artificial Sequence: Synthetic coding sequence
atggccgccagccaggccgtggaggagatgcggagccgggtggtgctaggcgagtttggagttcgcaatgtgcatacaactgactttccaggtaactactccggctacgacgacgcgtgggaccaggaccgtttcgagaagaactttcgggtcgatgtcgtacatatggacgagaattctctggaatttgatatggtgggcattgacgccgccatcgcgaacgcattcaggcgcatcttattggccgaggtaccaaccatggccgttgagaaagttttggtatacaacaatacatctatcgtgcaggacgagatcctagcacaccgacttggactcattcctattcatgccgatccgcgactgtttgagtacaggaatcagggcgatgaagaaggcaccgagattgataccttacagttccggttgcaggtccgctgtacccgtaatcctcatgctgctaaagattcaagcgatccgaacgagctctacgtgaaccacaaggtttacacccgccatatgacttggattcctctcgggaatcaggccgatcttttcccagagggcaccattagaccagtgcacgatgatattctgattgcccagctgagaccaggtcaggaaattgacctgttaatgcactgcgtgaaagggatcggaaaggaccatgcaaagtttagccctgtagcgacggcaagttaccgattgctccctgatattaccctacttgagcctgtggaaggtgaggcggcagaggagctgagccgttgcttttctcctggcgttattgaagttcaagaagtgcaaggaaagaaggtggcaagagtcgcaaacccacgcctagacaccttttcacgcgaaatctttcgcaacgaaaagctcaagaaggtggtgcgactggctagagttcgggatcattatatctttagcgtcgagtctactggcgtcttacctcctgatgtacttgtgtccgaagctatcaaggtgctgatggggaaatgtaggcgtttcctggacgagctggatgctgtccaaatggactag

SEQ ID NO: 200072 - DNA, 369 bp, Artificial Sequence
  Description of Artificial Sequence: Synthetic coding sequence
atggaggaggaccaggagctggagcggaaggccatcgaggagctgctgaaggaggccaagagagggaaaactcgtgcagaaaccatggggccaatgggttggatgaaatgccccctggctagcacaaataaaaggttcctgatcaacactataaagaataccctccccagccacaaagagcaagaccatgagcagaaagagggcgataaggagccggccaagtcccaagcccagaaggaggagaacccaaagaagcacaggtcgcatccatataaacattctttccgggcccgcggatccgcgtcctattctccgcctagaaagagatcgagccaagacaaatatgaaaagcgctccaacaggcgctag

SEQ ID NO: 200073 - DNA, 402 bp, Artificial Sequence
  Description of Artificial Sequence: Synthetic coding sequence
atggaggaggaccaggagctggagcggaagatcagcggcctgaagacaagcatggcagagggtgagcggaagaccgctctggagatggtacaggctgctggaaccgaccgccattgcgtgacattcgtgttgcatgaagaggaccacacgctgggcaattctctgcgctacatgatcatgaaaaacccagaggtggaattctgcggctataccacaacccatccgtccgaaagcaagatcaaccttcgaattcagactaggggtaccctgccagcggttgaaccttttcagcgcggactgaacgagctcatgaatgtctgccaacacgtgctcgacaaattcgaagcatcgattaaagactacaaagatcaaaaggctagtcggaatgagtctactttctag

SEQ ID NO: 200074 - DNA, 402 bp, Artificial Sequence
  Description of Artificial Sequence: Synthetic coding sequence
atggaggaggaccaggagctggagcggaagatcagcggcctgaagactagcatggcagaaggggaacgcaagaccgcattggaaatggtgcaggcagcaggcaccgataggcactgcgtcacatttgttctgcacgaggaagatcacacactggggaactcattgagatacatgatcatgaagaatcccgaggtcgaattctgtggctacaccacaacccaccccagtgagtccaagatcaacctgaggattcagaccagggggaccctccccgccgtagagcccttccagagaggactaaatgagctcatgaatgtgtgccagcatgtgctcgacaagttcgaagcatccattaaagattataaagatcagaaagcttcccgcaatgagtcaacgttctag

SEQ ID NO: 200075 - DNA, 5913 bp, Artificial Sequence
  Description of Artificial Sequence: Synthetic coding sequence
atgcacggcggcggcccccccagcggcgacagcgcctgccccctgcgaacaatcaagcgggtgcagttcggtgtactgtctcccgatgagctaaagaggatgagcgtcacagagggcggcattaagtaccccgaaactaccgagggcgggcggcccaaactcggcggcctcatggacccccggcagggcgtgatcgagaggaccggtagatgccagacctgcgcggggaacatgaccgagtgtcctgggcatttcgggcatatagagttggccaagcctgtgttccatgtcgggttcttagttaaaactatgaaggtcctaagatgtgtgtgctttttttgcagcaaactgctcgtcgacagcaataatcctaaaatcaaagatattctggcgaagtctaagggccaacctaagaaacgcttgacgcatgtgtacgacctttgcaaagggaaaaacatatgcgaaggaggcgaggagatggacaacaagttcggcgtggagcaaccagaaggagatgaagatttgactaaggaaaagggccatggcggctgcgggagataccagccaagaatcagaagatctggacttgaactgtacgcggaatggaaacacgtcaacgaggattctcaagagaagaagatcctcctctcacctgaaagggtgcatgagattttcaaacgcatatccgacgaagagtgctttgtactggggatggaacccagatacgcacgccccgagtggatgattgtgaccgtgctgcctgtaccgcccctgagcgtccggcccgcagtcgtgatgcaaggctctgcccgcaaccaggatgacctgacccacaaattagccgacattgtgaagatcaataaccagctgagacgcaacgagcagaatggagccgccgcacacgtgatcgcagaggatgtgaagctgctgcagttccatgtagccaccatggttgacaacgagttgccaggactgcctagggctatgcagaagtcagggagaccgctcaaaagcctcaagcaaagactgaaagggaaggagggacgggtgagaggaaacctgatgggaaagcgggtcgatttcagcgcaagaactgtgatcaccccagacccaaatctaagcatcgaccaagtgggagtccccagaagcatagcagccaatatgaccttcgccgagatagtaacaccattcaatatcgaccgcctgcaagagctggtgaggaggggaaatagccaatatcccggcgccaagtatatcatacgcgacaacggggataggatagatttacgcttccaccctaaaccctctgacctgcacctgcagacaggatacaaagtggaaaggcatatgtgcgacggcgacatcgtgatttttaacaggcagcctactctgcacaaaatgtctatgatgggacatcgggtgaggattctgccgtggagtacattccgcctgaatctttctgttactactccctataatgccgactttgacggggacgaaatgaatttacacctgccccaatctctggaaactcgtgccgagatccaggaattggccatggtcccccggatgatagttacaccccaaagcaaccggccggtcatgggcattgtgcaggacacattgacagctgtgaggaagttcactaagcgggatgttttcctcgagcgtggcgaggtgatgaaccttttgatgttccttagcacatgggacggaaaagttccacagccagccatcctaaagcccaggccactctggaccggcaaacagatcttcagcttgatcatcccaggacacattaactgcatccgaacacatagcactcatccagacgatgaggactcaggaccctataaacacatatcgcccggggacactaaggtggtggtggagaatggggaactgatcatgggcattctttgtaagaagtcattgggcacttcagccgggtccctagtacacatcagctacttagaaatgggtcacgacattacacgattgttctattcaaatattcagaccgtgatcaacaattggctcctgatcgaaggacacactatcgggattggagactcgatcgctgatagcaagacataccaggacatccaaaatacgattaagaaagcaaagcaggatgtgatcgaggtcattgagaaggcgcataataacgaactggagcccacgcctggaaacaccctgaggcagacatttgagaatcaggtgaaccgcatactgaacgatgcaagggataaaaccgggtcttccgcacaaaagtccctgtcggagtataacaattttaagtccatggttgtgtctggcgctaagggatctaagattaatatctcccaggtgattgctgtggtcgggcagcagaatgtggaaggaaagcgtataccctttggcttcaaacatcgtaccctaccccactttattaaggatgactacggacctgaatcccggggattcgtggaaaactcatatctcgctggactgacccccaccgagtttttctttcacgctatgggtggccgggaaggtttaattgatacagccgttaaaacagccgagactggctacatccagcggaggctgatcaagtcaatggaatctgtcatggtaaaatatgacgcaaccgttaggaattctattaatcaggtggtgcaactgcggtatggagaggacgggctggcgggtgaatcggttgaatttcaaaacctggcaacccttaagccaagcaacaaggcctttgaaaagaaatttcgtttcgactacaccaatgagagggctctgcgacggacgcttcaagaggatttggtaaaagatgtgctgagcaatgcccacatccaaaacgaactggagcgcgagttcgagcgtatgcgcgaagaccgtgaagttctccgcgtcatctttccaacaggcgactctaaggtggtcctgccttgtaatttattgagaatgatctggaatgcccagaagattttccacatcaatccaaggctaccaagtgatctgcatccaattaaagtcgtggagggcgtgaaggagctctccaagaaactcgttatagtgaacggagacgaccccttgagccggcaggcccaggagaatgctaccctgttattcaacattcacctgcgctctactctatgcagtcgcagaatggctgaagaatttaggctatctggcgaagcctttgattggctcctgggcgaaattgaatctaagttcaaccaggcaatcgcacatccaggcgaaatggtgggagctctggccgcacaaagtcttggggagccagcaacccaaatgacgttgaacacattccattacgccggagtctctgccaaaaacgtcaccctgggggtgccccggctgaaagagcttatcaatatcagcaaaaaacctaagacgccatctctcactgttttcctcctggggcagtcagccagagacgccgaaagagctaaggatatactatgtagactggagcacaccactctacgaaaggtgacagcgaatacagctatttactatgatcctaatccacagtccaccgtcgttgccgaagatcaggagtgggtgaatgtttactacgagatgccagattttgatgtcgctaggatctccccttggctcctcagagtggagctggaccggaaacatatgacagatcgcaagttaaccatggaacaaatagccgagaagattaacgccggattcggggatgatctgaattgtatctttaatgatgacaacgctgagaagcttgtactgagaataagaattatgaattccgacgaaaacaaaatgcaggaagaggaggaagtggttgataaaatggatgatgatgtgtttctgcgctgtatcgagtctaacatgctgaccgatatgacgctgcagggtatcgagcaaatttcaaaggtgtatatgcatctcccacagaccgacaacaagaaaaagattatcattacagaggacggcgaattcaaagcactgcaggaatggattctggaaaccgacggcgtcagtctgatgagggtgctctctgagaaggatgtggaccccgtgcgcaccaccagcaacgatatcgtggaaatctttacggttctgggaatcgaggcagtgcgcaaagccttggaaagagagctataccacgtgataagctttgatggctcatacgtaaattaccggcacctagcccttctgtgcgacaccatgacatgtcgaggccacttgatggcaattacccgtcacggcgttaaccggcaggatactgggccccttatgaaatgctcattcgaggagacagtcgacgtcctgatggaggcagctgcccacggcgaatctgatcccatgaagggagttagtgaaaacataatgcttggacagctcgctccagcaggcacgggttgcttcgaccttctgctggatgccgagaaatgcaaatatggaatggagattcctacaaatattcccggtctgggggccgccgggccaactgggatgtttttcgggtctgccccctcacctatgggaggcatctcacccgcgatgactccatggaatcagggggcaacaccggcctacggcgcatggagtccttcagtaggctccgggatgacaccaggcgcagccggcttcagcccatccgctgcctctgacgccagcggattctctcccggttattcgcccgcatggagccctaccccgggctctccgggaagccctgggcctagttctccctatattcccagcccaggaggagcaatgtcaccgtcatactctcccacctcaccagcttacgagccccgcagtccaggcggctacaccccacagagtccgagctattcgcccacatctccaagctattcacctacgtctccatcatactcccccacatcccctaattactctcctacgtccccgagctatagtcccacaagcccttcatatagtccgacctctccatcttactcacccacaagtccatcatactcacctactagcccctcctacagtccaaccagcccctcttatagccctacgagcccctcatacagccccacttctccatcttatagccccacgtccccatcatactcccccacatctccgtcatattcccccacttcaccgtcatatagccctaccagccccagctattccccaaccagccctagctactcgcctacttccccttcttattctccaacttccccatcttactctccaacctcccccaactatagcccaacctctccaaattacacacccacgtcgccctcctactccccaactagcccaagctattcccccaccagtcccaattacaccccaacatcgcctaactacagcccaaccagtcccagctattctccaacctccccgtcctattcacctacctccccaagctattccccatcttctccccgatatactccccagtctcccacctacacacctagctccccttcatactcaccttccagcccgtcatactctccagccagcccaaaatatacacccactagcccaagctatagtcctagcagccctgagtatacccctacaagccccaagtactcacccacgagccccaaatacagccctacctctcccaagtactctccaacatcaccaacatattcacccaccacaccaaagtatagtccaacctccccgacctacagcccgactagtccggtctacacccctacaagccctaagtacagccctactagtccaacttatagccctacttcccctaagtattctccaacgtcgcccacttacagtccgactagtcccaagggatccacatactctccgacctctccagggtactctcctacatcccccacctattctctgacctcccccgccatcagccccgatgactctgacgaggagaactag

SEQ ID NO: 200076 - DNA, 1626 bp, Artificial Sequence
  Description of Artificial Sequence: Synthetic coding sequence
atgcccggccggtgccagagcgacgccgccatgcgggtgaacggcccagcgagccgggcgcccgcaggctggacgtccggctcccttcacacaggccccagggccggaagaccaagagcccaggcaagaggggtgcgcggaagaggtctccttctcaggcctagacctgcaaaggaactcccactccctagaaaggggggtgcttgggcccccgccggtaaccctgggcctctgcaccccctcggagtggcagtgggcatggcaggatcggggcgcctggtactgcgaccctggatccgcgagctgattcttggttcagaaaccccaagctccccccgggctggtcagttgctcgaggacgccgaagccgcagtggctgggccctcacatgcacccgacaccagcgatgtgggcgccacacttcttgtatccgatggcacgcacagcgtgagatgtctggtcacccgtgaggccctggacaccagcgattgggaagagaaagagttcggcttccgtggaactgaggggcggctccttctcctgcaggactgtggcgtccacgtacaagtggccgaaggcggagcacccgcagagttctacttgcaggtcgatcgtttcagcctgctacccacagaacaaccaagactgagggttcccgggtgcaaccaggacctggacgtgcagaaaaagctttatgactgcctggaggagcacttaagtgaatctacatcctccaacgcaggcttgagccttagtcaactgctggatgagatgagggaggaccaggagcaccaaggcgctttggtgtgcctggcggagagctgtttgacgcttgaagggccctgcaccgctccaccagtgacacactgggccgctagtcggtgtaaagccactggggaggctgtatacacagttcctagtagtatgttgtgtatctctgaaaacgaccagctgattctcagttccctgggaccttgccagcgaacgcaagggcctgagctccccccccctgacccagcgctgcaggatttaagcctcactctgatcgcatccccaccatcatccccatcttcttctggaactcccgcacttcctggccacatgtcgtcagaagagagtggcacaagcatatccctgcttcccgctctcagtttggctgcgccagaccccggtcagagaagcagctctcagccttcacctgccatatgttctgcccccgccaccctgacacctcgctctcctcatgcctctagaacccccagctcccctctgcagtcctgtactcctagcctgtcacctcgtagccacgtgcccagccctcaccaggccttagtcactaggccccaaaaaccttccctcgaatttaaggagttcgttggcctgccgtgcaaaaaccgcccgcctttcccacggacaggtgccacaagaggggctcaggagccgtgttctgtttgggagcctccaaagcgccaccgagacggttccgctttccagtatgagtacgagcccccttgcacttcgctgtgcgcccgagtgcaggccgtgaggctccctcctcaacttatggcttgggcactccacttcctgatggacgctcaacctggaagtgagcccacacccatgtag

SEQ ID NO: 200077 - DNA, 2040 bp, Artificial Sequence
  Description of Artificial Sequence: Synthetic coding sequence
atggaccgggtgacccggtaccccatcctgggcatcccccaggcccacaggggtactggactggtccttgatggggataccagctacacctaccacttggtgtgcatgggcccggaggccagcgggtgggggcaggatgagccgcagacctggcctactgaccacagggcgcaacagggggttcagagacaaggggtcagttatagcgtgcatgcgtacaccggccagcctagccctagaggtctgcacagcgagaatagagaggacgaaggatggcaggtgtataggctaggcgctagagacgcccaccaaggacgacctacatgggccctgcgcccagaggatggtgaggataaggagatgaagacatatcgccttgacgccggtgatgccgacccccgacgactctgtgaccttgaaagggagcgctgggccgttattcagggtcaggcggtgcggaaatccagcaccgtggccacgcttcaggggacaccggaccatggggacccccgtaccccgggaccacctagatcaacacccctggaagagaacgtcgtggatcgcgaacagattgactttcttgcagcgcgacagcagttcctgtccttggaacaggccaataaaggcgcacctcacagctcacctgcacgcggaacgccagcaggtactacacccggtgcatcccaggcccccaaggcctttaataagcctcaccttgccaatggacatgtggtgcctattaagccacaggtgaagggtgtagtgcgggaggaaaacaaggtaagggctgtaccaacttgggccagtgtgcaggttgttgacgacccaggatctttggcctcagtagagtctcctgggacgccaaaggagaccccaatcgaacgggagattcgactggcccaggaaagggaggcagatctgcgggagcagaggggcctgcgccaggccaccgaccaccaggaattggtcgagattccaacaaggcctttgctgaccaaactaagtctgatcacagccccaagacgggagcgcggcaggccatcactttatgtgcagagagatattgtgcaggagacgcagcgcgaagaagaccatcggcgtgaaggactacatgtggggcgggccagcacccccgactgggtttccgagggtccacagccaggcctcagacgagcactctcatcggatagtatactttcccccgcaccagatgcccgtgctgccgaccctgctcctgaagtccgaaaagtgaacaggatccctcctgacgcctaccagccatacctgagcccgggtacgccacaactggaattcagcgcttttggtgctttcggtaaaccaagctcgctcagtactgcagaagcaaaggccgctacatctcccaaggccactatgtcccccaggcatcttagcgaatctagcggaaaaccactctcaacaaaacaggaagcaagcaagcccccccgaggatgcccacaagcaaataggggcgttgtcaggtgggaatattttagactgaggccacttcgtttccgagctcccgacgagccacagcaagctcaggtgccacacgtgtggggatgggaagtggctggtgcccccgccctgcgtttgcaaaaatctcagagctcagacctgctggaaagggaacgggagagcgtgttacgtcgagagcaggaagtggcggaagagagacgaaacgccttgttcccggaggtgttcagccctactcccgacgaaaattccgatcaaaattcacgatcttcatctcaggcaagtggtattaccggaagttattctgtcagtgagtcgccgttctttagcccgatccacctgcactcaaatgtcgcttggaccgtggaggaccccgttgatagcgccccaccagggcagcggaagaaggagcagtggtacgccggaatcaacccttccgacggtattaacagcgaagttctggaggcaattagggtgaccaggcacaaaaacgccatggcggagagatgggagagccgcatatatgccagcgaagaggacgactag

SEQ ID NO: 200078 - DNA, 381 bp, Artificial Sequence
  Description of Artificial Sequence: Synthetic coding sequence
atgagcgacaacgaggacaacttcgacggcgacgacttcgacgacgtggaagaggacgaagggctggatgatttggagaacgcagaagaggaaggccaggaaaatgtggaaattcttccttcaggcgagaggcctcaagccaaccaaaagcgcattacgacgccatatatgactaaatacgagcgagccagagtgctgggcaccagagccctgcagattgcgatgtgcgcacctgtgatggtcgagctcgagggagaaacggacccgctgctgattgccatgaaagaactgaaactcttgtgggggctcgagtatacagttctccggccttcctatgctcttgctcattcgctcggctccttctccatctccagccgctag

SEQ ID NO: 200079 - DNA, 477 bp, Artificial Sequence
  Description of Artificial Sequence: Synthetic coding sequence
atgagcgacaacgaggacaacttcgacggcgacgacttcgacgacgttgaggaagatgagggcctggatgatttagagaatgcagaagaagaaggacaggagaacgtggaaatcttgcctagtggagaacgacctcaggctaatcaaaagcgtatcactacaccctatatgacgaagtatgagagagctagagtgcttggcacacgcgccctccaaatagccatgtgcgcacctgtcatggtcgagttagagggcgagacggacccgctgcttattgccatgaaggagctgaacgcacgctctgcctccgaaccccctggcgaagagccgccatggatggacagaggtacacgagatgagcacctgcccagctgtcccggttgtcctgccgtggcttccaacacccgatgttgtcccccagccgcctgtcttccgggtatctcgctgtccaggcgccgccgcctacgagaagagtag

SEQ ID NO: 200080 - DNA, 384 bp, Artificial Sequence
  Description of Artificial Sequence: Synthetic coding sequence
atgagcgacaacgaggacaacttcgacggcgacgacttcgacgacgtcgaagaggatgaaggcctggatgatcttgagaacgctgaggaagagggacaagagaacgtcgagattttaccctctggggagcgccctcaggccaatcagaagagaatcaccaccccttacatgacaaagtatgagcgcgctcgcgtgttaggtacccgggctctacagatcgcaatgtgtgcccctgtgatggtcgagcttgaaggggaaacagatccactgttaattgcaatgaaagaattgaaggcgcggaagatacccatcattattcgccggtacctgcccgacggatcctacgaggactggggtgttgatgagttgatcattacagattag

SEQ ID NO: 200081 - DNA, 519 bp, Artificial Sequence
  Description of Artificial Sequence: Synthetic coding sequence
atgttctaccacatcagcctggagcacgagatcctgctgcacccccggtacttcggacctaatctgttaaatacggttaagcaaaaactcttcaccgaagtcgaaggaacttgcactggaaaatacggtttcgtcattgccgtcacaaccattgacaatataggcgccggggtgatccagccaggacggggcttcgtgctgtatcccgttaagtacaaggccatcgtttttcggccctttaaaggtgaagtggttgatgctgtggtgactcaggttaataaagtggggctcttcaccgaaattggtcctatgagctgcttcatctcgcggcactctataccaagcgagatggagttcgacccaaattctaacccgccctgttacaagaccatggatgaggacattgtgatccaacaggacgatgaaattcggttgaaaatcgttggaacacgtgtggataagaacgatatcttcgccatcggctcgcttatggacgactacctaggtcttgtgtcctag

SEQ ID NO: 200082 - DNA, 453 bp, Artificial Sequence
  Description of Artificial Sequence: Synthetic coding sequence
atggccggcatcctgttcgaggacatcttcgacgtgaaggacatcgaccctgagggaaaaaagttcgaccgggtgtcccgcctacactgcgagtctgagagtttcaagatggatctcatactcgacgtcaacatacagatctaccccgtcgatctgggcgataagtttaggctggtgattgcctccacactttacgaagacgggaccttggatgatggggagtataatccaacagatgatagaccatctcgagccgaccagtttgaatacgtgatgtacggcaaggtgtacaggatcgagggggacgaaacatctaccgaggccgcaacaaggttatctgcctacgtttcttatggcggcttgttaatgcggctccagggagacgccaacaatctgcatgggttcgaggtggacagccgagtttacctgttgatgaagaagctcgctttctag

SEQ ID NO: 200083 - DNA, 39 bp, Artificial Sequence; identical to SEQ ID NO: 93889
  Description of Artificial Sequence: Synthetic coding sequence

SEQ ID NO: 200084 - DNA, 450 bp, Artificial Sequence
  Description of Artificial Sequence: Synthetic coding sequence
atggccggcatcctgttcgaggacatcttcgacgtgaaggacatcgaccccgaagggaagaagtttgaccgggtcagccgtctgcattgtgaatctgagagtttcaagatggaccttattcttgacgtgaatatacagatctatcccgtcgatttaggcgataaattcagacttgtgatcgccagtactctgtacgaggacggcaccctggatgatggagaatataatccaaccgatgaccggccaagtagggccgaccagtttgagtatgtgatgtatggcaaggtttaccggatcgagggcgacgagacctccaccgaggcagctacccgactgagtgcatacgtgagctatggcggcctgctaatgaggctgcagggcgatgcgaacaaccttcacgggtttgaggtcgacagtagggtttatcttctgatgaagaaactggcgtag

SEQ ID NO: 200085 - DNA, 453 bp, Artificial Sequence
  Description of Artificial Sequence: Synthetic coding sequence
atggccggcatcctgttcgaggacatcttcgacgtgaaggacatcgatcccgaaggtaagaagtttgaccgtgtctccaggctgcattgtgagagcgagtccttcaagatggacctgattctggatgtgaacatacaaatctacccagtagaccttggtgacaagtttaggcttgtcatcgcgagtaccctctacgaggatggcacattggatgatggcgaatataatcccaccgacgacaggccaagcagagccgatcaatttgagtacgtcatgtacgggaaagtctaccgcattgaaggggatgagacatctactgaagccgcaactcggttgtccgcctatgtctcttacggcggactgctgatgaggttacagggtgacgcaaacaatcttcatggtttcgaagtcgattcaagagtgtatttgcttatgaagaagctggcattctag

SEQ ID NO: 200086 - DNA, 1491 bp, Artificial Sequence
  Description of Artificial Sequence: Synthetic coding sequence
atggaggagcagcgggaggccctgcggaagatcatcaagaccctggcagtcaagaacgaagagatccagtcctttatctacagtctaaagcagatgctgttaaacgtcgaggcaaattcggcaaaggtgcaagaagacctggaggctgaatttcaaagcttattctcgcttctggaagaattgaaagaaggtatgctgatgaagatcaaacaggatagggcctccaggacctatgagctgcaaaaccagcttgctgcttgtacccgagccctcgagagctctgaggaactgctggagacggctaatcaaaccctgcaagcaatggatagtgaggacttcccccaggccgccaagcagatcaaggatggggtgactatggcccctgccttcagacttagcctgaaggctaaagtctccgataacatgtcgcacctcatggtggattttgcacaggaacgccagatgctccaagcactgaagttcctgccagtgccctctgcacccgtgatcgacttagcagaatcactcgtggccgataactgcgtgacgcttgtctggcgaatgcctgacgaggactccaagatcgaccattatgttctggagtaccggcggacaaatttcgagggacctcctcgcctcaaggaggaccagccttggatggtgatcgagggcattcggcagaccgaatacaccctgactgggctcaagttcgacatgaaatacatgaacttcagagtgaaggcctgtaataaagccgtggcaggggaattttcagagcctgttactcttgagacaccagccttcatgttcagactggacgccagcactagccaccagaatttaagagtggacgatcttagcgtggaatgggacgcaatgggcggaaaagtccaggatatcaaggcaagggagaaagatggaaagggtcgcaccgctagcccgattaacagcccggcccgaggcacacccagccccaaacgcatgccgtctgggcgcggaggccgcgatagattcacagcagaaagctataccgtcctgggagatacacttatcgatggaggtgaacactactgggaagtccggtacgagcccgatagtaaagctttcggggtgggcgtagcataccgaagccttggaaggttcgagcaactcgggaagaccgctgccagctggtgcttacacgtgaataactggctacaggtgagtttcaccgctaaacatgccaacaaggtcaaggtgctcgatgcacctgtgcccgattgcctcggagtccattgtgatttccatcagggcttgttgtccttctataatgccagaacaaagcaagtgttacatacattcaaaacacgcttcacccagccgctcttaccagcattcacagtgtggtgcggatcattccaagtcacaacaggcctgcaagtgccatctgccgttagatgtctccaaaagcgtgggtcggccacctcaagctccaatacttctctgacatag

SEQ ID NO: 200087 - DNA, 354 bp, Artificial Sequence
  Description of Artificial Sequence: Synthetic coding sequence
atgaacgccccccccgccttcgagagcttcctgctgttcgagggcgaaaagaagatcactattaataaggatactaaggtcccaaacgcctgcctgtttaccattaacaaggaagaccacacactgggaaacataattaagtcccagctgctgaaggacccacaggtcctgttcgccggatacaaggtaccccatccgctggagcataagattatcatcagggtgcagacaactcccgactacagccctcaggaggcttttacaaatgccatcaccgatctgatttcggagctgtcattactggaggaacggttccgcgtagcgattaaggataaacaggagggcatagaatag

SEQ ID NO: 200088 - DNA, 384 bp, Artificial Sequence
  Description of Artificial Sequence: Synthetic coding sequence
atgaacgccccccccgccttcgagagcttcctgctgttcgagggcgaaaaaaaaatcaccattaacaaggatacaaaggtgccaaatgcatgtctcttcacaattaacaaagaggatcataccttgggcaacatcatcaagtcgcagcttctgaaagatcctcaagtgctttttgccggctacaaggtgccacatcccttggagcacaagattatcatcagagttcagactacccccgactattcaccacaggaggccttcaccaacgccatcaccgacctgatctctgaactgtcgctcctagaggagaggttcagggttcgcgccggccctgggggcgccgacggagtggcgatcaaagacaaacaggagggcatcgagtag

SEQ ID NO: 200089 - DNA, 351 bp, Artificial Sequence
  Description of Artificial Sequence: Synthetic coding sequence
atgaacgccccccccgccttcgagagcttcctgctgttcgagggcgagaagattacaatcaacaaggacacaaaggtccccaaagcatgcctctttactatcaacaaggaggaccacacactcggaaatataattaagagccgagcttgctttccgtttgcattctgtagggactgtcagttcccagaagcaagtccggctaccctacccgtgcagccagccgagctttgcccaagagctcaccagttatgcgcccccgctcttaagaggcatctcggcggggaagcccaccccgtgcatcttcacgccggggccgcctcacggccagtgcaacagccacaacatctgtag

SEQ ID NO: 200090 - DNA, 348 bp, Artificial Sequence
  Description of Artificial Sequence: Synthetic coding sequence
atgaacgccccccccgccttcgagagcttcctgctgttcgagggcgagaagatcacaattaataaagacactaaagtgccgaaagcctgcctttttaccatcaacaaggaggaccacacactgggcaacatcatcaaatctcagttactaaaggaccctcaagttctgttcgctgggtataaggtcccccatcccttagagcacaaaattattatacgtgtccaaacaaccccagattatagccctcaggaggcttttacaaacgccatcacagacttgatctcggagcttagcctcttggaagaacggttccgcacatgtctgctccctctgagactactgccgtag

SEQ ID NO: 200091 - DNA, 177 bp, Artificial Sequence
  Description of Artificial Sequence: Synthetic coding sequence
atggacacccagaaggacgtgcagccccccaagcagcagcccatgatctatatctgtggagagtgccataccgaaaacgagataaagagtcgggatcccatccgctgccgagagtgtgggtacagaattatgtataaaaaacgaactaaacggctggtggtgttcgacgctaggtag

SEQ ID NO: 200092 - DNA, 204 bp, Artificial Sequence
  Description of Artificial Sequence: Synthetic coding sequence
atgatcatccccgtgcggtgcttcacctgcggcaagatcgtgggcaataaatgggaggcatacctgggtctgctccaggctgagtataccgaaggggatgctctcgatgcgctcggccttaagcgctattgttgtaggcgcatgctgttggcacacgttgaccttatcgagaagttattgaactacgcaccgctagagaaatag

SEQ ID NO: 200093 - DNA, 204 bp, Artificial Sequence
  Description of Artificial Sequence: Synthetic coding sequence
atgatcatccccgtgcggtgcttcacctgcggcaagatcgtgggcaataaatgggaagcctatctgggactgctacaagccgagtacactgagggcgacgctttggacgcgctcggtctcaagcggtactgctgtcgtcggatgttattggcccacgtggatctgatagaaaagctgctgaactacgcccccctcgaaaaatag

SEQ ID NO: 200094 - DNA, 4173 bp, Artificial Sequence
  Description of Artificial Sequence: Synthetic coding sequence
atggtgaaggagcagttccgggagaccgacgtggccaagaagatcagccacatatgcttcgggatgaagagtcccgaggagatgaggcagcaggcccatattcaggtggtatccaaaaacttgtacagccaagataaccagcacgctcctctcctttacggggtcctggatcacaggatggggacaagtgagaaagaccgaccttgtgaaacatgtggcaaaaacctcgcggactgtctggggcactatggttacattgacctggagctgccatgttttcatgtcggctatttccgcgcagtgattggaatactccagatgatctgtaaaacatgttgccacattatgctgagtcaggaagagaagaagcaattcctagactatctgaagcgacctggactgacctacctgcagaagcgggggctgaagaagaagatctctgataaatgccgcaaaaagaacatctgtcatcactgcggggcctttaacggcacagtgaaaaagtgcggtctgctgaagattatccacgaaaagtataagacaaataagaaggtggtggaccccattgttagcaacttcttacagtcattcgaaaccgccatcgaacataataaggaggtggagcccctgctcggaagggctcaggaaaatctgaacccgttagtagtactgaatctttttaagcggatccctgccgaggacgttccactgctgttgatgaatcccgaagccggtaaaccgtctgatctgatcctcacacgactgctggttccacccctgtgtattcggcctagtgttgtctctgatcttaaatctggtaccaatgaagatgacctcacgatgaagttgaccgaaatcatttttctgaatgatgtcattaaaaaacacaggatttccggggcgaagacccagatgattatggaggattgggactttctgcagctccaatgtgcgttgtacattaacagtgaactgtccggtattcccttaaacatggccccaaagaagtggactcgaggctttgttcagagattgaagggaaagcagggacgcttcagggggaatctgtcaggcaaaagagttgactttagcggcaggactgtcatatccccagacccaaacctccgcatcgacgaagttgccgtgcctgtacatgtggctaaaatcttaacatttcccgagaaagtaaataaagcaaacatcaatttcctgagaaaactggtccagaatggccccgaggtccacccaggggctaatttcatccaacagcggcatacccagatgaagcgttttttgaagtacggaaatagggagaagatggctcaagagctgaagtatggtgatattgtggaacgacatctgatcgatggagatgtcgttttgtttaatcgacagcctagtctgcacaaattgagtattatggcacaccttgcgcgggtgaaacctcacaggacatttagattcaatgaatgtgtgtgcactccctacaatgcggacttcgacggagatgaaatgaatttgcacctgccccagacagaggaggcgaaagccgaggctctggtattaatgggaacaaaggctaacttagtcactccccggaacggagagcccctgatcgccgccatccaggattttctcacgggagcttatctgctgacgttgaaagatactttcttcgacagagccaaggcttgtcagatcatcgcttctatcctcgtgggtaaggacgagaagattaaggtacgcctccccccacctaccatactgaagcctgtgactttgtggactggtaagcaaattttttctgtgatccttcggccatcagacgataaccctgttcgagctaatctgcgcactaaagggaagcaatattgcggtaaaggggaagatctctgcgctaatgacagctatgttacaatacagaactcagagctgatgagtggatcgatggacaaggggactcttggcagcggctctaagaacaacattttctatatcctactccgggactggggccaaaatgaggctgcggatgcaatgtcccggttggctaggctcgcacccgtctatttaagcaatcgggggttttcaatcggaatcggggacgtcacccctggacagggccttctgaaagccaaatatgagctcctcaatgctggctacaagaagtgcgacgagtacatagaagcattgaacacaggcaaactgcagcagcagccaggatgcaccgcagaagaaacgcttgaagctctcattctgaaggagctcagcgtgattcgagaccacgctggcagcgcctgcctgcgggagctcgataagagcaatagcccactgaccatggccctctgtggttcaaagggtagcttcattaacatcagtcagatgatagcgtgcgtggggcagcaagctataagcggcagtagagtgcccgacggttttgagaaccgctccctgccgcacttcgaaaagcactctaagctgcctgctgcaaagggatttgtggccaacagcttctactcgggcctgacccccaccgagtttttctttcacactatggccggaagggagggtctggtggacactgcagttaagactgctgaaactggttacatgcagagaaggctggtgaagagcctggaagacctgtgcagtcagtatgatctcaccgtgaggagcagcacaggagatatcatccagtttatttacggaggggacgggttggatcccgcagctatggagggcaaggatgaaccccttgagtttaaacgcgtcctggataacatcaaagctgtgttcccatgtccttccgagcccgcgctcagcaaaaacgagctcattctcaccactgaaagcattatgaagaagtctgaatttctgtgttgccaggattcattcctgcaagaaatcaagaagtttataaaaggcgtctccgagaagatcaagaaaactagagataagtacggcataaatgacaatggtactacagaaccccgagtcctgtaccagctcgatcgcattacacctacacaggttgagaagtttttggaaacctgtcgagataaatatatgcgtgcacaaatggagcctggctcagccgtaggagcactgtgcgcccagagtatcggggagccaggcactcagatgactctgaagactttccacttcgccggtgttgcctctatgaatattacattaggggttccccgtatcaaggagattatcaatgctagcaaggcgatttctacaccgattatcactgcccagcttgacaaagacgatgacgctgactatgcccgcttggttaagggcagaatagagaagaccttgctgggagaaatcagcgagtatatcgaggaagtattcctgcccgatgactgctttatccttgtgaagctgtctctcgagcggattagactgctgcgcctcgaagtgaatgccgagacagtgcgctattcaatttgtaccagcaagcttcgcgtcaaacctggcgatgtcgcggtgcacggtgaggccgttgtgtgtgtgacacccagggagaactctaagtcctcaatgtattacgttctgcagtttctgaaagaagacctgccaaaagtcgtcgtacagggaattcccgaagtgagtcgcgctgtcattcatatcgacgaacagagtggaaaggaaaaatacaaactgctggttgagggcgacaacctgagagctgtgatggccactcacggggtgaagggtacgcgtaccacttccaataatacatacgaagttgagaaaacattggggatagaggccgccaggactactattataaacgaaattcagtacacaatggtgaatcacgggatgagtattgatcggcgccatgtcatgctgctttccgacctgatgacttacaagggcgaggtcctaggcattacccgttttggattagccaagatgaaagagagcgtcctaatgctggcgtccttcgaaaaaactgcagaccacctgtttgacgctgcctattttggccaaaaggactctgtgtgtggcgtgagcgagtgcatcattatgggcattccaatgaacatcggaactggtttgtttaagttgcttcacaaagcggacagggatcctaaccctcctaaacgcccactgattttcgacaccaacgaatttcatatccctctggtcacatag

SEQ ID NO: 200095 - DNA, 489 bp, Artificial Sequence
  Description of Artificial Sequence: Synthetic coding sequence
atgtactacgtgctgcagttcctgaaggaggacctgcccaaggtggtggtccaaggcatccctgaggtcagcagggctgttatccacatcgacgagcagagtggaaaggagaagtacaagcttctagtggagggcgacaatctgagggccgtgatggcaacacatggcgtaaaggggaccagaactacgtcaaacaatacctatgaagtagaaaaaacactgggaattgaggcagctaggaccacaatcatcaatgagatacaatacacaatggtcaatcatggcatgtcaatcgaccggcggcatgttatgctgctgtcggaccttatgacgtataaaggtgaggtgctggggatcacccgattcggactggccaaaatgaaggagagcgtactgatgctggcttcttttgagaagactgcagatcatctgtttgatgccgcctatttcggacagaaagactccgtgtgtgcatggccgcagccctag

SEQ ID NO: 200096 - DNA, 4110 bp, Artificial Sequence
  Description of Artificial Sequence: Synthetic coding sequence
atggtgaaggagcagttccgggagaccgacgtggccaagaagatcagtcacatttgtttcggcatgaaatcaccagaggaaatgcggcagcaagcacacatccaggtggtgtcgaagaatctttattcacaggacaatcagcatgctcccctgctctatggcgttctggaccaccgtatgggcacttctgagaaagacagaccctgcgaaacctgtggcaaaaatcttgctgattgcctgggacattatggatatatagatcttgagttaccctgtttccacgtcggttactttcgcgccgttatcggcatactccaaatgatatgtaagacttgctgccacatcatgctcagccaagaagaaaaaaagcagttcctggattacctcaagaggccgggactcacataccttcagaagcggggcctcaaaaagaagatttccgataaatgtcggaagaaaaatatctgtcaccactgcggggcttttaatggtaccgtaaagaagtgcggtctcctgaagattatacatgagaaatataagacaaacaagaaggtcgtagaccctatcgtgagcaactttctccaatcctttgaaaccgctatcgaacacaacaaggaggtggagccactactagggagggcccaagagaatctgaatcctttagtggtgctcaacctcttcaagagaatccccgcagaggatgtccccttgctgttgatgaatcccgaggcgggcaaacctagcgaccttatccttaccaggctgcttgttccccccctttgtataagaccgtctgtcgtatctgacctgaagtccggaactaatgaagacgatctaaccatgaagctgacagaaattattttcctgaacgatgtcatcaaaaagcatagaataagcggtgctaagacacagatgattatggaagattgggatttccttcaacttcagtgtgccctgtacatcaacagcgagctttctggaatcccgctgaatatggcaccaaaaaagtggaccagagggtttgttcagcgactgaagggtaaacagggtaggtttagagggaacctatccggtaagcgcgtggactttagcgggcggactgtgatctcacccgatcccaacctgcgcattgacgaggtagctgtgcccgtgcacgtggccaaaatccttacttttcctgaaaaagtcaataaagcaaacatcaacttcctccgcaaactggtgcagaacggccctgaggttcaccctggggcaaatttcatccagcagaggcatacgcaaatgaaacggttcctcaagtacggaaatagggagaaaatggcccaagaacttaagtacggggatatcgtggagcgccatttgattgacggtgacgtcgttctgttcaatcggcaaccctctctgcataaattgtccattatggcacacctcgctagggtcaaaccccacaggacatttcgttttaatgaatgcgtttgcaccccctacaatgcagactttgatggggatgagatgaatctccatctgccccagacggaggaggccaaagccgaggcactcgtgctaatgggcacaaaggccaacctcgtgacccctcggaatggagagccactaatcgctgcgattcaggattttctgacaggggcatacctgcttacactgaaggacacttttttcgacagagccaaggcatgtcagatcatcgccagtatacttgtggggaaggatgagaagattaaagtgcgcttgccccctcccacaattctcaaaccagtgaccctttggacagggaagcagatcttcagcgtgattctgcggccgagtgacgacaaccctgtccgagcaaatttgcgtacaaaaggtaagcaatattgtggcaaaggagaagatctctgtgctaacgacagctatgttactatccagaattccgagctgatgagcggcagtatggacaagggtaccttggggagcgggtccaagaataacatcttctatattctgcttcgggattggggacaaaacgaggccgctgacgctatgtccagactggctcgcctagctcccgtctacctcagcaacaggggcttctctattggtattggagacgtgacaccggggcaaggacttctgaaggccaagtatgaactgctgaacgcagggtacaaaaagtgcgatgagtacattgaggcccttaatactggtaaactacagcagcagcccgggtgcaccgccgaagagactttagaggcactcatactgaaagagctttccgtgattcgtgatcatgccggcagcgcctgcctccgagagttggacaagagcaattctcccctcaccatggcactctgtgggagcaaggggtcttttatcaacatctcccagatgatagcctgcgtcggacaacaggcaattagtggtagcagagtgccagacgggttcgagaaccgctctctgcctcatttcgagaagcactccaaattaccagccgccaagggtttcgtcgcaaattccttttacagcggcctcacgcccaccgaattcttctttcatacgatggcggggcgtgagggacttgtcgacacagctgtgaaaactgctgagaccgggtatatgcagcgcaggctggtgaagtctctggaagacctctgttctcaatacgacctgacggtgaggtcttcaacgggcgatatcattcagttcatttatggcggtgatggactagaccccgcagctatggaagggaaagacgaacccctggagtttaaacgtgtgctggacaatatcaaggccgtgtttccatgcccctcagaacctgctctctcaaagaacgagctgatcttgacaacagagagcattatgaagaaatctgaattcctgtgttgccaggactccttcctgcaggagattaaaaaatttatcaaaggcgtgtccgaaaaaattaaaaagacaagagacaaatatggcatcaacgataatggcacaacagagcctagggtattatatcaactagaccgcatcacccctacacaggtagagaaattccttgagacttgccgcgataaatatatgcgcgctcagatggaacccggctctgcggtcggcgctctatgcgcccagaggaacatcaccttgggcgtcccacgaatcaaggagataatcaacgcttcaaaagctatctcaacaccaatcatcaccgcacagttggacaaagatgatgacgcagattacgcacgcctggtcaaaggccgaatagaaaagaccctcctgggagaaatctccgagtacatcgaggaggtattcctgcccgacgattgctttatccttgtgaagctaagcttagagcgaattagactcttgaggctggaagtgaacgccgagacagtccggtacagtatatgcacatccaaacttcgcgtcaagccgggagacgtggccgtgcacggggaagctgtggtctgtgtgacacccagggagaacagcaagtcttctatgtactatgtgcttcagttcttgaaggaggatttgcctaaggtcgtagtccaagggattcccgaagtctcacgcgccgtcatacatattgacgaacagagcggtaaggaaaagtataaactgctcgtggagggagataatctccgggcagttatggccacacacggagtgaagggaacgagaaccactagcaataacacatacgaggtcgagaagacgctgggcatagaagcagctcggaccactataattaatgagattcagtatacaatggtgaaccatggcatgagcattgatagaagacatgtgatgttactatccgatctgatgacctacaagggggaagtcctcggaattaccaggttcggcctcgcaaagatgaaagaatccgtgttgatgctggcatccttcgagaagacagcggaccacctttttgacgctgcctacttcggacagaaagacagcgtttgcggggtgtccgagtgcatcatcatgggaatcccaatgaatattgggaccggattattcaagctgctgcataaagcggacagggacccaaaccctcccaagcggccgctcatcttcgacaccaacgagtttcacatcccactggtaacctag

SEQ ID NO: 200097 - DNA, 753 bp, Artificial Sequence
  Description of Artificial Sequence: Synthetic coding sequence
atgaaggccaccatcatcctgctgctgctggcccaggtgagctgggcaggtccttttcagcagcgcggtctgtttgattttatgctggaggatgaggcctccgggattggccctgaagttcctgacgaccgcgatttcgagcctagcttagggcctgtgtgtccattcagatgccagtgtcatcttcgagtggtgcagtgtagtgacttagaactgggaactaatcccctgaagagcagtggcattgagaatggggcattccaaggcatgaaaaagctgagttacatccgcattgccgatactaatataaccagtatcccgcagggtctgcccccgtccctaacagagctgcatctcgatggcaataagatcagtcgcgtggacgcagcttcactgaaaggccttaacaatctggcaaagcttggactaagcttcaattctatctctgcagtcgacaatggatcccttgcaaacactcctcaccttagggaacttcacctggataataacaagctgacccgggttcccggtggcttagcggaacacaagtatattcaggttgtttatttgcacaacaataatatctcagttgtaggaagcagcgatttctgtcccccaggtcacaacactaagaaagcctcatattctggtgtttccctgttctccaaccctgtgcagtactgggaaatccagccctctaccttcaggtgtgtgtacgtgaggtccgcaatccagctggggaattataagtag

SEQ ID NO: 200098 - DNA, 3228 bp, Artificial Sequence
  Description of Artificial Sequence: Synthetic coding sequence
atgaaggccaacgagaaggtgaccagcgacgccgaccccatgtggtacctcaagtacttaaacatctacgtaggcctccctgacgtcgaagaatccttcaacgtgacacggccggtctcaccacatgaatgtcgacttagagatatgacctatagcgcccccattactgtggacattgagtataccagaggttcccaaaggattatccggaatgccctgcctataggacgcatgcctataatgctgcgctccagcaactgcgtcctgactggaaagactcccgccgaattcgccaagctgaacgaatgtccactggaccccggaggctactttattgtcaaaggagttgagaaagtgatcctcattcaagagcaactgtcaaagaatcggatcatagttgaagccgatagaaaaggagccgtgggggcctccgtgacaagcagcactcatgagaagaagtcaaggaccaatatggccgtgaagcagggcagattttacttacgccacaatactcttagtgaggatattccgattgttattatcttcaaggccatgggcgtggaaagtgatcaggagattgtgcagatgattggcactgaggagcatgtgatggctgccttcggccctagcctggaagagtgtcagaaggctcagatattcacacaaatgcaggcactgaaatatattggtaataaggtgcgcagacagagaatgtggggggggggccccaagaagaccaaaatagaagaggctagggagctcctggcatccacaattctgacccatgtgccagtgaaagagttcaactttcgcgcaaagtgcatttatacagccgtgatggtcagacgtgtgattctggcccagggcgacaacaaggtggacgatagggattattacggcaacaagcggctcgaactggcaggacagctgctcagcctgcttttcgaggacctctttaaaaagttcaactcggaaatgaagaaaattgcagaccaagtgattcccaagcaacgcgcagcccagttcgacgtggtcaagcatatgaggcaagatcagataacaaacggcatggtgaatgcaatatctacaggcaactggagcttgaagcggtttaaaatggacaggcagggtgtgacccaagttctctcaagactttcttacatcagcgctctggggatgatgaccagaatctcaagccagttcgagaagactagaaaagtttcaggccctcgtagtctgcagccatcgcagtggggcatgctatgtccctccgacactccggagggcgaagcctgtggtctggtgaaaaacctggccctcatgacacacataacaacagatatggaggacggcccgattgttaaactcgcttcgaatttgggcgtcgaggatgttaatcttctgtgtggggaggagttgagttatcctaacgtctttctcgtgttcctaaacgggaatattttaggcgtcattcgggaccataagaagcttgttaacactttccgcctcatgcgtcgtgcgggatatattaacgagtttgttagcatcagcacaaacttgacagatcgatgcgtttacatctcatccgatggaggacggctttgtcgcccctacattattgtcaagaaacagaagccggcggttacaaacaaacacatggaagagctggcacaggggtacagaaacttcgaggatttcctgcatgagagcctagtggagtacctggatgtgaatgaggagaatgactgcaatatcgcactttacgaacatacaattaacaaagacacgactcatctggagattgagccatttacactgctcggagtatgcgccggcttaatcccgtacccacaccacaatcagtcgccaagaaacacgtatcagtgtgctatgggtaagcaagccatgggcacgattggctataatcagcgcaatcgcatcgacacactgatgtacctgctggcatatccccagaaacctatggttaagactaagactatcgaactaattgaatttgagaaattgcccgccggtcagaacgcaacggtggcagtgatgtcttactctggctacgacattgaggacgcattagtgctgaacaaggcatctcttgacagagggtttggcagatgtttggtatacaagaatgcaaagtgtaccctgaaaaggtatactaaccagacgttcgacaaggtcatgggacctatgctagatgcagctacacgcaagcccatctggcgtcatgagatacttgatgccgatggaatatgttccccaggcgagaaagtcgaaaataagcaggtccttgtgaacaaatccatgccgacagtgactcagatacctctggaggggagtaacgtgcctcagcagccacagtacaaggatgttccaatcacctataagggcgctaccgattcttatattgagaaggtcatgatcagcagcaacgctgaggatgctttcttgataaaaatgctcctgaggcagactagacggccagaaattggcgacaagttttcaagcagacacgggcagaagggcgtttgcggactgatcgtccctcaagaggacatgcctttttgcgacagcggcatttgcccagatataataatgaatccccatgggtttccgagccggatgacagtgggaaagttgatcgaacttttagcaggcaaggccggcgtcctggatgggaggttccattacggcacggcttttgggggatccaaggttaaagacgtatgcgaggacttggtgaggcatggctacaactatcttggaaaagactacgtaaccagtggtatcaccggagagccactggaagcctacatctacttcggccccgtgtattaccaaaagctcaagcatatggttctagacaagatgcacgcacgggctaggggtcccagagccgtcctaactcgacagccaaccgaagggcgctccagggatggcggcctgcgcctgggagagatggagcgggattgtttaattggatacggagctagtatgctgcttttggaacggctgatgatctcctccgatgcatttgaagtggacgtgtgcggacagtgcggtctgttagggtattcaggatggtgtcattactgcaagagctcctgtcacgtatcttcactcaggattccttacgcctgcaagctgctgttccaggaactgcagagtatgaatattattcctcgcctaaaactcagcaagtataacgagtag

SEQ ID NO: 200099 - DNA, 633 bp, Artificial Sequence
  Description of Artificial Sequence: Synthetic coding sequence
atggacgacgaggaggagacctaccggctgtggaagatccggaagactattatgcaactctgtcatgaccgcggctacctggtgacgcaagatgagctggaccagaccctggaggaatttaaagctcagtcgggagacaaacctagcgaggggcgcccaagaaggaccgacctgacggtgctggtcgcacacaacgatgatcccaccgatcagatgtttgtgtttttccccgaggagcctaaggtgggcatcaagactattaaagtgtactgtcaacgcatgcaggaggagaacattacgcgagctcttatcgtagtgcagcagggaatgaccccatccgcgaagcagtccctcgtcgacatggcaccaaagtatattctcgagcagtttctgcagcaagagttgcttatcaacatcaccgaacacgaacttgttccagaacacgtcgtgatgacgaaagaggaggtgacagagttgctggcaaggtataagctgcgtgagaatcagttgccgagaattcaggccggggatcccgtggcccgatacttcggcataaagcgcggacaagtcgtgaaaattattcgcccttctgaaaccgcgggacgctatataacgtataggctcgtgcagtag

SEQ ID NO: 200100 - DNA, 1173 bp, Artificial Sequence
  Description of Artificial Sequence: Synthetic coding sequence
atggaggaccccaccctgtacatcgtggagcggcccctgcccggctatccagatgccgaggccccagaaccatcctctgccggggcacaggccgcggaggaacccagtggcgctgggtctgaagagttgataaaaagcgaccaggtaaatggcgtgctggtcctgtctctcctcgacaagatcatcggagcagtggaccaaatccaactgacacaggctcaactggaagaaaggcaggcagagatggaaggagcagttcagtccatacaaggcgagctgagcaagttaggaaaggcacacgcaacgactagcaacactgtgagcaaattgctggagaaggttcgcaaggtaagcgtgaacgtgaagactgtacgtgggagcttagagcggcaagcgggacaaatcaaaaaattggaagtcaatgaagcagaattgctacggcgacggaactttaaggtgatgatataccaggatgaagttaagctgcctgcgaaattatctattagtaagagtctgaaagagtcggaagcgcttcctgaaaaagaaggtgaagaactcggcgagggggagcgtccagaggaggatgccgcagctttggaactctcatcagacgaagcggtagaagtagaggaggtgattgaggagtctagggctgaaaggataaagcgaagcggactgcgacgcgtcgatgatttcaagaaggcttttagcaaagaaaagatggaaaagacaaaagtgcgcaccagggagaatctggagaagacacgactcaagacaaaggagaacctggaaaagactcggcataccctggaaaagagaatgaacaagttgggcacgagactggtacccgccgagaggagggagaagctaaaaaccagtagagataagcttaggaagagtttcacacctgaccatgtggtgtacgcccgttccaagactgctgtgtataaagtgcctcccttcactttccatgtcaaaaagattagagaaggccaagtcgaggtcctcaaagccaccgagatggtggaagtgggcgccgacgacgatgagggtggcgctgaacggggagaagcaggcgacctgagacgggggagctctcccgatgtacatgctctgctggaaatcactgaggagagcgatgcagtattagtcgacaaaagtgactccgactag

SEQ ID NO: 200101 - DNA, 1038 bp, Artificial Sequence
  Description of Artificial Sequence: Synthetic coding sequence
atggaggaccccaccctgtacatcgtggagcggcccctgcccggctaccccgatgctgtggatcagatacaactgacacaagcccaactagaggaacgacaggctgaaatggaaggagctgtgcagtccattcagggcgagctctccaagctgggaaaggcgcacgccacaacctctaacactgtgagcaagctcctggagaaagtgaggaaagtcagcgtgaacgtgaaaacagttcggggcagcctggagagacaggccggccaaataaagaagctagaagttaatgaggccgaactgctccggcgtcgaaattttaaagttatgatttatcaggatgaggtaaaactccccgccaagttgtccatcagcaagtccctcaaggaaagcgaagccttacccgagaaggagggggaggaactaggagaaggggaacggccagaggaggatgcagctgccctggagctctccagtgatgaagcagtcgaggtggaggaggtcatcgaagagtcacgtgccgagcggatcaagcgcagtggcctgcgtcgtgtcgatgacttcaagaaggctttttctaaagagaagatggaaaagactaaggtgaggaccagggagaatctcgaaaaaactaggctcaagactaaagagaacttagaaaagaccagacatacactagaaaagaggatgaataagctgggaacccgactggtgcccgccgaaagacgggagaaacttaagacctccagagataagctgagaaaaagtttcactccggaccatgtggtgtacgcgaggagcaaaactgccgtttacaaagttccaccatttactttccacgttaaaaagattagagagggccaggtcgaagtgctgaaggccactgagatggtggaggtgggagcagacgacgacgaggggggggctgaacggggggaagccggcgatctgcggaggggctcaagccccgacgtccacgccttgttggagatcactgaagaaagcgacgctgtgctagtggataaatctgacagtgactag

SEQ ID NO: 200102 - DNA, 2295 bp, Artificial Sequence
  Description of Artificial Sequence: Synthetic coding sequence
atgctgctgttcgtgctgacctgcctgctggccgtgttccccgccatttctaccaaaagccctatatttggtcccgaagaagtcaatagcgtggagggcaactcagtgtccattacatgctattacccccctacctctgttaaccgccacacacgcaagtattggtgtagacagggtgctaggggagggtgtatcaccctgatctcatcagagggctacgtgagtagtaagtatgcaggtagagctaatctcaccaatttccccgagaatggtacttttgtggttaacatagctcaactgtcacaggacgactcaggtcgatacaaatgcgggttgggcattaactcacgcggactctcctttgacgttagcctggaggtgtcccagggcccagggctcctgaacgataccaaggtgtacactgtggacctcggaaggactgtgactatcaattgcccttttaagactgaaaatgcacagaagcgcaagtcactatataagcagattggtttataccccgtgctggtgatcgattcttccggatacgtcaatcctaactataccgggaggattaggctggatatccagggcaccggacagcttttatttagcgtcgtgattaaccaactgagactctctgacgccgggcagtatctctgtcaggctggggatgatagcaacagtaacaaaaagaatgcggacctccaggtgttaaagccggagccagagctggtatacgaggatctgagagggtcagtcacctttcactgcgccctgggcccagaggtggccaatgtggcaaaattcttatgtcggcagagttctggagaaaactgcgatgtcgttgttaacaccctgggaaagagagctcctgcctttgagggccggattctactcaacccccaagacaaagatggttccttttctgttgtcattaccggtctgagaaaggaagacgccgggcggtacctatgtggcgcgcatagcgacgggcagctgcaggagggctcacccattcaggcatggcagctctttgtgaatgaagaaagtaccatccctcgctctcccacagtcgtgaagggagttgctggcggtagcgtggccgtcctgtgcccttacaaccgtaaggaaagtaagagtataaagtactggtgtctttgggagggagcccagaacggcaggtgcccactgctagttgactctgaaggctgggttaaagcccagtatgagggccgccttagtctgttggaggaacccggaaatggaacatttacggtgatattgaaccagcttacgtcccgcgacgcgggcttttactggtgcctcaccaatggcgatactctgtggagaactaccgtggaaatcaagattatcgagggggagcctaacctgaaagtgccaggtaatgtcacggctgttctgggtgagacactaaaagtgccctgtcattttccctgcaaattcagtagttacgagaagtattggtgtaagtggaacaatactgggtgtcaagctctcccgtcccaggacgaaggcccaagcaaggccttcgtgaattgcgacgaaaacagccgtctggtaagcctcacactaaacctggtgacccgagccgacgaaggatggtattggtgtggagtgaaacagggccatttttatggagaaacggccgctgtctacgtcgcagtggaagagagaaaggctgcgggttcccgagatgtgagccttgccaaggccgacgccgcaccagacgagaaggtacttgatagtgggttccgcgaaatcgagaacaaggccattcaagaccctcgtttgtttgccgaggagaaagccgtcgctgatacccgcgatcaggcagatgggagcagggcatctgtggactccggaagtagcgaagaacagggcggttcgtctagggccttggtatctaccctggttccactcgggctcgtcttggcggtcggagccgtggctgtgggagttgctcgggccagacaccgcaagaacgttgatcgagtgtctattagaagttatcgcacagatatatccatgtccgactttgagaacagcagagagtttggagcaaatgataatatgggcgcgtcatctataacccaggagacctcactgggaggcaaagaagaatttgtggccacaactgagtcaacaaccgagacaaaggagccgaaaaaagctaagagatctagtaaagaggaggcggagatggcttataaggacttcctgctgcagtctagcactgtcgctgccgaagctcaagacggcccacaagaagcctag

SEQ ID NO: 200103 - DNA, 1596 bp, Artificial Sequence
  Description of Artificial Sequence: Synthetic coding sequence
atggacggcatcgtgcccgacatcgccgtgggcaccaagcggggctccgatgaactcttctcgacttgcgtgacaaatggtccctttatcatgtcaagcaattctgcttccgccgccaacggaaacgactctaaaaagttcaaaggagacagccgatctgccggtgttccgtctagagtgattcacataagaaagctccccatcgatgtgaccgagggagaggtgatatctctcggactccccttcggcaaggtaactaaccttctgatgctgaaaggaaaaaaccaggcattcatagaaatgaataccgaggaagccgcaaataccatggtaaactattatacttctgtgacccctgtcctgcggggccagccaatctacatccaattttcaaaccataaggagctcaaaactgactcatcgcctaaccaggcgcgcgcacaagcagctttgcaggcagttaacagcgtccaatcaggaaatctggcactggcagcttcagcggcagctgttgatgcggggatggccatggccggtcagtcgcctgtgctgaggattattgtggagaacctattctacccagtcactctggatgtgcttcaccagattttttccaagtttggaaccgtgctgaaaatcattaccttcaccaagaataatcagttccaggcgctcctgcaatacgctgatccagtgtcagcccaacatgcaaagctgtctctcgacggccaaaacatctacaacgcctgctgcaccctgaggatcgatttcagcaagctgacatccctcaatgtgaagtacaacaatgacaagtcaagagactacaccagacctgatcttcctagtggagattcgcagcctagcctcgatcagactatggccgccgccttcggattgtccgtgcctaatgtgcatggtgccctagctccactagctattccatcagcagccgctgctgcagctgctgcgggccgcatcgccatcccaggactcgcaggcgctggaaactctgtgttgttggtgtctaaccttaatccagaacgggtgaccccacagagtctgttcattcttttcggcgtctatggggacgttcaaagagtcaaaattctcttcaacaaaaaagagaacgcgttagttcagatggccgatgggaaccaggcccagctggctatgtctcacttaaacggccacaaacttcatggtaagcccatcagaataactttgagtaaacatcagaacgtgcaactacctcgagagggccaggaggaccaaggactgaccaaggactatggcaattcaccactgcatagatttaagaaacctgggtctaagaacttccagaatatcttccccccgagtgctacccttcacttgagcaatatcccaccctcagtgagcgaagaggacctgaaggtcttatttagtagtaacggaggcgtcgtcaagggtttcaagttcttccagaaggaccggaagatggcattgattcagatgggatccgtcgaggaggcagtacaggccctgattgacctgcacaaccacgacttaggtgaaaaccaccatctgcgtgtctcattcagtaagtccacaatctag

SEQ ID NO: 200104 - DNA, 594 bp, Artificial Sequence
  Description of Artificial Sequence: Synthetic coding sequence
atggacggcatcgtgcccgacatcgccgtgggcaccaagcgggtgaccccacagagtctgttcatcttgttcggggtgtatggggacgtccaacgggttaagattctgttcaacaagaaagagaacgccttggtgcagatggccgatgggaatcaggctcagctggccatgagtcacttgaatgggcataagttgcacgggaaacctatccgcataactctttccaaacatcaaaacgtacagctgccccgagaaggacaagaggaccagggccttacaaaggattatggcaatagtcccttgcaccgatttaagaaaccgggttcaaagaacttccagaacatctttcccccgtcggccactctccacctgtcaaatatacctcctagcgtctcagaggaagacctgaaggtgctgtttagttctaacggcggcgtggtcaaaggttttaagttcttccagaaggatagaaagatggccttaattcaaatgggctctgtggaggaagccgtccaggcgttaatcgacttgcacaaccatgacctgggtgagaatcaccatctgcgtgttagcttcagcaagtctacgatttag

SEQ ID NO: 200105 - DNA, 1674 bp, Artificial Sequence
  Description of Artificial Sequence: Synthetic coding sequence
atggacggcatcgtgcccgacatcgccgtgggcaccaagcggggctccgacgaactgttctcgacctgtgtgacaaacggccctttcatcatgtcatccaattctgcaagcgcagcaaatggcaatgactcaaagaagtttaaaggtgactccagaagcgcaggtgttccctcccgcgtgattcatattagaaagctccccatcgatgtaacagagggagaggttatctctctgggactgccatttggcaaggtgactaacctgcttatgcttaagggaaaaaaccaggcgtttatcgaaatgaataccgaggaagctgcgaatactatggttaactattacactagcgtcacccccgttctgaggggtcagccaatttatattcagttcagcaaccataaggagttaaagacagactcatcccctaatcaggctcgagctcaggcagctctgcaagccgtgaattctgttcagtccgggaatcttgccttagcggcaagtgcagccgccgtcgatgctggcatggcgatggccggccagtcaccagtccttcgaattattgtggagaacctcttttacccagtgacgttggatgtgctccaccagatctttagtaagtttgggactgtgctgaaaattataactttcaccaaaaacaaccagtttcaagctctgttacagtacgccgacccagtttctgcccagcacgctaagctgagtctggatgggcagaacatatacaacgcatgttgtacccttaggatcgacttctccaagcttacatcactcaatgtgaaatacaataacgataagagtcgcgattatactcggccagaccttcccagcggtgattctcagcctagtcttgaccagaccatggcggccgcctttggcgctccgggaatcatcagcgcctcgccttatgctggcgctggctttcccccaacttttgccatcccacaagcggccggcctttccgttccaaatgtgcatggggcactcgcaccactggctatcccttctgccgcggcagccgccgcagccgctggtcgtatcgcgatccctggactagcgggagcaggaaacagcgtactcctggtgtcgaatcttaatcccgagcgcgtgacaccacaatccctgttcattctatttggtgtttatggagacgtgcagcgagttaagattctgtttaataaaaaggaaaacgctctggtgcaaatggcagacggcaatcaggctcagctggctatgagccacctgaatggccacaagctacacggtaagcccatacgcattaccctgtctaaacatcaaaacgttcagctgccacgcgaaggacaagaggaccagggactgacaaaagattatggtaattccccactgcatcggtttaagaaaccaggaagcaagaactttcaaaacatctttccaccctcagcaaccctgcacctgtccaacattcctccaagcgtgtcagaggaggacctcaaagttctgttctcttcaaacggcggggtcgtgaaaggattcaaatttttccagaaggaccggaagatggcgctgatccagatgggttcagtagaggaagccgttcaagccctgatcgacctacataaccacgacttgggtgaaaaccaccacctacgtgtctcattctccaagtcaacgatttag

SEQ ID NO: 200106 - DNA, 1653 bp, Artificial Sequence
  Description of Artificial Sequence: Synthetic coding sequence
atggacggcatcgtgcccgacatcgccgtgggcaccaagcggggcagcgatgagctgttttcaacgtgcgtgacaaatggcccttttatcatgagttctaactctgcctctgccgcgaatggaaatgattctaaaaagttcaaaggggactccaggtccgctggagttccaagtagagtgatccacattcgcaaactgccaattgatgttactgagggcgaggtgatttccctgggcctccccttcggaaaggtcaccaatctcctcatgctcaaggggaagaaccaggcatttatcgaaatgaatactgaagaggctgccaacacaatggtcaattactacacatcagttactcccgtgctccgcggccagcctatctacatccagttcagtaaccacaaggaattaaaaactgattcttctcctaatcaagctcgagcacaggcagcccttcaagcagtgaatagtgttcaaagcggtaaccttgcattggcggcctccgctgcggcagttgatgcgggtatggcaatggccgggcagtctcctgtgttgcgcatcatcgtggagaatctgttctaccccgttaccttagatgttttacatcaaatttttagcaagttcggcaccgttttgaagataattacattcactaagaacaatcagtttcaagccctactacagtacgccgatccagtgtctgcccagcatgccaaactgagcttagatggtcaaaacatctacaacgcctgctgtacactccgtattgactttagcaagctgacctcgctgaacgtgaaatacaataatgataagtcccgggattatacgcggcctgatttgccatctggtgacagtcaaccaagcctcgaccagactatggccgcggcgtttgcatccccgtacgctggggctggattcccacctacctttgccattcctcaagctgccggcttgagcgttcccaacgtccacggagcactagctccgctggctattccaagcgctgctgccgccgccgccgccgctggtcggattgcgattcccgggctggcaggagcggggaacagtgtgcttctggtttcaaatttgaatccagagagggttacccctcagtccctattcatcctctttggagtgtacggtgacgtgcaacgcgttaagatcctgttcaacaaaaaggagaatgccctcgttcagatggctgacggcaatcaggctcagttggccatgtcacaccttaatggccataaactccacggcaaacccataagaataactctgagcaaacatcaaaatgtgcagcttccccgcgaaggccaggaggaccagggcctgaccaaagattacggaaactcccccttacatagattcaaaaagccgggtagcaagaatttccagaatatattccctcccagtgctactctccacctgagcaatataccgcccagcgtttcggaagaggatctgaaggttctgttttccagtaacggcggggtggtgaagggttttaaatttttccagaaggaccggaagatggctctgatccaaatggggtctgtggaggaggcagtccaggcccttatcgatctgcacaaccatgacctgggcgaaaaccaccatctgcgagtgagctttagcaagagtacaatctag

SEQ ID NO: 200107 - DNA, 1599 bp, Artificial Sequence
  Description of Artificial Sequence: Synthetic coding sequence
atggacggcatcgtgaccgaggtggccgtgggcgtgaagcggggctcagacgagctgctatcagggagcgttctctccagtccaaattccaacatgtcatcaatggtggtgacagccaacggcaatgattcaaaaaagttcaaaggggaggacaagatggatggagctccatctcgagtgctgcacataagaaagcttccaggtgaggtaaccgagactgaagtgatcgctctgggcctgccatttggcaaggtgaccaacattcttatgctgaagggtaagaaccaggcgttccttgaattggcaactgaggaagcggccatcaccatggtgaactattactctgctgtaaccccccatcttagaaatcagcctatctacatccagtactccaatcacaaggagctcaagacagataacaccttaaaccaacgagcccaggctgtcctccaagcagtcacagctgtccagacagccaacacgcccctgagcgggacaaccgtgagcgaaagtgccgtcaccccagcccagtcaccagtattacggatcatcatcgacaacatgtactacccggtgacactagatgtgcttcatcagatatttagcaaattcggtgcagtgctgaaaattattacattcacaaaaaacaatcagtttcaagccctgctccagtacggtgatcccgtcaatgctcaacaggccaaactggccctggatggacagaacatctacaacgcatgctgtacgcttcgcatcgatttttcaaagcttgttaatctcaacgtgaaatataataacgacaagagtcgcgattatacgcgaccagacttgcctagtggggacgggcagccggcattggaccctgctatcgcggcggcattcgccaaagagacaagcctgctcgctgtgccaggggctctgtcacctttagctattcctaacgccgcggcagctgctgctgcggccgcggctggacgtgtgggtatgcccggggtgagcgccgggggtaacacggtgttgcttgtgtctaaccttaatgaggaaatggtgacaccacagtcgctcttcacgttgtttggcgtgtacggagacgtgcagagggtcaaaatactctataacaagaaggactcggccctgattcagatggcggatgggaaccaatcacagctggcaatgaatcacttgaacggccaaaagatgtacggcaagattattcgggtaactctaagtaagcaccagaccgtgcaactccccagagagggtctggacgaccagggtctaacaaaggacttcgggaatagtcctctgcacaggttcaaaaaaccggggtccaagaatttccagaacattttcccaccttcagctactcttcatctgtcaaatataccacccagcgtagcagaagaggatctaagaacactgttcgcaaacaccggaggaacagtgaaggcctttaaattttttcagcgggaccataaaatggcccttctccagatggccaccgttgaggaggcgatccaggcccttatcgatctgcacaattacaacctcggcgagaaccaccacttgcgtgtcagtttttctaagtccaccatctag

SEQ ID NO: 200108 - DNA, 1614 bp, Artificial Sequence
  Description of Artificial Sequence: Synthetic coding sequence
atggacggcatcgtgaccgaggtggccgtgggcgtgaagcggggctccgacgaactcctgagcggttccgtcctaagtagtcccaatagtaacatgtccagcatggtggtgactgccaacggtaatgactccaaaaaattcaaaggtgaggataaaatggatggagctccatctagagtactccacatacgaaagctgcccggcgaagtgactgagactgaagtcatagctctgggcttacctttcggaaaagtgacgaatattctgatgttgaaaggtaagaatcaggccttcctggaacttgctaccgaagaggccgccatcactatggtgaattattatagtgcagtcaccccacacctcaggaatcagccaatctatatccagtactctaaccataaggaacttaagaccgacaacacactgaatcaaagggcccaggcagtccttcaagccgtgaccgccgtgcagacagccaacacccctcttagcggcaccaccgtgtcagaatctgccgtcactccagcacagtcccccgtgctgcgcattattattgataacatgtattatcccgtgaccttggacgttctgcatcaaattttctcaaaatttggagctgttttgaaaattataacctttactaagaacaaccagttccaggcccttctgcagtacggggatccagtgaacgcccagcaagctaagctcgcgctcgacggtcaaaacatatacaatgcgtgctgcaccctacgcatcgattttagcaagctggtgaaccttaacgttaaatataacaacgacaagtctagagactatactagaccggatctgccatccggagacggtcaacccgcactcgatccggctatagcggccgcctttgctaaggagacttccttgctcggattacccgtggctgccgtgccaggcgctctgtctcccctggcaattcccaacgctgccgctgctgccgctgcggccgccgccggccgcgtcggcatgcctggggtctccgcaggcggaaacaccgtgctgcttgtgtctaatttaaatgaggagatggtgacaccccagtcactcttcaccttatttggggtttatggcgacgtgcaacgtgtgaaaattctgtacaacaagaaggacagtgcactcattcagatggccgatggcaaccagtctcagctggccatgaatcatctcaatggacagaaaatgtatggcaagattatacgcgttaccctaagtaaacaccagacagtccagttgcctagggaagggcttgatgatcagggattaacaaaggactttggaaactcaccactccatcggtttaaaaaaccaggctccaagaacttccagaacatatttcctccatccgctaccctgcatctgagtaatatacctcctagtgtggccgaagaggacctgcgcacgttatttgcaaacaccggcggtactgttaaggcctttaaattttttcagcgagaccacaagatggctctgctgcagatggctaccgttgaggaggccatccaagcgctgattgatctgcataattataacctcggtgagaaccaccatttgcgagtgagcttttcaaagtccacgatttag

SEQ ID NO: 200109 - DNA, 1611 bp, Artificial Sequence
  Description of Artificial Sequence: Synthetic coding sequence
atggacggcatcgtgaccgaggtggccgtgggcgtgaagcggggctcagacgagctgctttccggctcagttctgagcagccctaactcgaacatgtcatccatggttgttacggctaacggtaatgatagtaaaaaatttaaaggcgaggacaaaatggatggtgccccaagtcgggtcctgcatatccgcaaactaccaggcgaggtcaccgagaccgaggttatagcccttggccttccttttggaaaggtcaccaatatcttaatgcttaaaggcaagaatcaagcatttctggaacttgctacagaagaggccgctatcaccatggtgaattattactcggcggttaccccccacctacggaatcagcctatctacatccaatattctaaccataaggaactgaaaacagacaatacactgaatcaacgcgcgcaggcagtgctgcaagccgtcacggccgtccagaccgccaatacacccctgtctgggacaaccgtctcagagagtgccgtgactcccgcccagtcacctgtgctgcggatcatcatagacaacatgtactatccggtgacccttgacgtgcttcaccagatcttctcaaagttcggggcagttttgaagatcatcacgtttacaaagaataatcaattccaagccctgctccaatatggggatcccgtgaatgcccagcaggccaagctcgcactcgatggccagaatatctataatgcctgttgtacactcagaattgactttagcaagcttgttaacctcaacgtgaaatacaataatgacaagtccagagattacacacgcccagatctcccatcaggcgatgggcagcccgctctggaccctgctatcgcagcagcttttgccaaggagacaagcttactgggtctgcccgttgctgcggtgcccggcgctttgtcccccctggccataccgaatgctgcagccgcggctgcagctgcagccgctggaagggtggggatgcctggggtaagcgccggtggaaacacagttttgctggtgagcaatctgaacgaagagatggtgacccctcagtccctatttacgctgtttggcgtctatggcgacgtccaaagggttaagatactctacaataagaaagattctgcgttgatccagatggccgatgggaaccagtcacagctggccatgaaccatctcaatggccagaagatgtacggaaaaatcatccgcgttactctgagcaaacaccagaccgtgcagctgcccagagagggcctagatgaccaggggctgacaaaagacttcggcaactcgccccttcatcgctttaagaaaccggggagtaagaacttccagaacatctttcctccttcggccactctgcatctttctaatattcccccatccgtcgccgaggaggacttgaggaccctcttcgctaacacagggggaacggtgaaagcctttaagttcttccaagaccacaaaatggccctgctgcaaatggctaccgttgaagaggccattcaggctctgatagacctccataactacaatctgggagaaaaccaccatcttcgggtgtctttcagcaaatctaccatctag

SEQ ID NO: 200110 - DNA, 1056 bp, Artificial Sequence
  Description of Artificial Sequence: Synthetic coding sequence
ggcatgaagcggggcagcgacgagctgctgagcggcagcgtgctgagctccccaaattctaacatgtcctctatggttgtgacggctaatgggaatgatagcaagaagtttaagggggaggacaagatggacggcgctcccagtcgagttttgcacatccgcaaactgcccggagaggtgactgagaccgaagtgatagctctcgggctgccgtttggaaaagtaacaaatatcctgatgctgaaaggcaagaaccaagcctttctggaattggccacggaagaagctgctatcacaatggttaattattactccgcagtgacccctcatctgcggaaccagcctatatacattcagtatagtaatcacaaagagttgaagacagacaatacgctgaaccagagagcccaagctgtgctccaggccgttactgctgtgcagactgcaaacacgccactatcggggaccacagtgtcggaatccgctgtcactcctgcgcagtcccctgtgcttcggattatcattgataatatgtactatccggtaactctagatgtgttacatcagatattttccaagtttggagcggtgctcaaaatcatcaccttcacgaagaacaaccagtttcaggccctacttcagtatggtgatcctgtgaatgctcagcaggccaaactcgcactcgatggacaaaacatttataacgcatgctgcaccctgcgaatcgatttcagcaagctggtaaatcttaacgtgaagtacaacaatgacaagagccgggactatactcggccagacctgcccagtggggatgggcagccagccctggaccccgccatcgccgcagcgtttgcgaaggagaccagccttctgggcctaccagttgcagctgttcccggtgcccttagcccactcgccatccccaacgcagccgccgccgccgccgccgcagcagctggcagagtgggaatgccaggtgtctctgcgggcggaaacactgtactgctagtatctaatttaaatgaagaggtgtttatggagatgtgttccgtgtag

SEQ ID NO: 200111 - DNA, 1647 bp, Artificial Sequence
  Description of Artificial Sequence: Synthetic coding sequence
atgtggagcaacctgaccttcagcttcttcggcctgcggaccaaggccaaaaaatatgtcacagtcaataataggggttccgacgaactgctcagcgggtccgtgctcagttccccaaacagcaacatgtcttcgatggttgtgacagctaacggaaacgatagtaaaaagttcaaaggtgaggataagatggacggcgccccaagccgggtcttacacattaggaagctaccgggagaggttacggagacagaggtcattgctctagggcttccgtttgggaaagtgacaaatatcctcatgctcaaaggaaagaaccaggcctttctcgaattggctactgaagaagctgcaatcacgatggtgaactactattccgctgtgaccccacacctgcggaaccagcctatctatatacagtatagcaatcataaagagctgaaaactgacaatactcttaaccagagagcccaggccgtgctccaggccgtaactgctgtgcagacagcaaacactccacttagcgggacgaccgttagcgagtcagcggtgacacccgcacagagtcccgtccttaggataatcatcgacaatatgtattaccctgttactctggacgtgcttcaccagattttctcgaaattcggcgcagtgctaaagataatcacattcactaaaaataatcaattccaggccctgctccagtacggagacccagttaatgcccaacaggctaagctcgctctggacgggcagaatatctacaatgcatgctgtactctgagaatcgatttctccaagctcgtgaacctgaatgtcaagtacaacaacgacaagtccagggattatacgagaccagacctgccttctggcgacggacagccggcccttgaccccgctatagctgctgcttttgcgaaagagacctctcttctgggattgcccgtggcggctgttccaggcgcactgagcccccttgccatccctaacgccgccgccgcagcggccgctgcggctgctggacgagtggggatgcctggggtttctgcaggggggaatacagtgctgctcgtgtcaaatttgaatgaagagatggtcaccccgcagtccctgtttactcttttcggagtgtatggtgatgttcagagagtgaaaattttatacaataaaaaggatagcgcgttgatccagatggcagacggaaaccagagccagctcgccatgaaccatctcaatggccagaagatgtacggcaaaatcatccgcgtcaccctgtccaagcatcagaccgtgcagctcccaagagaaggtctggacgatcagggattaactaaggatttcgggaattcccccctgcaccggttcaaaaaacccggaagcaagaactttcagaatatattccctccttccgccacactgcacctgagcaacatcccaccttccgtggcagaagaggacttacgcacactgttcgccaatactggcggtaccgtgaaggcgttcaaatttttccaacgcgaccacaagatggcgttgctccaaatggctaccgtggaagaagccatacaggcgctcatagatctgcataactacaaccttggtgagaatcaccacctgcgggtcagcttctccaagtcgaccatttag

SEQ ID NO: 200112 - DNA, 1596 bp, Artificial Sequence
  Description of Artificial Sequence: Synthetic coding sequence
atggacggcatcgtgaccgaggtggccgtgggcgtgaagcggggcagtgacgaattactgagcggtagcgtcctttcgtctcccaacagcaatatgtcaagtatggtggtgaccgccaacggcaatgattccaaaaaatttaaaggcgaagacaagatggatggagctccctctagggtgttacacatacggaaacttcccggggaggttacggagactgaggtgatcgccttgggcctgccttttgggaaagtgacaaacatccttatgttaaaaggcaaaaaccaggctttcctcgagttggccactgaggaggctgccataacaatggtgaattactattcagctgtgacgccacacttgcgcaaccaaccgatctatatacagtatagcaaccataaggaactgaaaaccgataatacactaaaccaaagagcacaggcggtgttgcaggcggtgacagccgtgcagaccgcaaacactcctctgtccggcactactgtgtccgagtcagcggtgactcctgctcagagcccggtcttacgcattatcatagataatatgtactatcctgtgacattggatgtcctgcatcaaatatttagcaaatttggagccgtcctgaagatcattactttcactaaaaacaatcagttccaggctctgctgcagtatggcgacccagtgaacgcacagcaggctaagctcgctttagacggacaaaacatctataatgcgtgttgcactttgaggatcgacttttctaagctcgtcaatcttaatgtcaaatacaacaacgataaatcccgcgactacactcgtcctgacctgccctccggcgatggacagccggccctggaccctgccatagccgcagcatttgctaaggaaacctcgctgttggctgttcccggagcactcagccccctcgcgatcccgaatgctgctgccgccgctgccgcagccgccgcaggcagagtcggtatgccaggcgttagcgccgggggcaatacagtcctcctggtcagtaacctgaacgaagaaatggtaactccacagtccctttttacactgtttggagtctatggagacgtacagcgggtcaagatcctgtacaacaagaaagacagcgccctcatccaaatggcagatggtaaccagtctcaactggccatgaaccacctcaatggccagaagatgtacgggaaaataataagagtaactctctcaaagcaccagacggtgcagctgccacgggaagggctcgacgatcagggacttactaaagactttggaaacagccccctgcaccgtttcaagaagcccggaagtaaaaactttcagaacattttccctccctccgcgacactgcatctgtccaacatcccaccatctgtggccgaggaggatctgcggaccttgttcgctaacacaggcggaaccgtcaaggccttcaaattttttcaggatcataagatggcactgctgcaaatggcaactgttgaagaagccatacaagctctcatcgatctccataactacaacttaggggagaatcatcacctaagggtttcatttagtaagtcaacaatctag

SEQ ID NO: 200113 - DNA, 978 bp, Artificial Sequence
  Description of Artificial Sequence: Synthetic coding sequence
atgagcagcatggtggtgaccgccaacggcaacgacagcaagaagtttaagggcgaagacaagatggatggcgctccttctcgggtacttcatattaggaagctgccaggtgaggtgacagaaaccgaagttattgctctcggtctaccattcggcaaggttacgaacatcctgatgctgaagggaaaaaaccaagcttttttagagttggctacggaggaagcagctattaccatggttaactactacagtgctgtgactcctcatctgcgtaaccagcccatttatattcagtatagcaaccacaaagagctcaagacagataatactttgaaccagagggcccaggcagtcctgcaggccgtaacggccgtgcagaccgctaacacacccctgtccggtaccaccgtcagtgaatctgccgtgacacctgctcagtctcccgtccttagaatcatcattgacaatatgtattaccccgtgacattggatgtgctgcatcaaatctttagcaaatttggggccgtgcttaaaatcataacgtttaccaagaataaccaattccaggccctgttgcaatatggggatcccgtgaatgctcagcaagctaagctggcactggatggacaaaacatttataacgcatgctgtaccctgaggatcgacttttccaagctggttaacctgaacgtcaagtataataatgacaaatcaagagactacactcgcccagacttgcctagcggcgacggccagcccgctctcgatcccgccatcgctgccgcttttgctaaggagactagtttgctagccgtccctggggccctctccccactcgccattcctaacgccgctgccgccgctgctgcagcagcagccgggcgggtaggcatgcctggggtttcagcaggcgggaatactgtcctgctcgtatctaacctgaatgaagaggtctttatggagatgtgttctgtctag

SEQ ID NO: 200114 - DNA, 615 bp, Artificial Sequence
  Description of Artificial Sequence: Synthetic coding sequence
atgcccggcgtgagcgccggcggcaacaccgtgctgctggtgagcaacctaaatgaggaaatggtgacgccacagtctctgtttactttgtttggggtgtacggagatgtgcagcgggtgaagatcttgtacaataaaaaggactcggctcttatccagatggccgatggcaatcaatcccaattggctatgaatcatctgaacggccagaaaatgtatggaaagataattagggtgactctgagcaagcatcagacggtgcagctgccccgcgagggtctggacgatcaaggactcactaaagactttggcaatagtcccctgcacagattcaagaagcctggatccaaaaactttcagaacatcttcccaccatctgctacgctacatttatccaatatcccacctagtgtggcagaggaggatctgcgcactctttttgccaacacaggcggaacagtcaaggcgttcaaattttttcagagagaccataaaatggcattgcttcaaatggcgacagtggaggaagccatccaggcactgatagatctacacaattataatctaggagagaaccatcacctgagggtctctttcagcaagagcacaatatag

SEQ ID NO: 200115 - DNA, 348 bp, Artificial Sequence
  Description of Artificial Sequence: Synthetic coding sequence
atggtgtgcagccccgtgaccctgcggatcgccccccccgaccggcgcttcagtagaagtgcgatcccggagcaaataatctccagcacactgtcctccccctcctctaacgccccagatccttgtgcgaaggagacagtcctcagtgcgttgaaagagaaaaagaagaagaggactgtggaggaagaggaccagatttttttggacggccaagagaacaagcgcagctgtttggttgacggtcttactgatgcctcaagcgccttcaaggtgcctagacctgggcctgatactctacagttcactgtcgacgttttccattttgctaacgactcacgaaacatgtag

SEQ ID NO: 200116 - DNA, 564 bp, Artificial Sequence
  Description of Artificial Sequence: Synthetic coding sequence
atggtgtgcagccccgtgaccctgcggatcgccccccccgaccggaggtttagtagaagtgccattcccgaacagattatctcatctacactctcctccccctccagcaatgctcctgacccttgcgcgaaagagacagtgctgtccgctcttaaagagaaaaagaagaagagaactgtagaggaggaagaccagatttttctggatgggcaagagaataaacgaagctgcttagtcgacggcctgacggacgcctcctcagcttttaaagttcctcgtcccggtcccgataccttgcagttcacagtggatgtgttccatttcgccaacgacagtcgcaacatgatctacatcacttgccatctgaaggtcaccctcgcggaacaggatcctgacgaactgaacaaagcttgctcgtttagtaaaccctctaattcttggtttcctgtcgagggactggctgacatctgccagtgttgtaacaagggcgactgcgggacacccagccacagtcgccgccagcccagggtcgttagccagtggtctactagtgcgagcctatag

SEQ ID NO: 200117 - DNA, 1095 bp, Artificial Sequence
  Description of Artificial Sequence: Synthetic coding sequence
atgagcgccaacagcagccgggtgggccagctgctgctgcagggcagcgcctgcatccgatggaaacaagatgtggaaggggctgtgtaccacctggccaactgtctgctactcctgggcttcatgggcgggtcaggcgtctacgggtgtttctatttgttcgggtttttgagtgcaggatacctgtgctgtgtgttgtggggatggttttcagcctgtggcctggacatcgtactctggtcatttctccttgccgtcgtatgccttcttcagctggcccatctcgtgtaccggttgcgggaggatacactcccagaggaattcgacttattatacaagactctgtgcctgcccctgcaggtacccctccagacgtataaagagatagtgcactgttgcgaagagcaggtgctgactctagctaccgagcagacatacgccgtggagggcgagactcctatcaatcgcctgtccctactgctctctggcagggtccgggtcagccaggatggccagtttctccattacatttttccataccagtttatggactccccagaatgggagagcctgcagccctctgaagaaggagtgttccaggttacactgaccgctgagaccagctgcagttatatcagttggccgaggaaaagtctgcacctcctcctcactaaggagcgctacatctcctgcctgttcagcgccttgctcggctacgatatctccgagaagttgtatacactaaacgacaagctttttgctaagttcgggctgcgctttgatatacggcttccctcgctctaccacgtcctgggaccaacggcagcagacgccgggccagaaagtgagaaaggagatgaggaggtttgtgaaccagcagtgagtcctcctcaagcaaccccaacctcactgcaacagacacccccctgctccaccccccctgctacaacaaacttccccgcaccccccaccagggctcggctgagcagacctgacagcggcatactcgctagccgaatccccctgcaatcctatagtcaggttattagcagggggcaggctcccctggccccaacccacacccccgaactttag

SEQ ID NO: 200118 - DNA, 1083 bp, Artificial Sequence
  Description of Artificial Sequence: Synthetic coding sequence
atgagcgccaacagcagccgggtgggccagctgctgctgcagggcagcgcatgtattaggtggaagcaggacgtcgaaggagccgtgtaccaccttgcgaactgtctgttgctcctaggctttatgggtgggtcgggcgtttacggctgcttttacctgttcggatttctctccgctggatatttgtgctgcgtactttggggatggttctcagcatgtggactcgatattgtgctgtggtctttcctgctggctgtcgtgtgtctgctgcaacttgcacatctcgtctaccggctcagggaggataccttgcccgaggaattcgatttgttgtataaaactctttgcttgcccctccaggtgccattgcagacttacaaggagatagtacactgctgcgaagaacaggtcctcacgttggccacggagcaaacctatgctgtggagggtgaaactcccatcaaccgactaagtcttctgctgtcggggagggtacgtgtgtctcaggatggccagttcttgcactacatcttcccctaccaattcatggacagcccggaatgggaaagtttgcagccctccgaagagggcgtattccaggtgaccctgacagctgagacttcgtgcagttatatctcttggccacgcaagagtctgcatctgctgttaacaaaggaacgctacatttcctgcttgtttagtgccctgctcggatacgatatcagcgaaaagttatatactttaaatgataagctgtttgcaaaatttgggttgaggttcgatattcggctaccctccctctatcacgttctgggacctactgccgctgacgcagggccagaatccgaaaaaggggatgaggaggtgtgcgagcctgctgtgagcccaccgcaggctacaccgacaagtctgcagcagacgcccccctgcagcacccctcctgctacaacaaactttcccgcaccaccaacgcgagcccgtctgagccgacccgattccgggattttagaaatagacgatttccccagttatttccatcagttcggcttcagcggcaaagtggcagcggggaggattccttag

SEQ ID NO: 200119 - DNA, 1083 bp, Artificial Sequence
  Description of Artificial Sequence: Synthetic coding sequence
atgagcgccaacagcagccgggtgggccagctgctgctgcagggctccgcctgcataaggtggaagcaggacgtcgagggcgctgtgtaccacctggccaattgtctgctccttctgggattcatgggcggctccggtgtatatggatgtttctacctgttcggcttccttagtgctggatacctttgctgtgtcctgtggggctggttttctgcctgcgggctggatattgtgctatggagttttttgctggcagtcgtgtgtctgctgcaactggctcaccttgtctacagattgagagaggacactcttccagaggaattcgacctcctgtacaagacactgtgtctccctcttcaagttccactccaaacctataaggagattgtacattgttgcgaggagcaggttctgacgctggccactgaacaaacctatgccgtcgaaggagagacccccattaatcgcctctccctgcttctgagtggccgcgttagggtgtcacaggatggacagtttctccactacatattcccctaccagttcatggactctcccgagtgggagagcctacagccgagtgaggagggggttttccaggtcaccctgaccgctgagaccagctgttcgtacatatcttggccacgtaagtcacttcacctgctgctgacaaaggagcggtatatatcgtgtctgtttagtgccctgctcggatatgacatcagcgagaaactctataccttgaatgacaagctgttcgccaagtttgggctgaggttcgatatccgcctccctagcctgtatcacgtgttggggccaacagccgcagacgcaggtcccgaaagtgaaaaaggcgacgaagaagtatgcgagcccgccgttagcccaccacaggccacccctacttcactacagcaaacgccaccctgtagtacccctccagccacaacaaactttcctgcccctcccaccagggctaggctctcaaggcctgattccggaatcctggagatcgatgacttcccatcctactttcatcagttcggcttctcaggtaaagtggccgcaggtcgcattccatag

SEQ ID NO: 200120 - DNA, 876 bp, Artificial Sequence
  Description of Artificial Sequence: Synthetic coding sequence
atggagcggaacagcagcctgtggaagaacctgatcgacgagcaccccgtttgcacaacttggaagcaggaggcagagggagcgatttatcatctagcctcaatcctctttgtagtgggctttatggggggatccgggtttttcggcctgttatacgtgttctcgttactgggcttgggctttctctgcagtgccgtgtgggcgtgggtcgatgtgtgtgctgctgacatattcagttggaattttgtacttttcgtaatttgtttcatgcaatttgttcatatcgcctatcaggtgagatcaattaccttcgcacgagagttccaagtgctgtattccagcttgttccagccgctgggcatctcccttcccgtgttccgcactatagcactgagcagcgaagtagtcacactggagaaagaacattgctacgctatgcaggggaagacctccatcgacaagctcagcttgctggtttctgggcgcataagagttaccgtagacggagaattcctccactacatctttcccctgcaattcctggacagtcctgaatgggactccctgcgccccaccgaagaagggatttttcaggttacgctaacagctgagacagactgtcggtatgtatcctggagaagaaagaagctataccttttgttcgcccagcatcggtatatatcccggctgtttagcgtgcttatcggtagcgatatcgcggacaaactatacgccttgaatgatcgagtctacatcggaaaacgctatcactacgatatccgccttcccaacttctaccagatgtccacaccggagattcgtagaagtcctctaactcaacatttccaaaatagtcgccggtattgcgataagtag

SEQ ID NO: 200121 - DNA, 306 bp, Artificial Sequence
  Description of Artificial Sequence: Synthetic coding sequence
atgctgttcctgtgcttcgaccggatccgggtgaccgtggacggcgagtttttgcactatatctttcctttgcagtttctagactctcccgaatgggacagtctgcgtcctactgaagaggggatattccaggtgacactgaccgctgagaccgactgcaggtatgtgtcctggagaaggaaaaagctatatctgttgtttgctcaacatcgatacatctcccggctttttagcgtgctgatcggatcagacatcgccgataagctgtacgccttaaatgatagagtgtacattggcaaaaggtag

SEQ ID NO: 200122 - DNA, 1386 bp, Artificial Sequence
  Description of Artificial Sequence: Synthetic coding sequence
atggccaccttcagccggcaggagttcttccagcagctgctgcagggatgtctgctgccgaccgcccaacaaggcctggatcagatctggttgctgctggcgatttgcctggcatgccgtctgctgtggcggttgggactgccttcctatctcaagcacgcctctacagtggccggtggcttcttctcgctttatcatttctttcagctgcatatggtctgggtggtcttgttatccttactgtgctatctggtattatttctatgccggcactcctctcatcgcggggtatttctgtccgtgaccattctcatctacctgctcatgggggaaatgcacatggtcgacacagtgacctggcataagatgagaggcgcccagatgatcgtcgcaatgaaggccgtttctttgggatttgacttagacaggggtgaagtaggtacagtgccttctcccgtcgagttcatgggctacttgtacttcgtcggtacgatcgttttcggcccctggatatcattccattcttacctgcaggctgtccagggcaggccactgagctgcaggtggctgcaaaaggtggccaggagcctggccctggctctgttatgtctggtgctgagtacctgcgtggggccttatctgtttccctactttattccacttaacggcgaccggcttttacgaaataagaagcggaaagcccgcggtaccatggtgaggtggttgagggcttacgaatccgctgtatcctttcatttcagcaactatttcgttggtttcctctcggaagcaactgcgactctggcgggagctgggtttaccgaggagaaagatcacttggaatgggatctcactgtcagtaagccactcaacgtggaactcccgaggtcaatggtagaagtagttacatcatggaacctgcccatgagttactggctcaataactacgtcttcaaaaacgcactgcgactcgggacgttttcagccgtgctggtgacttacgcggcaagtgcactgcttcatggattctcattccatctagctgccgtcctattatccctcgccttcatcacctacgtcgaacacgtcttgcggaagcgcctagctcggattctcagtgcatgcgtcttaagcaagcgctgtccacctgactgctcccaccagcatcggctcggcctgggggttagagctcttaatctcttgttcggcgcgttggctatttttcatctggcatacctgggctccttgttcgatgtggacgtggacgataccacagaagagcaggggtacggcatggcctacaccgtgcataaatggtctgaactctcctgggcctcacactgggtcaccttcggatgttggatattctatcgactcatcggatag

SEQ ID NO: 200123 - DNA, 1368 bp, Artificial Sequence
  Description of Artificial Sequence: Synthetic coding sequence
atggccaccttcagccggcaggagttcttccagcagctgctgcaggggtgtctcctccctaccgcacagcagggattggaccagatttggctcctccttgctatctgtctggcatgccggctgctctggcggcttggactccctagttacctaaagcacgcctccaccgttgcaggcggattctttagtctgtatcatttcttccagctgcatatggtctgggtggtgttactgtctctcctctgttatctggttctatttctgtgccgacattcaagccacagaggtgtttttctaagcgtcaccatcctcatttacctgctgatgggcgagatgcacatggtggatacagtgacatggcataaaatgaggggggcccaaatgatcgtcgcaatgaaagcagtctcactaggtttcgacctcgacaggggagaggtcggcaccgtcccctcccctgtggaatttatgggatacctatactttgtgggcaccatcgtatttggaccttggatctcttttcactcatatctgcaagccgtacagggaagacccctttcttgccggtggctgcagaaagtggcacgaagcctggccctggctttactgtgccttgtgctgtcaacatgcgtcgggccctacctgttcccatactttatacctctgaatggagacagactgcttagaaaaggcaccatggttcggtggctccgggcctatgagtctgcagtttcgttccacttctcaaattattttgtggggttcctcagcgaggctacagcaaccctggcaggcgcagggttcaccgaagaaaaagatcacctagagtgggacctcaccgtttctaagcccctgaatgtcgagctgcctcgctccatggtggaagtggtaacatcctggaatctgccgatgtcttactggctgaacaactatgtatttaagaatgccctgcggctgggtactttctcagctgtgttagtgacttatgccgcgtctgcactcctgcacggatttagctttcaccttgccgcagtgttgctgagcctggcctttatcacatacgtggaacacgtgcttagaaaaagactggcacggatactgagcgcctgtgtccttagcaagcgatgtcccccggactgttctcatcagcataggctggggctcggcgtgcgcgctctgaacttgttgtttggcgccctcgcaatttttcacctcgcctatctgggcagcctgttcgacgtggacgtcgacgacactacagaggagcagggctatgggatggcatacaccgtgcacaagtggtcagagctgtcttgggcatcccattgggtgacctttggctgttggatcttctaccggctgatcgggtag

SEQ ID NO: 200124 - DNA, 1371 bp, Artificial Sequence
  Description of Artificial Sequence: Synthetic coding sequence
atggccaccttcagccggcaggagttcttccagcagctgctgcagggctgcctgcttcccactgcccagcagggcctagatcagatctggctactcctcgcaatttgtctggcctgtcgtctcctttggaggctcggactgccgtcctatctcaagcacgcctctacagtggcgggcggatttttttccttatatcatttttttcaactccacatggtctgggtcgtactactgagtctcctatgctatctggtgttgttcctgtgcagacacagctcacaccgcggcgttttcttatcagtaaccatcctgatctacttgttgatgggggagatgcatatggttgatacagtgacttggcacaaaatgagaggggcacagatgatagtggccatgaaagcggtgagcctgggcttcgacttggacagaggggaggtgggaacagtgccctcacccgtggagttcatgggttacctgtatttcgtcggtaccatcgttttcggtccttggatatctttccactcttatctgcaggccgtgcagggtagacccttgagttgccgatggctacagaaggttgccagatcactggccctagccctcctgtgcctggtgctcagcacctgcgtagggccatatcttttcccgtatttcattcctctcaatggcgacaggcttctgcgcaataagaagagaaaagccaggtggcttagagcatacgagagtgcggtgtcatttcacttctccaactacttcgtcggcttcctctcagaagccaccgcgaccctggcaggggccggctttactgaggaaaaggaccatcttgagtgggacctgaccgtcagcaagccactgaacgtggagctccccagaagtatggtagaggtcgtcactagttggaacctgcctatgtcctattggcttaataattatgtgtttaagaatgcgcttcgactcgggactttctcagcagtgttagttacttatgctgcatcagccctgctgcacggcttctctttccatttggccgcagtgctgctctcccttgcttttattacctacgtagagcacgttctccgcaagcgcctggctaggatcctgagtgcttgtgtgcttagtaaacgctgccccccagattgttctcaccagcaccgcctcggattgggggtgagggcccttaatttgttattcggagccttggccatctttcacctggcctatctgggtagcctgttcgacgtggatgttgacgacaccaccgaagagcaaggttatggcatggcctatacagtgcacaaatggtcggaattgtcttgggcctcccactgggtcacttttggatgctggattttctataggctcatcggctag

SEQ ID NO: 200125 - DNA, 1368 bp, Artificial Sequence
  Description of Artificial Sequence: Synthetic coding sequence
atggccaccttcagccggcaggagttcttccagcagctgctgcagggctgcctgttacccacggcgcagcagggactggatcagatctggctactcctggccatatgcttagcctgccggctcttatggcgactgggtttgccttcttatcttaagcatgccagtaccgtggcagggggcttctttagcctgtatcattttttccagctccatatggtgtgggtggtgcttctttctttactctgctaccttgtcctttttctatgccggcactcatctcaccgaggggtgtttctgagcgttacaatcttaatctatcttttgatgggcgaaatgcatatggtggatactgtcacctggcacaaaatgagaggcgcccagatgattgttgccatgaaagccgtatcactgggcttcgacctggataggggggaagttggaacagtgcccagccctgtggaattcatgggttacttatatttcgtggggaccatcgtgtttgggccatggatttcattccattcttacctgcaagccgttcagggccgcccccttagctgccgctggctgcaaaaggttgcccggtccctagcccttgctttattgtgcctagttttgagtacttgtgttggaccctacctgttcccctacttcatccctctgaatggcgatcgcttgctgcggaaaggaaccatggttcgctggctcagggcctacgaatcagcagtctcgtttcacttctctaattattttgtcggctttctgtccgaggctacagccaccctagcgggcgcgggcttcactgaggaaaaagaccacttggaatgggatctgacggtgtccaaacccctcaacgtggaattacctcgctcgatggtggaggttgtaacaagttggaacctcccaatgtcctattggctcaataattacgtatttaaaaacgccctccgccttggcacattctccgctgtcctagtcacctatgcagcttctgcgctcctccatggtttttcattccacctggccgccgtgctcctgagcctggcttttattacgtatgtagaacatgtactccggaaaagactcgcacgaatccttagcgcttgcgtgctgtcgaaaagatgtcccccagactgcagtcatcaacaccgactcggtctgggcgttcgcgctttgaacctgctgttcggagctctggccattttccatctagcttatctcgggagcctgtttgatgtggacgtggatgatactacagaggaacagggctacggcatggcttatacggttcacaagtggagcgaactctcctgggcctctcactgggtgactttcggctgctggatcttttacaggctgatcgggtag

SEQ ID NO: 200126 - DNA, 1353 bp, Artificial Sequence
  Description of Artificial Sequence: Synthetic coding sequence
atggccaccttcagccggcaggagttcttccagcagctgctgcagggttgcctactccctacagcacagcaggggctagaccagatctggctattgctagctatatgtctagcctgtaggctcctttggcgcctaggacttccatcttacctgaagcacgcgtccacggtggctggtggctttttcagcctttaccatttcttccaactgcatatggtctgggtagtcttgctgtccttgctgtgttatctcgtcctctttctctgccgccatagctcgcacagaggagtcttcttgagtgttacaatacttatctacctcctcatgggtgagatgcacatggtggacaccgtgacctggcataaaatgcgcggagcacagatgatcgtcgctatgaaagccgtgtcactgggattcgatttagaccgcggcgaagtggggactgtaccgtcgccagtggaattcatgggctacttgtacttcgtgggcactattgtcttcggtccctggatctccttccacagctatctgcaggccgtgcaaggccgacctctgtcgtgcagatggcttcaaaaggtcgcacgcagcctcgccctggctctgctttgtcttgtgctgagcacgtgtgtaggaccctacctctttccctacttcattccccttaatggggaccgactgctacgcaaatggcttcgcgcgtatgaaagcgcagtaagctttcacttcagtaattatttcgtgggatttctgagtgaagctaccgctacactggccggcgctgggtttacggaggaaaaggaccatctggagtgggaccttacggtcagcaaacccctcaacgttgaacttccccgatccatggtcgaggtggtgacaagttggaacctcccaatgagctactggctgaacaactacgtctttaagaacgcgcttaggctcggaaccttctcagccgtccttgttacctacgctgcatctgcactactgcacggtttctcatttcacttagccgccgttctcttaagcctcgcttttatcacatatgtcgaacatgtgttgcggaaacggttggcacgcatcttgagcgcctgcgtcctgtctaaacggtgcccaccagattgcagccaccaacaccgcttgggcctgggggtgagagcattaaacttactcttcggggccctcgcaatcttccacttggcataccttggctctcttttcgacgtggacgttgacgataccaccgaagaacaagggtatggtatggcttacacggtgcacaagtggtccgagctgagctgggcgtcacattgggttacatttggctgctggattttttacaggttaatagggtag

SEQ ID NO: 200127 - DNA, 1140 bp, Artificial Sequence
  Description of Artificial Sequence: Synthetic coding sequence
atggtgtgggtggtgctgctgagcctgctgtgctacctggtgctgttcctctgtcgtcattcgagtcacagaggtgtcttcttgtcagtgacaattctgatttatctactcatgggtgaaatgcatatggtggataccgtgacttggcataaaatgcggggtgctcagatgatcgtcgcaatgaaggccgtgagtctgggctttgatctcgataggggggaagtagggacagtcccatctccagtggagttcatgggttacctgtatttcgtgggcactatcgtgtttggtccgtggattagctttcatagttatctccaggcggtgcagggccggcctctctcctgccgctggctccaaaaagtggcccgcagcctcgctctggccttgctctgcctcgtgctgtccacctgcgtgggtccttacctctttccttattttattcccctgaacggggaccggttactgcgtaaatggctgcgtgcttatgaatccgccgtctcttttcacttttcaaattatttcgtagggttcctttctgaagccaccgccactctagcaggcgctggctttaccgaggagaaggatcacctcgagtgggatcttacagtgagcaagccactgaacgtggaattacctcggagtatggtggaggttgtcaccagttggaaccttcctatgtcctactggctgaacaactatgtgttcaaaaatgcgctgagattaggcactttttctgcggtcctggtcacgtatgctgcttcggcattgctgcacggtttcagtttccacttggctgctgtattgctgagccttgcattcatcacatacgtggagcatgtcctgcggaaaaggttggccagaatcctgtccgcgtgtgtgctgtcaaagcgctgtccccccgattgttcacaccaacaccgattgggcttgggagtgcgtgcgctgaatctgctctttggcgccttagctatttttcacctggcatacctcggttccttattcgacgtcgatgtggacgataccacagaagaacagggttatggcatggcttacactgtgcacaagtggagtgaactgagctgggcctctcactgggtcaccttcggttgctggatcttctatcggttgatcggttag

SEQ ID NO: 200128 - DNA, 294 bp, Artificial Sequence
  Description of Artificial Sequence: Synthetic coding sequence
atggccaccttcagccggcaggagttcttccagcagctgctgcagggctgccttttacccacagcccagcagggactagaccaaatatggcttttattagcgatttgtttagcgtgtaggctcctctggaggctggggttgcctagttatctgaaacatgccagtacagtggccgggggttttttcagcctctatcacttctttcagttacacatggtctgggttgtgttgctgagcttgctgtgctatctggtcctcttcttgtgccggcacagtagtcaccgcggcgtgtag

SEQ ID NO: 200129 - DNA, 1386 bp, Artificial Sequence
  Description of Artificial Sequence: Synthetic coding sequence
atggccaccttcagccggcaggagttcttccagcagctgctgcaggggtgtctcctgcccaccgcgcagcagggccttgatcaaatttggctactccttgccatttgcctggcatgccgacttctgtggaggctgggcctgcccagttacttaaagcacgcctctacggtcgccggaggattcttcagtctgtaccatttttttcagctgcacatggtttgggttgttctcctatcgttgctgtgttatctggtcttatttctttgtcggcattcctctcacagaggcgtgtttctgtctgtgacgatactgatctaccttttaatgggagaaatgcatatggtagacaccgtgacttggcacaagatgcgcggagcccaaatgatcgtcgctatgaaagcagtctctctgggttttgacctagaccgcggtgaggttggcacagttcctagccccgtggaatttatgggatacctgtatttcgtgggaaccattgtgtttggaccctggatttcttttcattcatacctgcaggcagtccagggaagaccgctcagttgtcgatggctacagaaggtggcgcgaagtttggccctggcactcctgtgtctggtgctgtccacttgtgtaggcccttacctgtttccatattttatccccctgaacggcgataggttactgcgtaacaaaaaaagaaaggccagaggcaccatggtgcgctggctgcgcgcctatgagagtgccgtgagcttccacttcagcaattatttcgtcggattcctttctgaagcaacagccaccttagccggcgctggctttacagaagagaaggatcacctggagtgggatttaacagttagcaaaccactcaacgtggagctgcccaggagtatggtggaagtggtgaccagttggaacctgcccatgtcttattggctgaacaattatgtttttaagaatgctctgcggctgggcaccttttctgcagtgctggtaacatacgccgctagcgctctgctccacgggttttcatttcacctggccgcagtgctgctcagcctggcctttatcacgtacgtggaacatgtgctccggaagcggcttgccagaattttgagcgcttgcgtgttaagtaaaaggtgcccacctgattgttcacaccagcaccgcttaggcttgggcgtgagagccttgaaccttctcttcggtgcactggcgatcttccatctggcctaccttgggtctttgtttgacgtggacgtggacgacacaacagaggagcaggggtacggtatggcatataccgtccacaagtggtccgaactctcatgggcaagtcactgggtgacatttggttgctggatcttttacaggcttattggatag

SEQ ID NO: 200130 - DNA, 2769 bp, Artificial Sequence
  Description of Artificial Sequence: Synthetic coding sequence
atgttcctgcacagcgtgaacctgtggaacctggccttctacgtgttcatggtcttccttgctaccctcggtctttgggatgtgttttttggttttgaagaaaacaagtgcagtatgagctatatgtttgaatatcccgaataccagaaaatcgagctgcccaagaagctcgcaaagcggtatccggcctatgaactctacctctatggggaagggtcatacgccgaagagcacaagatcctccctctcaccgggattcctgtattgtttctaccaggaaacgccgggagttataagcaggtgagaagcatcggtagtattgctttgaggaaggctgaagacatcgatttcaaataccacttcgacttctttagcgtcaatttcaatgaggagctggtagcgttatacggtggtagcctgcagaaacagacgaagttcgtgcacgaatgcatcaagaccatccttaagttgtacaaaggacaggagtttgcacccaaaagtgtggcgataatcgggcattctatgggcggacttgtggcgcgggccttgctcactttgaagaacttcaaacacgacttgatcaatcttctgatcactcaagctaccccccatgtcgccccagtgatgcccctcgatcggttcattacagatttctacaccaccgtaaataactactggatcctcaatgctcgacatattaacctgaccacactctctgtcgcgggcggcttcagggattaccaggttcgttccggacttacgtttttaccaaaactgtcccatcacacatcagccctgtccgtagtttcgtctgccgtacctaagacttgggtatcaactgaccatctgtccatcgtgtggtgtaaacagctccaactgactacagtgcgcgccttcttcgacctaatcgacgccgacaccaagcagattacgcaaaactccaaaaagaagctttcggtgctttatcatcatttcattaggcacccaagcaagcactttgaagagaaccctgcgataatctctgacctcacgggaacttctatgtgggtgctggtgaaagtgtctaaatggacctacgtggcttacaacgagtctgagaagatctattttacatttcccctggagaaccatcggaaaatttacacacacgtctactgtcagagcacaatgctcgacacgaactcatggattttcgcctgcataaattcaacatcgatgtgtttgcagggcgttgacttaagctggaaagccgaactgctgcccaccattaagtatttaacactgcgactgcaagattatccctccttgagtcacctggttgtctacgtgccatcggtgcgagggagtaaatttgtcgttgactgtgagttttttaagaaggagaaaaggtacattcaactccccgtcactcacctgttctcattcggtttaagtagccgtaaagtagtgcttaatactaatgggctgtattataacctggagttacttaattttggccaaatatatcaggcattcaagatcaacgtggtctctaaatgcagcgccgttaaggaagagataacatctatttaccgactgcatatcccatggtcctatgaggattctctgacgattgcccaggcaccctcgtctacagagatctccctgaagttgcacattgcacagcctgaaaataatacgcacgtcgccctgttcaaaatgtacacgagctcggactgcagatacgaggttacagtcaaaacttcctttagccagatcctggggcaagtggtacggttccacggtggagcactgcccgcctacgtggtcagtaatatactcttggcataccgagggcagctctattctttattcagcaccggatgctgtctggagtatgctactatgttagacaaggaagctaaaccatataaggtggatccttttgtgatcatcattaagtttctgctcggatataagtggttcaaggagctgtgggatgtgctgttattgcctgagctggatgcagtgatcctgacttgtcaaagtatgtgttttccactgatcagcctgatactcttccttttcggcacctgcaccgcctactggtcgggattgctgagctctgcttccgtgagactgttgtccagcctctggctggcgttgaagcgtccgtccgaacttccaaaggacatcaaaatgataagcccagacttgccctttctgacgatcgtgctcattattgtctcttggacaacctgtggagctttggctatactgttgtcttatttatattacgtattcaaggtagtccatcttcaggcctctctaactacattcaagaattcacagcccgtgaatccaaaacattctcgacggtcggagaaaaagagtaaccaccacaaagactcgtcgatacaccacctgcgcctgtctgcaaacgacgcggaagactcgctgagaatgcactctaccgttataaatctgctcacctggatcgtcctgctatccatgccttccctcatatactggctcaagaatcttagatattattttaaacttaatccagatccatgtaaaccgctagctttcatcctgatacctaccatggcaatattgggcaacacatacactgtgtcaattaaatcatccaaactgctcaagaccacatctcagtttccgctgcctctcgccgtgggggtcattgcctttggttccgcgcacctttacagacttccatgctttgtatttataccccttctcctgcatgctctgtgcaacttcatgtag

SEQ ID NO: 200131 - DNA, 915 bp, Artificial Sequence
  Description of Artificial Sequence: Synthetic coding sequence
atggaggtgctggagagcaagaagatcgagctgcccaagaagctggcaaaacggtatccagcttacgagctgtatctttacggcgaaggctcctatgctgaagaacacaaaatcttgcccctcaccgggatccccgtactgttcttgccaggaaatgcaggaagctataagcaagtcaggtcaattgggagcattgcccttagaaaggctgaagacatcgactttaaataccatttcgattttttctctgtcaacttcaatgaggaactcgtcgcactatatgggggttctctgcagaaacagacaaaattcgtccacgagtgtataaagacaatactgaagttatataagggccaggaattcgctcctaagtccgtggccattatcgggcattcgatggggggtctggtggcacgcgcgttgctcacactaaagaactttaagcacgacctgatcaatttgcttatcacacaggcaacgccccacgtggctcctgttatgccactagacagatttatcactgatttttacaccacagttaacaattattggattctcaatgctagacacataaacctgactactctgtctgtggccggcggttttagggattatcaggtgaggtcggggctaacatttttgccgaagctcagtcaccatactagcgcactttcagtggtgagtagtgcggtgccaaaaacttgggtgtctactgaccatctaagcattgtttggtgcaagcagttacaactgacaacagtgcgcgcttttttcgacttgattgatgcggacactaaacagatcactcagaacagcaagaagaagctctcagtattgtatcatcattttattagacatccatccaagcactttgaagagaaccctgccattattagtgatctgactgggatctag

SEQ ID NO: 200132 - DNA, 1779 bp, Artificial Sequence
  Description of Artificial Sequence: Synthetic coding sequence
atgttcctgcacagcgtgaacctgtggaacctggccttctacgtgttcatggtgtttctcgccacattggggctttgggacgtgttctttggctttgaagaaaataaatgcagcatgtcttatatgttcgaatatccggagtatcaaaaaatcgagctccctaagaagcttgcgaagcggtaccctgcgtacgagttgtacctctacggcgagggatcttatgctgaggagcataagattctccccctgacggggatccctgtgctatttctcccaggtaatgccgggagttacaagcaggtaaggagcattggttcaattgccctaagaaaggcggaggatatcgactttaaatatcattttgacttcttctcagtcaatttcaacgaggaactggttgcgctatatggtggctcattgcagaaacaaaccaagtttgtgcacgagtgcataaagacaatactgaaactctacaagggccaggagttcgcccctaaatccgttgcaataattgggcattctatgggcggattggtagcccgagctcttttaactttaaaaaacttcaagcacgacctgattaacctcctcataactcaagccacccctcatgttgcccctgtaatgccgctggacagattcatcaccgatttctacacgacggtgaataattattggatcctgaatgcccggcacataaacctgactacgctgtctgtcgcaggcggatttagagattatcaggtgcggagcggcctgacattccttcctaagttgagtcatcacacctcggcattgtcggtggtttccagcgcagtccctaagacatgggtatctacggaccacctgtccatagtgtggtgtaaacaactgcagctgacaactgtccgggccttctttgatcttattgacgccgataccaaacagatcactcagaactctaagaagaaactttcggtgctctatcaccactttataagacatccaagcaagcactttgaagaaaatcctgccatcatctctgacctcacgggaacctctatgtgggtccttgtcaaggtttcaaaatggacatatgtagcttacaatgaatcggagaagatctacttcacatttcctctggagaatcatcgaaagatctacacacacgtatactgccagagcactatgttggataccaactcatggatctttgcctgtattaattccacatcgatgtgccttcagggagttgacctgagctggaaagccgagttgctaccaaccataaagtaccttacactccgcttacaggactacccatccctctctcacctcgttgtctacgtgccctcggtccgtgggagcaagtttgtggtggactgcgagttcttcaaaaaagagaaaaggtatattcagctgcccgttactcatctgttttcctttggcctgagcagccggaaggtagtattaaacaccaacggtttgtactacaatctggagctcctcaatttcggccaaatataccaggcattcaagattaatgtggtgagtaagtgctccgccgtaaaggaagagattacaagtatttaccgtctccacatcccatggagctatgaagatagtctgactattgcccaggcgccctccagtacagaaatttcacttaaattgcatatagctcaaccggagaacaatacacatgtggcgctcttcaagatgtataccagcagtgattgtcgttatgaggtcactgtgaagacctcctttagtcaaatccttggtcaggtggtcgcatag

SEQ ID NO: 200133 - DNA, 1293 bp, Artificial Sequence
  Description of Artificial Sequence: Synthetic coding sequence
atgttcctgcacagcgtgaacctgtggaacctggccttctacgtgttcatggttttcctggccacgttgggactgtgggacgtgttctttggcttcgaagaaaacaagtgttccatgtcttacatgttcgagtatccagagtaccaaagcagtgcggtacccaagacttgggtgagcactgatcatctgagtatcgtatggtgtaaacagttacagctgactacagtgcgagcattcttcgacttgatcgacgcggataccaagcagattacccagaactcaaaaaagaaactatccgtattgtaccaccactttattcgtcatcctagtaaacacttcgaggagaaccctgcaatcatatccgacctcaccggtacatctatgtgggtactggtcaaagtcagcaagtggacttatgtagcctataatgaatcagaaaagatctattttacattcccgctggagaatcataggaagatatatactcatgtgtactgccaatctaccatgcttgatacaaacagctggatcttcgcctgtattaactctactagcatgtgcttgcagggcgtggacctttcctggaaggccgagctgcttccaacgatcaagtaccttacccttcggctgcaggactatccctctctgtctcatcttgtcgtctatgtcccatcagtaaggggttctaaatttgtggtggactgtgagttctttaaaaaagagaaacgatatatacaactccctgtgacgcatttgttcagctttggactgagctcccggaaagtggtcctgaatacaaacgggctgtattacaatttagagttgctgaacttcggtcaaatttaccaggctttcaagataaatgttgtcagtaaatgttcagccgttaaggaggagataacctccatatatcgcttgcacattccttggagctatgaagatagtctcacaatcgctcaggctccttccagcaccgagataagtctaaaactacatattgcccaacccgagaacaacactcatgttgcgctgtttaaaatgtacacttcctcagactgcagatacgaagtcaccgtgaaaacttctttctcacagattctgggtcaggtagtcagattccatggcggagctctgcccgcttatgtggtctcaaatatcctgcttgcatatagaggtcagctatatagcttgttcagcacagggtgctgcctcgagtacgccacgatgttggacaaggaagccaagccctacaaggtcgaccccttcgttatcattatcaaattcctactgtag

SEQ ID NO: 200134 - DNA, 774 bp, Artificial Sequence
  Description of Artificial Sequence: Synthetic coding sequence
atgagccggcccctgatcacccggagccccgccagccccctgaacaatcagggcatcccaactcccgcccaactgactaagtcaaacgctccggttcacattgacgtcggtggacacatgtacacgagttctctcgcgacgctcacaaaataccctgagtcgaggatcgggagactttttgacggcaccgaacctattgtcctcgattctcttaaacagcattatttcatcgacagagatggtcaaatgttcaggtatattctaaactttctaaggacctcaaaactactcatcccagatgatttcaaggactatacactcctctatgaagaggcgaagtactttcaactgcagcctatgctgttggagatggaaagatggaaacaagatagagagacaggacgattttcccggccgtgtgagtgtctcgtcgtgcgagttgcccccgacctcggagagcgtattactttgtccggtgataagagtctgatcgaggaagtgttcccagagatcggtgatgttatgtgcaatagcgtgaatgctggctggaatcacgacagtacgcatgttattcgattccccctgaatggttactgtcatttgaacagcgtgcaggtcctcgagcgcctgcagcagcggggttttgagatcgtggggagttgcggcggcggcgtagactcttcacaatttagcgaatatgtactacgccgggaattgaggaggacgccacgtgtcccgagtgtgatccgtatcaaacaagagcctcttgattag

SEQ ID NO: 200135 - DNA, 774 bp, Artificial Sequence
  Description of Artificial Sequence: Synthetic coding sequence
atgagccggcccctgatcacccggagccccgccagccccctgaacaaccagggcatccctacacctgcccaactgactaaatcaaacgcacctgtccacatcgacgtcggcggacatatgtacacaagctccctggccactctgaccaagtaccccgagagtcgaattgggagattattcgacggaaccgagcctattgtgctggattccttgaaacagcattacttcatagatagagacgggcagatgttccgctacattctcaattttctgcggacgtctaagctcctgatccctgacgattttaaggactatactctgctgtatgaagaagctaagtacttccaactccagcctatgttactggaaatggaacgctggaaacaagatcgggaaacaggccgtttctcacggccatgcgagtgcttagtcgtccgcgtcgctcctgatcttggcgagcggatcacgctgtcaggagacaaaagcctgattgaggaggtgttccctgagatcggcgatgtgatgtgtaactcagtgaacgcgggctggaatcatgattctacccacgtaatcagatttcctctaaacggctactgtcatctcaattctgttcaggtcctcgaaaggcttcagcagcgaggatttgagattgtcggcagttgcgggggtggcgtcgattcatcccagttctccgagtacgtgctacgtcgagaactgcggcggaccccaagggtgcctagcgtgatacgcattaagcaagagccgcttgattag

SEQ ID NO: 200136 - DNA, 2598 bp, Artificial Sequence
  Description of Artificial Sequence: Synthetic coding sequence
atggcccggatgcccggcagcggcgactgcaacaccagcgccggcggatctgcatctgctgcagccgcagccgctgagaataatggagaaagaggtgagggggagaggggtgctggcggtaggggaaggaggcattcacggccccactactgctccgccggagaggaggaagaagaagaagaggaggaagatgaaatccaggaagtgcaaattaccggggatgaggaggaagaagaggatgggggcggtggcctcgaggaggacgaagaggaagaggaggaggaagaaatgggactcgactgggatgaacccctggagccggaggactccgcgggagaggaactggaacccgaaccagtacacatgatcaatatggatcagagcgctgcactcgagccagaagccccaccacgcttgctggcccctagggcccggggcggacctcccggggatggatccgagctagatccggatgtgttacagcgtccggagagagcccgtctgagcgagaacacaaggctggctacccgctacgccgtcagaatcttcagagagtacctcagcgaaaaagcacagtccccagacttcgagacaatggacaagggcgccttgtgtagggtgctgcgatccttttacgccgaggcgaggtctaagagcggtcagctgtattcaaaatccagtctcatttccatacgctcctcgcttaaccgttacctgaatgaacccccatattgccggacgctggatctcactaaggatcccgaactgagatctgccaatttaacacttgctgcagtgattaggaagcttgaggagcaaggcgctggacctgttgtccagaagcaagccataacaagggcggatctgcggaagctgtatacttcttccgtcttcagtacaaacactccatttggcttactcaacaaggtatggttcgaaacctgcatgtatttttgtactagaggaagagaaaatcagcgagaactcgaagaggacagcttcggcctggccatggacgaagacggaagaaaatttgtctattttaaaagccttggtccctaccacaaatcaaggagttctagctggagcaaaaagagggctgagagctcagacgaagagaacctccctcggatgtacgaaaccggcaccgagttctgtccctacgcaagttttgtgaagtacctgtctaagcggaacccactgtgcaaggccttctttcagaggccccgggaccactgttccgaaggagatgtgacgtggtatgagaacaaggccattggaaaaaatctcctgggcacgcgaatgcagatgctatccaaggcagccaaacttagcaagacttacactaaccactgtattggtgctgtcagcatagcaactcttaactccatagcaggaatcggaaccaagcttggcagccctgcgccacagggctgctatgccgaagcattaaatggggcggcccgccaccactcacaccatccacctacccacccctcccaccatcaccgtcctcagcctccttccctgggtaatacatacattctgcctaaagattcacaggtaggacctgacgtcaagtcggaggcggccccaaaaagggcgctatatgaatcggtatttggcagcggggaaatttgcgggcccacctctccaaaacgactgtgcatacgcccatcggaaccggttgacgccgttgtagtggtctccgtgaaacacgatcctttgcccctattaccagaagccaatggacaccgctcaaccaactcacctacaatagtcagccctgctatcgtgagtcccacgcaggactcccgacccaatatgtctcgccccttgattaccagatcccctgcttcccccctcaacaaccagggcataccaaccccagcccagctgaccaagtctaacgctcctgtccacatagacgtaggaggccacatgtatactagctctctcgccaccctaaccaagtaccccgagtcaagaatcggtcgcttatttgacggcactgaacccatcgtgctcgactccttgaagcaacactacttcattgacagagacggtcagatgtttcgctacattctgaactttcttcggaccagcaagctgctgatacccgacgattttaaggattatacgctgctctatgaagaggccaagtatttccagctccagccaatgttgctcgaaatggagagatggaaacaggaccgagagactggacggttctcaagaccctgtgaatgcctggttgtgagggtggcaccagacctgggtgagaggattacacttagtggcgataaatcacttattgaggaggtgtttcctgaaatcggcgacgtcatgtgtaatagcgtaaacgccggctggaatcatgattcgacccacgttattcggttccctttaaacggctattgtcacctcaattcagtgcaggtgctggagcggttacaacagcgaggattcgagatcgtggggagttgcgggggcggtgtagattcttctcagttctccgagtacgtgctaagaagggagctgcgcagaaccccaagagtgccttctgttatcagaatcaaacaggaaccactggactag

SEQ ID NO: 200137 - DNA, 774 bp, Artificial Sequence
  Description of Artificial Sequence: Synthetic coding sequence
atgagccggcccctgatcacccggagccccgccagccccctgaacaaccaggggattcccacgcctgcccagctgacaaaatctaacgcgcccgtgcatatcgacgtgggggggcatatgtacacgtcaagccttgctacgctcacaaagtatcccgagagcagaattggtcgcctctttgatggtaccgaacccatcgtactggactctctgaaacaacactactttattgatcgggacgggcagatgttcaggtatattctaaattttctccggaccagtaagctcctgattcctgatgactttaaggactataccttattgtatgaagaagctaaatatttccaattgcagcctatgctgttggagatggaacggtggaaacaggatcgcgaaaccggccgtttcagtaggccctgtgagtgtcttgtcgtgagggtggcacccgatctgggggagcgcataaccctgtccggagacaagagcctgatcgaagaggttttcccagagatcggtgacgttatgtgcaactccgtgaatgcgggctggaatcacgatagcacacacgtcataaggttccccctcaacggatattgccacttaaattccgttcaggttttagaaagactgcagcagcgcggttttgagattgtcggttcctgcgggggcggtgtggacagcagccagttttccgagtacgtgctgcgccgggagctgaggagaacaccaagagttcccagtgtaattagaatcaaacaggaacctttagattag

SEQ ID NO: 200138 - DNA, 1044 bp, Artificial Sequence
  Description of Artificial Sequence: Synthetic coding sequence
atgcgggtggtggtgatcggcgccggcgtgatcggcctgagcaccgctttatgtatccacgaacggtatcactcagtgctccagcctctggacatcaaggtatacgcggaccgcttcacaccattaaccaccaccgacgttgccgctggcttgtggcagccttacctgagcgatcctaataatccacaggaggccgactggagccagcagacctttgattacctgttatcgcacgtacactcacccaacgcggagaatttgggtctctttctcatttcaggctacaacctctttcatgaggcaatcccagatccgtcatggaaggacaccgtgttaggcttcagaaaactcacgccccgggagctggacatgttcccagactacggctacggatggtttcacacctctctcatcttagaaggcaaaaattatcttcaatggctgacggagcgtctcaccgagcgtggcgtcaaattcttccagaggaaagtagagagcttcgaagaagtggcaagagaaggggccgacgttattgtgaactgcaccggagtgtgggccggcgcactccagagagacccccttctgcagcccggcagaggccagatcatgaaagtggatgccccctggatgaaacactttattctcactcatgatccggaaagaggcatctataactctccatacatcattcctgggactcagactgttactctcggtggcatctttcagcttggaaactggtctgaactgaacaacatccaagaccacaatacaatctgggaaggctgttgtcgcctggaaccaaccttaaaaaacgctagaattataggagaacgtaccggatttcggcccgtgcgcccccagattaggctggagcgggagcagttgcgaacaggtccttctaataccgaggtgatccacaactacggccatggaggctacgggctgactatccattggggatgcgctctggaggccgctaaacttttcggccggattttggaggagaaaaaactctctaggatgccgccctcccatctctag

SEQ ID NO: 200139 - DNA, 399 bp, Artificial Sequence
  Description of Artificial Sequence: Synthetic coding sequence
atgctgaagaacatcgagctgttcgacaagctgagcctgcggttcaacgggagagtccttttcatcaaggacgttattggggacgagatctgttgctggtctttttacggtcagggtcggaaaatcgctgaggtatgctgtacttctatcgtctacgccacagagaaaaagcagactaaggtcgaattccctgaagctcgtatttacgaggagactctcaacatcctcttgtatgaagcacaggacggccggggacccgacaacgccctgctggaggcgactggcggagccgctggtcgctcgcaccaccttgatgaggacgaggagcgagaacgcatcgagcgcgtaaggcgcattcatatcaagcgaccagatgacagggctcatctgcatcagtag

SEQ ID NO: 200140 - DNA, 840 bp, Artificial Sequence
  Description of Artificial Sequence: Synthetic coding sequence
tgacggtactgccggagccccttctggagcggctacggcaacttctattctctgcagaaatcagggttccttccgacactgggcaccgttcaaccctttaactattgtaaatcaggctggatcctgattgacagatgtggcaaacatttcgggacaatactaaattacttacgtgacggcgcagtgcccctcccagaatcccggagagaaatagaggaattgttagctgaagccaaatactatctcgtgcagggactcgtggaggagtgccaagccgctttgcagaataaagatacctatgagcccttctgtaaggtgcctgtgatcacctcctctaaagaagaacagaaactcattgccaccagcaacaaacccgccgtgaaactgttgtataacaggtcaaataacaaatatagctacacaagtaactctgacgacaatatgctgaaaaatattgagctgttcgacaaactgtccttgcggttcaatggccgtgtgctgtttatcaaagacgtgattggcgacgaaatctgttgttggtcattttatggacagggtcgcaagatcgccgaggtatgttgtacaagcatcgtgtacgccacggagaaaaagcagactaaagtcgagtttccagaagccaggatctacgaagagactctcaatatcctgctctacgaggcccaagatggccgtggcccagacaacgctttgctagaagcaacggggggtgctgctgggcggagccatcatctggatgaggatgaagagcgagaacggatcgagagggtccgaagaattcacatcaagcgtcccgatgaccgagcacatttgcaccagtag

SEQ ID NO: 200141 - DNA, 864 bp, Artificial Sequence
  Description of Artificial Sequence: Synthetic coding sequence
atgagcggcgagagcgtggtgagcagcgccgtgcccgccgccgccactcggaccacttccttcaaaggcacttcaccatcttctaagtatgttaaactcaacgtggggggagcactgtactacaccaccatgcaaaccctgaccaagcaagacacaatgctcaaggcaatgttttctggacggatggaggtgcttactgacagtgaaggctggattctcattgaccgctgtgggaagcacttcgggacaatcctgaactatctgagggacggcgcagttccactaccagagagcaggcgggagattgaagagctgcttgccgaggccaagtactatctggtccagggccttgtggaggagtgtcaggctgccctgcagaataaggacacatacgaacctttttgtaaggtgcctgtgatcacaagcagcaaggaggaacagaagctcattgccaccagcaacaaacccgctgtcaaactgctgtacaacaggtccaacaacaagtactcctatactcgcgtgctgttcattaaggacgtgattggggacgagatttgctgctggtccttttacgggcaaggcagaaagattgctgaggtttgttgtacttccattgtgtatgcaactgagaagaaacagaccaaggtggaattcccagaagcccgcatctacgaggaaaccctgaacatcctcctttatgaggcgcaggacgggagaggtcccgacaatgctttactggaagccaccggcggagcagcggggaggtcccaccacctcgacgaggacgaagagagagagcgtatcgaacgcgtacgtaggatccatatcaagagacctgatgatagggcacatctacaccagtag

SEQ ID NO: 200142 - DNA, 468 bp, Artificial Sequence
  Description of Artificial Sequence: Synthetic coding sequence
atgatggccgtgttcaccagcctgtggagcccctaccagatgctgttttgttccaattccgatgataatatgctgaaaaacatcgagttatttgataaactgtccctcaggttcaacgggcgagtccttttcattaaggacgtgatcggagacgaaatctgctgctggtcattttatggccagggaagaaaaatcgccgaggtgtgttgcacaagcatcgtgtacgccacagagaaaaagcagaccaaggtagagttccctgaggccaggatctacgaggagaccctgaacatcctcctgtatgaggcccaggacggccgcgggcccgacaacgctttactggaagccacaggcggcgcagctgggcggagccaccacctagacgaagacgaagagcgtgagcgcatcgaacgcgtccggagaattcacattaagcgccccgatgacagggcacacctgcatcaatag

SEQ ID NO: 200143 - DNA, 990 bp, Artificial Sequence
  Description of Artificial Sequence: Synthetic coding sequence
atgagcgccgaggccagcggccccgccgccgccgccgcccccagcttggaggcccccaaaccatcaggcctggaacctgggcctgctgcttatggtcttaaacctctcacaccaaattctaagtatgtgaaactgaatgtaggggggtctctgcattacaccacgttgagaacactgactggacaggacaccatgctgaaggccatgttttccggacgagtggaagtattgacagacgctggcggttgggtgcttattgaccgctctgggcggcatttcgggaccatcctcaactacctccgagatggttcagtacctctgcccgaaagcaccagggaactaggggagttgctcggagaagctagatattatttggtccagggccttattgaagactgccaactggccctacagcaaaagagagaaaccctatctcccctgtgccttatccctatggtcaccagccctagagaagagcaacagctgttggcctccaccagcaaacccgttgtgaagctgctccataataggtcaaacaataagtattcatatacatcaacatctgacgacaacttactgaaaaatatcgagctcttcgacaaactcgctctccggttccacggaagactcttgttcctgaaggacgtgttaggagacgaaatttgctgttggagtttctatggccaggggaggaagatcgccgaggtgtgctgcacatccatcgtgtacgccacggagaagaaacagacaaaggtcgaatttccagaggctcgaatctttgaagagacgctcaacatcttaatttatgaaacccccagagggccggaccccgctctgctcgaggccactgggggagcagccggagctggaggcgctggacggggtgaagacgaagaaaaccgcgagcatagggtccgccggatacacgtaaggcgccacattacccacgatgaaagaccccatggccagcagatagtgtttaaagattag

SEQ ID NO: 200144 - DNA, 990 bp, Artificial Sequence
  Description of Artificial Sequence: Synthetic coding sequence
atgagcgccgaggccagcggccccgccgccgccgccgcccccagcctcgaagctcccaaaccctccggcctcgagccaggccccgcagcatatggcttaaaacctctgaccccaaactctaagtatgttaagctaaacgttggtggaagcctgcattacactaccttacggaccttgacaggacaggatactatgcttaaagccatgttttctggtagagtggaggttcttactgatgccggtggctgggtgctcattgacaggagcgggcgacacttcggtacaatccttaactacctccgtgatggtagcgtgcccctacccgagtccacccgggaactgggtgagctccttggcgaagcgcggtattatctggtgcagggtttgatcgaggattgccagctggctctgcagcaaaaaagagagacgctcagtccactatgcttaatccccatggtgacctctcctcgtgaggaacagcaactactggcctctacttccaagcctgtggtaaaactgctgcacaaccgctctaataacaagtactcatacaccagcacaagtgacgacaatctcctcaagaacatcgagttgtttgacaagctagcactgcgcttccatggcagactgctgttcctgaaagacgtactgggagacgaaatctgttgctggtccttctacggccaggggcgtaagatcgccgaagtgtgttgcacaagcattgtgtacgcgaccgagaagaaacagaccaaagtggagttccccgaggcgagaatttttgaagagactctgaacattctcatctacgaaactccccggggtcccgatccggcactgctggaagctactggcggggccgccggcgccggaggtgccggtcggggagaggatgaagaaaatcgtgaacaccgcgttaggcgaatccatgttcggcgccacattactcacgatgagcgaccccatggccaacagatcgtgtttaaggactag

SEQ ID NO: 200145 - DNA, 1287 bp, Artificial Sequence
  Description of Artificial Sequence: Synthetic coding sequence
atggccctgagcggcaactgcagccggtactacccccgggagcagggatctgcggtgcccaatagcttccctgaggtagtggaactcaatgtgggtgggcaggtttacttcactcgccattctaccctgatctctattcctcactccctcctgtggaaaatgttctctcccaagagggacactgcgaatgatctggcaaaggacagcaaaggcagattctttatagacagggacggctttttatttcgttacattctggattatctgcgggataggcaggttgtcctccctgaccactttcctgaaaaaggacgtctaaaacgcgaggcggagtatttccagctcccagaccttgtgaagttgctcacccccgacgagatcaagcaatccccagacgaattttgtcactccgactttgaggatgcctctcaggggagtgacacccgcatctgccctccgtccagtctgcttccagctgaccgtaaatggggatttattacggtggggtatagaggctcttgcacactcggccgggagggacaagcggacgcaaaatttaggcgtgtgcctcgcatactcgtctgtgggcggatttcactggcaaaggaggtgttcggagagaccctgaatgaaagtcgcgatccagacagggcacccgaacgatacacgagtaggttttatctcaaatttaagcatcttgagagagcattcgacatgttgagcgaatgtggctttcatatggtcgcatgcaactcctcagtgacagccagctttatcaaccaatacactgatgacaagatctggagttcatacaccgagtacgtcttttacagagagcctagcagatggtctcctagccattgtgactgctgttgcaaaaacggcaagggggataaggagggcgagagtggcacgagctgtaacgacttgtccaccagttcttgcgatagtcagagcgaggctagctcgcctcaggagacagtgatttgtggaccggtgacaagacagaccaacatccaaaccctggatcggcccatcaaaaaaggtcccgtccaactgatacagcagtctgagatgagaaggaagagcgacttgttgcggaccctgacgtccggaagccgagagtctaatatgtcatcaaagaaaaaggccgtgaaagaaaagctgtcaattgaggaggagttagagaaatgcattcaagactttttgaaaatcaagatcccagataggttcccggaaaggaagcacccttggcagagcgaactgctacggaagtaccacctgtag

SEQ ID NO: 200146 - DNA, 1287 bp, Artificial Sequence
  Description of Artificial Sequence: Synthetic coding sequence
atggccctgagcggcaactgcagccggtactacccccgggagcagggatcggctgttcctaactcattccccgaggtcgttgaactgaacgtgggaggccaggtgtattttacaaggcatagcacactgatttccatccctcattctctactgtggaagatgtttagccccaaacgggacactgccaacgatctggccaaagactcaaagggccgcttctttattgatcgcgacggatttctgtttaggtacatcctggattacctcagggaccgacaggtagtgctgcccgatcactttccggaaaaaggcaggctgaaacgcgaggcagaatattttcagttgccggacctggtcaagttattgacccctgacgaaattaagcagtcccctgacgagttttgtcactcagatttcgaggacgcgagccaggggagcgatacaaggatttgtccaccaagtagcctgctccccgccgatcgaaagtgggggttcatcaccgtaggatatagaggtagttgcaccctgggtcgagagggtcaggcagacgccaaattccgcagagttcccagaattcttgtatgtggtcggatctccttggccaaggaggtctttggggagacgttaaacgagtcacgggacccagaccgggcccctgaacgctacactagtcggttctatctgaagtttaaacacctggagagggcctttgacatgctctcagaatgtggatttcatatggtagcctgtaattcttctgtgactgcatcattcattaatcagtatactgacgataaaatttggagcagttacactgagtacgtgttttacagggagccctccaggtggtcaccttcccactgcgactgctgctgcaagaacggaaagggggacaaggagggcgagagcggaacctcttgtaacgatctgtctaccagctcttgtgatagtcagtctgaggcttcaagtccgcaggagaccgttatatgcggcccggtgacaaggcagaccaacatacagacgttggaccgccccatcaagaaggggccggttcagctgattcagcagagcgagatgcgtaggaaatccgatttactgagaactctgaccagcgggtcccgcgaaagtaacatgtcatctaagaagaaagccgtgaaagaaaagctgtctatcgaggaggagctggaaaagtgcatccaagattttttgaagattaagatacccgatcggttccccgaacggaaacacccatggcaatccgaactgctgaggaaataccatctgtag

SEQ ID NO: 200147 - DNA, 792 bp, Artificial Sequence
  Description of Artificial Sequence: Synthetic coding sequence
atggccgagctgcagctggaccccgccatggccggcctgggcggcggcgggggctccggtgtgggggacgggggcggcccagtacggggcccaccttccccacgtcctgcggggcccaccccgagaggtcatggccgacctgcagccgcagttgcacaaccgctggaacccggaccaggaccacccgaacgtgctggcggcggcggggctgcccggtgggtcagactgaacgtggggggcacatactttgtgaccactcggcagaccctagggcgggagcctaagagcttcttatgtaggttgtgttgtcaggaagaccctgagctggacagtgataaggatgaaacgggggcctacctgattgatcgagatcccacttacttcggtcctatcctgaattacttgagacacggaaagctgatcattaccaaggagctggcagaggagggggtgctcgaggaagcagagttttataatattgcttcccttgtgcggttagtcaaagaacggatccgcgataacgagaaccgaacctcacagggccctgtaaaacacgtgtatcgggtcctgcagtgccaggaagaggagcttacgcaaatggtctcaaccatgagcgatgggtggaaattcgagcagttaatttccattggcagtagctacaactatggcaatgaagaccaggcggaattcttgtgcgtggtgagtcgcgaactcaacaactcgactaatggtatcgttattgagccgtctgaaaaagcaaagattctccaggaacgcggcagcagaatgtag

SEQ ID NO: 200148 - DNA, 738 bp, Artificial Sequence
  Description of Artificial Sequence: Synthetic coding sequence
agcctgccccggaacggccccgcccggctgcgggccggcagcagcggaggcggcggagggccaaggtggaggaactgctcatggacccggagatggaggggatgggaaggcgctccaggtccgggtcccccagagcgcgccgggggcggtggcgccgctcgttgggttaggctcaacgtgggtggcacatacttcgtgacaactcggcagaccctgggtcgtgaacctaagtcttttctttgtaggctgtgttgccaggaggatccagagctggattctgataaggatgagactggggcttacctgattgaccgggaccctacctacttcggccctatcttgaattatctgcgtcacggaaagcttatcatcacaaaggagcttgctgaagaaggcgtgcttgaggaggcagaattctataacattgcatctctggtacggctggtcaaagagagaatccgcgataatgagaacaggactagccaggggccagttaagcatgtgtaccgtgtcctgcagtgtcaggaggaagagctgactcaaatggtatccaccatgagtgacggatggaagtttgagcagctgatctcaatcggcagtagctacaactacggcaacgaagatcaggctgaatttctttgtgtggtctcccgggagcttaacaattctactaatggaatcgtcatcgagccttccgagaaagccaagatcctgcaagagcgtggatcccgtatgtag

SEQ ID NO: 200149 - DNA, 2448 bp, Artificial Sequence
  Description of Artificial Sequence: Synthetic coding sequence
atggccggcggccactgcggcagcttccccgccgccgccgccggctcaggagagatagttcaactgaacgtgggaggaacacgcttttccacgtcccgccagacactcatgtggattcctgactcattcttctcctcactgctgtctggccgcatatccactttaagagacgagacaggtgccattttcattgaccgggaccccgctgcatttgctccaattttaaactttcttagaactaaagagctggacctcaggggggtatccatcaacgtactccggcacgaagcggaattttacggcatcacgcccctggtgagacggctgctgctttgtgaggaactggagcgttcttcatgtggctctgtcctttttcacggctacttaccaccaccaggcatccctagtcgcaaaataaataatacagtccgttctgcagattccagaaatggcttgaattccaccgaaggagaggcacgcggaaacggcactcaacccgtcctctccggcaccggcgaggaaactgtcaggttgggcttcccagtggatccgaggaaagtactcatcgtcgccggccatcacaactggattgttgccgcttatgctcacttcgctgtgtgttatcggatcaaggaatcttcaggctggcaacaggtttttacctccccttatctggactggacaatagaacgagtagctctaaatgctaaggtggtgggggggccccatggagataaggataagatggtggccgtggcgagtgagtctagtattattctatggtctgtgcaagacggcggctctggcagcgaaataggggtcttctctcttggagtccccgttgacgccctcttttttatcggcaatcagctggttgccacgagtcacacagggaaggtgggagtgtggaacgctgtgacgcagcattggcaggtccaggacgtggtccccatcacaagttatgacacggccggctctttccttctacttggctgcaacaacggctccatttactacatcgacatgcagaaatttcccctgcgcatgaaagataacgacctccttgtgaccgagctctatcacgacccctcgaatgatgccataacggccctgtctgtttacctaactcctaagacctcagtttctggaaactggattgagatcgcttatggtacctcatcaggcgcagtgagggttatagtccaacacccagaaaccgtgggcagcgggccccaactgttccagacattcaccgtccaccgtagcccggtgactaagattatgctaagcgagaaacatttagtttccgtctgtgcagacaacaaccacgtgcgaacctggaccgtcactcggtttcgcgggatgatctcaacacagccaggcagcacaccgctggcctctttcaaaatcctgagcctcgaggagaccgaatcccacggcagctattcaagcggtaatgacattggaccattcggggaacgagatgatcagcaggtattcatccagaaagtcgtgccaatcaccaacaagctcttcgtgaggctgtcatccacaggcaagcgcatatgcgagattcaggctgtggactgtacaaccattagtagtttcaccgttcgggagtgcgaggggagttctcgcatgggtagccgcccgcgaaggtatctctttactggccatacgaacggctcaatacagatgtgggacttgaccaccgccatggatatggtaaacaagtcagaggacaaggacgtcggcggacctaccgaagaggagctactgaaactgctggatcagtgcgatttaagcacgagcagatgcgccaccccaaatatctccccggctacctcggtggtgcagcactctcatttgcgcgaaagcaactcgagtctccagctgcagcaccacgatactacacacgaggctgccacatatggctcaatgagaccttatagagagagccccttattggctcgcgcccgacggactgaaagctttcacagttatcgtgacttccagacaattaatctgaatcggaatgttgagagagcagtgccggagaatggcaacctgggtccaatccaggctgaagttaaaggtgctacaggggaatgcaacatttctgaaaggaagagcccgggggtggaaattaagtctctccgtgaattagactcgggactcgaggtccataaaattgccgagggcttttcagagagcaaaaagagatcatcagaggacgaaaatgagaataaaatagaattccggaagaaggggggtttcgagggtggggggtttctgggccggaagaaagtcccatacttggctagctccccctccacttcagatggtggcacagactcgcccgggacagctagtccatcgccgacaaagaccacaccttccccgcgtcacaagaagagtgacagttccggccaggaatactctctgtag

SEQ ID NO: 200150 - DNA, 723 bp, Artificial Sequence
  Description of Artificial Sequence: Synthetic coding sequence
atggccggcggccactgcggcagcttccccgccgccgccgccggcagtggggagatagtccaactcaatgtgggaggcacgagattttcaactagtagacagactctaatgtggatcccagactccttctttagtagcctcctgtcaggcagaattagtacactccgcgacgaaactggcgctatattcatagacagagatccagccgctttcgccccaatactgaattttctgaggactaaagaactcgacttaaggggggtgagcatcaatgtgctccgtcacgaggctgagttttatggcattacgccccttgtgcggcggctgctcctatgcgaggaactggaacgaagctcttgcggtagtgtcctcttccatgggtatcttccaccacccgggatcccctctaggaaaattaacaacaccgtgcgttccgcagatagtcggaatgggctcaatagcacagagggcgaagccagggggaatgggacgcagcctgttctttcagggaccggcgaagaaaccgtgcggttggggttccccgtggacccaaggaaagtgctcatcgttgccggtcatcataactggattgtcgccgcctatgcacactttgcagtctgttatcgcgtgttctggttagggaccgtgggtcacgcatgtaacccctctaccctggggggtcgagacggctggtcatcaagatcagctcgacccacatggtag

SEQ ID NO: 200151 - DNA, 567 bp, Artificial Sequence
  Description of Artificial Sequence: Synthetic coding sequence
atgaaggacaacgacctgctggtgaccgagctgtaccacgacccctccaatgatgccatcaccgccctgtcggtgtacctgacccctaaaacttctgtatcaggaaactggattgagatcgcatatggcacatcctccggtgccgtgcgcgtcatagtgcagcatcccgagacagtcgggtccggaccacagcttttccaaaccttcacagttcatcggagccccgttacaaaaattatgctgtccgagaaacatctggtctcggtgtgcgccgataacaatcatgtcaggacctggacagtaacccgattcaggggaatgatcagcacccagccagggtccacaccactggcctcctttaagatactcagtctggaggagactgaaagtcatggctcctattcttctggcaacgacataggaccatttggcgaaagagacgaccagcaagtgtttattcagaaggttgtgccaattacgaataaactgttcgtacgactaagctccacaggcaagtcactgtgcggcgtttcgctggttagtagatcatcccaggaacccacatag

SEQ ID NO: 200152 - DNA, 642 bp, Artificial Sequence
  Description of Artificial Sequence: Synthetic coding sequence
tgattcagcaccagccggcagaccctgatgtggatccccgacagcttcttctcttccctcctgtcaggccgcatttctactctgcgggacgagacaggcgcgatcttcattgatagagaccctgccgctttcgctcctatactaaatttcctgcgcacaaaagaattggacctaagaggtgtatcaatcaatgtgctgcgacacgaagctgagttctacggaatcactcctttggtgagacggctcctgctatgtgaagagcttgaacggtcctcatgcggaagcgtcttgttccacggatatcttccccctcctggcattccgagcagaaagatcaacaacacagtgaggagcgccgatagtcgtaatggcctgaactccactgagggtgaggctagagggaacggtacgcagccagttttgagtggcacaggagaagaaactgtgaggttaggtttcccagtggatcccagaaaggtgctgatagtggctggccaccataactggatagtggccgcgtatgcccacttcgctgtgtgctatagagtgttctggctgggcaccgtcggtcacgcttgcaatccaagtaccctggggggacgggatggttggtcatcaaggtctgctagaccaacttggtag

SEQ ID NO: 200153 - DNA, 507 bp, Artificial Sequence
  Description of Artificial Sequence: Synthetic coding sequence
tgagccctgagcgtgtacctgacccccaagaccagcgtgagcggcaattggatcgagatagcctatggaacctcgagtggcgccgtacgcgtaatcgtgcagcaccctgaaaccgtcggaagtgggccgcagttatttcagacgtttactgtgcaccgctctcccgtcactaagattatgttaagtgaaaagcacttagtatcggtttgtgctgacaacaatcacgtccgcacctggacggtcacgagatttaggggcatgatcagcacacaaccaggcagcacccccttagcgagtttcaaaatcctcagtcttgaggagacagaatcgcacgggagctatagcagcggaaatgacatcggaccttttggcgagagggacgaccaacaggtcttcattcaaaaggttgtaccaattactaataaactattcgtgcgactctcttcaaccgggaagtccctatgtggcgtttcattggtgtcaagatccagtcaggagcccacctag

SEQ ID NO: 200154 - DNA, 870 bp, Artificial Sequence
  Description of Artificial Sequence: Synthetic coding sequence
atggtggtggtgaccggccgggagcccgacagccggcggcaggacggggcgatgtcttcttccgacgctgaggacgatttcctggagcctgccaccccaactgccactcaggccggccacgcattgcccctattgcctcaggaattccccgaggtagtccccctgaacattggcggagctcactttactacccggttatccacccttcgttgttacgaagataccatgttagcagccatgttcagtggtcggcattacatccctactgacagtgaaggcagatatttcattgatcgggacggtactcatttcggggatgtgctgaatttcctcaggtccggggatctccctccccgggaaagggtacgcgccgtatataaggaggctcagtattacgccataggacctttactggagcaactggaaaacatgcagcccctgaagggggaaaaagttagacaagctttcctaggtctgatgccatattacaaggaccacctcgagagaattgtggagatcgcccgcctcagagcagtccagcggaaagctcgattcgcaaagctgaaggtctgtgtcttcaaagaagagatgccaatcactccatatgaatgtccactattgaatagtttgcgcttcgaaagaagtgagtcggatgggcagctatttgagcaccactgcgaagtggacgtctcctttggaccatgggaggctgtggcagatgtttatgatttgctgcattgcctggttactgatctgtccgctcaaggccttactgtggaccaccagtgtattggagtgtgtgacaaacatcttgtcaatcactactattgtaaacggccaatatatgaatttaaaatcacctggtggtag

SEQ ID NO: 200155 - DNA, 1728 bp, Artificial Sequence
  Description of Artificial Sequence: Synthetic coding sequence
gtgagccggaagaagatgagcctgaagagcgagcggcggggcatccacgtagaccaatccgacctgctctgcaaaaagggatgtggttactatggcaatcctgcttggcaagggttctgttccaagtgctggcgggaagaatatcacaaggcaaggcagaagcagattcaagaggactgggaacttgccgaacgcgttctgctctgttatccgggttggtctgccatggtgcagttccagcttaccgccacttcggcttcgtgggcgcaggttattctgctgctccagcctccaaatgttctagggctgcaggccttgcagagggaagaagaggaggcctttgcatctagtcaatcatctcaaggagctcaaagcctcacgtttagcaagtttgaagagaagaagacaaatgagaagacaaggaaggtgacaactgtgaaaaagttcttctcagcttccagtcgggtcggaagcaaaaaagaaatccaggaggccaaagctccatctccatccatcaacaggcaaacatccatcgagaccgacagggtatctaaagagtttatcgaattcctgaagacattccacaaaactgggcaggagatctataagcagaccaaattgtttctggagggcatgcattataaaagagatctgtcaatcgaggagcagtccgaatgcgcccaggacttttaccacaacgtagccgagcggatgcaaacgagaggcaaagaaagacgctttcaccatgttggccaggctggcctcgaacttctcacctcaggcgatccacccgcctccgcctcccagagcgctgggaataccggagtcgagcctccacacccggctgtcccgcccgaacgggttgaaaagattatggaccaaattgaaaaatacatcatgactagactttacaaatacgtgttctgccccgaaaccaccgatgatgagaagaaagatcttgccattcaaaaaagaatccgcgccctgaggtgggtgacaccgcaaatgctctgcgtccctgtgaacgaggacattccagaggtgagcgatatggtcgtcaaggctataaccgatatcattgaaatggacagcaagagggtgccgcgagataagctggcatgcattaccaaatgctctaaacacatatttaacgccatcaaaattacaaagaacgaacccgcatccgcagatgactttctgccaacactcatctatatcgttcttaagggcaaccctcctcggctgcagtctaatatccagtatatcacccgtttttgcaacccaagtcggcttatgaccggcgaggacgggtactatttcacaaatctgtgttgtgcagtcgcgttcatcgagaagctcgatgcacagtcacttaatttaagtcaggaggatttcgatagatacatgtctggtcagacatcccctagaaagcaagaggcagagtcttggagcccagatgcctgcttgggagtgaaacagatgtacaagaacctagacctgctgtcgcagctcaacgaacgccaggaacggatcatgaacgaggcaaagaaactcgagaaggacctcatcgactggactgatgggatagcacgggaggtacaagacatcgtcgaaaaatatcccctggaaatcaaaccaccaaaccagcccctcgccgcaatcgactccgagaacgtcgaaaacgacaaactcccacccccactgcagcctcaggtgtacgcggggtag

SEQ ID NO: 200156 - DNA, 1596 bp, Artificial Sequence
  Description of Artificial Sequence: Synthetic coding sequence
atgagcctgaagagcgagcggcggggcatccacgtggaccagagcgacctactgtgcaagaaaggttgcggctactatggaaaccccgcttggcaggggttttgcagcaagtgctggcgagaagagtaccataaagccagacaaaaacagatacaagaagactgggagctcgcagaaagagttttgctttgttatccaggttggtctgctatggtccaattccagctgactgccacatctgcaagctgggcacaggtgatcctgttgctgcaaccgcctaacgtccttggactacaggcgcttcagagggaagaagaagaggcttttgcctcctcccagtcatcccaaggcgcccagtcactgacgttttctaaatttgaggaaaagaagaccaatgaaaagacaaggaaagtgaccactgtgaagaagtttttctctgcttcttcccgggtcggatccaaaaaggaaattcaggaggcaaaggccccatctccttctattaatcgccagacctccatcgagacagatagagtgtcaaaggagtttatcgagtttctgaagacattccacaagacaggtcaggagatatataagcaaacaaagctgttcctggagggcatgcattacaaacgggatctcagcattgaggaacaatctgagtgcgcacaggacttctaccacaatgtggctgagagaatgcagacccgaggcaaagttcctcctgagcgggtggaaaagatcatggatcagatcgaaaagtatatcatgaccagactatacaagtacgtcttctgtcctgagactacagacgacgagaaaaaggacctcgccattcagaaacggattcgcgccctaagatgggtaacccctcagatgctgtgtgtaccggtcaacgaagatatcccggaggtttccgatatggtcgtgaaagcgattaccgatattattgagatggattcaaagcgcgtcccacgcgacaaactggcttgcatcactaagtgctcaaagcacattttcaacgctatcaagattaccaaaaacgagccggcgtcagccgacgacttcctccctaccctgatctatatcgtcctgaagggcaaccccccacgcctacagtcgaacatacagtatattactcggttttgtaaccccagccggctcatgaccggggaagatgggtactatttcacaaacctctgttgtgcagttgcgtttattgaaaaactcgatgcccagtcactgaatctgtctcaggaggattttgatcgctacatgtctggacaaacttcgcccagaaagcaggaggccgaaagctggtctcctgatgcttgtttgggtgttaaacagatgtataaaaatctcgatcttctatcccagctgaatgaacgacaagagaggatcatgaatgaggcgaaaaaactggagaaggacttaatagattggaccgatggtatcgcaagagaggtgcaagatatcgtcgaaaagtaccctttagagatcaagccaccaaaccaaccactggcggcgatcgattccgagaacgtggaaaatgataaattacccccacctctccagccgcaggtatacgcaggctag

SEQ ID NO: 200157 - DNA, 1476 bp, Artificial Sequence
  Description of Artificial Sequence: Synthetic coding sequence
atgagcctgaagagcgagcggcggggcatccacgtggaccagagcgacctcctgtgcaagaaaggctgcggatactatggcaatcccgcctggcaaggcttctgcagcaagtgctggcgtgaagagtatcacaaagcacgccagaagcagatccaagaagattgggaactcgcagagcgactgcaaagggaggaagaggaggccttcgccagcagtcaaagcagtcagggcgcccagtcacttactttcagcaaattcgaggaaaaaaaaaccaacgagaagactcggaaagtcaccactgtgaagaaattcttctctgccagcagtagggtcggctccaagaaggaaatccaggaagcgaaagcgcctagcccgagtattaacagacaaacttccatcgagaccgatcgtgtttcaaaggaattcatagagtttcttaaaacatttcacaaaacaggacaagagatctacaaacagaccaagttgtttcttgaaggcatgcactacaagcgggatctgagcattgaagagcagagtgagtgcgcccaggatttttaccacaatgtggcggaaaggatgcaaactcggggcaaagtcccacctgagcgcgtggaaaagattatggaccaaattgagaagtacataatgacgcgactctataagtacgttttttgccctgagaccaccgacgatgaaaaaaaggatctggccatccagaagagaataagagccctccgctgggtgactccccaaatgctgtgcgtacccgtcaacgaggatatacccgaagttagtgatatggttgtgaaggccattacagatattatcgagatggactccaaacgcgttcctagggataaactggcctgtataacaaagtgttcaaagcacatattcaatgccatcaaaattacgaagaacgagcccgcatctgcagatgatttcctacccaccctcatttacatagttctgaaaggaaaccccccacgtctccagtcgaacattcagtacattacccgattctgtaatccgtctcgtctgatgacgggggaggacggatattatttcactaatctgtgttgtgcagtggcctttattgaaaaacttgacgctcagtctctcaatctttcccaggaggacttcgacagatacatgagcggacagacatcaccacggaagcaggaagcggaaagctggagccccgatgcatgccttggggtcaaacagatgtacaaaaacctggacctgctatctcagcttaatgaacggcaggaacggatcatgaacgaggccaagaaactggaaaaggatctgatagactggacggatggcattgcccgggaggtgcaggatatagtggagaagtaccctctcgagataaagcccccaaatcaaccattagccgctatcgactctgaaaacgtagagaacgacaagctccccccaccgctacagcctcaggtgtacgccggatag

SEQ ID NO: 200158 - DNA, 1476 bp, Artificial Sequence
  Description of Artificial Sequence: Synthetic coding sequence
atgagcctgaagagcgagcggcggggcatccacgtggaccagagcgacctactctgcaaaaagggctgcggatactacgggaacccagcctggcagggcttttgctctaagtgctggcgcgaagaatatcataaggcccggcagaagcagatacaggaagactgggagctggccgagcggctgcagagagaggaggaggaggcattcgcttccagtcagagcagccagggcgctcagagccttacattcagcaagttcgaagaaaaaaaaaccaatgaaaagaccaggaaagtgacgaccgttaagaagttcttcagtgcatcaagcagggtgggaagtaaaaaggaaatccaggaggctaaggctccttcccctagcatcaatcggcaaacttcaatcgaaacagaccgagtgtcgaaggagtttatagagtttcttaagaccttccacaagactggccaggaaatttataagcagacaaagttattcttggagggaatgcactacaaacgggacctctctattgaagagcagtccgagtgcgctcaggatttttatcacaatgtggcagaaaggatgcagacacgcggaaaggtcccgcccgaacgagtggagaaaattatggaccagatcgagaagtacataatgacaagactgtataaatatgtgttttgtccagagaccaccgatgatgagaaaaaggatctggctattcaaaaacgtattcgggccctacggtgggtgactcctcagatgctgtgtgttccggtaaacgaagacattcccgaggtgtcagacatggtggtgaaagccatcacagacattatcgagatggactcaaagagagtcccgcgcgataaactagcttgcattactaaatgttccaagcatattttcaacgccatcaaaatcacaaagaacgaaccggccagtgccgatgactttctgccaacactgatttatatagtgctgaaaggcaatcccccaaggctccagtctaatatacagtacatcaccaggttttgcaatccctcgcgcctaatgacaggcgaggatggctactattttactaacctctgctgcgcagtggcattcatagagaaattggacgctcagtccctcaatcttagccaggaggacttcgacaggtatatgtcaggccagacctctcccagaaagcaggaggccgagtcatggtcacctgatgcatgtctcggcgtgaagcagatgtacaaaaacttagatttgctgtcgcaacttaacgagcgacaggaacgtattatgaatgaggccaaaaagcttgagaaggatctcattgactggacagacggcattgcacgcgaagtgcaggacatagtggagaaatacccactggaaattaaaccgccaaaccagcctctggctgccatcgacagcgaaaacgtagagaatgacaaattgccgcctccattacagccgcaggtgtatgctgggtag

SEQ ID NO: 200159 - DNA, 1224 bp, Artificial Sequence
  Description of Artificial Sequence: Synthetic coding sequence
atgagcctgaagagcgagcggcggggcatccacgtggaccagagcgacctcctgtgcaagaagggatgcgggtactatggtaaccccgcctggcaggggttctgttccaagtgttggagagaggagtaccacaaggcccgacagaagcaaattcaggaggactgggagctcgctgagaggctgcagcgagaagaagaggaagcttttgcatctagtcagtccagccagggcgcgcagtccctcaccttttccaaatttgaagagaagaagaccaacgaaaagacgagaaaggtgacaaccgtcaaaaaatttttctcagcttcctccagggtcgggtccaaaaaacctcccgaacgtgtagaaaagatcatggatcagatagagaagtatattatgaccaggctttataagtatgtgttctgtcctgagaccacggacgatgagaaaaaggacctagctattcagaagaggattagagccctacggtgggttactccacagatgctttgtgtccctgtcaatgaagacatacctgaagtctccgacatggtggtcaaagccattacagatatcattgaaatggatagcaaacgtgtgcctcgcgataagctggcatgcatcactaagtgttccaaacacattttcaacgccatcaagattacaaagaacgagccagcgagcgccgatgactttttgcccacattgatatacattgtgctgaaggggaatcctccaaggctgcagagcaacattcagtatattaccaggttttgcaaccccagccggctgatgacaggggaggatggctattacttcaccaacctttgttgcgctgtggcatttattgagaagttagacgctcagtccttgaacctatcacaagaggactttgaccggtacatgagtggccagacatccccaagaaagcaggaggccgagtcctggtcccccgacgcttgtcttggggttaagcaaatgtataagaatttggaccttctttctcaattaaatgaaaggcaggaacgcataatgaacgaggcaaagaaactggaaaaggatctcatcgactggacagacggcatcgcgcgggaggtgcaagatatagtggagaaataccctctggaaattaagcctccaaaccagccgctcgctgccattgatagcgaaaatgttgagaacgacaaactccctccaccgttacagccccaggtatatgctggctag

SEQ ID NO: 200160 - DNA, 867 bp, Artificial Sequence
  Description of Artificial Sequence: Synthetic coding sequence
atggtggtggtgaccggccgggagcccgacagccggcggcaggacggcgcaatgtccagtagtgacgccgaagacgactttctggagccagctactccaactgccactcaggcaggacatgccttgcccctactccctcaggaatttccagaggtggtcccactgaacattggaggagcccatttcacaacccggctgagtacactccggtgctatgaggatactatgttggccgctatgttcagcggcaggcattacattcctactgattcagaggggaggtacttcattgatagggacgggacacactttggtgacgtgctgaactttctgcgaagtggtgacctgcccccgagggaaagggtgcgggccgtatacaaagaggctcaatattacgctatcggcccgctcctcgagcagctcgagaacatgcagccactgaaaggcgagaaggtgcgccaggccttccttgggctaatgccatattacaaggatcatctggaacgcatcgtcgagattgccaggctgcgtgccgtgcagagaaaggccaggtttgccaaactgaaagtctgtgtattcaaagaagaaatgccgattaccccatacgagtgccccctactgaatagcctccggtttgaacgctctgagagtgacgggcagttgtttgaacaccactgcgaggtcgatgtgagttttggaccttgggaagccgtcgcggatgtttatgatctcctacattgtctggtgacggatctctccgcccaggggctcaccgtggaccatcagtgtatcggcgtctgtgacaaacatctggtgaatcactactactgtaaacggcccatatacgagttcaagataacctggtag

SEQ ID NO: 200161 - DNA, 663 bp, Artificial Sequence
  Description of Artificial Sequence: Synthetic coding sequence
atgaagggctacggccacaccgtgcccctgagcgacggcggcaaggctttttgcatcatttactccgtcataggcatcccgtttacattgctcttcttgacagccgtggtgcagcgtatcactgtgcacgtcacccgccgtcctgttctttatttccacatacgatggggcttttctaagcaggtggtggccattgtccatgccgtacttctgggcttcgtaaccgtgtcttgtttctttttcattcctgccgccgtgtttagtgtgttagaagacgattggaattttctggaaagtttttatttctgcttcatttctttatctaccattggtttaggcgactatgtacctggggaggggtacaaccagaaattcagagagctttacaaaatcggcatcacatgttatctcctgctaggactgattgctatgctggtagttctggaaactttctgtgagctgcatgaactcaagaagttcagaaaaatgttctatgttaagaaggataaagacgaggatcaggtccacatcatcgagcacgaccagttgtccttcagcagcatcactgatcaggctgcaggaatgaaggaggaccagaagcaaaatgagccttttgtggccacacagagttccgcatgtgtcgacgggcctgcaaatcattag

SEQ ID NO: 200162 - DNA, 1011 bp, Artificial Sequence
  Description of Artificial Sequence: Synthetic coding sequence
atgctgcagagcctggccggcagcagctgcgtgcggctggtggagcggcacaggagtgcatggtgttttggcttcctggttctgggctacttactgtatctagtttttggcgcagtggtatttagctcagtggaactcccctacgaagacctgttacgacaagaactgagaaagctgaagaggagatttctggaggagcacgaatgcctcagcgaacagcagctcgaacaatttcttggccgcgtgttggaagccagcaactatggcgtatccgttctgtcaaatgcgtctgggaattggaattgggatttcaccagtgcactgttcttcgcatcaacagtactgagtacaacaggctacggccacaccgttcctctgtctgacggcggaaaggctttctgtatcatttattccgttattggtattccctttaccctgctatttctcaccgccgtcgtgcagcgcattactgtgcatgtcacccgccgtccagtgctctatttccatatcaggtgggggttcagtaagcaagtggtcgccatcgtccatgcagtgctgctggggtttgtcaccgtgtcctgttttttctttatacccgccgcagtcttttcagtgctggaagacgattggaattttttggagagtttttatttttgtttcatctcacttagcactataggcttaggcgactacgtaccgggtgagggctataaccaaaagttccgcgaactgtataaaatagggatcacttgctatttgttgctcggactgattgctatgctcgtggtgctggaaaccttttgtgagctgcacgaactgaaaaagttccggaagatgttctacgtgaaaaaggacaaggatgaggatcaagtgcacattattgagcatgaccaactgagcttttcctccatcactgaccaggctgccggcatgaaagaggatcaaaagcagaacgaacccttcgtcgctacacagagtagcgcctgtgtagacggcccggcaaaccattag

SEQ ID NO: 200163 - DNA, 729 bp, Artificial Sequence
  Description of Artificial Sequence: Synthetic coding sequence
gtgctgcgggtgctgagccccgacctggtgcggcggctgctgaaccttgcagtcagggcctttcaggttcccaagggggagagcttgaattttcccgaaagtactcccggctatggacacaccgtgcccctgagcgacggagggaaggccttttgcattatatattccgtaattgggatccctttcacacttttgttccttaccgcagtcgtccagcggatcacagtccatgtgaccaggaggccggtgctctactttcacatcagatggggcttcagtaaacaagtggtggccatcgtgcatgccgtgctgttgggtttcgtcaccgtgagctgctttttctttattcctgcagcagtgtttagtgtgcttgaagacgattggaactttctggagtctttctacttttgctttattagtctttccaccattggtctcggtgattacgtccccggagagggatataatcagaagtttcgagaactttacaagatcgggataacttgttaccttttactcggactaatcgcaatgctggttgtgctcgagactttctgtgaactgcacgaattaaaaaaatttaggaaaatgttctacgtgaagaaagataaggacgaagaccaggtgcacattatcgagcacgatcaactgtccttttctagcattaccgaccaggctgcgggcatgaaagaagaccagaagcagaacgagccattcgtcgccacctag

SEQ ID NO: 200164 - DNA, 1632 bp, Artificial Sequence
  Description of Artificial Sequence: Synthetic coding sequence
atggaggacggcttcaagggcgaccggaccgagggctgccggagcgattccgtcgccgtaccggcagctgccccagtctgccagccaaaatcagcaacaaatggccaaccacccgcccctgcccccactcctactccccgcctctcgatcagttccagggccacagttgtggcccgcatggaagggacctcacagggagggctccagaccgtgatgaaatggaaaaccgtagtggccattttcgtcgtagtggtcgtgtacctagttacaggagggcttgtgtttagagctctggaacaacctttcgagagttcccagaaaaataccatcgcgctggagaaagccgagtttcttcgcgaccacgtatgtgtttctcctcaggagctggagactctcattcaacatgccctggacgctgacaatgctggcgtgtctccgattggcaattcctcaaacaacagtagtcactgggacctgggctctgccttcttctttgcaggcacggtaattactacaatagggtatgggaacatcgcaccaagtaccgaagggggtaagatcttctgcattctttacgccatcttcggtattccgttgttcgggtttctcctggccggcattggcgatcagcttggcaccatcttcggcaagtctatcgcccgcgtcgagaaagtctttagaaaaaaacaagtctctcagaccaagatccgggttatctccacaatacttttcattctcgcagggtgcatcgtgttcgtgactatccccgccgttatttttaagtatatcgaagggtggacagctctggaatctatctacttcgtggtggtgacgttgactaccgtgggcttcggcgactttgtggccggcggcaacgctggtattaattaccgggagtggtacaaacccctagtatggttttggatactcgtcggacttgcatatttcgcagcggtcctgagtatgattggcgattggctgagggtgcttagtaagaagactaaagaggaggttggggaaatcaaagcacacgcagctgagtggaaagccaatgtgaccgctgagttccgtgagaccaggcggaggctaagtgttgaaatccacgataaactgcagcgcgctgcgacaatcagatcaatggaacgccgccgtctggggctggatcagcgcgcacacagccttgacatgctatctcccgaaaaacgcagcgtattcgcagcgctggacaccggtaggttcaaagcttcttcacaggagtcaattaacaataggcctaacaatttgcgcttgaagggcccagaacagttgaataagcatggccaaggcgcttctgaggacaatataattaacaaattcggatctacatcgaggctcacgaagcgcaaaaacaaagacctaaaaaaaacattgcccgaggacgtgcagaaaatttacaaaactttcaggaactactccttggatgaagagaagaaggaggaagagactgaaaagatgtgcaactctgataactcatcaacagcaatgttaaccgattgtatccaacaacacgcagaacttgagaacggaatgattcccaccgataccaaagatcgggagcccgagaacaactctcttcttgaggacagaaactag

SEQ ID NO: 200165 - DNA, 1632 bp, Artificial Sequence
  Description of Artificial Sequence: Synthetic coding sequence
atgaagttccccatcgagaccccccggaagcaggtgaactgggacccaaaggtcgcagtccctgccgccgcacctgtgtgtcagcccaagtcagctacaaacggtcagcccccggcgcccgctccaactcccacccccagactgtcaatttcctctagggcaaccgtggtagcgagaatggagggtactagccagggcggactacagacggtgatgaagtggaaaaccgtagtggccattttcgtagtggttgtcgtgtacttggtgacaggcggcctcgttttcagggctcttgagcagccttttgagtcctcacagaaaaacaccatcgctctcgaaaaagccgagttccttcgggatcatgtgtgcgttagccctcaagagctggagacactaattcaacacgctctagatgccgataacgccggtgtttctcctattggcaacagctcaaacaactcatcgcactgggacctgggctccgcctttttcttcgccggtaccgtgatcacaacaattggatatggaaacattgcaccttccactgagggaggaaagatattctgtatactgtacgcaatcttcgggatcccattgttcggatttctactggccggaatcggagaccagctaggcaccatatttgggaaatcaattgcgcgggtggagaaagtcttcaggaagaaacaggtctcccagactaagatcagagtcatttccaccattttattcatcctggccgggtgtatcgtgttcgtcactatccccgcagttattttcaagtacatagaagggtggactgctctcgaatctatatacttcgttgttgtcacgctcaccacagtcgggttcggcgatttcgttgcgggtgggaatgctggcattaattacagagaatggtacaagccactggtttggttttggatcttggtgggactggcatactttgcggcggtcctctccatgattggcgattggcttcgcgtgcttagcaaaaaaactaaggaggaggtaggcgagattaaagctcatgccgccgaatggaaagctaatgtgactgcagagtttagggaaactcgccggcgcctgagcgtagaaatccatgataaacttcagcgagccgctaccatcagaagtatggagagacggcgtctggggcttgaccagcgtgcccattccttggacatgctatcaccagagaaacgtagcgtattcgccgcactggataccggacggtttaaagcgtcttctcaggagtccatcaacaaccggccaaataatcttcggctgaaggggcccgagcagttgaacaagcatggccagggggcaagcgaagacaatatcatcaataagtttggttcaacaagccgcttaaccaaacggaaaaataaggacttgaagaagactctccctgaggacgtgcagaagatttataagacatttaggaattattccctcgatgaagaaaaaaaagaggaagagaccgaaaaaatgtgtaatagtgataactctagcacagccatgcttaccgattgtatccagcagcatgccgagctggaaaatgggatgattccaacggacacaaaggatagagagcccgagaacaactccctccttgaggataggaattag

SEQ ID NO: 200166 - DNA, 1617 bp, Artificial Sequence
  Description of Artificial Sequence: Synthetic coding sequence
atgttcttcctgtacaccgacttcttcctgagcctggtggccgtgccagccgccgcccccgtgtgccaaccgaagagtgccactaacggacaaccacccgcacctgcacctacccctacaccacgcctgtccattagttccagggctacggtagtagctaggatggagggcacctcccagggaggcctgcagaccgttatgaagtggaaaaccgttgtggcaattttcgtggtggttgtggtctatctcgtgaccgggggcctagtttttcgggctctcgagcagccctttgaaagctctcagaagaacacaatagcgctcgaaaaggccgaattcctgcgggaccatgtgtgcgtgtcccctcaagagctggaaactttgattcaacacgcacttgatgctgataatgcaggggttagtccaatcggcaacagctccaataactctagccattgggacctggggtccgcattcttttttgctggaacagtgataaccacaattggatacggcaatattgctccttcaacagagggggggaagatcttctgtattctttacgccattttcggcatcccattatttgggtttttactcgcagggatcggagaccagctcgggaccatctttggaaagagcatcgccagggttgaaaaggtgttccgcaagaaacaagtgtctcagacgaagatccgggtgatcagtacaatcctttttatcctcgctggttgcatcgtgtttgtcacaattcctgccgtaatcttcaaatacatcgaaggatggacggcattagaaagcatttattttgtcgtggtcactctgacgaccgtggggtttggggacttcgtggccggaggcaacgccggcattaactaccgtgaatggtataagcccctagtctggttctggattctcgtcggacttgcctactttgctgctgtgctgagcatgattggggactggttgcgtgtgctgtccaagaagacaaaggaagaagtaggtgaaatcaaggcgcatgccgcagaatggaaggcaaatgttacagcggagtttcgcgagacccggcgacggctgtctgtagaaattcatgacaaactgcaacgcgcggcaaccattcgaagcatggagagacggagactcggacttgaccagagggcccacagcctggacatgctgagccctgaaaaaaggagcgtgtttgccgcactcgacaccggacggttcaaggcctcctctcaggagagtataaataataggcccaataatctgaggcttaagggccctgagcagctgaacaagcatggccaaggagcaagtgaagacaacattattaataagttcggatccacctcaaggttaactaaaaggaagaacaaggatttgaaaaaaacactacccgaagatgtgcagaaaatctataagacattcagaaactatagcttggacgaggaaaaaaaagaggaagagacagagaaaatgtgcaattcagacaatagctccacagctatgcttaccgactgcatccagcagcatgccgaactggagaacggaatgatacccacagacaccaaggatagggaacctgagaataacagtctgcttgaagaccgcaactag

SEQ ID NO: 200167 - DNA, 1293 bp, Artificial Sequence
  Description of Artificial Sequence: Synthetic coding sequence
atgagcagccggagcccccggccccccccccggcggagccggcggaggctaccaaggccttcttgctgttgctgttgctgtcgaaggtctcacctcaacgaggacacaggaagattcgtcctactggcggcgttgatcggactttacctggtggccggagcgactgttttttctgctttagaatcgcccggcgaggccgaagcgcgggccaggtggggcgcgaccctgagaaatttctcagccgcacatggggtcgcagagcccgaactgagggccttcttgcggcattacgaggcagctctggcagccggcgtacgggcagatgctctccggcctcgatgggacttccctggagcattctattttgtgggcacagtcgtctccacgatcggcttcgggatgaccacccctgcgaccgtgggggggaaagcatttttgatcgcttatggcctattcggatgcgcaggaacgatattgtttttcaacctgttccttgaaaggataatcagcctcctggcctttatcatgagggcttgtcgcgaaaggcagttaagacggagcgggttgctgcctgcaacttttaggcgcggttccgccttgagtgaagcagatagcctcgccggctggaaaccgagcgtgtaccatgtcctcctgattttgggtctgtttgccgtgctgctttcttgttgtgcttccgcaatgtacacctccgttgagggctgggattatgtggatagcctctatttctgtttcgtaacttttagtaccatcggtttcggtgatctggtgagctctcagcacgccgcttaccgaaatcaggggctgtacaggcttggcaatttcttatttattctcctcggcgtctgctgcatttacagcctgttcaacgtgataagcatcctaatcaaacaggtactgaactggatgcttaggaagctctcctgccgctgttgtgcccgctgttgtcctgctcctggcgctcccctggctagacgaaatgcaatcacgccaggatctcgcctccggagacggctcgccgctttaggcgctgatcccgccgcccgggacagtgatgcggagggaaggcgtctaagtggagagcttatttcaatgcgggacctcaccgcctccaacaaggtgtctcttgcactactccaaaaacagttatccgagaccgcaaacggctatccccgttctgtctgcgtgaacacccgccagaacggtttttccgggggtgtcggagctctggggattatgaataaccggctggccgaaaccagtgcctcccgctag

SEQ ID NO: 200168 - DNA, 1227 bp, Artificial Sequence
  Description of Artificial Sequence: Synthetic coding sequence
atggccggccggggcttcagctggggccccggccacctgaacgaggataatgcacggttcctgctcctcgccgccctgatcgttctgtatctgttgggcggcgccgcagtctttagcgccctggaactggcccacgagcgtcaggccaagcaaaggtgggaggagcgcttggcaaatttctctcgcgggcataacctgtcccgtgatgagctgagaggcttcttgagacactacgaggaggctacacgggcaggtatccgggttgataatgtgaggcccaggtgggactttacaggcgccttctacttcgttggcacagtagtcagcacaatcggtttcggaatgaccacacccgctactgtagggggcaagatctttctgatattctacggtctagtaggatgctcttctactatcctgtttttcaatctttttctggagcgcttgataaccatcatcgcctacatcatgaaaagctgtcaccagcgccagctgcgacggcggggagctctgccgcaagaatctcttaaggatgcgggacagtgcgaggtggacagcttggctggatggaaaccaagcgtatactacgttatgctcatcctctgcacagcatctatcctcatctcttgttgtgccagtgctatgtacacaccaatcgaggggtggtcgtattttgacagcttatacttctgcttcgtcgccttctctactatcgggtttggggatctggtaagttcccagaacgcccactacgagagtcaggggttataccgcttcgcaaatttcgtgtttatccttatgggggtgtgctgtatctattcattatttaatgtgatctcgattctgattaagcaatcgctgaattggatccttaggaaaatggatagcggttgttgcccccaatgccagcgcgggctcctacgaagccgtcgaaacgtagtgatgcccgggagcgttaggaatcgctgcaatatttccatagagaccgacggagtggccgagagcgatacagatgggcgtcgtttgagcggcgagatgatcagcatgaaagatttactcgccgcgaacaaggctagtcttgccattcttcagaaacaattgtcagaaatggctaacggatgtccccaccagacttcaaccctagccagagacaatgagttcagtgggggagtaggcgctttcgctattatgaataacaggctggctgaaaccagcggagaccggtag

SEQ ID NO: 200169 - DNA, 993 bp, Artificial Sequence
  Description of Artificial Sequence: Synthetic coding sequence
atgcggcggcccagcgtgcgggccgccggcctggtgctgtgcaccctttgctacctgctggtgggagctgctgtcttcgatgctctggagtctgaggccgagtccggacggcaacggctgttggtccagaaacggggcgccctgcggaggaagttcgggttctctgcggaagactaccgagaattggaaagattggctctccaggcagagccacatcgggcaggacggcagtggaagtttcccggatccttctatttcgccatcacagtcatcacaaccatcgaatatggccacgcagccccagggacagatagtggaaaagtcttttgcatgttttacgccctccttggcattcccctcacacttgtgacattccagagcctgggggagcgtctcaacgcagttgtgagacgactactcctggccgcaaaatgctgtctgggattgcgatggacgtgtgtgagtactgagaatctggtcgtggccgggcttttagcatgtgcggccacactcgccttgggcgctgtcgcattttctcatttcgagggatggacctttttccatgcctattattattgctttatcaccctcaccaccataggttttggcgactttgtggcactgcagtccggagaagccttgcagagaaaactgccttatgtagctttctcctttctgtacatcttattggggctaactgtaatcggagcattcctgaatctcgttgtactcagattccttgtcgcttctgccgactggccagaacgcgcagcgcggacgcccagcccgcggccaccaggtgcccctgagtcccgagggctctggctgcctcgacggcctgcacggtcagtaggctcagcatctgtcttctgccacgtgcacaaactggagaggtgtgcccgggataacctggggttcagccccccctcatccccaggtgttgtccggggaggtcaagcccctcggctaggagcacggtggaagtcaatttag

SEQ ID NO: 200170 - DNA, 789 bp, Artificial Sequence
  Description of Artificial Sequence: Synthetic coding sequence
atgcccagcgccggcctgtgcagctgctggggcggccgggtgctgccactactgctcgcctatgtgtgttatctactgctgggcgctaccattttccagctgttggaaaggcaggctgaagcgcagtcaagggaccagtttcaactggagaagctgcggtttctggaaaactacacctgcctggaccaatgggcaatggagcaatttgtgcaagtgatcatggaggcctgggtaaaaggcgtcaatcctaaggggaactcaaccaaccccagcaactgggactttggctcaagctttttttttgccggcacagtggtgaccaccatcgggtatggcaacctggcaccaagcacagaagctgggcaagtcttctgcgtattttacgcactgcttgggatcccattgaacgtcattttcctcaatcacctgggaaccgggctccgcgcacacctggctgccatcgagcggtgggaagataggcccagaagatctcaagttctccaggttctgggccttgctttgttcctgacactggggaccctcgttatcctgatatttcctcctatggtgttctcccacgtggaaggctggagctttagtgagggcttttatttcgctttcatcacactcagtacaatcggattcggagactatgtcgtcgggctgcgccaaggatgtggagcgaaggccgcgcctgggcgcaggccacgtcgaggctctaccgccgcacgcggagtgcaggtgactccacaggactttccgatcagcaagaaaggactgggttcctag

SEQ ID NO: 200171 - DNA, 930 bp, Artificial Sequence
  Description of Artificial Sequence: Synthetic coding sequence
atgcccagcgccggcctgtgcagctgctggggcggccgggtgctgccactacttcttgcctacgtatgttatctgctgctcggggctactatattccaattgctagagcggcaggccgaggcacagtcgcgggaccagtttcagttagagaagctgcggtttctggaaaactacacttgcctggaccagtgggccatggaacaattcgttcaggtaatcatggaggcctgggtgaagggcgtgaatccaaaaggtaacagcacaaatccaagcaactgggatttcgggtccagcttcttttttgctgggacagtcgtgacgaccattggttacggtaacctggcgccatccacagaagctgggcaggtcttctgtgtgttctatgcgctgttaggtatacccctcaatgtcatctttttgaatcatctcggtacaggccttcgagctcatctcgccgcaattgagaggtgggaggaccgccccagacgaagtcaggtactacaagttctcggtctggcattattcctcacgcttggaactttagtcatactgatctttcctcccatggtcttttcccatgtggaggggtggtcgttctccgaaggcttctacttcgccttcatcacgttatccactattggtttcggggactacgtcgtgggcaccgatccaagcaagcactatatttctgtataccgctccctcgctgcaatctggattctgctgggtctcgcttggctggcactgatccttcctctgggtccactcttattgcatcggtgctgccagttgtggctgctgtccctgcgccaaggctgtggcgctaaagccgcgccaggaagacggcctcgtcggggcagcacagctgctaggggagtgcaggtaacacctcaggactttcccatttcaaaaaagggcctaggctcctag

SEQ ID NO: 200172 - DNA, 969 bp, Artificial Sequence
  Description of Artificial Sequence: Synthetic coding sequence
atgcccagcgccggcctgtgcagctgctggggcggccgggtgctgcccttgctgctggcgtacgtctgctatctgctgctcggagccacaattttccagctgttggagagacaggccgaagcccagagccgagaccagtttcaattggagaagctgcggtttctcgaaaattatacctgcctagatcagtgggcaatggaacaatttgttcaggtgatcatggaagcctgggtcaaaggtgtcaaccccaaaggaaacagcaccaacccgagcaattgggactttggatctagctttttctttgcgggcaccgtggtgaccactatcggttacggaaacctggccccgtctaccgaagccggacaggtgttctgcgtgttctacgccctactgggcatcccactgaacgtgatcttcttgaaccatttagggacagggctgcgcgctcatctggcggcaatagaacgttgggaggatcgccctcggagaagtcaggtgctgcaggtgctgggcctcgccctattcctcaccttgggcacccttgtgattctcatttttcccccaatggtgtttagccacgtggaggggtggtcctttagtgaaggcttctattttgcctttattaccctttccactattggtttcggtgattacgtggtcgggcatcctctcaatttcataaccccttccggcctgctcccctcccaagagcctttccagacgccacacggaaaaccggagtcacaacaaattcccggctcatttcaaaaggtgtcatcaatgaatgtgtggccccttagcggaatgcactctcccgggttagcgttccctctaccagattgtaatatacctgaccaggaacggtttaggccattgcaccccggagcttggaagttttggcccctgccacttccaagctctaactccaagtgggcgcccatgtggctggggagctctgcgcaggtttag

SEQ ID NO: 200173 - DNA, 885 bp, Artificial Sequence
  Description of Artificial Sequence: Synthetic coding sequence
atgcccagcgccggcctgtgcagctgctggggcggccgggtgctgccccttttgttagcctatgtgtgctacctcctcctgggagctacaatctttcagctactggagcggcaagctgaggctcaaagccgggaccagtttcagctcgagaaactcaggtttctggagaattacacctgtctggaccagtgggccatggagcaattcgttcaggtgattatggaagcctgggttaaaggcgtgaatcctaaaggtaatagcacaaacccgtctaactgggatttcggcagctcctttttttttgcggggactgtagtgaccactattggctacggcaacctggcaccttccacagaggctgggcaagtattctgcgtcttttacgccctgttgggcatccctctgaatgttatctttctcaatcatcttgggaccggtttaagggcgcaccttgcggcgatagagcgctgggaagaccggccacgaagatcccaggtccttcaggttctgggactggccttattcctcacccttggaacgctggtgatcctgatcttccctcctatggttttttcacatgtggaaggatggtctttctccgagggattctacttcgccttcattactctgagcactattgggttcggcgactacgtagttggtacagatcctagtaaacattatatcagcgtgtacagatcccttgcagcgatatggatcctgctaggcctggcgtggttagctctgatattgcctctcgggcccctgttgctgcacagatgttgccagctatggctcctgagtcggggcctaggtgtgaaagatggcgccgcttctgacccaagcggactgcctcgcccacaaaagatccccatctccgcatag

SEQ ID NO: 200174 - DNA, 594 bp, Artificial Sequence
  Description of Artificial Sequence: Synthetic coding sequence
atggagcagttcgtgcaggtgatcatggaggcctgggtgaagggcgttaatcccaagggcaattccactaacccaagcaattgggactttggttcatcgttcttttttgcggggaccgtggtgacaaccatcgggtatggcaatctcgctccctcaacagaggctggccaagtgttctgcgtgttctatgcgctgctcggaattccgttaaacgttatattcttaaaccatcttgggaccgggttgcgagcccacctggccgcgattgaaagatgggaagatagacccagacggtcccaggtactgcaagttctggggctggccttgttcctgactctgggtactctcgttattctgatcttccctcccatggtcttcagccacgtcgagggttggagtttttccgaaggattttatttcgcctttattactctgtcaaccatcggctttggagattatgtcgtgggcctgcggcagggatgcggggccaaggccgcgcctggaagacgacctcgcaggggaagcacggccgcccgtggggtacaggttactcctcaggactttcccatatcaaaaaaaggcttgggtagttag

SEQ ID NO: 200175 - DNA, 999 bp, Artificial Sequence
  Description of Artificial Sequence: Synthetic coding sequence
atgtaccggccccgggcccgggccgcccccgagggccgggtgcggggttgcgccgtgccttcaaccgtcctgctcctgctcgcgtacctcgcatacctagccctgggtaccggagtgttctggactctggagggtagagctgcacaggatagctctcgatcgttccagcgagacaaatgggaattgctacagaactttacatgccttgacagacctgctctcgactctttgatcagagacgtggttcaagcctataaaaatggagccagcctgctgtctaacactaccagcatgggaagatgggagttagtaggatccttcttctttagcgtaagcacaatcacaacaatcgggtacgggaaccttagccccaacaccatggcggcccgccttttctgcatcttcttcgccttagtggggatccccttgaatctggtggtgctgaaccgcctgggacacttaatgcaacagggagtgaatcactgggccagcaggctgggaggtacatggcaggaccccgacaaagccagatggctcgcagggagtggtgctttgttgtccggattgctgctttttctgctcctgcctcctctgctgttttcacatatggaggggtggtcttacacggaaggtttctacttcgcattcatcacgctgtcaacggtagggttcggggattatgtgattgggatgaaccccagccaacgctaccccctctggtacaaaaatatggtgagcttatggatcctctttgggatggcttggctggctctgattatcaagttaattctgagccagctggaaacccccggacgcgtatgcagttgctgtcaccattcttctaaggaggatttcaaaagccaatcatggcgacagggacccgatagagaacccgaaagccattctcctcagcagggatgctatccagagggcccgatggggatcatacagcatttagagcctagcgcccatgcagccggctgcggaaaggattcatag

SEQ ID NO: 200176 - DNA, 816 bp, Artificial Sequence
  Description of Artificial Sequence: Synthetic coding sequence
atgtaccggccccgggcccgggccgcccccgagggccgggtgcggggctgtgctgttccaagcactgtgctcctgttgttggcttacttggcttatttagcccttggaaccggagtcttttggactttggaaggtcgcgcagctcaggactcttctcgttcctttcagcgagataaatgggagcttctgcagaatttcacttgtctggaccgccccgccctagattctttgattcgcgatgtcgtccaggcgtacaagaatggagcctctctcctctccaacactacatctatgggaaggtgggagctggtgggatcatttttcttcagcgtgtccactatcactacaatcgggtacggaaacctgtctcccaacactatggcggctcgcctcttttgcattttcttcgctctcgttggaattccgctgaacttagtggtgctaaatcgcctggggcatctgatgcagcagggagttaaccactgggcgtcccggctgggtggcacatggcaagacccagataaggctcggtggttagccggcagtggcgcccttctaagtgggctgctgctgtttttactgttgccaccccttctgttctctcacatggaaggttggtcctataccgaaggtttttattttgcattcatcaccctgtccactgtggggttcggcgattacgtgatcgcctcttgcctcatcagtgatactagaaaacctaaccgggactggcagaccctcgagaggacctccaaatcctcggggggcctgttgaagtaccggtttctggctggccacggggggtctcatctgtag

SEQ ID NO: 200177 - DNA, 1155 bp, Artificial Sequence
  Description of Artificial Sequence: Synthetic coding sequence
atggaggtgagcggccacccccaggcccggcggtgctgccccgaggctcttgggaaactcttccctggtctgtgcttcttatgtttcttggtcacctatgctttggtaggcgcggtcgttttcagcgccatcgaggatggtcaagtgctggttgctgcagatgatggcgaattcgagaagtttttagaggaactttgtaggattttaaactgcagtgaaactgtagtggaagaccggaaacaggacctgcagggacacctgcagaaggttaaaccccagtggttcaacagaactacgcattggtccttcttgtctagtctgttcttctgctgtacagtcttttccaccgtgggatacgggtatatttaccctgtcactaggctgggcaaatacctctgcatgctttatgctctctttgggatccctctcatgtttctcgtactcactgacaccggggatatattggccaccatcctaagcacttcttataaccgcttcagaaagtttcctttcttcaccaggcccctcctaagtaaatggtgtcccaaatcattgtttaagaaaaagcctgacccaaaaccagccgatgaagccgtccctcagatcatcatctccgccgaggaactcccgggcccaaagctaggcacctgtccttcaaggccctcatgctcaatggagctctttgagagaagccacgctctcgagaaacagaatactctgcagcttccacctcaggccatggaacgcagcaattcatgccccgaactcgtgcttggtcgactctcgtattcaatcatttctaatttggacgaggtgggccaacaggtcgagcgccttgacatccccctgcctattattgccctgatcgtttttgcctacatctcatgtgccgccgctatattacccttctgggagacccagttggatttcgaaaatgccttctatttctgctttgttacgttaaccacgatcggatttggagacacagtgctcgagcatcctaatttctttctgtttttctcaatttacataatagtgggcatggagattgtctttatcgcttttaaactcgtgcagaacagattgatcgatatatacaaaaatgtgatgctcttcttcgcaaagggcaagttctatcatctagtaaagaaatag

SEQ ID NO: 200178 - DNA, 459 bp, Artificial Sequence
  Description of Artificial Sequence: Synthetic coding sequence
atgatgaacccccgggccaagcgggacttctacctggccgcccccgacttgctggatccaaagtctgccgcacagaattccaaacctaggctttcattcagtaccaagcccacagttctggcctcaagggtcgagtctgataccacaatcaacgttatgaaatggaagactgtctctactattttcctcgtcgttgtcctgtatctcattattggtgccaccgtctttaaggccctggaacaacctcacgagatttcccagcggactaccatagtgatccagaagcagaccttcatcagtcagcactcatgtgtaaatagcactgagcttgatgaattgattcaggaccttgaaactagtcatcacgcccaaaaagccgcgaaatacagcgtcagctctatgccctactgggagttccccagcctcgtgttctcttggttggaattggaaatctcttag

SEQ ID NO: 200179 - DNA, 1236 bp, Artificial Sequence
  Description of Artificial Sequence: Synthetic coding sequence
atggccgcccccgacctgctggaccccaagagcgccgcccagaactcgaagccccgactgtcattttcaaccaagcctaccgtattagcatctagagtggaaagcgatacaacgataaatgtgatgaagtggaaaactgtttcaactatttttttagtggtggtattgtacctcattataggggcaacagtttttaaggccttagaacagccacacgaaatctctcagagaacaacaatagtgatccaaaaacaaacctttataagccagcacagctgcgtgaactctacagaacttgatgagctgatccaacagatcgtggcggctataaacgccggaataataccattaggtaatacttcgaaccagatcagccactgggacctgggctccagctttttttttgctggcaccgttatcaccacaattggttttggcaatattagcccacgaaccgaggggggcaaaatcttctgcataatttatgctcttctgggcatacctctcttcggattcctgctcgccggcgtgggggaccagctagggacgattttcggcaaggggatagccaaagtcgaggacacattcattaagtggaatgtctcccagaccaagattcgaattatcagtactatcatcttcatcctgttcggatgcgtgcttttcgtggccctgccagctataattttcaagcacatcgagggatggtctgctttggacgctatctattttgtggttattacactgaccactatcggatttggagactacgttgccggaggcagtgacatcgagtatttggacttttataaacccgtggtgtggttttggattctggtcgggttggcttatttcgccgcagtattatctatgataggggattggctcagggtgataagcaaaaagacgaaagaggaagttggggagtttcgggcgcacgctgccgaatggacagcgaatgtgactgcagagttcaaagaaacccgcaggcggctgtccgttgaaatttacgacaagttccaaagagctaccagcatcaaaagaaagctgagcgccgagctggctgggaaccataaccaggaactgaccccatgccggaggacgctgtcagtcaaccatttgacaagtgagcgcgatgttctgcccccgcttctaaagactgaatctatttatctcaatgggctaacaccacattgcgccggcgaagaaattgctgtgatcgagaacatcaagtag

SEQ ID NO: 200180 - DNA, 1269 bp, Artificial Sequence
  Description of Artificial Sequence: Synthetic coding sequence
atgatgaacccccgggccaagcgggacttctacctggccgcccccgacctcctggatccaaagtcggccgctcagaatagtaagccccgcctgagcttttccaccaagccaacagtgctggccagccgcgttgagagcgacaccaccattaatgtcatgaagtggaaaacggtgtccaccatcttcctggtggtggttctttatctcattatcggggctacggtcttcaaggctttagagcagccgcacgaaatttcccaacggactaccattgtgattcaaaagcagacgtttatttctcagcattcttgcgtgaactccacagaactcgacgaacttatacaacagatagttgctgctatcaacgctggcattatccccttggggaacacaagcaaccagatctcccactgggatttgggttcatcctttttcttcgccggcacagtcattactaccattgggtttgggaacatttctcctcggaccgagggtggaaaaatattctgcataatttacgctctcttgggaattcccttgttcggcttcctcctggccggtgtcggggatcagttagggaccatatttgggaaagggatcgcaaaagtggaagacaccttcattaaatggaacgtcagccagactaagattagaatcatctccactatcattttcatcctcttcggctgcgtactgttcgttgctctgcctgcaataatcttcaaacacattgagggttggagcgctctggatgcgatttactttgttgtgatcaccctgaccaccatcggattcggggattacgtggcaggagggtccgacatcgagtacttggacttctataagcctgtggtgtggttctggattctggtcggcctagcttacttcgccgcagttttatctatgatcggagattggcttcgagttattagcaagaagacaaaggaggaagtgggggaattcagagcccacgcagccgagtggacggcgaatgttaccgcggagtttaaagagaccaggaggagattgtccgtggaaatctacgataaattccaacgtgccacctccattaaacgaaagctgtcagccgagcttgccggtaatcataaccaggagctgacgccctgccgtagaacgctatccgtcaaccatttgacgtctgagcgggatgtgctcccccccctcctgaaaaccgaatccatttatttaaacggactgactccccactgcgctggagaggaaattgcggtgattgaaaacatcaagtag

SEQ ID NO: 200181 - DNA, 1281 bp, Artificial Sequence
  Description of Artificial Sequence: Synthetic coding sequence
atgctgcccagcgccagccgggagcggcccggctaccgggccggcgtcgcagcccccgaccttttggaccccaagtcagccgcacagaatagcaaaccccggctctccttttcgacgaaaccgactgtcttagcctccagagtggaatccgacaccactataaatgttatgaaatggaagacggtgtctaccatattcttagtcgtggtgttgtatctaattattggcgcaaccgtcttcaaagccctggagcagcctcatgaaatctcacagaggactacgatcgtcattcagaaacaaacatttatctcgcagcattcttgtgtgaactcgactgagctggacgaactcatccagcagatcgtcgccgcaatcaacgcgggaatcattcctctgggaaatacaagcaatcaaatcagtcactgggatctgggatcatcattcttctttgccggtacggtgatcaccaccataggattcgggaatattagcccgagaaccgagggtggcaagattttttgcattatttacgcgctcctaggaatccccttgttcggcttcctgctcgctggcgtgggtgaccagcttggaactatcttcggaaaaggtatcgcgaaagtggaagatacgttcattaagtggaatgtgtcacaaactaagatcaggatcatctctacaatcatattcattctctttggatgtgtgctgttcgttgcattgccagcaatcattttcaaacacattgaaggttggtccgccctggacgcgatctacttcgtggtgatcacactcacaacgataggattcggagattacgtagccggagggtctgatatcgagtaccttgatttctacaaaccagtggtctggttttggatactcgtggggctggcatatttcgcagccgtgttatctatgattggggattggttaagggtgatttcaaagaaaaccaaggaagaagtcggggagttcagggctcatgctgcagagtggacggccaacgtgactgctgagttcaaggaaaccaggcggaggctgtctgttgaaatttacgataaattccagcgggccacgtccattaaaagaaaactgtccgctgagctggcaggaaatcacaaccaggaactaactccttgccgaaggacactgagtgtaaatcatttaacaagcgaacgtgacgttctgccaccattgcttaagacggaaagcatatacttaaatgggcttactccccattgtgccggagaagaaatcgcggtgattgaaaacatcaagtag

SEQ ID NO: 200182 - DNA, 687 bp, Artificial Sequence
  Description of Artificial Sequence: Synthetic coding sequence
atgatgaacccccgggccaagcgggacttctacctggccgcccccgatctgctggaccctaagagcgcggctcaaaacagtaagccacgcctatcattcagtaccaagcctacggtcttggcaagtagagtcgagagcgataccaccatcaatgttatgaagtggaagactgtatcaaccattttcctggtcgtagttctgtatttgatcattggggccactgttttcaaagcgctggaacagccccacgaaattagccaacggacaaccattgtgatccagaaacagactttcatttcacagcacagctgtgttaattctaccgaactggacgagctgattcaacagatcgtcgccgcgatcaatgccgggatcatccccctgggaaacacatccaatcagattagccactgggacctcgggagcagcttcttttttgccggtacggtcatcactacaatagggtttgggaacatctcacccaggaccgaagggggaaagatcttttgtattatttatgctctgttaggcatccccctcttcggcttcctgctagccggggtgggggaccagctcgggaccatttttggaaaaggaatcgcaaaagtcgaggacacgtttatcgttgaccccatcctgaacatatggacaagtatcagtctttcttgcgggtcagggtccctgtag

SEQ ID NO: 200183 - DNA, 471 bp, Artificial Sequence
  Description of Artificial Sequence: Synthetic coding sequence
atgctgcccagcgccagccgggagcggcccggctaccgggccggcgtggccgcccccgacctgctggaccctaagtcagcagcccaaaattcaaaaccgcggctctccttttccacaaagcctactgtcctagcaagtagagtggaatcagatactaccataaacgtgatgaagtggaagacagtgtctactatcttcctggttgttgtgttgtacttaattatcggcgctactgtcttcaaagcactggagcagccacatgagataagccagcggaccacaatcgtgattcagaagcagacatttatcagccagcactcttgcgttaactctactgagctcgacgagttgatccaggatttagaaactagtcatcacgcccaaaaagccgcaaagtacagcgtcagctctatgccctattgggagttcccatccttagtattcagctggctggagctggagatctcgtag

SEQ ID NO: 200184 - DNA, 459 bp, Artificial Sequence
  Description of Artificial Sequence: Synthetic coding sequence
atgatgaacccccgggccaagcgggacttctacctggccgcccccgacctgctggaccccaaatccgcagcccagaactcaaaacccagactctccttctccacaaagcctacagtgttggcctcaagggtcgagtccgatacaacgatcaatgtgatgaagtggaaaaccgtgagcaccatctttcttgtcgtcgtcctttacctgataattggggccactgttttcaaggccttggagcaacctcacgaaatcagccagaggaccacaatcgtgatacagaagcagacattcatctcgcaacacagctgcgtgaacagtacggaactcgacgagcttatccaagaccttgaaacgtcccaccatgcccagaaagccgcaaaatatagcgtttcatctatgccgtactgggagttccctagcctcgtgttctcctggctggaacttgagatatcttag

SEQ ID NO: 200185 - DNA, 1185 bp, Artificial Sequence
  Description of Artificial Sequence: Synthetic coding sequence
atgaagcggcagaacgtgcggaccctggccctgatcgtgtgcaccttcacctacctgctcgtcggtgccgccgtgtttgatgccctcgagtccgagccagagctgattgaaagacagcgactcgaactacgtcagcaggagctccgggcgcgatataacctgtctcagggcggctacgaagagctggagcgggttgttctgcggctcaaaccccacaaggccggagtacagtggaggttcgccgggagcttttactttgccatcacagtgattacaactataggctatggccatgcggccccctccaccgatggcggtaaggtcttttgtatgttctatgcgctactggggataccactgactttagtgatgttccagtctctcggcgaaagaattaacaccctagtgagatatctgttgcatcgtgccaagaagggcctcgggatgaggcgtgcagacgtgtctatggccaacatggtcctcatcggattctttagctgtattagcaccttatgcattggcgccgcagcgtttagccactacgaacattggacctttttccaagcatattactactgcttcattactttgactacaatcggattcggagattacgtggctctgcagaaggatcaggctcttcagacccagcctcagtatgtggcgttttcttttgtgtatattttaacgggccttacagtgattggtgcctttctcaatctggtcgtgctgaggttcatgactatgaatgcagaggatgagaagcgagacgccgaacatcgcgccttgctgacccgcaacggccaggcaggtggcggtggcggaggtggctcagctcacactacagatactgcttcttccacggccgctgctggcggcggcggtttcaggaatgtgtatgctgaggttctgcattttcagtctatgtgctcctgtttgtggtacaagtcccgcgaaaagttgcagtattccatccctatgattatcccacgcgatctatccacatctgacacatgtgtggaacagagccactcctcacctgggggaggcggtaggtattctgatacccccagtagacggtgcctatgctccggcgcacctagatccgccatcagtagtgtaagcacggggttgcattctttatccaccttccggggactgatgaagcgacgatcgtctgtgtag

SEQ ID NO: 200186 - DNA, 816 bp, Artificial Sequence
  Description of Artificial Sequence: Synthetic coding sequence
atgttccagagcctgggcgagcggatcaacaccctggtgcggtacttgcttcaccgcgctaagaagggtttgggaatgcgtagagccgatgtgagcatggctaatatggtccttattggttttttttcatgtatctctactctctgtattggcgcagctgctttttcacattatgaacactggacatttttccaggcttactactattgttttatcactttaaccacaatcggttttggggactatgtggccctgcagaaagaccaagcgttacaaacccagccgcagtacgtagccttcagtttcgtgtacattcttactggcctgacagttattggcgccttccttaatcttgtggttttaagatttatgaccatgaatgctgaggacgaaaaacgggacgctgagcacagggccctactgacacggaatggccaagcgggagggggaggcggcggaggatccgcacatactaccgacacagcaagttctaccgctgctgcgggcggcggcgggtttcggaacgtctacgcggaggtcctgcacttccaaagcatgtgttcgtgcctgtggtacaagtctcgggagaagcttcagtattcaattcctatgataatcccgcgggacctgtccacttctgacacctgtgttgaacagtcacactccagtccaggcggcggcggacgatattcagatactccaagcaggcgctgcctctgttctggagctccgcgcagcgccatctcctccgtctcgaccggattacacagcttgtctacctttcgcgggctgatgaagagacgaagttcagtctag

SEQ ID NO: 200187 - DNA, 1182 bp, Artificial Sequence
  Description of Artificial Sequence: Synthetic coding sequence
atgcggagcaccaccctgctggccctgctggccctggtgctgctgtacctcgtgtcaggtgctctggttttcagagctctggaacagcctcacgagcagcaggcccagagagagctaggtgaagtgcgggaaaagttcctgcgggctcatccttgtgtttccgatcaggaactgggccttttgataaaggaggtggccgatgctcttggagggggggccgatcctgaaactaactccacaagtaatagttcccattctgcatgggatctcggttcagcctttttcttcagtggaacaatcatcactaccattggttatgggaatgttgctcttcgcaccgacgccggacggctattttgtatattctatgccctggtcggtatcccactctttggcattctcctggccggagtcggtgaccgcctgggctcttcacttcggcacggcatcggccatattgaggcaatctttctgaagtggcacgtccctcccgagctggtgcgtgtcctttcagccatgctcttcctgcttatcggatgcctcttgttcgtgctgacgcccacttttgtgttctgctatatggaggattggagcaagttggaagccatttacttcgtcatcgtgactcttacgactgtaggcttcggtgattatgtggccggggccgatccacgacaggattccccagcataccagccgttggtgtggttctggatactcttgggcttggcctattttgcgtccgtcctgactactattggcaactggttgcgagtcgtgagcagaagaacgcgggctgagatgggggggctgactgcccaggcggcctcctggacgggcacagtgaccgccagagtcactcagcgggccggtccggccgcccctccacccgaaaaggagcagcccctcctgccacctcccccctgtcccgcccagcctttgggcagaccacgctcgccttcaccccctgagaaagctcaacctccaagtcctccgacagcctctgctctggattaccctagcgaaaacttggcttttatcgacgagtcatccgacacccagtcagagagaggatgtcccctccctagggctccccgaggacgccgccggcctaatccacctagaaagcctgtgcggcctcgcggtcccgggcggcccagagataaaggcgtccctgtgtag

SEQ ID NO: 200188 - DNA, 1182 bp, Artificial Sequence
  Description of Artificial Sequence: Synthetic coding sequence
atgcggagcaccaccctgctggccctgctggccctggtgctgctgtatctggtatcgggagccctggttttccgcgcactggagcagccacatgagcaacaggcacagcgggagctgggagaggttagagaaaaatttttgcgggcgcatccatgcgttagtgatcaggagctcggcctcttaatcaaagaggtggcggacgccctcggaggtggtgcagatccagagacaaactcgacatccaattcttcccatagcgcttgggacctaggcagcgcattcttttttagtggcaccatcatcaccaccattggatatggaaacgtagctctgaggacagacgctgggcggctgttttgcattttttatgccctggtgggcatacctctgttcggcatcctgctcgcgggagtgggtgaccggctcggctcaagtctgcgccacgggataggccacatcgaggccatctttctgaagtggcacgttccccccgagctagtgagagttctgagtgctatgctttttctgcttattggttgcctcctgtttgtactgacacccacatttgtcttctgttacatggaggactggtcaaaactggaagctatctatttcgtaatcgtgacactgactactgtcggtttcggcgactacgtggccggagctgatcctcgacaggacagcccagcctatcaacccctggtttggttctggatcctactgggcctcgcctatttcgcatccgttcttacaacaataggcaactggctgagagtcgtaagccgaagaactcgtgccgagatgggagggttgacagctcaggccgcctcttggaccggcacagtgaccgcccgggtcacacaaagagcagggcctgccgccccacccccagaaaaggaacagcctctgttaccccccccgccttgccccgcccaaccactgggtcgcccaaggtctccgtcaccacccgaaaaagctcagcccccgtccccccccacagccagcgcgctggactacccctctgaaaatctggccttcatcgatgagtcaagcgacactcagtctgagaggggctgtcccctgcccagagccccacgggggcgccgtaggcctaacccccctagaaagcctgtgcgtcccagaggtcctggccgaccacgcgacaaaggagttcccgtgtag

SEQ ID NO: 200189 - DNA, 1182 bp, Artificial Sequence
  Description of Artificial Sequence: Synthetic coding sequence
atgcggagcaccaccctgctggccctgctggccctggtgctgctgtatctggtgagtggtgctttggtatttagggcactcgagcaaccccacgagcaacaggcccagcgggaactgggcgaagtgcgcgagaaatttcttcgcgcccacccttgcgtgtccgaccaggaattaggcttgctcataaaggaagttgccgacgccctgggtggcggggctgaccccgaaacaaatagcacctccaatagctcccacagcgcttgggatctaggcagtgcctttttcttcagcggtacaatcatcacaacaattgggtacggcaatgtcgccctgcggactgatgccggcagactcttctgtatcttttacgcacttgttgggatcccactctttgggatccttttagcaggagtaggggatcggttggggagctctctccgccacggcattgggcacatcgaagctatttttctcaaatggcatgtcccgccagagctggtgagagtactaagtgcaatgctttttctgctgatcggctgtctgctcttcgtgctcactcctaccttcgtcttctgttacatggaagattggtctaagttggaggccatttattttgttatagtgacactaacaaccgtcggtttcggggactacgttgcaggagcagaccccagacaagactcccccgcctaccagcctctggtttggttctggatcttactgggactggcgtacttcgccagcgtcttgacgacaattggcaactggcttcgagtagtgtcaagacggactcgtgccgagatgggcggtcttaccgcacaggccgcgagttggaccgggacagtcactgctcgtgttacccagagggccggacccgcagctcctccaccggaaaaggaacaacccctcctacctccccccccttgcccagcccagccactgggccgcccacggtccccttctcccccagaaaaagcgcaacccccatcgccccctacggcgtctgcactggactaccccagcgaaaatctagcctttatcgatgaaagttccgacacgcagagcgagcgggggtgtcctctacccagagctccgagagggaggcgacgtcccaatcctccccgtaagcctgtcagaccccgggggccgggccgcccgagagacaagggcgtgccagtctag

SEQ ID NO: 200190 - DNA, 1257 bp, Artificial Sequence
  Description of Artificial Sequence: Synthetic coding sequence
accaccgccccccaggagccccccgcccggcccctgcaggccggcagtggcgccgggcctgcccccggccgagccatgcgtagtaccaccctgctggccctgctggcccttgttctcctttatttagtgtccggagctctcgttttccgcgcattggaacagccccacgagcagcaagcccagcgggaacttggggaggtccgggagaagttcctaagagcacacccttgcgtcagtgatcaggaactcggattattaatcaaagaggtggcagacgctttgggaggcggggctgatcccgagacaaattccaccagtaatagcagccacagtgcttgggacctgggcagtgctttcttcttttctggcacgataatcacgaccattggatatggaaacgtagccctgagaacagacgccggccgcctcttctgtatcttctatgccctcgtcggaatacctctgttcggtattttgctggcgggtgtcggcgacaggctcgggagttcactgcgacacggcattggccatatcgaagccatcttcctaaaatggcatgtccctcccgagctggtccgtgtgttgtctgccatgttattcctcctaatcggttgtttgcttttcgtgctgacaccaacttttgtattctgttacatggaagattggagtaagttggaagccatatacttcgtgatcgtgacccttacgaccgttggcttcggcgattacgtcgccggagcggatcctcggcaggattcgccggcttaccagccgctggtgtggttttggattctgctgggcctcgcatatttcgcctcggtgctgactaccatcggcaactggctaagggtggtgtcccggcggaccagagcagaaatgggcggactgacagctcaggcagccagctggactggaaccgtcactgcacgggtgactcaacgggccggccctgctgccccgccaccagaaaaggaacagcctctcctccctcctcccccctgtcctgcccagcccctcggcaggccaagatcccccagcccaccggagaaggcccaacctccaagcccgccaacggcgagtgctctcgactacccatccgaaaatcttgcctttattgatgagagttctgatactcagagcgagcgcgggtgcccccttccccgggctcctcgagggcgccggaggcctaacccgccccgcaagcccgttaggccgcggggccccggaaggcctcgtgacaagggagttcctgtttag

SEQ ID NO: 200191 - DNA, 1368 bp, Artificial Sequence
  Description of Artificial Sequence: Synthetic coding sequence
gtgcacgccagcgtgcacacccgggtgcggggcctgtgggtgccctggagagggcggcatgctcacgggggcagaggctgccgtggagtgtgcggcgagtgccggtgggttaccaccgccccgcaggaaccccctgcacgcccactccaggccggctccggcgccggtcccgccccaggccgggccatgcggagtactacattgttggcccttctggctcttgtgctgctatacctcgttagcggtgctcttgtcttccgcgcactcgaacaaccccatgagcaacaggcacagcgcgagctgggggaagttagggagaaattccttcgagcccacccctgcgtctccgatcaagagttggggctactgattaaggaggtggcagacgccctagggggcggtgccgaccccgaaaccaattcaacctccaactccagtcattctgcgtgggacctcggaagcgccttttttttcagtggcacaattattactactattggctatgggaatgtcgcactgaggactgatgctggccggctgttttgtatcttctatgctctggtgggtatacccttatttggaatcctcctagctggtgtgggcgatcggttgggatcctctctgaggcatgggattggacatatcgaagccatcttcctgaaatggcacgtacctcccgagcttgttcgggttttgtctgcaatgttgttcctgttaataggctgcctgctgttcgtgctgacccctacttttgtgttctgctatatggaagactggagcaaactggaggctatttacttcgtcattgtgacccttaccacagtgggcttcggcgactatgtagccggagcagaccctcgtcaggatagccccgcttatcagcccctggtttggttttggatcctactgggcctcgcttattttgcctccgttctcaccaccatcggcaactggctcagggttgtgagtcgacggactcgagcagaaatgggcggattaaccgcccaggccgcgtcctggacaggcacagtcaccgctcgggtgacccaaagagctgggcctgccgccccccctccagaaaaggaacaaccactgctcccccctcccccttgcccggcacagcccctcggccgtccgaggtctccctcgcccccagaaaaggcgcaaccaccgagtcctcctaccgcatcagctctggattacccaagcgaaaacctggcgtttattgacgagtcttctgacacgcagtccgagcgaggctgtcctctccctagagctcctcgtgggcgccggcggcctaaccccccaagaaaacccgtgaggcccagaggccctggcaggcctcgtgacaagggagttcccgtgtag

SEQ ID NO: 200192 - DNA, 1500 bp, Artificial Sequence
  Description of Artificial Sequence: Synthetic coding sequence
atggtggaccggggccccctgctgaccagcgccatcatcttctacctagcaatcggggccgcaattttcgaggtgctggaggaaccccattggaaagaagccaaaaagaactactacacgcagaaattgcacctgctgaaggagttcccctgcttgggacaggaaggcttggacaagatcctggaagtcgtctctgacgcagcgggccaaggagtcgcaatcacgggcaatcaaactttcaataactggaattggcccaatgcaatgattttcgccgcaacagtgatcaccactattggctatggaaacgtcgcccctaagacacctgccggcaggctgttctgtgttttctacgggctcttcggcgtgcctctttgcctgacctggatctctgctctcgggaaattctttggaggccgtgccaaacgcctggggcagttcctgacgaaacggggtgtcagtctgcgtaaggcccaaataacatgtaccgtcatattcatcgtatggggcgtgttggtgcatcttgtgattccaccattcgtgttcatggtgaccgagggctggaattacatcgaggggctctactacagctttatcacaatatccaccatcggtttcggtgattttgtggcgggcgtgaacccttccgccaactaccacgccctgtaccgctactttgttgagttatggatatacttgggcctcgcttggctttccttatttgttaactggaaggtgtcaatgttcgtggaggtgcacaaggccattaagaaacgacggagacgccggaaggagagttttgagtcatcaccgcattcccgcaaagccttacaagtcaagggcagtaccgcctctaaagacgtaaatatatttagtttcctatctaaaaaggaagagacctataatgacctgataaaacagatcggaaagaaagccatgaaaacctctggtggcggcgaaacgggtcctggcccaggcctcgggcctcaaggcgggggtcttcctgcactgcctccatccctcgtgccccttgtagtgtactccaagaatagggtgcctacgctggaggaggtcagtcagaccctgcgctccaaagggcatgtctcccgcagcccagacgaggaggcagtggcacgggcacccgaggactcctccccagcgcccgaggtgttcatgaaccagcttgatcgaattagcgaagagtgcgagccatgggatgcccaagattatcatccacttatctttcaggatgcttcaattactttcgtcaatactgaagccgggctgagtgatgaggagacatcgaagagcagcttagaggacaatctggccggggaggagtcaccccagcagggggccgaagccaaagctcctcttaatatgggggagttcccatcatcttctgaatccaccttcactagtaccgagtccgagctctcagtgccctatgaacagctgatgaacgaatacaacaaggctaactctcccaagggtacctag

SEQ ID NO: 200193 - DNA, 942 bp, Artificial Sequence
  Description of Artificial Sequence: Synthetic coding sequence
atgcggcggggcgccctgctggccggcgccctggccgcctacgccgcttaccttgtcttgggtgccctcctggttgccagactggagggaccacacgaagcccgactaagggccgaactcgagacccttagagctcagctcttacagcgaagcccatgcgtggcagccccggctttagatgccttcgtggaacgggtgctggctgccggccgcctgggaagggtcgtgttggccaatgcaagcgggagtgccaacgcgtccgaccccgcttgggacttcgctagtgctctattctttgcttcaacgctgattactacggttggctacgggtataccacaccactgaccgatgccgggaaagcattcagcatcgcctttgccctgctgggagtgcctactaccatgctgctcctcactgcttctgcacagcgtctatccctgttactcacacatgtgccattgtcttggctgagcatgagatggggttgggaccccaggcgggctgcttgttggcatcttgtggccttgctaggggtggtggtcaccgtttgcttcctggtccctgctgtgatattcgcccacctggaagaggcttggtcttttttggacgcgttttatttttgcttcatttccctgagtactattgggctcggggattatgttcccggagaggcacctggccagccataccgggcattatataaggtactggtcacagtttacctctttctcggccttgttgcaatggttttagtgcttcaaacttttcgccatgtttccgacctccacggcctgactgagctgatcttgttacctccaccttgcccagcttcgtttaatgcagacgaagatgatcgggtagacatattaggacctcaacctgaatctcaccagcaactgagcgcctcatcacacacagattatgcctccattcctaggtag

SEQ ID NO: 200194 - DNA, 924 bp, Artificial Sequence
  Description of Artificial Sequence: Synthetic coding sequence
atgggcggcctgcggccctggagccggtacggcctgctggtggtggctcacctgctcgccctgggactcggggccgtggtgtttcaggccctggagggaccgcccgcctgtcgcctgcaggctgagctgagggccgaactcgcagcctttcaagctgaacaccgcgcgtgcctgccaccaggggccctggaggagcttttggggaccgcactcgctacccaggctcacggtgtaagcacacttggtaacagcagtgagggaaggacgtgggacctgccatctgctctcttgttcgcagcctcgatcctgacaacaactggttatgggcacatggctccactctcacctggtggcaaggccttttgcatggtgtatgcggcactcggcctgcctgccagcctcgccctggttgcaaccctgcgacactgcctgttgcccgtgcttagcaggccacgggcatgggtggccgtccactggcaattgtccccagcaagagcagccctcctccaggcagttgcgctggggctgctggtcgcctcctctttcgttctgctgcctgccctggtcctgtgggggcttcagggcgactgcagtttgcttggcgctgtctatttctgtttctccagtctgagcactatcggccttgaggatctcctcccaggcagagggcggtcattgcatccagttatataccacctcggccagctggccctcctgggatatttgttgcttggcctgctcgctatgctgcttgccgttgaaactttctccgagctgccacaggtgcgcgccatgggaaagtttttccgccctagcggtcctgtgaccgctgaagaccaaggaggcatcctcggtcaggatgagcttgccctgagcacattaccccccgcagcacctgcctctgggcaggcccccgcttgttag

SEQ ID NO: 200195 - DNA, 759 bp, Artificial Sequence
  Description of Artificial Sequence: Synthetic coding sequence
atgggcggcctgcggccctggagccggtacggcctgctggtggtggcacatcttctggctctgggccttggagctgtggtttttcaagctttggagggaccaccggcatgtagactccaagccgaacttagggccgaactcgccgccttccaggcggagcatagagcctgtctgcctccaggcgccctggaggagctcctaggcacagctctcgctacgcaggcacacggcgtctctacgctgggaaatagctcggaggggcggacctgggacctgcctagtgcactcctctttgccgctagtatattgactaccaccggttacggacacatggctccgctgagccccggaggcaaagcgttctgcatggtatatgccgcgttgggactgcccgcgtctcttgcgctggtggccacgctgaggcattgtctgctgcctgttctatccagaccccgcgcgtgggtcgccgttcattggcagctgtcgccggcacgtgccgccctgctgcaagccgtggccctgggcctgctcgtggcaagctctttcgtgctgctgcccgctctggtcctgtgggggttacaaggcgactgtagtttgttgggagccgtttacttttgtttttcttccctctccacaatcggcctggaggacctgttacctggacgcggacgaagtctgcatccagttatctatcatctcgggcagttagccctactggggggagggacctctcttcaaggaacagcatgggaagggtag

SEQ ID NO: 200196 - DNA, 774 bp, Artificial Sequence
  Description of Artificial Sequence: Synthetic coding sequence
atgggcggcctgcggccctggagccggtacggcctgctggtggtggcccatctgctagctcttggcctgggggccgtcgtgttccaggcccttgaggggccgcctgcttgcaggctacaggcagagctgcgggcggaactggccgcctttcaagccgaacatagggcgtgtctcccgccaggagctcttgaggagctactaggaacagccctcgcaactcaagcccacggagtttcaacattgggaaattcctccgagggcagaacttgggacctgcctagtgctctcctctttgctgcatcaatactgactacaaccggttacggccacatggccccgttgagcccgggcgggaaggctttttgtatggtgtatgctgccctcggactccccgcttctttggcactggtggccacactgcgccattgtctgctgcccgtcctcagccgcccgcgcgcttgggttgccgtgcactggcagctctcccccgcacgggccgctctgctccaggctgtggcgctgggactcctggttgcttccagtttcgtcctgttgcctgcccttgtgctctggggactgcagggtgactgtagcctgttaggggccgtgtacttctgtttcagcagtctctctactattggccttgaggaccttctgcccgggcgtggaaggtccctgcaccctgtgatctatcatctgggccagttggcccttttgggtaagtccagccacctaacagcttgtggaggccgcggtaaacggtctctggactag

SEQ ID NO: 200197 - DNA, 759 bp, Artificial Sequence
  Description of Artificial Sequence: Synthetic coding sequence
atgggcggcctgcggccctggagccggtacggcctgctggtggtggctcacctattggccctgggactgggggcagtcgtgttccaggcgttagaaggccccccagcctgcaggctgcaggcagaattacgggcggagctggccgcctttcaagccgaacatcgggcatgtttgcccccgggtgccctcgaggaacttttggggacagcactggccacacaagcccacggggtgtctactctaggcaatagcagcgaggggcggacctgggacctcccgagtgccctactttttgctgctagcatacttacaacgacagggtatgggcacatggcccctctctcgccagggggaaaagccttttgtatggtgtatgcagctttagggctgccagcatcactggccctcgtggccactcttcgtcattgccttcttcctgtgttaagtaggcctagggcttgggtcgctgtacattggcagctctctcctgccagagctgccttgctgcaggccgtggcgctaggtttgctcgtggccagcagcttcgtgctcttgcccgctctggtcctgtgggggctgcagggcgactgtagcttgctcggcgcagtctacttttgcttctctagtttaagcaccatcggcttggaagacctgttgcctggccggggacgctcactgcatccagtcatttaccatttggggcagcttgcacttctgggcggcggcacgtccctgcagggtaccgcttgggagggatag

SEQ ID NO: 200198 - DNA, 87 bp, Artificial Sequence
  Description of Artificial Sequence: Synthetic coding sequence
tgactgcaccccgtgatctaccacctgggccagctggccctgctgggtggcggaacatccctccagggaacggcctgggaaggttag

SEQ ID NO: 200199 - DNA, 1125 bp, Artificial Sequence
  Description of Artificial Sequence: Synthetic coding sequence
atgaagcggcagaacgtgcggaccctgagcctgatcgtgtgcaccttcacatacctgctggtgggcgcggccgtgttcgacgctcttgaatcagaccatgaaatgagagaggaagaaaaattgaaagccgaggaaatcagaattaaaggaaaatataacatttcttctgaggactatcgccagcttgagttggtgatcctccagtccgagccgcaccgcgccggcgtccagtggaagttcgcgggcagcttctatttcgccatcaccgtaatcaccactatcggttatggccatgcagctcctggtaccgatgcaggtaaggcgttttgcatgttctatgcagtgctgggtatccccctgacattagtgatgttccagagtctgggagaacgcatgaacacgttcgtcagatacctgctaaagagaatcaaaaagtgttgtggcatgagaaatacagatgttagtatggagaatatggtgacagtggggtttttcagctgtatgggaacattatgcatcggcgccgcagcgttttcacaatgtgaggagtggagcttctttcacgcgtactattattgttttatcacactgactaccattggcttcggtgactatgtggcgctccagactaaaggagcactgcagaaaaagccactgtacgttgccttcagtttcatgtacatactggtcgggcttacagtaataggagcttttctgaatctcgtggttctgagattcctgacaatgaatagcgaagatgagcggcgagacgccgaggaacgggcatccctcgccgggaacagaaattccatggtcatacacatccctgaggagccacgcccaagcaggccacggtacaaagccgacgtgccagacctgcagagcgtttgttcatgtacctgctaccgcagtcaggattatggggggcgaagcgtggcgccacagaacagtttttcagcaaagcttgctccacactacttccattccatctcctacaagatagaagagatctccccatctacgttaaaaaactccctgttcccaagccccatctcaagcatttcccctggccttcatagcttcacggaccaccagaggctgatgaagagacggaaatctgtctag

SEQ ID NO: 200200 - DNA, 1125 bp, Artificial Sequence
  Description of Artificial Sequence: Synthetic coding sequence
atgaagcggcagaacgtgcggaccctgagcctgatcgtgtgcacctttacttatctgttagtgggcgctgcagtctttgacgcactagaaagtgaccacgagatgcgcgaagaggaaaagctaaaggctgaggagattagaattaagggcaagtataatataagttctgaggactataggcagctggaactggttatcctacagtcagaaccacatagagcaggagtgcagtggaagttcgccgggtcattctactttgcaatcacagtgatcaccactatcggatatggacatgctgcccccgggaccgacgcaggtaaggccttttgtatgttctacgccgtactaggaatccctctcactttggtgatgttccagtctctgggtgagcgaatgaacaccttcgtgagataccttctgaagcgcatcaagaaatgctgtgggatgcgcaatactgacgtctcaatggagaacatggtgaccgttggatttttttcctgtatgggcaccctgtgcattggggctgctgcatttagccaatgcgaagagtggagcttctttcatgcctattattattgtttcatcactctgacgactatcggcttcggagactacgtcgctctacaaactaaaggcgccctgcagaagaagcctctgtacgtcgcgttcagctttatgtatatcctggtggggctcaccgtcatcggcgcatttctaaatctggtagttctgcggtttctcactatgaatagtgaagatgagcggcgcgatgccgaggaaagggcctcactggcaggaaaccggaattccatggtgatccacatcccagaggaaccccgcccgtcaagacctaggtataaggccgacgtgcctgacctgcaaagcgtttgcagttgcacgtgttatagaagccaagactatggtggccgatccgttgccccccagaattcctttagcgcaaagctggccccccactattttcattcgattagctataaaatagaagaaatctccccctcaacattaaaaaactcgctgttcccctcccccatttcttccatctctccgggcctacattcttttaccgaccaccagcgactgatgaagagacggaaatctgtgtag

SEQ ID NO: 200201 - DNA, 1125 bp, Artificial Sequence
  Description of Artificial Sequence: Synthetic coding sequence
atgaagcggcagaacgtgcggaccctgagcctgatcgtgtgcaccttcacttacctcctcgtaggcgcagccgtattcgatgcactcgagagcgatcacgagatgagggaagaggagaagctgaaagccgaagaaattagaattaagggtaagtataatatctcctctgaggattatcggcagctggagctggttatactgcaaagcgaaccccatagagcaggagtgcagtggaagttcgccggatctttctactttgctatcaccgttatcacaaccattggatatgggcacgccgctcctggcacagacgccggcaaggccttttgtatgttctatgctgtcctcggaatccccttgactctggtgatgtttcagagtcttggggaaaggatgaatacgtttgtgagatatctgcttaagcgcattaaaaagtgttgcggtatgcgcaatacagacgttagcatggagaatatggttaccgtcggcttcttctcttgtatggggacactttgtattggcgctgcagcttttagccaatgcgaagagtggtccttctttcatgcctactactattgtttcattactctgacaacgattgggtttggagattacgtggcgttgcagactaagggcgctctgcagaagaaacctctgtacgtagcattctcttttatgtacatcttggtcgggctgaccgtgatcggagcattcctgaatctcgtggtgttgaggttcctgacaatgaactcagaggacgaacggagagacgccgaggagagggcctctctggcgggtaatagaaattcgatggttatccacatacccgaagagccccggccatccaggcctcgatacaaggcagacgtgccggatcttcagagcgtctgtagctgcacatgttacagatctcaagactacggtggtaggagcgtggcgccacaaaacagcttctcagctaagctagctccacactacttccactcaatcagctacaagattgaagagatcagcccttctacactgaagaactcactgttcccaagtcccatttctagtatctcccctgggctccacagtttcacagaccatcagaggcttatgaagaggcgcaagagcgtgtag

SEQ ID NO: 200202 - DNA, 3693 bp, Artificial Sequence
  Description of Artificial Sequence: Synthetic coding sequence
atggcccgggccaagctgccccggagccccagcgagggcaaggccggccccggcggtgccccggcgggagccgccgcacctgaggagccacacgggctctcaccgctgctgcctgccagagggggcgggagcgtaggaagtgacgtcggtcagcggttgcctgtcgaagatttcagcctcgattcttcgttaagccaggtacaagtggagttttacgtgaacgagaacacattcaaggagcgcctgaagcttttttttatcaagaaccagagaagctcactgcgcattcggctttttaatttttctctgaagctattgacgtgtctcctctacatagtgagggtcctccttgacgaccctgccctaggtatcggatgctgggggtgtcccaaacagaattacagctttaacgactcaagttctgagatcaactgggcaccaatcctgtgggttgaaaggaaaatgaccctgtgggcgatccaagttatcgtcgctatcatctctttcctcgaaaccatgctcctcatttatctgagctacaagggaaatatctgggagcaaatctttcgggtcagctttgtgcttgaaatgatcaacaccctgccattcattattactatattttggccccccctgcgcaacctatttattccagtttttttgaattgttggcttgcaaaacatgcgctggagaatatgatcaatgacttccaccgagccatcttacgtacacaatctgctatgtttaatcaggtacttattttgttttgcaccctgctttgtctggtgtttacgggaacatgcggaatacaacacttggagcgggccggggaaaatctgtctctgttgacgtcattttacttctgcatcgtaaccttcagcacagtaggctatggtgacgtgaccccaaagatctggccttcgcagctgcttgtggtgataatgatatgcgtggcacttgtcgtgctccctctgcagttcgaagagctggtgtatctgtggatggagaggcagaagtcaggtggaaactactcccgccatcgggctcagacagaaaagcacgtggtgttgtgcgtcagcagcttgaaaatagatctattgatggacttcctcaacgaattctatgcccatcctagattgcaagattattacgtagtcattctctgcccaaccgagatggacgtacaggtgcgaagagttttacagattccactgtggtcccaaagagtgatataccttcagggaagcgctttgaaagatcaggatttgatgagggcgaaaatggacaacggcgaggcctgctttatccttagctcccgcaatgaggtagaccggacagcagctgatcaccaaacaatcctacgtgcctgggcggtgaaggacttcgcacctaattgcccgctgtatgtgcagattttgaaaccagaaaacaaattccatgtaaaattcgctgaccatgtggtttgcgaagaggagtgcaagtacgccatgctggcgctgaattgcatttgcccggccactagcactttaatcacactgttggtccatactagtcgaggccaagagggccaagaatcgcccgagcagtggcagcgaatgtacggcagatgctcgggcaatgaggtgtaccacattaggatgggcgattcgaaattttttcgggagtacgagggcaagagctttacctatgcggcgttccacgcccataagaagtatggcgtgtgcctgatcggcctaaagagggaagataacaagagcatccttctcaaccctggtccacgacatattcttgccgccagcgatacctgtttttacatcaacattaccaaggaggagaactctgcttttatcttcaagcaagaggagaaacggaagaaaagagccttcagtgggcaggggttgcacgaaggtccagcccggctgcccgtgcactctataattgcttcaatgggcaccgtggcaatggatctgcaaggtaccgaacatagacccacacagtcgggcggaggaggcggcgggagcaagctagctctgccaacagaaaacggatctggatctcggcggccatcaattgctccagtcctcgaactcgccgatagttctgcactcttaccttgcgatcttctgtcagatcagagtgaggacgaagtgacaccaagcgacgatgaagggctgagtgtggtggagtacgtgaaagggtatccacccaactcgccttacatcgggagttctcctacgctgtgccacttgctgcctgttaaagctcctttttgctgtctcaggcttgacaagggctgcaagcacaactcttatgaagacgccaaggcctacggctttaaaaataaactaatcatcgtgtctgccgaaaccgcgggcaatggcttatacaattttattgttcctctgagagcatattaccgaagtagaaaagagctcaaccctattgtcctcctgctcgataataaacccgatcatcacttcctggaagctatctgttgcttcccgatggtctattacatggagggaagcgtagataatctggatagtttgctgcagtgtggaattatttacgctgacaacctcgttgttgtggataaagaatctaccatgagcgctgaagaggattatatggccgacgccaaaaccatcgtaaacgtccagacaatgtttaggttgttcccgtctctctccatcaccaccgagctgacccatcctagcaacatgagattcatgcagttcagagccaaggacagttacagcctggccctctcaaaacttgaaaaaagagaaagagagaatggcagtaacctggccttcatgttccgcctcccgttcgcagccggaagggtgttcagtatctccatgctggataccctactttatcaatcttttgttaaagactacatgatcactatcacgcgccttctcctaggactcgatactacacccggcagcggatatctctgtgccatgaaaatcacggagggagatctctggatcagaacctacgggagacttttccagaaactatgctcaagttcagcagagataccaattggaatttatcgcacggagagccacgtgtttagcacatccgagtctcagatcagcgtgaatgtggaagactgtgaagacacaagggaggtgaaggggccttggggcagcagggccggcactggaggaagctctcaaggcaggcacaccggaggtggtgaccctgctgagcatccactccttcggcgcaagagtctgcagtgggcacgtcggctttctcggaaagcccctaagcaggccggcagagccgccgcagccgaatggataagccagcagagactgtctctgtaccggaggagtgaacgccaagagcttagtgaactcgttaagaacaggatgaagcatctggggctccccaccaccggttatgaagatgtggccaatctcacggcatccgacgttatgaatcgtgtgaatcttggttacttacaagacgagatgaatgatcatcagaacacactatcctatgtgctgatcaaccctccgcccgatactaggcttgagccaagtgatatcgtttacctgataagatccgatcccctcgcgcatgtggcaagctcgtctcaaagtcggaaatcaagctgttcgcacaagctcagtagctgtaatcccgaaacccgggatgagacacagctgtag

SEQ ID NO: 200203 - DNA, 3771 bp, Artificial Sequence
  Description of Artificial Sequence: Synthetic coding sequence
atgcccctgcccgacggcgcccggacccccggcggcgtgtgccgggaagcacggggaggcggatacaccaatcggacctttgagttcgacgacggccaatgcgcccctagacgcccatgcgctggagatggcgcgctgttggacactgcaggctttaagatgtccgacctcgatagtgaagtgctgcccctccccccccggtacagattcagggatcttctcttgggagacccctcattccaaaacgacgaccgagttcaagtcgagttctacgtcaatgaaaacaccttcaaggaacggctgaagcttttttttattaaaaatcaaagatcaagtctgagaatcagactgtttaactttagcctcaagcttctgacatgtcttctgtatatagttcgagtcctgctggacgatccagctttgggaattgggtgctggggatgtcccaagcaaaattactcattcaatgatagtagtagcgagatcaattgggctcctattctctgggtggaaaggaagatgactctctgggccatacaggtgatagtggccatcatctctttccttgaaactatgctactcatctacttaagttacaaaggcaacatatgggaacagatattccgggtgtcttttgtgttggagatgattaacactttacctttcatcatcacaattttctggcccccgctccgaaacttatttattcccgtatttttgaactgttggctggctaagcacgcccttgaaaatatgattaatgacttccaccgcgcaatccttaggacccaatccgccatgttcaatcaggtgctgattttgttttgtactctcttgtgcctcgtgttcacagggacctgtggcattcagcacctggagagggccggagagaacttgagcctgctcaccagtttctatttttgcattgtgaccttctctaccgtgggatatggagacgtgaccccaaaaatctggcctagtcagctcctggtagtgatcatgatctgcgtggccctggtagtgctacccctgcaatttgaggaactcgtttatctctggatggagagacagaagtctggtggcaattatagccgacaccgggcgcagacggaaaagcacgttgtgctgtgcgtctctagtctgaaaatagacctgctaatggattttctgaacgagttttacgcccaccctcggctgcaggactactacgttgttattttatgccctacggaaatggacgttcaagtaaggcgggtcttgcagatacccctgtggagccagcgagtaatttacctgcaggggtccgctctcaaagaccaagacctaatgagggctaaaatggacaatggcgaagcttgtttcatcctgagtagtcggaacgaggtggatcggactgccgctgatcaccaaaccattctgcgagcctgggccgtcaaagattttgcgcccaactgtcccctttacgtgcagattctgaagccggaaaataagtttcatgtcaagtttgccgatcatgtggtctgcgaggaggaatgtaagtacgccatgttggccctgaactgtatctgccccgcgaccagcaccttaattaccctgttggtccacaccagtaggggacaagaaggccaggagtctccagagcagtggcagcgaatgtacgggcgttgttccggcaacgaagtctaccacattagaatgggagattctaagttctttcgcgaatatgaaggtaaatcgttcacgtacgctgcgtttcacgcgcacaagaagtatggagtgtgccttatcggtctgaagcgtgaagataacaagtctattctcctgaatccaggccccaggcatatactcgcagcttcagacacttgtttttatatcaacataactaaggaggaaaactctgccttcatcttcaaacaggaggaaaaacgcaaaaagagagcattttctggtcaaggactccacgaggggcccgcgcgactgcccgtccattccatcatcgcgagcatgggtacggtggccatggatcttcagggcaccgagcatcggccaactcagtctggggggggaggaggtggaagtaagctggctctgcccacagagaacgggtcgggaagcagacgcccttctattgctccagtgctggaactggctgactcttccgccctgttgccttgcgatttattgagcgatcaaagcgaagacgaggtgacgcctagcgacgacgagggcctgtccgtggttgagtatgtgaaagggtaccctccaaactctccatatattggctcatcacctaccctttgccacttgttacccgtcaaggctcccttttgctgccttcggctggataaaggttgcaaacataacagctacgaagatgccaaggcctatgggttcaaaaacaaactaattatagtttctgcagaaaccgcaggaaatggattgtacaatttcatcgtgccgctccgagcttactataggtctcgaaaagagttaaatccaattgtgctgctgctggataacaaacccgaccatcacttcctagaagcgatctgttgtttcccgatggtctattatatggaaggttccgtagacaacctagactccctcctgcaatgcggcataatatatgcagacaatttggtcgtggtcgacaaggaaagcactatgtccgccgaagaagactatatggctgatgctaagacaattgtcaacgtgcagactatgttccggctgttccccagcttgtccattacaaccgaactaactcaccctagcaacatgagattcatgcaattccgcgccaaagatagctattcactcgccttatccaagctcgaaaaacgcgagagggagaacggttctaatctggctttcatgtttcggctgccctttgctgccggcagagtttttagtattagtatgcttgataccctcctgtatcaatcctttgtgaaggactacatgatcaccataacaaggctgctcctggggctggacaccactccaggttcggggtacctgtgcgccatgaagataaccgagggcgacctgtggattagaacctacgggcgcctgtttcagaagctgtgctccagctcggcggagatccccattggtatatacaggacagagagccacgtcttctcaacaagcgagccgcacgacctgagggctcagagccagatctccgtgaatgttgaggactgtgaggatacccgtgaggtcaaaggtccatggggtagcagggccgggaccggaggctcatcacagggacgccacacaggggggggcgatccggccgagcatcctctgttgagacggaagtcgctgcagtgggcgcgaaggcttagccgaaaagcccccaaacaggccggccgagccgccgctgctgagtggatttcccagcagaggctatcactttataggcgcagcgaacgacaagagctctctgagctggttaaaaaccggatgaagcacctgggtctgcccacaaccggatatgaggatgttgctaatctgacagccagcgacgtgatgaatcgagtcaacctgggatacttgcaggatgagatgaatgaccaccagaacaccctttcctacgtcctgatcaacccacctccagacactcgcctggaaccctcagacattgtgtacctgattcgcagcgatcctctcgcacatgtggcatcaagctctcaatcacggaaaagcagctgttcccacaagctctctagttgcaatcccgagactagagacgagacccagttatag

SEQ ID NO: 200204 - DNA, 3708 bp, Artificial Sequence
  Description of Artificial Sequence: Synthetic coding sequence
atgcccctgcccgacggcgcccggacccccggcggcgtgtgccgggaggctcgggggggtggctacactaacaggactttcgaattcgatgacggccagtgcgcacccaggcgaccctgtgcgggggatggggctttgcttgatacagctggcttcaagatgtctgacctggattccgaagtgttgcccctgccaccaaggtacaggttccgcgatcttttgttaggagatccttcattccagaatgacgatcgcgtacaggtagaattttatgtcaatgagaacacatttaaagagcggttgaagttattctttatcaaaaaccagagatcttccctgcgtatccgcctcttcaatttttctctgaagctattgacatgcctgctgtatatcgtgcgcgtcctgctcgatgatccggctctggggatcgggtgttggggatgtccaaagcagaattattccttcaatgacagctcgagcgaaattaattgggctcctattctgtgggtggagaggaagatgacactatgggcaatccaggtcatagtggctattataagttttctcgagacgatgctgttaatttatctgagctataaggggaacatctgggaacagattttccgcgtctctttcgtgctagagatgatcaatacactcccttttattatcaccatcttctggccccctctgagaaatttgtttatccccgtctttttgaactgctggctggccaagcatgcccttgagaacatgatcaacgattttcatagagcgatattaagaacacaatctgcgatgttcaatcaggtccttattctgttctgtaccctattgtgtctggtgttcacgggtacctgtggcatacagcacctggagcgcgccggtgagaacctcagtctattgacaagcttctacttctgtatcgtgacattcagcactgtgggctacggcgacgtcacaccgaagatctggccgtcacagctcctcgtggtgattatgatctgcgtggcactggttgtcctgcctctccagttcgaagagctggtgtatctttggatggaaagacagaaaagcggaggaaattactccaggcaccgtgctcaaacagagaaacacgtggtactttgtgtgtcgagcttgaagatcgaccttctaatggatttcctcaacgagttctatgcacaccctagattgcaggactattatgtggtaatcttgtgtcccaccgagatggacgtgcaagtacgacgggtcctgcagattcccttgtggtcacagagggttatctatctgcagggctcagccctcaaggaccaagatctgatgcgagctaaaatggacaacggagaggcatgttttatcttgtcaagccggaatgaggttgacagaactgctgccgaccaccaaacaattcttcgagcgtgggcagtgaaagatttcgccccaaattgccccctatacgtacaaatcctcaagcccgaaaataagtttcatgtaaagtttgcagatcatgtagtttgcgaggaggaatgtaaatacgctatgctcgcactcaattgtatttgtcccgccactagcactttgataacgctgctagtgcatacgtcacgaggtcaagaaggccaggaatctcccgagcaatggcagagaatgtatggccggtgttctggtaacgaagtgtatcacatacgcatgggcgattccaagttttttcgtgagtacgaaggaaaaagctttacgtacgccgcattccacgcccacaaaaagtacggggtgtgtctgattggcttgaaacgcgaggataacaaaagcatcttgctcaacccaggcccccgacacattctggcagcaagcgacacatgcttctatataaatatcactaaagaagagaatagcgcatttatttttaagcaggaggagaagcgcaaaaagcgcgccttttcagggcaaggactacatgaaggaccagcccggctgccagtgcatagtattatcgcatccatgggaactgtggccatggacctccagggcacggagcaccgtccgacccaatctgggggtggtgggggcggctctaaactggccctacctactgagaatggctccggctctagaagaccatccatcgcacctgtccttgaactggcagactcgtccgccttgttgccttgtgacttgttgtcggatcagtcggaggatgaggtgactcctagtgacgatgagggcttatcagtggtggagtacgtcaaggggtaccctcccaattctccctacattggttcaagtcctacactatgtcatttgctccctgtgaaggcacccttttgttgccttcgactggataagggctgcaagcacaattcgtacgaagatgctaaagcatacgggtttaaaaacaagctcattatagtgagcgccgagaccgcgggtaacggcctttataatttcattgtcccccttagggcctactaccggtctcggaaggaattgaaccccatcgtgcttctgctagacaacaagcccgatcatcattttctcgaagcgatatgttgcttccctatggtgtactatatggaagggagtgttgacaatctcgatagcttgcttcagtgtgggattatttacgcggataacctggtagttgtggataaagaatctacaatgagcgccgaggaagattacatggcagacgccaagactatcgtaaatgtccagaccatgtttcgactgtttccctcattgagcatcacgacagagttaactcatccaagtaatatgcgttttatgcaattccgggccaaggattcatacagtctcgctttgtctaagttagagaaaagagagcgtgagaatgggagtaacctcgccttcatgtttagactgcctttcgcagccggcagagtcttcagtatttccatgctggacaccctgctgtaccagtcctttgtgaaggattacatgatcaccattaccagacttcttcttggccttgacacgactcccggcagtggatacctttgtgccatgaagattacagaaggagacttgtggattcggacctacggccgactctttcaaaaactgtgttcctcttccgccgaaattcctattggcatctataggactgagagccatgtattcagcaccagcgagccacacgacttgcgagctcagtcccagatctcggttaacgtggaagattgcgaagacacccgggaggtcaagggaccatggggtagccgcgcaggaacggggggaagcagtcaaggcagacataccggaggtggggatccggccgagcaccccttgctgcgacggaagtcactgcagtgggcccgacgtttaagcaggaaggcccccaaacaagctgggagagcggccgcagccgaatggattagccagcagcgtctgtcactttatcgccggagtgaaagacaggaactgagcgaacttgtcaaaaatcggatgaagcacctcggactccccacaaccggctatgacgaaatgaacgaccaccagaacaccctctcctatgtgctcattaatcctcctcccgatactaggttagagccctccgatattgtgtatcttattcgcagtgaccctttagctcatgtcgccagttcgagccagagcaggaagtcttcctgctctcataagctctcttcctgcaatccagagacccgggacgagacccagctctag

SEQ ID NO: 200205 - DNA, 3408 bp, Artificial Sequence
  Description of Artificial Sequence: Synthetic coding sequence
atggtggacctggagagcgaggtgccccccctgcccccccggtaccgcttccgggatctcttgctgggggatcagggttggcagaacgacgatcgggtgcaggtggaattttacatgaacgagaataccttcaaagagcggctcaagctgttctttattaagaaccagcgttcctccctgcgcattaggctatttaacttctcccttaagctgctttcatgccttttatacataatcagggtcctcttagaaaatcctagccaaggtaacgagtggtctcacatcttttgggttaaccgcagcctgcccttgtggggcctacaggtgagtgttgcgctgattagcctgttcgagaccattctcctggggtaccttagctacaaaggaaatatctgggaacagattctccgcatcccattcattctggagataatcaatgccgtccccttcatcataagtattttttggccctctctgagaaatctattcgtcccagtattcttgaactgttggctcgctaagcatgcactggagaacatgattaacgatcttcatcgcgccattcagcgaactcagagtgcgatgtttaaccaggttctcatcctaattagtactttgttgtgcctgatcttcacatgcatctgtggcatccaacacctggagcgcatcggaaagaaactcaacctctttgacagcctgtacttttgcatcgtgactttctctacagtcggttttggcgacgtcactcccgagacctggtctagcaagttgttcgtcgtcgctatgatctgcgtcgccctggtcgtgctgccaatacaatttgaacagttggcctacctctggatggagcgccagaagtctggtggaaattatagccgccaccgggcccagacagagaaacatgtggtactatgcgtaagctctcttaaaatagacctactgatggactttcttaacgaattttatgcgcacccacgcctccaggattactacgtggtgatactgtgcccgaccgagatggatgttcaggtgcgtcgagtgctccagataccgatgtggagtcagagggtgatctatttacagggttccgcattgaaagaccaggatcttctgcgcgccaaaatggacgatgcagaagcctgcttcatactgagttctcgctgtgaagtggacaggacctcttccgaccaccaaaccattctgagggcttgggcggtgaaggacttcgctcctaactgccctctgtacgtacagatcctaaagcccgagaataaattccacatcaaattcgcagatcacgtcgtgtgtgaggaggagtttaagtatgctatgctagcactcaattgcatctgccccgcaacctcgaccctaatcacactcttggtccatacaagtcgggggcaggaaggtcagcagagtcccgagcagtggcagaaaatgtacgggagatgcagcggaaacgaagtttatcatatcgtcctggaagagagtaccttcttcgctgaatacgaaggaaagagcttcacatacgcctcctttcacgcccacaagaagtttggagtctgcctgatcggcgtaaggcgggaagataataaaaacatcctcttgaatcccggaccccggtatataatgaactccacagacatatgtttttacatcaacatcacgaaagaagaaaattcagccttcaagaatcaggaccagcagcgaaagagcaacgtttctagatccttttatcatgggcccagtagactccctgtgcatagcatcattgcaagtatgggaacagtcgcaattgacctgcaggatacatcctgtaggtctgcctccggccccacactgtccctccccaccgaaggatctaaggaaatccgccgcccctcaatcgcacctgtgcttgaagttgccgataccagctctatccagacttgcgacctgttgagtgaccaatccgaagacgagactacacccgacgaagagatgagctctaatctcgagtatgccaagggctaccccccttatagcccatacattgggtcatccccaactttctgccatttacttcatgaaaaggtgccattctgttgcttgcggttagacaagtcttgccagcataactattacgaagatgccaaggcatatgggttcaaaaataagttaatcattgtggccgccgagaccgctggcaatggcctgtacaactttatcgtacccctgagagcttactatcgacctaagaaggaactgaacccaatagtgctgttattagataaccctccagatatgcatttcctggacgctatttgttggttcccaatggtatattatatggttggctcaatcgacaatctggatgacctcctccgatgtggtgttacctttgctgcaaatatggtggtcgtagataaggaatcgactatgagcgcggaagaggattatatggccgacgccaagacaatcgttaatgtacagaccttatttcggttgtttagtagtctcagtatcatcaccgagctgacgcatcccgccaatatgagattcatgcagtttagagctaaagattgctacagtttggccctgagtaaactggagaagaaggaacgagagcgcggtagtaaccttgcttttatgttcagacttccattcgccgccgggcgagtgtttagtatatctatgctggacacattgttgtaccaaagctttgtgaaggattacatgatttctattacacgactgctgcttggcctggacacaaccccgggttctggcttcctttgcagtatgaaaatcaccgcagatgacctgtggattagaacttacgctagactgtatcagaaactgtgttcaagcacaggtgacgtccctatcggcatctaccgtactgagtcacaaaaacttacaacctctgaaagtcagattagtatctctgtcgaagagtgggaggatactaaagattcaaaggagcaaggccatcaccgatctaaccaccggaactcaacttcctctgaccagtccgaccatcctctgctgcgacgcaaatctatgcagtgggctaggcgcctgtctcggaagggtccaaaacatagcggcaaaaccgcagaaaaaatcactcaacagagactaaatctttatagaagatctgagcggcaagaactggcagagctggttaaaaaccgcatgaaacatcttgggctgtcaacggttgggtacgatgaaatgaacgaccaccagagcactctgagctacatcctgattaaccccagtcccgatactaggattgaactcaatgatgtcgtctacctgatacgtcctgaccctctggcatacctgcccaatagcgagcctagcaggcgtaattcaatctgcaatgtcaccgggcaggactctagagaggagacccaactgtag

SEQ ID NO: 200206 - DNA, 3210 bp, Artificial Sequence
  Description of Artificial Sequence: Synthetic coding sequence
atggtggacctggagagcgaggtgccccccctgcccccccggtacagatttcgggacctgctcctaggggatcagggctggcagaatgacgatcgcgtgcaggttgaattttacatgaacgagaatacgttcaaggagcgtctgaagcttttttttatcaagaaccaaaggtcaagcctaaggatacggctcttcaattttagcctgaaactactgagctgcctcctctatattatccgcgtcctgcttgagaacccctcacagggtaatgagtggagtcacatattttgggtcaaccgctcgcttcctctttgggggttacaggtctccgtggcactcatttctctgtttgagacaattctcctgggctacttgtcttacaaaggaaacatctgggaacagatcctgcggatcccatttatcttagaaatcatcaatgccgtgcctttcatcatttctatcttctggccgtctttgcgcaatcttttcgtgccagtattcctgaactgttggctggcgaaacatgcattggagaacatgattaacgatctgcatcgggcaattcaacggacacagtccgctatgtttaatcaggttttaatcctgatctccacccttctgtgcctcattttcacatgtatctgtgggattcagcacctggagagaattggcaagaagctcaatctatttgattcgttatacttctgtattgtgacattctcaacagtggggtttggcgacgtgacacccgaaacgtggtcctctaagcttttcgtggttgctatgatctgtgtggccttggtcgttctccccatacagttcgagcaacttgcatatctttggatggagagacagaagagcgggggcaattattctaggcacagagctcaaaccgagaagcatgttgtgctctgcgtaagctcactaaaaatcgacctcctgatggatttcctgaatgagttttacgcgcacccccgtttgcaggattattacgtcgtgattctgtgccctaccgagatggacgtgcaggttagacgcgttctccagattcccatgtggagtcaacgtgttatttacttgcagggatccgcactgaaggaccaagaccttctgcgtgccaagatggacgacgctgaagcctgcttcattctctcctcacgctgtgaagtggatcgaacttccagcgaccaccagacaattctgagagcttgggctgtgaaagacttcgcccccaattgtcctctctatgtacaaattctgaaacccgagaacaagttccatattaaatttgctgatcacgttgtgtgtgaagaggagttcaagtatgccatgctcgcactcaattgcatttgcccagcgacttctacacttatcaccctgctggttcacacatctaggggtcagtttggcgtgtgtttaataggcgtgcggcgcgaagataacaaaaacattctgctgaatcccggccccagatatattatgaactcaacggatatttgtttctacatcaatattaccaaagaagagaacagtgcctttaagaaccaggaccagcaaaggaagtcgaatgtaagccggtctttctaccacggcccctcccgtctgccagtccatagcattatcgcctcaatgggaactgtggcaatagacctgcaagataccagctgtaggtccgctagcgggcctactctgtccctgcctacagagggatccaaggagatacggcgacccagcattgcaccagtcctagaggtggctgatacaagttccatccagacctgtgatctcctctcggatcagagcgaagatgagactacacccgacgaggaaatgagcagcaatctcgagtatgccaagggttatccaccctacagcccgtatataggttcgagtcctacgttctgtcacctgctgcacgagaaggtacccttctgctgtctgcggctagacaagtcatgccagcacaactactacgaagacgcaaaggcctatggttttaaaaacaagttaataatcgtggctgccgagaccgctgggaatggactgtacaactttattgttcccctccgagcctattatcgaccgaaaaaagaactgaaccccattgttttgcttctggataatcccctggacgacctcctgaggtgtggcgtgaccttcgccgctaacatggtggttgtcgacaaagagtctaccatgtctgcagaagaagattatatggccgatgccaagacgatcgttaacgtccagacactattccggttattcagtagcttaagcatcattacggagctgactcaccccgccaacatgcggttcatgcagttccgagctaaagattgctattctcttgctcttagcaagttggagaaaaaggaacgagaacgtggaagcaatctggcttttatgtttagactgccctttgccgcgggccgcgtgttctcaatttccatgttggatacactgctgtaccagagcttcgtgaaggattatatgatttccatcacaagactgctactgggactggatacaactccaggcagtggattcctgtgttctatgaaaataacggctgacgacttatggattcgcacctatgcccggttataccagaagctttgctcatctacaggagacgtacctatcgggatctacagaaccgaaagccagaagcttaccactagtgaggagacctatatattaatcttcttgagtcagatttccatcagtgtcgaggaatgggaagataccaaggatagtaaagagcagggccaccataggagcaatcacaggaactctacaagctctgaccagtcagaccatccgcttttgagaaggaaaagcatgcagtgggcccgcagattatcccgcaaaggcccaaagcatagcggcaagaccgcagagaagatcacccaacaacggctgaacctttaccgccgctcagagagacaagagctggctgagcttgtgaagaatagaatgaagcatttgggtttgtcaacagtggggtacgatgagatgaacgaccaccagagcaccctgtcttatatcttgattaatccgagcccagatactagaattgaactcaacgatgtggtgtatctaattcggcctgacccgttggcttaccttccgaatagtgagccttctaggagaaattccatctgtaatgtcacaggtcaggactctcgagaggagactcagttgtag

SEQ ID NO: 200207 - DNA, 3336 bp, Artificial Sequence
  Description of Artificial Sequence: Synthetic coding sequence
atggtggacctggagagcgaggtgccccccctgcccccccggtacaggttcagagatctgctgcttggcgatcagggatggcaaaatgacgacagggtccaggtcgagttttatatgaatgagaacacttttaaggagcgcctaaagctgtttttcatcaaaaatcagagatccagtcttaggattcgcctttttaacttctcactgaagcttctgagctgtcttctgtatattattagggtgcttttagagaacccttctcagggcaatgagtggagccacattttttgggttaatagatctttgccactgtggggactgcaagtcagcgtagccctgatttcactgttcgaaactatcctgctgggatacttgagctacaaaggcaatatctgggagcaaatccttagaatcccttttatcctggaaattatcaatgcggtgccgttcattattagcatcttctggccatctctcagaaatctgttcgtcccagttttccttaactgctggctagccaagcatgctttggaaaatatgatcaacgatctgcatagagctatccagagaacccagtccgctatgtttaatcaagtcctaatcttgattagtaccctcctgtgtctgattttcacatgcatctgtggcattcaacacctcgagcgtatcggcaaaaagttgaacctgtttgattcgctgtatttctgcattgttacattttccactgtcggttttggcgacgtcacccccgaaacatggtcctccaagttgttcgtggttgctatgatctgtgtggcgctggtagttcttccaattcagttcgagcagctggcatatttgtggatggagcgacaaaagtcaggcggaaactactcccgacaccgcgctcagaccgaaaagcatgtcgtgctgtgtgtgtccagcttgaagatagacctgttgatggatttcctcaatgaattctatgctcacccccgactacaggactattacgttgtcatcctatgcccaacagaaatggacgtgcaggtgcgtcgagtcctgcagatccccatgtggtcgcagagggtgatttacctacagggaagtgccctgaaagaccaggacctgctgcgagccaagatggacgacgccgaggcatgcttcatcttaagcagccggtgcgaggtagatagaacatctagtgatcatcagacgatattacgagcatgggctgtgaaagactttgctccgaattgcccactttacgtgcagattctgaagcccgagaacaagtttcacatcaaatttgctgaccacgtagtgtgcgaagaagaattcaagtatgccatgctggccttaaattgcatctgccccgctactagcactctaatcacccttttagtgcacacctcacgaggacaggagggccagcagagtcctgagcagtggcagaagatgtacggtagatgctcgggcaatgaggtctatcacatcgttttggaggaatccactttttttgcagaatacgagggtaagtctttcacatacgccagtttccatgcccataagaagtttggggtttgcctgatcggcgtgcgcagagaagacaacaagaacatcctgttgaatcccggcccacgatacatcatgaacagcaccgatatctgcttttacatcaacatcaccaaggaagagaatagcgccttcaaaaatcaggatcagcagagaaagtctaatgttagtcggtccttttatcacgggccatcccggctgcccgtgcactccattattgcctccatgggcaccgtcgctatcgacctgcaagacacaagttgtcgttcagcgtctggcccaacattgtcgcttcctaccgaaggctcaaaagagatccggaggcctagcatcgcacctgttctcgaagtcgccgatacttcctcaatacagacatgcgatttgttgagtgatcagtctgaggatgaaacgacccctgacgaggagatgagctcaaacctcgaatatgccaaaggatatcccccttactcaccctacattggaagctcccctaccttttgtcatttgctgcacgaaaaggtacccttctgctgtctacgtctggataaatcctgtcaacacaattattatgaggacgcgaaagcgtacggatttaaaaataagctcataattgttgctgctgaaaccgccggtaacggcctgtataacttcatcgtcccactgagggcctattatcggccgaagaaagaactaaacccaatcgtgctgctactggacaatcctttggacgaccttttgagatgcggagtaacctttgctgcaaacatggttgtggtcgataaggaaagcactatgtcagctgaggaagactacatggcagacgcaaagaccattgtaaacgtgcagacgctgttcaggctattctcttcactgtctattattactgagcttacacacccagccaacatgagattcatgcagttcagagccaaagactgttatagcctggcccttagtaaattggagaagaaggaacgggagcggggcagtaacttagcctttatgtttaggctacctttcgcggcgggtagagtcttctctatttcaatgctggacacgctgctctatcagagcttcgtgaaggattacatgatctctatcacaagactgctactcggcctggacaccaccccaggctccggattcctgtgctcgatgaaaatcacagctgacgacctgtggatcaggacatatgctaggctttaccaaaaactctgctcatccactggagacgtccctattggtatatacaggactgagtcacagaagctgacaacgtctgagtctcaaatttccatatccgtggaggagtgggaagatactaaagacagtaaggagcagggacaccaccggagcaaccacagaaatagcacttcgtcggatcagtccgatcatccactgcttaggaggaagagtatgcaatgggcccggcggcttagcaggaagggtccaaaacactctggaaaaactgccgagaagatcacccagcagagactaaatttgtataggcgttccgagaggcaggagttagcagagttagttaagaacagaatgaaacatctgggcctgagcacagtgggatacgacgagatgaatgatcatcagtctacgctgtcctatatccttattaatccaagcccagacactcgaatagagctcaatgatgttgtctatctgatccgacccgatcctttagcttacctgcctaattccgaacccagccggaggaattctatttgtaatgtgaccggccaagactctcgggaggaaactcaactttag

SEQ ID NO: 200208 - DNA, 1113 bp, Artificial Sequence
  Description of Artificial Sequence: Synthetic coding sequence
atgccctacctgcacctggaccaccagaccatcctgcgggcctgggcagtcaaggactttgccccgaactgcccattatacgtgcaaatactgaagcccgagaataagttccacataaaattcgctgaccatgtagtgtgtgaagaagagttcaagtacgctatgctcgccctcaactgcatctgtccagcaacttcaactttaatcacgctcctcgtccacacctccagagggcaggaagggcagcagtcgccagagcagtggcagaaaatgtacggccgatgctccggcaatgaagtttaccatatagtgctggaggagtcaacgttctttgcggagtatgagggtaaatcgtttacttacgcgagttttcacgctcataagaaatttggcgtgtgtctcataggcgtcagacgtgaggacaataagaacattcttctcaacccaggtccgcgttatataatgaattctaccgacatatgtttttatataaatattacgaaagaagaaaactcagcttttaaaaaccaagatcaacaaagaaagtcaaacgtgtctcgatcattctatcacggcccttcacgcctgcctgtgcattcgatcattgcgtcgatggggacggtggcaatcgatcttcaggatacttcatgtagaagcgccagcggcccaaccctatccttgcccacagagggaagcaaggagatacgtcggccctctatcgcaccagtactggaggtagcagacacctcttcaattcaaacatgcgacctactgtctgaccagtccgaagacgaaactacaccagacgaggagatgagtagtaatctggaatacgctaaaggctaccctccctacagtccctacattggtagtagtcccactttctgtcacttgctacatgagaaggtccctttttgttgcctgagactggataaatcctgtcagcataattactacgaagacgccaaagcctacggattcaagaacaagctgatcattgtggccgccgaaactgccggcaatggactgtacaactttatagtgcctctgcgtgcttactatcggccgaagaaggaattgaatcctatcgtccttttgctggataacccttag

SEQ ID NO: 200209 - DNA, 1572 bp, Artificial Sequence
  Description of Artificial Sequence: Synthetic coding sequence
atcatcaacgacctgcaccgggccatccagcggacccagagcgccatgttcaaccaggttctgatactcatctccacgctactgtgcctcatcttcacatgtatttgtgggattcagcatttggagagaatcggtaagaagctgaacttatttgattctttatacttttgtatcgtgacattctctaccgtgggattcggagatgtgacgcccgaaacctggagttcgaaactgttcgtcgttgccatgatatgcgtggctctggtcgttctgcccattcagttcgagcagcttgcttacctttggatggagcgacagaagagcgggggaaattactcccgccaccgggcccagactgagaagcacgtggttctgtgtgtctcctcattgaagatagacctgctaatggatttcttgaacgagttttacgcccacccaagacttcaggactattatgtcgtgattctgtgtccgacagagatggacgtccaggtcaggcgagtattgcagattcctatgtggagccagagagtaatatacttacagggcagtgccctgaaggatcaggatctcctgcgtgccaagatggacgatgcagaggcctgcttcattctcagcagccgttgtgaggtggaccgtacgtcaagcgaccaccagactattcttcgcgcgtgggctgtcaaggattttgctccaaactgcccactctacgttcagattctgaagccggaaaacaaatttcatatcaaatttgctgatcacgttgtttgcgaagaggagttcaagtatgccatgctggcgctaaattgcatttgcccagcaacgtccaccctgattacccttctggtccacacttcaaggggccaggaaggccagcagtcccctgagcagtggcaaaagatgtacgggcgatgtagtgggaatgaagtgtaccacattgtcctggaggaaagcacattttttgccgaatacgaaggcaagtccttcacatatgcgtctttccatgcacacaaaaaattcggtgtatgtctcatcggtgtccgcagggaggataacaaaaatatcttactcaaccccggacctcgatacatcatgaacagcacagacatctgcttctatattaacattactaaagaagaaaactccgccttcaaaaatcaggatcagcaaaggaagagcaatgtttctcgatcattttaccacggaccctctaggctgcctgttcattccatcattgcctcgatggggaccgtcgcaattgatttacaggataccagttgtagaagcgcatctggcccaaccctgtccctcccgaccgagggcagtaaggaaattaggcggccatcgatcgcccccgtcctagaggttgcagacaccagcagcattcaaacctgcgacctgctttccgaccaaagcgaggacgagaccactccggacgaggaaatgagctccaacctcgaatacgcgaaaggataccctccctactccccatacataggatcgtctcctaccttctgccatctgttacatgaaaaggtgcctttctgctgcctgcgattagataagttttag

SEQ ID NO: 200210 - DNA, 1503 bp, Artificial Sequence
  Description of Artificial Sequence: Synthetic coding sequence
atgcccagcagcggccgggccctgctggacagccccctggacagcggttcgctgacttccctggacagctcggtcttttgttctgaaggcgagggcgaaccactggctctgggagattgcttcaccgtgaatgttggtggctcccggttcgtgttgtcacagcaagcactttcttgctttccccacacaagactgggaaagttggctgtggttgtcgcctcgtatcgtcgtccaggcgccctagccgccgtgccctccccactggagctgtgcgatgatgcaaaccctgtggataacgagtatttctttgatcggtcaagtcaggcatttaggtacgtacttcactactataggaccgggcgcctccacgtaatggaacaattatgcgccctgtctttcctacaggaaattcaatactggggaatagatgaacttagcattgattcgtgctgccgtgatcgatattttcgacggaaggagctgagtgagaccctcgacttcaagaaggatacagaagaccaggagtcgcagcacgagtcggaacaggatttctcacaaggtccgtgtccaaccgtgcggcagaaactgtggaacatcctggagaagccgggctcatcaaccgccgcgagaatattcggggtgatatctatcatctttgtcgtagttagcatcattaacatggcgctgatgtctgctgaattatcttggctggatctccaacttttagaaattcttgagtacgtttgtatctcttggttcacaggggaatttgtactccgatttctgtgtgtaagggaccgatgtcgctttctcagaaaggtccccaacatcatagacctccttgccattttaccattttacatcaccttgctggtcgaatcactgagtggcagccagactacgcaagaactggagaacgtggggcgaatagtgcaggtcctcagacttttgcgagctttgagaatgctgaaactggggcgccactctactgggctccggtctcttggcatgaccatcacgcagtgctacgaagaggtgggtctgttgctgctcttcctgtccgttggcattagcatctttagtacagttgaatatttcgcggagcagagcattcctgacacaactttcacctctgtcccctgtgcatggtggtgggctaccaccagcatgactaccgttggttacggcgacatccggcctgataccaccacggggaaaatagtagcttttatgtgcattcttagcgggatcttggttcttgcacttcccattgcaatcattaatgatcgcttctcagcctgctacttcaccctcaaactgaaagaagccgccgtacggcagagggaagccctaaaaaagctaaccaagaatattgccaccgacagttacatttccgtaaaccttagagacgtctatgcacgatctattatggagatgcttaggttgaaggggcgtgagagggcttccaccagatcttccggaggggacgacttttggttttag

SEQ ID NO: 200211 - DNA, 1503 bp, Artificial Sequence
  Description of Artificial Sequence: Synthetic coding sequence
atgcccagcagcggccgggccctgctggacagccccctggacagcggttccctgacgtcactggactcctcagtcttctgctcagagggagagggagagcctctcgctctgggagattgcttcacagtcaatgtgggcggatcacgctttgtgctgtctcagcaggcccttagttgttttccccatacccgactcggtaagctcgcggtggtcgtggcatcttaccgacgtccaggcgctctcgcggccgtgccaagcccactggagctatgcgacgatgccaaccccgtggacaatgagtatttcttcgatcgctctagccaggcatttcgctatgttttgcattactatcgcacaggccgcctccacgttatggaacagctgtgcgccctgtcattcttacaagagatccagtactggggtattgacgagttatccatcgatagctgttgccgggatcgatatttcagacggaaggagctgtctgaaaccctggactttaagaaagataccgaggatcaggagtcacagcacgagtcagagcaagacttctcacagggtccttgccctaccgtgcggcagaaactgtggaatatcctcgagaagccaggttctagtaccgctgctagaatcttcggagtgatatctatcatattcgtggtggtgtcgattatcaacatggcgttgatgtctgcagagctgagttggctggatctgcagttgctggagatcctggagtatgtgtgcatcagctggttcaccggcgagttcgtgctgcgatttttgtgcgttcgcgatcgttgtcggttcctgagaaaagtgcctaacattattgatctgttagcaatcctccccttttacattacgctcctggttgagagcctcagtggtagccagacaacccaagaactggagaacgtgggccgaatcgttcaggttttgaggctgcttcgcgcactgaggatgctgaaactgggccggcattccaccggcctgcgaagtctggggatgaccattacacaatgctacgaggaagtcggcctgttgcttcttttcctttcagtgggaatctctatcttctccaccgtcgaatatttcgcggagcagagcattcccgacacgaccttcacctctgtgccatgtgcgtggtggtgggccacaaccagcatgacaacagtggggtatggcgacatccggcccgacaccaccacgggaaaaattgtggcctttatgtgtattttatcaggcatcctggtcctcgctctccccatcgctatcatcaacgatagattctccgcctgttattttaccttgaaattaaaagaggcagccgtgaggcagcgagaagctcttaagaaactcacaaagaacatcgcaacagatagttatataagtgtaaatcttcgcgacgtgtatgcacggtctatcatggaaatgttgcgtctcaaaggcagagaaagggcaagcactcgcagcagcggcggcgacgacttttggttttag

SEQ ID NO: 200212 - DNA, 1131 bp, Artificial Sequence
  Description of Artificial Sequence: Synthetic coding sequence
atggagcagctgtgcgccctgagcttcctgcaggagatccagtactggggcattgacgagctctctattgactcctgctgccgggataggtatttccgtcgaaaagagctgtccgagaccctggatttcaaaaaagacacagaggaccaggagtctcagcacgagtcagaacaagacttttcccagggcccttgtccaacggtgcgccaaaagttgtggaacatacttgagaagcccgggagctcaacagccgcgcggatcttcggcgtgatcagcatcatctttgtggtggtgtccatcattaatatggctctgatgagcgccgaacttagctggcttgatctgcagctgctggagattttggaatacgtgtgtattagctggtttacaggggaatttgtgcttcgtttcttgtgtgtgcgcgaccgctgtcgctttctgcggaaggtccctaacataatcgatctgctggctatcttacccttctatataacgctgctggtcgaatcactgtccggtagccaaaccacccaagagcttgaaaatgtgggaaggatagttcaggtcctacgcctgttgagagctctgcggatgcttaagctggggagacacagcaccggcctgagaagtctgggcatgacaatcacccagtgttatgaagaggtcgggctgcttctacttttcctcagtgtgggaatctctatctttagcacggtggaatactttgctgaacagagtatccccgacacaacatttacctccgtgccatgtgcgtggtggtgggctactaccagcatgactacagtcggatatggcgacattcgaccagatactaccacaggtaaaattgtcgctttcatgtgcattctgtcaggaattttggtgcttgctttgccaatcgcaatcattaatgatcgctttagcgcctgttattttaccctcaagcttaaagaagccgctgtgcggcagagagaggcattaaagaagctgaccaagaatatcgctaccgattcgtacatatccgtgaatttgcgcgatgtgtatgccaggagcataatggagatgctccgattgaagggtagggagcgtgcctctactcggtcgtcaggaggcgacgatttctggttctag

SEQ ID NO: 200213 - DNA, 1638 bp, Artificial Sequence
  Description of Artificial Sequence: Synthetic coding sequence
atgctgaagcagagcgagcggcggcggagctggagctaccggccctggaatactactgaaaatgaagggagccaacatcggcggtccatttgttccctgggtgctcgatcagggtcccaagcaagcattcacgggtggacagaggggaactacaactactatatcgaggaagacgaagacggagaggaagaagaccagtggaaggacgatctggctgaggaggatcaacaggctggagaggtcacgaccgcgaaacctgaggggcccagtgacccccccgccttactgtctaccctgaatgtgaatgtcggtggacactcataccagctggattattgtgaactcgcaggtttcccaaagacaagactaggtcgactggcaacatccacctcacgctcaagacaactgtccctgtgtgacgactacgaggaacagactgatgagtatttttttgacagagatccagccgtgttccagctcgtgtataatttctatctatcgggcgtactcttggtgctggatggcctgtgtcctcggcgatttctggaagagctcgggtactggggtgtgcgtctgaaatacaccccacgctgctgccgcatttgcttcgaagagaggagagacgagctgagtgaaagactcaagattcagcatgaattacgagctcaagcccaggtggaagaggcagaggaactgtttcgagacatgcggttttacgggccccagcgcaggaggttgtggaacttgatggagaagcctttctcctctgtcgcagcaaaggcaatcggcgtggcttctagcacgttcgtactggtctccgtggtcgccttggctctcaatactgtcgaggaaatgcagcaacatagcggacaaggtgagggcggtccagacttgcgacccatcctggagcacgttgagatgttgtgtatgggcttcttcacactcgagtatctcctgagactcgcttcgacaccagacttacggcgcttcgccagaagcgccttaaacctcgtggacctggtggcgatactccctctgtatttacaattactcctggaatgctttaccggggaagggcaccaacgaggtcaaactgtcgggtccgtgggtaaggtggggcaagtgttacgcgtcatgagacttatgcgcatttttagaatcctgaagctggctaggcactcaaccggcctgagagcttttgggttcacacttcggcagtgctatcaacaggtgggatgtttactgctgttcattgccatggggatcttcacctttagcgccgcagtctatagcgtagagcacgatgtgccctcaaccaattttacgaccattcctcactcatggtggtgggctgccgtgtccatcagcacggtcggttatggagatatgtaccctgaaacccacctaggtcgttttttcgcatttctatgcattgcttttggcataatcttaaatggaatgcccattagtattctctacaacaaattctccgactactactctaagttgaaagcttacgagtacaccaccatccgcagggagcggggagaggttaactttatgcagagagcaagaaaaaagatcgctgaatgtctgctgggctctaatccccagctcacaccgcgtcaggaaaattag

SEQ ID NO: 200214 - DNA, 963 bp, Artificial Sequence
  Description of Artificial Sequence: Synthetic coding sequence
atgctgaagcagagcgagcggcggcggagctggagctaccggccctggaacactactgaaaatgaaggcagccaacacaggaggtcgatctgcagccttggggcaagaagcggcagtcaggcctctatccacggatggaccgagggaaactataactattatatcgaagaggacgaggacggggaagaggaagatcagtggaaggatgacttggcagaggaagaccagcaggccggggaggtgacgacggcaaagccagaaggacccagcgacccccccgccctcctgagtacgctgaatgtcaatgtcggcggccattcgtaccaactcgattactgtgaactagcaggattcccaaaaacacgtcttggacggctggctacttctacgtctcgcagccggcagttgtccctgtgtgacgactacgaggagcagactgatgagtattttttcgatagggacccggcagtttttcaactggtttataacttctacctgtcaggggtgctgctggttctggatggcttatgccccaggcggttcttagaagagcttggctactggggcgttagactgaagtacaccccacgctgttgtagaatctgcttcgaggagagaagggatgagctgtccgagagactcaagatacaacacctcagagcgcgactgagaggcggggccggagcccaacacagagggggtgacgctgccgctctcggtgcaggcagagggcgcccccgtcctgccgcacatcctggtgctcgcggcgatgcggtccacggtctgctgcatgcacgggttcctgccgctccttcgctgcatgcccgaccagaagctctgcgtgcccagaggccgcagcccggcggtcccgggggtcaccccgccgctctgccaagtgccgctgcccgagtgctgcacggaaggggccctcctaccaggccagacggcggacagagaggctag

SEQ ID NO: 200215 - DNA, 1740 bp, Artificial Sequence
  Description of Artificial Sequence: Synthetic coding sequence
atgagcagctgccggtacaacggcggcgtgatgcggcccctgagcaatctgagcgcgagcagaaggaacttgcatgaaatggactccgaagcccagcccctccagcccccagcctctgtaggcgggggcggaggtgccagctccccgagcgctgcggcggcagccgctgccgccgtgtcttccagcgcccctgagatcgttgtttcaaagccagaacacaacaattcaaacaatctcgccctatacgggacgggggggggaggatctaccggcgggggaggaggcggcggtgggtccggccacggctctagtagcggtactaaaagttccaaaaagaagaatcagaacattgggtacaaactcgggcacaggagggccctgttcgaaaaaagaaagcgtctttcagattatgctttgattttcggaatgttcggcattgtggtaatggttattgagaccgaactgtcttggggtgcttatgacaaggcctccttgtatagcctggccctgaagtgtctgatttccttatctactataatcctgcttggcctgattattgtataccatgcgcgcgagatacaactatttatggtggacaacggcgctgatgactggcgtattgctatgacctatgagcgtattttcttcatctgtttggagatactggtatgtgcaattcaccccatccccgggaattatacattcacttggacagctcgtctggcgttctcctacgccccttcaaccaccaccgctgatgtggatattatcctgagtattccgatgttcctgaggctttatctgattgcaagagtcatgcttctgcattcaaagctcttcacggatgcttctagcagaagcattggcgcccttaataaaatcaactttaacacgcgattcgtaatgaaaacgcttatgaccatctgcccgggtactgttctgcttgtgttttctatctccctgtggataatagctgcatggaccgttagggcttgtgagcgatatcacgatcagcaagacgtgacctcaaatttcctgggagccatgtggttaattagcattacatttcttagtataggatacggggatatggtgccaaacacctactgtggaaaaggggtgtgcctgttgacagggataatgggagctgggtgcactgctctcgtagtcgcagtagtcgcacgcaagctggaactgaccaaagctgagaagcacgttcacaacttcatgatggacactcaacttacgaagcgcgtgaagaacgctgctgcaaacgtgctgagagagacctggttgatttataagaacaccaagctcgtaaaaaagatcgaccacgccaaggtgagaaaacaccagaggaaatttttacaggccattcatcaactgaggtcagttaaaatggaacaacgaaaattaaacgatcaggccaatacactggtggatttggcgaagacccagaacattatgtatgacatgataagcgacttgaacgagcgcagcgaggatttcgaaaagagaattgtgactctggagaccaaacttgagaccttgatcgggtctatccatgccctgcccggccttatttctcaaacaattagacagcagcagcgagatttcatcgaggcccagatggagagttatgacaaacacgtgacttacaacgcagagcggtctaggagttctagtcggcggcgaagatcttcctcaactgcccctccgacaagcagcgagtcaagttag

SEQ ID NO: 200216 - DNA, 696 bp, Artificial Sequence
  Description of Artificial Sequence: Synthetic coding sequence
atgtggctgatcagcatcaccttcctgagcatcggctacggcgacatggtccctaacacctactgcggaaagggagtttgtctcttaacagggattatgggagcgggctgtaccgcactggtggtggctgtcgtagcaaggaagctggagttgacaaaagccgaaaagcatgttcacaatttcatgatggatacccaactgaccaaaagagtgaagaacgctgcagccaatgtgcttcgggagacctggctaatttacaaaaatacaaaactggtgaaaaagatcgaccacgccaaagtgcggaaacaccagagaaaattcctgcaggcgattcatcaactgcgcagcgtgaagatggaacaacgcaaactcaatgatcaggccaatacattggtcgatctggccaagacacagaacatcatgtacgacatgatttctgatctgaatgagaggtccgaggatttcgaaaagcgaatcgtgactctggagacaaaactggaaacgctcattggatcaattcatgccctacccggccttatcagtcaaactattagacagcagcagagggactttatcgaggcccagatggagagctacgacaagcatgtcacctacaatgctgagagaagcagatcctccagcagaagaagacgttccagctctacggccccccctactagtagcgaaagctcatag

SEQ ID NO: 200217 - DNA, 1326 bp, Artificial Sequence
  Description of Artificial Sequence: Synthetic coding sequence
atgagcagctgccggtacaacggcggcgtgatgcggcccctgagcaacctgagcgcctcaaggagaaacctccacgagatggactccgaggcccaacctctgcaaccccccgcgtctgtgggcggcggcgggggagccagtagtcccagcgcagcggctgctgctgctgccgctgtatctagctccgctcctgaaatcgtcgtcagcaaaccagagcacaataattccaataacctggccctgtacggcactggtggaggagggtcgaccggaggcggtggaggtggcggcggtagtggtcacggaagtagttctggcactaagagcagcaagaaaaaaaatcagaatatcggctacaagttaggtcaccggcgcgccctgtttgagaaacgcaagcggctgtccgattacgctctaatcttcggcatgtttgggatcgtagtcatggtgattgagacggagctctcatggggagcctacgacaaggcctccctgtattcactcgccctcaagtgcctcatatcattgtctactatcatcctgttgggcttgattattgtgtatcatgcaagggagatccagttgttcatggttgacaacggggctgacgattggagaattgccatgacctacgagcggatttttttcatctgcctggagatcctcgtgtgcgccattcacccgatccccggaaattatactttcacctggacagcccggttagctttttcttatgcaccttccactaccaccgccgatgtcgacatcattctgtccatccccatgtttctgaggctctatctgattgcgcgggtgatgcttctacacagtaagctattcaccgacgcatcgagcaggtctattggagctctaaataagattaactttaacacccgctttgtaatgaagaccctgatgactatctgtccggggaccgtgctgctggttttctccatatctctttggatcattgccgcttggacagtccgagcctgcgaacgttaccacgaccaacaagatgtcaccagcaactttctgggtgcaatgtggctcatttccattaccttcctatccatcggctatggtgatatggtccctaatacgtattgtggcaaaggggtatgcctactcaccgggatcatgggtgctggatgtaccgcactcgttgtggcagttgtggcccgaaagctggagctcactaaagccgaaaagcatgtccacaattttatgatggacacacagctgactaaacgcgttagttactacccctacattttcaaagagaacatcatcgttattttctccgtactgggcaacatggcatag

SEQ ID NO: 200218 - DNA, 2196 bp, Artificial Sequence
  Description of Artificial Sequence: Synthetic coding sequence
atggacaccagcggccacttccacgacagcggcgtgggcgacctggatgaagatcctaaatgtccatgtccttctagtggcgatgagcagcaacaacagcagcagcagcagcagcagcaacagcctccgccccccgccccccccgctgcccctcaacaacccttggggccctcgcttcagccacagccacctcagctgcaacagcaacagcaacagcagcagcagcagcaacaacaacagcctccccaccctctgtcacaactagcccaacttcagtctcagccagttcatccgggcttgcttcactcctctcccaccgcctttcgagcaccgccgtctagtaatagtacagccattctacacccgtcctccaggcagggaagccagctgaacctgaatgatcatttgttagggcactctcctagctctaccgccacctccggacctggtggtggaagtaggcataggcaagctagtcccctcgtccatcggagagactccaacccttttactgagattgccatgagcagctgtaagtatagtggcggggtgatgaaacccctctccagactctccgcttcgcgtagaaatctgatcgaggcggagacagagggccagccgctgcagctattctcgccttcgaacccgcctgaaattgttatttcttctcgcgaagacaatcacgcccaccagacactgttgcatcatcctaatgctacacacaaccatcagcacgctggcaccacagccagctctaccacctttccaaaagccaacaagcggaaaaatcagaacatcggctataaactcggccatcggcgcgctctgttcgagaagcgaaaacggctcagcgattacgctctcatttttgggatgttcggaatagttgtgatggttatagaaaccgaattgtcctggggactgtattccaaggattccatgttcagtctggccctgaagtgccttatttccttgtcgactattatcctcttagggctgatcattgcttatcacacccgcgaagtccagctgttcgttatcgacaatggcgccgacgattggagaatcgctatgacatacgaacggatattgtatatttccctggaaatgctggtgtgcgccattcacccaatcccaggagaatataaattcttttggactgcaaggctcgcgttctcatacacaccatcaagagctgaagctgacgtggacatcatcctatccataccaatgtttctgagactgtacctgatcgccagggttatgctgttgcactccaagctctttacggacgcttcatctagatcaattggcgccttgaataaaattaatttcaacactcgcttcgtcatgaagacacttatgaccatatgccccggtacagtcctgcttgttttttccatttccctgtggattatagcagcgtggaccgtaagagtatgtgaacgctaccatgaccagcaggatgtcactagcaattttctcggcgccatgtggcttatatctatcacatttttgagtatcggatatggagacatggttccacatacttactgcggtaagggggtgtgtctcctcacgggcataatgggggccggatgtacagcgcttgtggtagccgtggtggctcggaagctggagctaacaaaggctgaaaaacacgttcataacttcatgatggacacgcagctcacgaagcggattaagaacgccgccgccaacgtcctgagggaaacctggctgatttataaacataccaagctcctaaaaaaaatcgatcacgccaaggtccgtaaacatcagcgcaaattccttcaggccattcaccagctccgtagtgtgaagatggagcagcgcaaactgtctgaccaagcaaatacacttgtcgacttgtctaagatgcagaacgtcatgtatgacctaattacagaactcaacgacaggtctgaggacctggaaaaacaaatcggttcactcgaatccaagctcgaacatcttacagcgtccttcaacagcctgccactgctgatcgccgacacactacgccagcagcagcagcagctcttaagtgctattatagaggccaggggcgtcagtgtcgccgtggggacgactcacacgccgatatccgattcaccaatcggagtgtctagcacgagcttccctaccccctacactagtagctccagttgttag

SEQ ID NO: 200219 - DNA, 1257 bp, Artificial Sequence
  Description of Artificial Sequence: Synthetic coding sequence
atgttcagcctggccctgaagtgcctgatcagcctgagcaccatcattcttctcggactcattatagcctaccatacccgagaagtacagctgtttgttatagataatggcgctgacgactggcgcatagccatgacctatgagagaatcctatatataagtctggaaatgctggtgtgtgcaattcaccctatccctggcgagtataaatttttctggactgctcggctcgcgtttagctacaccccctccagagctgaggcggacgtcgacatcattctcagtattccaatgttccttcggctatacctgattgcaagagtcatgctcctgcacagcaaactgttcacagatgcttcatctaggtcaatcggtgctctgaataaaatcaacttcaacacccgctttgttatgaaaacattgatgaccatatgtccaggaaccgttctgcttgtcttctcgatttctctctggattattgctgcgtggaccgtgagagtctgcgagagatatcacgatcagcaggacgtgacatctaactttttaggggctatgtggctgatttccattaccttcctctctatcggctatggtgacatggtgcctcacacctattgtggtaaaggcgtctgtctgctgaccggtattatgggagctggatgtacggccttggtggttgccgtcgttgctcgcaagttggagctcacaaaggcagagaaacatgtgcacaacttcatgatggatacccagctcacaaaacgcataaagaatgctgccgccaatgtgctccgcgagacctggttgatttataagcatacaaagctgctcaagaagatcgaccacgctaaggtgagaaagcatcagaggaagttcctccaggcaatccaccagctccgtagcgtgaagatggagcagaggaagctgtctgaccaggcaaacaccttggttgatctttccaagatgcagaacgtgatgtacgaccttatcaccgagttgaacgaccggtccgaggaccttgaaaaacagattggcagcctcgagtcgaagctggaacacctgacagctagctttaacagcctgccccttcttattgcagacacccttagacagcagcagcagcagctgttatctgccatcattgaagctcggggggtttctgtggctgtgggaactactcacacgccaatctccgattcccctatcggggttagctccacatcatttcccacaccttacaccagttcctctagttgttag

SEQ ID NO: 200220 - DNA, 1281 bp, Artificial Sequence
  Description of Artificial Sequence: Synthetic coding sequence
atggagcggcccatcaaggacagcatgttcagcctggccctgaagtgtttgattagcctgagtacgataattctgctaggccttattatagcgtatcacacacgagaagtgcagctctttgtcatcgacaacggggcagacgattggagaatcgccatgacttacgagcggatattatacatcagcctagagatgctggtctgcgcaatacaccccatcccaggcgaatacaaattcttctggacggctcgcctggccttttcctacacccccagccgcgcagaggctgatgttgatattattttgtcaattcctatgttcttgaggctctacctgatcgctagagtgatgttactgcattcaaagctctttactgatgcctctagtcgctccatcggcgcattgaacaagatcaattttaacacccgtttcgtgatgaaaacactgatgaccatctgccctggtaccgtactattagttttctccatttctctgtggatcattgctgcctggacagtgagggtgtgcgaacggtaccatgaccagcaggatgttactagtaattttttgggggccatgtggttgataagtattaccttcttgtccatagggtacggggatatggtgcctcacacttattgcggcaagggagtgtgtctgctgactggaataatgggcgctggatgcaccgccctggtcgtggccgtggtggctcgaaaacttgaactcactaaggccgagaagcacgttcataatttcatgatggacacccagctcacaaaacgtattaaaaatgccgcggctaatgtcttaagggagacttggctcatctacaaacatactaaactcctgaagaaaattgatcacgctaaagtaagaaagcaccagcgcaaattcttgcaggctattcatcagttgaggagtgtgaagatggaacagcggaaactgagtgatcaagcgaacacactcgtggacctgtccaagatgcagaacgtaatgtatgatctaattacagaactaaacgacaggtcagaagatcttgaaaagcaaatcgggagcctggagtctaaactggaacatctgactgcctcttttaactcattgccacttctcatagctgatacactccggcagcaacagcagcagctgttgtctgccattatcgaggcacgaggtgtcagcgtggctgtcggaaccacacacactccaatatcagactcgcccataggagttagttcaacgtcttttccgacaccctatacatcgtcatcaagctgttag

SEQ ID NO: 200221 - DNA, 684 bp, Artificial Sequence
  Description of Artificial Sequence: Synthetic coding sequence
ccccacaccctgctggaggaccacctgctgcgggagttcttccaccctctgtttttcctgcaggccccgctcctgttgagtctgccagcccaatacaacgcgttcctgtccggtagcgtctggaccccaggaagtcctcgggagcccaaacaggcgaaggaacgaaccggagccaagatcctcgtgggtgaaataggctgcctggccttcttcgaggacatcttcggcgcgcgcgtcgctctgggatggggcctggtacttcagggcatacagcctggccccaaaatggatacctctggtcattttcatgacagtggcgttggcgacctagatgaggatccaaaatgcccatgcccctcttccggtgatgaacagcagcaacagcagcagcagcagcagcaacagcaaccgccgccacctgctcccccggccgctccccagcagccgttgggcccatctctacagccacagcccccccagctgcaacagcaacagcagcagcagcagcaacagcagcagcaacagccccctcatcccctctcgcaactggctcaactacaatcccagccagttcaccctgggttgcttcactcaagccccaccgcattccggcccccttttgtccagctgcacaggcatcctccacctttccttcaggcacggcagcccgcgcagtctcagtag

SEQ ID NO: 200222 - DNA, 1284 bp, Artificial Sequence
  Description of Artificial Sequence: Synthetic coding sequence
atgggcggcgacctggtgctgggcctgggcgccctgcggcggcggaagcgattattggagcaggagaagtctctcgccggctgggctctcgtgcttgcagggacgggtattgggcttatggtgctccacgctgagatgctgtggttcgggggctgctcctgggccctttacctgtttctggtaaagtgtaccatttctattagtacttttctgctcctgtgcttaatcgtggccttccatgcaaaggaagttcagctcttcatgactgacaacgggctgcgggactggcgggttgctctgacaggacgacaagccgcccagatcgttttggagctcgtcgtttgtggtctacaccccgccccggtgagagggccgccctgcgtccaagacctgggtgccccccttacctcccctcagccttggccgggatttctgggtcagggcgaagcacttctgagcctggctatgctcttgcggctatatctagtccctagggccgtactgctgagatcaggcgtattattgaacgcctcgtatagatccatcggcgcactcaatcaggtcaggttccggcactggtttgtcgccaaactttacatgaacactcatcctggcagattactactgggtctgacacttggactctggttgactactgcatgggtgctttccgttgccgagcggcaggccgtcaatgcgacaggtcatctgagtgatacattgtggctgattcccataaccttcctgactattgggtacggagatgtggttccaggtaccatgtggggaaaaattgtctgtctatgcacaggtgtgatgggcgtctgctgcacagccctgctggttgctgtagtggcgagaaaattagagtttaacaaggccgagaaacatgtgcacaatttcatgatggacatccagtacactaaagagatgaaggaatcggcagcgagggtgctgcaggaggcctggatgttttataaacacactaggcgcaaagaaagtcacgcagcccgccgtcaccaacgcaagttgctggcagcgatcaatgccttcagacaggtgcgcctcaagcaccgcaagctccgcgaacaggtcaatagtatggttgacattagtaagatgcacatgatcttgtacgacctgcagcagaacctgagttcctctcatcgagccctagagaaacagattgacactctggctggcaagctcgacgctctgaccgaactattatcaactgccctcggacctcgccaactgcctgaaccgagccagcagtcaaagtag

SEQ ID NO: 200223 - DNA, 888 bp, Artificial Sequence
  Description of Artificial Sequence: Synthetic coding sequence
atgcacgaccagcacttccacctgctgacccccctgccccaccggggattatcctgtcagcgtggccccgctgtgcacgaccgccagagagctgccggtttagcccggggtgccgacagagccgcaggaaatgcgtcatataggagtataggcgcactgaaccaagtgcgcttcagacattggttcgtagcgaagctgtacatgaacacacacccagggaggctactgcttggacttacacttggtctgtggctgactactgcatgggtcctctctgtggcggaaagacaagctgtaaatgccacagggcacttgtccgacacattgtggttgatcccgattacattcctgaccataggctatggagacgtggttcctggcacaatgtggggaaaaatcgtgtgcttgtgtaccggagtgatgggtgtgtgttgtacagccttactggttgctgtcgtcgcaagaaaattagagttcaataaggctgagaaacatgtgcataactttatgatggacattcagtacacgaaagaaatgaaagaatctgccgcccgagtgttgcaggaagcatggatgttctataaacatacacgccggaaagagtcccacgccgccaggagacaccaacgcaagctgctggctgctataaacgcctttagacaggttcgccttaagcatcgcaaactccgcgagcaagtaaatagcatggtggatatttctaagatgcatatgatattgtatgacttacagcagaacctcagctcatcacatcgcgcactcgagaaacagattgatactttagctggcaagctggatgcactcaccgaacttctgagcactgctctcggcccacggcaactgccagagccttctcagcaaagtaagtag

SEQ ID NO: 200224 - DNA, 1119 bp, Artificial Sequence
  Description of Artificial Sequence: Synthetic coding sequence
atgttcaagcacctgcggaagtgggtggtgacccggttcttcggccactcccgccagagagcccgcctggtctcaaaagatggtagatgcaatatcgaatttggtaacgtcgaagcacagtctcgcttcatattcttcgttgatatttggacaaccgtgctggacctgaagtggcggtataagatgacaattttcataaccgcctttctgggcagctggttcttctttggtctgctctggtacgctgtagcctacatacacaaggatttgcccgagtttcatccttccgctaaccatactccctgcgtggaaaacatcaacggcctcacctcagcgttcctgttcagcctagagacacaagtgaccattggatatggcttcaggtgcgtcacagagcagtgcgcaactgccattttcctactgatttttcaatctattctcggagtcatcatcaatagttttatgtgcggcgcaatcctggccaaaatttcccggcccaaaaagcgggccaagacaattacttttagcaaaaatgccgtgatctccaaacgaggcggtaaactctgcctgcttattagagtggcaaatttaagaaaatcgctgcttataggcagccacatctacggaaaacttctgaagactacggtgacaccggaaggcgagaccattattttggatcagattaacattaactttgtggtggatgcaggcaacgagaatctcttttttatctccccactgacaatttaccacgtgattgaccataactctccttttttccatatggccgcagaaaccctgctccagcaggacttcgaactggtcgtgttcctcgacggcaccgtggagtccacgtctgccacatgtcaagtccggaccagctacgtgcctgaggaagtgttgtggggataccggtttgctccaattgtttctaaaacaaaggaaggaaaatacagagtggactttcataattttagtaaaaccgtcgaagtggagactcctcactgtgccatgtgcttgtacaacgagaaggacgtgcgcgcccggatgaagaggggatacgacaatcccaattttatactgtctgaggtcaatgagaccgacgatacaaagatgtag

SEQ ID NO: 200225 - DNA, 1119 bp, Artificial Sequence
  Description of Artificial Sequence: Synthetic coding sequence
atgttcaagcacctgcggaagtgggtggtgacccggttcttcggccactcccgtcagcgtgccagacttgtcagcaaagatggacgctgcaacatcgagtttggaaacgtagaagcccagagccgatttatcttttttgtggatatatggactacggtcctcgacttaaagtggcgatacaagatgactatcttcattactgccttcctcgggtcttggttcttctttggactgctctggtatgctgttgcatatatccacaaagatctgccggaatttcacccaagtgctaaccatacaccatgtgttgagaacattaatggcttgacgtcggctttcctgttcagtctggagacacaggtgaccataggctacggattccggtgcgtgacagaacagtgtgccaccgccatctttctgctcatcttccaatcaatcctcggcgtaatcatcaactcttttatgtgtggcgcgattctggccaagattagtaggcccaagaagcgcgccaaaaccataaccttttcaaagaacgccgtaatctccaaaagaggagggaagctgtgtctgctcatccgggtggccaatttgaggaaaagcttgctcatcggtagccacatctatggtaaattgctgaaaaccacagttacgccagagggcgagaccataatcctggatcagataaacattaacttcgtggtggacgccggaaatgagaatttatttttcatcagtcccctcaccatctatcatgtcatcgatcataattcccctttcttccacatggccgccgaaacactgttgcagcaggatttcgagcttgttgtctttctagatggcaccgtcgagtcaacgagtgcgacctgccaagtcaggacatcatatgttccagaggaggtgttgtggggctatagatttgctccaattgtgagcaagacaaaggagggtaagtaccgggtggattttcataacttttcaaagaccgtggaggtggaaaccccccactgtgccatgtgcctttataacgagaaagacgttcgggcccgcatgaagcgcggctacgacaaccccaatttcatccttagtgaagtcaacgaaacagacgacactaagatgtag

SEQ ID NO: 200226 - DNA, 912 bp, Artificial Sequence
  Description of Artificial Sequence: Synthetic coding sequence
atggcctggtggctgatcgccttcgcccacggcgacctggccccctctgagggtacggccgagccttgcgtcacctcgatacacagtttcagcagtgcgtttttattctctatagaggtgcaggtgaccatcggattcggtggacggatggtgactgaggagtgcccgctggcaatcttgatcttgatcgtccagaatattgtcggcctcatgattaacgccattatgctggggtgtatcttcatgaagactgcccaggcgcataggagggctgagaccctgatcttcagcaaacatgcggtgatcgctctaagacacggccgtctttgttttatgttacgagtcggtgatctgagaaagagcatgatcatctcagcaactattcatatgcaggttgtgagaaaaactaccagtccagaaggcgaggtcgtaccgcttcatcaggtggatatacccatggaaaatggggtggggggaaattccatctttcttgtcgcgccgctcatcatctaccatgtaatcgatgccaacagcccgctctacgacctcgcaccaagtgatttgcaccatcatcaagatcttgagatcatcgtcatcctagaaggggtggtggagacaaccggcattactacccaggctcggacatcgtacttggcagatgaaattctttggggccagcgattcgttccaattgtcgcagaggaggacggtagatattctgttgactactccaaattcggcaacactgtgaaggtccccacccccttgtgtacggctcgccagctggacgaggatcacagcttactggaggccctgacccttgcttcggctaggggaccgctcagaaagaggagcgttcccatggccaaagcaaaacccaaattcagtatcagcccagacagcctgtcctag

SEQ ID NO: 200227 - DNA, 1302 bp, Artificial Sequence
  Description of Artificial Sequence: Synthetic coding sequence
atgaccgccgccagccgggccaacccctacagcatcgtgagcagcgaagaggatggactgcacttggtaactatgagtggggccaatggcttcggaaacggaaaagtgcatactaggaggcggtgtcggaatcggttcgtgaaaaagaatgggcagtgtaacatcgaattcgcgaatatggatgaaaaaagtcaaagatatcttgccgatatgtttacaacttgtgtcgacataagatggcgatatatgttacttattttcagtctggccttcttggctagctggctgctcttcggtattattttttgggtgatcgcagtggcccacggcgacttagaacctgccgaggggcgcgggcgcaccccatgtgttatgcaggtgcatgggttcatggccgccttcctgttctctattgaaacccagacaacaatcgggtacggattacgatgtgtgaccgaggagtgtcccgttgccgtattcatggtggtggcccagtccattgttgggtgtatcatagactcgtttatgattggagccatcatggccaagatggccagacccaaaaagcgagcacaaacactgttattcagtcacaacgcagttgtggcattaagagatggaaaactctgccttatgtggagggtggggaatctgcgaaaaagccatattgtggaggcacacgtacgtgcccagctgatcaaacctcgagtgacggaggaaggcgaatatataccgctggaccaaatcgacatcgatgtaggattcgataaaggtttggatcggattttcctggtctctcccataaccatccttcatgagatagacgaggcttcacccttattcggcatcagcaggcaggatttagagacagacgatttcgaaatagtggttattctggaaggcatggtggaagccactgctatgactacccaggcccggtcatcctatctagcgaatgagattctctgggggcacaggttcgagccagttttgtttgaggagaaaaaccaatacaaaatagattacagccattttcacaaaacatatgaggtcccgtccactccccgatgctctgccaaggatcttgtggagaacaagttcttgctaccaagcgctaactccttctgctatgagaacgaattggcatttctgagtagagacgaagaagatgaggccgacggagaccaggacgggcggtccagagacggactgtccccacaggcgagacacgacttcgatcgactccaggccgggggtggggtgctggaacaacggccttaccgacgagagtctgagatctag

SEQ ID NO: 200228 - DNA, 1257 bp, Artificial Sequence
  Description of Artificial Sequence: Synthetic coding sequence
atgagctactacggcagcagctaccacatcatcaacgccgacgccaagtatcctggataccccccagagcatattattgcggagaaaaggagggcccggcggagactactccataaggacggcagttgcaacgtgtattttaagcacatttttggggaatgggggtcatatgtcgtggatatttttaccacccttgtggataccaaatggcgccacatgtttgtcatctttagcttaagttacattctgtcctggctcatcttcggcagcgtattttggctcatagcctttcaccacggtgacttgctcaatgatcctgatataactccttgtgtggacaacgtacactcatttacaggtgcatttttgtttagccttgagacccagacaacaattgggtatggctaccgctgcgtgaccgaagaatgtagcgtagcagtccttatggttattttacaaagcatcttgagctgtattatcaatacctttattatcggcgctgcactggccaagatggcgaccgcacgcaagcgcgcccaaactattcggttcagctattttgccttaatcggcatgagagatggaaagctatgtttgatgtggcgaattggcgactttaggccaaatcacgtagttgagggcacagtcagagcccaactcctgcgctatactgaagacagcgaaggccgtatgaccatggcattcaaggacctcaaattggtgaacgaccaaatcatcctggtgactccggtgaccattgtgcacgaaatcgaccacgaaagtccactctacgccttagatcgcaaagctgtcgccaaggataacttcgaaatcctagtgacattcatctacaccggtgacagcacagggacatcgcatcagtcccgctcaagttatgtgcctagagagatactgtgggggcacaggttcaatgacgtgcttgaagtgaagaggaagtattacaaggtgaactgcctgcagttcgagggctctgtcgaagtctacgcgcctttctgctccgctaagcagctcgattggaaggaccagcagctacacatcgagaaagcaccccctgtgcgcgaaagttgtacatccgataccaaggctaggcggcgcagctttagcgctgtcgccattgttagcagttgtgaaaatcctgaagaaacaaccactagcgcaacccatgaatatagggaaaccccttaccagaaagcgctattgactctcaatcggatctctgtcgagtcacagatgtag

SEQ ID NO: 200229 - DNA, 1119 bp, Artificial Sequence
  Description of Artificial Sequence: Synthetic coding sequence
atgttcaagcacctgcggaagtgggtggtgacccggttcttcggccattcccgccagcgagctaggttggtctcaaaagacggcaggtgtaacatagagttcggaaatgtcgaagctcagagccgattcatattctttgttgacatatggactacagtgctggacctgaagtggaggtataaaatgaccatattcattaccgcattcctcgggtcctggttctttttcgggttgctgtggtatgctgtggcgtatattcataaggatctaccggaatttcaccccagcgcaaaccatacaccttgtgtcgagaatataaatggcctcactagcgcgtttctcttctccctcgagacccaggtgacaattggctatgggttccgctgcgttaccgagcagtgcgcgactgctatttttctactgatttttcagtctatacttggtgtgataattaattctttcatgtgtggcgcaatactcgccaagatttcacgtcctaagaagcgggctaagacgatcacttttagcaagaacgcagtgatttccaagaggggggggaagctgtgcttgctcatccgcgttgctaatctgcgaaagtcccttctgattgggtcacatatttacggcaaattattgaaaacaaccgtcacacctgaaggggagaccattatcttggaccagattaacatcaactttgtggtggacgcaggcaatgaaaatctgttcttcatatccccacttactatttatcacgtcatcgatcacaactcgccgttcttccatatggccgcagaaacccttcttcagcaagacttcgagctggtagtctttctcgatggcacagttgagtccacttctgctacatgtcaggtcagaacttcctatgtgcccgaggaggtgctgtggggttatcgctttgcaccaattgtgtctaaaactaaggagggcaagtatagagttgatttccataatttttccaaaactgtggaggtagaaactcctcactgtgctatgtgcttatacaatgagaaggacgtgcgggcccgtatgaagcgtggttacgataatccaaacttcatcctgtctgaggttaacgagacagatgacacaaaaatgtag

SEQ ID NO: 200230 - DNA, 1176 bp, Artificial Sequence
  Description of Artificial Sequence: Synthetic coding sequence
atgaacgccagcagccggaacgtgttcgacaccctgatccgggtgctgaccgagtccatgtttaagcaccttcgcaaatgggtggtcaccagattttttgggcattcacgacagagggcaaggctggtctcaaaggacggccgctgtaatatcgaatttggcaacgtcgaagctcagtctcgattcattttctttgtggacatctggacaacggtgctcgatcttaaatggcggtacaaaatgacaatcttcatcactgcattcttaggcagctggttctttttcggtctgctgtggtatgccgtagcttacatacataaggacctgcctgagttccatcctagtgccaaccatacgccctgtgtcgagaacatcaatggcctcacgtcagcatttttattcagtctggagacccaggtaacaatcggatacggctttcgctgtgtcaccgagcagtgcgccaccgcgatctttttgctaatcttccaatcgatcctgggagttattataaattcattcatgtgtggcgccatcctggccaaaatttcacgtcctaagaaacgcgcaaaaacaatcacttttagtaagaatgcggtaatcagtaagcgcggggggaaactatgcctgctcatccgtgtggctaatttacgcaagtccttgctcatagggtcccatatttatgggaagctgctcaaaaccacggtcacaccagaaggggagacaatcatattagaccaaatcaatattaacttcgtggtcgacgctggcaacgagaatcttttcttcatctcacccctgactatttatcacgtgatcgatcataactccccgttctttcatatggcggccgagacattgctgcagcaggatttcgagcttgtggtatttttggacgggacggtggaatctacaagcgcaacctgccaggtgcggacctcatatgtgcctgaggaagtgctctggggctataggtttgcgcctatcgtgtctaagacgaaggagggcaaataccgcgtggatttccacaatttctctaagacagttgaggtggagaccccgcattgtgctatgtgcctgtacaacgaaaaagacgtgcgggcccgcatgaagagaggatacgacaacccaaatttcattctgtccgaggttaacgaaaccgacgatacgaagatgtag

SEQ ID NO: 200231 - DNA, 1119 bp, Artificial Sequence
  Description of Artificial Sequence: Synthetic coding sequence
atgttcaagcacctgcggaagtgggtggtgacccggttcttcggccattcacgccagcgggcacgactcgtgtccaaagacggccgatgtaacattgaatttgggaatgtggaggcccagtccaggttcatcttcttcgtggatatctggaccacagtgctggatcttaagtggcgctataagatgactatctttattacagcattccttggttcatggtttttctttgggctcctgtggtatgcagtggcatacatccataaagaccttcctgagttccaccctagcgcaaatcataccccatgtgtggaaaacattaacggcctcacctccgccttcctgttctcactggagacccaggtgaccataggctacggatttaggtgtgtgaccgagcagtgcgccacggctatcttcctactgatttttcagtccatcttgggagttattataaatagcttcatgtgcggagcgatcctggccaaaatctcaagaccaaaaaagcgcgcgaagaccatcacatttagtaaaaatgctgtgatttcaaagcggggcggaaaactgtgcctgttgatcagggttgctaacttaagaaagtcactgcttatcggaagccacatctacggtaaactgctgaagactaccgtgacaccagaaggagagacgatcatcctggatcaaattaatatcaactttgtggtagacgccggaaacgaaaaccttttttttatctccccgttgacaatatatcacgtcatcgatcacaactcaccgttcttccacatggccgccgagaccctgctgcagcaggacttcgagcttgtggtttttttggatgggacagttgagagcacaagcgctacctgtcaggtgcgcacaagctacgtacctgaagaggtgctttggggctaccgttttgcaccaatcgtcagcaaaacaaaagaaggtaaatacagagtggattttcataacttttcaaagactgtggaagtggaaacgccacactgtgccatgtgcctctacaatgagaaggatgtccgagctcgtatgaaacgggggtatgacaatccaaactttattctctccgaggttaacgaaactgacgatactaagatgtag

SEQ ID NO: 200232 - DNA, 1140 bp, Artificial Sequence
  Description of Artificial Sequence: Synthetic coding sequence
atgaccagcgtggccaaggtgtactacagccagaccacccagaccgaaagtagacctttgatgggaccaggcatccggcgcagacgggtcttaaccaaagacgggaggtcaaacgttaggatggagcacatagcagacaagcgcttcctgtacctgaaagacctgtggactacttttatcgacatgcagtggcggtataaactgcttctgttcagcgctaccttcgccgggacatggtttctgttcggggtggtttggtacctcgtggcagttgcacacggcgatttactggagctggaccctccagccaaccacactccgtgcgtcgttcaagtgcatacactcaccggagcctttctattctcccttgagtctcaaaccaccatcggctacgggttcaggtatatcagcgaggagtgcccgctggctattgtcctcctaatcgcccagcttgtcctcacgactatcctggagatattcatcacagggacgttcctggctaagatcgctagacccaaaaagcgagccgagactatccgcttttcccaacacgccgtcgtggctagccacaatggaaagccatgcctcatgattagggtcgccaacatgagaaagagcctgctgattggctgccaggtgacgggtaagcttctgcaaacgcatcagactaaggagggcgagaacataagactcaaccaggtgaatgtcacttttcaagtagatactgccagcgactctccttttctcattctgcccctcactttctatcatgtagtggacgaaacatcccctctcaaggatctgccactgcgcagcggggagggcgatttcgagctggtcctcattttgagcggcaccgtagagagtacatcagctacgtgtcaggtgagaactagctacttgcccgaagaaatcctttgggggtatgaatttactccagcaatttccctgtcagcaagtgggaaatatattgccgatttctctctcttcgatcaagttgttaaagtagcctctccctccggtttaagagattcaacagtccgttacggggatcccgagaaacttaagctggaggagagtttgcgggagcaggccgagaaggaaggcagcgccctcagcgttaggatctctaacgtttag

SEQ ID NO: 200233 - DNA, 1173 bp, Artificial Sequence
  Description of Artificial Sequence: Synthetic coding sequence
atgctgagccggaagggcatcatccccgaggagtacgtgctgacccgtttagccgaggatccagcaaagcccaggtatcgtgcgcggcagaggcgagcgagattcgtgtctaagaagggtaactgcaacgtagcgcacaagaacatccgcgagcagggtaggtttctgcaggacgtgttcacaacattggtggatctgaaatggccacacaccttgctgatcttcacaatgtcttttctgtgttcttggttgctgtttgcgatggcatggtggctgattgctttcgcacacggtgacttagcacctagcgagggcacggctgagccctgtgtcacaagtatccattccttttcgtccgccttccttttctccattgaagtgcaagttaccatcggcttcggcggccgcatggtgacagaggaatgccctcttgctatcctcatactgatcgtacaaaacatagttggcctcatgattaatgccattatgttgggctgcatttttatgaagactgcacaagcccaccgccgtgcagagaccctgattttcagtaagcatgccgttatcgcactacggcatgggcgcttgtgtttcatgctgagggtgggggaccttcgtaagtcgatgatcatcagcgccacaatccatatgcaggttgttagaaaaacgacatcccctgaaggggaagtggttcccctccaccaggtcgatatccctatggagaatggggtgggcggcaactcaatcttccttgtggccccacttattatctaccacgtgatagacgctaatagtcccctttacgacctcgcgccatcagacctgcaccaccatcaagatctggagataatagtgattcttgagggcgttgtggagacaaccggcattactacacaagcccggacgtcttatctggcggatgagatcttgtgggggcagaggttcgtgccaattgtggcagaggaggatggcaggtactccgtggactattcaaagttcggaaatactgtcaaggtccccacgcctctttgtaccgcccggcaactggacgaggatcacagcctgttggaagctctgaccctggcttccgctagaggacccctgcgtaagaggagcgtacctatggctaaggccaagcccaagtttagtatctcaccagactccctcagttag

SEQ ID NO: 200234 - DNA, 1302 bp, Artificial Sequence
  Description of Artificial Sequence: Synthetic coding sequence
atgaccgccgccagccgggccaacccctacagcatcgtgagcagcgaagaagacggactgcacctggtcaccatgagcggcgccaacgggtttggcaacggcaaggtgcacacacgcagacggtgccgaaaccggttcgtgaagaagaacgggcagtgtaacatcgaatttgcaaacatggacgaaaagtcacagagatacctcgccgatatgtttaccacatgtgtggacatccgatggcgctatatgctcttgattttcagtctggcatttttagccagttggctactattcgggatcatcttctgggtgattgcagtcgcccacggagatctagaacctgcagagggacggggaagaaccccctgcgtgatgcaggtgcacggctttatggccgcgtttctgttctctatagaaacccagactacaatcggttatggcctgagatgtgtcaccgaggagtgccccgtggctgtgttcatggttgtggcccagagcattgtcggctgcatcatcgactctttcatgatcggggcaattatggcaaaaatggcacgcccaaagaaaagggcacaaaccctgctgttttcccacaatgccgtcgttgctctacgagacggaaagctctgtttgatgtggcgcgtaggcaacttgcgcaaaagccatattgtggaagcccatgtgcgggcccagttgattaaaccccgcgttacagaggaaggtgagtatattcccctggatcagattgacatcgatgttggatttgacaaaggcctcgacaggatctttctggtaagtcccataactatcctacacgagatagacgaagcgagcccgttattcggaatttcacggcaagaccttgagactgacgatttcgagattgttgtgatactggaagggatggtcgaagcaacagcaatgacaacacaagctcgttcctcatatctcgccaacgaaattctgtggggacatcgattcgagcctgtcctgtttgaggagaaaaatcagtataaaatcgactactcacattttcataagacttacgaagtcccctctaccccccggtgttccgctaaggacctggtcgaaaataaattcctactccccagcgccaatagcttctgttacgagaatgagctggcatttttatcgcgagacgaggaggacgaagctgatggagatcaagatggccgcagccgggacggcctcagtccacaggcccgccatgacttcgaccgcctgcaagccggcggtggggtgcttgagcaacgcccctaccggagggaatcagaaatctag

SEQ ID NO: 200235 - DNA, 819 bp, Artificial Sequence
  Description of Artificial Sequence: Synthetic coding sequence
atggtgctgctgaccgccgtgctgctgctgctggccgcctacgccggtccagcccagtcgctcggtagcttcgtgcactgcgagccgtgcgacgaaaaagcactgagtatgtgtcctcccagccccctgggttgtgagctcgttaaagagccaggatgcgggtgctgcatgacgtgcgccctggccgagggccagagctgcggagtgtatacagaacgctgtgctcagggccttcgttgtctgcccaggcaggacgaagaaaagcctctgcacgcgctgttacatggcaggggggtttgtctgaacgaaaagagttaccgagagcaggtgaagattgaaagggactctcgggaacatgaagaacctacaacttctgagatggctgaggagacatatagcccaaagatctttagacccaaacatactcgtatcagtgaactcaaggcagaggccgtcaagaaggaccggcgcaagaagctcactcagtccaagttcgtgggtggcgctgaaaacactgcacacccaagaatcatatctgcccccgaaatgagacaggagagcgagcagggtccctgtcgtagacacatggaagccagccttcaagaactgaaagcatccccacgcatggtcccaagggccgtgtatttgcctaattgtgaccgaaaggggttttataagcgaaaacaatgtaaaccctcgaggggccggaagagagggatttgttggtgcgtcgacaagtatggtatgaaactgcctggaatggagtatgtggacggggactttcagtgtcacacctttgatagctctaacgttgagtag

SEQ ID NO: 200236 - DNA, 285 bp, Artificial Sequence
  Description of Artificial Sequence: Synthetic coding sequence
atggacagcagcaactgcaaggtgatcgcccccctgctgagccagcggtacagacggatggtgactaaagatggtcacagcaccctgcagatggacggggcccagcgaggcttagcctacctccgggatgcctgggggattctcatggacatgagatggagatggatgatgctcgttttctccgctagttttgtagtacactggctcgtgtttgcagtcctctggtgcttttgcggtgaggattgcccagccaagaagagctcgttctttaattccttgtactag

SEQ ID NO: 200237 - DNA, 1083 bp, Artificial Sequence
  Description of Artificial Sequence: Synthetic coding sequence
atggacagcagcaactgcaaggtgatcgcccccctgctgagccagcgctataggagaatggtgaccaaagatgggcattcaacactccagatggacggggctcaaaggggactggcctacctgcgggatgcctgggggatcctgatggatatgcggtggagatggatgatgctcgtgttcagcgccagctttgtcgtccactggctcgtcttcgcggtgttatggtacgtgttagccgagatgaacggcgacttagagctagaccacgacgcccctcccgaaaatcacaccatatgtgtcaagtacatcacatccttcacggccgcgttcagtttctccttggaaacccaattaacgatcggatatggcacaatgtttcctagcggagattgcccgagcgccatagccctgttagcaattcagatgctgctcggactgatgctggaagcatttattactggggctttcgtcgctaaaattgctcggcccaagaatagggccttcagcatcagattcacggataccgccgtcgtggctcacatggacggcaaacctaatctgatttttcaagtcgcaaatacacgcccaagccctctgacatccgttagagtttccgccgtgctataccaagagagagagaacgggaagttataccagacgtcagtcgactttcatctagatggaatttcatctgacgagtgtccctttttcatcttcccgcttacatactatcactccattacaccttccagccctctggctacgctcttacaacacgaaaatcctagccattttgaactggtggtgtttctaagcgccatgcaagaggggacaggcgagatctgtcagcggcggacctcatacctaccctccgagatcatgttacaccactgcttcgcatctctgcttacaagaggctccaaaggggaataccaaattaagatggagaatttcgacaagacagttcctgagttcccgactccacttgtgtccaagtcacccaatcgaaccgacttggatattcatatcaatggtcagtccatagacaatttccaaatttccgagacggggctgactgagtag

SEQ ID NO: 200238 - DNA, 1128 bp, Artificial Sequence
  Description of Artificial Sequence: Synthetic coding sequence
atggacgccatccacatcggcatgagcagcacccccctggtgaagcataccgccggggctgggcttaaagcgaatcgcccgcgggtgatgtcaaagagtggccactcaaacgttcggattgacaaggtcgacggcatttacttactatatttacaagatctctggacgaccgtcatcgatatgaagtggcgttacaagctcacattatttgcggccacgttcgttatgacctggttcctattcggggtaatatactacgctatcgcttttattcatggcgatttggaaccgggggagccaatctccaaccacacaccctgcattatgaaggtggatagtctgaccggtgctttcctattctctttggaatcccagaccaccattggttacggggtacgcagtatcaccgaagagtgtcctcacgccatattcctccttgtcgctcagcttgtcattacgaccctaatcgagattttcatcacaggaacattcctggccaagatcgctagacctaagaagagggctgagacaataaagtttagtcactgcgccgtgataactaagcagaacgggaaattatgcctcgttatccaagtggcaaacatgcgcaagtccctccttattcagtgccagctctccggcaaactgcttcagacccacgtgaccaaggagggtgaacgcatcctcctgaaccaggccaccgtaaagttccatgtagacagcagcagcgagagccctttcctgatactcccaatgacgttctaccatgttctcgacgagaccagtcctcttagagatcttaccccccagaacctgaaggaaaaggaatttgagctggtggtcctgctcaacgccacggtggaatccaccagcgccgtgtgccagagtaggacaagctacatccccgaagagatctattggggattcgaattcgttccagtcgtgagtctgagcaagaacggaaagtatgttgccgacttctctcagtttgaacagatccggaagtcccctgactgcaccttttattgtgccgattccgaaaagcagcagctcgaggagaaatatagacaagaggaccagcgggagcgtgagctcagaacacttcttctacagcaaagcaatgtgtag

SEQ ID NO: 200239 - DNA, 186 bp, Artificial Sequence
  Description of Artificial Sequence: Synthetic coding sequence
atggacgccatccacatcggcatgagcagcacccccctggtgaagcacacagctggggccggcctgaaagctaaccggccgagggtcatgtctaaatctggccattcaaatgtcaggatcgataaggtagatgggatctatctgctgtatttgcaggacttgtggaccaccgtcatagacatgtag

SEQ ID NO: 200240 - DNA, 471 bp, Artificial Sequence
  Description of Artificial Sequence: Synthetic coding sequence
atggacgccatccacatcggcatgagcagcacccccctggtgaagcacacagcgggagctggcctgaaagcaaaccgcccacgagttatgagtaagagcggtcatagtaacgtgagaatagacaaagtggacgggatttatctgctctacttgcaggacctctggacaaccgtcatcgacatgaaatggcgctacaagctgactctgtttgcggccactttcgttatgacctggttcctctttggagttatttattacgcaatcgcttttatacatggcgacctagagcctggcgagcccatatcgaaccatactccttgcatcatgaaagtggatagtcttacaggggccttcctatttagcctagaaagccagaccacaataggctatggtgtacgttccatcaccgaggagtgcccacatgccatttttttactagtcgcacaacttgtaataaccactctcatttag

SEQ ID NO: 200241 - DNA, 471 bp, Artificial Sequence
  Description of Artificial Sequence: Synthetic coding sequence
atggacgccatccacatcggcatgagcagcacccccctggtgaagcacaccgccggggctggcctgaaggcaaatcgcccaagggttatgtcaaagtcaggacactccaacgtcagaatcgacaaggtggacggaatatacttactgtaccttcaagacctgtggacaacagtaatagacatgaaatggcgctacaagctgactctgttcgctgctaccttcgtcatgacatggttcctgttcggcgtgatctactatgccatcgcttttatacatggggacctagagcccggtgaaccaatttcaaaccacaccccttgtatcatgaaagtagactccctgaccggcgcattcctgtttagcttagagtcccaaacaacaattggctatggtgtgcggtctatcacggaggagtgccctcacgccatctttttacttgtcgcacagctagtgattacgacattgatctag

SEQ ID NO: 200242 - DNA, 1128 bp, Artificial Sequence
  Description of Artificial Sequence: Synthetic coding sequence
atggacgccatccacatcggcatgagcagcacccccctggtgaagcacaccgcaggggccgggctaaaagcaaatcgacctagggtgatgagcaaaagcggccactcaaatgtccgtatcgataaagtagacggaatctacctactgtacctgcaggatctgtggactactgtcatagatatgaagtggcgctataagctgacactgtttgccgccacttttgtgatgacttggttcttgttcggtgttatctattacgccatcgcctttattcatggcgatcttgagcctggcgagcccatcagtaaccatactccctgcataatgaaggtggattcactcacaggggccttcctttttagccttgagtcccagacaaccattggttacggagtgaggagcatcactgaggagtgtccgcatgccatcttcctcctcgttgcccaacttgttattacaacactgattgagatcttcattacagggacttttcttgcgaagatcgcacggccaaaaaaaagagctgagaccatcaaattttctcactgtgccgttatcacaaagcagaacgggaaactttgtctcgtaatccaggtggctaacatgcgcaaatcgctgctgatccagtgtcagttgagcggaaagttactccaaacacacgtgacaaaggagggggaacgtatcctgctcaaccaggcgactgtgaagtttcatgtagattcgtccagtgagtcaccgttcctgatactgccaatgactttctaccacgtgctggatgagacatcccccctgcgcgatcttacccctcagaacttaaaagagaaagagttcgaactcgtcgtgctacttaacgccactgtggagagcacatccgctgtctgccagagtagaacgtcttacatacctgaggaaatctactggggcttcgagtttgtgccagttgtgtccctgagtaaaaacggaaagtacgtggcagatttttcccaatttgagcagatccgcaagagccccgactgtactttttattgcgccgactctgagaagcagcagctggaggaaaagtaccgtcaagaggatcagagggagcgggagctgcgtaccctcctcctgcagcagtcaaatgtttag

SEQ ID NO: 200243 - DNA, 1128 bp, Artificial Sequence
  Description of Artificial Sequence: Synthetic coding sequence
atggacgccatccacatcggcatgagcagcacccccctggtgaagcatacagccggagcgggcctgaaagctaatcggccccgcgtcatgtcgaagagtgggcactctaatgttcgcatagataaggtggatggcatttacttactttatctccaggatctgtggactacagtcatagacatgaaatggcgttataaattgaccttgtttgccgcgactttcgttatgacctggttcctgtttggggtgatctactacgctatcgcctttatccatggcgaccttgagcccggggaacctataagcaaccataccccgtgcataatgaaagtcgattctttaacgggcgctttcctgttctctttagaatcacagacgactattggatacggagtcaggagcattaccgaggaatgcccgcatgctatctttctcctagttgcccagcttgttataactacgcttattgagatctttatcaccggcacgtttcttgcaaaaatcgcacggccaaagaagagagccgagaccatcaagttcagccactgtgctgttataaccaagcagaacggtaagttatgcctggtcatccaggtcgccaacatgcgtaaaagtttattgattcagtgtcagctctccggtaagcttctccagacccacgtgaccaaggaaggggagcgaattctgttgaatcaggcgaccgttaaattccacgtcgattctagcagcgagtcgcctttcctgatcctgcctatgactttctaccatgtcctggatgagacaagcccgctgagagatttaacaccccagaacctgaaggaaaaggaatttgagctggttgtgctcctgaacgccactgtggagagtacctccgctgtatgccaatcccgaacttcttacatcccagaggagatatattggggattcgagttcgtgccagttgtgtccctgtccaagaacgggaagtatgtcgccgacttttcgcaatttgagcagattaggaagagccctgattgcaccttttactgtgccgactcagaaaagcagcagttagaagagaaatatagacaagaggatcagcgcgagcgagaattgcgcacactcctgctccagcagagcaacgtgtag

SEQ ID NO: 200244 - DNA, 1128 bp, Artificial Sequence
  Description of Artificial Sequence: Synthetic coding sequence
atggacgccatccacatcggcatgagcagcacccccctggtgaagcacacagccggagccggtcttaaggctaaccggccacgtgtgatgagtaagtcgggtcacagcaacgtccgcatcgataaggtcgatggaatctatctgctgtatctgcaagatttgtggaccaccgtcattgatatgaaatggcgctataagttaacattgtttgcggcgacttttgttatgacatggttcctatttggggttatttactacgcgattgcatttattcacggagatcttgaacccggagagcccatcagcaaccatacaccctgtataatgaaggtggattctttgacaggggctttcctgttctccctggaatctcaaacaactattggctatggtgttcggagcatcaccgaagagtgcccccatgccatctttctgttggtcgcgcagctggtgattactacgctgatagagatttttatcactggaactttcctggcaaagattgcccgccctaagaaacgggcagagacaattaagttttcccactgcgccgtcattaccaaacagaatggcaaactctgtctggtgatccaggtggcaaacatgcggaaaagcttactcatccaatgccaattgtcaggcaaactgctccaaacccatgttactaaagaaggggagcgtatcctgttgaaccaagcaacagtgaaattccacgttgactccagtagcgagtccccctttctgatcctgccaatgactttttaccatgtgttggatgaaacgagccctctgcgggacctcacgccacagaatctgaaggagaaagagtttgaactcgtggtactgctgaatgccaccgttgagagcacaagcgctgtctgtcagagtcgtaccagttacatcccagaagaaatttactgggggtttgagttcgtgcctgtggtctccctgtcaaagaacggcaagtatgtggcagatttttctcaatttgaacagattaggaaatcacccgattgcaccttctactgcgccgactcggagaaacagcaactggaggagaagtatagacaggaagatcagagagagcgcgagttaagaaccctgcttctccaacagagcaatgtgtag

SEQ ID NO: 200245 - DNA, 1128 bp, Artificial Sequence
  Description of Artificial Sequence: Synthetic coding sequence
atggacgccatccacatcggcatgagcagcacccccctggtgaagcatacagccggggccggactgaaagcaaacaggccacgggtgatgtcgaaatctggtcattcgaatgtgagaattgacaaggtcgacgggatctacctcctgtaccttcaggatctttggaccacagtaattgatatgaagtggcggtacaaactgacgctcttcgcagcaacgttcgtgatgacctggttcctgtttggtgtgatctactatgcgattgcattcattcatggtgatctcgaaccgggagaacccatttccaatcacaccccatgcatcatgaaggttgactccctgactggggcttttttatttagtctagagtcccagaccactattggctacggtgtgcgcagcatcactgaagagtgtcctcatgccatcttccttctagtggctcaactggtgattacaacccttatagagatattcatcaccggtacattccttgccaagattgccagacctaagaagagagcggagacaattaagtttagtcattgtgccgttattaccaagcagaacggcaagctttgtttggtgattcaggtggctaacatgcgtaaaagcctgttgatccagtgtcagctgagcggaaaattgctccagactcatgttacaaaggagggcgagcgaatcctgttgaatcaagctaccgtgaaattccacgtggattcaagctccgaatccccttttctaattctgccgatgacattttatcacgtgcttgacgagactagcccgttacgcgacctgacaccccagaacctgaaggaaaaggagtttgagctggttgtgctactgaatgctaccgtcgaaagtacgagtgcagtgtgtcaatcccggacttcttacattccagaagaaatatattgggggtttgagtttgtacccgtggtgtcactttctaaaaacggaaaatacgtggccgattttagtcagttcgaacagattcggaagtctcctgattgtaccttctattgcgctgattcagagaaacagcaactggaggagaaataccgacaagaggatcagcgcgaacgagagctgagaacgctgctcttgcagcaaagcaacgtatag

SEQ ID NO: 200246 - DNA, 60 bp, Artificial Sequence; identical to SEQ ID NO: 94052
  Description of Artificial Sequence: Synthetic coding sequence

SEQ ID NO: 200247 - DNA, 420 bp, Artificial Sequence
  Description of Artificial Sequence: Synthetic coding sequence
atggacgccatccacatcggcatgagcagcacccccctggtgaagcacacagccggagcaggtctcaaagcgaacagaccaagggtgatgagtaagtccgggcacagtaacgtaagaatagataaagtcgatggcatttatctgctgtatctgcaagacctatggactacagtcattgacatgaaatggaggtacaagctgacactgttcgccgctacctttgtgatgacgtggttcctcttcggcgtgatctattacgctatcgccttcatccatggggaccttgagccaggggaacctattagcaaccatactccctgcattatgaaggtcgattcactcacgggtgctttcttgttctctctcgagtcgcagaccactatcgggtacggcgtgcgctcaattacggaggaatgctag

SEQ ID NO: 200248 - DNA, 738 bp, Artificial Sequence
  Description of Artificial Sequence: Synthetic coding sequence
atggacgccatccacatcggcatgagcagcacccccctggtgaagcacacggcgggtgctggcctgaaagcgaacaggccccgtgtgatgtccaaatcgggccattcaaatgttcggattgataaggtggatggcatttatctactttacctgcaggatctgtggaccacagtcattgacatgaagtggaggtacaagctgacccttttcgcggccacattcgtcatgacctggtttcttttcggagtgatttactatgccattgcattcatccacggggacctcgaacctggagagccaatctccaatcatacaccatgtataatgaaagttgattcgctcacgggtgcctttttattctccttagagtcacagaccacaatcggatacggcgtccgctccataactgaagaatgtcctcatgcgatctttctgctggtagcgcagctcgtgataacaactctcattgagattttcatcaccggtaccttccttgcaaaaattgccaggccaaagaaaagggccgagacaattaagttttcacactgtgccgtcatcacgaaacagaacgggaaattgtgtctcgtgatccaggtggctaacatgcgcaagtcccttcttattcagtgccaactcagcgggaaattgcttcagacccatgtgaccaaagaaggggagaggatcctgctgaatcaagctactgttaaattccacgttgacagctctagcgaaagttag

SEQ ID NO: 200249 - DNA, 120 bp, Artificial Sequence
  Description of Artificial Sequence: Synthetic coding sequence
atggacgccatccacatcggcatgagcagcacccccctggtgaagcacacagcaggggcagggctaaaggcaaatagaccaagggtgatgagcaagagtggtcactccaatgtgcgttag

SEQ ID NO: 200250 - DNA, 147 bp, Artificial Sequence
  Description of Artificial Sequence: Synthetic coding sequence
atggacgccatccacatcggcatgagcagcacccccctggtgaagcacacagccggagccgggctaaaggcgaaccggccccgggtcatgagcaagtccggacatagcaacgtgagaatagacaaagtagacggtatttatctttag

SEQ ID NO: 200251 - DNA, 147 bp, Artificial Sequence
  Description of Artificial Sequence: Synthetic coding sequence
atggacgccatccacatcggcatgagcagcacccccctggtgaagcacaccgccggcgccggccttaaggccaatcgccctcgagtcatgtcaaaaagcggtcactccaacgttaggattgataaagtagatggcatttatctgtag

SEQ ID NO: 200252 - DNA, 147 bp, Artificial Sequence
  Description of Artificial Sequence: Synthetic coding sequence
atggacgccatccacatcggcatgagcagcacccccctggtgaagcacacagcaggcgccgggctgaaggccaatcgacccagggtcatgtcaaagtccgggcattccaacgtgagaattgataaagtcgacggtatttatttgtag

SEQ ID NO: 200253 - DNA, 78 bp, Artificial Sequence
  Description of Artificial Sequence: Synthetic coding sequence
atggacgccatccacatcggcatgagcagcacccccctggtgaagcacactgctggcgccggattgaaagccaattag

SEQ ID NO: 200254 - DNA, 147 bp, Artificial Sequence
  Description of Artificial Sequence: Synthetic coding sequence
atggacgccatccacatcggcatgagcagcacccccctggtgaagcacacggccggcgccggactcaaggccaacaggccgagggtgatgagcaaaagcggtcactcaaatgtgcgcatcgataaggtggacggtatttatctttag

SEQ ID NO: 200255 - DNA, 147 bp, Artificial Sequence
  Description of Artificial Sequence: Synthetic coding sequence
atggacgccatccacatcggcatgagcagcacccccctggtgaagcacaccgccggagctggccttaaggcaaatagacctcgcgtcatgtcgaagagtgggcatagtaacgtacggatcgataaggtggacgggatctatctgtag

SEQ ID NO: 200256 - DNA, 147 bp, Artificial Sequence
  Description of Artificial Sequence: Synthetic coding sequence
atggacgccatccacatcggcatgagcagcacccccctggtgaagcatacagctggagcggggctaaaggccaataggccgagggtgatgtccaaaagtggccactctaatgtccggattgacaaggtggacgggatttacctgtag

SEQ ID NO: 200257 - DNA, 1257 bp, Artificial Sequence
  Description of Artificial Sequence: Synthetic coding sequence
atgagctactacggcagcagctaccacatcatcaacgccgacgccaaataccctggttatccaccagaacatattatcgcggaaaagcgcagggcaagaagaaggttattgcataaggacgggtcctgtaacgtatacttcaaacacatatttggggagtggggcagctacgtcgtggacatttttacaaccttagtcgatactaaatggcggcacatgttcgtgatattcagtctgtcttatatcttgtcttggctgattttcggatctgttttctggctcattgcatttcaccatggggatcttctgaacgacccggatatcaccccttgcgtggataacgtgcattcgttcacaggagctttcctgtttagcctcgagacgcagaccaccataggctatgggtacagatgtgtgactgaagagtgctctgtggctgtgctcatggtgattttgcaatccatcttatcttgtattattaatacatttattattggggcagccctcgccaagatggcgaccgccagaaaacgcgcccagactattaggttcagctattttgccctgatcggtatgagagacggcaagctctgtctgatgtggagaataggcgattttagaccaaaccatgttgtcgaaggcactgtgcgtgcacagctgttgcggtatacggaggactctgaaggcaggatgaccatggcttttaaggacctcaagctcgtcaacgaccaaattatccttgtaacccccgtgactatcgtccacgagatcgatcatgaatccccactttatgccctggatcgcaaagcagtggcaaaggacaacttcgaaatcctggtgactttcatctacactggtgattctaccggtacatcccatcagtcaagatcgagttatgtacctagagagatcctgtggggccaccggttcaacgacgtgctggaggttaaaagaaagtattataaagtaaactgtttgcagtttgaaggatcagtggaagtgtacgcccctttctgttctgcgaaacagcttgactggaaggaccaacagctacatatcgaaaaagctccccccgtgcgcgagtcgtgcaccagtgatactaaggccaggcgcaggagcttttccgccgtcgctatcgtaagttcctgcgaaaatccagaagagaccaccaccagtgctacgcatgaatatcgggagaccccctatcaaaaggctctgctcaccctcaaccggattagcgtcgaaagccaaatgtag

SEQ ID NO: 200258 - DNA, 1257 bp, Artificial Sequence
  Description of Artificial Sequence: Synthetic coding sequence
atgagctactacggcagcagctaccacatcatcaacgccgacgccaagtatcctgggtatcccccagaacatatcatcgccgagaaaagacgtgcaaggcggcggttactgcataaagacggatcttgcaacgtctactttaagcacatctttggcgagtggggtagctacgttgttgacatcttcacaaccttggtggacacgaagtggcggcatatgttcgtcatattttctctcagttacatcctgtcctggctcatttttggttccgtcttttggctgattgcattccaccacggggatctgcttaacgacccagatatcaccccatgcgtcgataacgtgcacagtttcactggcgctttcctgttttcccttgagacccagactactataggatatgggtatagatgtgtcaccgaagagtgttctgtcgctgttctgatggtgattcttcagtcaattctgtcttgcattatcaatactttcataattggtgcggcactcgctaagatggccacagccaggaaaagggcccagaccatccggtttagctacttcgccctgataggaatgagggatgggaaactctgtctgatgtggcgcattggtgacttcaggcctaaccacgtggttgagggcacggtgcgtgctcagctgctcagatataccgaggactcggaggggcggatgacaatggcatttaaggatttgaaactggtgaatgaccagatcattttggtgactccagttactattgtgcacgagattgatcatgagtcacccctgtacgccctggacaggaaggcagtcgccaaagacaatttcgagatcctcgttaccttcatctataccggggattccaccggcacctcccaccagtctcggagctcttatgttccccgcgaaatcctctggggacaccgattcaatgatgtgttggaagtcaagagaaagtactataaagtcaattgcctccagtttgagggcagtgtcgaagtatatgcccccttctgcagtgccaagcaactggattggaaggatcagcagctgcatatcgagaaagctccacccgttcgtgaatcttgcacaagcgatacaaaggccaggcggcgctcattttccgccgtcgccatcgtcagcagctgtgagaaccccgaggagactacaacctcggctacacatgagtaccgagagaccccgtaccagaaggctctccttactctcaaccgaatcagcgtagagtcgcagatgtag

SEQ ID NO: 200259 - DNA, 1257 bp, Artificial Sequence
  Description of Artificial Sequence: Synthetic coding sequence
atgagctactacggcagcagctaccacatcatcaacgccgacgccaaatatccgggctacccgcccgaacacatcatcgcggagaaacggagggccagacgcagacttctacataaagacgggtcttgcaacgtttactttaaacatatcttcggagaatggggttcatatgtcgtggatatctttacaactctggtcgataccaagtggagacatatgttcgtaatcttttccttgtcctacatactgtcatggctgatcttcgggtcagtgttctggttgatcgctttccaccatggggacttgctaaatgaccccgatattacaccttgcgtggataacgttcatagcttcacaggggcattcctgttttccctggaaacgcaaacaacaataggttatggctaccgctgtgtgacagaggaatgttctgtagccgtacttatggtaattctccagagtatcttgagttgtatcatcaataccttcatcatcggggctgcgctggccaagatggcgacggcgcggaagagagctcagacaatccgattctcttacttcgcgctgattggtatgcgcgacggcaagctatgtttgatgtggaggatcggtgactttcgtccaaaccatgtggttgaggggaccgtgcgcgcccaattgctgaggtacaccgaagattcagagggccgaatgacaatggcttttaaggacttgaagctagtgaatgaccagattattctggtgactccggtgaccatagtgcacgaaattgaccacgagtcccccctctatgcgctggatagaaaggccgttgccaaggacaacttcgaaattcttgtgacatttatctataccggcgacagtaccggcacctctcatcagtcccggagctcttacgtgccccgtgaaattctgtggggccatcgctttaatgacgttttagaagtgaaacggaagtactacaaagttaattgcctgcagtttgagggttcagtggaggtatacgccccattttgcagcgctaaacagttagattggaaagaccagcagttgcatatagagaaggcacccccagtgcgggagtcatgtacctcagatacaaaggcgcgacggagatctttctccgccgtggccatcgtctcctcttgtgagaaccccgaggagaccacaacttccgccacccatgaatatagagagacaccataccagaaagcacttctcacgctcaacagaatttcagtggagagtcagatgtag

SEQ ID NO: 200260 - DNA, 1284 bp, Artificial Sequence
  Description of Artificial Sequence: Synthetic coding sequence
atgggcagcgtgcggaccaaccggtacagcatcgtgagcagcgaggaagatgggatgaaactggccacaatggcagtggctaacggatttggtaatggcaagtctaaagtgcacactcgtcagcagtgcagaagtagattcgtgaagaaagacggtcattgtaacgtacagtttataaacgtgggagaaaaggggcagcgctacctcgcagatatcttcactacctgtgtcgacatacgctggaggtggatgctggtgattttctgtctagccttcgtacttagctggctgtttttcggatgcgtgttctggctgattgcattactgcatggagacctggatgcctcaaaggaaggtaaagcatgcgtttcggaggtgaatagcttcacagccgcttttctgtttagcatcgagacgcagaccacgattggctatggcttccgatgcgtaacagatgagtgtccgattgccgtgtttatggtagtatttcaatctatcgtgggctgcatcatcgacgcatttataatcggagccgtgatggcaaagatggcaaagcccaagaagcgtaacgaaactttggtttttagccacaatgctgtgattgccatgagagacggaaaactgtgcctgatgtggagggtaggaaacctccgaaagtcccacctagtcgaagctcacgttagggcccagttgctgaaaagtcggatcacatctgaaggcgagtacattccacttgaccaaatcgatattaatgtgggcttcgatagtggaatcgaccggattttcttagtgtcccccattactatcgttcacgaaatagatgaggattcacccctgtacgatctgagcaagcaagatatagacaacgcagatttcgagattgtggtaatactcgaggggatggtggaagccactgccatgaccacacagtgtagatcctcatatctggccaacgagattctttgggggcaccgctacgagcctgtcttattcgaggaaaagcattactataaggtggactacagccgtttccacaagacctatgaagtgcctaatacgcccttgtgttccgcacgggatctggccgagaagaagtacatcctaagtaatgctaatagcttttgttatgagaacgaggtcgccttgacttccaaggaagaggacgactctgagaatggtgtgcccgaatccacctcaaccgacactcctccggacattgacctgcataatcaagcaagtgtgcctttggagcctcgccccctgcgccgggagagcgaaatttag

SEQ ID NO: 200261 - DNA, 1284 bp, Artificial Sequence
  Description of Artificial Sequence: Synthetic coding sequence
atgggcagcgtgcggaccaaccggtacagcatcgtgagcagcgaggaggacggaatgaagctcgccacaatggcagttgccaatgggttcggtaatggaaagtcgaaggtgcatactcgccaacagtgtcgttcaaggttcgtgaaaaaggatggtcactgtaacgtgcagttcataaacgtcggggagaaaggccagagatacttggctgacattttcacaacatgcgtcgatatacgctggcgatggatgttagtcatattttgtctcgcctttgtactgtcatggttgttcttcggctgtgtgttttggctgatagcactgctccatggcgacctcgacgcctcaaaagagggcaaggcttgtgtatctgaggtcaattcttttacagcggcgttcctcttctctatagagacacaaactaccatcgggtatgggttccggtgtgtaactgatgaatgcccaatagctgtcttcatggtcgtgtttcaatcaatcgtcggatgtatcatagacgcattcatcatcggcgcagtgatggcaaagatggccaagcctaagaagcggaatgagacccttgtgttctcccacaacgcagtgatagcaatgagagatggcaagctctgtttgatgtggagagtgggaaacttgcgtaaaagtcatctggtcgaggcgcatgtaagagctcagttgctaaaatcccgtatcacatctgagggggagtacattcccttggaccagattgacatcaacgtgggtttcgattccggcatagacaggatttttcttgtgtcccccatcacaatagtgcacgaaatcgacgaggactcgcctctctatgatctcagcaaacaggacatagataacgccgattttgaaatcgtcgttatcctcgaaggcatggtggaagcaactgctatgaccactcagtgccgctcctcttatctagccaacgaaattctctggggccacagatatgagccagtgctgttcgaagaaaaacattattacaaagtcgactatagccggttccataaaacctacgaggtgcccaatactcctctgtgtagtgcccgtgatctggcggagaagaagtacatattgagcaacgccaatagcttctgctatgagaacgaggttgcccttacttccaaggaggaagatgacagcgaaaatggggtgcccgagagtaccagtaccgatacaccccctgacatcgacctacataaccaagcaagcgtgccattggagcctcgaccattaagacgggaatccgagatttag

SEQ ID NO: 200262 - DNA, 1506 bp, Artificial Sequence
  Description of Artificial Sequence: Synthetic coding sequence
atgagcgccctgcggcggaagttcggcgacgactaccaggtggtgacaacaagctcctcgggatccgggctgcaaccccagggtcccgggcaggatccacaacagcaactggtgcctaagaaaaagcgtcagcgattcgtggacaaaaatggcagatgtaatgttcaacatggtaaccttggaagtgagacctcaaggtatctgagcgatctattcactactctcgtcgacctgaaatggcggtggaacctgttcatctttatcctgacttataccgtagcatggctgtttatggcttccatgtggtgggtcatagcttacactcgcggcgatctgaataaggcccacgtaggcaattacacgccctgcgtggctaacgtgtacaattttccttctgcatttctgttctttattgagactgaagcaaccatcggctatgggtacagatatataacagacaagtgcccagaggggatcatactattcctctttcagagcatccttgggagtatagtcgatgccttcctcatcgggtgcatgtttataaaaatgtcccagcctaagaagcgcgcagaaaccctgatgtttagtgagcacgccgtaatttccatgcgtgacgggaagctgacactcatgttccgcgttgggaacctgcgtaacagtcacatggtgagcgctcagattcggtgtaaactgcttaaatctagacagacacccgaaggggaatttctgccactggatcagctggagctagacgtcggctttagcacaggtgcagatcaattgttcctcgtctctcccctcacgatctgtcacgttattgatgccaagagtcctttctatgatctctcgcagcggagcatgcaaacagaacaattcgagattgtggtgatacttgaaggtatcgttgagacaacaggcatgacctgtcaggctcggactagctatactgaagacgaggtgctgtggggccatcgcttctttccagtgatatctctggaggagggcttcttcaaagtggattattcacaattccacgccacctttgaggtcccaacccctccatattcagtaaaggagcaggaagaaatgctcctgatgagcagccccctcattgcccccgctatcaccaattcaaaagaacggcacaattctgtcgaatgcctggatggcctggatgacatcaccactaagctaccgtccaagctccaaaagattacaggacgtgaggactttccgaagaagctgttgagaatgagttccacaacttctgagaaggcctattctctcggtgaccttccgatgaagctgcagaggatctcttctgtccctggtaactcagaagaaaagctcgtgtccaagaccacaaaaatgctgagtgaccccatgtcacagagcgtggccgacctcccaccaaaactccaaaaaatggctggcggtgctgccagaatggaaggaaatctgcccgcaaaattgaggaaaatgaactctgatcgattcacgtag

SEQ ID NO: 200263 - DNA, 708 bp, Artificial Sequence
  Description of Artificial Sequence: Synthetic coding sequence
atgagcgccctgcggcggaagttcggcgacgactaccaggtggtgacgacaagtagctccggctctggcctccaaccccaggggcccggccaggatccacagcagcagctcgtccccaagaagaaacggcaacgattcgtggataagaacgggcggtgcaatgtgcagcacggtaacctggggagcgagacttccaggtatctgagtgacctttttaccaccctggttgatctcaaatggcgctggaacttgttcatattcatccttacatacacggtagcatggttattcatggctagcatgtggtgggttattgcttatacaaggggtgatctgaacaaggcccacgttggcaactataccccatgcgtggccaatgtctataacttccctagcgcctttcttttttttattgagaccgaggccaccattgggtacggatatcgctacataaccgacaagtgccctgagggcattattttatttttgtttcagtcgatcttgggctcgatcgtggacgcttttctgataggttgcatgtttataaaaatgtctcaacccaaaaaacgagcagaaaccctcatgttctctgaacatgctgttattagtatgagggatgggaaactcaccctaatgtttcgagtcggcaatctgcgcaacagccacatggttagtgcccaaataaggtgcaagctactcaaaggatag

SEQ ID NO: 200264 - DNA, 1338 bp, Artificial Sequence
  Description of Artificial Sequence: Synthetic coding sequence
atgcacggccacagccggaacggccaggcccacgtgccccggcggaaaaggagaaaccggtttgttaagaagaacgggcagtgtaacgtatactttgctaatttaagtaacaagtcccagcggtatatggcagacatcttcaccacatgtgttgatactcgatggcgttatatgcttatgatctttagtgcagcctttttggtttcctggctattcttcgggttactgttttggtgtatcgcattcttccatggagacctcgaggcttctcctggcgtgccggcggctggaggtccagcggctggtggaggaggggcagcgcctgtagccccaaaaccatgcatcatgcacgtgaatggattcttgggcgccttcttattctctgtagaaacccagacaactataggttacggcttccgttgtgtaaccgaggagtgcccactggccgtgatcgctgtcgtggtacagagtatcgtaggatgcgtgattgactcattcatgattgggacgatcatggccaaaatggccagacccaagaagagggcccagactttactgttcagccaccatgccgttatttctgtgcgcgatgggaaattgtgcttgatgtggcgggtggggaacctgcgcaagagtcacatcgtcgaggcccacgttagggcacagctgatcaagccctacatgacacaggagggtgagtatctccctcttgatcagagagatctaaatgtcggctacgatattggcctggacaggattttcctggtgtctcccattatcattgtgcatgagattgatgaggacagcccgctgtacggaatggggaaggaagaactggagtcagaagatttcgaaatcgtcgttatcctagagggtatggtggaggccacagccatgactacacaggctcgttcttcctacttagccagcgagattctatggggccacaggtttgagcccgtcgtcttcgaagagaaatcacactacaaggtagactactctagatttcataaaacctacgaggtggccggaactccgtgctgcagcgcccgggaattacaggaatcaaagattacagtactgccagctcccccccctcccccttctgccttctgctacgagaatgaactggcactgatgagccaagaggaagaggaaatggaggaggaggccgcagctgcagccgccgttgcagccggattggggctcgaagcaggatcgaaggaagaggccggaattattcgaatgctagaatttggctcacatctggacctcgaacggatgcaagcctctctgcccctcgacaacatttcctataggagggaatcagccatttag

SEQ ID NO: 200265 - DNA, 1260 bp, Artificial Sequence
  Description of Artificial Sequence: Synthetic coding sequence
atggccggcgacagccggaacgccatgaaccaggacatggagatcggcgtcacgccttgggatcctaagaagatccctaaacaagcacgcgattatgttccaatcgcgaccgatcggaccagactcctggcagagggcaagaaaccccgccaacgctatatggagaagtccggtaaatgcaacgtgcatcatggaaatgtacaggaaacctaccgttacctgagcgacttgttcactacactggtcgatctcaaatggcggttcaacctgctggtattcacaatggtttacacagtcacgtggctgttctttggatttatttggtggctaatcgcgtatatacgcggcgatctggaccatgtcggagatcaggagtggatcccttgcgtggagaatctgagtggctttgtgagtgcattcttgttcagtatcgagaccgagaccaccattgggtatggattcagggtcatcactgagaagtgcccggaagggataatcctgctgctcgtgcaggctatcctgggctccattgtgaatgcctttatggtgggttgcatgtttgtgaagattagccaaccaaaaaagcgcgccgaaaccttgatgtttagcaacaatgccgtgatttccatgcgggatgaaaaactgtgccttatgttcagagtgggtgacttgaggaacagtcacattgtagaggcttccatcagggccaagctcatcaagagcagacaaacgaaagaaggagagtttattcctctcaatcagacagacattaacgtgggctttgataccggtgacgacagactgttcttggtgtctccgttaatcattagtcacgagatcaaccagaaaagtcccttttgggaaatgtctcaagctcagctgcatcaagaagagttcgaagtagtggttattctggaaggtatggtcgaagcgactggaatgacatgtcaggcaaggagctcttatatggatactgaggtgttgtgggggcatcgcttcactcctgtacttaccttagaaaaaggattctacgaggtggattacaataccttccacgacacttatgagaccaacacgccctcctgctgtgctaaggaactggctgaaatgaagcgagagggtcggctcctccagtacctaccatctccccctctgcttggggggtgtgcagaagcgggattggacgcagaagccgaacagaacgaggaggatgagcctaagggactgggcggaagccgggaggccagaggttctgtgtag

SEQ ID NO: 200266 - DNA, 1260 bp, Artificial Sequence
  Description of Artificial Sequence: Synthetic coding sequence
atggccggcgacagccggaacgccatgaaccaggacatggagatcggtgtcacaccttgggacccaaagaagattcccaaacaggctagagattacgtgcccattgcgacggacagaaccaggctcctggcagaaggcaagaagccaagacagagatatatggagaaaagcggcaaatgtaacgttcaccacgggaacgtacaagagacttaccgctatctgagtgatctgtttaccactcttgtggatctgaagtggaggtttaacctgctcgtttttaccatggtttacacagtgacttggctgtttttcgggtttatctggtggttgatagcctacatccgcggggatctcgaccacgtcggggatcaggaatggattccctgcgtggaaaatctctccggattcgtttccgcatttctgttttcgatagaaacagagacaaccattggctacggtttccgggtgataaccgaaaaatgcccagaaggaatcatcctgctcctggtgcaagccattctgggatcaatcgttaatgcctttatggtgggctgtatgttcgtgaaaatatcacagccaaagaaacgggctgaaactttgatgttttctaacaatgcagttattagcatgagggatgagaaactgtgtcttatgttccgggtcggcgaccttcgcaacagccatatcgtggaagcttccatacgagccaaactgatcaagagtaggcaaaccaaagaaggcgagtttattcccctaaatcagaccgacataaacgtaggatttgacaccggagacgaccggctcttcctagtgtccccacttattatctcacatgagattaaccagaagagtccgttctgggaaatgtcacaggcacagctgcatcaggaggaattcgaggtggttgtgatactggagggcatggtggaggctactgggatgacctgtcaggcccggtcatcctatatggatacagaggttttgtgggggcaccgctttacgccggtattgactcttgagaaaggcttttatgaggttgactacaacaccttccacgacacctacgaaaccaacaccccttcatgttgcgctaaagagctggccgaaatgaagcgggaaggtcgattgctgcagtacttacctagcccgccgctgctgggagggtgcgccgaggcggggttggatgctgaagccgaacaaaatgaagaagacgaaccgaaggggctggggggcagtcgggaggctcgaggtagtgtgtag

SEQ ID NO: 200267 - DNA, 1260 bp, Artificial Sequence
  Description of Artificial Sequence: Synthetic coding sequence
atggccggcgacagccggaacgccatgaaccaggacatggagatcggggtgacaccttgggaccctaaaaagattcctaaacaggcccgtgactacgtgcccattgcaaccgatcgcacccgcctgctggccgagggaaagaagccacggcagcgctacatggagaaatctggcaagtgcaacgtccaccatgggaacgtgcaggagacctatagatacctctcggacctatttaccactcttgtggacctgaagtggcggttcaatctcttggtttttaccatggtgtacacagtgacctggctgttcttcggtttcatttggtggctgatcgcatatattcgaggcgacttggaccatgtgggagaccaggagtggattccatgtgttgaaaacttatcaggttttgtgtctgcatttctattttcaatcgaaaccgagacaactatcggttacggttttcgcgtgatcaccgagaagtgtcccgagggaatcattcttctgctggtgcaagctattctggggagcatcgtgaatgcctttatggtcggttgcatgtttgttaagatctcccagccaaagaagagagccgagacgttgatgttttcaaataacgccgtgatctcaatgcgtgacgaaaagctgtgcctcatgttccgtgtaggtgatttgcgtaactcgcacatcgtcgaagcatctatccgagcaaagctgatcaaatcacggcagaccaaagaaggggagtttattcctctgaatcagaccgacatcaatgtgggattcgatactggcgacgacaggctcttcctggtttcaccgctgattatttcccatgaaatcaaccagaagtccccattttgggaaatgagtcaggcacagctgcatcaggaagagtttgaagtagttgtgatcctcgaaggtatggttgaagccaccggcatgacttgtcaagccaggtcctcttacatggatacagaagtattatgggggcatcggtttactcccgtgctaacgctcgaaaaaggcttctatgaagtcgactacaatacattccacgacacttatgaaacaaataccccgagctgttgtgctaaagagctagccgagatgaaaagagaaggtcggctgctccaatacctccccagtccccctctactgggggggtgcgccgaggcaggcctggacgccgaggccgaacaaaacgaggaggatgagccaaagggcctaggcggatcaagggaggctagggggtccgtgtag

SEQ ID NO: 200268 - DNA, 1272 bp, Artificial Sequence
  Description of Artificial Sequence: Synthetic coding sequence
atggccaagctgaccgagagcatgaccaacgtgctggagggcgactctatggatcaggacgtagagagtccagtggccatccatcagccaaagttaccaaagcaagcacgcgatgatctcccgaggcatatttctagggaccggacaaagaggaagatccagcgctatgtgagaaaggatgggaaatgcaatgtgcaccacggaaacgtgagggaaacatacagatacctgaccgacatctttaccaccctggtcgatctgaagtggcggtttaatctgcttatttttgtgatggtttatacagtcacatggttgttcttcggaatgatctggtggttgattgcgtacattaggggggatatggaccacattgaggatccctcatggacaccctgcgtgacaaacttgaatggtttcgtctccgcatttcttttcagtattgagaccgagaccaccattggctatggctacagggtcataaccgataagtgtcccgaaggaatcatcttgttgttgatccaaagtgtcttgggatcgattgtgaacgcatttatggtcgggtgtatgttcgtgaagatttcccagccaaagaaaagggccgagacactggtgttttcaacccacgcagtgattagtatgagagatgggaagctctgcttgatgttccgggttggggacctgaggaatagccacatcgtggaagcttccattcgggcgaaactcattaagtccaagcagacatccgaaggtgaattcatacctctcaatcagactgacatcaacgtgggctactatactggcgacgaccgtctgttcctggttagtcccctaatcatctcgcacgagattaatcagcagtcccccttctgggagatatctaaggcccagttgcctaaagaagaactggaaattgttgtcattctagaaggaatggtggaggccacaggtatgacttgtcaagctaggtcatcgtatatcacaagcgagattttatggggctaccgcttcacgcccgttctgacgctggaggacggattctatgaggtggattataattcattccacgagacctatgagaccagcacgcctagcctttctgctaaggagctggccgagctggcctcccgggccgaattgccactcagctggagcgtctcttctaagctgaaccaacatgctgaattggagactgaagaagaagagaagaacttggaggaacagacagagagaaatggcgatgtggccaacctggagaacgaatccaaagtgtag

SEQ ID NO: 200269 - DNA, 1272 bp, Artificial Sequence
  Description of Artificial Sequence: Synthetic coding sequence
atggccaagctgaccgagagcatgaccaacgtgctggagggcgacagcatggaccaggacgtcgagtctccagttgccatccaccaaccaaagctgcctaagcaggccagggacgacctcccacggcatatctctcgggatcgaactaaaaggaaaattcaaagatacgtgcgcaaagacggaaagtgcaatgttcaccacggcaacgtgagggagacctacaggtacctgaccgatatatttaccactttagtagacctgaaatggcggttcaatttgcttattttcgtgatggtctacacagtgacctggttgttcttcgggatgatctggtggttgattgcctacatcaggggagacatggatcacatagaggatccaagctggacgccttgtgtgactaatctgaatggtttcgtgtctgcgtttctattctccattgagaccgaaacaaccattgggtatggttatcgagttataacagataagtgccctgagggtataatcttgctgctgatacaatccgttttaggttctattgtgaacgccttcatggtcgggtgtatgttcgtcaaaatcagtcagcctaagaagcgggccgaaacactcgtgttcagcactcatgcagtcattagcatgagggacggcaaactctgcctcatgtttcgtgtgggcgacctgcggaattcacatattgtggaggcctccataagagccaagctgataaaatccaagcaaacatctgagggcgagtttattcctctgaaccaaacggacatcaacgtgggctattacacgggggacgacagactgttcctagtttccccacttattatttcccacgaaattaatcagcagtctccattctgggagatctccaaagcacaacttcctaaggaagagttggagattgtcgtcattttagaggggatggtggaagctacggggatgacttgccaagctcgcagcagttatatcacctcagaaatcctttggggctacaggtttactccggtgctcacccttgaagatggcttttatgaggtcgattataacagctttcacgaaacttatgagacatctactccttccctgtctgccaaggagctggcagagcttgcctcaagagctgagctccctctgtcttggagtgttagcagcaagttgaatcagcacgctgaactcgaaaccgaggaggaggaaaagaacctggaggaacaaactgagcgcaacggggatgttgccaatctggagaacgagagcaaggtttag

SEQ ID NO: 200270 - DNA, 1275 bp, Artificial Sequence
  Description of Artificial Sequence: Synthetic coding sequence
atgctggcccggaagagcatcatccccgaggagtacgtgctggcccgaattgccgcagaaaatctaaggaaaccccgcatcagggacagattacctaaggcccgtttcatagccaagtccggtgcttgcaatctcgctcataagaacatccgggaacagggcagatttcttcaagatatattcacaacccttgtggacctgaagtggaggcatacactagtcatctttacgatgagttttctgtgttcatggctgctgttcgccattatgtggtggcttgtcgcgtttgcgcatggagatatctacgcatatatggaaaagagtggcatggagaagagcgggctggaatcgacagtctgcgtcactaatgtgaggagctttactagcgcctttctgttctccatcgaggtgcaggtgacgatcgggtttggcggcaggatgatgaccgaagagtgtccgctcgcgataaccgtcctgatcttgcagaacatagtcgggctcataatcaatgccgtgatgctcggttgcatctttatgaaaaccgcacaggcgcaccggcgcgctgagactttgatttttagtcgccacgccgtaatcgccgtccgcaacggcaaactttgctttatgtttcgggtgggggacctccggaaatctatgataatctcggccagcgtgcgcattcaagtagtcaagaagacaaccacccctgagggtgaagtggtcccaatacatcagctagatattcccgtagataatccaattgaatccaacaacatatttctggtggcacctttaatcatatgtcacgtcatcgacaagagatctcccctgtatgacatctcagcaacagacctcgccaaccaggatctagaagtgatagtgatcctggaaggcgtagtcgagacgaccggcataaccacgcaggcccgcacaagctatattgccgaggagattcagtggggacatagattcgtgagtattgtcacggaagaagaaggggtctacagcgtggattattcgaaattcgggaataccgtcaaagttgctgccccccgatgcagcgcccgcgagctagatgaaaagccgagcatcttgatccagaccctccagaaatcggagctcagccatcagaacagcctgcgcaagcgtaacagtatgaggagaaacaacagtatgaggaggaataactcgataaggaggaacaattcctcgctgatggtccctaaagtccagttcatgactcctgagggtaatcagaatacaagcgagtcttag

SEQ ID NO: 200271 - DNA, 345 bp, Artificial Sequence
  Description of Artificial Sequence: Synthetic coding sequence
atgctggcccggaagagcatcatccccgaggagtacgtgctggccaggatcgccgccgagaatttgcggaaaccgcggatcagggacaggttgcctaaggcccgttttatagccaaaagcggagcctgtaacctggcccacaaaaatatccgagaacagggccgatttctgcaggatatttttacgactctggttgatcttaagtggaggcatactctggtcatattcacgatgtcttttctgtgcagttggctgctgttcgccatcatgtggtggctcgttgctttcgctcatggcgacatttatgcctatatggagaagtccggcatggagaagtctggctag

SEQ ID NO: 200272 - DNA, 1275 bp, Artificial Sequence
  Description of Artificial Sequence: Synthetic coding sequence
atgctggcccggaagagcatcatccccgaggagtacgtgctggcccgaatcgccgctgaaaaccttaggaaaccccgtatcagagaccgcctccctaaagccagattcattgcaaagtctggagcctgcaacttggcccacaagaacattcgagaacaggggcggttccttcaggatatcttcaccaccctcgtcgatctaaaatggagacatacacttgttatcttcaccatgagcttcttgtgctcctggctgctgttcgccattatgtggtggctggtcgcattcgcccacggagacatttacgcgtacatggagaaaagtgggatggagaagtctgggcttgagtctacagtgtgcgtgacaaacgtcagatcattcaccagcgcgttcctatttagtatcgaagttcaggttactattggcttcggcggccgtatgatgacagaggagtgcccacttgcgataactgttctcatcctgcaaaacatcgtaggacttatcataaatgccgtgatgctggggtgcatatttatgaagacagcccaggctcacaggagagcggaaacacttattttctctcggcacgccgtcatcgccgtgcgaaacggcaaactgtgttttatgttcagagtaggcgacctgcggaagtctatgatcatttcagcttcggtcaggatccaggtagtgaagaaaactaccactccagagggcgaggtggtgcccattcaccagctcgacattcccgtcgataatccaatcgaatcaaacaacatatttctcgttgccccactgataatttgccatgtgatcgacaaaaggtctccactgtacgacattagcgcaaccgacctcgccaaccaagatttggaagtgattgtcatcctcgaaggtgtggtagagaccacaggcatcaccacccaggctagaacgagttacattgccgaggagatccagtgggggcatcgatttgtttcaatcgtgaccgaggaggagggcgtctactcagttgattacagtaagtttgggaatactgtcaaagtcgcggcaccgcgctgttcggcccgggaactggacgagaagccctcaatcctgatccaaacactccaaaagtccgagctctctcatcagaactccctgaggaaaaggaacagcatgcggagaaacaacagcatgcggcgtaataattccatccgcaggaacaactcaagcctgatggtgcccaaagtgcagtttatgaccccagagggtaaccaaaacacatctgagagctag

SEQ ID NO: 200273 - DNA, 774 bp, Artificial Sequence
  Description of Artificial Sequence: Synthetic coding sequence
atgaccgccttccccgccagcggcaagaagcgggagaccgactactcggatggtgatcccctcgatgtgcacaagagattgccctcctctgccggagaggacagagcggttatgctgggatttgccatgatgggtttctctgtgttaatgtttttcctgctgggaactactatcctgaaaccctttatgctgtccattcagcgcgaagagagcacttgtacggccattcacaccgacataatggacgattggctggactgtgcatttacctgtggcgtgcattgccatgggcagggtaaatatccctgcttgcaggtgtttgttaatctaagccatccaggtcagaaagcattgctccattataatgaagaggccgtgcaaattaatcctaagtgcttttacacccccaagtgccaccaggataggaacgacctgcttaactctgcccttgatatcaaagagttttttgatcacaagaatggcacgccatttagctgtttctatagcccggccagccagagtgaggatgtaatactgataaaaaagtatgaccagatggctatcttccattgcctgttctggccctcgctgaccctgcttggcggcgcattgattgtggggatggttcgactgacccaacacttgtctttgctgtgcgagaaatacagcacggtggttcgggacgaggttggcgggaaggttccatatatcgaacagcatcagtttaaactctgcatcatgaggcgcagcaaaggacgagccgagaaaagctag

SEQ ID NO: 200274 - DNA, 522 bp, Artificial Sequence
  Description of Artificial Sequence: Synthetic coding sequence
atgcagcccttcagcatccccgtgcagatcaccctgcagggcagccgaagacggcagggaagaacagcatttcctgcatcgggaaaaaagagagagacagactactcagacggagatccacttgacgtccataagagacttcctagttctgcaggcgaagacagggcagtcatgctgggctttgctatgatggggttcagcgttttgatgttctttctgctgggaacaaccatactgaagcccttcatgctgagcatccagcgtgaagaatccacatgtacagcaatacacacagacattatggatgactggctggactgcgccttcacatgcggagtccactgccatgggcagggcaagtatccgtgcttgcaagtcttcgtgaacttgagccatccagggcagaaggcactgttacactataacgaggaggcagtccagatcaatcccaagagggatgtgaccgattgccgggttaaggaaaaacaaactctaaccgttagcgatgaacacaaacagtag

SEQ ID NO: 200275 - DNA, 840 bp, Artificial Sequence
  Description of Artificial Sequence: Synthetic coding sequence
atggacttcagccccagcagcgagctgggcttccacttcgtggccttcatcttgctgactcggcaccggacagccttccctgcctcagggaagaaacgcgaaacggattactcagatggtgaccccctggacgtgcacaaacgtttacctagttcagctggggaagacagagccgttatgctcggatttgctatgatgggattttcagttctcatgttctttctgcttggcaccactattcttaagcccttcatgctgtctattcagcgcgaggagagtacttgcacagcaatccacacagacatcatggacgattggctcgattgcgctttcacatgcggcgtccactgccatggccagggcaaatacccctgtctgcaggtattcgtcaatctatctcatcccggccaaaaggctttgttgcattataatgaagaagctgtgcagatcaatccaaagtgcttctatacaccaaagtgccaccaggatcggaacgacctgttaaactcagccctggatattaaggaattctttgaccacaaaaatggaacgccatttagctgcttctattcccctgcatctcagtctgaggacgtgatcttgattaaaaaatacgatcagatggcgatttttcattgtctgttttggccaagcctgaccctgttaggtggagctcttatcgtcggcatggtgcgtctcacacagcatctttcactcttatgtgaaaaatactccaccgtcgtgagagacgaagtggggggtaaggtgccttacatagagcaacaccagttcaagctctgtataatgaggcgtagcaaaggcagggctgaaaaaagttag

SEQ ID NO: 200276 - DNA, 834 bp, Artificial Sequence
  Description of Artificial Sequence: Synthetic coding sequence
atgcagcccttcagcatccccgtgcagatcaccctgcagggcagcagacggagacaagggagaaccgcgtttccagccagtgggaaaaaacgggaaactgactatagtgatggcgacccactggacgtgcacaagagactcccctcctcagcaggagaggacagggccgtcatgctgggctttgcaatgatggggttctcagtcctgatgttttttttattagggaccactatattaaagccgtttatgttgagcatccagcgggaagagtcaacttgcaccgctatccacaccgacatcatggatgattggctggactgcgccttcacatgtggagtccattgtcatggccaggggaaatatccgtgcctgcaggtttttgtgaacctcagtcaccccggtcagaaagctctgctgcactataatgaagaggccgtccaaattaaccccaagtgtttctacactcccaagtgccaccaggacagaaatgatttgttgaattccgcgcttgatatcaaagagtttttcgaccacaagaacggcactcccttttcctgtttttacagccctgccagccaatccgaagatgtgatccttattaaaaagtatgaccaaatggcaattttccactgcttgttttggccatccctgactctccttgggggggccctaatcgttgggatggtgcgactcactcagcacctgtctctgctgtgcgagaagtattctacagttgtgcgcgatgaggtgggcgggaaggtgccttacattgaacaacatcagtttaaactgtgcatcatgaggagatccaaggggagagctgaaaagtcatag

SEQ ID NO: 200277 - DNA, 828 bp, Artificial Sequence
  Description of Artificial Sequence: Synthetic coding sequence
atgttccccctgctgtacgagctgaccgccgtgagccccagccccttcccacagagaacggctttccccgccagcgggaagaagcgcgaaaccgattacagcgatggggaccctctcgatgtgcacaaaaggctgcctagcagtgcgggcgaggatagggcagttatgctgggctttgccatgatggggtttagtgttcttatgtttttcctcctggggactaccatactcaagccatttatgctgtcgatccaaagggaggaaagcacctgcactgcgatccacacagatattatggatgattggctggactgcgcttttacctgtggcgtacactgccatggacagggcaagtatccatgtctgcaagtttttgtgaacctgtcccaccccggacagaaagccctgttacactataacgaggaagctgtccagatcaatccaaaatgtttctacacccccaaatgtcatcaggatcgaaacgatctgttgaactccgccctggacattaaggagttctttgaccacaagaacgggacacctttctcatgtttttattcacccgcatcgcaatcagaagatgtgatcctcatcaaaaagtatgatcagatggctatttttcattgcctgttctggccatccctaactcttctcggaggcgcactgatcgtcggaatggtgcggcttacccagcatttgtctttgttgtgtgaaaaatactcgaccgtggtgcgcgacgaggtaggcggtaaggtgccatatattgaacaacatcagtttaagctatgcatcatgagaaggagcaagggcagggccgaaaaatcatag

SEQ ID NO: 200278 - DNA, 774 bp, Artificial Sequence
  Description of Artificial Sequence: Synthetic coding sequence
atgaccgccttccccgccagcggcaagaagcgggagaccgactactccgatggggacccactggacgtccataaacgactgccctctagcgcaggggaggatcgtgcagtgatgctgggctttgctatgatgggcttctcagttctcatgttttttctgctgggtacgactatcctgaaaccattcatgctgtcgattcaaagggaagagtctacttgtaccgctatccacaccgacataatggatgactggctcgactgcgcctttacctgtggtgtccattgccacggccaaggaaaatatccgtgcctacaggtcttcgtgaatctctcacaccccggccaaaaagccctccttcactataacgaggaggctgtccagataaacccaaaatgcttctacaccccaaaatgccaccaggaccgaaatgatctattaaatagcgctttggacatcaaagagtttttcgaccataagaacggcactccatttagctgcttctattccccggcatcccagtcggaggacgtgatactcatcaaaaaatatgatcaaatggctatctttcattgcctgttttggccctctctgactctgctgggtggggctcttatcgtgggaatggtgcggctgacccagcacctctcactcttgtgcgaaaaatattccacagtggttcgcgatgaagtaggtgggaaggtgccttacattgagcagcaccagttcaagctgtgcataatgcgacgatctaagggacgggctgaaaagagctag

SEQ ID NO: 200279 - DNA, 3537 bp, Artificial Sequence
  Description of Artificial Sequence: Synthetic coding sequence
atggccaacggcggcggcggcggcggcggcagcagcggcggcggcggaggtggtggagggtcctccctgcgcatgtcatctaatattcatgctaatcacctatctcttgatgctagtagttccagttcatcgtcatcttcttcctcaagcagcagttcgtcaagttcttcctcttcatcagtccacgaacctaaaatggatgccctgatcatccccgtcacaatggaggttccatgcgactctaggggtcagagaatgtggtgggcattcctcgcgagttccatggtcacattcttcggtggtctcttcatcattttgctttggagaaccttgaagtacctctggacagtatgctgtcattgtggaggtaaaaccaaagaagctcaaaagataaataatgggagctcgcaagctgatgggacacttaagcctgtggacgagaaagaggaagcagtggccgccgaggttggttggatgacgagcgtgaaggattgggccggcgtgatgatcagcgcccagacactcactgggagggtgttggttgtacttgtatttgccctgtctatcggagcactggtaatctacttcattgattcctccaatcctattgagagttgtcagaatttctacaaggacttcactctccagatcgacatggcttttaatgtctttttcttactgtactttggtctgaggttcatcgccgccaatgataagctatggttctggctggaagtgaattccgtggtcgacttcttcacagtgccaccagtgtttgtgtcagtctacctgaaccggtcgtggctcgggctgcgctttttgcgggctctgcgcttaatccaattttctgaaattctgcagttcctgaacatactgaagacctcaaattccataaagctggtgaacctcctgagcattttcatttcaacttggttgaccgcagccggcttcatccacctggttgaaaactccggggatccgtgggaaaattttcaaaacaatcaggcactgacatactgggaatgcgtgtatctgctcatggttacaatgagcactgtgggatacggcgacgtttatgccaagacgaccctgggacgtttgtttatggtgtttttcatactaggtggtctggcaatgtttgccagctatgtgcccgaaattatagagttaattgggaacagaaagaagtacggaggatcgtacagcgctgtctctggcagaaaacatatcgtcgtgtgtggtcatataaccctggaatccgtaagtaacttcttaaaagatttcctgcacaaggatcgggacgacgtgaacgtggaaatcgtattcctgcacaatatcagtccaaacctagagcttgaggcactcttcaagcgccatttcacccaggttgaattttatcaaggcagcgtgctcaatccccacgacctggcacgcgtgaagattgagtctgctgatgcgtgtcttatcctggcaaacaagtattgcgcagacccagacgccgaggatgccagtaacataatgcgggtgatttctatcaagaactatcatcccaaaattcgcattatcacgcagatgctgcagtatcataataaagcgcatctgctcaacatcccctcctggaactggaaggagggcgacgacgccatctgtttagctgagctgaaattggggtttattgctcagtcttgtctggcccagggcctatctacaatgctcgccaacctgttctcaatgagatctttcattaagattgaggaagatacatggcagaaatactaccttgagggagtttcaaatgagatgtatacggagtacctgtcctctgcatttgtggggttgtcttttcctacagtgtgtgagctctgcttcgtgaaactgaagctgctcatgatagccatagagtacaagtcggctaacagagagtctcggattctgattaaccctgggaatcacctgaaaatccaggagggcactctggggttcttcattgcgagcgacgcaaaagaagttaagcgcgccttcttttactgtaaggcgtgccatgacgatattactgaccccaaacggattaaaaagtgcggttgcaaaagattagaagatgaacagcctagcacccttagcccaaagaagaagcaaagaaatggcggcatgaggaacagccccaatacaagtcctaagctgatgcggcacgatcctttgctaattccaggcaatgatcaaattgataatatggactccaatgtcaagaagtatgacagcacgggaatgttccactggtgcgctccaaaagaaatcgaaaaggtcatactcactcgctccgaggccgccatgacggtcctttctggacatgttgtggtctgcattttcggggatgtgagttcagccctaattgggctccgtaacctagttatgccattgagggcaagcaacttccattaccatgaactgaagcacatcgtcttcgtggggagcatcgagtaccttaagagggaatgggagacactacacaacttccccaaggttagcatcctgccaggcacgcccctttccagggccgatcttcgggccgtcaacatcaacctgtgcgatatgtgtgtgatactgtcagccaatcagaataatatcgatgacacaagccttcaggataaggagtgcatcctagctagcctcaacatcaaatcgatgcagtttgacgactcgattggggtattgcaggccaactcacagggttttacacctccagggatggacaggtcaagtcccgataacagcccggttcatggcatgctgcgccagcccagcataacaactggggtgaacatacctattattaccgaattagtgaatgacactaatgttcagttcttggaccaggacgacgatgacgatccagatacagaactttatctcactcaaccatttgcctgcgggaccgctttcgcggtatccgtgctggactccctgatgtctgcgacgtatttcaacgataatatattaacactaatccgtacactcgtcacaggaggagcaacccccgaactggaggcgctgatcgctgaagaaaatgctctaagagggggatactctaccccccagactctggcgaatagggaccgctgtcgggtggcccaactggctctgcttgatggacccttcgcagatttgggggacggagggtgttacggcgatctcttctgtaaggccctcaaaacgtacaacatgctgtgctttggcatctatagactgagggatgctcatttgtcaacccctagccagtgtactaagcggtacgtcattacaaaccccccctatgagttcgagttggtgcctactgacctcatcttctgtctgatgcaatttgaccataatgccgggcagtcacgggcttcactgagccattcaagccacagttcccagtcatcgagcaagaagtcgagtagcgttcacagcatccctagcacagctaacagacaaaatcgacctaaatcaagggagtcaagggacaaacagaaatatgttcaggaggagcggctgtag

SEQ ID NO: 200280 - DNA, 3633 bp, Artificial Sequence
  Description of Artificial Sequence: Synthetic coding sequence
agcaacatccacgccaaccacctgagcctggacgccagcagcagctcctccagttcttctagctcctcctcctcctcctcatcctcctcttcgagctcctctgtccacgaacccaaaatggatgcacttattattcctgttacaatggaagttccttgcgattcacgagggcagcgtatgtggtgggccttccttgccagctccatggtgaccttcttcggcggcctgttcatcatcctgctgtggcggactctaaaatacctctggacagtctgctgccattgcggggggaagactaaggaggcccaaaagattaataacggaagttcccaggcggatggaacactgaaaccagtggatgagaaagaagaggccgtggccgctgaggtgggttggatgaccagtgtcaaggattgggccggggttatgatttctgcacagaccctcacggggcgggtgctcgtggtcttagtatttgctctctcaattggagctttagtcatctacttcatagactccagtaaccctatcgagtcatgccagaacttttacaaggactttacgttgcaaatagatatggcctttaatgtctttttcctattgtattttggattacggttcatcgcagccaatgacaagttatggttctggcttgaggtcaatagtgtcgtagatttcttcaccgtgcctcccgtgttcgtttcagtatacctgaatcgatcctggttggggctgcgctttctaagggcgctccggctgattcagttctccgagatcctgcagtttctaaacatattgaaaacctctaactcaataaagctggtgaatctactgagcatcttcatttctacgtggctgacagccgccggattcatccacctggtggagaatagcggggacccttgggaaaacttccagaacaatcaggccttgacctattgggagtgtgtctacctgttgatggttacgatgtcgaccgtaggctatggggacgtgtacgcgaagactaccttaggcaggctctttatggtcttcttcattttgggtgggttagctatgttcgcatcctatgtgccagaaatcatagaattgatcggtaacagaaaaaaatatggaggatcctactccgccgtgtccggtagaaaacatatcgtggtgtgcgggcatatcaccctggagagcgtaagcaacttccttaaagatttcttgcacaaggatcgggacgacgtaaacgtcgagatcgtctttctccataatatcagccctaacctcgaacttgaagctctgttcaaaaggcacttcactcaagtcgaattctaccagggatctgttctgaacccgcatgatctagccagagtcaagattgagagtgccgatgcttgcctgatcttagcaaacaaatactgcgcggaccctgatgctgaagatgcatcaaatataatgagggtgataagcattaaaaactaccacccaaagatcaggattatcactcagatgttacagtatcacaataaagctcatctccttaatattccttcttggaactggaaagaaggggacgacgcaatttgtctggcggagctcaagttaggcttcatcgcccagtcctgcctggcccagggcctttctacaatgctcgcaaacttattcagtatgcgatccttcataaaaatcgaggaggatacctggcaaaaatattacttggagggcgtcagtaatgagatgtacaccgaatatctgtcttccgctttcgtggggttgtccttcccaaccgtttgcgagctgtgtttcgtcaagctcaaattactaatgattgccatagaatataagagtgccaatcgggagtctcggattctgatcaatcctggcaatcacctaaaaatacaagaaggaacactgggattcttcatcgctagcgacgcgaaggaggtcaagcgcgcttttttttactgcaaagcatgtcacgacgacattacagatcctaagagaatcaagaagtgtggttgcaaacgccccaagatgagcatttacaagaggatgcgcagggcctgttgctttgattgtggccgctccgagagagattgtagttgcatgtccggcagggtccgcgggaatgtggataccctggagagggcctttcctttgagctctgtttcggtgaacgactgctcaacctcctttcgggcattcgaagacgaacagccgtccaccctgagtcccaagaagaaacagcggaacggtggaatgcgaaatagcccaaacaccagcccaaagcttatgcggcacgacccattactgatccccggaaatgaccagattgataacatggacagtaatgtcaaaaagtacgacagcaccggaatgttccattggtgtgccccaaaggagatcgaaaaggttattctcaccagatccgaggctgccatgaccgtcttgagtggccacgtcgtggtgtgtatattcggagacgtttcaagtgcacttatcggcctgcgaaatcttgtaatgccactgcgggcctcaaacttccactaccatgagttgaagcatatcgtctttgtagggtccatagagtatttgaaaagagagtgggagacactccacaacttcccaaaggttagcatcttgccaggcaccccactgtctcgagccgatctgcgcgccgtgaacattaacctttgcgatatgtgtgttattctgtctgccaaccaaaacaatatagatgacacaagtctgcaagacaaagagtgtatccttgcctctttaaatatcaaatccatgcagttcgacgattcaatcggcgttctgcaggcaaatagtcaggggtttacaccacctgggatggaccgctcctctccagacaactcgcccgtccacggcatgctgagacagcctagcatcacaacaggcgttaatatcccaattatcaccgagctggtgaatgacactaacgtccagttccttgaccaggacgacgacgatgacccagacacagagctgtacctgacccagccatttgcctgtgggacggcttttgcggtgagcgtgttggactcattgatgagcgctacatattttaacgataatatccttacactcattagaacactcgtgactggcggcgcgaccccagagctggaggcgcttattgcggaggagaatgctctgagaggcggttactcgaccccccagaccctggcgaatagggaccggtgcagagtagcacagctggccctccttgatggtccttttgccgatctgggagatggcggctgctacggcgatttgttttgtaaggccctgaaaacatacaatatgctatgctttggtatttatagactgcgggatgctcatctttctacgccctctcagtgtaccaaacgctacgtgataaccaatcccccttatgagtttgagttagtaccaacggacctgattttctgccttatgcagtttgaccacaatgctggccagtcacgggcatcgctgtcacactccagtcattccagccaatcatcctctaagaagagcagttctgtgcacagcattccttcgactgccaaccggcagaaccgcccaaaatctagggagagcagagacaaacagaagtatgtgcaggaagagaggctatag

SEQ ID NO: 200281 - DNA, 3720 bp, Artificial Sequence
  Description of Artificial Sequence: Synthetic coding sequence
atggccaacggcggcggcggcggcggcggcagcagcggcggcggcggaggtggtggaggttcctctctcaggatgtctagcaacatacacgccaatcatttgagcctggacgcgtcctcttcttctagctcatctagcagttctagtagcagctccagctcctccagctcttcctcctccgtccatgagccaaaaatggatgctttgatcattccagtaaccatggaggtcccctgtgacagtaggggacagcggatgtggtgggccttcctcgcctctagcatggtcaccttctttggaggtttatttattattttgttgtggcggacattgaagtacctgtggacagtttgctgccactgtggtggtaagaccaaggaggcccaaaaaataaacaatgggagctcacaggccgatggcaccctgaaacccgttgatgagaaagaggaggctgtggccgcggaggtgggttggatgaccagcgtgaaagactgggctggcgttatgatctccgcccagactctgaccggaagggttctggtcgtgcttgtttttgccctgagtatcggcgctctggtcatctatttcatagatagcagcaatcctatcgaatcttgtcaaaacttttacaaggatttcacactgcagatagacatggcctttaacgtgttttttcttctgtatttcggactgcgcttcatagccgccaacgataaattatggttctggctggaggttaacagcgtggtcgatttcttcaccgtcccgccagtatttgtttcagtgtatttgaacaggagctggctgggtctacgcttccttagggcactgagacttatccagtttagcgaaatcctgcaattcttgaatatcctaaagacttcgaacagcataaaactggttaatcttcttagtatctttatctccacctggctcactgcagctggtttcattcacttggtagagaactccggcgatccctgggaaaactttcaaaacaatcaggccttgacctactgggagtgtgtttacctcctcatggtgacaatgtctacggtgggttacggagacgtctatgccaaaaccactctggggagacttttcatggtcttcttcattctggggggcctggccatgtttgccagctatgtccctgaaatcatagagttgatcggaaacaggaaaaaatacggtgggtcatactctgcagtttctggaagaaagcatattgtcgtttgcgggcacattacgctggaatccgtcagcaattttctcaaagattttctgcacaaagacagggacgacgtgaacgttgaaatcgttttcctgcataacattagtccgaatctggagctcgaagcactctttaagaggcacttcacgcaggtagagttctaccagggaagcgtcttgaatccacacgacctcgccagggttaaaattgaaagcgctgatgcctgtctaatcctggcaaacaaatactgcgctgatcccgacgcagaggatgcgagtaacattatgcgcgtgatctcaatcaagaactatcatcccaagatcagaatcattactcaaatgttgcaatatcataataaagcgcacctgctcaacatcccgtcatggaactggaaggagggggacgacgccatctgtctggcggagttgaagctgggttttatcgctcagtcatgtcttgcccaggggttgagtacgatgttggccaatctcttttctatgcgttcatttatcaaaatcgaggaggacacctggcagaagtactacctggaaggggtgtccaatgaaatgtatacagaatatctgtcctccgcgtttgtgggcctgtccttcccaaccgtgtgcgagctctgctttgtcaagctaaaactgctgatgatcgccatcgagtacaagagtgccaaccgcgaaagtcggatcctgattaatcccgggaatcacctgaagatccaagagggcactctgggatttttcatcgcatcagacgcaaaggaggtgaagcgagcttttttttactgcaaagcatgccacgacgatattaccgaccccaagcgcataaagaagtgcgggtgcaaacgacgctgggaagaacattgcagcctgtggcgcctcgagtcaaaggggaacgtgagacggcttaactattgtagaggccaacagaccttctctgtaaaagtcaaggtagccgcccgatcaaggtactcaaaagatcccttcgagttcaaaaaggagacccccaacagtagactggtcacggaacccgtggaagatgagcaaccatccactctgtcccccaagaaaaagcagaggaacgggggtatgcgcaatagtcctaataccagcccaaaacttatgagacatgatccacttctgattcctggcaatgaccagattgacaacatggacagcaacgtcaagaaatatgattcgacgggaatgtttcactggtgcgcccctaaagaaattgagaaggtgattctgacccggagtgaggccgccatgactgtgctatcgggccacgttgtcgtgtgtatcttcggagacgtgtcgtctgcacttatcggtctcaggaacctcgtgatgccattgagagctagcaacttccattatcatgaactcaagcacattgtgtttgtgggcagcattgagtacttgaagagagaatgggagacgctgcataattttccaaaggtttccatcctgccagggacgcctcttagccgtgctgatttacgcgcagtcaatataaacctgtgcgatatgtgcgtgatcctcagtgctaatcaaaataacatagatgataccagcctccaggataaggaatgtattttggcttcactgaacatcaagtctatgcagttcgatgacagtattggagtactacaggctaactcacaaggcttcacgcctcctggaatggatcgctcgagccccgataacagccccgtgcacggaatgctgagacagccaagtattaccacaggcgtcaatattccaattatcacagagttggttaatgacaccaacgtgcagtttctggaccaggacgacgatgacgacccggacacagaactgtatctgacgcagcccttcgcttgtgggacggccttcgccgtcagtgtgcttgacagcttaatgtccgccacgtattttaatgataatatcttgactctcatcaggaccctggtcacaggaggagcaacaccagaactcgaggccctgatcgctgaggagaatgctttgagggggggctactccacccctcaaaccctcgctaatagggacaggtgcagggtcgcccagctcgccctattagacggaccattcgctgatctgggagatggaggctgctacggggatctgttctgcaaagccttaaaaacatataacatgttgtgtttcgggatctacaggctgcgggacgcccatctcagtactccatcacagtgcactaagcgctacgtcattacgaatccaccatacgagtttgagctggtgcctacagatttgatcttttgtctgatgcaatttgatcacaacgccggccagagcagagcctccctgagccactcctcccacagctcacagagctccagcaaaaagagcagctccgtgcactccattccctccaccgccaatcggcagaacaggccaaagagtagggagtcccgggacaagcagaagtatgtccaagaggagaggctctag

SEQ ID NO: 200282 - DNA, 3549 bp, Artificial Sequence
  Description of Artificial Sequence: Synthetic coding sequence
tgaagcagcagcagcagcagcagcagcagcagcgtgcacgagcccaaaatggacgccttaatcattcctgtcactatggaagtgccctgcgattcgcgcggtcagcgcatgtggtgggctttcttggcttcctccatggtcactttttttgggggtctgtttatcattctcttgtggcgcaccctcaaatacctctggactgtatgttgccactgcggcggcaagaccaaagaagctcagaagatcaataatggatcaagccaagccgatgggaccctgaagcctgtggatgagaaagaggaagctgtggctgcagaggtgggatggatgactagtgtgaaagactgggcgggcgtaatgatatcagcacaaactctcactggaagagttctggtcgtgctggtgtttgccctgtccatcggcgccttggtgatttattttatcgactcaagtaacccaatcgagtcatgccaaaatttctataaagacttcacactgcagatcgacatggctttcaatgtgttctttctgctatacttcggcctgcggtttatcgcagctaacgataaactatggttctggcttgaagtgaattccgtggttgattttttcacagtgccgccagtattcgtgtctgtgtatctgaaccgctcctggctgggcctgcggttcttaagagccctccggctcattcagttttccgaaattctgcagttcctgaatatcctgaagaccagtaacagcattaaactcgttaacctgctgagcatctttatttcaacatggctcacagcagctgggttcattcatctggtggagaacagcggcgacccatgggagaactttcaaaacaaccaggcactgacctattgggaatgtgtatatctcctgatggtgactatgtctactgtagggtacggcgacgtctacgccaagaccactttgggccggttgttcatggtgttctttattctgggcggtctcgccatgtttgcttcctatgtgccagaaatcatcgagctgatcggcaacagaaagaaatacggaggcagctactcggccgtgtcgggtcgtaagcacatcgttgtgtgtggtcatataaccctcgaatcggtgtccaacttcctgaaagatttcctacataaagaccgggacgacgtcaatgtcgagatcgtgttcctgcacaacatcagtccgaatctggagctcgaggcactgttcaaacgccatttcacgcaggtggaattctatcaaggaagtgttcttaacccacacgacctggcgcgcgtgaagattgaatccgccgacgcctgcctgattctagctaataagtactgcgccgacccggatgctgaagacgcctctaatattatgcgtgtcatcagcatcaagaattatcatcccaaaatccggatcattacacaaatgctgcaatatcataataaggcccatttacttaacatcccttcttggaattggaaggaaggcgacgacgctatctgtctggccgagctcaagttgggtttcatcgctcagagttgcctcgcccaaggcttgagtaccatgcttgccaacctgttttcaatgaggtcctttatcaaaatagaggaggacacgtggcagaagtactatctcgagggagtcagtaatgagatgtacaccgagtacctctcttcagcatttgtaggcttgtcattccctacagtgtgcgaactgtgctttgtgaaactcaagctgctgatgattgctattgaatataagagcgctaacagggaatctcgcattctgatcaacccagggaaccacctcaagatacaggaaggaactctcggttttttcatagccagtgacgcgaaggaggtgaagcgcgcatttttctactgcaaagcctgccatgacgacatcacggatcccaagcgcatcaaaaagtgcgggtgcaagcggctcgaagatgaacagccatcgacactgagtcccaagaagaaacagcgcaatggggggatgaggaacagccctaacacttcacctaagcttatgaggcacgaccccctgttgatacccgggaacgatcagatagataatatggattccaacgtcaagaaatacgactccacaggaatgttccattggtgcgcccccaaagagatcgagaaagtgatcctgacacggtctgaagctgctatgacggttctgtcagggcatgtcgttgtttgcatcttcggagacgtctcctctgcacttatcggtctgaggaacttggtcatgcctctgagggccagcaatttccactatcacgagctgaaacacatcgtcttcgtgggtagtatcgagtatctcaagagggaatgggaaaccttacacaatttccctaaagtgtccatcttacctggaactccattaagcagagccgacctgagggccgtcaacatcaacctttgcgacatgtgtgtgatcctaagcgctaaccagaataatatcgacgacaccagtctccaggacaaggagtgcattctggcctctctgaacataaagtccatgcagttcgacgacagtatcggtgtactccaggccaactcccagggattcactccccctgggatggaccgctcatctccagacaatagcccagtgcatggcatgcttaggcagcctagcattaccacgggcgtgaacattccaattattacagaactggtcaatgatacaaatgtgcagttcctggaccaagacgatgatgacgaccctgacaccgagctgtacctgacccagcctttcgcctgcggaactgctttcgccgtaagcgtcctggatagtcttatgagcgccacctattttaacgataacatcttaactctcatcaggactttggttacaggaggcgctactcctgagctggaggctttgattgccgaagagaacgccttgcgcgggggttatagcactccgcaaactctggctaacagggaccgctgcagagtggcccaactggctttgcttgacgggccctttgccgatttaggagatggaggttgctatggcgatttgttttgtaaggccctgaagacctataacatgctgtgtttcggcatctacagacttagagatgctcatctgtcaacaccctctcaatgcactaaaagatacgtaatcacgaaccctccttacgagttcgagctggtgccgacagatctaattttctgcctgatgcaattcgaccacaacgcaggccagtcccgggcctccctgagccacagcagccactctagccagtcttcctctaagaagtcaagttcagtgcactcaatcccaagcacggccaatagacagaatcgaccgaagtcacgcgaatccagagacaagcagaacgccacccggatgaataggatggggcaggccgagaaaaaatggtttacggatgagccagataatgcttacccccgaaacatccagattaagcccatgtccacccacatggcaaaccagatcaatcagtacaagtctacttcgagcctgatcccccctattcgcgaagtggaagacgaatgttag

SEQ ID NO: 200283 - DNA, 3504 bp, Artificial Sequence
  Description of Artificial Sequence: Synthetic coding sequence
cccaagatggacgccctgatcatccccgtgaccatggaggtgccctgtgactctagggggcagagaatgtggtgggcgttcctggcctcaagcatggtcactttctttggcggcttgtttatcatcctcctctggagaaccttaaagtacctgtggaccgtgtgctgccactgcggcggcaagaccaaagaggcccagaaaatcaataacgggagctctcaggctgatggcacgctgaagcctgtcgacgagaaagaggaggcagttgccgctgaggtggggtggatgaccagcgtcaaggactgggctggcgtgatgatcagcgcccagactctcactggcagggtgctggtggtgttagtgttcgcactcagcattggtgccttggtcatttattttatcgacagctctaatcccatagagtcatgtcaaaacttctataaggacttcacactccagattgatatggccttcaacgtgttttttctactctatttcggtttacggtttattgccgccaacgacaaactgtggttctggttagaagtcaattcagtagtggattttttcactgtaccaccagtgttcgtgtcagtttatctgaaccgcagctggctgggtctgaggtttctgagggccctacggctgattcagttcagcgagatcctccagttcctcaacattcttaagaccagcaactctattaagcttgttaacttactttccattttcatttctacctggctcactgccgctggatttatccatctagtggaaaatagtggggacccctgggagaatttccagaacaaccaagcattgacatattgggaatgcgtctatctgctcatggtgactatgtccaccgtcgggtatggtgacgtgtacgccaagacaacgctgggaaggttgttcatggtcttttttattctcggcggtttagccatgtttgcgagctatgtgcccgagattatcgagctgattgggaatcgcaaaaagtatggcggctcctactctgccgtgtccggtaggaaacatatcgtggtatgtggacacattaccttggaatcagtgagtaattttctgaaggactttcttcacaaggacagggatgacgtaaacgtcgaaatcgtcttcctgcataatatttctcccaacctggagctggaagcactgttcaaaagacatttcactcaagttgaattctatcaaggcagcgttctcaatccccatgatcttgctcgggtgaaaatagaatcagcggacgcctgtctaattctggccaacaaatactgtgcagatcctgatgccgaggacgcatctaatataatgagggtcatcagcattaaaaactatcacccgaagattaggattattacgcagatgcttcagtatcataataaagcccacctcctgaacattccatcatggaactggaaggaaggtgatgatgctatctgtctagcagagctcaagctcggtttcatcgctcagtcttgcctggcccagggactcagcaccatgttggcaaatctgttctctatgaggagttttataaaaattgaagaggacacctggcagaagtactacctggaaggggtttcgaacgagatgtataccgaatatctctcaagcgctttcgtagggctgagttttcccaccgtgtgtgagttgtgctttgtgaaattgaaactactgatgatagccatcgagtacaaatcagctaatagagagagtcgtatcctcattaatcccggcaaccacttaaaaattcaggagggcactctgggtttcttcatagcgagcgacgcgaaggaggttaagcgcgccttcttttactgcaaagcttgtcacgacgacattacagatcccaaaaggatcaagaagtgcggttgcaagcgccttgaggacgagcaaccctcaaccttatcacccaaaaagaagcagaggaacggcggcatgagaaacagccccaacacctcacccaaacttatgcgccatgaccctctgctgatccccggcaatgaccagattgacaacatggattctaatgtgaagaaatatgactcaaccggcatgtttcattggtgcgcgcctaaagagatagagaaagtgattctgaccagaagcgaggccgccatgaccgtgttatcaggccacgtggtcgtttgcatattcggcgacgtgtcctcggccctgattggtctcaggaacctggttatgccgctgagagcatccaactttcactaccatgagcttaagcatatcgtgttcgtgggctctatcgaatatctgaaacgagagtgggagacgctccacaacttcccgaaagtgagcattctgcccggaactccgttgtctagggccgaccttagagccgtgaacattaatctgtgcgatatgtgcgtcattctctccgcgaaccagaataacatagatgatacctccctacaagataaagagtgtatccttgccagcctgaatatcaaaagcatgcaatttgacgactcgataggagtgctgcaggccaatagtcagggcttcacccccccaggaatggaccggagttccccagacaactcccctgtgcatgggatgctcaggcaaccatcaatcactaccggggtgaacatcccaatcatcaccgagctagtgaatgataccaacgtgcaattcctggatcaggacgatgacgatgaccccgatactgagctgtatctcacacagcccttcgcgtgtggcacggcctttgctgtgtctgtgctggattccctgatgtccgcaacatattttaatgataacatcttgacgctcataaggacacttgtgaccggcggtgccacacctgaacttgaggcattaatagctgaagagaacgccttgaggggcggttactccaccccccagaccctggccaacagagaccgatgcagggtggcccagctggcactcctagatgggccttttgcagatttgggagacggaggctgttacggggatcttttttgtaaagccctcaagacttataacatgctgtgttttggtatctatcgcttaagagatgcgcatctgtccacacccagtcaatgtaccaaaaggtacgtcattaccaatcccccctacgaatttgagctggtgcctactgaccttatattctgtctgatgcagttcgaccataatgctggtcagtcccgagcaagcctcagccactcaagccattcatctcagtcctcaagtaaaaagtcaagtagcgtgcacagtatcccgtctaccgctaaccgccaaaaccgccccaaatcccgtgagtctagagataagcagaatgctacccggatgaaccggatgggtcaggaaaaaaaatggttcactgacgagcctgataacgcttacccacggaatattcaaataaaacccatgagtactcacatggcgaaccagattaaccaatataagtctacatcttcccttatcccccccattagagaagtcgaggatgagtgctag

SEQ ID NO: 200284 - DNA, 3504 bp, Artificial Sequence
  Description of Artificial Sequence: Synthetic coding sequence
tgaggcggcggcggcggcggcggcggcagcagcctgcggatgagcagtaacatccatgctaaccatctttctctcgacgcatcttctagctccagttcaagctccagcagtagtagcagctctagctcttcgtctagctcttcgagcgtgcatgagcctaaaatggatgcactgatcatccctgtcaccatggaggtgccttgcgactcgagggggcagaggatgtggtgggcctttttggccagctccatggtaacattcttcggtggcttatttatcattttactgtggaggacacttaagtatttgtggaccgtgtgttgtcattgtggcgggaaaaccaaggaagcgcaaaaaatcaacaatggatccagccaggcagatggcaccctaaagcctgtcgatgaaaaggaggaagctgtagccgccgaggttggttggatgacctcagttaaggattgggccggggtgatgatcagcgcccagactttgaccggcagggttctggtggtcctggttttcgctctgagcattggcgccctcgtgatctacttcatcgattcttccaaccccatcgagagttgccaaaacttttacaaggatttcacactgcagattgatatggcttttaatgtgtttttcctgctgtatttcggcctgcgctttatcgctgccaatgataagctgtggttctggctcgaggtgaactccgtcgtggacttcttcacagttcctcccgtgttcgtgagtgtatacctgaaccggagctggctcggcctgcggtttctgagagccctgagactgatccagtttagtgagatcttacagtttctcaatatcttaaaaacaagcaactccatcaaactggtcaacctgctttctatatttattagcacttggctaacagctgctgggtttatccacttggttgagaattcaggtgacccatgggaaaattttcagaataatcaggccttaacctactgggagtgtgtttatctgctgatggtcacgatgtcaactgtgggctatggcgacgtctatgccaagactacgctggggagactgttcatggttttttttatcctgggcggattggctatgttcgcaagctatgttcctgaaattatcgagcttatcggaaaccggaaaaaatacggtggtagttattccgccgtgagtggacggaaacacatcgtggtctgtggccacattacccttgagtcagtgtctaattttcttaaggacttccttcacaaggatagggacgacgttaatgttgagatcgtgtttctacataatatttctccaaacctcgagttagaggctctgttcaagaggcacttcacacaggtagagttttaccaaggatccgtcttaaacccccatgacctcgccagagtcaagatagaatcggctgatgcctgcctcatcctggcaaataagtactgcgcagaccccgatgctgaggacgcttctaacattatgagagtgatcagcatcaagaactatcaccccaagatcagaattattacccagatgctccagtatcacaacaaagctcaccttctgaacatccccagttggaactggaaggaaggagacgatgctatctgtttggccgaactgaaactgggcttcattgcccaatcctgtctggcccaggggctgtctactatgttggccaacctgttcagcatgagatctttcatcaaaattgaagaagatacctggcagaaatattacttggaaggtgtctcgaacgaaatgtacaccgaatatctcagcagtgcctttgtgggtctgtctttcccaacagtgtgcgaactttgcttcgtgaaactcaagttgctgatgatcgccatagaatacaaaagtgcgaacagggagagcagaattctgattaaccctggaaatcacctgaaaattcaagaggggacactggggttctttatcgcttctgatgctaaggaagtgaaacgtgcctttttctattgcaaggcctgtcatgacgatattaccgatcccaaacggatcaagaagtgtggttgtaaaaggctggaggacgagcagccgagcaccttgagccccaagaagaaacaaagaaatggcggtatgagaaattcgcccaatacaagcccaaaacttatgcgccatgacccactcctgatacccggaaacgatcagatcgacaatatggattctaacgtgaaaaaatacgactccaccggaatgtttcattggtgtgcacccaaagagattgagaaagtgattctcacaaggtctgaggctgccatgaccgtgctgagtggccacgtggtggtgtgtatctttggcgacgtctcctcagctctgatcggcctcaggaacctagtcatgccgctgcgagcttccaacttccattaccatgagctgaaacacatcgtcttcgtcgggagtattgagtacctcaagcgagagtgggagactctgcacaattttcccaaagtgagcattctgcctgggacgccgcttagcagagccgatttgcgcgccgtcaacattaatctttgcgacatgtgcgtgattctgtcagctaatcagaataacatcgacgacacatccctacaggataaggaatgcatccttgcctctctgaatatcaagtccatgcagttcgatgattctattggcgtgttgcaggctaatagtcagggctttacgccccccggcatggacaggtcctcccctgacaattcaccagtgcacggtatgcttcgacaaccctccataactacgggcgttaatatccccattattaccgaactggtgaacgatacaaatgtacagtttttagaccaggatgacgacgacgaccccgacactgaactgtatcttacgcagccattcgcctgtggaaccgccttcgccgtcagcgttctagacagcctaatgtcagcaacgtatttcaacgataacatccttacactcattcgtacattggtcacaggtggagctactcccgaattggaggcgctgatcgctgaggagaacgcactgagaggcgggtattccactccacagacccttgcaaacagagaccgctgcagagtggctcagctggctctgttagacggacctttcgccgatctcggagatggcggatgctacggggacctcttctgtaaggccctcaaaacctacaatatgctgtgcttcggcatctaccgattacgtgatgcacacctctcaaccccaagccagtgtaccaaacggtacgtcatcaccaatcctccatacgagtttgagctggtgccaaccgatcttatattttgtctcatgcagttcgatcataatgctggccagtccagagcatccttgagtcatagctctcattcaagccagtcctccagcaaaaagagcagtagcgttcactcgatccccagcactgccaacagacagaatagacccaaatctcgggagtctagggacaagcagaaccggaaagagatggtttatcggtag

SEQ ID NO: 200285 - DNA, 3516 bp, Artificial Sequence
  Description of Artificial Sequence: Synthetic coding sequence
atggacgccctgatcatccccgtgaccatggaggtgccctgcgactcccggggacagcggatgtggtgggccttcttggccagcagtatggtgaccttctttggaggactgtttataattctcctgtggcgtacactcaaatacctttggactgtctgctgtcactgcggaggcaagaccaaagaagcccagaagattaacaatgggagctcccaggctgatggcacgctcaagcccgtggatgagaaagaagaggcagtcgcagctgaagttggctggatgactagcgttaaggactgggctggggtgatgattagtgcgcagacactaaccggccgggtgctcgtagtccttgtcttcgcgctctccatcggtgcattggtgatctacttcatcgactcatccaaccctattgagagttgtcagaacttctataaggattttaccctccaaatcgatatggccttcaacgtctttttcctgctttattttggcttgagattcattgccgccaatgataaactttggttctggctagaagtcaattccgtggttgactttttcacggtacccccagtcttcgtgagcgtttatttaaaccgctcctggctaggacttaggttcctccgtgcacttaggctcatccagtttagcgagattctgcagttcctgaacatcttaaagacaagtaacagtatcaaacttgttaacctcctgagcatttttatctccacatggctgaccgcagccgggtttattcatctggtggagaacagcggcgatccatgggagaacttccagaataaccaagctcttacctactgggagtgcgtctacctgctgatggtgacaatgtccaccgtcggctacggtgacgtctatgcgaagacaacactaggaagactgttcatggttttcttcattctcggcggtctggcaatgttcgcctcctatgtcccagaaatcatcgaattaataggtaaccgcaagaaatacggaggaagttactccgcagtgagtggccgcaaacatattgtcgtgtgcggccacatcactcttgaatccgtgtcaaatttcttgaaggattttctccacaaagatcgggacgacgtgaacgtggagatcgtatttttgcacaacatttcacccaacttagaactggaggcgttgttcaagcgtcatttcacacaggtcgagttctatcaggggtctgtcctgaatccacatgatcttgcgagagtgaagattgaaagtgctgacgcctgtctgattctggcgaacaagtattgtgcagatcctgatgcagaagacgcttctaacatcatgagggtcatctctatcaaaaattatcacccaaaaattcgcatcatcacccagatgctccagtaccacaacaaggcccacctgctgaatatcccctcttggaattggaaagagggcgatgatgctatatgtctggcggagttgaagttagggttcattgcccagtcttgcctcgcccagggtctgagtacgatgttggccaatcttttctccatgcggtctttcattaaaatcgaagaagatacgtggcagaagtattatctggagggagtgagtaatgagatgtacacagaatacttgagctcggccttcgtgggactgagcttccctaccgtgtgcgaactgtgtttcgtgaagctcaaattgttgatgatcgccattgagtacaaaagcgccaacagagaaagcagaattcttattaaccctgggaaccatctgaagattcaggaaggaactctcgggttctttatcgccagcgatgctaaggaagtaaagcgtgccttcttctattgcaaggcctgtcacgacgatattacggatcccaagcgtatcaagaagtgtgggtgtaagagacctaagatgtcaatttataaaagaatgcggcgcgcatgttgcttcgactgcgggagatctgaaagagattgcagctgtatgtctggacgtgtgagaggaaatgtggacacacttgagcgcgcctttcctctcagttctgtttcagtgaacgattgtagcactagctttagggcattcgaggacgagcaacctagcaccctgagccccaagaagaaacagcggaacggtggcatgcgtaatagccccaatacctcacctaagttgatgcgccacgatcctttattaattcctggcaatgaccagatcgacaatatggattccaatgtgaagaaatacgactcaaccgggatgttccactggtgtgcaccgaaagaaattgagaaggtcattctaacacgaagtgaagctgctatgactgtgctatccggacacgtggtggtgtgtatttttggtgacgtgagtagcgctttaatcggactgcgtaatctcgtcatgcccctccgggcctcaaactttcactatcacgagctcaagcacatcgtcttcgtggggagcatagaatacctaaagcgcgagtgggagactttacataattttcccaaagtgagcatcttgcctgggaccccactaagtcgtgccgacttgcgagctgtgaatatcaacctttgtgacatgtgcgtcatcctgtcagcaaatcagaataacattgacgacacaagcctccaggataaggagtgcattctggcatcgctcaacatcaagtccatgcagttcgacgacagcattggggttcttcaagctaattcccagggcttcacaccccccggtatggaccgctcctcccctgacaacagcccggtgcatgggatgttaagacaaccgtccattactacaggtgtcaacatccctatcatcactgagcttgtgaacgacaccaacgtccagtttctggatcaagacgacgatgacgatcctgatacagaattgtatttaacacagccattcgcctgtggaactgcatttgcagtgtcagtgctggactctctgatgtccgccacttatttcaatgacaacatcctgacactgattcgaacgcttgtcacagggggcgctacgccagaactggaggcccttattgccgaagaaaacgccctgcgagggggctactccacccctcagacgctcgcaaatcgtgatcgatgcagggtcgcccagctagccctgcttgatgggccattcgcagaccttggcgacggggggtgctacggtgacctcttctgcaaggccctcaagacgtacaatatgctgtgtttcggcatctaccggctccgcgacgcccatctttcaacaccatctcagtgcactaaacgttacgtcatcaccaacccgccttacgaatttgagttggtgccaacagatcttatcttctgcctgatgcaatttgaccataacgcagggcagagcagagccagcttaagtcatagcagccattccagtcaatctagttccaagaaatcgagctctgtccacagcatcccaagcactgcaaatcgccagaatcggccgaagagccgtgagagtcgagataagcagaaccggaaggaaatggtttatagatag

SEQ ID NO: 200286 - DNA, 3534 bp, Artificial Sequence
  Description of Artificial Sequence: Synthetic coding sequence
atggccaacggcggcggcggcggcggcggcagcagcggcggcggcggaggaggaggcggatctagcctaaggatgagctcgaacattcacgcaaaccacctctccctagatgcaagtagctcttctagtagctcttcttcttccagtagcagttcctcctctagcagttcatcatcttctgtgcatgaaccgaagatggatgctctgatcattcccgtgaccatggaagtgccttgtgactccagggggcagaggatgtggtgggcctttctagcaagcagtatggttactttcttcggcggactcttcatcatcctcctgtggcgtactctgaaatatttgtggacagtttgttgccactgtggtgggaagaccaaggaggctcagaagatcaacaacggcagtagtcaagccgatgggacactgaagccagtcgacgagaaggaggaagcggtggccgccgaggtgggatggatgacttcagtgaaggattgggcgggtgtgatgatcagcgctcagacactgaccggccgggtcctggttgttctcgtgttcgcactatctatcggcgccctggttatctactttatcgatagttccaatcctattgagagctgccagaatttctataaagactttacactgcaaatagacatggcttttaatgtcttcttcctcctttatttcgggctgcgctttatcgcagcaaacgacaaactttggttctggctggaggtgaactctgtggtagactttttcacagtgccgcccgtctttgtgtcggtttatctaaatcgcagttggctgggcctgaggttcctgagggcgctccgactgatccagttctccgaaattctgcaattcctgaacattttaaaaacgtctaattcaataaagctggtgaacctcctgtcaatctttatttcaacctggctaactgcagccggtttcatccacctggtagaaaattctggagacccatgggagaattttcagaataatcaggccctgacctattgggagtgtgtgtacctgctgatggtgactatgtctactgtgggctacggcgatgtgtacgccaagacaacactgggaaggctgttcatggtgtttttcatacttgggggcctggcgatgttcgcctcttatgtccctgaaatcatcgaactgattgggaacagaaagaaatacggtggctcctattctgcagtgtcagggcgcaaacacatcgtagtgtgcgggcacattaccctggaaagtgtcagcaactttctgaaagatttcctccacaaagaccgggacgatgtgaacgtggagatcgtgttccttcacaacatttctcctaacctggagttagaagcactgtttaagcggcacttcactcaggttgagttttaccaaggatctgtcctgaacccacacgatctcgcccgggttaagattgagtctgccgacgcttgtctgatcctggcgaacaagtactgcgccgatccagacgctgaagatgcgagcaatatcatgcgcgtaatcagtattaagaactaccacccaaagatcagaatcatcacccagatgctgcaataccacaacaaggcccacctactaaatattcctagttggaactggaaggagggagatgatgcaatatgcctggccgagctcaaactcggcttcatcgcgcagagctgcctggcccaaggcctgtccacaatgttggcaaacctgttttcaatgaggtcattcatcaaaatagaagaggacacctggcaaaagtactatttagagggtgtgtccaatgagatgtataccgagtatctgagttccgcctttgtcggtttaagctttcctaccgtctgcgagctgtgtttcgtgaagctgaagctcctgatgattgctatcgaatacaaatccgccaacagagaaagtagaatcctaatcaatcctggaaaccatctcaaaattcaagaaggtacactgggtttctttatagcttctgatgctaaagaagtgaaacgcgcctttttttattgcaaggcctgccatgacgacatcaccgatcctaagagaataaaaaaatgcggttgtaaacggctggaggatgaacagccttcaaccctatcaccaaaaaagaaacagcgaaacggcgggatgcggaattcgccgaacacttctccgaagctgatgagacatgacccgctgctgatccctggcaacgaccaaatcgataacatggatagtaacgttaagaaatacgactctacgggaatgttccactggtgcgcccctaaggaaatagaaaaggtcattttgaccaggtcagaagctgcaatgacagtgctgagtggccacgttgtcgtgtgtatcttcggcgatgttagtagcgcccttatcggattgcgcaacctcgtgatgccactccgggcaagcaacttccattatcatgaactaaaacatatcgtctttgtagggtcaatcgagtatttgaagcgggaatgggaaactcttcataattttcccaaggtgtctattcttcccggcacccccctaagcagggccgacctgcgggctgttaacatcaatctttgcgacatgtgcgtcatcctgagcgcgaaccaaaataatattgacgacacatctctgcaagacaaggagtgtattctagcttcgttaaacattaaaagtatgcagttcgatgacagcattggggttcttcaggctaacagtcagggatttaccccgccaggcatggaccggtcttcgcccgacaactcacccgttcatggcatgttgcgccaacctagcattacaactggcgttaatatccctattatcacagaactcgtcaacgacacaaacgtgcaatttcttgatcaggacgatgatgacgaccctgacactgaactctatctgacacagccctttgcctgcgggacagcattcgccgtgagcgttcttgactctctgatgtccgccacatacttcaacgataatatcctcacactgattaggaccctggtgacaggtggagccacaccagagctggaggctcttatagccgaggagaatgccttacggggtggctactcaaccccccagaccctcgccaaccgcgacagatgtcgggtggcccagttagcattactagacggccctttcgccgacctcggagatgggggatgctacggcgacttgttttgtaaggccctaaaaacatacaatatgctctgcttcggaatctataggctgcgcgacgcgcacttatccacccctagccagtgcaccaaaagatacgttattaccaatcctccatacgaatttgaacttgtgcctaccgacctgattttctgtctgatgcagttcgaccacaacgccggacagtcacgggcctctctttcccatagttcacattcttcccagtcttcctctaagaagtcctcttctgtccacagcatcccctccaccgcaaatagacaaaatagaccgaaatcccgggagagccgcgataagcagaagaaggagatggtctataggtag

SEQ ID NO: 200287 - DNA, 3618 bp, Artificial Sequence
  Description of Artificial Sequence: Synthetic coding sequence
atggccaacggcggcggcggcggcggcggcagcagcggcggcggcggaggggggggcggttcgtcactgcggatgagcagcaatattcacgccaaccaccttagtttggatgcttcctcttcaagctctagctcttcctcaagctccagcagttctagtagttccagcagctcatcaagcgttcatgagccaaagatggatgccctcatcatacctgtcacaatggaagtcccctgtgactcacgtggtcagagaatgtggtgggcctttcttgctagtagcatggtgacattctttggcggcctgtttattattcttctatggcggactctgaaatatctttggaccgtgtgctgccactgcggaggtaaaacaaaagaggcgcagaaaatcaataacggcagcagtcaggccgatggcacattgaagcccgtagacgagaaagaggaagccgttgcagctgaagtgggatggatgactagcgtgaaggattgggccggtgtcatgatctccgcgcagaccttaacagggcgagtcttagtagttctggttttcgccctaagcattggtgcactggttatatattttattgacagtagcaatccgatagagtcctgccagaatttttataaggatttcacacttcagatcgatatggcttttaatgtgttctttctactgtatttcggactgcgtttcatcgcagctaatgacaagctttggttctggctggaggtgaactctgtggtcgatttcttcacagtgccccctgtgtttgtttcggtctacttgaacaggtcttggttaggccttagatttctgcgagctctacggcttatacagttctctgagatcctgcaatttctgaacatcctgaaaacctcgaacagcatcaagctggtgaatctactatctatcttcatcagcacttggctgactgccgctggttttatccacctcgtcgagaatagtggggacccttgggaaaattttcaaaacaaccaggcccttacctactgggagtgcgtatatctactgatggtgactatgtcaactgtcgggtacggtgacgtatacgccaagacaaccttgggaaggctttttatggtcttctttatccttgggggtctggccatgtttgcctcttacgtgccagagatcatcgagctcattggcaaccggaagaagtacggagggtcctattccgccgtatcaggaaggaaacacatagtggtctgtggtcacatcaccctggagtccgtctccaactttttaaaagattttctgcataaggatagagacgatgtaaatgtcgagatcgtctttctgcataacatatctccaaacctggagttagaggcgctgttcaaaaggcatttcacccaagtggaattctatcaaggctccgtgctgaaccctcatgatctcgccagggtgaagattgaaagtgcagacgcctgcttaatcctggccaacaagtactgcgcagacccagacgcagaagatgcatcaaacataatgcgagtgatcagcatcaagaactaccatcccaagattaggattatcactcagatgctgcagtaccacaataaagcacacctcctcaatattccttcatggaactggaaagaaggtgatgatgccatctgcctcgcggagctcaaactcgggtttattgcccagtcatgcctggctcaggggctgagtactatgctggccaacctcttcagtatgaggagcttcatcaagatcgaagaggatacttggcagaagtattatctggagggggtgtcaaacgagatgtacaccgagtatctgagttccgcatttgtgggactgtccttcccaactgtatgcgaactgtgttttgtcaagctcaaactcctcatgattgcaatagaatacaagagtgctaatagggagtcccgcatcttgattaatcccgggaaccatttaaagatccaggaaggtacattaggtttcttcatcgctagtgatgcgaaagaggtgaagcgagccttcttctattgtaaggcctgtcatgacgatattactgatcccaagcgtattaagaagtgtgggtgtaaacgcctggaggacgaacagcctagtacactgtcccccaagaaaaagcagaggaacggggggatgcgaaacagtccaaacacaagccccaagctgatgcgacatgatcctctgttgatccctgggaatgatcaaatagacaacatggactccaacgtaaaaaaatacgattcaaccggcatgtttcattggtgtgcaccaaaagaaatcgaaaaagtcattctgacaagatctgaagccgccatgaccgtgctatccggccatgtcgtggtgtgcatttttggcgacgtcagttccgccttgatcggtctccggaatctggtgatgcctctacgtgcatccaactttcactaccatgagctcaagcatattgtctttgttgggtccattgaatatctgaaacgcgaatgggagactctacataattttcccaaggtcagtattctgcctgggactcctcttagtcgcgccgatcttcgcgcagtcaacattaacctttgtgacatgtgtgttattctgtctgcaaaccaaaacaacattgatgacacatccctgcaggacaaagagtgcatcttagctagtcttaacattaagagcatgcagtttgacgacagtattggcgttctacaggccaactcgcagggctttaccccacccggcatggatagatcctcccccgacaactcgcccgtccacggcatgctgcggcagcccagcattaccacaggtgtgaacatccccatcattactgagttagcaaaacccgggaagctgcctctcgtctctgtcaaccaggaaaaaaattctggaacccacattttaatgattacagaactggtaaacgataccaatgtccagttcttggatcaggatgatgatgacgatcccgacaccgagctgtatttgacgcagccattcgcttgcgggacagcttttgctgtgagtgtgcttgactctctcatgtcagccacatatttcaatgacaacattcttactcttataagaaccttggtgaccggtggcgctacaccagagctggaggccctcatcgcggaggaaaacgcgctgcgggggggctactcaaccccccaaaccctagctaatcgagacagatgccgagttgcccaactagccctgctcgacgggccttttgcagatttgggagacggcggatgttatggcgatcttttctgtaaggcactgaaaacatataacatgttgtgtttcgggatctatcgcctccgcgacgcccacctcagcacaccctcacagtgtaccaaacggtacgtgattaccaatcctccctacgagtttgagcttgtacccactgatctgatcttctgcctcatgcagttcgatcataatgcaggccagtcccgggctagcctctctcattcttcacattcatcccaatcgtcctcaaagaagagtagttccgtccactccatcccaagcacagccaacagacagaatagaccaaagtccagagagagtagagacaagcaaaacaggaaagagatggtgtacaggtag

SEQ ID NO: 200288 - DNA, 3678 bp, Artificial Sequence
  Description of Artificial Sequence: Synthetic coding sequence
cccaagatggacgccctgatcatccccgtgaccatggaggtgccctgtgatagccggggccagcggatgtggtgggcattcctcgcatcttcgatggtgacattcttcgggggcctgtttattattctgctgtggcgaactcttaaatatttatggaccgtctgctgtcactgtggcggtaagacaaaagaagctcagaaaatcaataatgggtcaagccaggctgatggtactctcaaacctgtggacgagaaggaggaagctgttgccgctgaagtgggctggatgacttctgtcaaagattgggcgggggttatgatatctgcccagacattgaccggcagggtgctggtcgttttggtctttgccttgtcaatcggtgcgctggtcatttactttattgacagttccaatccaatcgaaagctgtcagaatttctataaggactttactctccagatagacatggcatttaacgtgtttttcctgctgtactttggcctcagatttatcgccgccaatgacaagttgtggttctggctggaggtaaattctgtggtcgattttttcactgtgcctcccgtgttcgtatccgtctacctgaacaggtcgtggcttggactgagattcctgcgcgccttaagattgatacaattctccgaaatcctgcagttcctgaacattctgaaaacgtctaactcgataaagctcgtgaatctgctgagcatcttcattagtacctggttgactgccgccggatttatccacctcgtggaaaacagcggggacccgtgggagaacttccaaaataaccaggctcttacatattgggaatgcgtttaccttctgatggttaccatgtctactgttggatatggcgatgtgtacgccaagacaaccctgggcaggctctttatggtgtttttcatcttggggggactagcaatgtttgcctcatacgttcctgagatcatagagctaatcggcaacaggaagaagtacggcggatcatacagcgctgtatcaggacgcaagcatattgtagtgtgtggacacattaccttggagtccgtctcgaattttctcaaggacttcttgcacaaggatcgagacgacgtcaacgtcgagatcgtgtttctccacaacatatctcccaaccttgagcttgaagcattgtttaagaggcatttcacacaggtagagttctaccagggatccgtgctgaatccacatgatctggccagggtgaagatcgaaagcgctgatgcttgccttattctcgccaataaatattgtgcggaccctgacgccgaagatgcatcaaatatcatgcgcgtgatctccatcaaaaattaccatcctaaaatccgaattatcacccagatgctgcagtatcataacaaggcccatctactgaatatccctagttggaattggaaggaaggtgacgatgccatctgtttagccgaactgaaactggggtttatagcccagtcctgcctcgcccaggggctaagcactatgctcgctaatctctttagcatgcggagtttcatcaaaatagaagaagacacttggcaaaagtactacttagaaggtgtatcaaatgaaatgtatactgaatatctcagcagtgctttcgtaggcctctcattcccaaccgtttgcgaactgtgtttcgtcaaattgaagctcctgatgattgcaatagagtataagtctgctaatagggaatcccgtatactcatcaatcccggtaaccacctcaagatacaggagggtactttgggattctttattgcgagtgatgctaaagaagtgaaaagggcattcttctactgtaaggcttgccacgacgatattaccgaccccaagcggatcaaaaagtgtggatgcaaaaggcccaagatgagcatctataagcgtatgagacgagcctgttgttttgattgtggacgtagcgagagggattgctcttgtatgagcgggagggtgagaggaaatgtggatacccttgaacgagcttttcctttaagttccgtgtcagtcaacgactgtagcacttcctttcgcgcgttcgaggacgaacagcccagtactctgagccccaagaagaagcagcggaacgggggcatgcgtaatagtcccaataccagcccaaagcttatgcgtcatgacccccttctcattccaggaaatgatcagatcgacaatatggattcgaacgtgaagaaatacgactccacaggaatgttccactggtgtgccccaaaggaaatcgagaaagtaattctgactcgcagcgaggccgccatgacagtgctgagtggacatgtcgtggtttgtattttcggggatgtttcgtctgccctcattgggctgaggaacctggttatgcctctgcgtgcctccaacttccattatcatgagctcaagcacatagtgtttgttgggtctattgaatatctgaaacgggagtgggagaccctgcacaacttccctaaggtgtctatactccccggcacccctttgagccgggctgatctccgggcagtaaatatcaacctgtgcgacatgtgtgtgatcctttcagccaaccagaataatattgacgataccagcttgcaagacaaggagtgcattcttgcgtccctaaacatcaagagcatgcagtttgacgatagtattggggttctccaggcaaactcgcaggggttcacaccccccggcatggaccgatcctcacccgataactcccccgtccacgggatgctgagacagccctcgatcactactggtgtgaacataccgattattacagagttggtgaacgataccaatgtgcagttcctagaccaagacgatgacgacgatcctgatacagagctgtatctgacgcagccatttgcttgtggcactgccttcgctgtaagtgtgctagactccttgatgtccgcaacatacttcaacgacaacattttgaccctaatcagaacgctggttacgggtggggcaacgcccgagcttgaggccttgattgcggaggagaacgctcttaggggcggctactccacaccccagaccctcgctaatcgggatcgatgtcgggtggcccagctcgccctcctggacggtcccttcgcagacctcggcgacggaggatgttatggtgatttattctgtaaagcattgaagacttacaacatgctgtgctttggaatctaccgactgagggacgcgcacttgtctaccccaagccagtgcacgaagcgatacgtgattacgaaccccccctacgagttcgagctggtcccaaccgatctaatcttctgtctgatgcagtttgatcacaacgccggacaatcccgagcctcgctgagccattcatcccatagcagccagtcttcctctaagaaatcctctagcgttcactcgattccttctacagccaacaggcaaaacagaccgaagtcccgggagtccagagataaacagaatgctactcgcatgaaccgcatgggccaggagaaaaaatggttcacggacgagcctgacaacgcctatcccagaaatattcagataaagcctatgtccacacacatggcgaaccaaataaaccagtacaaatctacctctagtctaatccccccaattagagaagttgaggacgagtgctag

SEQ ID NO: 200289 - DNA, 3660 bp, Artificial Sequence
  Description of Artificial Sequence: Synthetic coding sequence
atggccaacggcggcggcggcggcggcggcagcagcggcggcggcggtgggggggggggctcatctctgagaatgtcgtcgaacatacacgccaatcacttaagtctggacgcatcttcctccagctccagctccagctcctcaagttcgagttctagcagtagcagttcaagttcctctgttcacgaaccaaagatggatgccctgatcattccagtgaccatggaggtcccatgcgactccaggggccaacgaatgtggtgggccttcctcgccagttccatggtaacttttttcggcgggctgtttatcatcctgctctggaggaccctgaagtacctgtggaccgtttgctgccactgcggcggaaagacaaaggaggctcaaaagatcaataacgggtccagtcaagcagacgggaccctgaagcccgtggacgagaaagaggaggccgtcgccgcagaggtgggctggatgaccagcgtgaaagactgggctggcgttatgatcagcgctcaaactcttaccggcagggtgctggtggtactggtgtttgctcttagcatcggcgccctggtcatctacttcatagactctagcaatcccattgagtcctgtcagaacttctacaaagacttcactttgcagatcgatatggctttcaacgtcttttttttgctgtactttggattgagatttattgcagcaaacgacaaattatggttctggctggaagtgaactctgtggtcgactttttcaccgtgccccccgtgtttgtgtccgtttacctgaatcgtagctggcttggcttaaggtttctccgcgcactgaggctcatacaattttcagagattttgcagtttctgaacattctcaagacatccaatagcattaagctggttaacttgctgtcaatctttatctcaacctggctgaccgccgccggtttcatccacttggtggaaaactctggcgatccatgggagaacttccaaaataaccaggcacttacgtactgggaatgtgtgtacctgcttatggtcacgatgtccacagttggctacggagacgtctacgccaagaccactctcggccggctgttcatggtgttcttcatcctaggtggtctggctatgtttgcgtcctatgtacccgaaattatcgaacttatcggcaatagaaaaaagtatggcggttcttactccgctgtcagcggccgtaagcacatcgtggtgtgtggccacatcaccctggaatccgttagcaacttcctcaaggatttcctgcataaagaccgtgacgacgtgaacgttgagattgtatttctccacaatatttccccaaacctggagttagaagctctgttcaaacgtcatttcacccaggtggagttttaccaggggtctgtgctcaatcctcatgatctcgcgagagtgaagatagaaagcgcagacgcttgtctcattttggctaataagtactgtgcggaccccgatgctgaagatgcaagtaacattatgcgcgtgatcagtattaagaactaccacccaaagatccgcatcatcacacagatgcttcagtatcacaacaaggctcatctcctcaacatcccctcctggaactggaaagaaggcgacgacgcgatctgcctggcggaactgaagcttggcttcatagcgcaaagctgtctggctcaggggctgagcaccatgttagctaatttattctctatgcgttccttcatcaaaattgaggaagatacgtggcagaagtactacttagagggggtgtccaatgagatgtacaccgagtatctcagttcagcctttgtaggtctcagtttccctacagtgtgcgaactatgttttgtgaagctgaaactccttatgattgcaattgaatacaagtcagccaacagggagtctcgcattctgatcaacccagggaatcacttgaagatccaggagggcaccctgggtttttttattgcatctgatgcaaaagaagttaagagagctttcttctattgtaaagcctgtcatgatgatatcactgatccaaaaaggatcaagaaatgtgggtgcaagagactcgaagacgaacagccatcaactctctctcccaagaaaaaacagcggaatggggggatgcggaacagccctaataccagcccgaaactgatgcggcacgatccactcttgatacccggaaacgatcaaattgacaatatggattcaaacgtgaagaagtacgattcaactgggatgttccattggtgcgccccaaaagaaatcgagaaggtgatactggtgacaggctggatgccttaccttgggccgagggttctaatgacttgtctggatataggcgtggtgtgcatgcctaccgatatccagtccaccagccccgcttcgatcaaaaaattcaaggagacccggtctgaggctgctatgaccgtcctgagtggtcacgtggttgtctgtatctttggcgacgtgagctcagcactcataggactcaggaacctagtgatgccactgcgcgctagcaattttcactaccatgagctcaaacatatcgtgtttgtcggcagcatcgagtacctgaaaagggaatgggagaccctgcacaacttccctaaagtctcaatcctcccaggcacccctctttctagagcagatctgagggccgtgaatatcaatctctgcgacatgtgtgtgatactcagcgccaatcaaaacaacatcgatgacacatctttacaggacaaggaatgtatcctggcgtctctcaacatcaagagcatgcagttcgatgacagcattggcgttctgcaggccaattcccagggatttaccccacctggcatggaccggtctagtcccgataacagtccggtacatgggatgctgagacaaccgagcataacgactggagttaacatccccataatcaccgagctggtcaatgacaccaacgtacagtttctcgaccaggacgatgatgatgaccccgacacggagttgtacctgacgcaaccttttgcctgcggcaccgcctttgcggtttctgtgctggactctttgatgtctgctacttactttaacgataacattctcaccctcattaggacactggtgaccgggggcgctacgccagaactcgaggctttgatcgccgaggagaatgcactgcgcggaggatactccacaccccagacgttagccaatagagacagatgtcgggtggcacaattggcactcctggacgggccattcgctgatctcggagatgggggttgctacggcgacctgttttgcaaggcactgaagacgtataatatgctctgcttcggaatataccgactgagagatgcccatctaagcactccctctcagtgcactaaaagatacgtgatcactaacccaccatatgaattcgaattggtaccaaccgacctgatattctgcctgatgcagttcgaccataatgccggccagtctcgagcaagcctctcacatagttcacatagctcccagagcagttcaaagaaaagttcctcagtacactccattccctcaacagccaatagacagaatagacctaagtccagagaatcacgagacaagcagaaatatgttcaggaggagcgactctag

SEQ ID NO: 200290 - DNA, 3723 bp, Artificial Sequence
  Description of Artificial Sequence: Synthetic coding sequence
atggccaacggcggcggcggcggcggcggcagcagcggcggcggcggggggggtggcggttcatctctcagaatgagttcaaatatacatgccaaccacctgtctttagacgcgtcttcctcatcctctagttcaagtagctcctcgagcagtagttcctcatcatcttcttcaagttccgtgcatgagccaaaaatggatgctttaattatcccagtcacaatggaagtgccctgtgactctaggggacaacggatgtggtgggcattcctggcttccagcatggtcaccttttttggcggtttgttcataatcttactgtggagaacactaaaatacctctggacggtttgttgtcactgcggaggaaaaacgaaggaagctcagaagattaacaatggcagtagccaggcagacgggacactcaaacccgtagatgaaaaggaggaagctgtcgccgcagaggtgggctggatgaccagtgtgaaagactgggctggcgtgatgatatccgcccagaccctgacagggcgcgtactagtggtgctcgtctttgcactttcaatcggggctcttgtgatctactttatcgacagcagcaatccaatagagtcatgccagaacttctataaagacttcaccttgcaaatcgatatggctttcaacgtcttttttctgctgtactttgggctgcggtttattgctgcaaacgacaaactgtggttctggctcgaggtgaactctgtggttgacttttttacagtgccacctgttttcgtctcagtgtacctgaaccggtcctggttagggcttaggttcctccgggcactgcggctcattcagttttcagagatccttcaatttctgaacattttgaaaaccagtaatagtattaagttggttaacctcctgtcaatcttcatcagtacctggctcacagcagccgggttcattcacctcgtggagaatagtggggacccttgggaaaacttccaaaacaaccaggccctgacttattgggaatgcgtgtatcttctaatggtcacaatgtccacagtgggttacggtgacgtttatgcaaagaccacgcttgggcgtctctttatggtgttttttatcctgggcgggctcgctatgtttgcctcttacgtgccggagattatcgagcttatcggcaatcgaaagaagtacggtggtagctattctgctgtttctggccgcaagcacatcgtcgtgtgcgggcatatcaccctggaaagcgtatccaacttcctgaaggacttcttgcacaaagacagagatgatgtgaacgtggaaatcgtttttctgcataacatatctcctaacctagaactggaggcactctttaaaagacatttcactcaggtggagttttaccaaggctcggtgttgaacccacatgacctggcccgcgtaaaaattgagtccgcagacgcctgcctcatcctggccaacaagtactgcgccgaccccgacgccgaggatgcaagtaatatcatgcgggtgatctcaatcaagaattaccatcctaagatccgcatcattacccagatgctacagtatcacaacaaagcgcacctgctgaatattccttcttggaactggaaagagggagacgacgccatttgcctggccgaactgaagcttggctttatagctcagagttgcctcgcacaaggcctgtcaaccatgctagcgaacctcttctcgatgaggtcatttataaagatcgaggaggacacatggcagaaatattacctggaaggcgtatctaatgaaatgtacaccgagtacctgtcgagcgctttcgttggtctgtcatttcctacagtatgcgagctctgcttcgtaaaacttaaactcctgatgattgctattgagtataagagcgccaatagagagtcccgggggaggctaagtatcctcatcaaccctggaaatcacctgaagattcaagagggtaccttaggattctttatcgcctccgacgccaaggaggtgaagagagcgtttttctattgtaaggcctgtcacgatgatatcacggacccgaaaagaattaagaaatgtggctgcaaaagacccaaaatgtctatctacaagcgtatgaggagggcctgttgctttgattgtggcaggtctgaacgagattgttcatgtatgtcagggagggttagaggaaacgtggatacattagagcgcgcctttcctctttcaagcgtgtcggttaacgactgttccaccagtttcagagccttcgaggatgaacagccatccacactatctcccaagaagaagcaacggaacggcggcatgagaaactcccccaacacttcccctaaactgatgagacacgatccgctgttaatccctgggaacgatcagattgacaacatggactctaacgttaagaaatacgatagcacagggatgttccattggtgcgctcccaaagagatagagaaggtgatactcacacggtcagaggcggcgatgactgttctcagtggacacgtcgtggtgtgcatcttcggtgatgtctctagcgcactgattggcctgaggaatctcgtgatgcccttgcgcgcatcgaatttccattatcacgagctcaagcacattgtttttgtgggctcaattgagtatctcaaacgcgagtgggaaactctgcataatttccccaaggttagtatcctgccaggaacccccctctcaagggccgatctgcgggcagttaatatcaacctctgtgacatgtgcgttatcttgtccgccaatcagaacaatatcgacgacactagcctgcaggataaagaatgcatcctcgcctctctgaatatcaaatccatgcagtttgatgatagcatcggcgtgttgcaggcgaattcccaagggttcacgccaccaggcatggatagatctagccccgacaactcacctgtacacggaatgctgcggcaaccgagcatcacaactggagtcaacatcccaattatcactgagctcgtgaatgatacaaacgtgcagttccttgaccaggacgatgatgacgaccccgacaccgaactgtatctgacccagcctttcgcttgcggcactgcatttgcagtgtccgtgctggactctctgatgtctgcaacatacttcaatgataatattctgaccctgattcgaactttagtgacagggggcgccacacccgaactggaagccttgatcgctgaggaaaatgctttacgcggcggctactctacgccccagactttggcaaacagggataggtgtagagtggcccagctcgctttattagacgggccctttgcggacctgggagatggaggctgttatggcgatctcttctgcaaggccctgaaaacatacaatatgctgtgcttcggaatatatagactgcgggatgcacatctctccactccaagccagtgcacaaaaaggtatgtgatcactaatcccccctacgaatttgagctagtgccaacagacctcattttttgtcttatgcagttcgaccacaacgcaggccaatccagagcctcactgtctcactcttctcattctagccagtcaagtagcaagaagtcctcttcggttcactcaatcccgtccaccgccaatagacagaaccgcccaaaatcccgcgaatcaagagacaagcagaagtatgtgcaagaggaacgattgtag

SEQ ID NO: 200291 - DNA, 2970 bp, Artificial Sequence
  Description of Artificial Sequence: Synthetic coding sequence
atggccttcaacgtgttcttcctgctgtacttcggcctgcggttcatagcggcaaatgacaaactgtggttttggcttgaagtcaactccgttgtggatttctttaccgtcccgccagttttcgtttccgtctatctgaatcgcagttggctcggtttacgttttctccgggctctccggctgatccagttcagtgagattttacaattcctgaacatcctgaagacgtctaatagcatcaaattggtcaatcttctgagtatattcatcagcacatggctcaccgccgccggcttcatccacttagtggagaactcaggggacccgtgggaaaatttccaaaataaccaagctttaacttattgggaatgcgtctatttgttgatggtgactatgagtacggttggatatggtgacgtttacgcaaaaacgacgctgggtcggctctttatggtcttttttattcttggcggcttggccatgttcgcgagctatgtgcctgagatcattgaactaatcggcaatcggaaaaagtatgggggatcatattctgcggtgagcgggcgcaagcatatcgtcgtgtgtggccacatcacacttgaatccgtctccaattttctcaaagactttctccacaaggatagggacgatgttaatgtggagattgtctttcttcacaacattagcccaaatcttgaacttgaagccctgttcaagagacactttacccaggtcgagttttaccagggcagcgtgcttaatccgcatgatcttgccagggtgaagatcgaaagcgccgacgcttgcctgattctcgccaataaatactgtgcagaccctgacgccgaagacgccagtaatattatgagagtcatcagtattaagaattaccatccaaaaattcgaatcatcacacaaatgcttcaatatcataataaagcacacttactaaacatccctagttggaactggaaagaaggcgatgatgcaatttgtcttgccgaactgaagctagggttcatcgcacagtcctgcttagcccaaggcttaagtactatgctggcaaacctcttctccatgaggtcctttattaagatagaagaggatacctggcagaagtactacctggaaggcgtgtccaacgagatgtacactgagtatctgtcatctgcctttgtcggcctctccttcccgaccgtctgtgagctgtgcttcgttaagctcaagctgcttatgattgcaatcgaatataaatcagctaatagggaaagcagaattttgatcaatccagggaaccacttaaagattcaggaaggcacactgggattctttattgccagcgatgctaaggaggtgaaacgtgcctttttttattgtaaggcatgtcatgatgacataacggaccctaaaaggattaagaaatgcggatgtaaacgactgaaggtggccgcccggtccaggtatagcaaagacccattcgagttcaagaaagaaacacctaatagcagactggtgacagagcctgtcgaggatgagcagcccagtacgttatcaccaaaaaagaagcagagaaacggcggcatgcgtaactctcccaacacctctcctaaattgatgaggcatgacccattacttatccctggaaatgatcagatcgacaacatggactctaatgtaaagaagtacgattctacagggatgtttcattggtgcgctcccaaggaaatcgaaaaggtcattctgacgcggtccgaggctgctatgacagtgcttagcgggcacgtggtggtgtgcatcttcggggatgtttcttcagctttaatcgggctcaggaacctggttatgccactacgtgcctccaattttcattaccatgagctgaagcacatcgtatttgtgggctccattgagtatttgaaacgcgaatgggagactctacacaacttccctaaggtttccattcttcccggcacccccctgagtcgggctgatctacgcgccgtcaacatcaacctctgtgacatgtgtgttatcttgagcgcaaaccagaataatatcgatgacacgagtcttcaggacaaagaatgcatcctggcctctctcaacatcaaatcaatgcaattcgatgactcaattggcgtgctgcaagccaatagccagggctttaccccaccaggcatggaccgctccagccccgataacagtcccgttcacgggatgctccgtcagccctctataacaacgggtgtcaacattccaatcatcacggagctggtaaacgataccaatgttcaattcctcgatcaggacgatgacgatgatcctgataccgagctttatctcacgcaacccttcgcatgcggcacagcctttgctgttagcgtgctcgatagcttaatgagcgccacttactttaacgacaatattcttacccttattcgaaccctcgtaaccggaggcgctacgcccgaacttgaagctctcatcgccgaagaaaatgctctaaggggcggctattctacccctcagaccctcgcaaatcgcgaccgttgtcgagttgctcagctagccctgctcgacgggccctttgctgacttgggtgacggaggctgttatggcgacctcttctgtaaggctctcaaaacttacaacatgctgtgtttcggtatttacaggctgcgggacgcccacttgtcaaccccttcacagtgcacaaagagatatgtgattacgaacccaccatatgagttcgaactggtccctaccgacctgatcttctgtcttatgcaattcgaccataacgccggccagagccgagcgtccctaagtcactcatcccactcatctcaatcaagtagtaaaaagtcctcatccgtccacagcattccctcaacggctaacaggcagaaccgccctaagtcccgagagagtcgcgacaaacaaaagtatgtccaagaggaacggctttag

SEQ ID NO: 200292 - DNA, 543 bp, Artificial Sequence
  Description of Artificial Sequence: Synthetic coding sequence
tgaaagatccggatcatcacccagatgctgcagtaccacaacaaggcgcacttactcaacattcctagctggaattggaaggagggtgacgatgctatatgcttagccgaattgaagctgggcttcatagcacagtcctgcttagcccagggcctgagcacgatgctcgcaaacctattttctatgcggagctttattaagatagaagaggatacatggcagaagtattatcttgaaggggtctcaaatgaaatgtacacggaatatttgagcagtgctttcgtgggactgtcctttcccacggtgtgcgaactgtgctttgttaaacttaaactgctgatgattgccattgagtacaagagcgccaacagagaatctcgtattctgataaacccaggaaaccatctcaagattcaggaaggaactttggggttctttattgcctctgacgctaaggaggtgaagcggcctcctcaactttgcctgccccttgccgcccagaaacggtgttttcaatccgataaactggacatctttatctag

SEQ ID NO: 200293 - DNA, 2661 bp, Artificial Sequence
  Description of Artificial Sequence: Synthetic coding sequence
tgaaacagcggcgacccctgggagaacttccagaacaaccaggccctgacgtattgggagtgtgtgtatcttcttatggtcaccatgagcacggttgggtatggtgatgtgtacgctaagactaccctgggaaggctgtttatggtgttttttattctcggggggctggcgatgttcgcttcttacgtgcccgagattattgagcttatcggcaacagaaaaaagtatggcggcagttatagtgccgtatcaggtcgcaaacatattgttgtctgcggtcatattacactcgaatctgtttctaatttcctgaaagactttctgcacaaggatagggacgacgtgaatgtggagattgttttcctccacaatatcagccctaacctcgaactggaagcgctcttcaagaggcacttcacccaggtcgagttctatcaggggtctgtgctgaatcctcacgatctggctagggtgaagattgaatctgcagacgcctgtctcattctcgcaaacaagtactgtgctgatccagatgctgaggatgcctctaatatcatgcgggttatctctatcaaaaactatcatcctaagatcagaatcattactcagatgctgcagtatcacaataaggcccacttactcaacatcccaagctggaactggaaggagggagacgacgctatttgcctggcagaactcaaactgggatttatagctcagtcctgtttggcacagggattaagcactatgttagctaacctcttctctatgcgttctttcatcaaaatcgaggaagatacctggcagaagtactacttagagggggtgtccaatgagatgtacactgagtacctctcctctgcattcgtgggattaagctttcccacagtgtgcgaactctgctttgtcaaactgaaacttctaatgattgctatagagtataaaagtgctaatcgggagagtagaatattaatcaatccaggaaatcacctgaaaattcaggagggaacgctcggattctttatagcgtccgatgccaaggaggtgaagcgggccttcttttactgcaaagcctgccacgacgatatcacagatccaaagcgtatcaaaaagtgtggttgtaagcgactgaaagtcgccgcccgtagtcgatatagtaaagacccatttgagttcaagaaagagaccccaaactcccgtttggttactgaaccggttgaggacgagcagccaagcaccttgagtccaaagaaaaaacaacggaacgggggcatgagaaatagtccgaacacatctcccaagctaatgcggcacgatccgctgttgattccaggtaacgaccaaattgataatatggactctaatgtgaagaagtatgattcgacgggtatgttccactggtgtgccccaaaagagattgagaaggtgatcttaactcggtctgaggcagccatgacagtgctgtctggacatgtggtggtttgtatctttggtgatgtgtcatctgccttaatcggcctgcggaatttagtgatgcctctcagggcctccaacttccactatcacgagctgaagcacatcgtgttcgttggatcgatagagtacttgaagcgtgaatgggagacactccataatttcccaaaagtgtctattttacccggaacgcccctgagccgcgcggacttgcgtgccgtaaacataaatctgtgcgacatgtgtgtgatactgagcgccaatcagaacaacatcgatgatacatccttgcaagataaggaatgcatacttgcttccctgaacatcaaatctatgcagtttgatgatagtatcggggtgctgcaggccaattcacaagggttcactcctcccggtatggaccgctcttctccagacaatagcccagtccatggaatgctgcgtcagccgtcaattaccacaggcgtaaacattccgatcatcactgaattagtcaacgatacaaacgtccagtttctagatcaggacgatgatgacgatcctgacacagaactttacctgacgcagccttttgcctgtgggacagcatttgcggtctccgtactggactctcttatgtcggctacatacttcaacgataacattctcactctgatccgcaccttggtcactggcggagccacaccagaactggaggccttgattgcagaggaaaacgccttgcgaggagggtattcgacaccacagaccctggctaatcgggaccggtgcagggtggctcagctagctctgcttgacgggccttttgccgatctgggagatggtggatgctacggcgatctgttctgtaaagctctgaagacatacaacatgctgtgctttggaatttatcgccttagagacgcacatctctcgacaccatcccaatgcacaaaacgttatgtgataaccaacccaccctacgaatttgagctagtgcctacagatctcattttttgtcttatgcaatttgatcataacgcaggccagagcagagcttctctctcccactccagtcattcttcacagagctcctccaagaagagttcttctgtccatagtatccccagcactgccaatagacaaaatcggccgaaaagcagagagtccagggataagcagaaatatgttcaggaagaacggctctag

SEQ ID NO: 200294 - DNA, 795 bp, Artificial Sequence
  Description of Artificial Sequence: Synthetic coding sequence
tgagtgatcagcatcaagaactaccaccccaagatccggatcatcactcagatgcttcagtaccacaataaggcccacctgctgaacataccaagttggaactggaaagaaggagatgacgcgatttgtctcgctgagctgaagctgggattcatcgcccagtcgtgtctggcccaaggactcagtaccatgctcgcaaacctgttctcaatgagaagctttattaaaattgaggaagatacctggcagaaatattaccttgagggagttagcaacgagatgtacacagagtatctgtcctctgccttcgtggggctgtcattccccacagtgtgcgaactttgctttgtcaaacttaagctgctgatgatagccattgaatacaaatctgccaatcgcgagtcacgcattctgatcaaccctggaaaccacctgaagatccaggaaggaacgctcggattcttcatcgcttcagacgccaaagaggtgaagagagcctttttctactgtaaggcatgccacgacgacatcaccgaccccaagaggatcaagaaatgtggttgtaagcggctcgctggatcccaggatacacaccccgacagcttctaccatcaagccgttaatgccagctcctacctgcacgggggcggccagatgtggccagttagctcgagtagcagcatccttctgcactacttacgacgacagatgcccggccccgcaagactgcccctcgagcttagttgtcaaggatcagcactgagcccaaatcccgacctgtactgcatgaagtag

SEQ ID NO: 200295 - DNA, 3630 bp, Artificial Sequence
  Description of Artificial Sequence: Synthetic coding sequence
agcaacatccacgccaaccacctgagcctggacgccagcagcagcagttcttctagcagctcaagctctagctcatcctctagcagctcctcaagctcatccgtgcatgaacccaaaatggatgctctgatcatcccggtgacaatggaagtgccttgtgacagccgaggtcagaggatgtggtgggcctttcttgcctctagtatggtcacattctttggcgggctgtttatcatcctcctgtggaggacccttaagtatttgtggacagtctgctgccactgtggcggcaaaactaaagaggctcaaaagatcaataacggcagctcccaagcggatgggacactgaagccagtcgacgagaaggaggaagcagtggctgctgaagtggggtggatgacttctgtaaaggattgggccggcgttatgattagcgctcagactctgacaggtcgggtgctggtcgttttggtttttgcactctctatcggcgccctggtcatatatttcatcgatagttcaaaccccatcgaaagttgtcagaatttttacaaagacttcaccctccagattgacatggcttttaatgtgttcttcctactctatttcggcctccgctttatcgctgcaaacgacaagttatggttctggcttgaagtgaactcggtcgttgattttttcacagtgccacccgtctttgtctcagtgtacctcaacagatcctggctagggctgcgttttttacgcgccctgcggttaattcaattctctgagatcctgcagtttctcaacattttgaagacctctaactccattaagctggtaaatctcttgtccatcttcatctcaacctggctcacagccgcgggtttcattcacctggtcgagaactctggagacccgtgggaaaacttccagaacaatcaggcactgacatattgggagtgcgtctacctgctgatggtgacgatgagtaccgtgggctatggggatgtttatgccaaaactaccttgggacgtctctttatggtgttctttattttaggcgggcttgccatgttcgcctcttatgttcctgagatcatcgagctgatcggaaacaggaagaaatacgggggctcttattcagccgtgtccgggcggaaacacatcgtggtgtgcggccacataacgctcgagtctgtgagtaatttcctgaaggacttccttcataaggatcgcgacgatgtgaacgtggagatcgtgttcctccacaacattagtccgaaccttgaattagaggcgctgttcaagaggcattttacccaggtggagttctatcaggggtctgtgttgaatccccacgacttagctcgagtgaagatcgaatccgccgatgcatgtctaatactcgcaaacaagtattgtgcagatcccgacgccgaagatgcttctaatatcatgcgcgtcataagtatcaagaactaccacccgaaaatacgtattataacccaaatgctccagtaccacaataaggctcacctgctgaatataccctcatggaactggaaggagggcgacgacgcaatatgtctcgcggagctcaaactgggatttattgcccaatcgtgtctggcccaaggcctctctaccatgttagccaacttgttctctatgcgctccttcatcaagatcgaggaagacacctggcagaaatactaccttgagggcgtctccaacgagatgtacacagaatacctcagctccgccttcgtggggctgtccttccctactgtgtgcgagctgtgttttgtgaagctaaagttgctcatgatagcaatcgagtacaagagtgctaatcgcgagtcacgcattctcattaaccctggaaaccatctaaagatccaggagggcacattgggattttttatagcctctgatgccaaagaagtaaaaagagctttcttctactgtaaagcctgtcacgacgatatcaccgaccccaaaaggattaaaaagtgcggatgcaaaagaccaaagatgagtatatacaagaggatgcggagagcatgctgcttcgattgtgggagaagcgagagggactgcagttgtatgtcaggcagagttcgagggaatgtggacacccttgaacgggcctttccactaagctccgtctccgtgaacgactgttctacaagcttcagagcattcgaagacgaacaaccttccacactcagccccaagaaaaagcagcggaacggcggtatgcggaattctcccaacacaagccctaaactaatgcgacacgatcctctgttgatcccaggcaacgaccagatcgataatatggactccaatgttaagaaatatgacagtacaggcatgtttcactggtgtgcaccaaaagagatagagaaggtgattctgactcggtcagaggccgccatgacagtgctcagcggccatgtagtggtttgtatctttggagatgtgtcatcagctctgatcggtctaaggaacctagtgatgccgctgagggctagcaacttccactatcacgaactgaaacacattgtgtttgtcggaagtattgagtatttgaagcgcgagtgggagaccctgcacaactttcccaaggtcagtattctgcctggcactcctctcagcagagcagacctcagagcggtgaacatcaacctctgcgatatgtgcgtcatcctttctgccaaccaaaacaatattgatgacacctctctccaggataaagaatgcatactggcatctctaaacataaagtctatgcagttcgacgacagtattggggtcctccaggctaacagccagggcttcaccccccccggtatggacaggagttccccagataactctccagtgcatggaatgttacgtcaaccaagcattaccaccggggttaatattcctatcataacagagctcgtgaacgacaccaacgtccagtttttggatcaggacgacgacgatgatccagataccgagttgtacctaacccagcctttcgcgtgtggcactgccttcgctgtctcggttcttgacagcctcatgtctgccacctattttaatgacaacattctgacactcattagaactcttgtcactggaggcgcaacccccgagctggaggctctgatagcggaagagaacgctctccgaggaggatattccactccacagacattagctaatcgggataggtgccgcgtcgcccaactggcgctccttgatgggccctttgctgatcttggggatggaggatgttacggagatctgttttgtaaggcgctgaaaacctacaacatgttatgtttcggcatctacagacttcgtgacgcacatttgtctaccccctcacagtgcacaaaacgctacgtaataaccaatccaccctacgaatttgaactggtgcccactgacctgattttttgcctgatgcagttcgaccacaatgccggccaatctcgcgctagcctgagccatagcagccacagctctcagtcctcctctaagaaatcttctagtgtgcacagcatcccatctacggccaaccgccagaatagacctaaatctagggagagcagggacaaacagaagaaggaaatggtgtaccggtag

SEQ ID NO: 200296 - DNA, 576 bp, Artificial Sequence
  Description of Artificial Sequence: Synthetic coding sequence
atggtgaagaagctggtgatggcccagaagcggggcgagacccgggcgttatgccttggggttactatggtggtgtgcgccgtgataacatactacatccttgtgaccaccgtgctgcccctttatcaaaagtcagtctggactcaggagtctaaatgtcacctgatcgaaacgaacattcgcgaccaggaagagttgaaagggaagaaggttccgcaatacccgtgtctctgggtgaatgtgagtgcggccggacgctgggcagtgttgtatcatacagaggacactcgtgatcaaaatcagcaatgctcctatatacccggcagtgtggacaactaccaaactgctcgggcagacgtggagaaggttcgcgccaagttccaggagcagcaggtcttttactgttttagtgctcctcgcggtaatgagacatccgtattgttccaaagactgtacggaccgcaagcactcctattttccctgttctggccaactttccttctcactggcggcttactcattattgctatggtgaaatctaaccagtacctgtctatcctcgccgcacaaaagtag

SEQ ID NO: 200297 - DNA, 393 bp, Artificial Sequence
  Description of Artificial Sequence: Synthetic coding sequence
atggtgaagaagctggtgatggcccagaagcggggcgagacccgggctttgtgcctgggtgtgaccatggtggtatgtgcggtgatcacctattacattttagtgactacagtcctgcccctgtaccagaagagcgtttggactcaagaatccaagtgtcacctcatcgagacaaacattcgcgaccaggaggagctgaagggtaagaaggtgccacagtatccgtgcctctgggttaatgttagcgcagccgggcgatgggctgtcctctaccacacagaagatactagagaccaaaatcagcaggttttgaactggagggatggtgatacaagcttgtatccatgccaagtctgtgagccggtgcccaattgtccgtgtcctcgggggtag

SEQ ID NO: 200298 - DNA, 633 bp, Artificial Sequence
  Description of Artificial Sequence: Synthetic coding sequence
atggccaagctgcgggtggcctacgagtacaccgaggccgaggacaaatctattaggctcgggctgtttttgatcatcagcggagttgttagcctgttcatctttggcttttgctggttgtcccctgccttacaggatctccaagccaccgaagcaaactgtaccgtgctctcggtccaacagataggagaggtattcgagtgcacgttcacttgcggcgctgactgtcgcggaacatcacagtacccatgcgtccaggtgtacgtgaacaattccgaaagcaattcccgggccctcttacatagcgatgagcaccaattgctgaccaacccaaaatgctcttatatacctccctgcaaacgggaaaaccagaaaaacctggagagcgttatgaactggcagcagtactggaaagatgagattggctcccagccattcacctgctacttcaaccagcaccagcgcccagacgacgtgctgcttcatcgtacccacgatgaaatagtcctgctacactgtttcctgtggcctctggtgacctttgtggtgggtgtcctgatcgtggtactgacaatttgtgctaaaagcctggccgtgaaggctgaggctatgaagaaaagaaaattctcatag

SEQ ID NO: 200299 - DNA, 2259 bp, Artificial Sequence
  Description of Artificial Sequence: Synthetic coding sequence
atgaagcccgccgagcacgccaccatgttcctgatcgtgctgggctgtcttatcctcgctgtgttgactacattcaaggaatatgaaaccgtatccggagattggctgctccttctggagacctttgccatctttatctttggtgccgagtttgccctcaggatttgggctgctggctgttgttgccgctacaaggggtggcggggccgtctgaaatttgcaaggaaacctctgtgcatgctggacatcttcgttctgatcgcgtcagtcccagtggtggccgtgggcaatcagggtaacgtccttgccacttccctccgcagtcttcggttccttcagatattgcgcatgctcaggatggacaggcggggcgggacttggaagctgttgggaagcgccatctgtgcgcattccaaggagctaattactgcatggtacattgggttcttaaccctcatactttcgagctttttggtgtatttggtcgagaaagacgtccctgaggtcgacgcccagggcgaagagatgaaagaagagttcgaaacttacgccgacgctctgtggtggggcctgataactttagctacaatcgggtacggagataagacacccaaaacctgggaagggcgcttaatcgcggctaccttttcgctgattggagtctccttttttgcactgcccgccgggattctgggatccgggctcgcattaaaggtccaggagcagcaccggcaaaaacatttcgaaaaacgccgaaagcccgccgctgaactgatccaagcggcatggcgctattacgcaactaatccgaatcggatcgacctggtcgccacctggagattttacgaatccgtcgtgagcttccccttcttccgcaaagagcagcttgaagcagcgagcagccagaaactcgggctactggacagagtccggctaagtaaccctcggggatcaaataccaaggggaagctatttacacccttgaatgtagatgctatcgaagaaagcccatcaaaggagccgaagcccgtcgggttgaacaacaaggaacggtttagaaccgcattcagaatgaaggcgtacgccttctggcagagttctgaggacgccggcaccggcgatccgatggccgaggataggggatacggaaatgatttcccaatcgaggatatgattcccaccttgaaggccgcaataagagccgtcagaatactgcagttccgactctataagaagaaatttaaagaaactttgaggccatacgacgtgaaggatgtgatagaacagtacagcgccggccatctggatatgctgtcacgtatcaaatatctgcaaacacgcattgacatgatatttacacccggtcctccatcaacccctaagcataagaaatcccagaaaggttcggccttcacctttccctctcaacagagccctagaaacgaaccctacgtggcccgcccctctacctccgaaatcgaggaccagtctatgatgggcaagttcgtcaaagtggagaggcaggtgcaggatatggggaagaagcttgactttctggtcgacatgcatatgcaacacatggagaggctccaggtgcaggtgacagagtactaccccacaaaagggacctcgtctccagctgaggctgaaaaaaaagaggataaccggtatagcgacctgaaaactattatctgtaattattctgaaaccgggccacccgagccaccatacagcttccatcaggtgaccatcgataaggtttccccctacggattcttcgctcatgatccggtgaacttgcctcgtgggggaccatctagcgggaaagttcaagcaacccctccctctagcgcgacaacatacgtggagcgccctacggtcttacccatacttaccctgttagactcccgagtgtcatgtcacagtcaagccgacctgcaggggccatattccgaccgcattagcccacggcaacggagaagtatcaccagagactcagatacccccctgtccttaatgagcgtaaaccacgaggaactggaacggtcaccatctggattcagtattagtcaagatcgggacgactacgtattcggtcctaacggtggatctagttggatgcgggagaaaaggtacttggcggagggggaaacggatacagatactgaccccttcactccttccggaagcatgcctctctccagcactggcgatggaatcagcgatagcgtgtggactccaagtaacaaacccatttag

SEQ ID NO: 200300 - DNA, 1434 bp, Artificial Sequence
  Description of Artificial Sequence: Synthetic coding sequence
atgaccggccagagcctgtgggacgtgagcgaggccaacgtggaggatggagaaatccgaattaatgtgggcggctttaaaagaagattacggtcccacacgctcctgaggtttcctgagacccggcttggcaggctcctcctctgccattctagagaggccatattagagctgtgtgatgactatgatgacgtccagcgtgaattttactttgatagaaatccggagttgttcccttatgtcctgcacttctaccatactggcaagcttcatgtgatggcggagctctgtgttttttctttttcccaggagatagaatactggggaataaatgagttctttattgattcttgctgctcgtacagctatcacgggcgcaaggtggaaccagagcaagaaaagtgggacgagcagtccgaccaggaatctaccacttccagcttcgacgaaatcctcgctttctataatgacgctagtaaatttgatggccagcccttgggaaacttccgtcggcaactgtggctcgctctagataatcccgggtactcagtcctgagtcgcgtgttttccatattgtccattctggttgtaatgggtagcattatcaccatgtgtcttaacagtctacctgattttcagattccagactctcagggcaaccctggagaggaccctcgttttgagatagtggagcattttgggatcgcatggtttacctttgagctggtagcccggttcgcggtcgcgcccgattttctcaagtttttcaagaatgccttgaacttgatcgatttgatgagcattgtccccttttatatcacactggtagtcaatttagttgtggaaagcactcctactctggctaacttgggacgggtggcacaagttcttcggctgatgaggatctttaggattctgaagctggctcggcacagcaccggactgcggagtctgggcgccaccctcaaatatagctacaaggaggttgggctgcttctgctgtacctgtcggtgggcataagcatattttccgtcgtggcctataccattgagaaggaggagaacgagggcctggcaactattcccgcctgttggtggtgggcgacagtgtcaatgaccaccgtgggctatggagacgtcgtcccagggacaactgcaggtaagctcacagcctccgcttgtatcttagcagggattttggttgtggtgcttcctattactcttatttttaataagttttctcatttttatcggaggcagaagcaattagaatccgccatgcggagttgtgacttcggggatggaatgaaagaagtgcctagcgttaacttgcgtgattattacgcccataaggtgaaaagcttgatggcttcgctgactaatatgagtcgaagttctccatctgagctgtcactcaatgacagcctcagatag

SEQ ID NO: 200301 - DNA, 1434 bp, Artificial Sequence
  Description of Artificial Sequence: Synthetic coding sequence
atgaccggccagagcctgtgggacgtgagcgaggccaacgtggaggatggggagatccggattaatgttggaggcttcaagcgtagactcagatcacataccctgctgagatttcctgagaccaggctcggaaggctgctactatgccactcgcgcgaagctattctggaactgtgcgacgactacgacgacgtgcaaagagagttttattttgatcggaaccctgaactcttcccgtacgtgctgcacttctatcataccggaaaactccacgtcatggcggagctgtgtgtgttttcatttagtcaggaaatcgagtattggggcattaacgagttttttatcgactcctgttgtagctattcatatcacggccgcaaggtggaaccagaacaggaaaagtgggatgaacaatcagaccaagaatccacaacatccagcttcgatgagatcttggccttctacaatgatgctagcaagtttgacggccagccactcggcaacttcaggcgtcaactgtggctcgccctggacaatcctggttacagcgtgctaagccgggtgtttagcatcctatccatcttagttgtgatggggagcattattacaatgtgcctgaactcgctgccggacttccagattcctgactcccagggaaacccgggtgaggacccccgatttgagatcgtcgagcacttcgggatcgcatggtttacatttgagctggtggctcggttcgcagtcgccccggatttcttgaagttctttaaaaacgccctcaacctgatagatttgatgagcatcgtcccattctacattacactggtagtgaacctggtggtcgagagtacacccacacttgcaaatctgggtagagtggcgcaagtgcttcgtcttatgcggatcttcaggattttgaaattggcaaggcactcgactggccttcggagcctgggcgccactctcaagtatagctacaaggaggtgggtctgctccttctctacctgagcgtgggcatatctatattcagtgtcgtggcgtacacaattgagaaagaagagaatgaggggcttgctacaatccccgcgtgttggtggtgggctacagtgtcaatgaccaccgtcggctatggtgatgtggttcccggcaccactgccggaaaactgactgctagcgcatgtatactcgcaggtattctcgtcgtggtactgcctatcaccctgatcttcaacaagttctcccacttctatcgtcggcagaagcagctcgagagcgccatgcggagctgcgatttcggagatggaatgaaggaggtgccttccgtaaacttgcgcgactactacgcccacaaagtgaagagccttatggcttctctgacaaacatgagtagaagcagccccagtgagctctcattgaacgactccctgaggtag

SEQ ID NO: 200302 - DNA, 1476 bp, Artificial Sequence
  Description of Artificial Sequence: Synthetic coding sequence
atggtgttcggcgagttcttccaccggcccggccaggacgaggagttggtgaacttaaatgtaggcgggtttaaacagtctgtcgatcagagtactctgctaaggtttccccatactcgtttgggcaagcttctgacatgccattccgaagaagccattttggagctctgcgacgactactctgtcgcagacaaagaatattatttcgaccgcaacccttccttgtttcgctatgttctaaatttctactacacgggcaagctgcacgtcatggaagaactatgcgtgttcagtttttgccaggaaattgaatattggggcatcaacgaactgttcatcgactcatgctgtagcaataggtaccaagaacgtaaggaggagaaccacgagaaggactgggatcagaaaagtcacgacgtctctaccgactcctctttcgaggagagttcccttttcgaaaaggagttggagaagttcgataccctccgatttggccaactgcggaagaaaatttggattaggatggaaaaccccgcctattgtttgagtgccaagctgatcgcaatatcaagcctgtctgtagttcttgcctcaatcgttgccatgtgcgttcactccatgtccgaattccagaatgaagatggggaggtggacgaccccgtgctggaaggggtggagatcgcctgcatcgcctggtttacaggagagctggccgttcggttagccgcagctccctgccaaaagaaattttggaaaaacccactgaacatcatcgacttcgtgtcaataattcccttttacgccacacttgccgtggatacaaaagaggaagagagcgaggacattgaaaatatggggaaagtcgtgcagatacttcggctgatgcgcatctttagaattcttaagcttgctcggcacagcgttggcttaaggtctttgggcgcaaccctgcgccatagctaccatgaggtcggactcctcttgttgttccttagcgtggggatttccatcttcagcgttctcatttactccgtagagaaggacgaccacacgtcttctcttacttccattcctatctgttggtggtgggccaccatttccatgactactgtggggtacggtgacacgcatcctgtgactctggccggtaaactaatcgcatccacttgcatcatttgcggtatactggtggtagcgctgcctatcactatcatctttaataagttttccaaatattaccaaaagcaaaaagatatcgacgtggatcagtgctctgaggatgctcctgagaagtgtcacgaactcccctactttaacattagggatatttatgcccagcggatgcacactttcatcacctctttgagcagtgtgggaattgtcgtgagcgatcccgactctactgacgcgagctccattgaagataacgaggatatctgcaataccacctcactggagaactgtacagccaagtag

SEQ ID NO: 200303 - DNA, 1476 bp, Artificial Sequence
  Description of Artificial Sequence: Synthetic coding sequence
atggtgttcggcgagttcttccaccggcccggccaggacgaggagctggtaaacctcaacgtcggcggcttcaagcaatctgtggaccaaagcactctcctaaggttccctcacacccgactgggtaagctgctgacgtgtcatagtgaagaggccattcttgaactgtgtgacgattactccgtggcagataaggagtattatttcgatagaaacccgtctctgtttaggtatgtactaaatttctattacacagggaagctgcacgtcatggaggaactgtgtgtgttttcgttctgccaggagattgaatactggggtattaatgaattattcatcgattcatgctgcagtaacagataccaggaacgaaaagaagaaaaccatgaaaaggattgggaccagaagtcacacgacgtgtctactgactcttcattcgaggaatcttctctttttgagaaagagttggagaaattcgacacacttcgcttcggacaattacggaaaaagatttggataaggatggagaaccctgcctactgcctgagtgcgaagttgatcgctatctcatccctgtccgtggtgcttgcctccattgttgccatgtgtgtgcacagcatgagcgaattccagaacgaggacggagaggtggacgaccccgtcctggagggggttgagattgcctgtattgcgtggttcacaggagagcttgcagtacgcctcgctgccgcaccttgccagaagaaattttggaaaaatccgctaaatatcatcgactttgtttccattatccccttctatgcgacattggccgtagatacaaaagaagaagagtcggaggatattgagaatatgggaaaggtcgtacagatcttgcgcctcatgaggatctttcggatcttaaaactcgcacgccattccgtgggactccggtctctcggagcaaccctcaggcattcctaccacgaggtggggcttctcctgctgttcctgtcggtggggatctccatcttttcagtcctgatatatagcgtagagaaggacgaccacacctcttctttgactagtatcccaatctgttggtggtgggcaaccattagcatgacgaccgtgggctacggcgacactcatccagtgacacttgcagggaagcttatcgccagcacctgtatcatctgcggcatccttgtggtagccttgcctattaccattatatttaacaaattctcgaagtactatcagaagcaaaaggatattgatgtggatcagtgcagtgaggacgcgcccgagaagtgccacgaattaccctattttaacatcagagatatctacgctcagagaatgcatacatttatcacctccctgtcatcagttggaatcgttgtctctgaccccgatagcacagacgccagcagcattgaggataatgaggacatctgtaataccacatccttggaaaattgcactgccaaatag

SEQ ID NO: 200304 - DNA, 225 bp, Artificial Sequence
  Description of Artificial Sequence: Synthetic coding sequence
atggtgttcggcgagttcttccaccggcccggccaggacgaggagcttgttaacctgaacgtgggcggattcaagcagtcagttgaccagagtactctcctccgcttcccacacaccaggctgggcaaactcttgacatgccattccgaggaggcaatactcgagttatgcgacgattactcagtggccgacaaggagtattatttcgatcgaaacccctcatag

SEQ ID NO: 200305 - DNA, 390 bp, Artificial Sequence
  Description of Artificial Sequence: Synthetic coding sequence
atgatcctgagcaacaccaccgccgtgacccccttcctgaccaagctctggcaggaaaccgtgcagcaaggcggaaacatgagcggcctggcccgccgcagcccaaggagctctgacggaaaactggaagcactctacgtactgatggttttgggatttttcggatttttcaccctggggatcatgctgagctacatcagatccaaaaagctggagcactcaaatgatcctttcaatgtgtacattgagagcgacgcctggcaggaaaaagataaggcatacgtgcaggctcgggtcctggaatcctatcgctcatgttatgtggtagaaaaccacttggccattgaacagcccaatactcacttgcccgaaaccaagcccagcccctag

SEQ ID NO: 200306 - DNA, 390 bp, Artificial Sequence
  Description of Artificial Sequence: Synthetic coding sequence
atgatcctgagcaacaccaccgccgtgacccccttcctgaccaagttgtggcaagagactgtacaacaagggggtaacatgagcggcctcgcccgtcgctctccaagatccagcgatgggaagctcgaggccctgtacgtactgatggtgcttggattctttggatttttcactctgggcataatgctgtcatacatcaggtctaagaagctggagcacagcaatgaccctttcaacgtttacattgagtccgacgcatggcaggagaaggacaaggcctatgtgcaggctcgggtgctggaatcttacaggtcttgttacgtggtcgagaatcacctggcaattgaacagccgaatacacacttacccgagacaaaaccctccccttag

SEQ ID NO: 200307 - DNA, 390 bp, Artificial Sequence
  Description of Artificial Sequence: Synthetic coding sequence
atgatcctgagcaacaccaccgccgtgacccccttcctgaccaagctctggcaggaaactgttcagcagggagggaatatgtcgggacttgcgcgacggtcaccccggagctccgatgggaaactggaggcactgtacgtgctcatggtcctaggctttttcggcttctttactctgggaattatgctctcttacatccggtctaagaagttagagcactctaacgacccatttaatgtttatatcgagagcgacgcatggcaggagaaggataaggcttatgttcaagcccgcgtcctggagagttatagaagctgttacgtcgtagaaaatcacctcgcaatcgagcaacctaacacccacctgcctgagacgaaaccgagcccgtag

SEQ ID NO: 200308 - DNA, 390 bp, Artificial Sequence
  Description of Artificial Sequence: Synthetic coding sequence
atgatcctgagcaacaccaccgccgtgacccccttcctgaccaagctatggcaggaaaccgtgcagcagggtgggaacatgtccgggcttgctcggcgcagtccccgctcctcggacggaaaattagaagccctgtacgtgctgatggtgctcgggttctttggatttttcacattgggtattatgctcagctatatcaggagtaagaagctcgagcactcaaatgatccattcaacgtgtacattgaatccgacgcttggcaggagaaggacaaagcctacgtgcaggcccgcgtccttgaaagctacaggagctgttatgtggtcgaaaaccatcttgcgattgaacaacctaatacacacttgcctgaaacgaaaccttctccatag

SEQ ID NO: 200309 - DNA, 390 bp, Artificial Sequence
  Description of Artificial Sequence: Synthetic coding sequence
atgatcctgagcaacaccaccgccgtgacccccttcctgaccaagctgtggcaggagacagtgcagcagggcggtaacatgagtggcctggcgagacggtcccccaggtcctcagatggtaaattagaagcactttatgttttgatggtgctggggttctttggattttttactctcggtattatgttaagttacatcaggtcaaagaagttagagcactcaaatgacccattcaatgtgtatattgagtctgacgcatggcaagaaaaggacaaggcctacgtccaggcccgcgtgctcgagtcttacaggagttgctacgtggtggaaaatcacctggcaatcgagcaacccaacacccacctcccagaaacgaagccgagtccatag

SEQ ID NO: 200310 - DNA, 390 bp, Artificial Sequence
  Description of Artificial Sequence: Synthetic coding sequence
atgatcctgagcaacaccaccgccgtgacccccttcctgaccaagctctggcaggagaccgtgcagcaaggagggaatatgtctggtctcgctagacgctccccaaggtcgagcgatggcaagctcgaggctctgtacgtgctgatggtgcttggcttcttcggttttttcaccctcggcatcatgctctcatatattcggtcgaagaagttagaacactctaacgacccatttaacgtctacattgaatccgatgcctggcaggagaaggataaggcttatgtgcaagcccgcgttctggagtcatatagatcatgttatgtagtggagaaccatttggcaattgaacaaccgaatactcaccttcccgagaccaagccatcgccttag

SEQ ID NO: 200311 - DNA, 372 bp, Artificial Sequence
  Description of Artificial Sequence: Synthetic coding sequence
atgagcaccctgagcaacttcacccagaccctggaggacgtgttccgtaggatcttcatcacttacatggataactggcgacagaacactacagccgaacaggaggcactccaggccaaggtagacgctgagaacttttactatgtcatcttataccttatggttatgattgggatgttttcttttattatcgtggctattctggtgagcaccgtcaaaagcaagcgtcgagaacatagcaatgatccctatcaccagtacatcgtggaggactggcaggagaagtacaagagtcaaatcctgaacctggaggagtctaaggcaacgatccacgagaacataggcgccgccggctttaaaatgtctccttag

SEQ ID NO: 200312 - DNA, 312 bp, Artificial Sequence
  Description of Artificial Sequence: Synthetic coding sequence
atggagaccaccaacggcaccgagacctggtacgagagcctgcacgcagttctgaaggctcttaacgctactctgcattctaatctgctgtgcaggcccggaccaggcctgggcccagacaaccagaccgaagagcggcgagccagcctacccggaagagacgacaatagctatatgtacatcttgtttgtcatgttcctcttcgcagtcacagtaggatcattaattctcggctacacccgctcacggaaggtggataaacggtccgatccttatcacgtgtatatcaagaacagagttagcatgatatag

SEQ ID NO: 200313 - DNA, 312 bp, Artificial Sequence
  Description of Artificial Sequence: Synthetic coding sequence
atggagaccaccaacggcaccgagacctggtacgagagcctgcacgccgtgctgaaggctctcaacgccacgctccattcaaacctgctctgccggcccggcccaggcctgggacctgataatcaaacagaggaacgacgggcatcgctgcctggtagggatgataattcctatatgtatatcctgtttgtcatgttcctgtttgcggtcaccgtggggagcctgattttgggatatacccgtagccggaaagtggataagcgctctgatccttaccacgtatatataaaaaacagagtgagcatgatttag

SEQ ID NO: 200314 - DNA, 39 bp, Artificial Sequence; identical to SEQ ID NO: 94120
  Description of Artificial Sequence: Synthetic coding sequence

SEQ ID NO: 200315 - DNA, 153 bp, Artificial Sequence
  Description of Artificial Sequence: Synthetic coding sequence
atggagaccaccaacggcaccgagacctggtacgagagcctgcacgcggtcctgaaagcgctgaatgccactctccacagcaacctgctttgtcgccccgggcccggcctcgggcctgataatcagacggaagagcgcagggccagtctgtag

SEQ ID NO: 200316 - DNA, 162 bp, Artificial Sequence
  Description of Artificial Sequence: Synthetic coding sequence
atggagaccaccaacggcaccgagacctggtacgagagcctgcacgccgtgttgaaggccctcaatgccacactgcactcaaacctcctctgtaggccaggaccagggctgggacctgataaccagactgaggaaaggcgagccagtttacccgggagatag

SEQ ID NO: 200317 - DNA, 300 bp, Artificial Sequence
  Description of Artificial Sequence: Synthetic coding sequence
atggagaccaccaacggcaccgagacctggtacgagagcctgcacgcggtcctgaaggcgctcaatgcaaccctccacagcaatttattatgccggcccggccccggccttggccccgacaaccagacggaggaaagacgcgcaagcctgcctggcagagacgacaacagctatatgtatattcttttcgtcatgttcctcttcgcagtgaccgtgggtagtttgatcttagggtatactaggagcaggaaagttgataagaggagcgatccttaccacgtgtacattaagaatagatag

SEQ ID NO: 200318 - DNA, 513 bp, Artificial Sequence
  Description of Artificial Sequence: Synthetic coding sequence
atgctgaagatggagcccctgaacagcacccaccccggcaccgccgccagtagttcccccctggagtcacgcgctgcgggcggtggatccggcaacgggaatgagtacttttacattctggtggtgatgtccttttacgggatcttcttgatcggaatcatgctcgggtatatgaagtcaaaacggagggagaagaaatcctcactgctgctcctgtacaaggatgaggaacgcttatggggggaagcaatgaagcctcttccggtcgtttcaggcctccgctcagtgcaagtacctctgatgttaaacatgctgcaggagtcagtcgcccccgctctttcttgcactctgtgtagtatggagggcgattccgttagctcagagagttcaagccccgatgtccacctgactatccaggaagagggggccgatgacgagctggaggagactagtgagacccctctcaacgagtctagcgaaggcagtagcgaaaacatacatcagaattcctag

SEQ ID NO: 200319 - DNA, 2031 bp, Artificial Sequence
  Description of Artificial Sequence: Synthetic coding sequence
atggccgccgccagcagccccccccgggccgagcggaagcggtggggttggggtaggcttcccggtgcacgcaggggaagcgcagggttggcaaagaaatgccctttttcgttagaacttgctgagggtggacccgcagggggggcactatatgcgcccattgcccccggcgccccaggacctgctccccctgccagcccggctgcccctgctgcccccccagtagccagcgaccttggcccacgccctcccgtttcacttgatcctcgcgtgagcatttattctacaaggagacctgtgctggcaagaacacacgtccagggtcgcgtgtacaactttcttgagcgccccaccggatggaagtgtttcgtgtaccattttgccgtatttctcatagtgcttgtgtgcctgatctttagtgtgctctctaccattgaacagtatgctgctcttgccacgggcacgctgttctggatggagattgtgcttgttgtgttttttggaacagaatacgtggtccgcttatggtccgcaggctgtcggagtaagtatgtggggctctgggggagactacgctttgccagaaagcccatttcaataatcgacctgatcgtggtcgtggctagtatggtagttctatgcgtcggctcaaaagggcaagtatttgccacttctgcaattagaggcattcggttcctgcagattctccggatgctgcacgtcgatcgtcaagggggaacttggcgcctcctgggtagcgtggtctttatccaccgacaggaactgatcacaaccctctacatcggcttcctcgggctgatcttttcaagttacttcgtgtacttagccgaaaaggatgccgttaacgagagtggccgggtagagttcggatcatacgcagatgcactatggtggggagttgtaacggtcaccactatcggatatggtgataaggtcccccagacctgggtggggaagaccatcgcctcatgcttctccgtgttcgcaatttcgttctttgctctgcccgctgggatcttaggttccggttttgctctgaaggtccagcagaagcagcgtcagaaacacttcaataggcagattccagcagctgcatccttgatccagactgcttggcgctgctacgctgctgagaaccctgactcgagcacttggaaaatttatatacgcaaggctcccagatctcatacactgttgtcaccctcccccaaacctaagaagtctgtcgtggtgaaaaagaagaaattcaaactggacaaggacaacggcgtcacgccaggtgagaaaatgctgacagtgcctcatatcacatgcgacccccctgaggaacgtaggctagaccatttttctgtggatggttacgacagcagcgttcggaagtctcccaccctcctcgaagtatcaatgccacacttcatgcggacgaactcattcgcagaggatcttgacctggaaggagagaccctgctcacacctattactcatatctctcaactccgcgaacaccatagggctacaatcaaagtcattaggcgcatgcaatatttcgtggccaagaagaaattccagcaagctcgcaaaccctatgatgtgcgggatgtgattgagcagtactctcagggtcacttaaatctgatggttcgcatcaaggagttacagcgccgcttagatcaatcaatcggaaagccttcactgttcatctccgtctccgaaaagagcaaggatcggggctcaaatacaatcggagcccgactgaaccgggtggaagataaggtgacccaactcgaccagagactggctctcatcacagatatgctccatcagctcctctcactccatggcggttcgacgcccggctcgggtggccctcccagagaagggggagcccacatcactcaaccatgcggaagtggcgggagcgtggaccctgaactgttcctgcccagtaataccttaccaacgtatgaacagttgaccgtaccaagacggggccccgacgaagggagttag

SEQ ID NO: 200320 - DNA, 1650 bp, Artificial Sequence
  Description of Artificial Sequence: Synthetic coding sequence
atggacttcctgatcgtgctggtgtgcctgatcttcagcgtgctgagcacgattgagcaatatgccgccctggcaacagggaccttgttttggatggaaattgtgctagtggtctttttcggcaccgagtacgtagttaggctctggagtgcgggatgcagatccaagtacgttggtttgtgggggagactcaggtttgccaggaagcctatctccatcatagatttaatcgtggttgtggcaagcatggtagtgctgtgtgtaggttctaaggggcaagtgtttgcaacttctgccatcagaggcatacggtttttacagatcctgcgtatgcttcacgtggatcgtcaggggggaacgtggcggctgctagggtcggttgtgttcatccatagacaggagctgattaccaccctttacatcggctttctcgggctgatcttttccagctattttgtctaccttgcagagaaggatgcagtaaatgaaagcggccgggttgagtttggtagctatgccgacgctctctggtggggggtcgttaccgttactactatcgggtatggggataaggtcccacagacatgggtaggcaagaccattgccagctgcttctctgtgttcgccatatcatttttcgcattacctgccggcattctggggtctggattcgccctgaaggtccagcagaagcagagacagaaacacttcaataggcaaatcccggccgccgcctcactgattcagactgcatggcgttgctatgccgcggaaaaccctgattccagcacttggaagatctacatccgcaaggccccacggtctcacacgctcctgtcaccaagccctaagcctaaaaagtccgtcgtggtgaagaaaaagaagttcaagttggataaggataatggtgttactccaggagaaaagatgctcaccgtgccacatattacatgtgatcctcccgaggagcgacggttagatcacttcagtgtggatggatacgatagctcagtgcgcaaaagcccgacattactcgaagtatccatgcctcacttcatgcggactaactccttcgcagaagacttggacctggagggagaaacactgctgaccccaattactcacatctctcagctgcgcgagcaccacagggcaactataaaagtgattcgccgcatgcagtactttgtggctaaaaagaagttccagcaggccagaaagccctatgatgttagggacgtcattgaacaatactcacagggacatctgaatctcatggttcgtatcaaagagctgcagcgtcgcttggaccagagcataggaaaaccgtctctctttatctccgtgtccgaaaagtctaaggatcgaggctccaacacaattggggcccggctaaacagagtcgaagataaagtgacccagctggatcagagactcgcccttatcacggatatgctgcaccagttgctatcactgcatggcgggtctacaccaggctccggcggccctcccagggagggaggcgcgcatatcactcagccctgcggatcaggggggtccgtggaccccgaactgtttctgccctccaacacattgcctacatacgagcagcttactgtgccacgcaggggaccggatgaaggcagttag

SEQ ID NO: 200321 - DNA, 1182 bp, Artificial Sequence
  Description of Artificial Sequence: Synthetic coding sequence
atggtgcagaagagccggaacggcggcgtgtaccccggccccagcggggagaagaagctgaaggtgggattcgttgggttagaccctggagctcccgatagtacacgagatggcgctttgctcattgccgggtctgaggctccaaaaagaggcagtatcctgagcaaaccaagggccggcggtgccggggcgggcaagccacctaaacgtaatgcgttttacaggaagttacagaatttcctgtacaacgtgctggagaggccccgaggctgggcttttatttaccacgcctacgtttttctgctggttttctcgtgccttgtgctctcggtgttctctaccataaaagagtacgaaaagtcctctgagggggccctgtacatcctggaaatcgttacaattgttgtcttcggggtcgaatacttcgttcgcatttgggcagccggatgctgctgcaggtatcgaggctggaggggtcgcctgaaatttgcacgcaagcccttttgcgtgattgatattatggtgttaatagctagtattgccgtgctggcagctgggtcccagggcaatgtttttgctacatctgctcttcgcagcttgaggtttttgcagatcctgcggatgatccgcatggacagacgaggcggtacctggaagcttctcgggtccgtggtgtatgctcatagcaaggagctggtgaccgcatggtacattggcttcctctgcctaatcctcgcgagctttttagtttatcttgccgaaaagggggaaaacgatcattttgacacctatgcagacgcactctggtgggggctgatcacactcaccactatcggctatggcgacaagtacccacagacctggaatggtcgcctgctcgctgcaacgttcactctgattggcgtttcattcttcgccctgccagcagggatcctcggctcaggattcgcactaaaggttcaggagcagcacagacaaaagcacttcgagaaacgtcgcaaccctgccgctggccttatccagagtgcctggagattctacgctactaacctttccagaaccgatctccacagtacatggcagtactacgagcgcaccgtaacggtacccatgtacaggtaccggcgcagggctcctgccacaaagcaacttttccatttcctcttttccatctgtagttag

SEQ ID NO: 200322 - DNA, 2607 bp, Artificial Sequence
  Description of Artificial Sequence: Synthetic coding sequence
atggtgcagaagagccggaacggcggcgtgtaccccggccccagcggtgaaaaaaagctaaaggttggattcgtgggcctggacccaggcgctccagattcaactagagacggcgccctgctgattgccgggtctgaagcccctaagaggggatcaatcctgagtaagccacgggccgggggcgcaggcgccgggaaacccccgaagcgtaatgcattttatcgcaaacttcagaatttcttatataacgtactggagcgccctaggggctgggccttcatctaccacgcttacgtcttcctcctggttttttcctgtctggtgctgtccgtcttttccactatcaaggagtacgagaaatcctctgaaggcgcactgtacatcctggagatagtgacgatcgtggtctttggcgtagagtactttgtgcgcatctgggccgcggggtgctgctgtagataccggggttggcgaggacgcctgaagtttgcccgtaagcctttctgtgtgatagacataatggttctcatcgccagcatcgctgtcctcgcagccggatctcaggggaatgtgttcgcgacctccgccttgcgcagtctccggttcctccagattctgcgaatgatccggatggaccggcggggtggtacatggaaactgcttgggagcgtagtttatgctcattcaaaggaacttgttacagcgtggtacatcgggtttctgtgcctgatcctggcttcttttctggtttatctggcagagaaaggggaaaatgaccattttgatacgtacgctgacgctctgtggtggggactgatcactctgaccactataggctacggggacaaataccctcaaacctggaacggccgtctgctggctgctacgtttaccctgattggcgtgtcattcttcgcactgcctgcagggatactgggctcggggttcgcactaaaagtacaggagcagcacagacaaaagcatttcgagaagcggcggaaccccgccgccggcctaattcaatctgcctggcgcttctacgcaaccaatctcagtcgaacagacctgcactcaacatggcaatactacgaacggactgtgacggttccgatgtaccgccttattcctcctctgaatcagctcgagctactgagaaacttgaaatctaaaagcggcctcgcattccggaaagaccccccccctgagccttctcctagcccacgaggcgttgctgcaaagggcaagggcagcccgcaagcccagacagtgaggaggtctccctctgcagatcagtccctggaggattccccctccaaagtgcctaagtcctggagctttggtgacagatcccgggccaggcaggctttccgcatcaagggagccgcgtccaggcaaaactccgaggaggccagcctccccggagaggatatagtcgatgataaatcctgcccatgtgaatttgtcaccgaggacctgactcccgggctgaaagtgagcataagggccgtgtgtgttatgcgctttctggtgtcaaagcggaagttcaaagagtccctcagaccgtacgatgtgatggacgtgatagagcaatactccgccgggcacctggatatgctctcaaggatcaaaagcctgcaatccaggatcgatatgatagtggggccgccccccccctctacgccacggcataaaaagtatcctaccaaaggacccactgctcccccacgggaatctccacagtattcccctcgagttgatcagattgtcggccggggcccagcgattacggataaggaccgaaccaagggccctgccgaagctgagttacccgaggacccctccatgatggggaggctcggcaaagtggagaaacaggtcctgagcatggagaagaagcttgattttctcgtgaacatttacatgcagcggatgggcattccaccaaccgagaccgaagcatacttcggcgcgaaggaacccgagcctgctcctccataccatagccctgaagacagcagagaacacgttgatcgccatggctgtatcgtgaaaattgtgagatcaagtagcagtaccgggcagaaaaattttagtgcccctcctgctgctccacctgtgcaatgtcctccttccacatcttggcagcctcagtctcaccctcgtcagggtcatggaaccagccccgtcggagaccacggtagcctcgtccgcatccctcccccacccgctcatgagaggagcctgtctgcctacggagggggcaacagagcttccatggagttccttagacaggaggataccccaggttgtcgtccaccagagggcaacttgcgcgattctgacacctccatctctattccaagtgtcgatcatgaggaacttgagagatccttttctggcttttccatttcgcagtctaaagagaatcttgacgcactgaattcttgttatgccgctgtggcgccatgtgctaaggtgcgcccttatatcgctgaaggggaaagtgacaccgactccgacctttgtacaccatgcggtcccccacctcggtcagcaaccggggaaggcccttttggcgatgtgggttgggccggacctcgaaaatag

SEQ ID NO: 200323 - DNA, 2643 bp, Artificial Sequence
  Description of Artificial Sequence: Synthetic coding sequence
atggtgcagaagagccggaacggcggcgtgtaccccggccccagcggagaaaagaaattaaaggtcggtttcgtgggcctggaccctggagcacccgactcaactagggacggcgccctccttatcgctggatccgaggcacccaaacgaggctcaattcttagtaagcctcgagcggggggagccggcgcaggaaagcccccaaaacggaatgcattttatcgaaagctgcagaactttttatacaacgtcctggagcgtccccggggttgggcgttcatttatcacgcctacgtttttctgctagtgttttcatgcctggtgctgagtgtgttctctactattaaggagtacgaaaagtccagcgaaggcgccttatacatattggagattgtgacaatagtggttttcggcgttgagtacttcgtccgcatctgggcagctggttgttgttgtagataccggggttggcgcgggcgcttgaaatttgcacgaaaacctttctgtgtcattgacattatggtgctcatcgcttcaatcgctgtgctggccgccggcagccaaggaaatgtttttgccacgagtgctctgcgatcactccggtttctccagatccttaggatgattagaatggatcggaggggcggaacctggaagttgttgggctccgtagtctacgctcatagcaaggaacttgtcaccgcctggtatatcggcttcttgtgtttaatcctggcctcgttcttggtttacttagcggagaagggggaaaacgaccacttcgacacgtatgcagacgccctgtggtggggcctgatcactttgacaactatcgggtatggggacaaatatccccagacttggaatggccggctgttggccgctacgtttactctaatcggcgtgtcattcttcgcactgcccgcaggcatactaggatccggatttgccctaaaagttcaggagcagcaccgccagaaacatttcgaaaagaggcgtaatcctgccgcgggtttaattcaaagtgcctggcggttctatgctactaatctgtctagaacagacttacatagtacatggcagtactacgaacgcaccgtaacagtgccaatgtaccgattgataccaccattgaaccaactggagttgcttcggaacttgaagagcaaatcagggctcgccttccgcaaagacccccctcctgaaccctccccgtcccagaaggtgagcctgaaggatcgggttttctctagtccacggggcgttgccgctaaaggcaaagggagcccccaagcacaaaccgttaggcgctccccctcagccgatcagtctctcgaagatagcccgtccaaagtccctaagtcatggtcctttggggataggtcaagagcaaggcaggcgtttcgaattaagggggctgcctcccggcagaattctgaagaagcatcactgccaggtgaggatattgtggatgataaatcgtgtccttgtgagttcgtgacagaagatttaacaccgggacttaaagtgtctatcagagctgtatgcgtcatgagattccttgtgagcaagcggaagttcaaggagtccttgaggccatatgatgtgatggacgtgatcgaacagtactccgctgggcacctggatatgctgtctagaattaagtcacttcagactggcattgacatgattgtggggccccccccaccttcaaccccccgccataagaagtatccaacgaagggcccaactgccccacctagggagtccccacagtactctcctcgggttgatcagattgtgggacggggccccgccatcaccgacaaagatcgcaccaagggtccagcggaggccgagcttcccgaggatccatctatgatggggagactaggcaaggtcgagaagcaagttctctccatggaaaagaagctggacttcctggtaaatatatacatgcagcgcatgggtattccgcccacggagaccgaagcctatttcggcgcaaaggagcctgaaccagcccccccatatcattccccagaagacagtcgtgagcatgtggaccgccatggctgtatcgtgaaaattgtgaggagctctagctccaccggccagaaaaatttttccgctcctcctgcggccccacccgtccagtgcccgccctcaacttcatggcagccacagtcacatccccgacagggccacggtacctccccagtgggcgaccacgggtcactcgtgagaatcccccccccacctgcacacgagaggagcctctccgcatatgggggcggaaaccgagcttcaatggaatttcttcgacaggaggacacaccagggtgcaggcccccggagggaaatctgagagatagcgatacgagcataagcataccctcagttgatcatgaagaactggagaggtccttttccgggttctctattagccaaagcaaggaaaatttggacgctctgaactcttgttacgctgctgtggctccctgcgcaaaagtcaggccctacattgccgaaggggagtctgacactgactctgatttgtgcacaccttgcgggccgcccccacgatcggcgactggcgagggaccctttggcgacgtaggatgggcagggcctcggaagtag

SEQ ID NO: 200324 - DNA, 2565 bp, Artificial Sequence
  Description of Artificial Sequence: Synthetic coding sequence
atggtgcagaagagccggaacggcggcgtgtaccccggccccagcggcgaaaagaagcttaaggtgggatttgtaggtctggacccaggcgcacccgattcaacacgcgatggcgcacttttgatcgcagggagtgaagcccccaagagaggatctatcctgtcaaagcccagggccggcggggcaggtgcagggaagcctccaaagcggaacgccttctaccgcaagctgcagaatttcctctataacgttctcgagcgaccaagggggtgggccttcatctatcacgcctatgtgtttttgctggtcttctcatgcttagtccttagcgtcttcagtaccatcaaagaatatgagaagtcatccgagggcgctctctatatcttggaaatcgtcactattgtcgtgttcggtgtagaatatttcgttaggatctgggcagcaggttgctgctgccgatacagaggctggcgggggcgcctgaagtttgcaaggaagccattctgcgtgatcgacatcatggtgctcatcgcctcaatcgccgtgcttgctgccggaagccaaggaaatgtcttcgccacctccgccttgcggagcttgaggttcttgcaaattctgcgcatgatccgcatggatagaagaggcgggacctggaagctgctgggaagcgtcgtgtacgcccattccaaggaattggtgaccgcctggtatatcggttttctatgtctgatcttagccagttttctggtgtatttagctgaaaagggcgagaacgatcattttgacacttacgccgatgccctgtggtggggcctgatcaccctaacaacaataggctatggcgataagtacccacagacgtggaacggacgcttgctagccgccacctttacacttataggagtgtcttttttcgccctgcccgccggcatactgggaagcggtttcgcactgaaggtgcaggaacagcataggcagaaacattttgagaagagaaggaaccctgcagccgggctgattcagtcagcttggcgtttttatgccaccaatctgtcccgtacagatctgcactccacttggcaatattacgaaaggactgtcacagtccccatgtacagttcccagacacagacatatggcgcgtcccggctgattcccccactgaatcagcttgaactcttgaggaacttgaagtccaaatctgggctcgccttcagaaaagacccaccccccgagcctagtccctctcaaaaggtgtctctgaaggacagagttttttcatctccaagaggggtggccgccaaaggtaagggatcaccgcaggcccagaccgtcagaaggagtcccagcgccgatcagtcgcttgaagattcccctagtaaggttcctaagagttggtctttcggcgatcgtagcagggctcggcaagccttccgcattaagggggccgctagccggcagaactctgaggaagcctcattacccggggaggacatcgtcgacgataagagttgcccatgcgaatttgtcacagaggatcttacccccgggttgaaggtctctatacgggccgtttgcgttatgcgattcctggtctctaaacgcaaattcaaggagtccctgcgcccatatgacgtgatggatgttatcgaacaatacagtgctgggcacctagacatgctaagcaggatcaagtcgctccagagcagggtagaccagattgtcgggagaggcccagcaatcactgataaagatagaactaagggccctgccgaggccgagctgcccgaggacccctctatgatgggacggctgggcaaggtggagaagcaggtgttgtccatggaaaagaagctggacttcctggtgaatatctacatgcagcgaatgggtatccctccgactgaaaccgaagcctactttggcgctaaagagcccgagccagctcctccataccactcccctgaggatagtagagagcatgtggaccgccacggatgcattgtgaagatagttagaagttccagtagcacaggccaaaagaacttttctgcaccacctgctgcccccccagtccagtgcccaccctctacctcgtggcagccgcagagccatcccagacaaggccacgggacttcaccggtgggagaccacggctctctggtacgtatcccgccccccccagcacacgagagatccctgtctgcctatggtggcggcaaccgagcctcgatggagtttctgaggcaggaggatacgcctggctgccgtcctcccgaagggaacctgcgagactctgatacgagtatcagcatccctagtgtggatcatgaggagcttgaacggagtttctctggattcagcatttcacaatcaaaggaaaatttggatgcccttaattcttgctacgccgctgttgcaccttgcgctaaggtgaggccatatatcgctgagggcgagtcagacacggattccgacctttgcaccccctgcggcccaccaccaaggagcgctacgggggaagggccctttggggacgtgggatgggctggaccccggaaatag

SEQ ID NO: 200325 - DNA, 2619 bp, Artificial Sequence
  Description of Artificial Sequence: Synthetic coding sequence
atggtgcagaagagccggaacggcggcgtgtaccccggccccagcggggaaaagaagcttaaggtaggctttgtggggctggatccaggggcacctgattccacgagagatggcgcactgctgattgcaggaagcgaggctcccaaacgaggtagtatactaagcaagcctcgcgctggtggggccggcgcagggaaaccacccaaaaggaacgctttctaccgcaagctgcagaattttctctacaacgttttggagagacctaggggctgggcatttatataccacgcgtacgtgttcctcctggtgttttcctgtctggtattgagtgtgtttagcacgatcaaggagtatgaaaagagcagcgagggcgccctgtatatactggaaattgtgacaatagtggtgttcggagttgaatactttgtgcggatttgggcagccgggtgctgttgtaggtatcgggggtggcggggcagattaaagttcgccaggaagcctttttgtgtgatagacattatggtcctgatagcgtccattgccgtgctggctgctggtagtcagggcaacgtcttcgcaactagcgcgctgagaagcttaaggtttctccaaatcctcaggatgatcaggatggatagacggggtggaacttggaaactgctgggaagcgtagtgtatgcccattcgaaagaactggttaccgcttggtatatcgggttcctgtgtctgattctggccagttttctggtgtacctcgcagaaaagggtgagaacgatcacttcgatacgtacgctgacgctctttggtggggactgattactctgactacaatcggttatggcgacaaataccctcagacctggaacggtagactgctcgcagcaactttcaccctgattggggtctccttcttcgcacttcccgcaggcattctcggctcagggttcgcactcaaggtgcaggaacaacatagacagaagcacttcgaaaaaagaaggaatccagcagctgggcttatccagtcggcctggcggttctacgcaactaacctctctcggaccgatctccattctacatggcagtattacgaacggacggtaaccgtaccaatgtatagctcccagacccagacgtatggggcatccagattaatcccgcctctcaatcagttagaactcctccgaaaccttaagagcaagtcaggactggcgtttcgcaaagatccacccccagagcccagtccatcgaaagggtccccatgccgggggccattatgtggatgctgcccaggtcgtagttcacagaaggttagcttaaaggatagggttttttcatccccacggggagtagcggcaaagggaaagggaagcccacaggcccagactgttcggcggtccccgtcagccgatcaatccctggaggattcaccctccaaggtgcctaaatcctggagcttcggcgatagatccagggctaggcaggcctttcgcattaagggcgctgcctcgagacagaactctgaggaggcttccttaccaggggaagacatcgtcgacgataaatcgtgcccgtgcgaattcgtgaccgaggatctgacccccgggctgaaagtgagtatccgggccgtgtgcgtaatgcgcttcctggtgtctaagcggaagttcaaggagtctcttaggccatatgatgtgatggatgtcatcgaacagtatagcgctgggcatttagacatgctcagccgtataaagtctctgcagagtagggtcgaccagattgtggggaggggcccggcaatcacagacaaggatagaacaaaggggccggctgaggctgaacttcccgaagaccccagcatgatggggagattaggcaaggttgagaagcaggtcctttcgatggaaaagaagttggattttctggtgaatatatacatgcagcggatgggaattccccctacggaaactgaggcatacttcggagctaaggagccggagccagctccaccataccatagtccagaggattctcgcgaacacgtcgacagacacggatgcattgtcaagatcgtgcgcagcagcagtagcacgggtcagaagaatttcagcgcaccgccggccgctcccccggtgcagtgtcctccgtccacttcatggcagccccagagccaccctcgccagggacacggaacatccccagtcggggaccacggctccctggttcgaattcctcctccaccggcgcatgagagatccctcagtgcatacggcggtggcaaccgcgccagcatggagttcctgcggcaggaggacacgcctggctgtagaccacctgagggcaacctcagagatagcgacacttccatctctattcctagcgtggaccacgaagagttggagcgatctttcagtggattcagcatttctcagtcaaaggaaaatctggatgcattgaacagctgttacgccgctgtagctccatgcgctaaggtgcgaccatacatcgctgaaggagagtccgataccgattctgacttatgcacgccatgcgggcctcctcctcgctctgctacgggggagggaccctttggagacgtgggttgggctggaccccgtaaatag

SEQ ID NO: 200326 - DNA, 2619 bp, Artificial Sequence
  Description of Artificial Sequence: Synthetic coding sequence
atggtgcagaagagccggaacggcggcgtgtaccccggccccagcggtgaaaagaagctgaaggtgggatttgtaggcctcgatcccggggctcccgattccactagggacggagccttgctcatcgcaggtagcgaagctccaaagcgaggaagtattctcagtaaacctcgcgcgggaggtgcgggagccggaaaacctcctaagcgtaacgcattctacaggaaactgcaaaacttcctgtacaacgtgttagaaagaccacgcggctgggcattcatctaccacgcgtacgtgttccttttggtgttctcctgcctagttctctccgtgttctccactatcaaagagtacgagaagagcagtgagggagccctctacatcctagagatcgtgactatcgtggtgttcggcgtggagtactttgtgcggatatgggccgccggttgctgctgtcgctaccggggctggcgggggaggctgaagttcgcgagaaagcccttctgcgtaattgacattatggtgcttatagctagcatcgccgtactggccgccggctcacaggggaacgtgtttgccacttcagcccttagatccctgagattcctgcagattctccgcatgattaggatggataggcgaggagggacgtggaaactccttggctctgtcgtatatgcgcactcaaaggagctagtcacagcctggtatattggatttttatgccttatcctagccagcttcctggtctacctggctgagaagggcgagaacgatcactttgacacatacgccgacgccctgtggtggggtctgattacgctgacaactattggctacggagataaataccctcagacctggaatggccggcttttggcagcaaccttcactcttattggggtctccttcttcgcgctgccagcaggtatcctgggcagtggcttcgctctcaaggtgcaggagcagcataggcaaaaacactttgagaagagaagaaaccccgccgccggcctgatccagtcagcgtggcgtttttacgccactaacctgtcaagaaccgatttgcattctacctggcagtactatgagaggaccgtgacagttcctatgtactctagccagacacaaacatacggcgccagtagactgattcccccactgaatcaactcgagctgcttagaaacctgaaatcaaagtctggacttgctttccggaaagatcctcctcccgaaccctccccctcaaaagggtcgccttgtcggggccccctttgtggatgttgtcccggacgcagttcacagaaggtcagcttgaaggacagggtgttttcttcgccacggggagtggctgctaaaggcaaaggcagtccccaggcgcaaactgttagacgatccccatccgcagatcagtctttggaagactcccctagtaaggtaccaaagtcttggtcgtttggagacagatcacgggctagacaggcttttcgcatcaaaggcgcagccagcagacagaactctgaggaagcgtctctgcccggagaggatattgtggatgataaatcttgcccttgcgagtttgtgacggaagatctgaccccgggcctaaaagtctcaatccgcgcagtttgcgtgatgagatttctggtgagcaagcgaaagtttaaggaatccctgcgcccatatgacgtgatggacgtcatagaacaatactcggccgggcacctcgacatgctctcacggattaagtctctgcagtcacaagttgatcagatcgttggacgaggaccagcgatcacagataaagaccgcactaaggggccagccgaagcagagctgcctgaagatcctagcatgatggggagactgggcaaggtggaaaaacaggtgctgagtatggaaaaaaagttggattttctggtaaacatctatatgcagcggatgggaatccctcccacagagacggaggcttactttggcgccaaggaacccgaacccgcacctccatatcacagcccggaagattcccgcgagcacgtggatcgccacgggtgcattgtgaagatagtgcggtcctcctctagtaccggccagaagaattttagcgcccctcccgctgcgccgcccgtgcaatgtcctccctccacgagttggcagccccagagccacccgagacagggacatggcacatctccagtaggagaccacggttccttggtgcgcatcccgccgcctcccgcccacgagcgcagcttgagcgcatatgggggagggaacagggcaagcatggagtttctgaggcaagaggacacccccgggtgccgcccgccggaaggaaacctgcgagacagtgacactagcatatctattccctcggtggaccatgaagagcttgagcggtctttttctgggttctccatttctcaatcaaaggaaaatttagatgcccttaacagctgttacgcagcagtggctccctgcgcaaaagttcgcccctacatcgccgaaggtgagagtgacactgattcagacttgtgcactccttgtggtcccccacctcgaagcgctaccggtgagggtcccttcggcgatgtgggctgggccggaccacgtaaatag

SEQ ID NO: 200327 - DNA, 2535 bp, Artificial Sequence
  Description of Artificial Sequence: Synthetic coding sequence
atggtgcagaagagccggaacggcggcgtgtaccccggccccagcggagaaaaaaagttaaaggtgggttttgttggcctggaccccggagctccagacagtactagagacggtgctcttctgattgccgggtcggaggctccaaagagaggctccatactttccaagcccagagccggaggggccggcgccggcaaaccccccaagaggaatgccttctacagaaagcttcagaatttcctctacaacgtgctagagcgaccccgggggtgggctttcatttatcatgcctacgtgtttctcctggtcttcagttgcttggtgctgtccgtcttcagtacaataaaagagtatgagaaatcctcagagggagccctgtacattttggagattgtgactatcgtcgtcttcggggtggaatacttcgtcagaatctgggctgcaggttgttgctgcagatatagaggctggaggggcaggctgaagttcgcccgaaagcccttttgtgtcatcgacattatggtactcatcgcatccatcgcagtgctggcggccgggagccaaggaaacgtgtttgcgacatcagctctacgatccctaagattcctgcagatattgagaatgatccgcatggaccggcggggtgggacatggaaattactaggctccgtggtgtacgcccattcaaaggaattagtcactgcatggtacataggatttctttgtctcattcttgcttcctttctcgtatacctggctgagaagggggaaaatgaccatttcgatacatacgcagatgccctgtggtggggcctaattaccttgacaacaatcggttatggcgacaaataccctcagacctggaatggccggctgctcgcagcgacctttacactcatcggggtgtctttttttgcgttgcctgccggtattctaggctccggcttcgctctgaaggtgcaggagcagcataggcagaagcatttcgaaaaaaggcggaatcctgctgcgggcctgattcaatccgcatggcgcttctacgccaccaacctgtctcgcactgacctacactccacttggcagtactacgaacgcaccgtaaccgtgcctatgtataggctgattcctcccctaaaccagctagaactgctccggaacctgaaatcaaagtcgggcttggcatttcggaaagaccctccccccgagccctcccctagccaaaaggtgagcctgaaggatagagttttcagttccccccgtggggtagccgccaaggggaagggctctccccaagcacaaactgttagaaggtcgccctcggctgaccagtccctcgaagatagcccttcaaaggtaccaaagagctggtcttttggtgaccggtctagagctcgccaagcattccgtattaagggggccgcttcccgacaaaactccgaggaagcttctctccccggtgaggatatcgtcgacgacaagtcatgtccctgcgagttcgttaccgaggacttaacccctgggctgaaagtgagtattcgcgcagtgtgtgttatgcgatttctggtctcaaagcggaagtttaaggagagcttaagaccttatgatgtgatggacgtgatagagcagtatagcgcaggccacctcgacatgctgtcccggattaagagccttcagtcccgggtggatcaaatcgtgggtagaggtcctgctattaccgataaggacagaaccaaaggaccagccgaggccgagctacctgaagaccccagcatgatgggtcgattgggcaaggtagagaagcaggttctcagcatggaaaagaagctggatttcctggtcaatatatacatgcaacgcatgggcatccctccgaccgagacggaagcttattttggggcaaaggagcctgagcctgcaccaccctaccattcacccgaggactctcgggagcacgtggatagacatggctgcatcgtcaagattgtgcgtagtagctcatcaactggccaaaaaaacttcagcgcccctcctgccgcacccccagtccagtgccccccaagtacctcttggcagccccagtctcaccccaggcaaggccatggcacgtcacccgtaggggatcacgggtccctggttcgaataccaccccctcctgcccatgaacggtccctaagcgcctacgggggtggcaatagagcttcgatggagtttctgaggcaggaggacaccccaggctgccggccacctgagggcaacctgagggactctgatactagtatatccatcccaagcgtggatcacgaagaattagaacgaagttttagcgggttttccatttctcagtctaaagagaatttggacgccctgaattcttgctacgcagcagtcgccccttgtgccaaagtgagaccatatattgcagagggggagagcgatacagacagcgatctttgcaccccttgtgggcctccccctcggagtgcaacaggggaagggccatttggagatgtcgggtgggccggtccccgcaagtag

SEQ ID NO: 200328 - DNA, 1311 bp, Artificial Sequence
  Description of Artificial Sequence: Synthetic coding sequence
atggtgcagaagagccggaacggcggcgtgtaccccggccccagcggcgagaagaaattgaaagtcgggttcgtcggtctcgaccctggagctccagactctacccgggacggggcactgctgatcgcgggcagtgaggcccctaaacgcggctctatcctgtccaagccgcgagctggtggcgccggagcaggcaagccgccgaagcgcaatgcgttctataggaagctgcagaatttcttgtataatgtcctcgagcggccgaggggttgggccttcatctaccatgcctacgtgtttttgcttgtgttcagttgcttggtactgagcgtgttttcaaccatcaaggagtacgagaagtcttccgaaggggctttgtacatcctggaaatagtgactattgtggtttttggtgtggagtatttcgttagaatttgggccgcaggctgctgttgcaggtaccgggggtggcgcggtcgtctcaagtttgcacggaagccattctgtgtaatcgacatcatggtccttatagccagtatcgctgtactggctgccgggagccaggggaacgtcttcgccacctccgcactcaggtcactgaggttcctgcagatcctccgtatgatccgaatggacagacggggcgggacctggaagctccttggatctgttgtctatgcccactccaaagagcttgtgaccgcctggtacataggattcctttgtctgattctcgcttccttcctagtgtaccttgcagaaaagggagaaaatgatcacttcgatacatatgcagacgcattatggtggggtctgattacactaaccaccatcggttacggagacaagtacccgcagacttggaatgggcgacttctcgctgccaccttcaccctgataggcgtgtcattctttgcccttcctgccggcattctcgggtcaggttttgcccttaaagtgcaggagcagcatcggcaaaaacactttgaaaaaagacgcaacccggcagctggtcttattcagtcagcgtggcgattttacgcaacaaacctctcccggaccgacctgcactcaacctggcaatactatgagcgtactgttactgtgccgatgtacaggctgatccctccccttaaccaacttgaactcttgcgtaacttaaaatccaaaagcggattagcgttccgcaaagaccctccacccgaaccctcccccagaagcgtccctcctgctgccaccttggtgtccgccgtgtgtacggccgtatggagtctgtcccatacatgcgcacagccagtaatggagatgtag

SEQ ID NO: 200329 - DNA, 1848 bp, Artificial Sequence
  Description of Artificial Sequence: Synthetic coding sequence
atggtgcagaagagccggaacggcggcgtgtaccccggccccagcggcgagaaaaagcttaaggtcggttttgtcggattggatccgggagcaccggactcaacaagggacggcgccctcctgattgccggcagcgaagccccaaagagggggagcattctaagcaagccgcgtgcgggcggtgcgggtgcaggcaaacctccaaagaggaacgcgttctacaggaagctgcagaacttcctgtataatgtgctggagagacccagaggatgggcatttatttatcacgcctacgttttcttgctggtcttctcctgcctcgtcctcagcgtcttctccactatcaaagaatacgaaaaatcatcagaaggtgcgctctacattttggagattgtcacaatcgtggtcttcggggtcgagtactttgtgaggatttgggccgcaggatgttgctgccggtacaggggttggaggggacgattaaaatttgcacgcaaaccgttttgcgtaattgacatcatggtgctgattgcatctatagccgtgctggccgcaggctcacagggcaatgtgtttgcaacttcagctcttaggtcactgaggtttctccagatcttgcgcatgattagaatggaccgccgaggcgggacctggaaacttctaggcagcgtggtgtacgcccacagcaaggaactcgtgacagcctggtacatcggttttctgtgtttgattttagccagctttctggtctacttggctgagaagggtgagaacgaccatttcgacacttacgcagatgccttatggtggggacttattaccctaacaactatcgggtatggcgacaagtatccccagacctggaacgggaggctgctggccgccaccttcaccctgatcggcgtttcgttctttgccttacccgctgggatccttggctcaggattcgcgctgaaggtacaggaacagcatagacagaaacattttgagaagagaagaaatccagccgctggcctgatacagtcagcttggcgcttttatgcgacaaaccttagtcgaactgacctgcacagcacctggcagtactatgagcggactgtgactgtaccgatgtatcgtctgattccccccctgaatcaattagaactgttgcgcaatcttaagtcaaaaagcggactggcctttcggaaggacccccctccggaaccaagcccttctcagaaagttagcctgaaagatagggtatttagtagcccgagaggcgttgccgccaaaggcaagggcagtccacaggcccagacagtaagaagaagtccctcagcagatcagtctctggaagacagtccatcgaaagtcccaaaatcctggtcctttggtgatcggtctagggctcggcaagcctttcggataaaaggagcagccagccgccagaactctgaggaggcctccctccccggggaagatatcgtggatgacaagagctgcccatgcgagttcgtgaccgaggatctgaccccagggctgaaggtctcaatcagagctgtctgtgtcatgaggtttctcgtatcaaagaggaagtttaaggaatctctaaggccatatgacgtcatggacgtgatcgagcaatattcagcaggccacctcgatatgctcagcagaattaagagccttcagagtcggcaggaaccacgcctgccagtacaacagggaactcggacaggctgggcttcaggtacaaaacctactgtggcccacggtggctctgctggaggtgtttgggctggcccacctccccaccccagacgcccactcagcgcatctgtggtctcctcccagtccttgttctag

SEQ ID NO: 200330 - DNA, 2643 bp, Artificial Sequence
  Description of Artificial Sequence: Synthetic coding sequence
atggtgcagaagagccggaacggcggcgtgtaccccggccccagcggggaaaaaaaactgaaagtaggctttgtgggtctggatccaggggctcctgactctacccgcgatggcgcccttctgatagccggtagtgaggccccaaagcgggggagcatcctttcaaaacccagggccggcggcgctggtgcaggcaagcctcccaaacgtaacgccttctatcggaagctgcaaaatttcctctacaatgtcttggagcgcccccgcggttgggcgttcatataccacgcgtacgtcttcctcctcgtctttagctgcctcgtgctctctgtcttctcaaccatcaaggagtacgaaaagagttcagagggcgccttatacatcttagagattgtgaccatagtcgtattcggggtggagtactttgtacggatctgggctgcagggtgctgctgcagatatcgaggttggagaggccgccttaaattcgcgaggaagccattttgcgtcattgatataatggtcttgatcgctagtatcgccgtgctggccgcaggaagccaaggaaacgtatttgcaacttccgcgctcaggtcgctcaggtttttacagattctaaggatgattaggatggaccgcaggggtgggacctggaagcttcttggctcagtggtgtatgcgcattccaaagagctggtgaccgcctggtatattggatttttgtgcttgatcttagcttctttcctggtgtaccttgccgaaaagggggaaaacgaccacttcgacacatacgccgacgctctgtggtgggggttgattacgctgactacaattgggtatggggataagtacccccagacgtggaatggcagactgctggctgctacattcacactgattggagttagcttcttcgcgctgccagctggcatcctcggttcgggcttcgctctcaaggtccaggaacagcatcggcagaagcatttcgaaaagcggagaaatcccgctgccggccttatccaatccgcctggcggttttatgctaccaacctgtctagaactgacctgcactctacttggcagtactacgagaggacagtgaccgtgcctatgtacagactcattccaccccttaaccaattggagcttctgcgcaatctgaagagcaaatccgggctggcatttcggaaagacccccccccagagcctagcccttctcagaaggtgtctctcaaagaccgtgttttttcatctcctcggggggtcgcagccaaggggaaaggaagtccgcaagctcagactgttcgtagaagtccctcggctgaccagagcctagaggactccccttccaaggtgcccaaatcctggtcctttggcgacagaagtagggcacgccaggccttccgcattaagggagctgcctcacggcagaactcagaagaagcttctctccccggagaagacattgtcgacgacaagtcctgtccttgcgagtttgtcactgaagatctaactcctggtctcaaggtcagcatccgagcagtttgcgtgatgcgatttcttgttagcaaacgcaagttcaaggaaagtttgcgaccttatgacgttatggacgtgatcgaacagtattcagctggccaccttgacatgctgtcccgcatcaagtcattgcagtccaggatcgatatgattgtaggccccccaccccccagcaccccaagacacaagaagtacccaaccaaaggtcccaccgccccacccagggagagtccccaatacagtcctcgcgtcgatcagatcgtcgggcgcggcccagcaatcacagacaaggatcgtactaagggcccagcagaagcggagttgcccgaagacccaagcatgatggggcgcctcggaaaggtggaaaaacaggtgctatctatggagaaaaaacttgacttcctggtgaacatttacatgcaacgcatgggaataccccccacagaaaccgaggcctacttcggagccaaagaacccgaaccagctcccccataccacagtccagaagactcccgcgagcacgtggatcgccacggctgtatcgtgaagatcgtaagaagctcctcatcaaccggtcagaaaaatttttctgcgccacctgcagctccaccggttcagtgtcccccatcaacatcctggcagccgcagagtcatccccgccagggccatggaaccagccctgtgggagaccatgggagtctggttaggattccccccccccccgcccacgagcgctcactgtctgcctacggtggaggtaacagagcatctatggagtttctgcgccaagaggacacccccggatgtcgccccccagagggaaatctgagggattccgacactagcatatcgatcccaagtgtggatcatgaagagttggagcgaagttttagtgggtttagtattagtcaaagtaaggagaacctggacgcactgaacagctgctatgccgcagtggctccctgcgccaaggtgaggccctacattgccgaaggcgagtctgatactgactctgatctttgcacgccatgtgggccccccccacgtagcgcaacgggcgaggggccattcggggatgtgggatgggctgggcctagaaaatag

SEQ ID NO: 200331 - DNA, 2529 bp, Artificial Sequence
  Description of Artificial Sequence: Synthetic coding sequence
atggtgcagaagagccggaacggcggcgtgtaccccggccccagcggtgaaaaaaagcttaaggtaggattcgtggggctagaccctggcgcgcccgactctacacgggatggcgctcttctcatagccgggtctgaggccccaaagagaggaagcatcctgagcaaacccagagccggaggcgcgggcgccggtaaaccacctaagaggaatgccttctaccgcaagctccagaacttcctatacaatgtcttagagcggcctagaggctgggccttcatttatcacgcctatgtgtttctgcttgtgttctcctgcctggtgctgagcgtgttcagcacaatcaaagaatacgagaaaagcagtgaaggagccctttacattctggaaattgtgactatcgtggtcttcggagtggaatattttgtcaggatttgggctgccggatgttgctgtcggtaccgtggatggcgcggacgtctcaaatttgcgagaaagcccttttgcgtaattgatataatggtcttaattgcatcaatcgcagttttggcggccggttcacagggcaacgtgtttgctaccagtgcactcaggtctttaagattcctgcagatcctgcgaatgattaggatggaccgaagaggggggacttggaagttacttggctctgtggtgtacgcacacagcaaggagctcgtgactgcgtggtacattgggttcctctgcctaattctagccagttttctggtttacctagccgaaaagggtgagaacgaccatttcgacacgtacgctgacgcactatggtgggggctgatcacacttactactatcggatatggtgacaaatatccacagacatggaacggaagactgcttgccgccaccttcaccttaatcggagtgtccttttttgctctgccagcgggtattttgggatcaggctttgctttaaaggtgcaggaacaacaccggcaaaaacatttcgagaagaggcgcaatcctgctgctggccttatccagtcagcctggcgattctacgcaactaatctcagtagaaccgacctgcacagcacttggcagtattacgagcgcacggtcacagttcccatgtacagctcccagacacagacctacggtgcatccagactcatcccacctttgaatcagctagaattgcttcgcaacctcaaaagcaaatctgggttagctttccgtaaagatccccctcctgagccgtcaccgagtcctaggggggtggcagccaaaggcaaagggagccctcaggctcagaccgttcgaagaagcccttccgccgaccagtctcttgaggactcaccaagtaaggtgcccaaaagttggtcatttggagatcgatcgcgggctaggcaggctttcaggataaaaggcgcagcgtctcggcagaatagtgaggaggcgtcattaccaggcgaggatatagttgacgataagagttgtccctgcgaattcgtgactgaagacttaacccctggcctgaaggtgtccatccgggccgtgtgcgttatgcgcttcctcgtctccaagcgaaaatttaaggagagtctgcggccatacgacgtaatggacgtgatcgagcaatattccgctggtcaccttgatatgctctcaagaataaaatcactccagtccagagtggaccagatcgtaggtagggggcctgcaattactgataaagacagaaccaaagggcccgccgaggctgagctgcctgaagatcccagcatgatgggaagactgggcaaagtcgaaaagcaggtcctctccatggagaagaagctggacttcctcgttaacatatacatgcaaaggatgggaattccacccacagagacggaggcttattttggcgcgaaagagcccgaacccgctccaccttatcactccccagaggattcacgcgaacacgtcgatagacatggatgcattgtgaagattgttcgtagttcgagtagcaccggacagaaaaacttttctgccccacccgctgccccgccggtgcagtgccctccctccactagctggcagccccagagccatccccgccagggtcatggaacaagccccgtcggtgatcacgggagcctggtgcggattccaccaccccccgcccacgagagaagcctctctgcatacggcggaggcaacagggctagtatggaattcctgcggcaggaggacacacctggatgcaggcctccagagggcaatctgcgcgattccgatacttctattagcataccaagcgtggatcacgaagaacttgaacgctcatttagtgggttttcaatctctcagtcgaaggagaacctggacgcactcaatagctgctacgctgccgtcgccccatgtgctaaggtcagaccatacattgcggaaggcgaatctgacacggactccgacctttgcactccatgcgggccccccccccggtctgccactggagagggacccttcggcgacgttggctgggccggcccgaggaaatag

SEQ ID NO: 200332 - DNA, 2526 bp, Artificial Sequence
  Description of Artificial Sequence: Synthetic coding sequence
atggtgcagaagagccggaacggcggcgtgtaccccggccccagcggcgagaagaagttaaaggtaggtttcgtaggcctggaccctggagcccctgatagcacaagagatggcgctctgctgatagcaggtagcgaagctccaaaaagaggatctatcctgtcgaagccgagagctggaggcgctggggctgggaaaccccccaaacgaaatgccttctataggaagctccagaactttttatacaacgttcttgaaagaccaaggggatgggccttcatctaccacgcatacgttttcctcctcgtttttagctgcctagtcctctccgttttctccacaattaaggaatacgagaagagttcggagggagccctgtatattctcgaaattgttacgattgtagtgttcggtgtcgagtactttgtgaggatatgggccgccggctgttgctgtagataccgtggttggaggggccggctgaagtttgcccgcaagcctttctgcgtgattgatatcatggtactcattgccagtatcgccgtattagctgccggaagccaaggtaacgtgttcgcgacttctgctctgaggagcctgaggttcctgcagatcttaagaatgatccgaatggaccgtcggggtggcacatggaaattgctcggctctgtggtgtatgcccactcgaaagagctggtgacagcctggtatattggatttctgtgtctgatcctggcctctttcctggtgtacctggctgaaaagggcgaaaatgatcacttcgacacgtatgcagatgctctgtggtgggggcttattacacttactacaatcgggtatggcgataagtacccccaaacttggaacggccggcttctcgccgcaacctttacattaattggggtgagcttcttcgcactgcccgcaggcatccttggcagtggtttcgcactgaaggtccaggagcagcacaggcagaaacatttcgagaaacgtaggaatcctgccgcgggactgattcagtcagcatggcgtttttatgcgacgaacctgagtaggaccgacctgcattctacctggcagtattacgagaggactgtgactgtgcctatgtattcctcacaaacccagacttatggggcgtcccgattaattcctccgctgaaccagctcgaattgcttcggaatttaaaaagtaaaagtggcctggccttccggaaagatcccccacccgaaccgagtccctcaccgaggggagtcgccgctaagggcaaaggatctccccaagcccagacggtcagacggagcccaagcgcggatcagagtctggaagatagtccatccaaagtgccaaaatcttggtcctttggcgaccggagtcgcgccagacaggcttttaggatcaagggggcagccagtaggcagaactccgaagcctccctccccggcgaagacattgtggatgacaagtcttgcccatgtgaattcgtgacggaagacctgacccccggcctcaaggtgtccataagggctgtttgcgtgatgcgtttcttagtatccaaaaggaaattcaaagagtcgctaaggccctatgacgttatggacgtcatcgagcaatatagcgccggacatttggatatgctgagccgcatcaaaagtcttcagagcagagtcgaccagatagtagggcgtggcccggctattaccgacaaggatcggacaaaaggcccagccgaggcagaactgcctgaagatcccagcatgatgggacgcctgggtaaagttgagaagcaggtgttgtccatggaaaaaaaactagattttctggtcaacatatacatgcagcgaatgggaatcccgcccaccgagactgaggcgtacttcggcgccaaggagccagaacccgccccgccctaccattcgcccgaagacagtcgggagcacgtagacagacatggctgcattgttaagatcgtcaggtcatccagcagcactggccagaagaatttctctgctccccccgccgccccccccgtccagtgcccgccatcaacgagctggcagcctcagtctcaccctcgccaaggtcacggcactagccccgtcggggaccacggctctttggtgcgcatccctcccccaccagctcacgagagaagtctgagcgcctacggggggggcaaccgcgcatctatggagttcctgcggcaggaagatactcccgggtgccgccctccagagggaaatctcagagactccgacacctcaatctcaatcccatcagttgatcatgaggagcttgagcggtccttctcaggcttctccatttcacagtctaaagagaacctggacgcgctcaattcgtgctatgccgccgtcgccccttgcgccaaggtgcgaccatatatcgctgaaggggagtccgacacagacagcgacctctgcaccccatgcggacctccacccaggagcgccacaggagagggccctttcggcgatgtggggtgggccggtccccggaagtag

SEQ ID NO: 200333 - DNA, 2619 bp, Artificial Sequence
  Description of Artificial Sequence: Synthetic coding sequence
atgggcctgaaggcccggcgggccgccggcgccgccggcggcggcggtgacggcggaggcggaggagggggcgcggctaatcccgccgggggagatgctgctgccgcaggagatgaagaaaggaaggtggggctggcacctggcgatgtcgaacaggtaacactcgccctgggggcaggcgcagacaaggatggcactcttttactggaaggtgggggccgggacgaaggacaacgcagaacaccccaggggatcgggctgctcgctaaaactcctctgtctagacccgtcaaacgcaacaacgctaaatataggcggattcagacgctgatttatgatgcgctcgaaagaccccgggggtgggctctcctttatcacgcacttgtgttcctaattgtgctgggatgtctaatcctggcagtgctgacaacttttaaggagtacgagaccgtctccggcgactggctgctcctcctggagacatttgctatatttatttttggagccgaattcgccctgcggatctgggcggccggatgctgctgcaggtacaagggttggagaggcaggcttaagttcgccagaaaacccctgtgcatgcttgacatcttcgtcctcatcgccagcgtcccagttgtagccgtaggaaaccagggtaacgttttagcaactagcctacgaagcctgcggttcctacagatcctgcggatgctacgaatggatagacggggaggaacctggaaactgctggggtcggcaatctgcgcgcattccaaggagctcattactgcctggtacattggcttcttaaccctgatcctgtcctcattccttgtttacctggtggaaaaggatgtgccagaagttgacgcgcaaggtgaggaaatgaaagaagaatttgaaacgtatgcagacgccctctggtggggcctcattactctggccactataggatatggcgacaaaacccccaaaacttgggagggaaggctcatagctgctactttttctctgattggagtgtcttttttcgctctgcccgctggcattttggggtcaggactggccctgaaagtccaagagcaacaccgacagaagcatttcgaaaaaagacgaaaaccagccgcagagctgattcaggccgcgtggaggtactatgccacgaatcctaaccgtattgacctggttgctacgtggcgcttttacgaatcagtcgtttccttcccgttctttcgaaaagagcaactggaggccgcatcctcacagaagctcggcttgctcgatcgcgtgcgattgtccaacccccgcggcagcaataccaaaggtaagctcttcaccccccttaatgtggatgcgatcgaggagagtccatccaaggaacccaaacccgtgggactcaataacaaggagcgattccggacagcctttcggatgaaagcctacgcattctggcaatcttcagaagacgccggcaccggagaccccatggcagaggaccggggttacggcaacgatttccctattgaagatatgatccctaccctgaaagccgctatacgcgcggtgcggattttacagttccgcctgtataagaagaagttcaaagagacacttagaccatacgacgtgaaggatgtgatagagcaatatagtgcgggtcatctggatatgctcagtaggatcaagtatctccagaccagaatcgatatgatcttcacaccagggccgccgagcactccgaaacataagaaatcacaaaagggttccgcatttactttcccttcccagcagtccccaaggaatgagccctatgtagctcgcccttcaacctcagagatcgaggaccagagcatgatgggcaagttcgtcaaagtggagagacaggtgcaagatatgggcaagaagttggacttcctcgtggacatgcacatgcagcatatggagcgcttgcaggtccaggtgaccgaatattaccctacgaaggggacctcctcacccgccgaagcagaaaaaaaggaggacaatagatactccgacttaaagaccataatctgtaactattctgaaaccgggcccccagagcctccatactctttccatcaggttacaattgataaggtaagcccctatggttttttcgctcatgatcctgtgaacttacccagaggaggaccttccagtgggaaagtgcaggccacccctccttcgagcgccacaacgtacgtggagcggcctaccgtacttccaatccttactttgctcgatagtcgcgtcagttgtcacagtcaggccgacctacaaggcccgtactctgacaggatctccccccggcagcggagatccataacccgggactctgataccccactaagcctgatgagcgtgaatcacgaggagcttgagaggtctcccagcggtttctcaatatcacaagacagggacgattacgtgttcgggcccaacggcggctcctcttggatgagggaaaagaggtatctcgcggaaggggaaacagataccgatactgatccatttaccccctcggggagcatgcctctgtcaagtaccggcgatgggatatccgacagcgtttggactccaagtaataaacctatttag

SEQ ID NO: 200334 - DNA, 2256 bp, Artificial Sequence
  Description of Artificial Sequence: Synthetic coding sequence
aagcccaagaagcacggccccatgttcctgatcgtgctgggctgcctgatcctggcggtactgactacgtttaaagagtatgaaacagtcagcggtgactggcttctcctgctcgaaacatttgcaatctttatattcggagccgagttcgctctccggatctgggctgcaggctgctgctgtcggtacaaaggctggcgtggaagacttaaattcgcaaggaagcccttatgcatgctcgatattttcgtccttattgcatctgtgcccgtggtagctgtcgggaaccagggaaatgtacttgccactagcctgcgctccctccgctttctccagatccttcgcatgctgcggatggaccgcagaggcggtacctggaaattactggggagtgccatctgcgcccattccaaggagctaatcacagcctggtatatagggtttctgacccttatccttagctctttcttggtgtacctggtggagaaagacgttccagaggttgacgcccaaggtgaggaaatgaaggaggagttcgaaacttatgctgacgccctgtggtggggcctcatcacattagccaccattggatatggcgataagaccccaaaaacttgggaaggaaggctcattgctgccactttttcgttaataggcgtctcattttttgccctgccggcaggaatattaggatcaggccttgcactgaaagtgcaggagcagcatagacaaaaacacttcgaaaaaaggcggaaacctgctgcagagctgatacaggcggcctggcgatattatgccacgaaccccaataggatcgacctggtggccacctggagattctatgagagtgtggtgtcattcccattcttccgtaaagagcaactggaagccgcctcaagtcagaaactcggcctcctggatagagtccgtctgtcgaacccgagaggctccaacactaaaggcaaactgtttactccccttaacgttgatgcaatcgaggagagccccagtaaggagcctaaaccagtgggccttaacaacaaagaacgctttagaacggcctttagaatgaaagcttatgccttctggcagtctagtgaagatgccgggacaggggatccgatggccgaagacagaggctatggaaacgactttccaattgaagatatgattcctacccttaaagctgcaatacgagcagtgagaattttacagttccggttgtacaagaagaagtttaaggagactctcaggccgtacgacgttaaagatgtgattgaacagtattctgcgggtcatctggacatgctctctcgaattaagtacttacagactcgtatagatatgatttttaccccggggcccccttccactcccaagcacaaaaaatctcagaagggctcagccttcacattccccagccaacagtctcctcggaacgaaccctacgtcgcaaggcccagcacatcagagattgaggatcagagtatgatggggaagttcgtaaaggtggaaagacaagtgcaggacatgggtaagaagctcgattttttagtagatatgcatatgcaacacatggaaagactgcaggtccaagtgacagaatactaccctacaaagggtacaagctcacccgcggaagctgagaaaaaggaggataaccggtattccgatcttaagaccatcatctgtaactacagcgagacaggacccccagaaccaccctatagctttcatcaggtgacaatcgataaggtgagcccttacgggttcttcgcccatgaccccgttaatctcccacggggggggccaagttctggaaaggttcaggctacgcctccttcaagcgctacaacctacgtagaaagaccaacggtcctcccaatcctaaccctcttggactcccgcgtaagctgtcactcacaagctgacttgcaagggccgtatagcgacagaatttctccacggcagcgcaggtccatcacaagggacagcgatacgcccctgagcctgatgtccgttaatcacgaagaactggaacgaagcccctccgggtttagcatctcacaggaccgcgatgactacgtgtttgggccaaacgggggatcttcctggatgcgtgagaaacgatacctggcagagggagagacggacaccgacacagatcccttcacaccctcaggttccatgcctttgtcttctacgggagacggcattagtgatagtgtgtggacaccctccaacaagccaatatag

SEQ ID NO: 200335 - DNA, 2550 bp, Artificial Sequence
  Description of Artificial Sequence: Synthetic coding sequence
cgggccgccgccgagaaggccaagcggcccgccggcgcccggcagatgggactgaaggcacggcgggccgccgcaggtgacgaagaacggaaggtcggtcttgcccccggagatgtcgaacaagttaccctcgcactgggggccggggccgacaaggacggcactctgttgcttgagggggggggtagggacgagggacagcgtcggactcctcagggcatcggactgttggctaagactcccttaagtaggcccgtgaaacgtaacaatgccaaataccggagaattcagactctcatttacgatgctctcgagaggccgcgcggctgggctctgctttaccacgctttagtgttcctgatagtgctcgggtgtctaattctggctgtgctcaccacgtttaaagaatacgaaacagtgagcggagactggctgctcttgctggaaacgtttgccatctttatctttggggcagagttcgccctgaggatctgggccgctgggtgctgctgcaggtacaaaggctggcgaggcaggctgaagtttgcccggaaacctctttgcatgctggacatattcgtcctgattgccagtgtgcccgttgtggctgtgggcaatcagggaaatgtccttgccacctcactgagaagcctgaggtttttacagatccttcgcatgctgcgcatggatcggcgggggggaacctggaaattacttgggtcagcaatctgtgcacacagtaaagagttgatcaccgcctggtacatcggttttctgaccctgatactgtcctccttcctagtttatctagtggagaaagacgtgccagaagtagacgcccaaggcgaggaaatgaaagaagagttcgaaacatacgccgacgccctctggtggggcctgattacgctggcaaccataggatacggagataagactcccaaaacatgggaaggccgccttattgctgcaactttctcactgatcggcgtgtctttctttgccctgcctgccggtatcctgggaagcggccttgcacttaaggtgcaggagcaacaccgacagaagcattttgaaaaacgcagaaaacctgcagccgagttgattcaagccgcctggcggtactatgccactaacccgaaccggattgatcttgttgccacctggcggttctatgagagtgtggtctcatttccatttttccgtaaggagcagttggaggcggcatcatcccagaaactgggccttctggatcgcgtgcggctgtctaatcctcgcggaagtaataccaagggaaagctctttactccactaaatgtagatgctatcgaagagtcccccagcaaggagcctaaacctgtcggactgaataataaggaaagattcaggacagcatttagaatgaaggcctatgccttctggcagagctccgaggatgccgggactggtgacccgatggctgaagacagaggttacggcaacgacttccctatcgaagatatgatccccacgctgaaggccgccattagggcggtcaggatcctgcagtttcgcctgtacaagaagaagttcaaggagacgttgcgcccctacgatgtgaaggatgtaattgagcaatacagtgccggacacctggatatgctgagccgaattaaatacttacagaccagaatagatatgatcttcactccaggacccccttctacgcctaaacacaaaaagtcccagaaaggaaacgaaccatacgtcgcgcgtccctcaacatctgagatcgaagatcaaagcatgatgggaaaatttgtgaaggtggagcgccaagtgcaggatatgggcaaaaaactggacttcctggtggatatgcatatgcagcatatggagcgtttgcaggtgcaggttactgagtattatcctacgaagggcacctcatccccagcagaagcagaaaaaaaagaggacaatcgctacagcgacctgaagacgattatttgcaattactcagagactggtcctccagagccaccatacagttttcatcaggtgacaatcgataaggttagtccttacggtttttttgcccacgaccctgttaatttgcccagaggaggcccgtcctccggcaaggttcaggccacaccgccatcgagcgcgaccacgtacgtcgagcgacccaccgtgctgcctatccttacattgctcgactcacgagtgtcttgtcactctcaggccgacttacaggggccatattctgataggatcagcccccggcagcggagaagcattacccgcgactctgatacaccactgtccctcatgtcagtcaatcatgaggagttggagcggagtccaagcgggtttagcatttcccaggatagggatgattacgtctttggacccaatgggggttcatcatggatgcgggagaaaaggtacctggctgaaggggagacagatacagatacagacccttttacaccctccggttcaatgcctctgtccagcacaggggatggcattagcgattctgtgtggacacccagtaacaaacccatatag

SEQ ID NO: 200336 - DNA, 2088 bp, Artificial Sequence
  Description of Artificial Sequence: Synthetic coding sequence
atggccgaggcccccccccggcggctgggcctgggccccccccccggcgacgcccccagggctgaactggtcgccctaacagcggtgcagtcagagcagggggaggccggcgggggcggaagcccacgcagactagggttgctgggttctcctttgccgcccggggccccactgcctggccccggcagcggctcaggaagtgcttgcgggcagagatcatccgccgcacacaagcgctataggcgcttacaaaactgggtttacaacgttctggagcggccaaggggctgggcattcgtctaccacgttttcatttttctgctggtatttagctgtctagtgctttctgtcttgtccacaattcaggaacatcaggagctcgcgaatgagtgcctgctgatcctggagtttgtaatgattgtggtatttggacttgaatatattgtgagagtctggtcagcgggctgctgctgccgctatagagggtggcaaggacgctttcggtttgcgcgaaaacccttttgcgttatcgactttattgtattcgtggctagtgttgctgtaatcgctgccggcacgcaaggcaacattttcgctacgagcgcccttaggagcatgcggttcctgcagatcctgaggatggtgaggatggacagacggggcggcacgtggaaactcctgggatccgttgtatatgcccactctaaagaactgattacggcctggtacatcggttttttggtgttgatttttgcctcattcctggtatacttggccgagaaagacgccaattccgacttctcctcctatgcagattctctgtggtggggcacaataacactgactacgattggttatggggacaaaactccccatacttggctcgggcgggttctcgctgccggcttcgccctactcggcatctcattctttgccttacctgcaggtatcttgggctctggctttgccctgaaggttcaggagcagcatcggcaaaagcattttgagaagcgtcgaatgcccgctgcaaacctaatacaggccgcctggagactgtattccacagacatgagccgcgcatacttgacagcaacatggtactattatgattctatcctccctagttttagggagctggcgttgttattcgagcatgtacagcgagctagaaatgggggtttacgtcctctcgaggtgaggcgggcccctgtgcctgacggggcgccgtcccggtacccacccgtggctacctgccacaggcccggcagcactagcttttgccccggagagagttcccgtatgggaattaaggatcggatcagaatgggctcttctcagcggcggacagggccttcaaaacaacatctggcgccgccaaccatgcctacatctccttcctcagagcaagtgggtgaggctacctcgccaacgaaagtgcaaaagagctggagctttaatgatcggaccagatttcgcgcatcacttaggttaaagcccagaactagcgccgaggacgctcccagcgaggaagtggctgaggagaagtcttaccagtgcgagctgaccgtggacgacatcatgcctgccgtcaaaacagtgattagatcaatcagaatattgaaatttttagtcgccaaacgcaagttcaaagaaacattgcggccatacgatgtcaaggacgttatagagcaatattctgccgggcatttggacatgctgggccgcatcaaaagcctgcagacccgagtggatcagattgtcggacgtggcccgggagatagaaaagcgagagagaagggagacaagggcccctctgatgctgaggtggttgacgagattagtatgatgggaagggtcgtaaaagtggaaaagcaggttcagtccattgagcacaaacttgacctgttattaggcttctattcccggtgcttgcgaagcggaacttctgcatcccttggggcagtccaggttcccctgttcgatccagacattacatccgactaccattcaccggtggatcatgaggacatcagcgtgtctgctcagaccctgtccatctctcgcagcgtgtctacaaacatggactag

SEQ ID NO: 200337 - DNA, 2856 bp, Artificial Sequence
  Description of Artificial Sequence: Synthetic coding sequence
atgccccggcaccacgccggcggcgaggagggcggcgccgccggcctatgggttaaatccggtgcagccgctgcagcggccggtggtggacgccttggctccgggatgaaggacgtggaaagtggacgcggccgcgtcctcctgaatagcgctgccgcgcgtggagacggtctgctgctgctgggcacccgcgccgcaaccttgggtggcgggggaggcggattgcgggagtcgcgcagaggaaagcagggcgctcgcatgagcctgttaggtaagcctctgtcttacacaagtagtcagtcctgcaggcggaacgtcaaatatcgaagggtccagaactacctgtacaatgtactcgagagaccccgggggtgggcatttatctaccacgcttttgtcttcctcctcgtattcggctgtctcattttgagtgtgttcagcactatccccgaacacactaagctggccagctcctgtttgttaatcttagagttcgttatgatagttgtcttcggcctggaatttattatcagaatttggagtgccggatgctgctgtaggtatcgaggctggcagggaagactaaggttcgctagaaaacctttttgcgtcatcgatactattgtgctgatagcttctatagcggtagtcagcgccaagacccagggcaatatttttgccacttccgcccttcgctcactgagattcctacagatcctcagaatggtaaggatggataggagaggcggcacatggaaactgcttggcagcgtggtgtacgctcactccaaggaactgataaccgcgtggtacatcgggttcttagtgcttatattcagctctttcctggtatatctggttgagaaagatgctaacaaagaattttctacctatgctgacgccctgtggtggggtacgatcacacttactactattggctacggtgataaaaccccactgacatggctcggcaggctgctgtcggccgggtttgccctcctcggcatctctttctttgctctgcctgccggcattctcggcagcgggtttgccctgaaagttcaggaacaacaccgccaaaagcactttgaaaagcggagaaatcccgccgccaacctgattcagtgtgtgtggcgctcctatgccgccgatgagaagtcagtgagtattgcaacgtggaagccccatcttaaagccttgcatacgtgctcccctacaaagaaggaacagggggaagcctctagcagtaagttctgtagcaacaagcaaaaactctttcgcatgtatactagcagaaagcaaagccaaaagctcagtttcaaagaaagagttcgaatggcatctcctcggggacagagcattaaatcacgacaggcctcagttggcgatcgccgaagccccagcacagatataacagcggaagggtcacccacaaaagtgcagaagtcttggtcatttaacgatagaacccgattcagaccatcactccggctcaagtcctcgcaacccaagccggttattgatgctgataccgcactggggacggacgacgtttatgatgaaaagggctgccaatgtgatgtgtctgtcgaggatctcactcctcccctcaaaacagtaatccgcgccatacgaattatgaagttccatgtagccaaaagaaagtttaaggaaaccctccgaccatacgatgtcaaggacgtcattgagcagtatagcgcgggacatcttgacatgctgtgcaggattaagtcccttcagacccgggtcgaccagattcttggcaaaggacagattacaagcgacaaaaagtcccgtgagaagatcacggccgagcacgagacaaccgacgatctgtcaatgctcgggcgggtggtgaaagtggaaaagcaggtgcagtctattgagagcaagttggactgcttgttagacatctatcaacaagtgcttagaaaggggagcgcctctgccttagcactggcctccttccagatccctcccttcgagtgcgagcagacctcggattaccagagccctgtcgatagtaaggacttgtccggatctgcacagaacagcggctgtctaagtcggagtaccagcgctaatatctccagggggctccagttcattcttacacctaacgagttttccgcacagaccttctatgctttgagccccaccatgcatagccaagccacccaagttccgatctctcagagtgatggatcggccgtggccgcaacaaatactattgctaatcagataaacactgcccccaagcctgccgcccccacgactctgcagattccaccccccctccctgcgatcaagcacttaccccgtcctgaaacgctccaccccaatcccgccgggctgcaagagagtatcagtgatgtcaccacatgcttggtggcatcaaaggagaatgttcaagttgctcagtccaacctaaccaaagaccgatcaatgcgtaaatcctttgacatggggggggagaccctcctgtccgtgtgtccgatggtccctaaagatctgggcaaatctctctcagtgcagaatttgattaggtccacagaagaactgaatattcaactttctggctcagaatcaagcggtagccgaggcagccaggatttctaccccaaatggcgggaatccaagctgttcatcacagacgaagaagtgggcccagaagagaccgaaaccgacactttcgatgcagctccacaaccagcaagagaggcagcttttgccagcgattcccttcgcacaggccggtcgcggagctcccaaagtatctgcaaagccggcgagagtaccgacgcactgtccttgccccatgtgaaactcaagtag

SEQ ID NO: 200338 - DNA, 2799 bp, Artificial Sequence
  Description of Artificial Sequence: Synthetic coding sequence
atgccccggcaccacgccggcggcgaggagggcggcgccgccggcctttgggttaaatctggggccgcggctgcagccgccggcggcggtcggctgggatctgggatgaaggatgtcgaatccggaagaggacgggttctcttgaactcagccgcagcaagaggcgatggcctcttgctgctgggcactagggctgcaaccttgggcggtggcggagggggcctccgggaaagccggaggggaaaacagggggcccggatgtctctgctgggaaaacccctttcctatacatctagccaaagttgccggaggaatgtcaagtatagacgcgtgcagaattatctctacaatgtattggagagaccccgcggctgggccttcatataccacgcctttgtgttcctcccggtgttcggttgcctaatactctcggtgttttcaaccatacccgagcacactaaactcgcctcatcatgccttctcatcttggaattcgttatgatagtggtgtttggactcgaatttatcattcggatctggtcggcaggatgctgctgccgatacagaggctggcaaggaaggctgaggtttgcccggaagcctttttgcgtcatagatacaatcgtgctaattgcgagcattgcagtggtctctgctaagacacagggcaacattttcgcaaccagtgctctgcgtagtctccggttcctgcaaatcctccgtatggtgaggatggatcggcgcggaggaacttggaaactcctgggctccgtggtgtatgcccacagcaaagagctaattaccgcctggtacatcggctttttggtcctgatttttagtagcttcctggtgtacctcgtcgagaaggacgccaataaagagttctccacctatgcagacgcactgtggtggggcactatcacactgaccacaattggttacggggataagacccctctgacatggctcggccgcctgctgtcagctggcttcgcccttctcgggattagtttttttgccctcccagccggtattcttgggagcggctttgcactgaaagtacaggaacagcatcggcagaagcattttgaaaaacgtaggaacccggctgccaacctcattcagtgcgtgtggaggtcttacgctgcagacgagaagagcgtcagcatcgctacttggaagccacatctcaaggctctacacacctgctcccctacgaagaaagagcaaggcgaagccagctcgtcccagaagttgtctttcaaggaacgcgtgcgtatggcctcaccacgcggccagtcaatcaagagccgacaggcgtctgtgggcgatagacgcagcccttcgaccgatattacagcggaggggtcccctaccaaggttcagaaaagttggtctttcaacgatcggacacgcttccgaccctcactgagattgaaatccagtcagcccaaaccagtgattgatgccgataccgccctgggaactgacgatgtctacgatgagaaaggttgccagtgcgatgtctccgtagaggatcttactccccccttgaagacggtcattcgcgccatccggatcatgaagtttcacgtggcaaaaaggaaatttaaggaaacattgcgcccttacgatgtgaaagatgtgatcgaacagtactccgctggccacctcgacatgctttgtcggatcaagagtctgcagactcgagtggatcagatcttaggcaaaggtcagattacttctgacaaaaaatccagagagaaaatcactgccgagcacgagactacagacgacctctcaatgctgggtcgagttgtgaaagttgagaagcaggtccagagcatagagtccaaactggactgccttctggacatctaccaacaagtcctcaggaaagggtccgccagtgccttggccctggcctcttttcaaatcccaccgtttgaatgtgaacagaccagcgactaccagtccccagtggacagcaaggatctgtctggctccgctcagaattcggggtgtctgtctcgttctacctctgcaaatatcagtcgagggctgcagttcatccttacacccaatgaattttccgcacaaaccttctacgcgctatctccaactatgcactcacaggcgacccaagttccgattagccagtccgatggaagtgctgtggccgccacaaacactattgctaaccagattaataccgctccaaaaccagctgctcctactactctgcaaattccccccccactgcctgccatcaagcatctgccacgtcccgagacattgcatcctaatcccgccgggctgcaagaatccatctctgacgtgaccacatgcctggtggcaagcaaagaaaatgtgcaggtcgcccaaagcaacctgacgaaagaccgatccatgaggaaatctttcgatatgggaggtgaaactctgttgtcggtatgcccaatggtaccaaaagacctcggaaagtctttgtcagttcagaacttaataagatcgactgaggagctgaacattcaactcagcggatcggaaagtagtggctcccgcggatcacaggatttttaccccaaatggagagaaagtaagctctttatcaccgacgaggaagttgggccagaggaaacagagactgatacctttgacgctgcgcctcagcctgcacgcgaagcagcgtttgccagtgactcactcagaaccggtcgttcccggagctcgcaatctatttgcaaagcaggggagagcacagacgccctgagccttccacatgtgaagctgaaatag

SEQ ID NO: 200339 - DNA, 2802 bp, Artificial Sequence
  Description of Artificial Sequence: Synthetic coding sequence
atgccccggcaccacgccggcggcgaggagggcggcgccgccggcctctgggtgaagagtggtgcggcggcagccgctgccgggggagggaggctgggaagcgggatgaaagatgtagaatctggacgcggcagagtgttgctgaattccgccgcggcaaggggagacggtctcttactattggggactcgagccgccacactggggggtggtggcgggggactccgggaaagccgcaggggaaagcagggagcacggatgagcctgttgggcaagccactcagctacacaagcagtcagagttgtcgccgaaacgttaaataccgccgggttcagaattacctgtataacgtgctcgaacgtcctcgagggtgggccttcatttatcatgcattcgtgttccttctggtattcgggtgccttatcttaagcgtgttcagcacgatcccagagcatacaaaactggcatcgtcctgcctgttgatcctggagttcgtcatgatcgtggtttttgggctcgagtttatcatacggatatggagcgcaggatgctgctgtcggtaccgaggttggcaggggcggctccgcttcgcccgcaaaccattttgtgtcatagacaccatagtgctgattgcgtcaattgcggtggttagcgcaaagacccaaggtaatatcttcgctacctctgctttaaggtcattaaggttcttgcagatcttgcgtatggtgaggatggatcgccggggagggacatggaagttgttgggcagcgtggtgtatgcacattccaaagaattaattaccgcatggtatatcggcttcctcgttctgattttttcaagcttccttgtatacctggtggagaaggacgctaacaaggagttttccacttatgccgatgccttatggtggggcacaatcactctgaccacaattggatatggagacaaaacaccactgacctggctgggccgattactctctgccggatttgcactgctcggaatctcatttttcgcactgcccgccggcattttgggcagtggttttgccctcaaagttcaggagcagcatagacaaaagcactttgagaaacggcgaaaccctgccgctaacctgatacagtgcgtctggcgctcttacgctgcggacgaaaaatccgtttctatcgcaacatggaaaccccacctgaaggcactgcacacctgttcccctactaaacagaaccaacagggcgagagccagagttgccagaagttatcattcaaggagagagtacgaatggcatcacccaggggtcagagcatcaagtcgaggcaggcgagtgttggagatagacggtctccaagcactgacataaccgcagagggtagtccaaccaaggtccagaagtcctggtcattcaacgaccggactcgttttcgaccgtccctgaggctgaagagttcccaacccaagccagtgattgatgccgatacagccctgggcaccgacgatgtgtacgatgagaagggatgtcagtgtgatgtttcggtcgaagatttgaccccgccgttgaagactgtgattcgcgcgatcagaataatgaagttccatgtcgctaagcgaaagttcaaggagactttgcgtccttatgacgtgaaggatgtgatcgagcagtactcggccggccatctggacatgctttgtcgaatcaagagcctgcagacaagagtagaccaaatattgggcaaggggcagattacgtcagacaaaaaatcacgcgaaaagataaccgccgaacatgaaacgaccgacgatctctcaatgttgggtcgcgtcgtcaaggtcgagaaacaggtgcaatcgatcgaatccaagctggattgtctgctggacatttaccaacaggtcctgcgcaagggatccgcgtccgctctggccctcgcctcctttcaaatacctccttttgagtgtgagcagactagtgactatcagagcccagttgactccaaggacctctctggatccgcacaaaactcaggttgccttagtagaagcacttccgccaatatctccagaggcctccaattcatccttacccccaatgaattctccgcccagacattttacgccttgagccctaccatgcattctcaggctacccaggtgcccatcagtcagagtgacggctcggcagtggcagcaaccaatacaatagcaaaccagataaacactgctcctaagcctgccgccccgacaaccttgcagattccaccccctttaccagcaatcaagcatttgccgagaccagagacgcttcacccgaacccagcaggtctgcaggagtctatttccgacgtcacgacctgcctcgtagcgagtaaggaaaacgttcaggttgctcaatcgaatctcaccaaggaccggagcatgcgcaagtcattcgatatggggggggagaccttgctttccgtgtgtccaatggtgcccaaggacctaggtaagtctctgagcgtgcagaatttaattaggagcacagaggagctcaatatccaactcagtggaagtgaatcctccgggtcaaggggctcgcaggacttctatcccaaatggcgcgaatctaagctcttcatcactgatgaggaagtgggcccggaagagaccgaaactgacacgttcgacgccgccccacagcccgccagggaagccgctttcgcgagcgactcccttcgcacgggccgctcacgcagttcgcagtccatatgtaaggctggcgagtcgacagatgctctgtccctaccgcatgtcaaattgaaatag

SEQ ID NO: 200340 - DNA, 1284 bp, Artificial Sequence
  Description of Artificial Sequence: Synthetic coding sequence
atgccccggcaccacgccggcggcgaggagggcggcgccgccggcctgtgggtgaaaagtggcgccgcagccgccgccgcaggcggggggagactcggcagcggtatgaaggatgttgagagcggaagaggaagggtactgctgaacagtgccgcagcgagaggcgacggcctgttactgctggggactagagccgccacgttgggcggcggcgggggaggtctgagggaaagtaggaggggcaaacaaggagctcgaatgtcgcttcttggcaagccattatcttatacttccagccaaagctgtcgaaggaacgtgaaatacaggagagttcagaattacctgtacaacgtgctggaaagaccgagagggtgggcttttatctaccacgccttcgtgttcctgcttgtgtttggctgcctgattctctccgtgttttccacgatacctgaacatactaaactagccagtagctgccttctgattcttgagttcgtcatgatcgtggttttcggtttggaattcattattcggatttggagcgccgggtgctgttgtcgctacaggggatggcaagggagactgcggtttgctcgcaagcctttctgtgtaattgatactatcgtgctaattgcatccatagcggtcgtctcagccaagacacagggaaatatattcgcaacttccgcattacgttccttaaggttcctacagattttaaggatggttagaatggatcggcgtggaggaacatggaagctcttaggttcggtggtgtacgcccactccaaagaactcatcactgcctggtacataggcttcctagtgcttatttttagtagttttctggtgtatttggtcgaaaaagatgccaacaaggaattctctacgtatgccgatgctctttggtggggaactatcactttgaccacgatcggttacggagataaaacacctttgacatggctagggcgtctcctctctgcaggtttcgctcttctgggtatttctttctttgcattgccagccggcattttgggctccggcttcgccctgaaagtccaagaacagcatagacagaagcatttcgaaaagcggcgcaatcccgcggccaatctaatccagtgcgtgtggagaagctatgcggctgatgaaaaaagcgtctccattgcaacttggaaacctcatctcaaggccctccatacttgcagccctacgaagaaagaacagggcgaggcttctagtagatttgtcatcagcttgctcctgcacgtgtgtctatag

SEQ ID NO: 200341 - DNA, 2799 bp, Artificial Sequence
  Description of Artificial Sequence: Synthetic coding sequence
atgccccggcaccacgccggcggcgaggagggcggcgccgccggcctgtgggtaaagtccggagctgcggccgccgctgcaggcggcggcagactggggagcggaatgaaagatgtcgagagtgggcggggcagggtgctgctgaattccgcagctgcccggggtgatgggctgcttcttctggggacgagggctgctaccttaggtggtgggggtggcggactgagagaatcgcgccggggaaaacagggggctcggatgtctctgctggggaagccgctgtcttatacctcttcccagagttgccgccgcaatgtaaagtacagaagagtgcaaaattatctgtataacgttcttgagaggccacgagggtgggcctttatttatcatgcatttgtgttcttattggtgtttggctgtctgatcctttcagtcttttcaactattcccgagcacactaagttagctagctcttgtttgctgatcctcgagtttgtgatgattgtggttttcggcttggagtttatcataaggatctggagcgctgggtgttgttgtaggtacaggggttggcagggtcggcttcgcttcgcccggaaaccattttgcgtcattgacactattgtgctgatcgcctctatcgcagtagtgtccgctaaaacccaaggcaatatcttcgcaacttctgccctgcgctccctccggtttctgcagatcctcagaatggtgcgcatggaccggcgggggggtacctggaaattgttgggcagcgttgtttatgcccacagtaaagaattgattaccgcctggtatatcggcttcctcgttttgattttctccagcttcttggtgtacctggtggagaaagacgctaataaagaattctctacgtacgcagacgccctctggtggggtacaattacccttactaccatcggatatggcgataaaaccccactcacatggctcggccgattgctttccgccggctttgcattactgggaataagtttcttcgcgctgcccgctggaatacttggaagtggatttgctctgaaggtgcaggagcagcatcggcagaagcacttcgaaaagcgaaggaacccggccgccaatcttatccagtgcgtgtggcgctcatatgctgccgatgaaaaaagcgtgagcattgcaacatggaagcctcatctgaaagcactgcatacgtgtagccctacaaagaaggaacagggagaggcttctagcagccagaaactatctttcaaggagagggtccgcatggcaagtccacggggacagtctattaaatcaaggcaagctagtgtcggggaccgcaggtccccatctacagatatcacagccgaaggctctccaaccaaggtacagaagtcatggagttttaatgatcgaacccgttttagaccctccctgcgcctgaaaagcagtcagccgaaaccagtgatcgacgcggacacagccctggggacggatgacgtctacgacgagaaagggtgccagtgtgacgtcagtgtagaggatttgactccccccctgaagaccgtgatcagggccattcgcataatgaaattccatgtcgccaaacggaaattcaaggaaacactcagaccctatgatgtcaaggacgtaatagagcaatattccgccggacacctggatatgctatgccgaatcaaaagcctacagacccgcgttgaccagattctagggaagggtcaaatcacatccgataagaaatctcgggagaaaataaccgcagagcatgagaccactgatgacctgtccatgctgggcagagtcgttaaggtcgaaaagcaggtgcagtccatcgagagtaagctggattgtctactggacatctatcaacaagtgctgcgtaaagggtctgcttcagctctggcgctcgcgtccttccagattcctcctttcgagtgcgagcagacaagcgattatcagtctcctgtggatagtaaagatttaagcggctctgcccagaacagcggctgcctctcacgatctacatccgccaacatcagcagggggctccagtttatactaactcctaacgaattcagcgctcagaccttttacgctttgagccccactatgcactcccaggctactcaggttccaatttcccagagcgatgggtccgctgtggccgccaccaacaccatcgccaatcagattaacaccgcccctaagccagctgcgcctaccactctgcagatcccccccccgctcccagccatcaaacatctcccccgcccggaaaccctccaccccaatcccgcagggcttcaggagtctatctcagatgttactacgtgcctcgtcgcctcgaaggagaacgtgcaagtcgcccagtcaaacctgacaaaagacagatccatgagaaaatcttttgatatgggcggcgagactctgctatctgtgtgtcctatggtccccaaagaccttggaaagagcctatcggtacagaaccttatacggtctacggaggaattgaacatccagctgtcgggatccgagagtagtggaagcaggggatcccaggatttttacccaaagtggcgggaatccaagctgttcattacagatgaagaggtgggtcctgaggagacagagaccgatacatttgacgccgccccgcagcctgcccgtgaggctgccttcgcaagcgactcactcaggactggacggtctagatcctcccagtctatctgcaaagcaggagagtcaactgacgcactctccctgcctcatgttaagctgaaatag

SEQ ID NO: 200342 - DNA, 2829 bp, Artificial Sequence
  Description of Artificial Sequence: Synthetic coding sequence
atgccccggcaccacgccggcggcgaggagggcggcgccgccggcctgtgggttaagagcggtgcagctgccgcagccgcgggtggagggagacttggatccggcatgaaagacgttgagagcggacggggccgcgtcctattgaactctgctgccgcccggggagacggactgcttctgttaggtactagggctgctacactgggtggggggggagggggactccgcgagagccggcgcggtaagcagggggcgagaatgagtctcctggggaaaccactttcatatactagttctcaatcttgcagacgcaatgtgaaatatcggcgcgtacagaattacctctacaatgtgttggaaagacccagagggtgggcgttcatttatcacgcctttgtatttctcctggtctttggctgcctaatcctgagtgtgttcagtactattcccgaacacacaaaattggcgagcagttgtcttctgattttagagttcgtcatgatagtagttttcggactggagtttatcattaggatttggtccgcgggctgttgttgtcgttaccgcggttggcaggggaggttgaggttcgcccgcaagccattttgcgtcatcgatactattgtgttaattgcaagtattgcagtcgtcagcgctaaaacacagggaaacatctttgccacctccgctctgagatctctgcgctttttgcagatattacgaatggtcagaatggaccggagggggggaacctggaaactgctgggatccgttgtttacgcccacagcaaagagttaatcactgcctggtatatagggtttcttgtattgatcttcagtagcttccttgtgtacctggtcgaaaaggatgccaataaggaatttagtacatatgccgatgccctctggtggggcacgatcacacttaccaccattggttatggggacaagacccccctcacctggttaggccgcctgcttagcgcagggttcgccctgctgggcatctcctttttcgcccttccagcagggatcctgggctcgggctttgccctgaaggtacaggagcagcataggcaaaagcacttcgaaaagcggaggaaccccgccgcaaacctaatccagtgcgtttggcgctcttatgcggccgacgagaagagcgtgtccatcgcgacctggaagccccatctcaaggcgctgcatacatgcagccccaccaacaagttctgttccaataagcaaaagttgttccgcatgtatacaagccgcaagcagtcacagaagttaagttttaaggagcgggttaggatggcgtcgccccgtggccagtcaattaagtctcgacaggccagtgtgggagacagacgttcaccatcaactgacattactgctgaaggatccccaaccaaagtacagaagtcttggtcatttaatgatcgtaccaggtttcgtccctctctgcgtctgaagtcctcccaaccaaaaccagttattgatgccgatactgccctcggaaccgatgacgtttatgatgagaaagggtgtcagtgtgatgtctcagtggaagatctgacacctcccctcaagactgtgataagggctattcggattatgaagtttcatgtggccaaaagaaagtttaaggagactctgagaccctacgatgtgaaggacgttatcgaacagtacagcgccgggcacctcgacatgctgtgcagaataaaatcactgcagacacgcgtggatcagatcctcggaaagggccagatcacaagcgataagaagagtagagagaaaatcaccgccgagcacgagaccacagatgacctcagcatgttaggccgagtggtgaaagtggagaagcaggttcaatccattgagtcaaaactggactgtcttctcgacatataccagcaggtgttacggaaaggctctgcgagcgccttggcattggcctcgtttcagatcccccctttcgaatgcgagcagacaagcgattaccagagcccggtggacagcaaggatttgtccggttcagctcagaatagcggctgcctatcccggtcaacgagcgctaatatatcccgcggattgcagttcatactgacaccaaacgagttctcggcccagacgttttatgctctgtcacccacgatgcactcccaggcaacacaggtgcctatctctcagtccgatggatccgccgtagcagccacaaatacaattgcaaaccagatcaataccgcccccaagcctgccgcaccgacaacactgcagatacctccaccattgcccgccatcaagcacctgcctaggcccgagacccttcatcctaatcccgcggggctgcaggaaagtatctcagatgtaacaacatgcctggtcgcttcaaaagagaatgtgcaggttgcgcagtccaacctgacaaaggacaggtcaatgcgtaagtctttcgacatggggggtgaaaccctactctccgtttgtccaatggtgcccaaggacctgggtaagagcctgtccgttcagaacctcatacggtccacagaggagctgaacattcagcttagcgggtctgaatcgagtggcagccgcggatcccaagatttctatcctaaatggcgagaatcaaagctatttatcacggacgaggaagtgggtccagaggagaccgagaccgataccttcgacgccgctccacagcccgcacgagaagcagcgtttgctagcgactctctgcggacggggcggtcacgtagctcacagtccatatgtaaagcaggggagtcaaccgatgccttgagcttaccacacgttaagctgaaatag

SEQ ID NO: 200343 - DNA, 2772 bp, Artificial Sequence
  Description of Artificial Sequence: Synthetic coding sequence
atgccccggcaccacgccggcggcgaggagggcggcgccgccggcctatgggtcaaatccggggctgcagcggccgctgctggaggaggacgcctggggtctgggatgaaagatgtggaaagcggaagaggccgggtcctcctgaattctgccgccgccaggggggatggacttttactcctgggtaccagggctgccacactcggtggaggtggtgggggcctgagagagtctagacgaggaaaacagggagccaggatgagtcttttagggaaacctttatcctacaccagttcccagagctgtcgcagaaacgtcaaatacagacgggtgcagaattacctgtacaatgtgctggagagacctagaggatgggcgtttatctatcatgccttcgtcttccttctggtgttcggatgcttaattctttctgttttcagcactatccctgagcacactaaactggcttcctcctgcctgctgatccttgagttcgtgatgatcgtggtattcggcctcgaattcatcattcggatatggtccgccggctgctgctgtcgctaccgaggatggcagggcaggcttcgtttcgcacgcaagcccttttgcgtaattgacactattgtgttgattgcctccatcgccgtggtttccgccaagacccagggcaatattttcgccacatctgctctgcgcagcttgcggttcctgcagatacttaggatggtgcggatggatagaagggggggcacatggaaattgctgggcagtgtcgtgtatgctcacagcaaagagctcatcactgcgtggtacattggattcctggtcctcatcttttctagctttttggtctatctggtggagaaagatgccaacaaggaatttagcacctatgctgacgctctgtggtggggcactattacgctcacaaccattggctacggggacaaaaccccactgacctggctaggcagactcctgtctgccgggttcgctctgctcggcatatcatttttcgcactgccagccggaatcttaggcagcggctttgcacttaaagttcaggaacagcacaggcaaaaacactttgagaagagacgcaacccggccgctaaccttatccagtgcgtttggagatcatatgcggcagacgagaagagcgtgtctatcgctacctggaagccgcatctgaaggccttgcacacctgttctcccacgaatcagaaactatcttttaaagagagggtgagaatggccagtcccagaggtcagagtatcaagagtcggcaggcaagcgtcggagacaggaggagtccttctaccgacattacggctgagggaagcccgactaaggttcagaagtcttggagctttaacgatagaactcgatttagacccagtctccggctcaagagctcccagcccaagcccgtgatagatgcagatactgcgctgggcacagacgatgtctatgatgaaaaagggtgccagtgcgatgtgagcgtggaagatttgaccccccccctcaagaccgtaataagagccatacggattatgaaattccacgtcgccaaacgaaaatttaaggagaccctgagaccctatgatgtcaaggatgtcattgaacagtactctgctggacacctggacatgctgtgcaggatcaagtcacttcagacccgtgtcgatcaaatactcggcaaagggcaaattacttcggataaaaaatctagagagaagatcacagcggagcatgagactaccgacgatctgtccatgttgggccgcgtagtcaaggtcgagaaacaggtccagtctatagagagcaagctggactgtctccttgacatctatcaacaggtgctgcgtaagggatctgcctctgcgttggctttagcttcgtttcaaattccacctttcgagtgtgaacagacgagtgactaccagtcacctgtggactccaaggacttaagcgggagtgctcaaaacagcggttgtttaagtcgctccacctccgctaacatctccagggggctgcagtttatccttacgccaaacgaatttagtgcccagacattctatgctctgtcacccaccatgcactcacaggcaacccaggtccccatcagtcagtctgatggaagtgctgtggcagccacgaacacgattgccaatcagattaatacggctcctaagccggctgctcccacaactctgcagatccctccgcctcttcccgccatcaaacatttgccacgaccagaaacactgcatccaaaccccgccggtctgcaggaatctatcagcgatgtcactacttgcctggtcgcttcaaaggagaatgtgcaggtggcccagagtaacctcacaaaggaccggagtatgcgaaagagcttcgacatgggcggtgagacacttctaagtgtttgtccaatggttcctaaagaccttggtaaaagcttgtctgtccagaaccttattagatcaacggaggagttgaacatccaactcagcggttccgaatccagtggctctagaggaagccaggacttttatcccaagtggcgagagtctaaactgttcatcaccgatgaagaggtcggtcctgaggaaaccgagaccgataccttcgacgccgctccacagccagcccgcgaggcagctttcgcaagtgattctctgcggaccggacgctcccgcagctctcagtcaatctgcaaagccggcgagtccaccgacgccctgtccctacctcacgtaaagctcaaatag

SEQ ID NO: 200344 - DNA, 2469 bp, Artificial Sequence
  Description of Artificial Sequence: Synthetic coding sequence
atgccccggcaccacgccggcggcgaggagggcggcgccgccggcctctgggtcaaatcaggagcagctgctgcagccgccggtggaggacgattagggtctggcatgaaagatgttgaaagcggtcgcggaagggtgctgcttaatagtgccgcagcccgcggcgacggtctcttgctgctcggaactagagctgcaacgctgggggggggcggcggcgggcttcgggagtctaggagaggcaagcagggtgcccgcatgtcccttctgggcaagcctctgagttatacgtcttcccagtcttgccgcagaaacgtgaaataccgtcgtgttcagaactacctatataacgtcctagagaggccacgcggatgggcgttcatttaccatgctttcgtattcctgctcgtgttcgggtgcttaatcctttccgtgttctcaacaatccccgaacacactaaattggcatcctcctgtcttttgattttggagttcgttatgatcgttgtgttcggactggagttcatcatccgcatttggtctgccgggtgttgttgtagatatcgggggtggcaggggaggctgagatttgctagaaaacccttctgcgtcattgatacgatagtgttgatcgcttcaattgccgtcgtgtcagcaaagacccagggcaatatattcgccacaagtgccttgaggagtttgaggttcctacagatcctgcgaatggtccgcatggatcgcagaggtgggacctggaaacttctggggagcgtggtatatgcccacagcaaagaactgatcacggcttggtatatcggattcctggtgctgatctttagctcctttttagtctacctggtggagaaagatgccaataaagagttctccacatatgccgatgcactttggtgggggacaatcaccctgactacgatcggttacggcgacaaaacgccactgacctggctcggaagactgctcagcgctggctttgcgctgctggggatctcctttttcgcattgcctgcgggaatcctgggatctgggttcgcgttaaaggtacaggagcagcaccgccagaaacactttgaaaaacggcgcaatcctgcggcaaatctgatccagtgcgtatggcggagttacgcagcggacgagaagtccgtgagcattgcaacttggaaaccacaccttaaggctctgcacacgtgtagcccgacaaagaaggagcaaggagaagcctcctcccggatcatgaaattccacgttgctaaacgcaagttcaaagaaacactgagaccatacgatgtcaaagacgtgattgaacagtactcagccgggcacctggacatgctttgtcggataaaatcacttcagacaagagttgaccaaattcttggcaagggtcaaattactagcgacaagaaatcacgggaaaagattaccgctgaacacgagactacagacgatttgagtatgttggggcgtgtcgtgaaggtggagaaacaagttcaatccatcgaatctaagctcgactgcctgctagacatctaccaacaggtgttgaggaaggggagcgccagtgctctggctctggcctcattccagattccgcctttcgaatgcgagcagacatcagactatcagtcaccagtagattccaaagacctttccggaagcgctcaaaactcagggtgtttgtcacgctctacatctgctaatatttctcgtgggctacagtttatcttgacgcccaacgagttctctgcgcaaacattctatgcgctcagccctacaatgcattctcaggcaactcaggttcctatctcccagagcgacggctcggccgtggcggcaacgaacacgatcgctaaccagatcaacaccgctcccaagccggcagctccaacaacactgcagattcctcctcctttgcctgccatcaaacacctgccacgccctgagaccctgcaccctaatcctgctggtctccaagagtccatctcggacgtgacaacctgtctcgttgcctcaaaggagaatgttcaggtcgcccagagcaacttgactaaagacagatcaatgaggaagagctttgatatgggcggggagacgctgcttagtgtatgtccaatggtcccaaaggatctgggcaaaagccttagcgtgcagaatctaattcgatccacagaggagctgaatattcagttgtctggtagtgagtcctctggaagtaggggctcccaagatttctaccccaagtggcgagaaagcaagttgtttattacagatgaagaggtggggccggaagagaccgagacagatacctttgacgcagccccgcaaccggcccgcgaagccgctttcgcttctgacagtctgcgtaccggccgtagtcgcagtagccagagcatttgcaaggctggtgaatctacagatgccttgtcattaccacacgtgaagctaaagtag

SEQ ID NO: 200345 - DNA, 2856 bp, Artificial Sequence
  Description of Artificial Sequence: Synthetic coding sequence
atgccccggcaccacgccggcggcgaggagggcggcgccgccggcctgtgggttaaatccggagccgccgccgccgctgcagggggagggcggcttgggagcggcatgaaagacgtggagtcaggtcgcgggcgtgtacttctgaactccgctgccgctcggggtgatgggttgctcttgcttggcactcgtgccgccacactgggaggtggcggaggcggactgagggagagccggcgcggaaagcagggagccaggatgtctctgcttggaaagccactttcttacacaagttcgcagtcatgtcggaggaacgtgaagtataggcgggtgcagaattatttgtacaatgtgttagagcgccccagaggatgggcattcatctaccatgctttcgtgtttctcccagtgttcggatgtctcatcttgtccgtcttcagcacaataccggagcatactaagctggcttcttcctgccttctgatcctggaattcgtcatgatcgtcgtgttcgggctagaatttatcattcggatatggagtgctggatgctgttgtcgctacaggggttggcaaggacgtttgcgtttcgcacggaaacctttttgcgtcattgacacaattgtgttgatcgcctcaattgccgtggtctctgcaaagacccagggcaatatcttcgctacctcagccctcagatccctaaggttccttcagatcctgcgcatggtgcgcatggaccgtaggggaggcacatggaagttgctaggaagcgtcgtttacgcccattcaaaggaactgataactgcatggtacattggcttcctcgtcctgatcttttcatccttcctggtttacctcgtcgagaaagatgccaacaaggagttctctacatacgccgatgccctttggtggggtacgattactctgaccaccatcggatacggggataagacacctctgacctggctgggaagattgcttagtgccgggttcgcactcttagggattagcttctttgccctccctgccggtattctgggatcaggttttgcccttaaagtccaggaacagcatcggcagaagcattttgagaaaagacggaacccagcagccaacctgatccagtgcgtgtggcggagctatgctgccgacgaaaaaagtgtctccatagccacatggaagccgcacctgaaggccctccatacttgttctcccaccaaaaaggaacaaggagaggcctccagttctaagttctgtagtaacaagcagaaactcttcaggatgtacacctcccgaaaacagagtcagaaattaagctttaaggagcgggtccgcatggcctctcctcgaggacagagcataaagtctcgacaggcctcggttggtgatcgcaggtctcccagcactgacattacagccgaggggtcccccaccaaggtccagaaatcatggagctttaatgacagaactcgctttcgcccttccctgaggctgaagtccagtcagcctaaacccgtgatcgatgcagacaccgccttaggcactgacgacgtatacgatgaaaaggggtgccagtgcgatgtatctgtagaggacctgactcctccactcaaaaccgtgatcagggctataaggatcatgaaatttcacgtcgcaaaacgcaaatttaaggaaacactgaggccctacgatgtgaaggacgtgattgagcaatattctgcggggcatttggacatgctgtgccgaataaaaagccttcaaacgcgcgttgaccagatcttaggcaagggccagataactagcgacaagaagtctcgcgagaagatcaccgcagagcacgaaacaaccgatgatcttagtatgcttggccgagttgtgaaggtagagaagcaggtccagtccatcgagtcaaagctggactgcctgctcgacatttaccaacaggttctgaggaagggtagtgcaagcgccttggccctcgcctcttttcaaattcccccttttgagtgcgaacaaacatctgattatcagtctcctgtggactcaaaagacctgtctggaagtgcccagaactccggttgtctatcgagatcaacctcagccaacatcagccgaggactacagtttatcctcactcccaacgaattttccgcccagacattctatgccctgagccccaccatgcactctcaggccacacaggtccctatatctcagtcggacggctctgcagtagccgccaccaataccattgctaatcagataaacaccgccccaaagccggccgcccctaccacgttgcaaatccctcctcctcttcccgcgataaagcatctccctcggcccgagacccttcatcccaaccccgccgggctgcaggaatccatctctgatgtgactacatgtttagtggcgagcaaagaaaacgtgcaggttgctcagtccaatttgacaaaagataggtcgatgcgcaaaagctttgatatgggcggtgagacactgttaagcgtctgtccaatggtcccgaaggatctcgggaagagcctgtcagtgcagaacctgatacgctcaacagaggagctgaatattcagctgagtggcagtgaaagttcaggctcccggggcagccaggacttctacccaaagtggagggagtctaaactgttcataaccgacgaggaagtcggtccagaggagacggagactgacacctttgatgctgcaccacagcctgcacgcgaggcagcctttgcctcagacagcctgagaactggcaggtcccgctcgagccagtctatatgtaaggccggagagtcgaccgatgcactgagcctgccccatgtcaaacttaaatag

SEQ ID NO: 200346 - DNA, 2577 bp, Artificial Sequence
  Description of Artificial Sequence: Synthetic coding sequence
atgcccgccggcatgaccaagcacggcagccggagcaccagcagcttgcctcccgagcccatggagatagtccgaagtaaggcctgctcgaggagagtgcgcttgaatgtcggtgggctggcccacgaagtgctgtggcgaactctggatcgtctgccccggactcgcctgggcaaactgagagattgcaatacccatgactccttgctagaggtgtgcgatgattatagcctcgatgacaacgagtacttctttgaccgccatccaggggccttcacttcgatattgaacttttacaggaccggtcgcctacacatgatggaggagatgtgtgctttgagcttttctcaggaactggattactggggcattgacgagatctacctggaatcgtgctgccaagccagataccaccagaagaaagaacagatgaacgaggagcttaagcgcgaagcagagactcttagggagcgcgaaggcgaagagtttgataacacttgctgcgcagaaaaacggaagaagctgtgggacctgctggagaagcccaattccagtgtcgccgcaaaaatactggcaatcatcagcattatgtttatcgtcctgagcacaatcgctctgagtctgaacaccttaccggagctccagagtttggatgagtttggacagagcactgacaatccacagttggcccacgtagaagctgtttgcatcgcgtggtttaccatggagtaccttctgcgctttctctccagcccaaaaaagtggaagtttttcaaggggccgttaaatgccattgacctcctggccatacttccctattacgttaccattttccttactgaaagtaacaagtctgtgcttcagtttcagaacgtacgcagggtggttcagatctttcgcatcatgaggatccttaggatcctaaaacttgcacggcattcgacagggctccagagcctgggattcaccttaaggcgaagctataacgagttaggtctccttatcctcttcctcgctatgggtattatgatcttttccagtctggtgttttttgccgaaaaagatgaagacgacaccaagtttaagtctattcccgctagcttctggtgggctacaattaccatgactactgtcggctatggggatatctatcccaagactttgctggggaagatcgtaggaggactttgttgcattgcaggggttctcgtgatcgctcttcccatccccattattgtaaataatttctccgagttctataaggagcaaaaacggcaggagaaagcaatcaaacgtcgtgaggccctagaaagggccaaaaggaacggcagcatcgtgtccatgaacatgaaagacgcctttgccaggagcatcgaaatgatggatatcgtggtggagaagaacggcgagaacatgggtaagaaagataaggtgcaggataaccatctgagccccaataaatggaagtggactaaacggactctgtccgagacaagttcctctaaatccttcgaaaccaaggagcaaggctcgcccgaaaaggctcggtcctcctcatccccacagcacttaaatgtgcaacagctcgaagacatgtataacaagatggccaagactcagtcccagcccatcttgaacacgaaagaatctgccgctcagtcaaagcctaaagaagaactggagatggagagcatcccctcccctgtggcccccctccccacgcggactgaaggcgtgatcgatatgaggtctatgtccagcatcgattccttcattagctgtgctactgacttcccagaagccaccaggttttctcactcgcccctgacatccttgccttcaaagacgggtggctcgacagcacccgaggttggctggcgtggtgccctgggcgcctcaggggggcgattcgtcgaggctaacccatcacccgacgcaagccagcacagttccttcttcatcgaatcccccaaatcttcaatgaagacaaataacccactaaagcttcgggcactgaaggtgaattttatggagggggacccttccccccttctgccagtcttggggatgtatcatgaccccctgaggaacagagggtctgcggcggccgctgtggccggcctggagtgtgcgactctgttggacaaggccgtcctgtcccccgagtcctcaatttacacaaccgcttccgctaagacgccgccaagatcgcccgaaaagcatacggccatcgctttcaattttgaagcgggagtacatcagtacatagacgcggacacagacgacgaagggcaactgctgtacagcgtcgattcttccccgcctaaatccctccccggatcgaccagcccaaaattctccactggaacccgaagtgaaaagaatcacttcgaatcgtcgccgctcccaactagcccaaagttcttgaggcagaattgcatctactcaacggaggccttgacagggaaggggccgagtgggcaagaaaagtgtaagcttgagaatcatatctctccagatgtgagagtcctgccagggggaggcgctcatgggagcacacgggatcaaagcatctag

SEQ ID NO: 200347 - DNA, 2442 bp, Artificial Sequence
  Description of Artificial Sequence: Synthetic coding sequence
cgggacggcggcgagaagaccgccgtgacccggctgggcaagctgagggattgcaacacacacgacagtctgttggaggtctgtgacgattatagcctggacgataacgaatatttcttcgatcgacaccctggggcatttaccagcattttaaacttctaccggaccggccggctccatatgatggaagaaatgtgtgcgctcagttttagtcaggagttggactattggggcatcgacgagatctatctggaaagctgttgtcaagccagataccaccagaaaaaagagcaaatgaacgaggaattaaagagggaagccgagacattgagggaaagggagggggaggagtttgacaacacgtgctgcgccgagaagaggaagaagctatgggacctcctggaaaaacctaatagttcagtggctgctaaaatccttgccattatatccatcatgttcattgtcctgtctacaatcgcactatctctgaatactctccccgagttgcagtctctagacgagtttgggcagtccacagataaccctcagctggctcacgtggaagcagtgtgcattgcatggttcacgatggagtatctgctcaggtttctctcctcacctaaaaaatggaaattctttaagggacccctgaatgcaatcgacctgttggccatcctcccatactacgtgacaatatttctgaccgagagcaacaagagcgtacttcagttccagaacgtgcgaagagttgtgcagattttccgtatcatgagaatcctacggatcctgaaactggccagacattctaccgggctccagtccttaggctttactttgagacggtcttacaatgaattgggactcctgattttattcctggccatggggataatgatcttttcatcattagtcttctttgcagagaaggatgaagatgacacaaaattcaaatcgattcccgcctcattttggtgggccactataaccatgacaacagttgggtacggcgatatatatcctaagacacttctaggtaaaattgtaggtggtttgtgctgcattgccggagtactagtgattgccctgcccatccctatcatcgttaataacttctccgagttttataaagaacagaagcgtcaggaaaaagctattaaaagacgtgaggctctagagagggccaaacgcaacgggtctatcgtatccatgaatatgaaagatgcctttgctagatccatcgaaatgatggatattgtggtggagaaaaatggcgaaaacatgggcaagaaggacaaggtgcaggacaaccacctcagccctaataaatggaaatggaccaaaagaactctgtccgagacaagcagtagcaaaagcttcgaaaccaaagaacagggcagtccggagaaggctagatcatcaagtagcccgcagcacctaaatgtgcagcagctggaagatatgtacaataaaatggccaagactcagagccagcccattcttaataccaaagaaagcgctgcacagtccaagccgaaggaagaactggagatggagtccatcccttcccctgtggcgccgcttccaacccgcacagaaggcgtgatcgacatgagatctatgagctctattgactctttcatctcttgtgccaccgatttcccagaggctacacgattcagccactctcccttgacctcacttcctagcaagaccggcggctccaccgctccagaggtgggttggcgcggagcattgggggcttctggtggccgattcgtggaggcgaatccatcccccgacgctagtcagcacagtagcttcttcattgagtccccaaaatcgtccatgaagacaaacaaccccctcaagctgcgggccttgaaagtgaacttcatggagggcgaccctagccccctgctgccggtgctggggatgtaccacgacccactccggaacagagggtcagccgctgcagcggtggccggccttgagtgtgcaaccctccttgataaggcagtgcttagccctgagtcctcaatttacactactgcatctgctaaaacacccccgcggtcaccagagaaacacacggcgatcgcttttaacttcgaagccggggtacatcagtacatcgacgccgatacagacgacgaagggcaactgttgtatagtgtggacagctcgcctcctaagagccttcctggctcaacaagtcctaagttttcaaccgggacgaggagcgagaaaaatcacttcgagtcttcccctctccccactagtcccaagttcctgcgacagaactgcatctatagcacagaagcgctcactgggaagggtccctcggggcaagagaagtgcaaactggaaaatcatatttccccagatgtccgtgtgctccctggcggtggcgcacatgggtccacacgtgatcaatctatctag

SEQ ID NO: 200348 - DNA, 2736 bp, Artificial Sequence
  Description of Artificial Sequence: Synthetic coding sequence
atggccgagaaggccccccccggcctgaaccggaagaccagccggagcaccctttcattgcctccagagcccgtcgacatcatccggtctaaaacatgctcacgtcgagtcaagataaatgtgggggggctgaaccatgaagtgctctggaggacgttagataggctgccccgcacacgtttgggaaaattgagagactgtaacacgcatgaatctttactggaagtttgcgatgattataatctgaatgagaatgagtatttctttgatagacaccccggggctttcacatcaatcttgaacttttacagaactgggaaactgcacatgatggaagaaatgtgtgcactgagtttcgggcaggaactcgactattggggtatcgatgagatttacctggagtcttgctgtcaggcccgctaccaccaaaagaaagagcagatgaacgaggaactccgtagggaagccgaaactatgagggaacgggagggcgaggaattcgataacacttgttgtcctgacaagcgcaaaaagctgtgggacctgctggagaagccaaattcaagcgtagctgcaaagattctggccatcgtatccattttgttcatcgtgcttagtaccatcgctttgagtttgaacaccctgccagagctgcaggaaaccgacgagtttggccagctcaacgacaataggcagctagcccacgtagaggccgtatgtattgcatggtttacaatggaatacctccttagatttctgtctagccctaacaaatggaagttttttaaaggccccctgaacgtcatcgatctcttagcaattctcccctattatgtcactatattcctgaccgagagcaataagagcgtgctgcagttccagaatgtccggcgggtggtccagatattcagaatcatgaggattctaagaatccttaagctagcccgacactctaccggcctgcagtctctcggatttactctcaggagaagttataacgaactgggtctgctgatcctctttcttgcaatgggtatcatgatttttagcagcctagtgttcttcgccgaaaaagacgaagacgccacaaagttcacgtctatacctgccagtttctggtgggcaaccataaccatgactaccgtggggtatggtgatatctacccaaagaccctactcggcaagatagtgggcgggctctgctgcatcgcaggtgtgttggttatagcactgccgattccaatcatcgtcaacaacttcagcgagttttacaaagagcagaaaagacaggaaaaggccatcaagagaagagaggctctggagcgcgcaaagcgcaacggttcaattgtcagcatgaaccttaaggatgcttttgcacggagtatggagcttatcgacgtcgcagtagagaaagccggtgaatctgcaaacaccaaggacagcgcagacgacaatcacctttcaccatctcgctggaaatgggctcgcaaggcactcagtgagactagcagcaacaagagtttcgaaaacaagtaccaggaggtctcccaaaaagatagtcatgaacaactgaataacaccagttcttcaagtccccagcacctctccgcccagaaactggaaatgttgtacaatgaaattactaaaacgcagccacatagccacccgaatcctgattgtcaggaaaagcctgaacggccatctgcttatgaagaggagatcgaaatggaagaggtagtgtgcccccaggagcagctcgcagtggctcaaaccgaggttattgttgatatgaagagcacctcttccattgatagtttcacctcatgcgccaccgactttacagagacagagcggtcgccactccctccaccttcagcctcccatctgcagatgaagttcccaactgacctgccagggacggaagagcaccaacgcgcaaggggacccccttttctcacccttagcagagagaaaggccccgccgcgagagacggtaccctggaatacgcccccgtcgatatcacagtgaatcttgatgccagcggctcccaatgcggacttcattctccgcttcaaagcgacaacgctaccgacagcccgaaatcttctctcaagggcagcaatcccctcaagtcaaggagtctgaaagttaattttaaagagaaccgagggagcgccccccagacaccaccctcaacagcccggcccctgcccgtaaccaccgcagactttagtttgaccaccccacagcacatatcaaccatcctgcttgaagagacaccctcccagggagataggcccctcctaggaacagaggtatctgctccttgtcaagggccctcaaaaggactttcgccaagatttcctaaacagaagttgttcccttttagttctagggaacgcagatccttcaccgagatcgatacaggggacgacgaagatttcctggagttacctggggcccgtgaggaaaagcaggtagattcttctcccaattgtttcgctgataagccttcagacggccgcgacccactgagggaagaggggagcgtgggtagcagttcacctcaagacacaggccacaactgcagacaggatatctatcatgcagtaagcgaagttaaaaaggacagctcacaagaagggtgtaaaatggagaaccatttatttgcccccgaaattcactccaatcccggtgacaccgggtactgccccacacgggagacaagcatgtag

SEQ ID NO: 200349 - DNA, 1206 bp, Artificial Sequence
  Description of Artificial Sequence: Synthetic coding sequence
atgcaggtgagcatcgcctgcaccgagcacaacctgaagagccggaatggagaggaccgcctgctcagtaaacagtcctccacagcaccaaatgtggtaaatgcagcccgcgccaaattcagaaccgtcgcaataattgccagatccttaggtacattcactccacagcaccacatttctttgaaggagtccacagccaagcaaactgggatgaaatacagaaatctaggtaaaagcggcctgagagtaagctgtctagggttaggcacttgggtgacttttgggggccagatcagcgatgaagtagcagagcgattaatgaccattgcctacgaatccggagttaacctgtttgacactgccgaggtgtatgcggcgggtaaggccgaagtgatcctgggttcaattattaagaaaaaaggttggcgccgtagctccctggttatcacaacaaaactgtattggggcggcaaggccgaaacagagaggggattatcccgtaaacacataattgaaggactcaaggggagcctccagagacttcagcttgagtacgtggatgtcgtgtttgccaacaggcccgatagcaatacccccatggaagaaattgtgagagcaatgactcatgtcatcaaccagggcatggcaatgtactggggaacatctcgatggtcggcaatggaaattatggaggcatactccgtggcaagacagtttaacatgatcccccccgtctgcgagcaagccgagtatcacttattccagagggaaaaggtcgaagtacagctgccagaattgtaccataagattggcgtgggtgcaatgacctggtcccctcttgcctgtgggatcatttctgggaaatatggaaatggagtccccgaaagcagcagagcgtccctgaaatgctaccaatggttgaaagagcgtattgtctcagaggaaggtcggaagcagcagaacaagcttaaagacctctctccaatcgcagaacgcctgggttgcacactgcctcagctggccgtggcgtggtgtctgaggaacgagggggtatcaagcgttctcctgggtagttcaactcccgaacaactaatcgagaatctcggagccatccaggtgctgcccaagatgacgtcccacgtggtcaacgaaatcgacaacatcctcaggaacaagccatacagtaaaaaagattataggtcgtag

SEQ ID NO: 200350 - DNA, 1173 bp, Artificial Sequence
  Description of Artificial Sequence: Synthetic coding sequence
atgctggccgcccggaccggcgccgccggcagccagatcagcgaggagaacaccaaactgcgcaggcagtccggcttttccgtagccggaaaggacaaatcacctaagaaagcttctgagaatgctaaggacagtagtctttcgccaagtggtgaaagccagttacgtgctcgacaactagccttgttgcgggaagtggaaatgaattggtatctcaagctgtgcgatttgtcttccgaacacacaacagtgtgcaccactgggatgcctcacagaaacctcgggaagtcaggcctgcgcgtcagttgtctgggtctgggcacatgggtgaccttcggtggccagatcagtgacgaagtggctgagaggttgatgactatagcatacgaatctggagtgaacctctttgatacggccgaggtctacgctgcaggcaaggccgaagttatactcgggagtatcataaaaaagaagggctggcggagaagcagccttgtcatcaccaccaagttgtattggggcggaaaggccgaaaccgaaagaggcctctccaggaaacacatcattgaagagatagtgcgagccatgacacacgttattaaccagggaatggcgatgtactggggaacttctcgttggtctgccatggagatcatggaggcctacagcgttgcacgtcagttcaatatgatcccacccgtttgtgaacaggccgagtatcatttatttcagcgtgaaaaagtcgaagttcaactccctgaactgtaccacaagatcggagtgggcgccatgacctggtctccgctagcctgtggaatcataagcgggaagtatggcaatggcgtcccagaaagctccagggcgtcgctcaagtgttaccagtggttgaaggaaagaattgtatcagaggaaggaaggaagcagcagaacaagctaaaggacctctctccaatcgccgagaggctgggctgcacactccctcagctggccgtcgcttggtgcctgcgcaatgagggagtttcaagcgttctgctaggctcctcaacccctgagcagttgattgagaatctcggcgccattcaggttctgcctaagatgaccagtcacgttgtgaacgagatagacaatattctaagaaataaaccttacagcaagaaagactaccggtcctag

SEQ ID NO: 200351 - DNA, 1227 bp, Artificial Sequence
  Description of Artificial Sequence: Synthetic coding sequence
atgcacctgtacaagcccgcctgcgccgacatccccagccccaagctgggactcccgaagtcctctgaaagcgcattaaagtgtagatggcatctcgcagtgaccaaaacacaaccacaggccgcctgcaagcccgtgaggccctccggagccgccgagcagaaatatgtggaaaagtttctccgcgtgcatggtatatctctgcaggagacgacaagagccgaaacaggcatggcctatagaaaccttggaaaatcgggtttgagggtctcctgcctgggtttaggcacatgggtcactttcggaggccagatttcggatgaggtggcagaacggttgatgactattgcctacgagtccggggttaatctctttgacacggcggaggtatatgcagcaggaaaggccgaagtgattttgggatctataattaagaaaaagggctggcggcgctcttccctcgtcatcaccacaaaactgtactgggggggcaaggcggagaccgagcggggcctgtcccggaagcatatcatcgaggggctgaaagggtcattacagagactgcagctagagtacgttgatgtcgtgtttgcaaaccgtcctgattcgaatacaccaatggaggaaatagtgcgcgccatgacacacgtaatcaaccagggaatggcgatgtactggggcacatcccggtggtcagccatggagatcatggaggcttattctgtcgcacgccagtttaacatgataccacccgtatgcgagcaggcggaataccacctattccagagagaaaaggttgaggttcagcttcctgagctttatcacaagataggtgttggggcgatgacatggagtcccctagcttgcggcatcatctctgggaaatacggcaacggggtgcccgagagctctcgcgcaagccttaagtgttaccaatggctgaaggagcgcattgtgtcagaagagggcagaaagcagcaaaacaaactgaaggacctaagccccatagcagaacgcctgggctgcaccctcccccaactcgcagttgcttggtgcttacgcaatgagggcgtatctagcgtactgctggggtccagcacaccagagcagctgatagaaaatctgggcgccatacaggtcttgccaaagatgacatcgcacgtggtgaacgaaatcgataacatcctgcgcaacaagccctattccaagaaagactatcgcagctag

SEQ ID NO: 200352 - DNA, 1260 bp, Artificial Sequence
  Description of Artificial Sequence: Synthetic coding sequence
atgctggccgcccggaccggcgccgccggcagccagatcagcgaggagaatacaaagctgcgcagacaaagcggcttctctgtggctggcaaagacaagtcccccaaaaaagcttcggaaaatgccaaagatagtagtttgagcccatcgggtgagagccagttgagagcacgacaactggctttactgcgggaggtcgaaatgaactggtacctcaaactgtgtgatctgagctcggaacacaccaccgtgtgtaccaccggtatgccccatcggaatctcggcaaatcagggctgcgcgtttcctgcttgggcctagggacctgggtcacattcggcggccagatcagtgatgaggtggccgaacggctcatgactattgcctatgaatcaggagttaacctcttcgatactgcagaagtctacgccgccggcaaggccgaagtaatcctggggagtatcataaaaaagaaagggtggcgcaggtcaagcctggtgattactacaaagctgtattggggggggaaggcagagaccgagcgtggtctgtcccggaaacatatcattgaaggcctgaaggggtctctccagaggcttcagctcgaatacgttgacgtggtttttgcgaaccggcccgatagcaatacccccatggaggagatcgtcagagccatgacccatgtgatcaaccagggcatggccatgtactggggcacatcgcgctggtctgcaatggaaattatggaggcttacagcgtcgcaagacagttcaacatgattccacccgtgtgcgaacaggcagaatatcacctgtttcagagggaaaaagtggaggtgcaattgccagagttatatcataaaattggcgttggggcaatgacttggtctcccctggcctgcgggattatttccggtaaatacggcaatggagtaccggagtccagtagggcatcactcaagtgttatcaatggctgaaggagagaatcgtttcggaggagggacggaagcagcagaacaagctgaaggatcttagtcctattgcagagagactggggtgcacgctccctcaactggctgtggcatggtgtctacgaaacgagggagttagctcagtactcttgggttccagcactcctgagcagttgatagagaatctaggcgccattcaagttctgccaaagatgacttcccacgtcgtaaatgagattgataatattctgaggaacaaaccgtactcgaagaaagattaccgttcttag

SEQ ID NO: 200353 - DNA, 1104 bp, Artificial Sequence
  Description of Artificial Sequence: Synthetic coding sequence
atgtaccccgagagcaccaccggcagccccgcccggctgagcctgcggcagaccggcagccccggtatgatatatagtacgcgctatgggtcgcccaagagacagctgcagttctatcggaacttaggaaagtctgggctgcgggttagctgtttgggactcgggacgtgggttactttcggcggacaaataaccgacgagatggccgagcagctcatgacattagcttatgacaacggcattaatctgttcgacactgcagaggtatacgcagcagggaaagcggaagtggtcctaggcaatattatcaaaaagaagggctggcgccgctcgtcactagtgattactactaagatcttctgggggggcaaagctgagaccgaacgcgggctgtcccgcaagcacattatcgaagggctcaaggcttccctggagcggttgcagctggaatacgtggatgttgtgtttgcaaatcgacccgatccaaacactcccatggaggagaccgtgagggcaatgacacacgtcatcaaccagggcatggctatgtactgggggacaagtaggtggtcatcaatggaaatcatggaggcctattcggttgcacgccagttcaatctcacgcctccgatctgcgagcaggccgagtaccacatgttccaaagagaaaaagttgaggtgcagctgccagagctgttccataaaattggagttggagccatgacatggagcccgctggcatgcggcatcgtaagtggtaaatacgacagtggaatccctccgtactcacgagcctctctcaaaggctaccagtggttgaaagataaaatcctgagcgaggaggggaggcgtcagcaggcaaagttgaaagaactgcaggccattgctgaacgactgggctgtacactgcctcagttggccattgcatggtgcctcagaaatgaaggtgtgagctcagtcctccttggagcctctaatgccgaccagctgatggagaacataggagcaatacaggtgttacccaaactcagctccagtatcatccacgaaatcgacagcatcctgggaaacaagccctatagtaaaaaggactatcgtagttag

SEQ ID NO: 200354 - DNA, 1104 bp, Artificial Sequence
  Description of Artificial Sequence: Synthetic coding sequence
atgtaccccgagagcaccaccggcagccccgcccggctgagcctgaggcagaccggttcccccggcatgatctactccaccaggtacgggagcccgaaacgtcagttgcaattctatcggaatctcggaaaatcagggctgcgggttagctgcctcggattgggaacctgggtaactttcggcggccagattaccgacgaaatggccgagcagttgatgaccttggcctacgataatggcattaacctgttcgatactgccgaggtgtacgccgcaggaaaggcagaagtggtgctgggcaacatcataaaaaagaaggggtggaggcgctcttctctggtaatcacaaccaaaatcttctgggggggtaaagccgagaccgaacgcggactcagtcggaaacatattattgaagggctcaaagccagtctggaacggctccaattggaatatgtcgacgtggtgttcgccaataggccagaccctaatacacctatggaggaaaccgtgagggctatgacccacgttatcaatcaaggtatggcaatgtattggggaacttcccgatggagctctatggaaattatggaagcatattccgttgcacgacagtttaacctgactccccccatttgtgagcaagctgaataccacatgtttcagcgggagaaagtggaagtacagctgcctgagttgttccacaagattggcgtgggagccatgacctggtctcccctggcctgtggcatcgtgtctggtaaatacgacagcggaataccgccctatagcagggccagcctgaaagggtaccagtggctgaaagacaagatactaagcgaggaaggccgcaggcagcaggccaagctcaaggagcttcaggccatcgcagagcggctcggctgcacactgcctcagcttgcaattgcctggtgtcttcgcaacgaaggagtgagttccgtcctcctgggtgctagcaacgctgaccaactgatggagaacattggcgcaatccaggtgcttccaaagttgagctcaagcattatccacgaaatcgactctatcctcgggaataagccttatagtaagaaagattaccggagctag

SEQ ID NO: 200355 - DNA, 1062 bp, Artificial Sequence
  Description of Artificial Sequence: Synthetic coding sequence
atgtaccccgagagcaccaccggcagccccgcccggctgagcctgcgtcagaccggaagcccgggaatgatttatcggaacctgggcaagagtgggctgagagtgagctgcctcggcctcgggacctgggtcacgtttggggggcagatcaccgatgaaatggccgagcagctcatgacccttgcatatgataatggtatcaacctgtttgacactgccgaggtttacgccgctgggaaagccgaggtcgtgctgggcaatatcattaagaaaaagggctggagacggtcatccttggtcatcacaacaaagatcttctggggcggcaaagccgagaccgaaaggggactgtccaggaaacatattatcgaaggtttaaaggcctctctggaacgtctccagttagaatacgtggatgtggtgtttgcaaatcggcccgaccccaacacccccatggaggaaacagtgagagcaatgacccacgtcatcaatcagggtatggcaatgtattgggggacatcccgctggagctccatggagattatggaagcatatagtgtggcccgccagttcaatcttacaccaccaatttgtgaacaagcggaataccatatgtttcaacgcgaaaaagtggaggtgcagctgcccgagttattccataagattggggtgggtgcaatgacctggagcccattagcgtgtggcattgtatcagggaagtacgacagcggaattcctccttactccagggcttccctcaaaggctaccaatggctgaaggataagatcctctccgaggaggggcgaagacagcaggccaaactgaaggagcttcaggcgatcgctgagcgcctggggtgtactctgccacagttggccattgcctggtgtctccggaatgagggagtctcctcagtgctcctaggcgcgagcaacgccgaccagctgatggaaaacatcggcgccatccaggtgctgccaaaattgtcatcttctattattcatgagatcgattcgattctaggaaataaaccgtactccaagaaagattacagatcatag

SEQ ID NO: 200356 - DNA, 1248 bp, Artificial Sequence
  Description of Artificial Sequence: Synthetic coding sequence
atgctgagcatgacctacagcgagagcctgcggagcgtgagcagccgatgccatagcgagtgggccctgcacccagtaagacagactgacaccctagagctgcaacgacttagggaggtccgcgccgccgcccaggctaggaacatggagagcttcctcaggatgcacggtctgtccctagatggatgcaccgcccaacgaaccggaatgaagtacaggaacctgggcaagtctggtctgcgggtgagctgcttaggcctgggcacgtgggtaacatttgggggccagatcactgacgagatggccgagcagctgatgaccctagcctatgataatggtatcaatctctttgatactgccgaggtttatgcagccgggaaagctgaagttgtgctcggaaacatcatcaagaagaaaggctggcggcgcagctccctcgtcatcacaaccaagatcttttgggggggcaaagccgagacggaaagaggactgtcacggaaacacatcatcgaggggcttaaggcctccttggaaaggctgcagctggaatacgtggacgtcgtattcgccaatagaccggaccctaacacacctatggagggcgatcctttcagctcatctaagagccgcacatttatcatcgaggagacagtcagggcgatgacgcatgtgatcaatcaaggcatggctatgtactggggtacctcgcgctggtcaagcatggaaattatggaagcgtactccgtagctcgccaatttaatttgacaccacccatctgcgaacaggccgaatatcatatgttccagcgggaaaaggtagaggttcaactcccagagctgttccataaaataggagtcggcgcaatgacctggtcaccgcttgcttgcgggattgtatctggtaaatatgattccggaatacctccctactccagggccagcttgaaaggttaccagtggctaaaagacaagatcttatcagaagaggggcgcaggcagcaagccaaacttaaggagctccaagcaatcgctgagcgtctcgggtgtactctgcctcaattggcgatcgcttggtgtctgagaaacgaaggggtgtcctccgtgctgctaggggccagtaacgcagatcagctaatggagaacatcggagccattcaggttttgccgaaactgagttcgagcattatccacgagattgacagtattctcggcaacaagccatattccaagaaggattatcgatcttag

SEQ ID NO: 200357 - DNA, 522 bp, Artificial Sequence
  Description of Artificial Sequence: Synthetic coding sequence
atgtaccccgagagcaccaccggcagccccgcccggctgagcctgcgccaaaccggtagccctgggatgatctactcaacgcgttacgggtctccaaaacggcagttacagttctacagaaacctcggtaaatctggactcagagtcagctgtctgggcctgggtacatgggtcaccttcggagggcagattaccgacgagatggctgaacagctgatgactctcgcatacgacaacgggataaatctcttcgatactgccgaagtctacgcagctgggaaggccgaggtcgtgctggggaacattattaagaagaaaggctggtctcagcagggcgaaagagccggacaggcgagggtgaccccaccatgttcactgggacgtcgcgcacgggatgcgtcaaaatctgccggtgcgggctgccacctacaggctcaggcttgcgtgcccagctccacacaggcgctccagacaacgcggggaagggcccccctgaaaccacctcctccacttgcatcatag

SEQ ID NO: 200358 - DNA, 1062 bp, Artificial Sequence
  Description of Artificial Sequence: Synthetic coding sequence
atgtaccccgagagcaccaccggcagccccgcccggctgagcctgaggcagacggggtcaccgggaatgatttacaggaatctcggcaaatcaggactgagagtgtcgtgcttagggctggggacgtgggtaaccttcggtggtcagattacggacgagatggctgaacagcttatgaccctggcctatgacaatggcatcaacctgttcgacaccgccgaggtctacgcagccggaaaggccgaggtggtcttgggcaatattattaaaaagaaaggctggcgccgttctagcttggtgatcactactaaaatcttctggggcgggaaggccgagacggagcggggtttaagccggaagcacattattgaagggctaaaagcgagtttggaaaggctacaactagaatatgtcgacgtagtgtttgcaaataggcctgaccctaacacccccatggaggagacagtgcgggctatgacccatgtcattaatcagggcatggctatgtactggggtacctcccgctggtcgtcaatggagattatggaagcatattctgtggcaaggcagttcaacttgactccacctatctgtgagcaggcagagtaccacatgttccagcgcgagaaggtggaagtgcaactgcccgagctcttccacaagattggggttggcgctatgacttggtcccctctggcctgcgggattgtgagcgggaagtacgactccggaatcccaccatactcacgcgcatctctgaaaggatatcagtggctgaaggataaaattctgtccgaggaaggcaggcgccaacaggccaaactgaaggaactgcaagctattgccgaaaggttaggatgtaccctgccgcagctcgcaatcgcatggtgcctgcggaacgagggggtgtcatctgttttgttgggcgcctccaacgcagaccaacttatggaaaacatcggggctatccaggttctcccaaagctgagttcctccatcatccatgaaatagacagcatacttggaaacaaaccctactctaagaaggactatagaagctag

SEQ ID NO: 200359 - DNA, 1104 bp, Artificial Sequence
  Description of Artificial Sequence: Synthetic coding sequence
atgtaccccgagagcaccaccggcagccccgcccggctgagcctgaggcagacgggctcaccagggatgatttactctacccggtatgggtctccaaaacggcagctgcagttctatcgcaacctggggaaatctggcctgagggtgagctgcctcggattgggcacatgggtgacattcggaggtcagattacggatgagatggcagagcagctgatgaccctggcgtacgacaacggcatcaacctctttgacacagccgaggtgtatgctgcagggaaagctgaggtcgtcctcggtaatataatcaaaaagaagggatggaggcggtcttccctggtaatcactactaaaatcttctggggaggaaaagcggagaccgagaggggactctcccgcaaacacatcatagaaggcctgaaggcaagccttgaacggctgcagctcgaatatgtggacgtcgtgtttgccaaccggccggatcccaacacccccatggaggagacagtgagggctatgacacatgtgattaatcagggaatggctatgtactgggggacgtcccgatggtcaagcatggaaatcatggaagcatacagcgtcgcccgtcaatttaacctgacaccacccatctgtgagcaagctgagtaccatatgttccagagggagaaagtagaagtgcagcttcctgaattgtttcataagattggagttggcgcaatgacttggagcccccttgcctgcgggatcgtcagcgggaagtatgatagcgggattcccccgtactcccgggctagtcttaaggggtaccagtggctcaaggacaagattctgagtgaagaggggcggcggcagcaggctaagctgaaggagctccaagctatagcagagagacttggatgcaccctgccacagctcgccatcgcttggtgtctacgcaacgagggcgtttcatctgttctcctgggtgcctctaacgccgatcaactgatggaaaacataggagctattcaggtcctgcccaaactttcaagcagtattattcacgaaatcgattctatcctcggtaacaaaccctactctaaaaaggactatcgcagctag

SEQ ID NO: 200360 - DNA, 522 bp, Artificial Sequence
  Description of Artificial Sequence: Synthetic coding sequence
atgtaccccgagagcaccaccggcagccccgcccggctgagcctgcgccagacaggctctcctggaatgatctatagcactcgttatgggtcacccaaacgacagctgcagttctatagaaacttggggaaatcaggactcagggtatcctgcttaggcctcgggacctgggtgactttcggaggacagatcactgacgaaatggccgaacagctaatgacactggcgtacgacaatgggatcaacctgttcgataccgcagaagtctatgcagcaggcaaagctgaagtagttcttgggaatattatcaaaaaaaagggctggcggcagaggggggagcgagctgggcaggcaagagttactccaccctgcagcctgggccgcagagccagagacgcaagtaagtccgctggagccggatgccacctccaggcccaggcctgcgttcctagcagtacccaggccctgcagacaacccgagggcgcgctcctctgaaacctccaccccctttggcgtcctag

SEQ ID NO: 200361 - DNA, 762 bp, Artificial Sequence
  Description of Artificial Sequence: Synthetic coding sequence
atgtaccccgagagcaccaccggcagccccgcccggctgagcctgaggcagactggatctcctggcatgatttactccacacggtatggcagtcctaagagacaattgcagttttatcgaaatttaggaaagtctggtctcagggtgtcgtgcctgggactgggtacctgggtaaccttcggcggccagatcaccgatgaaatggcagaacaactgatgactctggcctatgataacgggatcaacctgtttgacactgccgaagtgtatgccgctggaaaagccgaggttgtgctggggaacatcatcaagaaaaagggctggcgacggagtagcttggtcatcacgacaaagattttctggggtggcaaagcggagacagagcgaggattatcacgcaagcacattattgagggactgaaggcaagtctcgaacgactgcagttggaatacgttgatgtggttttcgccaacaggcctgaccccaacacaccaatggaagaaacggtgcgtgcgatgacccatgtgatcaaccaggggatggccatgtactggggcaccagccggtggagcagcatggagattatggaggcgtatagtgtggcaagacagttcaacctgacaccccccatttgtgagcaggcggagtaccacatgttccagcgtgagaaggttgaggttcagctgccagaactgtttcacaaaatcggcgttggcgctatgacctggtcccccttagcctgtggcatcgtctctggatag

SEQ ID NO: 200362 - DNA, 765 bp, Artificial Sequence
  Description of Artificial Sequence: Synthetic coding sequence
atgtaccccgagagcaccaccggcagccccgcccggctgagcctgcgacagacaggatctccaggcatgatctacagaaatctggggaagtccggtctgagggtctcatgccttggcctcggtacatgggtcacattcggagggcaaatcacggacgagatggcagagcaactcatgacacttgcttatgataatggcattaatctcttcgacactgccgaagtctatgcggccggtaaggcagaagtggtactcggaaatatcatcaagaaaaaggggtggagacgtagttcattggtgatcacaactaaaatcttctggggtgggaaggcggagaccgagcgaggacttagtaggaagcacattatcgaaggactcaaggcatcgctggagcgattgcagctggagtacgttgacgtggtctttgctaacagacccgatcccaacacccccatggaagagactgtgagggcaatgacacatgtcatcaaccagggcatggccatgtactgggggacctccaggtggagctccatggagatcatggaggcatactctgtggccaggcagtttaatctgacccctccaatttgtgaacaggcagagtatcacatgttccagagggaaaaggtggaggtccaactgcctgagctcttccataagatcggcgttggtgcaatgacatggtcgccgcttgcatgcgggatagtgtccggaaaatatgacagtggcatcccaccctacagcagagcctctcttaagtag

SEQ ID NO: 200363 - DNA, 288 bp, Artificial Sequence
  Description of Artificial Sequence: Synthetic coding sequence
atgtaccccgagagcaccaccggcagccccgcccggctgagcctgcggcagacagggagcccagggatgatttacagaaatttgggtaagagcggacttcgtgtatcatgcctggggctcggcacgtgggttacattcggaggacagattaccgatgagatggccgagcaattaatgactctggcatacgataacggtatcaatctgtttgatacagcggaggtgtatgccgccggcaaggccgaggtagtcctggggaatatcattaagaagaaagggtggaggtag

SEQ ID NO: 200364 - DNA, 159 bp, Artificial Sequence
  Description of Artificial Sequence: Synthetic coding sequence
atgtaccccgagagcaccaccggcagccccgcccggctgagcctgcgtcagacagggtcaccaggcatgatttactcaaccagatacggatcccccaaacggcagttgcaattttacagaaacttgggcaagagtggcctcagagttagctgtttatag

SEQ ID NO: 200365 - DNA, 903 bp, Artificial Sequence
  Description of Artificial Sequence: Synthetic coding sequence
atggccgagcagctgatgaccctggcctacgacaacggcatcaacctctttgacactgcagaggtgtatgcagcgggcaaggctgaggtggtgctgggaaacattattaagaagaaaggctggcgtagaagcagtctggtgatcactactaagattttttggggaggcaaggccgaaacagaaagagggctgtctagaaaacatatcattgaaggtctgaaagcatctctggaacggttgcaactggagtacgtagacgtcgtcttcgctaataggcccgatccaaatacgcctatggaagaaaccgttcgcgcaatgacacatgtgattaaccaaggaatggcgatgtattggggaacttcccggtggtcctcgatggagatcatggaagcctattccgtggctaggcaatttaatctgaccccccctatctgtgagcaggccgagtaccacatgttccagagggagaaggtggaggtgcagcttccggagttgtttcacaagatcggcgtgggggccatgacatggtcccctcttgcatgcgggatcgttagtgggaaatatgactctggcattcctccctacagtcgcgctagcttaaagggatatcagtggctgaaggacaagatcttaagtgaagaaggccgcaggcaacaggcaaagctcaaggagcttcaggctattgccgaacgcctcggctgtactctgccccaactggccatcgcatggtgcctcagaaatgagggagtgagcagcgtgctcctgggtgcctctaacgcagaccagctcatggagaacatcggcgctattcaagtgctgccaaagctttctagctcgattattcatgagatagactccattctcggtaacaaaccttacagcaaaaaggactaccgaagctag

SEQ ID NO: 200366 - DNA, 1215 bp, Artificial Sequence
  Description of Artificial Sequence: Synthetic coding sequence
atgcaggtgagcatcgcctgcaccgagcagaacctgcggagccggagcagcgaggacagactgtgcggaccaaggccaggtccaggaggaggaaatgggggtccagccggaggtggtcatgggaaccctcccggtggaggcggaagcggacccaaggccagggccgcattggtcccaaggccgccagcgccagccggcgctctgcgggaatctactggacgtggtacaggaatgaagtaccggaacctgggcaaaagcgggctgcgtgtgtcctgtctgggccttggtacctgggtgacctttggaagtcagatctcggatgaaacagccgaggacgtgctgacagtagcttatgagcacggagtcaatttatttgatacagctgaagtctacgccgcaggcaaggctgagaggacattagggaacattctaaagtccaagggatggaggcgtagctcctacgtgataacaacaaaaatcttctggggaggtcaagccgaaactgaaagaggcctgagtcgaaaacatatcattgagggtctacggggttcactagagcggttgcagctgggctacgtggacattgtattcgctaacaggagcgatccaaactgcccgatggaagagatcgtaagggccatgacatatgtcattaatcagggactggctttatactggggaacatctaggtggggagctgctgaaattatggaggcgtacagcatggcaaggcagtttaatctcatccccccggtgtgtgaacaggctgaacatcacctgtttcagcgcgagaaagtagaaatgcagttgccagagctgtatcacaaaatcggggttgggtcagttacatggtatccgcttgcttgcgggcttatcactagtaagtacgacggtcgcgtcccagacacctgtcgcgcaagtatcaaggggtaccagtggttgaaggataaggtccagagtgaggatggtaaaaagcagcaggcaaaggtaatggacctgctgccggtcgctcaccagctgggctgcactgtagcacagctggctatagcatggtgcttgcggtcagagggcgtgtcttccgttctgctgggcgtgagctccgcagagcaattgatagagcatctgggagccctgcaggtgctcagtcagctgacccctcagacagtcatggagatcgatgggttgctggggaataaacctcacagcaaaaaatag

SEQ ID NO: 200367 - DNA, 2562 bp, Artificial Sequence
  Description of Artificial Sequence: Synthetic coding sequence
atgagcgagaaggtggactggctgcagagccagaacggcgtgtgcaaagtcgatgtgtactcgcccggggacaaccaggctcaggactggaaaatggacacaagtacagatcctgtgcgcgtcctgagctggttaaggagagatttagagaagtctacggctgagtttcaggacgtaaggttcaagccgggagaatctttcgggggcgagacctccaactccggcgatccccacaagggcttctctgtcgattattataacacaacgaccaaaggaacgcccgaacgcttgcatttcgagatgacacataaggagatcccttgtcaaggaccccgggctcaacttggtaacgggtccagcgtcgacgaggtctccttctatgcaaaccggctcaccaatctggtgattgccatggcacggaaggaaatcaacgagaaaattgacgggagcgagaataagtgtgtctaccagagtctgtacatggggaacgagccaacgcccaccaagtctcttagcaaaattgcttcagagctcgtgaatgaaaccgttagtgcctgctctcgaaacgccgcacccgataaagcccccggaagtggcgatcgcgtgagcggttcaagtcagtcaccccctaacttgaagtacaagtcgacccttaaaatcaaggagagcacgaaagagcgccaagggcctgatgataaacctcctagcaagaagtcctttttctacaaggaggtgtttgagagcagaaatggtgattacgccagggaaggcggacgattttttccccgcgagaggaaaagatttagagggcaagaaaggccagacgactttacagctagcgtgtccgagggaatcatgacttatgccaactcagtcgtcagtgatatgatggttagtattatgaagacgctcaaaattcaggttaaggacacaacaatcgcaactatcctcctcaagaaagtgctactcaagcatgcgaaagaggttgtttccgacctaatcgattccttcctcaggaatctgcatagtgtgaccggcaccctgatgacagatacacagtttgtgagcgctgtcaagcgaacagtcttcagccatggctctcaaaaggccactgatatcatggacgccatgctgaggaagctgtataacgtcatgttcgccaagaaggtgcctgaacacgttaggaaggcccaagacaaggcagaatcttactctctgatctccatgaaaggcatgggggatcctaagaaccgtaacgtgaacttcgcgatgaaaagcgaaacaaaactgcgcgagaagatgtattcggagcctaaaagtgaagaggaaacatgcgccaagacccttggcgagcacattatcaaggagggtctcacactgtggcacaagacacagcagaaggagtgcaagtccctgggcttccagcatgctgccttcgaggctccaaacacccagaggaagcccgcctctgatataagctttgaatatccagaggacataggaaatctgagcctgcccccttaccctcctgagaaaccagaaaatttcatgtacgattcagattcctgggctgaagacctgatagtctctgccctcctgttgatccagtatcaccttgcgcaaggcgggcgccgtgacgctaggtcttttgtagaagctgcagggaccactaatttccccgctaacgagcctccggttgcgccagacgaaagctgcttaaaatcagctccaattgtcggcgatcaggagcaggctgagaaaaaggatctgcggtctgttttctttaattttattaggaatctgttaagcgagacgatatttaaacgagatcagagtcccgagccaaaagtgcctgaacagcctgtgaaggaagaccgaaagctatgcgagaggccactggcaagtagtccacctcggctgtatgaggatgacgagacgcctggcgctttatcagggctcactaaaatggccgtctcccagattgacgggcacatgagcgggcaaatggttgaacacctgatgaatagcgttatgaagctgtgcgtaataatcgcaaaaagttgcgatgcttcgttggccgaattgggtgatgacaaaagtggggatgcgtccagactcacgtcagcctttcctgattccttatacgagtgcttaccagcaaaggggacagggtccgcagaagctgttcttcaaaacgcgtatcaggcgatccacaacgagatgcgagggacaagcgggcaacctcccgaaggctgcgctgcccccaccgtgatagtctcgaaccacaacctcacggataccgtacagaataaacagctccaagcggtgctccagtgggtggcagctagcgaattaaacgtacccatcctctacttcgccggggacgacgagggcatacaggagaagttgctccagctgtctgccgcagccgtggataaaggttgttctgtgggggaagtcctccagagcgtcctccggtatgagaaagagcgacagctgaacgaggctgtgggaaatgtgactccgctgcagttgcttgactggctcatggtaaacctgtag

SEQ ID NO: 200368 - DNA, 1488 bp, Artificial Sequence
  Description of Artificial Sequence: Synthetic coding sequence
atgaccgtgatgagcggcgagaacgtggacgaggccagcgccgcccccggacaccctcaagacggctcttacccacgtcaggcggaccacgatgaccacgagtgctgtgaacgggtagtgataaacatctccggcctacgatttgaaacgcagcttaagaccctcgcccaattccccaatacactgctggggaaccctaagaagagaatgcgctatttcgacccacttaggaacgaatatttctttgacaggaatcgaccctcttttgacgcaatcctctattactaccagtccggcggacgcctgaggagacccgttaatgtcccactcgatatgttttcggaagagattaagttctacgagcttggcgaggaggctatggagaaattccgggaagacgagggctttattaaggaagaggagcgtccactacccgagaaagaataccagagacaggtgtggctcctctttgagtaccccgagtcaagcgggcctgctcgggtgatagctatcgtcagcgtgatggtgatactgatcagcattgttatcttttgtctcgagacactgcccgagctcaaggatgataaagatttcaccggaactgtgcacagaatcgataacacaaccgtgatctacaattccaacattttcaccgaccccttcttcattgttgaaactctgtgcattatatggttcagctttgagctcgttgtacgctttttcgcctgtccgagtaagaccgacttttttaagaatatcatgaacttcattgatattgtggccatcatcccatattttatcacgcttgggacagagattgctgagcaggaaggcaaccagaaaggagagcaggccacctctctcgcaattcttcgtgtgatcagattggtccgcgtattcagaattttcaaactgtcccgacatagcaagggtctccagatcctcgggcaaacactaaaagcatcgatgagagaactaggacttctcatcttcttcctctttataggtgtcatactgtttagttctgccgtgtacttcgcagaggccgaagaggcggagtcacacttttcatccatccctgatgccttctggtgggccgtggtcagtatgaccacagtcgggtacggtgatatgtaccccgtgactattggcgggaaaattgtgggctccctgtgtgcgattgctggcgtgctcactatcgctttacccgtgccagtgatcgtctcaaacttcaattatttttatcacagagaaaccgaaggtgaggaacaggcccagctgcttcatgtatcctcacctaatctggcctcagactccgatctgagcaggcgatcatcttctacaatgagtaaaagtgaatacatggagatagaagaggatatgaacaatagtatcgctcattacagacaagtcaatatcaggacagccaattgcactacggctaaccagaattgcgttaacaaatccaagttactgaccgatgtgtag

SEQ ID NO: 200369 - DNA, 1536 bp, Artificial Sequence
  Description of Artificial Sequence: Synthetic coding sequence
atggacgtgtgcggctggaaggagatggaggtggccctggtgaacttcgataatagcgatgaaatccaggaagagcctggatatgccacagattttgactcaaccagccccaaggggagacccgggggcagtagtttcagtaatggtaagatactcatctcagagagtaccaatcacgaaaccgcgttctctaagctacctggtgactacgcagatcccccaggtcctgagccagttgttctgaatgaaggtaaccagcgtgtgattatcaatatcgccggcttacgcttcgaaacccagcttcgtaccctgtcgcagtttcctgagacactcctaggagaccgggaaaaacgaatgcagtttttcgatagtatgcgtaacgagtatttctttgatcgcaacaggcccagcttcgatggcatcctttattattaccagtccgggggcaagatcaggaggccagccaacgtgccaatagatatttttgccgatgagatttcattctatgagctcgggtccgaagccatggatcagtttcgagaggatgaaggattcattaaggatccggagacactcctcccaacaaatgatatacaccggcagttctggttactctttgagtatcccgagtcttcctctgcagcaagggctgtggctgtcgtatctgtgctagttgtggtgatatcgattacgatattttgtttggagacgctccctgagttccgtgaggatcgcgaattgaaggtcgtcagagatccgaacctcaacatgagcaaaactgtactttctcagaccatgtttactgacccattcttcatggtagagtccacttgcattgtatggttcacttttgaactcgtgctgaggttcgtagtctgtccatctaagactgacttctttagaaatattatgaatattattgatattatctccatcattccctattttgccactctgattactgagctcgttcaggaaacggaaccatccgcccagcagaatatgtccctagccatcctccggatcattcgtctggtgagggtgtttagaattttcaaactctcacgccattcgaagggcctccaaattctcgggcaaacacttaaagcctcaatgagggaattaggtcttttgattttttttctcttcataggcgtcattctgtttagcagtgctgtttattttgcggaggtggatgagcccgaaagtcatttctctagcattccagacggcttttggtgggcggttgtgactatgaccacagtcggatatggtgatatgtgtcccaccacccctgggggaaaaatcgtggggacactctgcgccatcgccggagtgctgacgatagctctccccgttcccgttattgtcagcaacttcaactacttctaccatcgagagaccgaaaatgaagagaaacagaatatccctggcgaaatagagcggatcctcaatagcgttggaagtcgcatgggaagcacagactctctcaacaaaaccaacggcggttgctctaccgagaagtcccgcaaatag

SEQ ID NO: 200370 - DNA, 1728 bp, Artificial Sequence
  Description of Artificial Sequence: Synthetic coding sequence
atggacgagcggctgagcctgctgcggagcccccccccccccagcgctagacatcgggctcacccgccacaacggccagcgagttcgggaggtgcacataccctcgtcaatcatggatacgctgagcccgccgcgggacgggaactgccaccggatatgactgtcgtgcctggagaccacctgctagagccagaagttgcagatggcgggggcgcaccccctcaggggggatgtggaggcggtggatgcgacagatacgagcctttaccaccgagtctgcccgctgcgggcgaacaggattgctgcggcgagcgcgtggtgataaacataagcggtctgcggttcgagacgcagctgaaaacgctgtgccagtttcccgagaccctgctcggggatccaaagagacgcatgcggtatttcgaccccctgcggaatgaatacttttttgataggaacagaccttctttcgatgcgatcttgtattactatcaaagtggggggaggattcggcgccctgtaaatgttccgatcgatattttcagcgaggagataaggttttaccagctcggcgaggaagccatggaaaaattccgtgaggacgagggattcctgagagaagaggagagacctctgccccgcagagacttccagagacaggtgtggcttttgtttgagtaccccgagtcatctggtcccgctcgaggcatagcaattgtgtctgtgttggttatccttatctctatcgtgattttttgcctggagacactcccggaatttagggacgagaaagattatcccgcctctacttcccaagacagtttcgaagcagctggcaacagcacttcagggtcccgtgccggggccagttcatttagcgatccctttttcgtagtggagacactgtgtatcatttggtttagtttcgaattattggtgagattcttcgcctgtccttcaaaggctacattttccagaaatattatgaacctgatcgacatcgtggcgattatcccctactttatcacactgggtaccgaattagctgagaggcaggggaatgggcagcaggccatgagcctggccattctacgtgttattagactcgtgcgagtattcaggatctttaagctgagccggcacagcaagggccttcaaattctcggccagaccctgaaggcttctatgcgagagctggggctgctgattttttttctcttcatcggagtgatcctattcagttccgctgtgtacttcgcagaggcagatgatcccacgagtgggttcagcagtatcccagatgcgttttggtgggcagtcgtgactatgacgactgtcgggtacggtgacatgcaccctgtgaccattggggggaaaattgtaggcagcttgtgtgcaatagccggcgtcctaactattgctttaccggtccccgtcattgtcagcaactttaactacttctatcatagagagacagagggagaagaacaatcacagtacatgcacgtcggctcctgccagcacctgtccagttccgcagaggagctccggaaggcccgctccaattcaactctcagtaagagtgagtatatggtgatagaggaaggcggtatgaatcatagcgccttcccccaaactcctttcaaaaccggcaactccacggccacgtgtaccactaacaataatcccaactcctgcgttaacattaagaaaatctttaccgacgtgtag

SEQ ID NO: 200371 - DNA, 1962 bp, Artificial Sequence
  Description of Artificial Sequence: Synthetic coding sequence
atggaggtggccatggtgagcgccgagagcagcggctgcaacagccacatgccgtatgggtatgctgcgcaagcacgcgcacgcgagcgtgagcgattagctcatagcagggcggcagctgcggctgccgtcgcagcagcgacagccgctgtggagggctctggggggagcggcggtggcagccaccaccatcaccagagtcggggggcctgcacaagccacgacccccaatcttcaaggggctcaagacgcagacgtagacaacgctccgagaagaagaaggcccattatcgccaaagcagcttcccccattgttctgaccttatgccgagcgggtctgaggagaaaatcctgcgcgagttaagcgaggaagaagaagatgaagaggaggaggaggaggaagaggaggagggacggttctattactccgaggacgatcatggagacgaatgtagttacaccgacctgctcccacaggatgaaggcggcggaggatactccagcgtccggtattctgactgctgcgagagggtggtcatcaacgtgagtggccttagattcgaaacccagatgaaaacgcttgcacagttccccgagaccctgctgggcgatcccgagaaacgaacacagtacttcgacccactccggaatgaatactttttcgaccgaaatagaccaagtttcgatgccattttgtattattaccagtcgggtggtaggctgaagcggccagtaaacgtgcccttcgatatctttactgaggaggttaaattctaccagctaggagaagaggcactcctgaagttccgcgaggacgagggctttgtgagagaggaggaggatcgtgccctcccggagaacgagtttaagaagcagatttggctcctgttcgaataccctgaaagcagttccccggcacgcggaatcgccatcgtgtcggtgctcgtgatactgatttctatagtgatcttctgcctagagacacttcccgagtttcgcgatgaccgggacctagtgatggccctcagcgccggtggtcatggcgggcttcttaatgataccagtgctccgcatctggaaaactcaggccacactatctttaacgacccattctttattgttgagacagtgtgtatcgtctggttctccttcgagttcgttgtcagatgcttcgcatgcccctcccaagcgctgttctttaaaaatatcatgaacattatcgacattgtctcaatcctgccatatttcataacattggggacagatcttgcgcagcaacagggcggcggaaatggtcagcagcaacaggccatgtcttttgccatcctgcggataattcgtttggtccgggttttccgaatattcaaattgtccagacattccaaaggactgcagattctgggacatacactgagggcgagcatgcgggagttggggcttcttatttttttcctgtttatcggagtgattctgtttagtagcgcggtctacttcgcagaagcggatgagcctactactcacttccaatccattccagatgccttctggtgggctgtggtcactatgaccacagttgggtacggagatatgaagcccattactgtgggcggtaagatcgtaggttccttgtgtgccatcgctggggtgcttacaattgcattgcctgtccccgtaatcgtatccaatttcaattatttttaccaccgcgaaacagaaaatgaggagcagactcagctcacccagaatgcagtgagctgtccctatctgccttctaacctcctcaagaaattcaggtcttcaacaagcagcagtctgggagataagagcgaatatttagagatggaggaaggtgtgaaagaatccttatgtgcaaaagaggaaaaatgtcaggggaagggggatgacagtgaaacagacaagaataattgtagtaatgctaaagccgtggagactgacgtatag

SEQ ID NO: 200372 - DNA, 1842 bp, Artificial Sequence
  Description of Artificial Sequence: Synthetic coding sequence
atggagatcgccctggtgcccctggagaacggcggcgccatgaccgttagaggtggcgacgaggcgcgtgcgggctgcgggcaggctaccggaggagagctccagtgtccgcccaccgccggcttatcagatggtccgaaagaacctgcccctaaaggaaggggggctcagcgggacgcagacagcggcgtgcgcccactgcccccgttgcctgatcctggagttcgcccccttcccccactcccagaagagcttcctaggcccaggaggcctccacctgaggacgaggaagaagagggcgaccccgggctcggtaccgtcgaggatcaggccctgggaactgcctccctccaccatcagcgggtacatatcaacatctccggattacgctttgaaacacaactggggacactggcacagtttcctaacacgttacttggagaccccgccaagagactccgctacttcgatcctctgcgaaacgagtatttctttgacagaaataggcctagtttcgatgggatcttgtactactaccagagtggaggcaggttgagacggcccgtgaatgtcagcctcgatgtgttcgcagacgagatcaggttctaccagttgggagatgaggccatggaacgtttcagggaggatgaaggctttataaaggaggaggagaagcccctgccccgtaacgagtttcagcgacaggtgtggctcatcttcgaataccccgagtcaagcgggtctgctcgcgccatcgcgatagtgtctgtcctcgtcatactcatcagcatcataactttctgtcttgagacgcttccagaattcagggatgagcgcgagctccttcggcacccacccgctccccaccaacctccagccccagcgccgggtgctaatggcagcggggttatggcacctccttctggacctacagtcgcccctcttctgcccagaacgctggccgatccttttttcatcgtggaaaccacttgcgtgatttggttcacattcgagctccttgtgaggtttttcgcctgtcccagcaaagctgggtttagcaggaatatcatgaatatcatcgacgtagttgcaatattcccttactttatcaccctggggactgaactggccgagcagcagcctggcgggggcgggggaggccagaacggtcagcaggcgatgtctctcgctatactcagagttattaggctggtgcgcgtgttccggatcttcaaattaagccgacacagcaagggcctccagattctgggtaaaacactgcaggcttccatgcgcgagctgggcctactgatattcttcttgttcatcggcgtgatcttgttcagctctgccgtgtatttcgccgaagcggacaaccaaggtactcatttctcgagcatccctgatgcgttctggtgggctgtggtgacaatgacaactgttggatacggtgacatgcgccccattacagtgggagggaagattgtcgggtccttgtgcgctatcgcaggcgtgctaactatagccctgccagtaccggtcatcgtaagcaacttcaattatttttaccaccgcgaaaccgaccacgaagaacctgcagtgctgaaggaggagcaaggcactcaaagtcagggaccagggttagacaggggcgtgcagcgtaaagtgtccggtagccgaggctccttctgtaaggctggggggactttggaaaatgccgatagcgccaggcggggatcctgtccattggagaaatgtaatgtcaaagccaagtctaatgtggatctgcgccgctctctgtacgccttgtgtctcgatacctcacgggagaccgatctgtag

SEQ ID NO: 200373 - DNA, 1557 bp, Artificial Sequence
  Description of Artificial Sequence: Synthetic coding sequence
atggccgccagcatggcccggcggctgtggcccctgctgacccggagaggcttcagacctaggggcggctgcatcagtaatgatagtccccgccgctcctttacaacagaaaaaagaaataggaatctattgtacgaatatgcccgagagggctattcagcacttccccaactggatatcgaacgcttctgcgcatgccctgaagaggccgctcacgccctagaactgagaaagggggagctccgatctgctgacctgcctgcgatcatctccacctggcaggaattgaggcaactacaggaacagattaggtctctggaggaggagaaagctgcagttacagaggccgtgcgcgcactgctcgcgaaccaggattctggcgaggtgcagcaggaccccaaatatcagggcctccgcgcccgcggtcgggaaatccgcaaggaattggtgcatctttatccacgtgaagcacagcttgaggagcaattctatctgcaagcattaaagctaccgaaccagacgcaccctgacgtgcctgtcggagatgagtcccaggctcgggttctgcatatggtgggtgataagccagtcttcagttttcagccacgtgggcacctggaaataggcgaaaagcttgatatcatccggcaaaaaaggctgagtcatgtgagcgggcatcgatcatactacttgagaggcgcaggagcactgctgcagcatgggctcgtcaacttcaccttcaataagttgctgcgtcgcggcttcacaccaatgactgtgcccgacctcttacggggggcggttttcgaggggtgtgggatgacacccaacgccaacccttctcagatctacaatattgacccagccagatttaaggacttgaacctagcgggcacagctgaggtcggtctcgcaggctattttatggaccataccgttgcttttagagaccttccagtgaggatggtgtgcagctcaacttgttacagggccgaaacgaatacagggcaggaaccccgcggcctgtacagagtccaccatttcaccaaggtggaaatgttcggcgtcactggaccaggcctcgagcagtcttcacagctcctcgaggaattcctgtctcttcagatggagattctgaccgagttaggactgcacttccgagtgctcgacatgcccacccaggagctcgggctgccagcatatcggaagtttgatattgaagcctggatgccaggcagggggcggttcggcgaggttacatccgcatcaaactgtactgacttccagagcagacgcctgcacatcatgtttcagacagaagctggggaacttcagtttgcccacactgtgaacgctaccgcttgcgcagttccacgactgctcatcgccttactggaaagtaaccagcagaaagacggcagcgtgctcgtccctcctgccttgcagtcctacctcgggactgacagaattactgcaccaacccatgtgccactacaatatataggcccaaatcagccacgcaagccagggctgccaggccagccagcagtttcttag

SEQ ID NO: 200374 - DNA, 1893 bp, Artificial Sequence
  Description of Artificial Sequence: Synthetic coding sequence
atggccgccggcgtggccgcctggctgcccttcgcccgggccgccgcgattggctggatgcccgtcgcctcggggccaatgcctgccccacctcgacaggaacgcaaacggacccaagatgctctgatagttttaaatgtcagcggaacaagatttcagacatggcaggacaccttggaacggtaccccgacactttactgggctcatctgagcgtgactttttttaccaccctgagacccaacagtacttcttcgacagggatccagacattttcaggcatattctcaatttttatcggacaggcaagctacactaccctagacacgaatgtatcagtgcctatgatgaggagctggcattttttggcctcattcctgagatcatcggggactgctgctatgaggagtacaaagaccgcagacgggaaaatgcagaacgactgcaggatgacgccgacacagacactgcaggggagagtgccctgcccacaatgactgcccgtcagagagtctggcgggcctttgagaacccccatacctcaactatggccctggttttttactacgttaccggcttttttatcgcggtctcagttatcgcaaatgttgttgagactgttccatgtggcagcagtcccggacacatcaaagaactgccttgtggggaaaggtacgcagttgcgttcttttgcttagatacggcctgcgtgatgatattcaccgtagagtacttattgcgcttggcagcagcgccatcccgctacagatttgtccggagcgtaatgagcatcattgacgtcgtcgctatccttccttattacatcggactcgtgatgacggacaatgaagacgtctctggcgcttttgtcacactcagggtttttcgcgtctttaggatttttaagtttagccgtcattcacagggactgagaattttgggatacacgctgaaatcttgtgctagtgaactgggcttcttgctcttctctctgacaatggccattatcattttcgccaccgtcatgttttatgccgagaaaggttcctccgcctcaaaattcacatccattcctgcagccttttggtataccatcgtcactatgacaaccctgggctacggagatatggtgcccaagaccatcgctggaaaaatctttggctcaatttgcagtctaagtggagtgctggtcatcgccctgccagttcctgtcattgtttccaatttctccaggatctatcaccaaaatcagcgcgctgacaagaggcgcgcacagaagaaggctcggctggcacgcataagagcagctaagagtggaagtgcgaacgcctatatgcagagcaaaaggaatggcctactgtccaatcagcttcagagctccgaggatgagcaggcttttgtcagtaagagcgggagcagcttcgagacgcagcaccaccatttactgcattgcctggaaaagactaccaaccatgagtttgtcgacgagcaggtcttcgaggagagctgcatggaggtcgccacagtgaatcgacctagttcccattccccctctttgtcctctcagcagggagtcacttctacctgttgttccagacgccacaagaaaacgtttagaatccccaacgccaacgtatctggctctcatcaggggtcgattcaggagttgtctacaattcaaataagatgcgtagagcgtacacctcttagcaatagccggagttccctcaacgcgaaaatggaagagtgtgtcaaactgaactgtgagcagccatatgtgactacagctattattagtatccccacacctccagtcacgacccccgaaggtgatgacagaccagaatcccctgagtatagtggggggaacattgtgcgggtctccgccctttag

SEQ ID NO: 200375 - DNA, 1911 bp, Artificial Sequence
  Description of Artificial Sequence: Synthetic coding sequence
atggccgccggcgtggccgcctggctgcccttcgcccgggccgccgccattgggtggatgcctgtcgccaattgtccgatgccccttgcccctgcagacaaaaataagaggcaggacgaactgattgtgctgaacgttagcgggagacggtttcagacttggcgtactactctcgagaggtatcctgacacactgctcggtagtactgagaaggagttcttttttaacgaggataccaaggagtatttttttgaccgagaccccgaagtcttccgatgtgtgcttaatttctataggaccggaaagctacactacccccgctacgaatgcatttccgcctacgacgacgaactggcattctacggtatcctgcccgaaatcatcggagattgttgttacgaggagtataaggaccgcaaacgggaaaacgctgagaggttgatggacgacaacgactcggagaataaccaggagagtatgccttccctgagttttcggcagactatgtggagggctttcgagaatcctcacaccagtacgctggccctcgtattctactacgttaccggcttttttattgctgtgagtgtgatcactaacgtcgtggaaactgtgccgtgcgggactgtcccaggatctaaggaattgccctgcggtgagaggtattcagtagcgtttttttgccttgataccgcatgcgtgatgattttcactgtggaatacttgttgaggttgtttgccgctccatctagataccgcttcattcgatctgttatgtccatcattgacgtcgtcgccataatgccttactacatcgggctggtgatgacaaataacgaagatgtatccggtgcctttgtgacactacgcgtcttccgggtgtttagaatctttaaattttcccgccattcccaggggcttagaattctggggtacacgctgaagagttgcgcgagcgaactgggtttcttgctcttctcactcacaatggcgatcatcatctttgccactgtgatgttttatgcagaaaagggaagctctgctagcaagttcacttctattcccgctagtttttggtacactatagttactatgacaacactgggctatggcgatatggtgcccaagactatcgcgggtaagattttcggcagtatttgctcgctctcaggcgtcttagtgatcgcattgcctgtgcccgtgatagtttcaaactttagtcggatctaccaccaaaatcagagggctgataaaagacgagcacagaagaaggcccgcttagcaaggatccgtgtcgctaagactgggtccagcaacgcttatttacattccaagaggaatgggttattaaacgaagccctggagctgactggcaccccagaggaggaacatatgggcaaaacgactagccttatcgaatcacaacaccaccacctgcttcattgtctggagaaaacaaccaaccacgaattcattgacgaacagatgttcgagcagaattgcatggagtcctccatgcaaaattatccaagcacccggtcaccttcactgtcctcccatcctggactgaccacaacatgctgcagtcgcaggtcaaaaaagaccacccacctgcccaactccaatctgcccgcgactagactgcgatccatgcaggaacttagcaccatacacattcagggatccgaacagccgagtctaacgacatcccgcagctccctgaacctgaaggcagacgacggcctgagaccaaactgcaagaccagccagataacgacagctattatttctatccccaccccacccgccctaacccccgagggagaaagccggccccccccggctagtcctgggcccaacaccaatatacctagcatagcgtccaacgttgtcaaggtcagtgccctctag

SEQ ID NO: 200376 - DNA, 1968 bp, Artificial Sequence
  Description of Artificial Sequence: Synthetic coding sequence
atggccgccggcgtggccgcctggctgcccttcgcccgggccgccgcaatcggctggatgccggtggcaaattgccccatgcccctggcccctgcagacaaaaacaagaggcaagacgaactgatcgtgctgaacgtgagcggccgccgcttccagacttggcggactaccctggagcgctaccctgacacgctgctcggcagcaccgagaaggaattcttctttaatgaggatactaaagagtacttttttgatagggacccagaggtgttccgttgtgtgttgaatttttacaggactgggaaactgcactatccccggtacgaatgcattagcgcatacgatgatgaactggcgttctatggaattctgcccgagattatcggtgattgttgctatgaggagtataaggatagaaagagggaaaatgccgagcgccttatggacgataacgactccgagaacaaccaggagtcaatgccttcactgtcctttcgtcagacgatgtggagggcctttgaaaatccccatacatctaccttggcactggtcttctattacgttacaggcttttttattgctgtctccgtgatcactaatgtggtcgagaccgtcccttgcggaaccgttcctgggtctaaagaactgccctgcggcgagcgctacagcgtggcctttttctgcctggacactgcatgcgtgatgatcttcacagtggagtacttgctgaggctctttgcagccccatcccgctacaggttcataagaagcgtgatgtccatcattgacgttgtagccatcatgccatactacattggtctggtcatgacaaataatgaggatgtaagcggagctttcgttaccctacgagtatttagagtttttagaatctttaagttcagtcggcacagtcaggggctgagaatacttggatataccctaaaatcctgcgctagcgaactcggatttctgctgttttcgctgacaatggcaatcattatctttgccacagtcatgttttacgcagagaagggcagcagcgcatctaagtttaccagcatccccgctagtttctggtacaccattgttaccatgaccaccctagggtacggcgacatggtgccgaagacaattgccggcaaaatctttggctccatctgctctttatccggagttcttgtcatagcattgcccgtgcctgtgattgttagcaacttctccaggatttatcaccagaaccagcgggccgacaaaaggcgtgctcagaagaaggctagactagcccgcattagggtggctaagacagggtcttctaacgcctacctccactccaagagaaacgggctgcttaatgaggccctggaacttaccggaacacccgaagaggaacacatgggaaaaactacttctctaatagaatcccagcaccaccacctcctgcattgcttggaaaagacaacaggattgtcatatcttgttgatgaccccctcttgtctgtgagaacgagtaccataaaaaaccatgagtttatcgatgagcagatgttcgagcagaactgcatggaaagcagcatgcagaactaccctagcacgcggagcccgagcctgtcatctcacccaggcctgactaccacgtgttgcagccggagaagcaagaagacaactcatttgcctaactcaaatctccccgccacaagactgagatcaatgcaagaactttctactatacatatccaaggcagcgaacagcctagtctgacaaccagtaggagctccttgaacctcaaggctgatgacgggctgagacccaattgcaaaacgagccagatcacgactgctatcattagcatcccaaccccacccgctctaacacctgaaggcgagtctcggccaccgccagctagtcctgggccaaacaccaacatccccagcattgcttccaacgtcgtaaaagtatctgctctctag

SEQ ID NO: 200377 - DNA, 1911 bp, Artificial Sequence
  Description of Artificial Sequence: Synthetic coding sequence
atggccgccggcgtggccgcctggctgcccttcgcccgggccgccgcaatcgggtggatgcctgttgccaactgtccaatgccattggcgccagccgacaaaaacaaacgacaggatgaactcatcgtgctaaacgtctcaggaagacggttccagacctggcggacaactctggaaaggtatcccgatacactcctggggagtacagagaaggagtttttctttaacgaagatacaaaggaatacttcttcgatcgtgatcctgaggtgtttcggtgcgtgctcaatttctataggactggtaaactccactaccctaggtatgagtgcatttccgcctacgacgacgagctagcattctacggcatacttccagagatcataggggattgttgttatgaagagtataaagatagaaaacgcgaaaacgctgagcgactgatggacgacaatgatagcgaaaataatcaggaaagcatgcccagcctgagctttcggcagacaatgtggcgggcctttgagaatccacacacttctacattggccctggtgttttactatgtgactggattcttcattgcagtgtcagtgattaccaacgttgtcgagactgttccctgcggaacagtccccggctcaaaagagctcccatgcggtgagcgttatagcgtggcctttttttgcttggacactgcatgtgtgatgatcttcacggtggagtatctgctcaggctgttcgccgctccaagtcgctaccgttttatcaggtcagtcatgtccattattgatgtggtggccattatgccctattacattggtctggtcatgacaaataatgaagatgtgtcaggcgcttttgtgactctccgcgtgttcagagttttcaggatcttcaagttctcacgacactctcaggggctgaggattctaggttacacactcaagtcgtgcgcctctgaattagggtttctccttttctctctcaccatggcaattatcatctttgctactgtgatgttctacgcagaaaaagggagttcagctagtaaattcacctccataccagcaagcttctggtatacaattgttaccatgacgaccctgggttatggcgatatggtgccaaaaacaattgctggaaaaattttcggatccatatgcagtctgagcggggtccttgtcattgcactgcccgttcccgtaatcgtctcaaacttttctcgcatctatcaccagaaccagcgagccgataaaagacgggctcagaagaaggcgagactggctcggattagagtggcaaagacaggatcctcgaatgcgtacctgcactctaaaaggaatggcttactgaacgaagctttggagctcactggtacaccagaggaagaacatatgggtaagaccacctctctcatcgagtctcagcaccatcatttgctacattgcctggaaaagacgactaatcacgaattcatcgatgaacaaatgttcgagcagaactgtatggaatcaagcatgcagaactacccttccacacgttcacccagcctctcctcccaccctgggctgaccaccacttgctgctctaggcgcagtaagaaaaccacacatctgcccaacagcaaccttccagctactcgtctccggtccatgcaggaactcagtaccatccacattcaagggtctgaacagccctctttgacaacaagccgaagctctctcaacttaaaggcggatgatgggttgagacccaattgtaagacatcccagatcaccaccgccataatctccattccaacccctcccgccttgactccagagggagagagtcgcccgcccccggcctccccaggtccaaacaccaacattccatccatagccagcaacgtcgtcaaagtgtcagctctctag

SEQ ID NO: 200378 - DNA, 1758 bp, Artificial Sequence
  Description of Artificial Sequence: Synthetic coding sequence
atgggccagggcgacgagagcgagcggatcgtgatcaacgtgggcggtacaagacaccagacctatcgctccaccctgcggaccctgccaggcactaggctcgcttggttggctgagcctgacgcccactcccactttgactatgatccaagagccgatgaattcttttttgatcggcaccccggcgtctttgcacatatccttaattactatcgaaccggtaagctgcactgtccagccgatgtgtgtggtccactgtacgaagaagagcttgcgttttggggtatcgatgagacagacgtggaaccttgttgctggatgacatataggcagcacagagacgcagaggaagccctcgattcctttggcggggcaccgctggacaattccgcagatgatgccgacgccgatggccccggtgactctggagacggagaggacgaacttgaaatgactaagcgcctcgccctatccgactccccggatgggaggcccggcggattttggcggaggtggcaaccaaggatctgggccctcttcgaagatccatactcttccagatacgccaggtatgtggcctttgcaagtttgtttttcatcctggtttcaattaccacgttctgcctcgagacacatgagcgtttcaatcctatcgtcaacaaaacagagatcgagaatgtgaggaacggaacccaagtaaggtactatcgcgaggcagaaacagaagcctttctcacgtacatcgaaggcgtctgtgtggtatggtttaccttcgagttcctcatgcgggttattttctgcccaaacaaggttgagttcatcaaaaatagcctgaacatcatagattttgttgctattctgcccttctaccttgaggtgggactgagtggactgtcctctaaggctgccaaggacgttctcggtttcctgcgggtcgtccgattcgtacggatccttcgtatcttcaagttgaccaggcattttgtaggattgcgcgtcttgggtcacaccctgcgcgccagcacaaacgaatttctgctgctcattatttttctcgcactcggggttctgatttttgccacaatgatctactatgccgaacggatcggggcccagccaaatgaccctagtgccagtgagcatacccacttcaagaacattcccattggcttttggtgggccgtggtgactatgaccacactggggtacggagatatgtacccacagacatggtctggaatgctggtcggagcattatgtgcattagccggggtgctgactatcgcaatgcctgtgcccgtgatcgtgaataacttcgggatgtattactctctggccatggcaaagcagaaacttccaaaaaagaaaaagaagcacattccaaggcctcctcagcttgggtcccctaattactgcaagtctgtagttaattcccctcaccacagtacccagtctgatacatgtcctttggcccaggaagagatcctggagatcaatagagctgacagtaagttgaatggtgaagtggctaaagcggctctcgctaacgaggattgcccccatattgatcaagcacttacacctgatgagggcctgcccttcaccagatctggaacgagggagcgatacgggccctgcttcctgctgtctacaggtgagtatgcttgtccaccaggcggggggatgagaaaggatctgtgtaaagagtctcccgtgatcgccaagtacatgcccactgaggctgtgagggtgacttag

SEQ ID NO: 200379 - DNA, 1536 bp, Artificial Sequence
  Description of Artificial Sequence: Synthetic coding sequence
atgggccagggcgacgagagcgagcggatcgtgatcaacgtgggcgggaccagacaccagacctatcgctccaccctcaggacactcccaggtactcgcctcgcctggttagcagagcctgacgcccatagccacttcgattatgacccaagggccgatgaattcttctttgaccgccatcctggggttttcgctcacatattgaactattatcgaacgggaaagctgcattgcccagcagacgtgtgcggcccactgtatgaggaggagttggcgttctggggtattgacgagaccgacgtggagccttgttgctggatgacatatagacagcaccgggatgcggaggaggccttggatagtttcggcggagctcctttagacaatagcgctgatgatgccgacgcagatgggcccggcgatagtggagacggagaggacgagctagagatgacaaagaggctggcgctgtcagattccccggatggaagacccgggggattttggcgcaggtggcagcctaggatctgggcactgttcgaagacccgtattcatcacgctacgcgagatatgtcgcctttgcatctctatttttcatcctggtttcaattacaaccttttgcctcgaaactcacgagaggtttaacccaatcgtcaacaaaacagagattgagaacgtgcgcaacggcacccaggttcggtattatagggaagctgagaccgaagccttcctaacctatatcgaaggagtgtgtgtggtgtggttcaccttcgagtttctcatgcgagtcattttctgccccaataaagtagagttcataaagaacagtctgaacatcattgatttcgtggctattcttcccttttacctggaagtgggtctgagcggtttaagcagtaaggccgcaaaagatgtgcttgggtttctgcgagtggttaggtttgtgaggatcctccgaattttcaaactcacacgccactttgtcggactacgggtgcttggccacactcttagggcttctacaaacgaattcctgttactgattatttttttagcccttggtgttctcatcttcgccactatgatctactacgctgagcgcataggcgcacagccaaacgacccttccgcttcggagcatacgcacttcaagaacatccccattggtttttggtgggcagtggtgacaatgaccacgctcggatatggcgacatgtatccccagacctggagcggtatgttggtgggagccctctgtgccttagccggggtcttaactattgcaatgcctgtccccgtgattgtcaataattttgggatgtactactcccttgctatggcgaagcagaagctcccaaagaaaaagaaaaagcacattccaagacccccacagttagggtctccaaactattgcaaatctgtggtgaattccccccatcattctacacaatccgacacatgccccctggcccaggaggagattcttgagattaacagggcaggtcgcaagcctctgcggggcatgtccatttag

SEQ ID NO: 200380 - DNA, 1842 bp, Artificial Sequence
  Description of Artificial Sequence: Synthetic coding sequence
atgggcaagatcgagaacaacgagcgggtgatcctgaacgtgggcggcacccgccatgagacctataggagcactctgaaaaccctacctgggacgaggctcgccctgctcgccagcagcgagccaccaggggattgtttgacaaccgccggcgacaagctgcaaccaagcccacccccactcagtccacccccaagagctcctcccctgtctccaggccccggagggtgtttcgagggtggcgccggaaattgctctagcagaggtggtcgtgcgtctgatcatccaggtggcggtagggaattcttttttgaccgacatcccggggtcttcgcttatgtcctgaattactatagaacaggaaagcttcactgcccggccgatgtttgcggtcctctattcgaggaagagttggctttttgggggattgacgagacagacgttgagccttgctgttggatgacataccgacaacatcgtgatgctgaggaggccttggatatattcgaaacaccagacctgatcgggggcgatccaggcgacgacgaagacctcgcagccaagcgccttggcatagaggacgccgcaggtcttgggggccccgatggaaagtccgggcgttggcgtaggctccagccgcggatgtgggctctgttcgaagacccctactcttccagggcagctcgattcatagcatttgcatcactgttttttatactcgtgagcattacaaccttttgcttggaaacgcacgaggcctttaacatagtgaagaacaagacagaacccgtcatcaatggcacgagtgtggtactgcagtatgagatagaaaccgaccctgccctgacatacgtggaaggggtttgcgtcgtgtggttcactttcgaatttctcgtgcgtatcgtgtttagtccaaataaacttgaattcatcaagaacctactgaacattattgattttgtggccatcctccccttctatctcgaagttggtctaagtggtctcagttccaaagccgctaaggacgtgctggggttccttcgagtggtgcgctttgtgcgtattctgcggatcttcaaactaactaggcacttcgtgggcctgagagtgctcggccatacgctgcgcgccagtaccaacgaatttctgctcctgatcatatttctggccctcggcgtcctcattttcgccactatgatctattatgctgaacgggtcggggcacaacctaacgacccgagcgcttccgaacacactcagtttaagaatattcccatcgggttctggtgggccgtcgtaacaatgacaacactaggttatggggatatgtatccccagacatggtctggcatgttggtgggcgctctgtgtgctctggccggagtcttgactattgccatgcccgtgcccgtgatcgtgaataacttcggtatgtactactctctggcaatggccaaacagaaactgccgaggaagcggaagaagcatattccccctgcaccccaagcctcctcgccaacgttttgtaagacagaactgaacatggcttgcaattcaacacagtcagatacctgcctgggaaaagataacaggctgctggagcataatagatctgtactatccggggacgattccaccggaagcgaaccgcctctttctcctcctgagaggctccccattcggaggagctctactcgggataagaatcgccggggcgaaacttgctttctcctaaccacaggagactacacttgtgcaagcgacggaggaatccgaaaggataactgcaaggaggttgtcattactggatacacgcaggcagaagctaggtccctgacctag

SEQ ID NO: 200381 - DNA, 1890 bp, Artificial Sequence
  Description of Artificial Sequence: Synthetic coding sequence
atgggcaagatcgagaacaacgagcgggtgatcctgaacgtgggcggaacgcggcacgaaacatatcgttcaaccctgaagacactccccggcacaagattggctcttctggcttccagcgaaccaccaggtgactgtttaacaactgctggcgataagctgcagccaagccctcctcctcttagcccccctccgcgcgcaccgcctctcagtcctggcccgggaggctgttttgagggcggggcggggaactgctcttcacgcgggggcagagcctcagaccacccaggcgggggcagggaattcttcttcgatcgtcatccaggggtttttgcttacgttctcaattactaccgcaccggtaagctccactgtccagcagacgtttgtgggcccctctttgaggaggaactggccttctggggcatcgacgaaactgacgtggagccttgctgttggatgacctacagacagcaccgggatgcagaggaggctcttgacatcttcgagactccagatctgattggaggcgatcccggcgacgacgaagaccttgctgcaaagcgcctagggatcgaggacgcagccgggctaggcggacccgatggcaagtccggtcggtggagaaggctgcagcctcgtatgtgggctctgtttgaagacccttatagctctcgagccgcgcggtttatcgcatttgcatctctctttttcattctcgtaagtatcacaacgttttgtttggagacccatgaggctttcaatatcgtcaaaaacaagaccgaaccagtgatcaacggaacctccgtagtcctccagtatgaaatcgaaacagaccctgccctgacttatgtcgaaggcgtctgcgtggtttggtttacatttgagttcttggtacgtatcgtgttttcacccaacaagctggagttcattaagaacctgctcaacatcatagatttcgttgccatactgcctttttacctggaggtggggttatccggactcagctcaaaggccgcaaaagacgtgctgggattcctgcgtgtagtgagatttgtgagaattctgcgcatctttaagctgactcgacacttcgtgggactccgggtgttaggacacactttgcgcgcttccaccaacgaattcctgttgcttattatctttttagctctgggagtactgatctttgctacaatgatttattacgccgagcgagtcggcgcccaacctaatgaccccagcgcatcggagcatacgcaattcaaaaatatcccgatcggattctggtgggcagtggtgacaatgactactctgggctacggtgatatgtacccgcaaacctggagcggcatgctcgtcggtgcactttgtgctttggccggagtcctgacaatagccatgcctgtccccgtaattgttaataacttcggtatgtactatagccttgctatggccaagcagaagctgccaaggaagaggaagaagcatattcccccagctccgcaggctagctctccaacattttgcaagactgaacttaatatggcgtgtaactcaactcagtctgatacctgcctaggcaaagacaacaggttactcgaacataaccgatccgtcctgagcggagacgacagcactggcagcgaaccaccactgtccccacccgaacgcttgccgataaggcggtcctctaccagagataagaaccggcggggtgaaacctgtttcttgcttaccacaggggactacacatgcgcttccgacggaggaataaggaaggtactataccggatttaccatggtcttctgactgcagagaaaggcaccgtggagttttcacacaccaaagactacacaggcaatcggctgcttcttttaaatgtgccttag

SEQ ID NO: 200382 - DNA, 1677 bp, Artificial Sequence
  Description of Artificial Sequence: Synthetic coding sequence
atgggcaagatcgagaacaacgagcgggtgatcctgaacgtgggcgggacaaggcatgagacttacaggtccactctgaagacgctgcccggcacccgtctcgccctgctggccagtagcgagccacctggcgactgcttgacaacagctggggacaagcttcagccctccccacccccgcttagccctcctccgcgggctccgcctctgtcacccgggccaggtggctgctttgagggcggtgctggaaattgtagtagtcgggggggaagggcgtctgatcaccctggaggcggcagagagtttttctttgaccgtcacccaggggtctttgcatacgttcttaattattaccggacagggaagctgcactgccctgcagatgtctgcggaccgctctttgaagaagagctggccttctggggaatagacgaaacagacgtggaaccttgctgctggatgacctaccgccaacatcgtgatgcagaagaagccctggacatcttcgagacccctgacttaatcggcggagatcctggcgatgacgaagatctagcggcaaagcggttggggatagaggatgccgctggcttgggcggccctgacgggaagtccggtcgatggagaaggttgcagcctcggatgtgggccttattcgaagatccatattcgtcgcgggcagcacgcttcatcgcatttgccagcttgtttttcatcttagtcagcatcactacattttgtctggaaacgcacgaggctttcaatattgtaaaaaacaagacggagcctgttatcaatggaacctcggtggtgctgcagtacgaaattgagaccgaccccgccctgacctacgttgaaggggtctgtgttgtttggtttaccttcgagttcctagttaggatagttttcagtccaaataagctggaattcataaagaacctgctcaacatcatcgatttcgtcgctattctgcccttctacctcgaagtcgggttgagtggccttagttcaaaggccgccaaagatgttctgggattcctgcgggttgttcgttttgtcagaatcttgagaatctttaagctgacacgacacttcgtgggcctacgggttctcggccacaccttaagagcctcgacgaacgagttcctattactgataatttttctcgccctgggagttctgatctttgctactatgatctactacgcggaaagagttggagctcaacccaacgacccaagcgcctctgagcacacacagtttaagaacataccgataggcttctggtgggcagttgtgactatgacaaccctgggatatggtgacatgtatccacagacctggagcggcatgttggtaggagcactgtgcgcgttagcaggcgtgctcaccatcgccatgcctgtcccagtcattgtaaacaattttggtatgtactactcgctcgctatggccaaacaaaagttaccgaggaagagaaagaagcacattcctcccgctccccaggcctctagtccaactttctgcaaaacagagctgaatatggcttgcaatagcacccagagcgacacatgccttggaaaggataatcgacttctcgaacataatcgaagcgacaattgcaaggaggtcgtcatcaccggatatacccaagcggaagctcggtcactgacttag

SEQ ID NO: 200383 - DNA, 1842 bp, Artificial Sequence
  Description of Artificial Sequence: Synthetic coding sequence
atgggcaagatcgagaacaacgagcgggtgatcctgaacgtgggcgggactcggcatgaaacttatcggtctaccttgaaaactcttcctggcactcggttagccctgctggcttcttccgaacctcctggagactgcctgaccaccgctggggacaaactccagcctagcccaccccccttgtcgcccccccctagggcaccacctctgtctccaggcccagggggttgctttgaaggcggggcaggtaattgttccagcagaggtggaagggcctctgaccaccccggcgggggacgtgagtttttttttgaccgccacccgggcgtgttcgcctatgtccttaattattatagaacaggaaagctgcactgtccagccgacgtttgtggacccctctttgaggaggagttggccttctggggcatcgatgagacggatgtcgagccttgctgttggatgacctaccggcagcatcgcgatgcagaagaagccctagatatttttgagactccggatctgatcgggggggaccccggagacgatgaggacttagccgcaaagcgattaggaattgaggatgcagccggcttgggaggtcccgacggaaaatctggccggtggcgacggctccagccccggatgtgggccctctttgaagacccctactcaagccgtgcagctcgctttatagcattcgcatcccttttcttcatcttggtaagtatcaccaccttctgcttggaaacgcacgaggctttcaacatcgtgaaaaacaagactgagccagtcatcaacgggactagtgttgtgctgcagtacgagatagagacagatccagccctgacatatgtggaaggtgtctgtgtcgtctggtttacattcgaatttttagtgcgaattgtgttttcacccaataaacttgagtttatcaagaatctcttaaatatcattgattttgtagccattcttcccttttacttggaagttggtttaagtggactgtcctccaaggcagccaaggacgtgctgggtttcctgcgcgtggttcgttttgtaaggattctgcgcattttcaagctgaccagacatttcgtgggtctgagggtgctcggtcacacattgcgagcttccactaatgagtttttactgctcataatcttcttagccctcggcgttctgatctttgccaccatgatatattatgcagagcgcgtgggggcccaacctaacgatccatcggcgagcgagcacacccaattcaagaacatcccaattggattttggtgggcagtggtgactatgactacactcggatacggcgatatgtatcctcaaacatggtctgggatgctggtcggtgctctgtgcgcactggcaggggtccttacgatcgccatgccagtgcccgtgatcgtgaataacttcgggatgtattattcactggccatggcgaagcagaagttgcccaggaaaagaaagaaacatatcccacccgcgccccaggcaagcagcccaacattctgtaagacagagctgaacatggcgtgtaacagcacccagtctgatacgtgtctagggaaggacaacagactgcttgaacacaatcgctcagtgttgtctggagatgattctaccgggagcgagccacctctgtccccaccggagaggcttccaatcaggcggtctagtacacgtgacaagaacagacgaggcgagacgtgcttcttgctgacaactggagactatacctgtgcgtccgatggaggaatccggaaggacaactgtaaagaagttgttatcactggttacactcaggcggaggcccgttctttgacgtag

SEQ ID NO: 200384 - DNA, 1917 bp, Artificial Sequence
  Description of Artificial Sequence: Synthetic coding sequence
atgggcaagatcgagaacaacgagcgggtgatcctgaacgtgggcggcacaaggcacgagacctaccggtccactctcaaaaccctgccaggaacgcggctggcactgcttgcctcaagcgagccccccggcgattgcctcacgacagccggtgataaactgcaaccgtcgccaccccccctgagccctcctccgcgggctcccccacttagtccaggccccggtggttgctttgaaggtggggcaggcaactgcagcagccgcggcggacgcgcctccgaccatcccgggggcggccgggaattcttttttgaccggcaccccggagttttcgcctacgtactgaattattaccgcactgggaagctgcactgtcctgctgacgtgtgtgggccgctcttcgaggaggaactggccttctggggaatcgacgagacagacgtggagccctgttgctggatgacttaccgacagcaccgcgacgccgaagaggctctggatatcttcgagactccagatttaattggtggggatcccggcgatgacgaagacctcgcagccaagcgtttggggatcgaagacgcagccggactgggagggcctgacggtaagagcggacggtggcgaagactgcagcctcggatgtgggctctctttgaagacccatacagttctcgggctgcccgcttcattgcttttgctagtctgttttttatcctggtaagcatcacaaccttctgcttggaaacacacgaggcgtttaacatcgtgaagaacaagactgaacctgtcatcaatggcacgtccgtggtgttgcagtatgaaatcgaaactgacccagcccttacatatgtcgaaggggtgtgcgtggtgtggttcacttttgagttcttagtacgaatagtgttcagccctaataaactggaattcatcaagaatttgctcaacatcattgactttgtcgccattcttccattttatctggaggtgggcctaagtgggttgtcatcaaaggccgctaaagatgttctcggattcttaagggtggtgcgctttgtcagaattcttcgtatatttaagctcacccgtcacttcgtcggcttgcgtgtgttgggccacacactgcgagccagtacgaatgagtttttgttgctcattatctttttggctcttggtgtgcttatcttcgccacgatgatttactatgcagagagagtgggggcccagcccaacgaccccagcgcatcagagcatacccagtttaaaaatatccccatcggtttttggtgggcagtagtcacgatgactaccctgggctacggcgacatgtaccctcagacatggtccgggatgctggttggagctctgtgtgcgttggcaggggtgctcacgatcgcaatgccagtgcctgttattgtgaataatttcggcatgtattactccctggccatggcaaagcaaaagctgcctcgaaaacgaaaaaaacacatcccccctgctccccaggccagctcccccactttttgtaaaacagagttaaacatggcttgtaacagtacacagtccgatacgtgtttgggcaaagacaataggctactggaacacaatagatcagtgcttagcggagatgactccacaggatccgaaccgcctctgagcccccccgagcggctacctatacggagatctagcactcgggataagaacagacggggggaaacttgtttcttactgactaccggtgactacacatgtgcttcagatggggggatccgtaagggctacgaaaaaagccggtctttgaacaacatcgcagggctagctggaaacgccctcaggctaagcccagtgacgtctccttacaattcaccttgtcctttaaggcggtctcgtagtccaatccctagcattttgtag

SEQ ID NO: 200385 - DNA, 1890 bp, Artificial Sequence
  Description of Artificial Sequence: Synthetic coding sequence
atgggcaagatcgagaacaacgagcgggtgatcctgaacgtgggcgggaccagacacgaaacttacaggagtacactcaaaactctccccggcactaggttggcactcctggctagctcagagcctccgggagactgtctcacaaccgctggcgataaactacagcctagcccccccccactcagccctccaccccgcgcccctcccctgagccctgggccaggcgggtgcttcgagggaggggctggaaactgctcaagccggggtgggcgcgcctccgatcaccctggcggcggtcgggaatttttcttcgatcggcacccgggcgtgtttgcctatgttctgaactactaccgaacgggcaaactccactgcccagccgacgtctgtgggccgctcttcgaagaggagctggcattttggggcatcgacgaaactgacgtggagccatgctgctggatgacttaccggcagcaccgggacgccgaagaagctctggacatcttcgagacaccagacctgattgggggagaccctggagatgacgaagatctggctgcaaagagacttgggatagaggacgctgccgggctcggtggaccagacggcaaatctggacgatggaggcgactccagccccggatgtgggctcttttcgaggatccctacagttcccgggctgccagatttattgccttcgcatccctcttcttcattctggtctccataacaacattctgtctcgagactcacgaggcttttaatatcgtgaagaataagaccgaaccagtgatcaatgggacctctgtggttctgcaatacgagatagagactgatccggcactgacatacgttgagggagtctgtgtggtgtggttcaccttcgagtttctcgtgagaatcgtcttttcccctaataagctggagttcattaaaaaccttttaaacataattgatttcgtggctatccttcctttctacctggaggtcggcctgtcggggctctcctccaaagcagccaaggacgtgttaggttttctgcgagtcgtaaggttcgtacgaattcttcgaatcttcaaattgactcgccatttcgtagggctgcgagttctgggtcatacactgagagctagcacaaatgagttcctgctactgattatattcttggccttgggcgtcctgatattcgccaccatgatctactacgccgagagggtaggggcccagcccaacgatccgagtgccagtgagcacacccagtttaagaacatccccatcggattttggtgggccgtcgtcacgatgactacgctgggctatggcgacatgtatcctcaaacctggtctggaatgcttgtgggggccctgtgtgcactggcgggcgtgttgacgattgccatgcctgtacctgtcattgtgaacaatttcggaatgtattactccctcgctatggccaagcagaaattgccacggaagcggaaaaaacacattcccccagcgccacaggcttcctcccccactttttgcaaaacagagttgaatatggcttgcaatagcacgcaatcagatacttgcttgggaaaagacaaccggcttttggaacacaatcgatcagtgttgagcggcgacgattctactggctccgaaccgcccttatctcctcctgagcgcttacccatccggaggtcatctactagggataagaaccggagaggcgagacctgctttttgctgactactggtgattacacttgcgcttcagacgggggtattcggaaggtgctgtaccgcatttatcatggactactgacagccgaaaagggcacggtggagttcagtcacaccaaggactatacagggaacaggctgctgctgcttaatgtgccctag

SEQ ID NO: 200386 - DNA, 2187 bp, Artificial Sequence
  Description of Artificial Sequence: Synthetic coding sequence
atgctgagcagcgtgtgcgtgagcagcttccggggccggcagggcgccagcaaacagcagcctgcacctcccccccaaccccctgagagtcccccccctcccccactgccccctcagcagcagcagcccgcgcagcccggtccagcagcctccccggcaggcccacccgcccctcgcggacctggggatcggagagccgagccttgtccaggtcttcctgccgctgccatgggacggcacggagggggaggcggcgattcaggtaagattgtcattaacgtaggtggggtcaggcacgaaacttaccgatccacgctgaggactctgccaggcactagactcgccggactcactgaaccggaggcagcagctcggttcgactacgatcctggtgcggatgagtttttctttgacaggcatccaggcgttttcgcctatgtgctgaactactatcgtaccggcaagctgcattgccctgcggatgtgtgcggccccttatttgaggaggagctggggttctggggaatcgatgagacagatgtggaggcctgttgttggatgacctatcgtcagcacagagacgccgaggaagctctggatagctttgaagcaccagacccagccggtgccgcaaacgctgctaacgccgcaggggctcatgatggcgggttggacgacgaggcaggggcagggggtgggggtctggacggcgctgggggggagctcaagaggctttgctttcaggatgcgggagggggcgcaggcggacccccgggaggagctggaggcgcaggggggacatggtggcgccggtggcagccacgagtgtgggccctgttcgaagatccttacagttctcgcgccgctcgttatgtagccttcgcatctttattttttattctgatcagcataactacattctgccttgagacacacgaggggttcatccatatttcgaacaaaacagtgacacaagccagtcccattccaggggcacctccggagaatatcacaaacgtggaggtggagacggagcccttcctgacatacgtcgagggcgtttgcgtggtctggttcacatttgagttcctgatgagaatcacattctgtcccgacaaagtggaattcctaaagtcaagcctaaacatcatagactgtgttgctattctccccttctatttggaggtagggttgtccgggctaagctcaaaagctgctaaggacgtccttggcttcctgcgagttgtcaggttcgtgcggatcttaagaattttcaagctgactaggcatttcgttgggctgcgagtactgggacatacactgagggcgtcgacaaatgagttcctgttgctgattattttcttagcactaggcgttctaatctttgccaccatgatctattatgccgagaggatcggcgctgatcccgacgatattctgggctcgaaccatacatatttcaagaatattcccatagggttttggtgggcggttgtaaccatgactacactcggctatggcgacatgtatcctaagacttggtcaggtatgctggttggcgcactgtgtgcgctggctggtgtgctcaccattgctatgccagtacccgtgatcgtgaataactttggcatgtactattctcttgctatggccaagcagaagcttcccaaaaagaaaaataagcatattccccggccgccccagccaggaagcccaaactactgcaagcctgatcctcccccccctcctcctccccatccccaccatgggagtgggggcatctccccccctcccccgataacaccaccatcaatgggcgttacggtagcaggtgcctatccagcaggcccgcatacccacccagggttgttaagagggggagcgggaggtctaggcatcatggggctgccccctctgcctgccccaggcgagccatgcccactggcacaggaggaggtcattgaaatcaacagagctgacccacgacctaatggtgatccggccgcagcggcgttagcacatgaggattgtccagcgatcgatcagcccgctatgagccccgaagacaagagtccaatcacccccgggagtagaggcagatatagccgtgaccgcgcctgctttctgctgaccgattacgcccccagccctgacggctccattaggaaagcattggttacagcctag

SEQ ID NO: 200387 - DNA, 468 bp, Artificial Sequence
  Description of Artificial Sequence: Synthetic coding sequence
atgggcatccggcagcagctgcggctgcccacccggaccgcccagccattaacgagtctcccgtgtcccagaaagacaagagcgccgagtcgcttagaggctgtcgctgccatcgccggtaccgagccagctagttcatcacccaccatgccactcccgcttatggctccgagcgagaaactgctaagtccacccgagactagcagggactttcgaagtccaccacctcttcccccccggctaagggagattccccagcctcagcagcaccgcggccctgagagaggagtgccagcccctcgggccccatgccatcctccatggctgtctcccgggcgacctcctcgttccccagaccccgcgctgcatcccctggccctccccagccctctttggggagactcgggggtaactggcaaaaaagttaagggcgcaggcggcggaggctgggggaaggggttcttctag

SEQ ID NO: 200388 - DNA, 1629 bp, Artificial Sequence
  Description of Artificial Sequence: Synthetic coding sequence
atgacctaccggcagcaccgggacgccgaggaggccctggacagcttcgaggctccagatcccgccggagccgctaacgccgcaaacgctgccggagcacatgacggtgggctggacgacgaagccggagctgggggaggcggtctggacggggcaggcggggagctcaaaagactttgctttcaggacgctgggggaggagcaggaggcccccccgggggcgccggaggtgcgggaggtacctggtggaggaggtggcagccacgcgtttgggccctgtttgaggatccgtatagctcccgcgccgcaaggtatgttgcttttgccagtcttttcttcatccttatcagcataaccacgttctgtttggaaacgcatgaaggatttatacacattagtaataagacagtaactcaggcttcccctatccccggggcccccccagaaaacataaccaatgtggaggtagagactgagccatttctcacctacgtcgaaggagtgtgtgttgtgtggtttaccttcgaattcttgatgaggattacgttttgcccagacaaggttgaattcctgaagagttccctgaacatcatcgactgtgtcgcaatcctgcctttctacctggaagtcggactgtccggactgtcttctaaggccgctaaggacgtgctgggttttcttagagtggtacggtttgtccgaatcctgaggattttcaagctcacacgccacttcgtaggcctacgggtgctgggtcacaccctgcgcgcatcaacgaacgagtttctgcttctgattattttcctggcacttggagtcctgatatttgcaactatgatttactatgcggaacgcattggtgccgatcctgacgatatcctgggatctaatcatacctacttcaaaaatatccctatcggcttttggtgggcggtggtgacaatgaccacactgggatacggggacatgtatcctaagacgtggtctggcatgctcgtaggcgccctctgtgcccttgccggtgtgctgaccatcgcaatgcctgtcccagtgattgtgaacaactttgggatgtattattctctcgctatggcaaagcaaaagctgcctaagaaaaaaaacaagcacatccctcgaccaccccagccaggaagccccaactattgcaaaccagaccccccaccaccgccgccgcctcatccccatcacggaagcggagggatttccccgccaccgccaattacacctcctagcatgggtgtaactgttgccggggcataccccgcaggcccacacactcaccctgggttgctgagaggaggggccggggggctggggattatggggctccccccactgcctgcacccggcgaaccttgccctttggcccaggaagaggttatagagattaaccgggctgacccgaggccgaatggcgatcctgctgccgctgcactggcacacgaagactgcccagccatcgatcaacccgcgatgagcccggaagacaagtcccctatcactccgggctcaaggggccgctactctcgagatagagcctgctttttgcttacagactatgcaccctcaccagacgggtcaatacggaaggcgctggttactgcctag

SEQ ID NO: 200389 - DNA, 2274 bp, Artificial Sequence
  Description of Artificial Sequence: Synthetic coding sequence
atgctgagcagcgtgtgcgtgagcagcttccggggccggcagggcgcctctaaacaacagccagcccccccaccacagcccccagagagtcctcctcctccacctctgcccccccagcagcagcagcccgctcagcccgggccagcagcctcccccgccggaccgcccgcaccgagaggaccaggcgatcggcgggcagaaccttgtcccggattacctgcagccgcaatgggaagacacggtggagggggaggagatagtggaaagatcgtcattaacgttgggggcgtgcgccatgagacctaccgctcaactctccggactttaccgggcactagactggccggactgacggaacccgaggccgcagctcggttcgattatgaccctggcgcagacgagttttttttcgacaggcacccaggtgttttcgcgtatgtgttaaactattacaggacaggcaaattgcactgtccagctgacgtctgtggtcccctgttcgaggaggagttgggattctgggggattgacgaaaccgatgtggaagcatgctgctggatgacataccggcagcaccgagatgcggaggaggccctggacagcttcgaagcaccagaccccgccggggccgcaaatgccgccaacgctgctggagcacacgatggggggctggatgatgaggctggagccggcggcggaggtcttgatggcgcgggcggcgaattgaaacggctctgttttcaggacgcaggtgggggcgccggcggcccaccaggaggagccggtggcgccggcggaacttggtggcgtaggtggcagcccagggtgtgggcactttttgaagacccgtactctagtagggccgccaggtatgtggccttcgcctcactgttcttcatcctgatatccatcacaactttctgcctcgaaacacacgaggggttcattcacatatctaacaaaactgttacacaagccagcccaattcccggagctcctccagaaaacatcacaaacgtcgaagttgagacagaacccttcttaacatatgtcgagggggtctgtgtagtttggtttacttttgagtttctgatgcgtataacattctgccccgacaaagttgagtttttaaaaagtagtttaaacatcattgactgtgtggccatattgccattttatcttgaagtcggtttgagtggcctgtcttccaaagcagccaaggatgttctgggattcctgagagtcgttcggttcgtgcggatcttgcggatcttcaaactgaccagacatttcgttggattacgggtcctgggccacacacttagggcatccacgaacgaattcctgctgttaataatatttctagctctcggggtcttaatctttgccactatgatctactacgcggaaaggattggggccgacccagatgatatcctggggagcaatcatacatattttaagaacatccctattggattttggtgggctgtagtcactatgacaaccttaggttacggggatatgtatccaaagacctggtcaggaatgttggttggtgctttgtgtgcactggcaggagttcttaccatcgctatgccggtacctgtgattgtgaataattttgggatgtactattccctcgcaatggccaaacaaaaattacctaagaagaaaaacaaacacatcccaaggccacctcagcccggatcaccgaattactgcaagcccgatcctccaccacctcccccgcctcacccccaccacggctctggaggcattagcccacctccaccgatcactccgccttcaatgggagtgacagtcgctggcgcttatccagcaggacctcacacccaccctggacttctgcgggggggtgctgggggcttaggaatcatgggcctgccaccactcccagctccaggggagccctgcccacttgcacaggaggaggtcattgagatcaatcgtgccgaccctcgacccaatggcgaccctgctgccgccgcactcgctcacgaggactgccctgcaatagatcagcccgccatgtcccccgaggacaagtcaccaatcactcccgggagcagaggcaggtactctagggacagagcctgcttccttctaacagattacgcgcctagcccagacggcagcattagaaaggctacaggagccccccctctgccccctcaagactggaggaagccggggccgccctccttcctgcctgacttgaatgcgaatgcagctgcgtggatcagtccttag

SEQ ID NO: 200390 - DNA, 1908 bp, Artificial Sequence
  Description of Artificial Sequence: Synthetic coding sequence
atgatcagcagcgtgtgcgtgagcagctaccggggccggaagagcggcaacaagccaccgtcaaagacatgtttaaaggaagagatggccaagggcgaggcaagcgagaaaataatcatcaacgttggagggactcggcacgaaacttacaggtccacattacgtaccctcccaggtactaggctcgcctggttggcagatcctgatgggggtgggcggcccgagaccgatggcgggggcgtgggatcaagtgggtcttcaggaggtggcggttgtgagtttttcttcgataggcatccgggcgttttcgcctatgtgctaaattactacagaaccggcaagctgcattgtcccgccgacgtgtgcggacccctgttcgaagaggagctcacgttctggggaatagacgaaactgatgtagagccatgctgctggatgacttatagacaacaccgagacgccgaagaagcactggacatattcgaaagccccgatggaggcgggtccggagcagggccaagcgatgaggcaggcgatgacgagcgagaactcgctctccagagattgggaccccatgaagggggggcggggcatggcgctggtagtggaggttgccggggttggcaaccccgcatgtgggcactgttcgaagatccttactcttcgcgcgctgcccgcgtagttgcgttcgcaagtcttttttttatcctcgtgtccatcactactttctgtctcgagacacatgaagcttttaatattgatcgcaacgtgactgagattctccgggtgggtaacatcactagcgtccatttccggagagaagttgaaaccgaacccattctgacctacatcgaaggcgtttgcgtgctgtggtttacgcttgagttcctcgtcaggatcgtgtgttgcccggacactctggacttcgtgaaaaatctgctgaatatcatagacttcgtcgcgatcctgccattttacctcgaagtcggtctgtctggcctgtcctccaaggctgcccgcgacgttcttggttttctccgggttgttcgcttcgtgcgtattttacgaatattcaagctcactcgacatttcgtcggcttgagggtgttaggtcataccttgagggcttcgaccaatgagtttcttttgcttataatttttctggcgctgggtgtgcttatattcgctaccatgatttactatgcagagaggattggcgcccgaccaagcgacccacgcggtaacgatcacaccgactttaaaaacatacctataggcttctggtgggctgtagtgaccatgacaaccttgggttacggggacatgtatccgaagacatggagcggcatgcttgttggagccttgtgtgctctggccggggtgctgacaatcgcaatgccagtccccgttatcgttaataattttggcatgtactactctcttgccatggctaagcaaaagctcccgaagaagagaaaaaaacacgtccccaggcctgcccagctggaatctcccatgtattgtaagagtgaagagacaagcccccgtgactccacttgttccgacacctcccccccagcacgtgaggaaggaatgatagaaaggaagagagcagacagtaagcagaacggcgacgccaacgccgtgctgagtgatgaggaaggtgccggtcttactcagcctctggctagcagcccaaccccagaggaacgtagagcactccgcagatccacaactcgtgatcggaataagaaggccgccgcctgtttcttgctttccaccggagactatgcatgtgcggatggctcagtcaggaaagggacattcgtgctgcgggatctcccgttacagcacagccctgaagcagcctgccctcctacagcaggaaccctgtttttaccacactag

SEQ ID NO: 200391 - DNA, 1881 bp, Artificial Sequence
  Description of Artificial Sequence: Synthetic coding sequence
atgatcagcagcgtgtgcgtgagcagctaccggggccggaagagcggcaataaacctccctccaaaacttgcttgaaagaagaaatggcgaaaggagaggctagcgaaaagatcatcatcaacgtgggaggaacacgtcacgagacttataggtctactctgcgaacacttcccggcaccagactggcttggctggcagatccagatggaggcggcagacccgaaaccgatggcggcggggtggggagcagcggtagctctgggggcggcggctgtgaattctttttcgataggcacccaggcgtgttcgcatacgtgcttaattactatcgcaccgggaagcttcactgccccgccgacgtgtgcgggccgctcttcgaggaagaactcaccttctgggggattgatgagacggacgtagagccgtgctgttggatgacttataggcagcatcgtgatgcagaagaagcactggatatctttgagagtcccgacggtggcggatccggcgccgggccttctgatgaggccggcgacgacgagcgcgaactggctctgcagcgcctcggcccccatgaaggcggggcgggacatggggctggatctggcggctgtagaggctggcagccccgcatgtgggctctgtttgaagatccctactccagccgcgcagctagggtggtggcctttgcctcattgtttttcattttggtctctattacgactttttgtctcgagacccacgaggcttttaacatcgaccggaatgtaacggagatacttagggtgggaaatattacttctgtccacttccggcgcgaggtggagaccgaaccaattttaacttatattgagggcgtatgtgttctgtggtttactttagaattcctcgtgaggattgtttgctgccccgacaccctcgattttgtgaaaaacctgctgaatattatagatttcgtggccatcctaccattctatttggaagtaggcctgagtggcttatcatctaaagccgcccgcgacgtcctgggctttctgagggttgtgcggtttgttaggatactccggatctttaaacttacaaggcactttgttggcctgagggtgctaggacatacccttcgcgcgagcactaatgaatttctgctgctgataatcttcctagccctcggtgtgcttattttcgctactatgatatactacgctgagagaatcggagctcgaccttccgacccaaggggcaatgaccacaccgacttcaagaatattcccatcgggttctggtgggccgtggtgacaatgactaccctcggatatggggatatgtaccccaaaacctggagcggtatgttagtgggtgccctatgcgcccttgctggcgttctgactattgccatgccagtcccagtcatcgttaacaatttcggtatgtactattcccttgcaatggcaaaacagaagctgcctaagaagaggaagaaacatgtgccaaggccagcccagctggaatcccccatgtactgcaagtccgaagaaacatcaccaagggactctacctgctccgataccagcccaccagctagagaagaaggcatgattgagagaaagcgtgccgactccaaacagaatggtgacgccaatgccgtccttagcgatgaagagggggcaggcctcactcagcctctggcatcctctccaacgccagaagaaagaagagctttacgaagatctaccacccgggatcgcaacaaaaaggcggctgcttgtttcctattaagtactggggactatgcctgcgccgatggcagcgtccggaaggagacgtgccaagatgcattgtcttccaattatgcacaggctgaagtcctcacactgtcctag

SEQ ID NO: 200392 - DNA, 1908 bp, Artificial Sequence
  Description of Artificial Sequence: Synthetic coding sequence
atgatcagcagcgtgtgcgtgagcagctaccggggccggaagagcggcaacaaacctccatccaagacatgtcttaaggaagaaatggcaaaaggagaagcgtcggaaaagatcataattaacgttggcggtactaggcatgagacttatcgaagcaccctcaggactcttccggggacccgactggcctggctggctgatcctgacggcggggggcgccctgagaccgacggtggaggggttggatcctctggttcaagcggcggtggcggatgcgaattcttctttgatcgccaccccggcgtcttcgcctacgtgttgaactattatcggaccggcaaactacactgccccgctgatgtatgcggtcctttgtttgaggaagaattgactttctggggaatcgatgaaacagacgtggagccttgctgctggatgacatatcgacaacatcgcgacgccgaagaagcccttgacatctttgagagtccggatggaggcggatccggagccgggccaagcgatgaggccggagacgacgagagagaactcgctttgcagcgcctggggccccatgagggaggggccggccacggggcgggctcagggggctgccgaggctggcagccaaggatgtgggccctgttcgaagatccctattcctccagagctgcccgggtggttgcttttgccagcttgttcttcatccttgtctccatcacaacattctgtctggagacgcatgaagcattcaacatcgaccgcaacgttaccgagatcctgagagttggcaatattaccagtgttcatttccggcgggaggtggaaacagaacccatcctgacctatattgagggggtctgcgtcttgtggttcaccttggaattcttagtcagaatcgtttgctgccccgacaccctagactttgttaaaaacctgttaaacatcattgatttcgtggctattcttcctttttatctggaggttggattgagcggtctcagctcaaaggctgcccgagatgtcctcgggttcttacgagttgtgcggtttgtacggatccttagaatcttcaagctgacaaggcattttgtcggcttgcgtgttctgggacacaccctgagggcgtcaactaatgaattcctactcctcattatcttcttggctttgggggtgcttatatttgccacgatgatctactacgcagagcgaatcggcgcccgacccagtgatcccagaggcaatgatcatactgactttaagaacatcccaatcggattttggtgggccgtggttacaatgactaccctcggatacggagacatgtatcccaaaacttggtcgggtatgctagtgggcgccttatgtgcgctggcgggcgtccttacaatcgctatgcccgtgcccgttatagtaaacaattttgggatgtactactctttggctatggccaaacagaaactgcccaaaaagcgcaaaaaacacgtgccccggcccgctcagttggagtcaccaatgtactgcaaaagtgaggagacatccccccgggactccacctgctccgacaccagtcccccggctagggaggagggcatgatcgagcgcaaacgggcagactccaagcagaacggcgacgccaatgctgtcctttccgatgaagagggagctggcctcacacagcccctagcttcctcccctactccagaggaacggagagccctgagaagaagcacaacacgggacaggaataaaaaagccgcagcttgcttcctgctttctacaggagactacgcgtgcgccgatgggtcagtgaggaagggaacattcgtccttagggacctgcccctacaacactcaccagaagctgcctgccccccaaccgcaggtactcttttcttgccacattag

SEQ ID NO: 200393 - DNA, 1485 bp, Artificial Sequence
  Description of Artificial Sequence: Synthetic coding sequence
atggacggcagcggcgagcggagcctgcccgagcccggcagccagtcaagcgccgcgtcagacgatatcgaaatcgtagtcaacgtaggcggtgtacgacaggtcctgtacggtgatctcctgagccaataccctgagactcggctcgcggaattaatcaactgtttagcgggaggctacgatacgatcttttccctttgcgacgactacgaccccgggaagcgggaattctacttcgaccgtgaccccgatgcttttaagtgcgtgattgaggtgtactattttggcgaggtgcacatgaagaaaggcatttgtcccatctgtttcaaaaacgagatggatttttggaaggtagatttaaaattcttagacgattgttgtaagagccacttgtctgagaagagggaagagctcgaggagatcgcacgtagagtgcagctgatactggacgatctgggcgtggatgctgcagaaggaagatggcgacgttgccagaagtgtgtatggaaatttctggagaagcctgaatcttcttgcccagctagagtcgttgcggtcttgtcgtttctcctgatattggtgtccagcgtcgtaatgtgtatgggcactattccggagctacaggtcttagatgccgaggggaaccgggtggagcaccccacgctggagaacgtggaaactgcgtgcattggctggtttaccctggaatacctgttacgcctgttctcatcacccaataagctccactttgccctgtcctttatgaatattgttgatgtgctggctatactgcctttctacgttagtctcacacttactcatctgggagctcgtatgatggaattaaccaacgttcaacaagccgtgcaggcccttaggatcatgagaatcgccaggattttcaaactagcccggcattcatcgggcttacagacattaacttacgctctgaaaaggagctttaaggagctgggcctgctgctaatgtatcttgccgtgggcatctttgtattttctgcattaggctatacaatggaacaaagccacccagagaccctgttcaaaagtattcctcagtctttctggtgggccatcattacgatgaccacagttggctatggggacatctaccccaaaacaaccctcgggaagctgaatgcagccatctcttttctgtgcggcgttatagcaatcgcattacctatccatccaataattaacaacttcgtgcgatactacaataagcagagagttctggaaaccgcagcaaagcacgaactcgagttgatggagctcaattctagttccgggggagaaggaaaaacaggtggcagccggtcggacctggataacctgcccccagaaccagctggcaaagaggccccttcctgttcttcccgcctgaagctgagccatagcgataccttcatccctctgctgacagaggaaaagcaccatagaactagactgcagagctgtaaatag

SEQ ID NO: 200394 - DNA, 1542 bp, Artificial Sequence
  Description of Artificial Sequence: Synthetic coding sequence
atgaccctgctgcccggcgacaacagcgactacgactacagcgccctgtcctgcacgtcagatgcctcctttcatccagcatttttgccccagcgacaagctattaaaggagcattttatagacgggctcagagactgagaccccaagacgagccacggcagggatgtcagcctgaagaccggcgcaggagaatcatcataaacgtcgggggcataaagtactctctgccatggactacattggatgaattccccctcacccggttgggtcaattaaaggcttgcactaatttcgatgatatcctgaatgtctgcgacgattatgatgttacctgcaacgaatttttcttcgaccgcaacccaggggcttttgggacaattctgactttcctgcgggccggaaagctcaggctgcttcgggagatgtgcgcactaagcttccaggaagagctgttgtattggggaatcgccgaggaccatttggatggctgttgtaaacggcgatacttacagaagatcgaggagttcgccgagatggtggaaagggaggaggaggatgacgcactcgatagtgaaggaagggattccgaaggccctgccgagggggaaggcaggttgggaaggtgtatgcgcagactccgggacatggttgagcgacctcacagtggcctccccgggaaagtgttcgcttgcctgtcagtgttatttgtgaccgtgaccgccgtgaatctgagcgtgtccactctccctagcttgcgggaagaagaagagcaaggccattgctcccagatgtgtcacaacgtgtttatcgtggaaagtgtgtgcgtgggttggttcagcttggaattcctgcttaggctgatccaggccccaagtaagtttgcttttttgaggtctccccttactttgatcgatctcgttgcaattctgccatattatatcaccttgctggttgacggagccgctgcggggcgccgcaaaccaggtgcgggcaactcttatcttgataaagtgggtctcgtgttgcgcgtacttcgggcactgagaatcctgtacgtgatgaggttagctcgacactcccttggattacagactctcggattaacagccagacggtgcacaagagaattcggattgctactgctcttcctttgcgttgcaatcgccctctttgctccactgctgtatgtaattgagaacgagatggcagactctcccgagtttacatctataccggcgtgttactggtgggctgtaatcaccatgactacagtcggctacggggacatggtccctcgctccacacctggacaagtcgttgccctttctagtattctgagtggcatcttgcttatggcttttccagtgaccagcatctttcatactttttctcgttcctacctcgaattaaagcaggagcaagagcgggtcatgttcaggagagcccagttcttgataaaaaccaaaagccaactgagcgtgtcccaggattccgatatactgttcggctccgccagttcagatacccgggataataactag

SEQ ID NO: 200395 - DNA, 828 bp, Artificial Sequence
  Description of Artificial Sequence: Synthetic coding sequence
atgaccctgctgcccggcgacaacagcgactacgactacagcgccctttcatgcacaagcgacgccagtttccatcctgcgtttctgccacagcgccaagcaatcaaaggggccttttaccggagagctcagcggctgcggccccaggatgaaccaaggcaaggttgtcagcctgaagaccgcagaaggcgcattataattaacgtgggaggcatcaagtacagtttaccatggaccacactcgatgagtttccactaacaaggcttggccagttgaaggcgtgcacaaatttcgatgacatacttaacgtgtgcgatgactacgacgttacttgtaacgagttctttttcgatcggaatcccggagccttcggtacgatactaacgttcttacgcgccggtaaactacgcttactccgcgagatgtgtgccctctcttttcaggaagaactgctgtattggggtattgccgaggatcatctggatggttgttgcaaacggcgctatttgcaaaaaatcgaagaattcgctgagatggtggagcgggaagaggaggacgacgcactggattcagagggtcgcgattcagaaggccctgcagagggcgaaggtcgtctcggcaggtgcatgcgccggcttcgcgacatggtagaaaggccacactccggcttgccaggcaaggtgttcgcttgtttatccgtactgttcgtgacagtaactgcagtgaacctttctgtgtctactcttcccagcttgagagaggaggaagagcaagtccgtgcacatgcccctagggggaacgctcctccgaggggaaaaggcttgtag

SEQ ID NO: 200396 - DNA, 543 bp, Artificial Sequence
  Description of Artificial Sequence: Synthetic coding sequence
atgaccctgctgcccggcgacaacagcgactacgactacagcgccctgagttgtacgtctgacgcatccttccacccagccttcctaccccagagacaggcgatcaagggagccttctaccgccgggctcagcgtcttagaccccaggacgaacccaggcagggatgtcagccggaggaccggaggcggcgtatcataatcaacgtcggggggattaaatacagcctcccatggacaaccctggacgagtttccacttacacgccttggccagctgaaggcctgcaccaacttcgacgacatcctcaacgtctgcgacgactacgacgtgacatgcaacgaatttttctttgatcgaaatccgggagcttttggcaccatcctgacattcctgagggccggcaaattgagacttcttcgtgagatgtgcgctttgagctttcaagaggaactgctgtattggggcatcgcagaggaccatctcgacggctgctgcaagcgccggtatctgcagaagattgaagaatttgcagagatggtatag

SEQ ID NO: 200397 - DNA, 291 bp, Artificial Sequence
  Description of Artificial Sequence: Synthetic coding sequence
atgaccctgctgcccggcgacaacagcgactacgactacagcgccttgtcctgcaccagtgatgcctcctttcatcctgcttttttgcctcagaggcaggccattaagggcgccttctaccgcagagctcaaagactgaggccccaggatgagcctcgacagggatgccagccagaggaccggcgaagaagaattatcattaacgtaggcggaatcaaatacagcctcccatggacaaccctcgatgaatttcctctgacgcgactggggcagctaaaagcctgtacttag

SEQ ID NO: 200398 - DNA, 777 bp, Artificial Sequence
  Description of Artificial Sequence: Synthetic coding sequence
atgaccctgctgcccggcgacaacagcgactacgactacagcgccctgtcatgcacctcagatgcctcctttcatcccgctttcctgccacagagacaggcaattaaaggtgctttttatcggagggcccagaggcttcgccctcaggacgaacccagacaggggtgtcagcccgaggacagacgcaggagaattatcattaatgtcggcggtattaagtatagcctcccatggacaactctcgacgaattcccactgactcgccttggacagctcaaggcatgtacgaacttcgatgacattctaaacgtttgcgacgactatgatgttacctgcaatgagttcttttttgatcgcaacccaggggccttcgggaccatcctgacattcctgcgggcgggaaaactgcgcctgctgcgcgagatgtgcgccttgagcttccaagaggagctcctttactggggaattgccgaggaccacctagatggttgttgtaagcgccgctatctccaaaaaatcgaggagtttgcggaaatggttgaacgagaagaggaagacgatgcactcgattccgagggccgggattccgaaggcccagcagagggtgaagggcgactcggtcgttgcatgcgtaggctcagagacatggtggaacggccgcacagcggcttgcctggtaaggtgtttgcctgcctgagcgtcttgtttgtaaccgtgaccgcagtgaacctcagtgtttcgacgctgcctagcctccgggaggaggaagagcagtag

SEQ ID NO: 200399 - DNA, 147 bp, Artificial Sequence
  Description of Artificial Sequence: Synthetic coding sequence
atgaccctgctgcccggcgacaacagcgactacgactacagcgccctctcctgcacatccgacgcctcatttcatcccgccttccttccgcaacgccaagccatcaaaggagccttttacaggagggcccagcgcctacgaccctag

SEQ ID NO: 200400 - DNA, 1311 bp, Artificial Sequence
  Description of Artificial Sequence: Synthetic coding sequence
atgaccttcggccggagcggcgccgccagcgtggtgctgaacgtgggcggagcgagatacagcctctctcgagaactcctcaaggacttccccctcagacgggtgtccagactgcacggatgtaggtcagaacgcgacgtgctggaagtctgcgacgattatgatcgagagagaaacgagtattttttcgatcgccactccgaggcctttgggttcatactgttatatgtccgtggtcacggcaaattaaggttcgccccccgaatgtgcgagctgtctttctacaatgagatgatctattggggactcgagggcgctcatcttgagtattgctgtcagcggcggctggatgacaggatgtctgacacatacactttttactcagccgacgaaccgggggtcttagggcgtgatgaagctcggccgggcggggccgaggcagctcctagtcggaggtggctagagaggatgcgccgcacctttgaagagcctacttcttccctcgctgcccaaatcctggcatctgttagtgtagtgtttgtaattgtgtctatggtggtcctctgtgctagcacgttaccagactggcgaaatgccgcagccgacaaccgctctctggacgaccgctcaaggtactccgcgggcccgggcagagagcctagcgggattatcgaggctatctgtattggatggtttactgctgaatgtattgtgcgcttcatagtatcaaagaataagtgtgaatttgtcaagcgtcccctgaatattatagaccttttggccatcacgccatattacatcagcgtcctgatgacagtattcaccggtgaaaattcccagctgcaaagagcaggcgtgacgctccgcgttctgagaatgatgagaattttttgggtcataaagttggcacggcacttcatcgggctgcaaactctcggcctgacgctgaagagatgctacagggaaatggtgatgctgctggttttcatctgcgtcgccatggctattttctctgcattgtctcaactgctagagcacgggctggatctggaaacaagtaacaaagactttacaagcatcccggccgcctgctggtgggtgattattagtatgaccacagtgggctacggcgacatgtacccaatcaccgttccagggcgcatcctggggggagtatgtgttgtatcaggaattgtgctgcttgccctgcccattacctttatttatcattcttttgttcagtgctaccacgaacttaaattcaggtcagctcggtactccagatccctgtccacggaattcttaaactag

SEQ ID NO: 200401 - DNA, 1278 bp, Artificial Sequence
  Description of Artificial Sequence: Synthetic coding sequence
atgaccttcggccggagcggcgccgccagcgtggtgctgaacgtgggaggggcccgttattctctgtcccgcgagttgctcaaggactttcccctgcgaagagtgtctaggctgcacggctgtaggagcgagcgtgacgtgctcgaggtgtgtgatgattatgatagagagcggaatgagtacttcttcgaccgccacagtgaggcatttggctttatcctcctgtatgtgcgcggccacggaaaactgcgttttgccccacggatgtgcgaactctctttttacaatgaaatgatatactggggtcttgaaggagcccacctggagtattgctgtcagaggagactcgacgacagaatgtcagatacttatacgttctattccgccgacgaacccggcgttttagggcgtgacgaggcgaggccaggcggcgccgaagctgctccttccaggcggtggcttgagcgcatgagaaggaccttcgaagaaccaacttcatccttggcagcccaaattttggcctcagtttcagtggtatttgtcattgtgtccatggtcgtgctgtgcgcaagcactctgcccgattggagaaatgcagccgctgacaatcgctcgttagatgaccggagtcgaatcatcgaggccatttgcattgggtggttcactgctgagtgtatcgtgcgcttcattgtttctaagaataagtgcgagtttgtgaagagaccattaaatatcatcgacctgctggctattactccatactatattagcgtgctgatgaccgtttttacaggcgagaattcgcagctgcaacgcgcaggagttaccctcagggtgctacgaatgatgcgcatcttctgggtgataaagctagcaagacattttatcggcctgcagacacttgggttgactttgaaaaggtgttatcgagaaatggtgatgctactggtctttatttgtgtggctatggccatcttttctgccctcagtcagctgcttgaacacggactcgacctggaaacctccaataaagattttacctctatccctgccgcttgctggtgggtgattatcagcatgactactgttggctatggagacatgtaccctattaccgtgcctgggcgcattctggggggtgtatgcgtggtgtccggtatcgtacttctggcgttacccatcacttttatctaccacagcttcgttcagtgttaccatgaattgaagtttaggtctgccaggtacagtagatccctgtccacggagttcctaaactag

SEQ ID NO: 200402 - DNA, 1560 bp, Artificial Sequence
  Description of Artificial Sequence: Synthetic coding sequence
atgcccatgcccagccgggacggcggcctgcacccccggcaccaccactatggttcccatagcccatggtcccaacttctgagttcccccatggaaaccccttccatcaaaggcttgtattaccgaagggtgcgcaaggtgggtgcacttgacgcctcccctgtggatctaaagaaagaaatattaattaacgtgggcgggcggaggtatctgctcccgtggtctaccctggatcgctttcctcttagcaggctgtccaaattacggctctgcaggtcttacgaagagatcgttcagctgtgcgacgattacgatgaggatagtcaggaatttttctttgatcggagcccatccgcgttcggcgtgatcgtaagcttcctggccgcagggaagctcgtactgttacaggagatgtgtgctctcagtttccaagaagagcttgcctattggggcattgaagaggctcatctcgaacgctgttgcctccggaaactgctccgaaagctggaagagctcgaggaactggctaagcttcaccgcgaagatgtcctcaggcagcagcgggaaacccgccggcccgcatcccattcaagccgatggggtctgtgtatgaaccggttgagggagatggtcgaaaacccccagagtggactgcccggcaaggtgtttgcatgtctgagcatcttgttcgtagcaacaacagccgttagtctatgtgtttccacaatgcccgatttgagggctgaagaggaccaaggagaatgctcccgcaaatgttactacatctttatagtagagacaatctgtgtcgcgtggttctctctggagttttgtcttcgctttgtgcaggctcaagacaaatgccaatttttccagggacctcttaatattatagatattctcgcaataagtccctactacgtcagcctggccgtctctgaggaaccccccgaagacggagagagaccttcaggttcaagttacctcgaaaaggtgggattggtgcttagggtgctacgcgctcttcgcatattgtacgtaatgaggctcgctagacattctctcgggctgcagactcttggtttgactgtgaggagatgtaccagagagttcggcctattactcttatttctcgcagtggcaatcaccctgtttagtcctctggtgtacgtggccgagaaggaatccggtcgagtgctcgagttcacctcaatccccgcttcctattggtgggccatcatcagtatgactacagtcggctacggcgacatggtacctagatctgtgcccggacagatggtcgctctgtccagcatcctgtccggcattctcattatggcatttccagccacttcaattttccacacttttagtcattcttatctcgaactgaagaaagagcaggaacagctgcaggcgaggctgcgccacttacagaatacaggacccgcatcagagtgtgaacttttggatcctcacgtggcctcagagcacgaacttatgaacgacgttaacgacttaatcttggaggggccagcacttcctattatgcatatgtag

SEQ ID NO: 200403 - DNA, 2970 bp, Artificial Sequence
  Description of Artificial Sequence: Synthetic coding sequence
atgaccatggccggcggccggcggggcctggtggccccccagaacacattcctggagaacatagtacgccgcagcaacgataccaattttgttctcgggaacgctcagatcgtggattggcctatcgtctacagcaacgatggcttctgcaaattgagcggttaccaccgagccgaagtgatgcaaaagtcctcgacttgctctttcatgtacggcgagttaactgacaaggataccatcgagaaggtgcgccagacgttcgagaactacgagatgaattcctttgaaatcctgatgtacaagaagaatcggaccccagtttggttttttgtgaaaatagcgcccatccggaatgagcaggataaagtcgtgctgtttctctgcactttcagtgacattaccgctttcaaacagcctattgaagatgactcatgcaaaggctggggaaaattcgctagactgacaagagcactgacgagctcccggggcgtacttcagcagttggccccatctgttcagaaaggggagaacgtgcacaaacactcaaggctggccgaggtgcttcaattgggttccgacatcctccctcagtacaagcaggaagcccctaagacgccacctcacataatattgcattattgtgtattcaaaacaacctgggactggatcattctcatcctgaccttctacaccgccatcctggtaccttacaacgtgtcttttaaaacccggcagaataatgtggcttggctcgtggtcgacagcatagtcgatgtgatcttccttgttgatatcgtgctgaacttccatactacctttgtgggaccggccggggaggtcatctcagatccaaagttaatccgcatgaattacctcaagacctggtttgtgatcgatcttctctcctgcttgccatatgatgttatcaacgcctttgaaaatgtggatgaggtgtccgcctttatgggcgacccaggaaagataggatttgcagaccagattccacctcctctggaaggtcgggagtcacaggggatttctagccttttttcctccctaaaagttgtccgcctgcttagactcggccgcgtcgccaggaagttggatcattacattgaatatggcgccgctgtgctggttcttctcgtttgtgtttttggactggcagctcactggatggcatgcatttggtatagcatcggtgactacgaaattttcgatgaagataccaagacaatacggaataattcatggctgtaccagcttgctatggacataggtaccccttatcagttcaatggctccggctcagggaaatgggagggagggccctctaaaaacagtgtatacatttcttcgctgtacttcacaatgacatcactgacaagcgttggatttggaaacatcgctccaagtactgacattgaaaagatctttgccgtggccattatgatgatagggtcgctcctgtatgctaccatctttgggaatgtgactaccatttttcagcaaatgtacgctaatacaaatagataccatgaaatgttaaacagcgtgagggatttcttgaagctgtatcaggtgcctaaaggccttagcgaaagggttatggattacatcgtgagtacttggagcatgagtcgcggtatagatacggagaaggtcttgcagatttgccccaaggacatgagagccgatatatgcgttcacctgaatagaaaggtgtttaaggaacacccagcgtttcggctcgccagcgacggctgccttcgtgctttggccatggagtttcagacagtccactgcgccccaggagacttaatttatcatgccggagaatctgtcgatagtctgtgttttgttgtatctgggtccctcgaggtgatacaggatgatgaggtcgtagccattctgggaaaaggcgatgtatttggcgacgtgttttggaaagaagcaacactagctcagtcttgtgccaacgttcgagccctgacttattgcgacctccatgtcattaaaagagacgccctacagaaagtcttggagttttataccgccttttcccactccttttctagaaacctgatcttaacatacaatttgcggaagcgtatcgttttcaggaagatctccgacgtgaagagagaagaggaggagcgcatgaaacgcaaaaacgaggcccctctgattctcccaccagatcatccagtgaggcggttatttcagcgctttcgccagcagaaagaggccaggctggctgctgagcgcggagggagagaccttgatgacttagatgtggaaaaggggaatgtcctgactgagcatgcaagcgcaaaccactctctggtcaaggcaagcgtggtcaccgtcagagaaagtccggctacccccgtgagctttcaggccgctagtacctctggcgtccctgatcacgctaagctgcaagctcctggaagtgagtgtcttggacccaaaggcgggggaggtgactgcgccaagcgcaagagttgggcccgctttaaagatgcttgcgggaaatcagaagactggaacaaagtctctaaggccgaaagcatggagactctgccagagcgtaccaaagccagcggcgaggcgactctcaaaaaaacagactcttgcgactcaggcatcacaaagagcgacttgagactggataatgttggcgaggcccggagccctcaggacagatcccctattttggccgaggttaagcacagcttttaccccattccggaacaaaccctgcaggcgaccgttctggaagtgagacacgaactgaaagaggacatcaaagctctgaacgccaagatgaccaacatcgagaaacagctcagcgagatactacggattctgacgagtagaaggagctctcagagtccccaggagctcttcgaaatatcacggcctcagtcgccagagtctgaaagagacatcttcggggcctcgtag

SEQ ID NO: 200404 - DNA, 2889 bp, Artificial Sequence
  Description of Artificial Sequence: Synthetic coding sequence
atgaccatggccggcggccggcggggcctggtggccccccagaacacattccttgagaatattgtgagaagaagtaatgatacgaatttcgtccttgggaacgcccagattgttgactggccgattgtgtattccaatgacggcttttgtaaactgagcggatatcatagggcggaagtgatgcagaagtcaagcacctgttcctttatgtacggggagctcacagataaagatacgatcgaaaaagtgcgccagacgtttgaaaactacgagatgaattcttttgaaatcctgatgtataagaaaaataggaccccagtgtggttctttgttaagatcgccccaatccgcaatgagcaggataaagtcgtcctgttcttatgcactttcagcgatatcacagcatttaagcagcccattgaagacgacagctgcaagggctggggaaagtttgcgaggctgacgcgcgccctgacctcttcaagaggcgtgttgcaacaactggcaccgagcgtccagaaaggcgaaaatgtgcataaacactcaagactggcagaagtactccagctgggatctgacatcctgccacagtacaagcaggaagcacctaagactcccccccacataattcttcactattgtgtgtttaagacaacctgggactggataatcttgatcttgaccttttatacggctatcctggtgccttataacgtctctttcaaaaccaggcaaaataacgtggcttggttagtggtggatagcattgtagacgtcatctttcttgtcgacatcgtgctgaattttcacaccacttttgttggacctgccggggaggtaatctccgatcccaaactgatccgcatgaactacctgaaaacctggtttgttattgatctgttgtcctgcctgccctatgacgtgattaacgcattcgagaatgtggacgagggcatcagttctcttttctctagcttgaaggtggttagacttttgcggctgggccgcgtcgccagaaaacttgaccattacattgagtatggcgcagccgtccttgttctgctggtctgtgtgttcgggctggcagcacattggatggcatgcatatggtacagcataggagattacgagattttcgatgaagacaccaaaacgatccgaaataacagctggctgtaccagctggctatggatatagggaccccttatcagtttaacggtagcggaagcggcaaatgggaaggcgggccctcaaagaatagcgtgtacatttctagtttgtactttaccatgacttcattaacatctgttggatttggaaatatagctccgtcaaccgacattgaaaagatcttcgcagtggcaatcatgatgatcgggagcttgctctacgcaaccattttcggcaacgtgaccactatctttcagcaaatgtatgccaacacgaatcgatatcatgaaatgctgaattctgtgcgcgacttcctcaaactctaccaagtgcctaaaggcctttcagaacgggtgatggattacattgtcagtacctggtccatgtcccgcggcatcgatacggaaaaggttttacagatatgtccaaaagacatgagggctgatatttgcgtgcacctgaataggaaggtgtttaaagaacatccagctttccggctggctagcgacgggtgccttcgtgctcttgccatggaatttcagacagtccactgcgcgccaggggatcttatctaccacgctggagagtccgttgattctctgtgcttcgttgtgtcggggagcttagaagtcatccaggatgacgaagtggtggcaatccttggtaagggggacgtgttcggggacgtattctggaaggaggctacgctggctcaaagctgtgccaacgtaagggcactgacctactgcgatttacacgtgatcaagcgtgatgccctgcagaaggtcctagaattctatacagctttctctcacagcttctctcggaatctgatcctgacctataacctgcgcaagaggatcgtttttaggaagatttccgacgtgaagcgcgaggaggaagaacggatgaagcgaaagaatgaagctcctcttatcctgccccccgaccatcctgtgcgtaggctgtttcaacgctttcgccaacagaaggaagcacggctggcagctgaacgtggtggcagagatttagacgacctagacgtagagaaaggcaacgttctgactgaacacgcctcagcaaatcactctttggttaaggcctctgtagtgacggtgagagagtcacctgccacaccggttagcttccaggctgcatccacaagcggcgtgccagatcacgcaaaattgcaggctccgggttccgagtgcttagggcctaaaggcggaggtggtgattgcgccaaacggaagagttgggcccggttcaaagacgcctgcgggaagtcagaggactggaataaagtgtcaaaggcggagagcatggagaccctgcctgaaaggaccaaagcgtccggcgaggcaaccctaaagaagacagattcttgtgattctggcatcaccaagagcgacttgagactcgacaacgtcggggaggcaaggagtcctcaggatagatctccaatactggcagaagttaagcacagcttttatcctatcccagagcagacgcttcaggcaactgtgctggaggtgcgacatgagctgaaagaagacatcaaggcccttaacgccaagatgacaaatatcgagaagcaactgagcgaaatcctgaggattcttacctctcggcggtccagccagagtccgcaggagctattcgaaatttccaggccccagtctcctgaaagtgagcgtgacatttttggggcgtcctag

SEQ ID NO: 200405 - DNA, 3480 bp, Artificial Sequence
  Description of Artificial Sequence: Synthetic coding sequence
atgcccgtgcggcggggccacgtggccccccagaacaccttcctggacacgattattcgaaaattcgaaggccagtccaggaagtttattattgccaacgccagagttgagaattgtgctgtcatctactgtaatgatggtttctgcgaactttgcgggtatagtagagccgaggtgatgcagcgaccatgcacgtgcgacttcctccacggaccccgcactcagcgccgagctgccgcacaaatcgctcaggcactcctgggggccgaggagagaaaggtggaaattgccttttataggaaagacggatcatgctttctctgtcttgtcgacgtggtgccagtgaaaaacgaggacggggctgtgatcatgtttattcttaactttgaagtggtcatggagaaggatatggtgggttcccctgcccacgacaccaaccatagaggtcctccgaccagttggctggcccctggccgcgcaaagactttcaggctgaagctgcccgcactgttagcactaaccgcacgagagtcatctgtgcggtccggaggagccggcggtgcaggagccccaggggcagtggtggtagacgtcgacctgacccctgcagcaccttcaagcgagtctctggctttggatgaggtcactgcaatggataatcacgtcgctggtttgggacctgcagaagaacggagggctctcgtgggccctggctctcccccccggtccgcccccggccagctcccttctcccagggcacactcactgaatccagatgcctctggatcatcctgttcgctggcgcgaacacgaagccgcgagtcttgcgcgtcagtgagaagggcctcatccgctgacgatatcgaagctatgcgggccggtgtgctccctcctcctcccaggcacgcatccacaggggctatgcatcctttgagatccggcttactcaattcaacatctgacagcgatttggttagataccggaccatttcaaagattccccaaatcaccctgaactttgtggatctgaaaggcgacccatttctggcatccccgacatctgatagggaaattatagcccccaaaatcaaggagcggacacacaatgtaacagagaaggttacgcaggtcctgagcctcggggccgatgtgctgcccgaatacaaactacaggcccctaggatccatcgatggactatcttgcattacagcccttttaaagccgtctgggactggctcatcctcctgcttgttatctacactgctgttttcacgccctattcagccgccttcttgctgaaagaaacagaggagggaccaccagcgaccgagtgtggttacgcatgtcagcctctcgccgtagttgaccttattgtagacatcatgtttattgttgatatactgataaacttccgtaccacctacgtgaacgccaacgaagaggtcgtgtcacaccccgggcgtatagcagttcactactttaagggttggtttttgattgacatggtggcggccattcccttcgatctattgatcttcggttcaggttctgaagagctcattgggctgcttaagacagcgcgactcctaaggctggttcgggttgctcgcaagctagaccgctactctgagtatggggcagccgtgctttttctgcttatgtgtacatttgcccttattgcccactggctggcatgtatctggtatgctattggtaatatggaacagccgcacatggattctagaataggctggctgcacaaccttggcgaccagattgggaaaccttataactcttctggcctcgggggaccgtctatcaaggacaaatacgtgaccgcactatacttcacattctcatcactgacctcagtgggcttcgggaatgtgtcccccaataccaacagcgagaaaatattctcgatctgtgtcatgttgataggctctcttatgtacgctagcatcttcggaaatgtgagtgcaataatccagaggctctatagtggcacagctagatatcacacacagatgctgagggtgcgagagttcatccgattccaccaaataccaaatcctttgcggcagagattggaggagtatttccaacatgcctggtcctacactaacggcattgacatgaatgcagtgctgaaaggattccccgaatgtttgcaggccgatatctgcctccatttgaatagatcattactccagcactgcaaaccttttcgtggggccacaaaaggatgcctgcgcgccctagctatgaagtttaagacgacacatgccccacctggggacaccctggtccacgctggggacctgctgacagcgctgtattttattagccggggcagcatagagattctcagaggggatgtagtggtggccatcctaggcaagaatgatatctttggggaaccgctgaacttgtatgctaggcctggcaagtccaacggagatgtaagggcattgacatactgtgatttgcacaaaatccatcgggatgatttactggaggttctggacatgtaccctgagttttccgaccatttctggagttcactagagattacatttaacttacgagatacgaacatgatccccggatcccccgggagtactgagctggaggggggattttctcgccagcgcaagaggaagctgtctttccgccgacgcaccgacaaggacacggagcagccaggagaggtgagcgccctaggccccgggcgcgctggagcagggccttctagccgaggtcggcccggaggcccttggggagagtcccctagctccggaccttcaagtcctgagtcaagcgaggatgaaggacccgggcgttccagctccccactgagactggtcccttttagctcaccacgcccccctggtgaaccaccaggcggggagcctctgatggaggattgcgaaaagtcctctgacacctgcaacccactttccggagccttttctggggtctctaacatcttcagtttctggggagactccaggggcaggcagtaccaggaactgccccgatgtcctgcccccaccccaagtctgctaaacatcccgctctccagcccagggagacggcccagaggggacgtagagtctagactggatgcccttcagagacaattgaaccgtctggagacccgcttgagcgctgatatggccacggtgctgcagctactgcagcgccagatgactctcgtgccaccagcatattctgccgtcaccactccggggcctggaccaacgagtacttccccactgcttccagtttctcctctgcctacgttgacattagactctctgtcccaggtgagccagttcatggcgtgcgaagagctaccccccggagcgccagaacttccacaggaagggcccacccgaagactgtcactccccggtcagctgggcgcactcacatcccagcccctgcaccgacacggcagtgatcctggtagctag

SEQ ID NO: 200406 - DNA, 2460 bp, Artificial Sequence
  Description of Artificial Sequence: Synthetic coding sequence
atggccgcccccgccggcaaggccagccggaccggcgccctgcggccccgcgcgcaaaagggccgggtgagaagagccgtgcggataagcagcctggtggcccaggaagtgttgtcattaggggctgacgttctaccagagtacaaattgcaggccccccgcattcacagatggacaatcttgcattactccccttttaaggccgtgtgggattggctcatccttctactcgttatatacaccgcagtttttacaccctattctgctgcattccttctgaaagagaccgaggagggcccccctgcgaccgagtgtgggtatgcctgtcaacccctggcggttgtcgatctcattgtcgatatcatgttcatcgttgatatccttatcaactttagaaccacttatgtcaacgccaacgaggaggtggtgtcccaccccggccggattgcagtgcactattttaaggggtggtttttgattgatatggttgccgcaattccctttgacctccttattttcggctctggctcagaagaattaataggactcctgaaaactgctaggcttcttcggttggtgagagttgccaggaagctggacagatactccgaatacggtgccgctgtactgttcctgcttatgtgtacattcgcacttattgcacattggctcgcatgtatatggtacgctatcggcaatatggaacagccacacatggatagtcgcatcggatggctacataacttgggagaccaaataggcaagccttataacagtagtggattgggcggccccagtatcaaggataagtacgttaccgccttatactttacatttagttcgcttacctcagtcgggttcgggaatgtctctccgaacacaaattctgagaagattttttctatttgcgtgatgctgattgggagcttaatgtatgcaagcatatttgggaacgtaagcgcaataatccagcgactgtacagtgggaccgccaggtaccacacccaaatgctgcgggtacgggagttcatcaggtttcatcagattccaaatccacttaggcagagattggaagagtatttccaacatgcttggagttatactaacggcatcgatatgaacgctgtgctgaagggctttccggaatgcctccaagccgacatatgccttcacctgaaccgctctctcctgcagcactgcaagccgttcagaggagcgacgaaagggtgtctccgtgccctggcgatgaagttcaaaacaacccacgccccccctggagacactttggtgcacgccggcgacctgctgactgcactgtatttcatcagcagagggagtatcgagatccttagaggagacgtggtcgtggccattcttgggaagaatgacatttttggtgaacccctcaacctttatgcccgaccggggaagagcaatggggacgtgagagccttaacatattgtgacctgcacaaaatacacagggacgatctgttagaggtcttggacatgtaccctgaattttccgaccatttctggtcttctttagagataacttttaatctgcgagataccaacatgatccctgggagccctggaagcaccgaacttgagggcggattcagccgtcagagaaagcgaaaactgtcctttcggaggcgcaccgataaggacaccgagcaaccaggagaagtttccgccctgggcccgggccgcgcaggtgcagggccttcaagccgcggacgacccggcgggccatggggggagtcacccagtagcggaccttccagtccagaaagctcggaggatgagggtcctggaaggagctctagcccactgaggctggtccctttctcctccccccggccccccggagaacccccgggaggagaaccactgatggaagactgcgaaaaaagtagcgatacatgtaatcctctgtctggggcctttagtggggtttccaatatcttcagtttctggggtgactctcgaggccggcaatatcaggagcttccgcgatgccccgcgcctaccccgtccctgttgaacatccctcttagcagtcctggaaggagacccaggggcgacgtggagtcacggctggatgcgcttcagcggcagctgaataggctggagacgaggctgtccgccgacatggctactgtgttacagttattacagcgccagatgacactggtcccacccgcttactcggccgtgacaacccccgggcctggccccacgtctacgtcccccctgttgcccgtgtcccctctgccaactctaaccctggattcgctcagccaagtgtcccagttcatggcctgtgaagaactaccccccggcgcccccgagctccctcaggaaggccctactaggagactgagcctgcctggtcagctcggcgcgctgacgagtcagccattgcatcggcacgggtcggatccagggtcatag

SEQ ID NO: 200407 - DNA, 1182 bp, Artificial Sequence
  Description of Artificial Sequence: Synthetic coding sequence
atggccgcccccgccggcaaggccagccggaccggcgccctgcggcctcgagcgcaaaagggtagggtccgccgtgctgtgcgcataagctcgctcgtggcccaggaagttctgagtctgggagctgatgtgttacctgaatataaactacaagcaccaagaatccacagatggaccatcttgcattatagtccatttaaggctgtctgggactggctgatacttctgctggtgatatatacagcggtgtttactccttacagcgcagcgtttctgctgaaggagactgaggagggaccgcccgccacagaatgtggttacgcctgccagcccctcgctgtcgtggacctgattgtagatatcatgtttattgtggatatcctgatcaattttagaacaacttacgtcaacgctaatgaagaagtggtgagtcacccaggcagaatcgctgtgcattactttaaaggctggtttctcattgacatggtggccgctatcccattcgatctgctcatttttggctcaggatccgaggagctcattggccttttgaagactgcacgccttctgcgtttagtgcgcgtggcccggaagttagaccgctatagtgagtatggcgccgccgtcctctttttactgatgtgtaccttcgccctgatcgcgcattggctggcatgtatttggtacgctataggcaatatggagcaaccacatatggattcaagaataggctggctccataacctgggcgatcagataggcaagccttacaacagctctggcttgggagggccctctattaaggataaatatgttaccgctctgtattttacattctcgtccttaacatccgtgggcttcggtaacgtttctcctaacaccaacagcgaaaagatttttagcatctgcgttatgctcattggctctctgatgtatgcctctattttcgggaacgtgtcagctataatccagcggttatacagtggtactgcccgctatcacacccagatgctaagggtcagagagttcatcaggttccaccaaatcccaaatcctctgagacagtgttgtgatcatcccggagcgtggcctcactttcatatccccgctgtcgctaggcagcctcctcctcacccccatctgggcctagcctttagcgggttccccgtccacggcgtctag

SEQ ID NO: 200408 - DNA, 3192 bp, Artificial Sequence
  Description of Artificial Sequence: Synthetic coding sequence
atgagcagccacagcgccggcagctgcttcctgtgcctggtggacgtcgtaccggttaagaacgaggacggtgcagtgatcatgttcatcctgaattttgaggtggttatggagaaagacatggtggggtccccggcacatgacactaaccaccggggacctcctacctcgtggctcgccccaggacgcgcaaagacttttagactgaaactgccagccctgttggccctgaccgctcgagagtcttccgtgcgatcaggcggggccggcggcgccggggctcctggtgctgtcgtggtggatgttgacttgacccccgccgcgccttcctcagagtccctcgctctagacgaagtgaccgctatggacaaccacgttgctggcctaggacccgctgaggaaagaagggccctcgtgggtccaggatctcctccaagaagcgcacccggacagctccctagcccccgagcacactcactcaacccagatgcaagtggctctagttgtagtctggctcggactcgctcaagggaatcgtgtgcctctgtaaggagggcgagcagcgccgacgatatagaggcgatgcgcgctggcgtgctcccccccccacctcgtcacgccagcacgggcgcgatgcaccccctacgtagcgggctgctcaattctacctccgacagcgacctagttaggtatagaaccatctccaagattccccagataacccttaactttgtggacctgaagggcgaccctttcctggcctcaccaacatcggacagagagattattgcccctaagattaaggaaaggacacacaatgtcactgaaaaggtcacccaagttctctctctgggtgccgacgtgctcccagagtacaagctccaggcgccccgaattcataggtggaccatcttacactacagtccctttaaggcagtctgggattggctgattctgttactggtgatatacacagcggtgttcaccccgtactctgcagcgttcctgctgaaggagacggaggagggtcctcccgcgactgagtgtggatacgcgtgtcagccactggcagttgttgacttgatagttgacatcatgttcatcgtggacattttgatcaattttaggactacatacgtgaacgccaatgaggaagtcgtgtctcatcccgggcgcattgcagtgcactactttaagggctggttcctcattgatatggtggctgcgatccccttcgacctcctgatttttggctccggttccgaggaattgataggactactaaagaccgcaagactgttgcgactggttcgagtggcaaggaagttggacagatactccgagtacggagccgccgtcttgttcttgctgatgtgcaccttcgccctgatcgcccattggcttgcttgtatatggtatgccattggtaacatggagcaaccccacatggactcccggattgggtggctgcataacctcggtgaccaaattggtaagccctacaacagctcgggtttgggaggaccgtctatcaaggacaaatatgtcaccgctctgtatttcacttttagctctttgacatctgtcggcttcgggaacgtgtctccaaataccaattctgaaaaaatcttctcaatttgtgtgatgctgataggctccctcatgtacgcctcaattttcggaaacgtgtctgccattatacagcgcctctactctggaacagcccgttaccatacacagatgcttagagtgagagagtttatccggtttcatcaaatcccgaatccgctcaggcagaggttggaggagtactttcagcacgcctggagttatacgaacggaatcgatatgaatgctgtgctaaagggcttcccggaatgcctgcaggccgacatctgcctacacctgaatcgttctctgttgcagcactgcaaaccatttcgcggcgcaacgaaggggtgccttagagccttggccatgaaattcaagacaacacacgcccctcccggggacaccctcgttcatgcaggagatcttcttactgcgttgtacttcatatctcgggggagcatagaaatcttacgcggcgacgttgtggtcgcaattttaggaaaaaacgacatcttcggcgagcctctgaatttgtacgcaagacccggaaagtccaatggcgacgtgagagctctgacctactgtgacctgcacaaaatccaccgagatgaccttttggaggtattggacatgtaccccgaattctccgatcatttttggagttctctagagattacctttaacctccgcgacaccaacatgataccgggctctccaggctcaaccgaactggaaggtggctttagccgacagcgcaagcgcaaattatcatttcgaaggcgaacagacaaggatactgaacaacccggcgaggtctctgctctcggtcccggaagggctggggctggaccctcaagccgcggacggcctggcgggccttggggggagagcccaagctctggtccatcctcacctgagtcttctgaggatgagggacctggtcgctcttccagccctctccgtctggtcccgtttagttctcccagaccaccaggagaaccacctggaggagaaccgttgatggaggattgtgagaagtccagcgacacatgtaatccgctcagtggcgcctttagcggcgtctccaatattttcagcttttggggagatagtcgtggcaggcagtatcaggagctaccgagatgtcccgctcccacgccctctttgctaaacattccactgtcgtctcctggcaggagaccgagaggcgacgtggagagtaggctcgacgccttgcagcggcagttaaatcgcctcgagaccaggcttagtgcggatatggccactgtgctccagctgttgcagcgacaaatgactttggtgcctcccgcatatagcgcggtgaccacccccggacccggaccgactagcacctcaccccttctgcctgtctcgccgcttccaacactcactctggactctcttagtcaggttagtcagttcatggcgtgtgaggagctgcctcctggggctcccgaactaccacaagaaggtcccaccagacgactctccctgccaggtcagttgggggccttgacttcccagccattgcatcggcacgggtctgatccagggagctag

SEQ ID NO: 200409 - DNA, 2667 bp, Artificial Sequence
  Description of Artificial Sequence: Synthetic coding sequence
atgcccgtgcggcggggccacgtggccccccagaacaccttcctggacacgatcattcgcaaattcgaaggacagtcacgaaagttcattatcgcgaacgccagggttgaaaactgcgcggtcatctactgtaacgacggattttgtgagttatgcgggtattcaagagccgaagtcatgcagcggccttgcacttgtgactttctccacggacctcgcacccaacgaagagccgccgcccagatcgcccaggcactccttggcgcggaagagaggaaggttgagattgctttctaccggaaggatggttcctgctttctgtgtctggttgacgtggtacccgtgaaaaacgaagatggtgcagttatcatgttcatcctgaatttcgaagtggtcatggaaaaggacatggtgggcagtcccgcacacgataccaatcatagagggcccccaacatcttggctcgccccagggcgggccaagacattccggttaaagttacccgccctgttagctctgaccgcgcgcgaatcgtcagttaggtctggcggtgccgggggggcgggggcccccggagctgtcgtcgtggacgttgacctgacgccagccgccccgagcagtgagtccctggccctggacgaagtgactgctatggacaatcacgttgctggcctcgggcctgccgaagaacgacgggcactggtcggcccaggcagtccgccccggtccgcacctggacagctgccttcccccagggctcattcactcaacccggacgcctctggatcaagctgttcattggctcgcacaaggagtagggagagttgcgcttccgttaggcgagcatcttccgccgatgacatagaggcaatgcgggcaggagtgctccctcctccaccacggcacgcgagcacgggtgccatgcaccccctgagatcgggactcttgaactcgacctcagacagcgacctggtgcggtaccgaacaatatcaaaaatacctcaaatcacattgaattttgtggacttgaagggagaccccttcctcgcttcccccacctccgacagagagatcatcgccccaaagataaaggagcggacacataacgtcaccgaaaaggtgacacaggtcctaagcttaggggccgatgtgctgcctgaatataagctgcaggcacccagaatacatcgctggacaatcttacactactctcctttcaaagccgtctgggattggcttatcttattactggttatctacacagcagtgttcacaccctacagtgccgccttcctgcttaaagagacagaggagggaccgcctgcaactgaatgtgggtatgcatgtcagccccttgcagtcgtggacctgatcgtggacatcatgttcattgtcgacattcttatcaatttccgcacgacttacgtcaatgccaatgaggaggtggtttcccatcccgggcggattgctgttcactacttcaagggctggttccttattgatatggttgccgccatcccgttcgacctactgatcttcggcagtggctcagaggagctgataggcctgctcaagacagcgcggctcctccgcctggtacgcgttgctcgaaagctggataggtacagcgaatacggcgcagcagttttgttcctcctgatgtgtacatttgcactcattgctcactggctggcttgtatctggtatgctattggtaacatggagcagcctcatatggattctaggatcgggtggcttcacaacttgggcgatcagattggcaagccctataactcatcaggcctgggaggacctagcatcaaggataaatacgtgactgccctgtactttaccttcagctcactgacctcagtgggatttggcaacgttagccccaataccaatagcgaaaagattttttccatctgcgttatgctgatcggctcattgatgtacgcatcaatcttcggcaacgtttctgccattatccagcgactgtacagcggtacggctaggtaccacacccagatgctacgggtccgggaattcatacgctttcatcagattcccaatccgctgcgtcaaagacttgaggagtacttccagcacgcatggtcctacactaacggaatagatatgaatgctgttctgaaggggttccccgaatgcctacaggctgatatttgcctccacctgaaccgcagcttgctgcagcattgtaagccattccgcggagctacaaaaggatgtttgcgggctctggccatgaaattcaagacaactcatgcaccgcctggggatacactggtacacgccggagacttgcttaccgccctatatttcatttcgcgcgggtctatagaaattcttcgcggggatgtagtggttgctattctcggcatgggctggggcgctggcaccggtttggaaatgccctctgcggcctctcggggagcctccctgctgaatatgcagtctctgggcctatggacttgggattgtcttcagggccactgggcacctctgatccacctgaactccgggcctccatctggcgccatggagaggagtccaacctggggcgaggccgcagagctttgggggagccacattctgctaccatttcgtatcaggcataaacagaccctcttcgccagtctgaagtag

SEQ ID NO: 200410 - DNA, 3252 bp, Artificial Sequence
  Description of Artificial Sequence: Synthetic coding sequence
atgcccgccatgcggggcctgctggccccccagaacaccttcctggataccatagcaactagattcgacggaacccactccaattttgtgttaggcaatgcacaggtggccgggcttttccccgtggtctattgcagcgatggcttctgtgacctcactggcttctcccgggccgaggtgatgcaacgtggctgcgcatgctcatttctctacggccccgacacctctgagctggtgaggcaacagataaggaaagccttagacgagcataaggaatttaaggccgaactgatcctatataggaagtccggcttaccattctggtgcctgctggacgtgattcctataaagaacgaaaagggggaggttgctctcttcctcgtgtctcataaggacatctccgaaacgaaaaatcgcggtggtcctgatcgctggaaggagacaggtggaggtcggcggcgctatggacgagctcgatccaagggatttaacgctaatcgtagacgctcacgcgccgtgttgtaccatctgtcagggcatctgcaaaaacagcctaaggggaagcacaaacttaataaaggggtttttggagaaaaacccaaccttcctgagtacaaagtcgcggcaatacggaagagtccatttatccttctgcattgcggcgccctccgtgcaacctgggacggctttattctactggcaacactttacgttgcagtcactgttccttacagtgtgtgcgtcagcacggctcgggaaccatcagctgcccgaggacctcctagtgtgtgtgacctggcagtggaggtactgttcatcctcgatatcgtcctgaacttcaggacaaccttcgtgagcaaaagtggtcaggttgtctttgcccccaagtccatctgcctgcactacgtcaccacctggtttttgctggacgtgattgcggcgctgccctttgaccttttgcacgcatttaaggtcaacgtctactttggtgcccaccttctcaagactgtgaggctcctgcgactgctgcgacttctgccaaggctggatagatattcccagtacagcgctgttgtacttacgttgctcatggccgtattcgccttgctggcccactgggtggcctgtgtgtggttttacatcggtcagcgggagatcgaaagttcagagtcagagttgccggaaatcggctggctgcaagagcttgcgcgccgcttggagaccccatactacctcgtcggtagacggcccgccggggggaactcctctgggcaaagcgataattgttctagctccagcgaggctaacggcaccgggctggagctcctgggtggcccaagtttgcgctctgcatatattacaagcttgtatttcgcactgtctagcctcacctcagtcggctttggtaacgtgtctgctaataccgacactgagaaaattttcagcatctgtaccatgctaatcggggccctgatgcacgctgtcgtgttcggcaatgttaccgccatcattcagcgcatgtacgcacgaagattcctgtaccactcccggacacgtgacctgcgcgattatatccgcatacataggatcccgaagccgctgaagcagcgcatgcttgaatactttcaggccacatgggctgtcaacaatgggattgataccacagagctgctgcaaagcctacctgacgaactgcgggccgacattgccatgcatctacataaggaagtgctgcagctgccactcttcgaagccgcctcaagagggtgccttcgcgcactttctctggccctgaggccagccttttgtactccgggcgagtaccttatccatcaaggcgacgcccttcaggctctgtactttgtgtgttcaggcagtatggaggttctgaaaggcggcacggtgctggctatccttggcaaaggagatcttatcggatgtgaactgccacgccgtgaacaggtagttaaagccaacgcagacgtcaagggactcacatactgcgttctgcagtgtctgcagttagctggcctccatgacagccttgccctctatcctgaatttgctcccaggtttagtaggggcctgaggggggagttgtcatataatctgggggcaggcgggggcagtgccgaggtggacacttccagcttgtccggagacaatacactgatgtccaccttagaggaaaaagaaactgacggcgagcaaggccccacagttagccctgctccagctgatgaaccatcttcgcccctcctgtcgccaggatgtacgtcaagttctagcgccgcgaagctgctttccccacggcgcacagccccacggcctcggctgggcggtcgtggcagacccggacgtgcaggtgcactcaaggcggaggcaggaccctctgctccaccaagggcactcgaagggctgagattgccccccatgccttggaatgtgcctcctgacctgtcccctagagtggtggacggtatagaggatgggtgtggaagcgatcagccaaaattctcttttagggtaggccaatccggccctgagtgctcttcctcgccctccccaggaccggagtcgggactgttaacagtacctcacggcccatccgaggccaggaatacggatacactggataagctccgccaggcagttaccgaactgtctgaacaagtactccagatgagagaggggctgcagtccctaaggcaggcggtacagctggttctggcaccccatcgggagggcccgtgcccacgtgcctcaggtgaaggaccctgtcccgcttctaccagcggcttattgcagcctctgtgcgtggacacaggggcgagttcttattgtcttcaacccccggcagggtccgtcctgagcggaacctggccccacccaaggcccggccccccacccctaatggctccctggccatggggtccaccagcctctcagagcagtccctggccgcgagctaccgctttctggacctccacaagtgactcagagcccccagcttccggggacttatgtagcgaaccgtcaacaccagcttcccctcccccttccgaagagggggctcggacggggccggctgagccggtgtctcaggcggaggctacttcgacaggggagccaccccccggctctggcggtctggccttaccttgggatcctcattctctcgaaatggtacttattgggtgccatggatccgggacagtgcagtggactcaggaggaaggcacaggcgtgtag

SEQ ID NO: 200411 - DNA, 2967 bp, Artificial Sequence
  Description of Artificial Sequence: Synthetic coding sequence
atgcccggcggcaagcggggcctggtggccccccagaacaccttcctcgagaacattgtgcgtcgttccagcgaaagtagttttctactcgggaatgcacagatcgtagactggccagtcgtgtactcaaacgacggattttgcaagctttctggttatcatcgggctgatgtcatgcagaagtcaagtacatgctcattcatgtacggcgaactgactgataaaaagactatagagaaggtgagacagaccttcgacaactatgagtctaactgcttcgaggtacttctgtataagaagaatagaacccccgtgtggttttacatgcagatcgctcccatccggaacgagcacgaaaaagttgttctcttcctgtgcacatttaaggatatcacgcttttcaaacagcccatcgaagacgactcaacgaagggctggactaagtttgctaggctgacaagggccctcactaattctcgctctgtcctgcagcagttaactcccatgaataagaccgaagtagttcataaacacagccgcctggccgaggtgttacaattagggtcagatattctgccacagtataagcaagaggcccccaagactccgcctcacattatcttgcactactgtgccttcaagacaacttgggactgggtaattcttattttaactttctataccgccattatggtaccatataacgtctcgtttaagaccaaacaaaataacatcgcctggctggtgctggacagtgttgtcgatgtgattttccttgtggatatcgtactgaatttccatactacttttgtcggcccaggcggagaggtgatcagcgaccctaaactgattaggatgaactacctgaaaacctggttcgtcatagatttattgtcctgccttccttacgacatcattaatgcctttgagaatgtcgacgagggaatctcctcattgttcagctcactgaaagtcgtgcgactgttgcggctaggcagagtcgctcggaagttggatcattatctggaatatggggccgccgttttggttctgttagtgtgcgtctttggcctcgttgcccactggttggcttgcatctggtattccatcggcgattatgaggtgatcgacgaagtaaccaataccattcagatcgacagctggctgtatcagctggccctgtcaatcgggaccccttaccgctacaatactagcgccggcatatgggagggcggaccaagcaaagatagcctctacgtctcaagtctctatttcacaatgacctcattgactactattggattcgggaacattgcacctaccacggatgtggagaagatgtttagcgtggctatgatgatggtgggaagcctgctctacgccaccatcttcggtaacgtgacgacaatctttcagcagatgtacgcgaacacaaaccgataccatgagatgcttaacaatgttagagattttctgaagctgtatcaagtgcccaaggggcttagtgagcgagttatggactacatcgtatccacctggtccatgtcaaagggcattgatacagaaaaggtcctgagcatttgtccaaaagatatgagagccgatatctgcgttcatctgaacaggaaagttttcaatgagcatcccgcgtttaggctggcctccgatggctgcctgcgcgctctcgctgtcgagtttcagaccattcactgtgccccgggcgatctgatctatcacgccggggaatctgtcgacgccctttgctttgtggtcagtggatccctagaggtcattcaagacgatgaggtggtcgcaatccttggaaaaggtgacgtgttcggggacatcttttggaaggaaactacactggctcatgcctgcgctaacgtgagggctcttacctattgtgacctgcacattataaagagagaggcactgctgaaagtgctggacttctataccgcctttgccaacagtttcagccgcaacctgacgctgacctgcaatcttcgaaagaggatcatcttcagaaagatttctgacgtaaagaaagaggaggaagaaagactgaggcagaagaatgaagtgaccctgtccataccggtggatcacccagtccgaaagctattccaaaaattcaaacagcagaaggaattgcgtaaccaagggagcacccagggtgacccagaacggaaccagctccaagtggaatcgcgctctctccagaacggcgctagtataaccggtaccagtgtcgtgacagtgtcacagattacgcccatacagaccagcttggcatatgtgaaaacatcggaaagcctgaagcaaaacaacagggatgccatggagttgaagcctaatggcggtgccgaccaaaagtgtctgaaggtaaattcaccaattcgaatgaagaatggtaacggcaaagggtggctgcggctaaagaataatatgggcgcccacgaggagaagaaagaggactggaataatgtgaccaaagccgagagcatgggactgctgagcgaagacccgaagtcctcagactcagagaatagtgtgacaaaaaatccgttgcgcaaaaccgacagctgtgattctgggattacaaaatccgacttgcggctcgataaagcaggagaggcgaggtccccacttgaacattccccgattcaggctgatgcgaagcacccgttttatcccatacccgaacaagctttgcaaacaacattgcaggaggtcaagcatgagttgaaagaggatatccagctgctttcctgccggatgacagcattagagaagcaggtagccgaaatcctaaaaatactcagtgaaaagagtgtgcctcaagcctccagccctaaatctcagatgcctctgcaagttcccccccagatcccttgtcaggacattttttcagtgtcccggcccgaatctcccgaaagcgataaagacgagatccacttctag

SEQ ID NO: 200412 - DNA, 1269 bp, Artificial Sequence
  Description of Artificial Sequence: Synthetic coding sequence
atgcagaagagcagcacctgcagcttcatgtacggcgagctgaccgataaaaagacaattgagaaggttagacagacctttgataactacgaatccaactgctttgaggttctgctatacaagaagaataggacaccagtctggttttatatgcagattgcgcccatccgaaacgaacacgagaaggttgtcctctttctctgcacttttaaggacatcactctctttaaacagccaatcgaagatgactctaccaagggttggacaaaattcgcccggctcactcgagcgctgacaaactcccggtctgtgctgcagcagctgaccccaatgaataaaacagaggtcgtgcacaagcacagtcgactcgcagaggtccttcaattgggctcagatattctgcctcagtacaagcaggaagccccaaagacccctccacacattatacttcattactgtgctttcaaaacgacatgggattgggtcatactcatcctaaccttctacaccgccatcatggttccttataacgtctcttttaaaacgaagcagaataacatcgcttggctggtcttggacagcgtggtcgacgtgattttcctggtggacattgtgctcaattttcataccaccttcgtgggaccaggcggcgaagtcatcagcgatcccaagctaattagaatgaactacctgaaaacctggtttgtcatcgacctgctttcctgcttgccttatgatatcattaatgcattcgaaaatgtggatgaggggatctcttctttgttcagctcacttaaagtcgtgcggctgctcaggctgggccgtgtggcaaggaaactcgaccactatctggagtatggagccgcagttctcgtgctcctggtctgtgtgttcggccttgtggcccattggttagcctgcatttggtattcaatcggggactacgaggtgattgacgaagttacaaatactatccagatcgactcctggctctaccagttggccctgtcaataggaactccataccgctataataccagcgcagggatctgggagggcgggccctcgaaggatagtctgtacgtcagctccttgtatttcaccatgacttctttaacaactatcgggtttggaaacatcgcacctaccaccgatgtggagaagatgtttagcgtagccatgatgatggtcggctgcaagtatttcaacttttttatagaaaactattgctactggcagttttcctggctgcagagtcagatagggtag

SEQ ID NO: 200413 - DNA, 2199 bp, Artificial Sequence
  Description of Artificial Sequence: Synthetic coding sequence
atgcccgtgcggcggggccacgtggccccccagaacaccttcctgggtactatcattagaaagtttgaggggcagaataaaaagttcatcatcgcaaacgcccgggttcagaactgtgcgatcatttactgcaatgacggattttgcgaaatgacggggttttcacgtccagatgttatgcagaagccctgcacatgcgactttcttcacgggcccgagacaaaacggcacgacatcgcacagatcgcacaggccctgttgggctccgaggagcgtaaagtggaggtgacctactatcataagaatggttcgacgttcatatgcaatacacatatcatcccggtcaaaaatcaagagggggtggcaatgatgtttatcattaattttgagtacgtgaccgataatgaaaacgccgctacccccgagcgagtaaaccccattttgcctataaagacagttaacagaaaattttttgggttcaagttccccgggttgagagtcctgacataccgcaagcagtcgctaccacaagaagatccagatgtagttgtcattgacagcagcaagcactccgacgacagtgtggcaatgaagcactttaaatctcccactaaggagtcttgcagtccgtctgaggctgacgacactaaggccctgatccagccttcaaaatgtagccccctggtgaacatctctggaccactcgaccactcttcgcccaaaagacagtgggataggctttaccctgatatgctccagagttcctcccaactgtctcatagtaggtctagagaaagtttatgtagcattcgacgcgcctcttccgtgcacgacattgaaggctttggggtgcacccgaaaaatatcttcagagacaggcacgccagcgagggtcccttcaatcacatcaagtcctcactcctcggctcaactagtgacagcaatttaaataagtattctactatcaataaaattccacagcttactcttaatttttcagaggtaaagaccgagaagaagaactcgagtcccccaagttccgataagactatcatcgctcctaaagtgaaggatcgcacccacaatgttaccgagaaagttacgcaagtgcttagtctgggtgctgacgtgctgcctgagtacaagctgcagacccctcgtattaacaagttcacaatccttcactacagtcccttcaaggcagtatgggattggttgatcctgctcctggtcatatataccgccatatttactccgtatagcgccgcgtttctgctgaatgaccgcgaagaacaaaagcgccgtgagtgcggatattcttgtagtccactgaacgtcgtcgacttgattgtggatatcatgtttatcatagatatcctaataaacttcaggacaacctacgtcaaccaaaatgaagaggtggtaagtgaccctgcaaaaatcgcaatccattatttcaaaggctggtttctgatcgacatggtagctgccattccattcgaccttctaatctttggatcgggaagcgacgaaaccaccacccttatcgggcttctcaagactgccaggctcctccgcctggtcagagtggcccgcaagttagaccgatacagcgagtacggtgcagcagtactgatgcttctgatgtgtatctttgccctcatagcccactggttggcttgtatttggtatgccatcgggaatgtcgaaaggccctacctgaccgataagatcggatggctcgattctttaggacagcagattggtaagcggtataacgatagcgactcgtcttcagggccgtccatcaaggacaaatacgtgaccgccctgtattttaccttcagttctctaacgtcagtggggttcggcaacgtgagccctaacacaaactcagagaagatcttctccatctgcgtgatgctgatcggcagcctgatgtacgcatccatcttcggaaatgtgtcggccatcatacagcgcctgtactcaggcactgcgcgctaccacatgcagatgttgcgcgtaaaggagttcatcaggttccaccagatacccaatcctctgcgtcagagactggaagaatacttccagcacgcttggacctacacaaacgggattgatatgaatatggtatgcatgtctgtctttcagaacgaatcagccgccgggataattgtcatcgctaaaatggaatag

SEQ ID NO: 200414 - DNA, 3591 bp, Artificial Sequence
  Description of Artificial Sequence: Synthetic coding sequence
atgcccgtgcggcggggccacgtggccccccagaacaccttcctgggcacaatcatccgcaaattcgaaggccagaacaagaagttcatcatcgcaaatgctagggtgcagaactgcgcaatcatctattgcaacgatggcttttgtgaaatgactggattcagcagacctgacgttatgcaaaagccttgcacctgcgattttctccacggccccgaaactaaacgtcacgacatcgcccaaattgcccaggctcttttaggtagtgaggagcgcaaggtggaagtgacctactatcacaagaatggcagcacatttatttgtaacactcacataatccccgtgaaaaatcaagaaggggtggctatgatgtttatcattaacttcgagtacgtcacggataacgaaaatgccgctaccccagaacgtgtaaaccctatactgccaattaaaacagtaaaccgcaaattctttgggttcaagtttcctggcctccgggtgcttacataccgcaaacagagtcttccacaggaggacccagatgtagtggttatcgactcgtccaagcattcagatgattctgttgcaatgaaacacttcaagtctcctacaaaggaatcatgctcgccctctgaggcagacgacactaaagctctgatacagccctccaagtgtagcccactcgtcaatatttctgggcctctggaccatagttctcccaagaggcagtgggatcggctgtacccagacatgctgcagtctagtagccaattgagccactccaggtccagagagtctctgtgcagtatcagaagagcctctagtgtacatgacatagagggcttcggggtccaccctaagaatatcttcagagacagacatgcttctgaagacaatggtcggaacgtcaaaggaccttttaaccatataaaatcttccctcctcggctccacctccgatagcaatctgaacaaatacagcaccattaacaagatcccacaactcacgctcaacttttccgaagtcaagacagaaaagaagaattcatcccctccaagctctgataaaacaatcatcgcacccaaggtcaaagacaggacccataacgtcaccgagaaagttacacaggtgctctccctcggcgcagacgtgcttcccgaatacaagctgcagactccgaggataaataagtttacaatcctccattatagtcccttcaaggccgtctgggattggctgattttgttactggtgatatataccgctatctttaccccttattccgccgcttttctattgaacgatcgagaggaacagaagcggagggaatgtggctactcatgtagccctcttaacgtggtcgatctgatcgtggacataatgttcattatagacatacttattaacttcagaaccacctacgtgaatcagaacgaggaagttgtcagcgatcctgctaagattgccattcactattttaagggttggtttctcattgacatggtcgcagcaattccatttgatctcctgatttttggctccggatcagacgagacgaccactttaatagggttgctcaagacggcccggttactgagactggtgagggtggcaaggaaactagataggtacagtgagtacggtgccgctgtgctcatgttgcttatgtgtatttttgcgctcattgcacactggttagcctgtatatggtatgcaataggaaacgtggagagaccctaccttactgataagataggatggctggactcactggggcagcagatagggaagcgttataatgatagtgactcatcgagtggcccaagtataaaggacaaatacgtgacagctttatatttcaccttttctagcttgacatcagtaggatttggaaacgtttcacccaacacaaacagcgagaagatcttttctatttgtgtaatgttaatagggtctctgatgtacgcgagcatctttgggaacgtctcggccattatccagcggctgtattctggaactgctagatatcatatgcagatgcttcgggttaaggagttcatcagattccatcagatccctaacccgctgcggcagagactggaggaatacttccagcacgcctggacatatacaaacggaatcgatatgaatatggtgctgaagggattccccgagtgcttgcaggcggacatttgcctgcacctcaatcagacactgctgcagaattgcaaagccttccgaggcgcctcaaaggggtgtctgcgcgcccttgccatgaagtttaagaccacacatgcaccccccggggacacactcgtacattgtggtgatgtgctcacagcattgtacttcttatctcgaggcagtatcgagatcctgaaagatgacatcgtggtggctatcctgggcaagaacgacatattcggcgagatggtacatttatacgccaaaccagggaagtccaacgccgacgtgagggctctcacgtactgcgatctccataaaatccagagagaggacctgctggaggtcctagacatgtatccagagttttccgaccactttcttacaaacttggagctgacctttaacctgcgacacgagtcagccaaggccgaccttttgcggagtcagagcatgaatgacagcgagggggataattgcaagcttaggcggcgcaagctgagcttcgaatccgagggggaaaaagaaaactccacaaacgatcctgaagatagcgctgataccatccgccattaccagtccagtaaacggcactttgaggagaagaagtccagatctagtagttttatcagttcaatcgatgatgagcaaaagccactctttagtggcatcgtggatagctctcctgggataggcaaagcatccgggctcgatttcgaggaaacagtccccaccagcggccgcatgcacatcgacaaaagatctcattcctgcaaagatattaccgatatgagaagctgggagcgggaaaatgcccatccacagcctgaagacagctcgccatcagcactccagagagctgcttggggaatatcggagacagagtcagacctaacctacggggaagtggaacagcgtctggacctgctgcaggagcagctgaatcgccttgaaagccagatgaccactgatattcagaccattcttcagctgttgcaaaaacaaaccaccgtggtgcccccggcctacagtatggtgaccgcagggtctgagtatcagcgcccgataattcagctgatgagaacctcacaacctgaggcttcaataaagacagatcgatccttttccccttcaagtcaatgtccagagttcctcgatctcgaaaagtccaagttaaagtctaaagagagcctcagctcaggtgtgcatctgaacactgcgtccgaggacaatctgacctctctcctcaaacaggatagcgacctctcactggagctccaccttcgacagcgtaaaacatatgttcatcccataaggcatccaagcttaccagactcaagtctctcaactgtgggcattgttgggcttcaccgccacgttagcgatccagggctgcctggcaagtag

SEQ ID NO: 200415 - DNA, 1755 bp, Artificial Sequence
  Description of Artificial Sequence: Synthetic coding sequence
atggtggccgaggtgtgcagcatgcccaccgccagcaccgtgaagaagccattcgatctgaggtcaaaaatgggaaagtggtgccaccaccgcttcccatgctgtagaggaagcggaaagagtaacatgggcacttctggcgatcatgatgatagctttatgaagatgttgcgctctaaaatgggcaaatgctgccggcactgcttcccatgctgtcgcggcagcggtacatcgaatgttggtacatccggagatcacgagaattcgttcatgaagatgctgcgcagcaaaatgggtaaatggtgctgtcattgctttccttgctgccgcgggagcgggaagtctaatgtgggtgcgtggggcgactacgatcactcggcttttatggagccacggtaccacatcagacgggaagacctggataaactgcacagagctgcgtggtgggggaaagtccctaggaaggacttaatagtaatgctccgtgacaccgatatgaacaagcgcgacaaggagaagagaactgcccttcacctggcctccgccaacggaaactccgaagtggttcagctgcttctggatagacgttgccagctcaacgttctcgataacaagaagcggaccgcgctgattaaagcgattcaatgccaagaagatgaatgtgtgttgatgcttctggagcacggagctgaccgcaatatccccgatgaatatgggaacacggctctgcattacgcgatttacaacgaggacaagctgatggcaaaggcattgcttctgtatggcgccgacatagaaagcaagaacaagtgcggtttaacgccacttttgctaggcgtgcacgagcagaaacagcaggtggtaaagtttctcatcaagaagaaggcaaatctgaatgtcctggataggtacggacgtacagcactgattctggccgtgtgctgcggcagtgcctccatcgtgaatctgttgttagagcagaatgtggacgtgtcctcccaggacctgagcgggcagactgcccgcgaatacgctgtttcctctcatcaccatgtgatctgtgagttgctttctgactataaagaaaaacagatgcttaagatctcatccgaaaatagcaatccagagcaggacctaaaattaacctcagaggaagagagccagcgccttaaagtgtccgaaaattctcaacctgaaaagatgagccaggaacccgagattaacaaagattgcgaccgagaagtcgaagaggaaatcaagaaacacggatcaaaccccgtggggctgcccgagaacctgacaaatggtgcttctgcagggaacggcgacgatggcttaatcccgcagcgccggtccagaaagcccgaaaaccaacagttcccagataccgagaacgaagagtaccattcagacgaacagaacgatacccgcaagcagctgtcagaggaacagaacacgggaatctcacaagacgagatcctcaccaacaagcagaaacagatcgaagtcgctgaacaaaagatgaattcagaactgtccctcagtcataagaaggaggaggacctcctaagagagaatagtgtgctccaggaggaaatagcaatgttaagattggagctggacgagacaaaacatcagaatcagttgagggagaacaaaattctcgaggagatagagtcagtgaaagaaaaaaccgacaaactgttgcgcgcaatgcagctcaacgaggaggcactgacaaagacgaatatttag

SEQ ID NO: 200416 - DNA, 1638 bp, Artificial Sequence
  Description of Artificial Sequence: Synthetic coding sequence
atggtggccgaggccggcagcatgcccgccgccagcagcgtgaagaaaccatttggactccggagtaagatggggaaatggtgtagacattgtttcgcctggtgccgcggcagtggcaaatccaacgtcgggacgagcggagaccacgacgattctgccatgaaaaccttgcgctcaaaaatgggaaagtggtgctgtcactgcttcccatggtgccgcggcagcggaaagtccaacgtaggcacttcgggggaccacgatgattcagctatgaagacccttcgcagcaaaatggggaagtggtgctgtcattgcttcccatgctgccgcggttctggaaagagcaacgtgggaactagcggggaccatgatgactccgccatgaaaaccctgcgctctaagatgggtaaatggtgctgccattgctttccgtgttgccgtggatccggcaagaataaagtgggcccttggggagattacgacgacagtgcttttatggaaccacggtatcatgtccgtcgggaggatcttgacaagctgcatcgagcagcttggtggggcaaggtgccacggaaagatctgatcgtgatgctcaaagacacagacatgaacaaaaaggataagcaaaaaagaactgctcttcatctggcatccgccaatggtaacagcgaggtggttaaactcctgctcgataggaggtgccagctgaacatcctggataataaaaagagaacagccttaactaaggctgtccagtgtcaggaggatgagtgtgccctgatgctcctggagcacggaacagatccgaacattcctgacgagtatggcaatacagccctccattacgcaatctacaacgaggacaaactgatggcaaaagccctgcttctgtatggcgctgacattgaaagcaagaacaaacacggcttaacgcccctcctgcttggcgtacacgaacagaagcagcaggtagttaagtttcttatcaaaaagaaggcaaacctgaacgcgcttgataggtatggccgcaccgcccttatcctggctgtgtgttgtggctcggcctcaatcgtttccctgttgctcgaacagaatatcgacgtgtcttcacaggatctctccggccagacagccagagagtacgccgtttcttctcgtcataatgtgatctgccaattgctgtctgactacaaggaaaagcaaattctgaaggtgtccagcgagaacagcaatcccgaacaagatctaaagttgacatccgaagaggaatctcagcgattgaagggatctgagaacagccagcccgaggagatgagtcaagagccagaaattaacaagggcggcgacaggaaggtagaggaggagatgaagaaacacggaagtacccatatgggctttcccgaaaatctcactaacggggccactgccgacaatggtgatgacggtcttattcccccgcggaagtcaaggacaccagagagtcaacagtttcccgataccgaaaacgagcagtatcacagtgacgaacagaacgacacccagaaacagctgtctgaggagcaaaacaccgggatcttgcaggacgagatcctcatccatgaggaaaaacagatcgaggtggctgaaaacgagttttag

SEQ ID NO: 200417 - DNA, 867 bp, Artificial Sequence
  Description of Artificial Sequence: Synthetic coding sequence
atggtggccgaggccggcagcatgcccgccgccagcagcgtgaagaaaccattcggcctaagaagcaaaatgggaaaatggtgtcgacattgcttcgcatggtgtcgcggcagtggcaagagcaatgtcggcacatcaggagaccacgacgacagtgctatgaagacattgagaagcaaaatgggaaagtggtgttgccattgtttcccatggtgcaggggttcagggaaatctaatgtggggacctcaggggaccacgacgacagcgctatgaagacactgcggtccaagatgggcaagtggtgctgccattgcttcccatgctgcaggggaagcggcaagtctaatgtgggaacctcaggtgatcacgatgattcggccatgaagacattacgctctaagatgggtaagtggtgctgccattgcttcccctgctgccggggcagcggcaaaaacaaggtgggtccctggggggactacgacgattctgcttttatggaaccaagatatcacgtgagacgagaagacctagataaactccaccgagctgcctggtggggcaaggtgcccaggaaagatttgattgtgatgctcaaggatacagatatgaacaaaaaggacaaacagaaaagaaccgcccttcatctggcgtcagccaatgggaattctgaggtagtgaagctgctgttagacaggcgatgtcagctcaatatccttgataataaaaaaaggacagctcttacaaaggctgttcagtgtcaggaagacgaatgcgccctgatgttactagagcatggcaccgatcctaacatccccgatgagtacggcaatacagccctgcactacgcaatttataatgaagattag

SEQ ID NO: 200418 - DNA, 1527 bp, Artificial Sequence
  Description of Artificial Sequence: Synthetic coding sequence
atggtggccgaggccggcagcatgcccgccgccagcagcgtgaagaagcccttcggtttaaggtcaaaaatgggcaagtggtgtcgccactgcttcgcatggtgcagagggtcgggcaaatccaacgtgggcacttctggggaccacgacgatagcgctatgaagacattgaggagcaaaatgggcaaatggtgctgtcactgctttccttggtgcaggggaagtgggaaaagtaatgtgggtacgtccggagaccatgatgatagtgctatgaagacactccgctcaaagatgggcaaatggtgctgccactgcttcccctgctgtagaggctcaggtaaaaataaggttggcccttggggagattacgatgattcggccttcatggagccgcggtaccatgtgcgccgggaggacctagacaagctgcatcgagcagcttggtggggtaaggtgcctaggaaggaccttattgtgatgctgaaggataccgacatgaataagaaggataagcaaaaaagaacagccctacacttggcgtccgccaacggtaattcagaagtggtcaaactattgctggaccgacgctgccaactgaacatattggacaacaagaagagaaccgctctgaccaaagctgtgcagtgccaggaggatgaatgcgctctgatgctgctggagcatggtacagatccaaacattcccgatgagtacggcaataccgctctacactatgctatctacaacgaggataagctgatggccaaggctctgttgttgtacggcgcagacatcgagtcaaagaacaagcatggtttgacaccgttgctgttgggagtacacgagcagaagcagcaggtggtgaagtttctaatcaagaagaaggccaacttaaacgccttggacaggtatggccgaacagctctgatactggcagtgtgttgcgggtccgctagtatcgtgtccctcttgctggagcagaatattgatgtgagttcacaggacctctccggacaaactgcacgggagtatgctgtgagcagccgccacaatgtgatctgccagctgcttagcgactacaaggagaagcagattctaaaggtgtcaagcgaaaacagtaatcccgaacaggatctgaagctcacctccgaggaagagtctcagcgattaaaaggctccgaaaacagccagcccgaagagatgagccaagagcccgagattaacaagggtggcgacaggaaagttgaagaggagatgaaaaagcacggctctacccacatgggctttccggagaatctgacgaacggagccacagctgataatggtgatgatgggctgatcccccctaggaaaagtcgcacacctgaatcgcagcagttcccagacaccgaaaacgagcagtatcattccgacgagcaaaatgatacacaaaaacagctgagcgaggagcaaaataccggcattctgcaggatgaaatcctgattcacgaagagaaacaaatcgaagtggctgaaaacgaattctag

SEQ ID NO: 200419 - DNA, 954 bp, Artificial Sequence
  Description of Artificial Sequence: Synthetic coding sequence
atgagctgccaggccttcaccagcgccgacaccttcatccccctgaacagcgatgcctccgcaaccctgccattaatcatgcaccactctgcggctgaatgtcttccggtctcaaaccacgccaccaatgtaatgtcaaccgtgccaagtatactttccctgattcagacaccaaagtgtctctgtacccacttttcagttacgaccctcggaaacacggctactggactgcactattctgtgccttcttgtcattatggcaatcagccatctacatacggggtgatggccggatcccttaccccctgcctctataagtttcctgaccacaccctgtctcacggtttcccccccatccaccagccgctgctggccgaggacccaacagcagccgatttcaaacaggagttgagaaggaaaagcaagctggttgaggaacctatcgacatggactctccagaaatccgggaacttgagaagttcgccaatgagttcaaggtacgcagaatcaagctgggatatactcagaccaacgttggcgaagccctggcagccgtgcacggatcggagttttcacagaccaccatttgtcggtttgagaacctgcaactgtcttttaaaaacgcgtgcaagctcaaagccattctctctaaatggctggaggaagccgagcaggtgggagctctgtacaacgaaaaagtcggggcaaatgaacggaaacgcaaacggaggaccaccatcagcatcgcagcaaaggacgccctagagagacatttcggagaacagaataagccatcttcacaggagataatgagaatggccgaggagctgaatctagagaaagaggtggtacgtgtctggttctgtaaccggaggcagcgggaaaagagggttaagacttctctgaatcaatctctcttttccatctccaaggagcatttggagtgccggtag

SEQ ID NO: 200420 - DNA, 876 bp, Artificial Sequence
  Description of Artificial Sequence: Synthetic coding sequence
atgagctgccaggccttcaccagcgccgacaccttcatccccctgaactctgacgccagcgcgacgctccccctcattatgcaccatagtgctgccgagtgcctgcccgtatccaatcatgcaacaaacgtcatgtcaacagctactggacttcactatagtgttccatcttgccactacggtaatcaaccatcgacttatggggtcatggctggcagtctgactccttgcttgtataaatttccagatcatacattatctcatggattcccgccaatccatcagcccctgctggctgaagacccgacagcagccgacttcaagcaggagctccgccgcaagtccaagctggtagaggaacccatagacatggatagtccggagatcagggaactggaaaagttcgcaaatgagtttaaggttaggaggattaagttggggtatactcagactaatgtgggcgaagctctggcggccgttcacggatcggaattcagccagacaacgatctgtaggttcgagaatctccaactgagctttaaaaatgcgtgcaagctgaaagcaatcttgtcaaaatggcttgaggaagcggaacaggtgggggcactgtacaacgagaaggtaggcgctaacgaaagaaagaggaaacggcgcaccactatcagtatagcagccaaagacgccttggaacggcatttcggagaacaaaataaacctagttcacaggaaattatgagaatggcagaggagttgaacctcgagaaggaggtagtgagggtgtggttttgtaataggaggcagcgggagaaacgcgtaaagacatccctgaaccagtcccttttctctatttccaaggagcacctcgagtgcaggtag

SEQ ID NO: 200421 - DNA, 771 bp, Artificial Sequence
  Description of Artificial Sequence: Synthetic coding sequence
atgctgtggcagaagcccaccgcccccgagcaggcccccgcccccgccaggccatatcagggcgtgagagtaaaagagccggtcaaggagctattaaggcgtaaacggggacatgcaagttctggggccgcccccgcgccaacggccgtggtgcttccccatcaacccttagctacctatacgacagtgggcccctcctgcctggacatggaaggctccgtttcagcagtaacagaagaggctgccttatgcgccggctggctctcgcaacccacacctgcaactctgcagccccttgccccttggacaccttacacggagtatgtgccacacgaggccgtcagctgtccttactccgctgacatgtacgttcagccagtctgtcctagctatactgtggtagggccctcgtccgtcctcacatacgcgtcgccacccctgattaccaacgtgacaactcgctcgtcagctacccctgctgtgggtcctccactggagggtcccgagcatcaggcaccattaacatacttcccctggcctcagccactttctaccctccccactagtaccttacaataccagccacctgccccggccttaccaggccctcagtttgtgcagttgccaatctcaattcccgagcccgtgctccaggacatggaagaccctcgcagggccgcttcttcccttaccatagacaagcttctgctggaggaggaggactcggatgcctacgccctgaatcacaccctatcggtggaagggttttag

SEQ ID NO: 200422 - DNA, 1440 bp, Artificial Sequence
  Description of Artificial Sequence: Synthetic coding sequence
atggtgcacagcagcatgggcgcccccgagatccggatgagcaagcccctcgaagcagaaaaacagggacttgattccccatctgaacatactgacacagagcgaaacggccctgataccaatcaccaaaatcctcagaacaagacatcccccttcagcgtgagccctaccgggcccagtaccaaaattaaggctgaagacccgtcaggagactctgctcccgccgcccccctgcctccacagcccgcgcagccccacctgccccaagcgcagcttatgctcacagggtcacaactggccggagacatccagcagctcctgcagctgcagcagctcgtgctggtgcccggacaccaccttcagcctccggctcagtttctcctaccgcaggctcagcagagccaaccaggactgctccctactcctaatctgttccagctgccccagcagacacaaggggcccttctgacatcccaacctcgggccggcctgcccacacaggctgttaccaggcccaccctgccggatcctcacttgtcgcacccccagcccccaaaatgcttggaaccaccttctcacccagaggagccctctgacttggaggaactggagcagttcgctcggacgtttaaacagcgtagaatcaaattgggttttacgcagggggacgtgggtcttgctatgggaaagctgtatggaaacgacttctctcagacgaccatctctcggtttgaagcactcaatctgagttttaagaatatgtgcaagttgaagcctctcctagagaaatggcttaacgatgccgaaacgatgtctgtggatagcagcctgccgtccccaaaccagctgtcttccccctccttgggctttgacggccttcctggcaggcggaggaagaaacgaacaagcattgaaactaacgtgcgtttcgccctagagaagagttttctggccaaccagaagcctacctcggaggagattttacttatagctgaacagctgcacatggaaaaagaagtgatccgggtatggttttgtaatagacggcagaaggagaagcgaatcaacccgtgttccgccgcaccaatgctgccatctccagggaagccagcgagttacagcccccatatggtgactccacagggaggagccgggacactgccgttgagccaggcttcaagcagtctatctactacggtgactacactgtctagcgcggtggggaccctgcacccatcccgcactgccggcggcggagggggtggggggggtgcagctccaccgttaaactctatcccctctgtcactccccccccgcctgcgactaccaacagcactaaccctagtccccagggctctcatagcgccattggccttagcggcctcaatccatcaaccgggcccggactgtggtggaatcccgcaccataccagccttag

SEQ ID NO: 200423 - DNA, 1809 bp, Artificial Sequence
  Description of Artificial Sequence: Synthetic coding sequence
atggtgcacagcagcatgggcgcccccgagatccggatgagcaagcctctggaagccgagaagcagggactggattctccgagcgaacacactgacactgaaagaaacggaccagacactaaccaccaaaatccccagaacaagacctctcctttttccgtctcaccaaccggcccgtcaacaaaaatcaaggcggaggatccttctggcgattctgcaccggctgctcctctgccacctcaaccagcccagccccacctgccacaagcccagctcatgctgacaggctcccagctggccggtgacatccaacagctgctgcaattacagcagcttgtgctggtgcccggccatcatctgcagccccctgcgcagttcctattgccacaagcccagcaatctcagccaggcctccttcctacaccaaatttattccagctcccgcagcagacacaaggtgccctcctgacaagccaaccacgcgcaggtctgcccacgcaggccgttacacgaccgaccctgccagacccccacctgtcccaccctcaaccccccaaatgcctggagccgccctcccatccagaagagccaagcgatctcgaagagctagagcaattcgcacgcacttttaagcaacggcggatcaaactgggcttcacacagggcgacgtcggcttagcaatgggaaaattgtatggaaacgacttctcccagactactatcagcagatttgaggccctgaatctcagtttcaaaaacatgtgtaagctgaaaccattgctagaaaagtggctcaacgatgctgaaacgatgtctgttgattcctcactgccctcccctaaccaactgagcagcccctcactgggattcgacggcctgccagggaggcgccgcaaaaagcgcacctccattgagaccaatgtgaggtttgccttggagaaatcattcctggctaaccagaagcctactagcgaagagatacttctcatcgctgaacagttgcacatggagaaagaagtcataagagtgtggttctgtaatcgaaggcaaaaggaaaagcgcataaatccctgttccgctgctcccatgttaccttcccccgggaaacccgcttcttattccccacatatggtgaccccccaagggggcgccggcaccctgcctctctcccaggcctcaagctccctatcgacaaccgttaccacactcagttctgctgtgggaaccctccacccttcaagaactgccggcggcgggggcggagggggaggggctgcgccccctcttaattccatccccagtgtgaccccaccgccacctgcgaccacaaactccaccaacccctcaccgcaagggagccattctgcaatcggcctcagcggtctcaatcctagcactgggtcgaccatggtcggactttcgagcggtctgagtcccgcgctgatgtctaacaatccgctggctacgattcaggctctggcctctggagggacattgccccttacgagtttagacggcagcggtaacctagtcctgggggccgccggtgcggctcccggctcaccgggactggtgacatcacctctgtttttgaatcacgccggacttccgctactgtctacgccccctggggtaggactggtgagcgccgcagccgcagccgtcgccgcatcaatctcttctaagagccctggtctgagcagcagcagctcaagtagtagctcttcctcatctagcacctgttcagaaacagccgcacagactccgggtggaccaggcggtcccgaagctggcagtaagcccgagtag

SEQ ID NO: 200424 - DNA, 1392 bp, Artificial Sequence
  Description of Artificial Sequence: Synthetic coding sequence
atggtgcacagcagcatgggcgcccccgagatccggatgagcaagcctctagaagccgagaaacaggggctggattcaccttctgaacatacagacaccgagaggaatgggcctgacaccaaccaccagaacccacagaataagacctctccattctcagtatcgccaacaggcccctctaccaagatcaaggcggaggatccttcaggagacagcgcccccgccgcccctcttcctcctcagcccgctcagccgcacctccctcaggctcaattaatgctgactggaagtcaactggccggcgacatccagcaactgctgcagcttcaacaattggtcctggtgcctggtcaccacctccagccacctgcacagtttctcttgccccaggcgcagcagtctcagcccggtctcctccctacacccaacctgtttcagcttccacaacagactcagggcgctttacttactagtcaaccacgagcaggcctgccaacacagccgccaaagtgcttggagccccccagtcaccctgaggagccctccgacctcgaagagctggagcagttcgcccgcacgttcaagcagaggcgtatcaaactcggatttacgcagggcgacgtgggactcgcaatgggtaagctgtatggcaacgatttctcccagactactatttcgcggtttgaagcactaaatctgtccttcaagaatatgtgtaaacttaagccgttgctggaaaaatggctgaatgacgcagaaactatgtctgtggactctagcctgccaagccctaaccagctgagcagtcccagtctcgggttcgacggcctccctggccgacgaagaaaaaaaagaacatccattgagaccaatgtgaggttcgccctggaaaaaagtttcctcgccaaccagaagccaacatccgaggagatattgttaatcgcagagcaactgcatatggaaaaggaggtgattagggtctggttttgcaacagacggcaaaaagaaaaacgtattaacccctgcagcgccgcccccatgctgccgtctcccgggaaacctgcatcctattcaccccacatggttactccgcaaggtggcgccggcactttgcccctgagccaggcatcatcttcactgtcaacgacagtgacaactctgtcctctgctgtaggcacccttcacccatctagaaccgctgggggcggcggcggcggcggaggcgctgccccgcctctgaactctattccctccgtgactccccctcccccggcaactaccaatagcaccaacccttctcctcagggatctcactctgccataggactgagcggactcaatccttctactgggccaggcttgtggtggaatccggcaccgtaccagccctag

SEQ ID NO: 200425 - DNA, 1425 bp, Artificial Sequence
  Description of Artificial Sequence: Synthetic coding sequence
atgggcgcccccgagatccggatgagcaagcccctggaggccgagaaacagggactggattcgcctagcgaacacactgatactgagcgcaatggccctgatacaaatcatcagaatccccagaataagacatctcccttctcggtgtctccaaccggaccttcaactaaaattaaagcggaggatccatctggtgactccgcacctgctgcccccctcccaccccagcctgcccaaccacacctgcctcaggcccaactaatgctgaccggttcacagctggctggagacatacaacaactcctccaactccagcagctcgtcctggttccagggcatcacttgcaaccacccgcacagtttcttcttccccaggcccagcagtcacaacccggactcctgcctactccaaatcttttccaattaccccaacaaacccaaggcgccttactcacatcccagccccgagcaggccttccaacacaagcggtaactcgacccaccctacccgatcctcacttatcgcaccctcagccgccaaaatgcctggagccacccagccaccccgaggagcctagcgatctcgaggaattagagcaatttgcccgaacctttaaacagcgcaggattaaactcggctttacgcagggcgatgtgggcctggctatggggaaactgtacgggaatgatttcagccagactactatctcccgtttcgaggcactgaacctcagctttaaaaacatgtgcaaattgaaacctctgctggagaagtggctgaacgacgcagagactatgtctgttgattcttcacttccctctccaaaccagttgagtagtccatctttaggcttcgacggcctgccaggccgccgcaggaaaaaacgtacatcaatcgaaaccaacgttcggtttgccctggagaagagctttctggctaatcagaagcccacttcagaggagattcttttaatcgcagaacaactgcacatggagaaagaggtgatccgtgtctggttttgtaaccgtagacagaaagagaaacgtattaacccttgcagcgcagccccgatgcttccaagtcccggtaaacccgcctcctactctccacacatggtcacccctcagggcggggcaggcactctaccactctcccaagcttcctcatcactcagcacgaccgtgacgaccctgagttccgccgtgggtacattacatcctagcagaaccgcaggcgggggaggcggcgggggcggcgccgcacccccattgaacagcatccccagcgtcacccccccacctccagccacgacgaactccactaacccctccccgcaaggcagtcactctgccattggcttgtctggcctaaatcctagcacaggacccgggctgtggtggaatccagccccataccagccttag

SEQ ID NO: 200426 - DNA, 1203 bp, Artificial Sequence
  Description of Artificial Sequence: Synthetic coding sequence
atggtgcacagcagcatgggcgcccccgagatccggatgagcaagccacttgaagccgagaagcagggactggactcaccttccgaacacacagacaccgaaagaaacggaccggacaccaatcatcaaaacccccaaaacaagactagccctttttcagtaagccccactggcccatctactaagataaaggcagaggaccccagtggagatagcgcgcccgcagccccattgcctccacagcccgctcagccccatctcccacaggcacagttgatgttgacggggtcccaactagcaggggacatccagcagcttcttcagctacagcagctggtcctcgtgcccggacaccacctccaaccacccgcccaattcctattgcctcaagcacaacagagtcaacccggcctcctgcccacccccaacttgttccaacttccacagcagactcagggggcacttctcacgagccagccgagggcggggctccccacccagcccccaaaatgcttggagccaccttctcacccagaagagccaagtgatcttgaagaactggaacagtttgccagaacttttaaacaaagaagaatcaagctagggttcactcaaggcgacgttgggctggctatggggaagttgtacggcaacgatttctcacagacaacgatttcacggtttgaggcactaaatttgagctttaaaaatatgtgtaagctgaagcctctcctagaaaagtggctgaacgatgcagaaaccatgagcgttgacagcagcctcccctcccccaatcagttatcctccccatccctggggtttgatgggcttccaggccgtcggcgtaagaagcggacatccatcgaaaccaatgtcaggtttgcattagagaaaagcttcctagcaaaccagaaacctactagcgaggaaattctgctgatcgcagagcagctgcacatggaaaaagaggtgataagggtgtggttctgtaaccgtaggcagaaggaaaagcggatcaatccttgttccgccgcaccaatgcttccctcccctggcaagcccgcctcctactcccctcacatggtaaccccccagggaggggccggcacccttcctctctcacaggcgtcttcatccctatctaccaccgctcagacccctgcgttgaaggctgctacgcgcctctccgcttgtcaggcctag

SEQ ID NO: 200427 - DNA, 1404 bp, Artificial Sequence
  Description of Artificial Sequence: Synthetic coding sequence
atggtgcacagcagcatgggcgcccccgagatccggatgagcaagcccctcgaagccgaaaagcaagggctagacagtcctagtgagcacaccgacacagaacgtaacgggcctgatactaaccatcagaacccccagaacaagacatctcccttcagcgtgtcacctaccgggccaagtacgaagataaaggctgaggacccatcaggcgattctgcaccggctgcgcctttgccaccccaacctgcccagcctcacctcccacaggcacagctgatgcttacaggatcccaactggccggagatatccagcaattattgcaacttcaacagctcgtgctggtcccaggccaccatctgcagccccccgcgcagttcctccttccccaagcccagcagtcccagcctgggttgctaccaaccccgaatctgttccagctcccccagcaaacacagggtgccctcctgacgagccaacctagggctggattacctacgcaggccgttacgagacccacattgccagatcctcatctctctcacccgcaacctcctaagtgcctcgagcctccatcgcaccccgaggaaccatcagacctggaggagttggagcaatttgcccgaacctttaagcaacgtaggataaagctcggttttactcagggtgacgttggcttggcaatgggcaagctgtacggaaatgacttcagccagactactatttcgcgattcgaggccctgaatctgtcttttaaaaatatgtgtaagcttaaacccctcctcgaaaagtggctgaacgatgccgagaccatgagcgtggattcttctcttccctccccaaaccaactgtcctccccctctcttgggtttgatggtctgcctggtcgcagacgtaaaaaacggaccagtattgagactaacgttcgattcgctttggaaaagagcttcctggcaaatcagaaacctaccagtgaggagatcctgctcatagctgaacaattgcacatggagaaggaagtaataagggtatggttctgtaaccggcggcagaaagagaagagaatcaacccatgcagtgcagcacccatgctgccaagtccagggaagcctgcttcttactctccacacatggtcaccccgcaaggcggcgccggaactttgcccctgtcacaggcctcgtcaagcttatccacgacagtgacaaccttatcaagcgccgtggggactctgcacccgagtcgcaccgctggtggggggggggggggcggaggcgctgcacctccactgaacagcattcccagtgtcacacctccaccacccgctacaacaaacagcactaacccatccccacagggctctcactccgcaatcggcctgtccggactgaacccaagtaccggctag

SEQ ID NO: 200428 - DNA, 1761 bp, Artificial Sequence
  Description of Artificial Sequence: Synthetic coding sequence
atggtgcacagcagcatgggcgcccccgagatccggatgagcaagcctcttgaggccgaaaaacagggactcgactcacccagtgagcatactgacacggaaagaaatgggccggacaccaaccatcagaatccccagaataagacctccccgttctcggttagccccacaggtccatcaactaaaattaaggctgaagatccaagtggcgatagtgcccctgccgcgccactgcctccccagccagcccaaccacaccttcctcaagcacaactgatgctaactggttcacagttagctggggacattcagcaattgttgcagttacagcagttggtcctcgttcctgggcatcatctgcagcctcctgcccagtttctgctgccccaggctcagcagtcacagcctggtctcttgcccacccccaacttgttccagttacctcagcaaacccagggagctctgctgacctcgcaaccgcgcgccgggctccccacccaaccccccaaatgtttggagcctcctagtcatcccgaggagccgtccgacctggaggagctggaacaattcgccaggacatttaagcagagacgcattaaactgggcttcactcagggagatgtgggacttgccatgggaaaactgtatggaaacgacttcagccagactacaatctccaggttcgaggctctgaacctgtcattcaaaaatatgtgtaagttgaaacccttgctcgagaaatggcttaatgacgcagaaaccatgagtgttgactccagtctgccatcgcctaaccaactatctagcccaagcctgggatttgatggcctgccgggaagaagaaggaagaagcgaacctctattgagacaaacgtaaggtttgcgttggagaaatcttttctggccaaccagaagcctacctcagaagagattctactgatcgctgagcaattgcacatggaaaaagaggtgatcagggtgtggttctgtaaccgccgacagaaagaaaagaggattaacccttgttccgctgctcctatgctcccatctccaggcaaaccagcttcctactcaccccacatggtgacaccgcagggtggagccgggaccctgccactgtcccaagcaagctcctcgttgtccaccaccgttacaacactttcctctgcagttggcaccttgcaccctagtcggactgcaggcggcggaggggggggcggaggtgcagccccccccctgaatagtatcccatctgtgacacctcccccacccgccacgacaaactctaccaacccaagcccacagggatctcatagtgctatcggcctctctgggttgaatcccagcactggtagcactatggtggggttgtcgtcgggtttgtcacccgcactcatgtccaataatcccttggcaaccatccaggcacttgctagtggcggtactctgcctctcacatctttagacggctctggtaatctcgtattgggcgccgctggtgctgcaccgggttcacctggccttgtcacatctcccctctttttgaaccacgcgggtttgccactcctgagcacgccccctggtgtcggactagtgtcagctgcagcagcagctgtggctgcctcgatttcctccaaatcccccgggctaagctcttcttcctcttcgtcaagctcaagctcatcttccacatgtagcgagactgccgctcaaacacctggtgggcccggcgggcctgaagccggcagcaagcccgaatag

SEQ ID NO: 200429 - DNA, 1311 bp, Artificial Sequence
  Description of Artificial Sequence: Synthetic coding sequence
atggtgaacctggagagcatgcacaccgacatcaagatgagcggcgacgttgctgacagtacagacgctcggagcacactctctcaagttgaacctggcaatgatcgcaacggccttgatttcaacaggcagataaagacagaagacctctctgatagtttacagcagaccctttcccaccgcccctgtcacctaagccaaggtccggccatgatgagtgggaatcagatgagtgggctcaatgcaagtccctgccaggatatggcaagccttcatcctctccagcagctggtgctcgttcccgggcacctccagagtgtgagccaattcctgctgtctcaaacacaaccgggccagcagggactgcagcccaacctactccccttcccacagcagcaatcaggcctgctgttaccccagacgggcccaggtctggcgtcccaggccttcggccaccccggccttcctggttccagcctggaaccccacctcgaagcaagccagcacctccctgttcccaagcatttgccttcctctgggggagctgatgagccttcagatcttgaggaactcgaaaagtttgccaaaacatttaaacagaggcgaatcaagctgggatttacccagggggacgtagggttggccatgggcaagctttacggcaacgacttcagtcagacaaccatcagtcggtttgaggccttaaacctgtcgttcaaaaacatgtgtaaattgaagcctctactcgagaaatggctgaacgatgccgaaagttcaccatcagatcccagcgtgagcaccccatcgtcctacccctccttgagcgaagtcttcgggaggaaacggaagaaaagaacaagcattgaaactaacattagactgaccttggaaaagaggtttcaggataatcccaagccaagctcagaggagattagtatgattgcggagcagctttcaatggagaaggaggttgttagggtttggttttgtaacagaaggcagaaagaaaagcgaattaactgtccggtggctacccctattaaaccccctgtctacaatagtagactcgtgtccccatccggatccctcggtcctctctctgtcccgcctgtgcattcaaccatgcccggaacagtgaccagctcatgcagccctggcaataacagtcggccatccagtcccgggtccggactgcacgcatcaagtcccaccgcgtcgcagaacaattcaaaagctgcggtcaatagcgcctcatccttcaatagttctggcagctggtatcgctggaaccacagtacatatctgcactag

SEQ ID NO: 200430 - DNA, 1317 bp, Artificial Sequence
  Description of Artificial Sequence: Synthetic coding sequence
atggagagcccccggaccgccaagggcggccgggacatcaagatgagcggggatgtggcagattcaaccgatgcccggtccaccctgtctcaggtggagcctgggaacgaccggaacggcctggacttcaacagacagataaaaacggaggacctgtctgacagccttcaacaaaccctgagccatcggccttgccacttgagtcagggacccgctatgatgtccggcaaccagatgtctggtctcaatgcaagcccatgccaggatatggcaagcctccaccccctccagcagctcgttttggttcccgggcacctgcaaagcgtttcccagttcctgctatcccagacccagcccggacaacagggactgcaacccaatctgctgccctttccgcagcaacagtccggacttctgttaccgcagacaggccctggtctggcaagccaggcttttgggcaccctggtctgcctggcagctcacttgagcctcacttagaagcttcacaacatctgcccgttcccaaacacctcccatccagcggcggtgcagacgagccatcagacctggaggagctggaaaagttcgccaaaacctttaagcagcggcgaattaaactgggcttcacacaaggcgatgtagggctcgccatgggcaaactgtacgggaatgacttttctcagaccactatttcccggtttgaagctctgaatctgtcctttaagaacatgtgtaaactgaagcccttactagaaaaatggcttaatgacgccgaatcctccccaagtgacccctctgtgagtaccccctcaagctatccaagcctgtctgaggtgtttggacgcaagaggaagaaacggacgagtatcgaaaccaatattcgcctgactctggagaagcgttttcaggataatccgaaaccgtcatctgaggaaatctctatgatcgccgagcagctctcaatggagaaggaagtcgtaagagtgtggttctgtaacaggcggcagaaggaaaagagaattaactgccccgtggcaaccccgattaaacctccagtgtataattcaaggctggtgagtcctagcggttcattggggcctctatctgtgcctccagtacattcgacgatgcctgggacagtgacctcctcatgcagtccaggaaacaatagccgcccatcatcccccggcagcggtctgcacgccagctctcccactgcctctcagaacaattctaaggccgccgtgaattctgcgtcatctttcaatagctcaggttcctggtaccgttggaatcacagcacgtacctccactag

SEQ ID NO: 200431 - DNA, 1356 bp, Artificial Sequence
  Description of Artificial Sequence: Synthetic coding sequence
atggccaccaccgcccagtacctgccccggggccccggcggcggcgctggaggaactggtcccctgatgcaccctgatgcagccgccgcagccgctgcagccgcagcagccgagcgcctgcacgctggcgcggcttacagggaagtgcagaaattaatgcaccatgaatggctaggcgctggcgcaggtcaccccgtgggactggctcacccccagtggcttcccacgggtggggggggaggtggcgattgggccggtggtccgcatctcgaacatggtaaggctggcggcggcggaacaggccgcgccgacgatggcggcggcgggggcggttttcatgctaggctcgtgcaccagggtgccgcccatgcgggagccgcctgggctcaggggtcaacagcccatcaccttggtccagcaatgagcccctccccaggagcatcgggcggccatcagccccagcctctcggattgtacgcccaagccgcttacccaggtgggggcgggggtggactggccggcatgctggctgccggcggaggcggagctgggcccggtctccatcacgcactccacgaggacggacacgaagctcagctggaaccatcaccgcctccccacttgggagcccatggccatgcccacggccacgctcatgcaggtgggctccacgcggctgctgcccatctgcatcccggtgcgggcggcggcgggtccagtgtgggagagcacagcgatgaggacgccccgagcagcgatgaccttgagcagtttgctaaacaatttaagcagcggagaatcaagctcggctttacccaggctgacgtgggcctcgcgttaggaactctgtatggcaacgtattcagtcagacaaccatctgtagatttgaagccctccagctttcatttaaaaatatgtgcaagcttaagccgctcctgaacaaatggctggaggaaactgattcgtcctctggtagcccaactaacttggataagatcgccgcccaaggtcgcaagaggaaaaagcgcaccagcatagaggtgggggtgaaaggcgccctagagtcccactttcttaaatgtcccaaaccctctgcacatgagatcacaggactggctgatagtcttcaactagaaaaagaggttgtgagagtctggttctgcaatcgacgacagaaggagaaacgcatgacacccgcagccggggccgggcacccgccaatggacgatgtctatgcacctggggagcttggtcccggcgggggaggggcgtcgcctcctagcgccccgccccctccgccgccagctgcgttgcaccaccatcaccaccatacacttcccgggtctgtccagtag

SEQ ID NO: 200432 - DNA, 1332 bp, Artificial Sequence
  Description of Artificial Sequence: Synthetic coding sequence
atggccaccgccgccagcaaccactacagcctgctgaccagcagcgcatccattgtacacgctgaaccccctggtggaatgcagcaaggtgctggaggctatcgggaggcgcaatctctggtccagggcgattacggcgcacttcagagcaatggacacccactttctcatgcgcaccagtggataaccgcattaagccatggaggcggcggtggcggaggggggggaggaggtggaggtgggggcgggggtggtggggggggtgatggaagtccttggagtacctcaccattgggacagcctgatataaagcccagcgttgtcgtccagcagggggggcgaggtgatgaactgcacggacccggggccctgcagcagcaacaccagcagcagcagcagcagcagcagcagcagcaacagcagcagcagcagcagcagcagcaacaacggcccccgcatctcgtccaccatgccgctaaccaccaccccgggcctggtgcctggaggtccgcagccgccgctgcacacctccccccttccatgggcgctagcaatggtggtttattgtactcacagccgagctttactgtaaatgggatgctgggtgcaggaggtcaacctgctggactgcaccaccatggattacgggatgctcacgacgaaccacaccatgccgaccatcacccgcacccgcattctcatccccaccagcaacctcctccgccccctcctcctcagggaccaccaggtcaccccggagcccatcacgacccccatagcgacgaggacacaccaacctccgacgatttagagcagttcgctaagcagtttaaacaacgccggattaaactgggcttcacacaggccgacgtcggcctggccctgggcacgctttacggcaacgttttttcccagactacaatttgcagattcgaagccctgcagctgtccttcaagaatatgtgcaagttgaagcctctgttgaataaatggttggaggaggcagatagttcctcagggtccccgacttctatcgataagatagccgcccagggacgcaaacgaaagaagcgtacttccattgaagtttccgtaaagggggccctcgagtcacatttcctcaaatgtcccaagcccagtgcccaggaaattactagtttagcggatagcctccagttggagaaggaagttgtgagggtgtggttttgtaaccgacgccagaaagagaagaggatgacacctcccggtggcaccctgcccggggccgaggacgtgtacggaggatcaagagatactccaccacatcatggggttcagaccccagtgcagtag

SEQ ID NO: 200433 - DNA, 1131 bp, Artificial Sequence
  Description of Artificial Sequence: Synthetic coding sequence
atggccaccgccgccagcaaccactacagcctgctgaccagcagcgccagcattgtgcacgcagagccccccgggggaatgcagcagggtgccggcggctatcgcgaagcacagagcctggtgcaaggggactacggcgctctgcagtccaacgggcatccattatcccacgcccatcaatggatcacagctttaagccacgggggggacggctcaccttggtctacctctccattggggcagccagacattaaaccgagcgtggttgttcagcagggcggtcggggggatgaactgcatgggccaggggcccttcagcagcagcaccagcagcaacagcaacaacagcaacaacagcagcagcagcaacagcagcaacagcagcaacaacgaccgccccacctggtgcaccacgctgccaatcaccatccaggtcccggtgcttggcgctccgcggcagcagctgcccacctgccgccttccatgggtgctagcaatggtggtttactctactcccaacccccaccaccccctcagggcccaccgggtcacccaggagctcaccatgaccctcactccgatgaggacactccaacctcagacgatttagagcagttcgcgaaacaattcaagcaacgccgcataaagctggggttcacccaggccgacgtgggactagcactgggaactctttatggaaacgtgttcagccagacgactatctgtcgtttcgaggcgttacagctgtcctttaaaaatatgtgcaagctcaaaccacttcttaataaatggcttgaagaagccgactctagctctggatcaccgacatcaatagacaagatcgccgcccagggccggaagcgtaagaaaagaaccagcattgaagtgagtgtcaagggggccctggagagccacttcttaaagtgtcctaagccaagcgcccaagaaatcacgagcctggcagactctttgcagctggagaaggaagtagttagggtctggttttgcaatcggcgccagaaggagaagagaatgacgccaccgggagggacccttccaggcgcagaagacgtgtacggagggagcagggacacacccccgcaccacggtgtgcagacccctgtgcaatag

SEQ ID NO: 200434 - DNA, 1503 bp, Artificial Sequence
  Description of Artificial Sequence: Synthetic coding sequence
atggccaccgccgccagcaacccctacctgcccggcaacagcctgttagccgcaggtagcatcgtgcacagcgatgctgccggcgccggggggggtgggggcggtgggggaggaggaggcggtggtggtgctggaggcggcgggggcggtatgcagccaggctcggccgcagtgacttctggagcttaccgtggggacccttcctccgtgaaaatggtccaatcagactttatgcagggggccatggcagcgagtaacggaggacacatgctgtcccatgcccaccagtgggttacagccttaccacatgctgctgctgctgccgcagccgccgccgcagccgccgtcgaggcgtctagtccgtggtccgggagcgcagtgggcatggctggaagccctcaacaacccccacagccacctcctcctccacctcagggaccagatgtaaaagggggcgccggcagagatgacctgcatgcaggtactgccctccaccacagggggccgccgcacctgggccctcctccgccccctccccatcagggtcatccgggagggtggggagcggccgcggccgctgccgccgctgctgcagcagccgcagccgccgctcacctgccaagcatggccggcggtcagcaaccacctccccaatcacttctgtacagtcaacctgggggattcacagtgaatggaatgctcagcgcaccaccgggaccgggcgggggaggaggcggggcaggaggtggtgcccagtcactggtacacccaggtttagtaagaggtgatacccccgagctggctgaacatcatcatcaccaccatcaccatgctcacccacatccgccgcatcctcaccacgcccagggccctccacatcatggcggaggcggcggcggagcagggcccgggctaaattcgcacgatcctcactcagatgaagacacaccaacgtcggacgatttggaacaatttgccaaacagttcaagcagcgccgtatcaaactcgggtttacacaggctgatgtaggactggccttaggcaccctctacgggaatgtattttctcaaacaacaatttgtcgcttcgaagctttacagctgtcgttcaagaacatgtgtaagctcaagcctctgctgaacaaatggcttgaggaagcagacagcagtaccggaagtcctacaagcattgacaagatcgcggcccagggcaggaaacgcaaaaaaagaaccagcatcgaagtttccgttaagggcgctctggaatcccacttcctgaaatgtcccaaacccagtgctcaggagatcaccaatttggctgactctctccagctggagaaggaagtcgtgcgggtctggttttgcaatcgacggcaaaaagagaagcgcatgactcctccgggaatccagcagcagactccagatgatgtatactcccaggtgggcactgtgagcgccgacacgccacccccacaccacggacttcagacttctgttcagtag

SEQ ID NO: 200435 - DNA, 1086 bp, Artificial Sequence
  Description of Artificial Sequence: Synthetic coding sequence
atggccaccgccgccagcaacccctacagcatcctgagcagcacctcactggtccacgccgattccgcaggaatgcaacagggctccccctttcgtaaccctcagaagctcctccagtccgattatctccaaggcgtgcccagtaatggccaccctctgggacaccactgggttacaagcctaagcgatggcggaccgtggtcttcaacccttgcaacctccccgcttgatcagcaggatgtaaagcccggccgcgaagacctgcagctgggagccatcattcaccatcgtagcccccatgtcgcccaccactctcctcatactaatcatccgaatgcatggggagcaagccctgcccccaatccatccattacctccagcggacagccccttaacgtgtacagtcagccaggttttacggtgtcgggcatgctggaacacggtggccttacgccccccccagccgcggcctccgcccaatccctgcaccctgtcctgcgcgagccacctgatcacggggaactggggtcccaccactgccaagatcactcagatgaagaaacaccaacatccgacgaattagagcagttcgccaagcagtttaaacagcgccgcattaagctgggcttcactcaggcagacgtaggcctagcactcgggaccctatacggcaatgtgttctcccagaccactatatgtcggttcgaggggcttcagctctcatttaagaacatgtgcaaactcaagcctcttctgaacaagtggctcgaggaggccgatagcagtaccggaagtccgacatctatagataaaattgctgcacagggaaggaaacgcaagaagagaacttcaatcgaagtgtcagtgaagggggtgctagagactcatttcttgaagtgtcccaagccagctgcccaggaaatctctagtcttgctgacagcctgcagctggagaaggaagtggtgcgcgtctggttctgcaatagacgccagaaggaaaaaaggatgacacccccaggcgaccagcagcctcacgaggtatacagtcacaccgtgaaaaccgacacatcttgtcatgacctgtag

SEQ ID NO: 200436 - DNA, 1260 bp, Artificial Sequence
  Description of Artificial Sequence: Synthetic coding sequence
atgatgagcatgaacagcaagcagccccacttcgccatgcaccccacacttccagagcacaagtatccgagcctccatagtagcagtgaagcaatccggcgggcttgcctcccaaccccaccgcttcagtccaacttattcgcttcacttgacgagacactgctggcccgcgccgaagcgctagctgcagttgatatcgctgttagccagggtaagagtcacccctttaaacctgatgccacctaccacaccatgaattccgttccatgcacgtctacttcaacagtcccattggctcaccatcaccaccatcaccatcaccaccaggctctcgagcctggagatctgctggatcatatcagctcaccatccctcgcccttatggctggtgcagggggcgcaggggccgccgccggtgggggtggggctcatgacggaccaggaggcggcggcgggccaggcggaggaggcggcccaggtggtggccctggtggcgggggcggaggcggcccaggaggtggtggcggcggccccggaggcggactgctgggcggtagcgcccaccctcatccacacatgcactccctgggtcacctgtcccacccggccgccgccgctgctatgaatatgcctagcgggctcccacacccgggactggttgcagctgcagctcatcatggcgctgcggcagcagcagcggcagctgccgccggccaggtagctgctgccagcgcagcagctgcagtggtgggggctgccgggcttgcgagcatttgcgattctgacaccgatccgagggaactggaggcctttgctgaacgcttcaagcaaagacggataaaattgggggtaactcaagctgacgttggcagcgcgttagctaatcttaagatcccgggtgtgggaagtctatcccagagcactatatgtcggtttgagtccttaacattaagccacaacaacatgattgctttgaagcctattctgcaggcctggctggaagaagccgagggagcccagagagagaaaatgaataagcccgagctttttaatggcggtgagaaaaagaggaagagaacatcaatcgctgcccccgagaagcggagtctcgaggcctactttgccgtgcagcctcggccatctagtgagaagattgccgccatagctgaaaagttagatctgaaaaagaatgtcgtgcgagtgtggttttgtaaccagagacagaagcagaaacgcatgaagttcagtgcaacatattag

SEQ ID NO: 200437 - DNA, 1911 bp, Artificial Sequence
  Description of Artificial Sequence: Synthetic coding sequence
atgaagaagctgcagggcgcccacctgcggaagcccgtgacccccgatctgctgatgacacccagcgaccagggggacgtcgacctagacgtagactttgcggcccaccgtgggaattggacaggaaagttagacttcctcctgtcctgcattggctactgtgttggtctcggtaatgtctggcgcttcccataccgggcctacactaacggaggtggcgctttcttggtcccctatttccttatgctggctatatgcgggatccccctcttttttcttgaactcagcctgggacaattctcttcattaggtcccctagcggtgtggaaaatctccccactgtttaagggagcaggggctgcgatgcttcttatcgtcggactcgtggccatctactacaacatgattatagcttacgtgctcttctacttgttcgcctctctcaccagtgacctgccatgggagcattgtggaaactggtggaatacagaactttgcctagaacacagggtatctaaagacggaaacggcgcattgcctttaaatctcacttgcacagtatcacctagcgaggagtattggtcaaggtatgtgcttcacattcaaggatctcagggcattggctcaccgggtgagattagatggaatctgtgtctctgccttttgctggcgtgggtaattgtttttttgtgtatactgaagggagtgaaaagctccggcaaggtggtgtatttcactgctacattcccatatctaattctgctcatgctccttgtccgtggtgtgacactccccggtgcttggaaggggatccagttttacctgacacctcagttccaccacctgctcagctctaaggtgtggatagaggctgcgcttcagatattttattccctgggcgtgggatttggcggattgcttacgttcgccagttacaacactttccaccagaacatctatagagacacattcatagttacgctcggtaacgctattacctcaatccttgctgggttcgcgatcttcagtgtcctgggttatatgtctcaggagctcggagtccccgttgatcaagttgccaaagcagggcctggtttagcattcgtggtgtatccccaggccatgactatgctccccttaagcccgttctggtccttcctctttttcttcatgctgttgaccctgggtttggattctcagtttgccttccttgaaaccattgtcaccgccgtgacagacgaattcccgtactacctgcgcccgaaaaaagcagtattctcagggttgatctgcgtagctatgtatctgatgggtctgatcctcaccacagacggcgggatgtattggttagtgctcctggatgactactccgccagtttcgggcttatggtggtcgtcatcacgacatgtctggctgttacccgggtatatgggattcagaggttttgtagggatattcacatgatgctggggttcaagcccggactctacttcagagcatgctggctgtttcttagtccagcaactcttctggccctcatggtttattcaatagttaagtaccagcctagcgagtatgggtcctaccgctttcccccatgggcggagctactcgggattctgatgggcctgctctcctgcttgatgattccagccggcatgttagtggctgtgttgagagaggaagggagcctctgggagcggttgcagcaggcaagtcgcccagctatggattggggtcccagtctggaagaaaaccgaacaggaatgtatgtggccacactcgcaggcagccagtcacccaagccgctaatggtccacatgaggaagtacggaggtataacttcttttgagaatacagcgatcgaggtggatcgcgagatagctgaagaagaggagtccatgatgtag

SEQ ID NO: 200438 - DNA, 798 bp, Artificial Sequence
  Description of Artificial Sequence: Synthetic coding sequence
atgcacttctaccggctgttcctgggcgccacccggcggttcctgaatccagaatggaagggcgagatagacaattggtgcgtctacgtgcttactagcctcctgccttttaagatacagagtcaagacattaaggcattacaaaaagaactggagcagttcgcaaagttactgaagcaaaaacgtatcactctagggtacacccaagcagacgtgggactgaccctcggtgtcctgtttggtaaggtctttagtcagacaacaatctgccgttttgaggcacttcagctctccttcaagaacatgtgcaagctaagaccactgctgcagaagtgggtcgaggaagctgacaataacgagaatttacaggagatatgcaaagcggagaccctcgtccaggcccgtaagagaaaacggacctccatcgaaaaccgagtgcgaggtaatttggagaacctttttctgcagtgccccaagccgaccctccaacaaattagccacatcgctcagcagctcggcctggaaaaggatgtagtacgggtttggttctgtaaccgccggcagaaagggaaaagatcaagttccgattacgctcagcgtgaagactttgaagccgccggcagcccattctcaggaggccccgtctctttccccctggcccccggcccccatttcggaactcctggctatggcagcccccactttacagcactgtactcgagcgtacccttcccggagggagaggccttcccccctgtttcggtcacgaccttagggtctcctatgcattccaattag

SEQ ID NO: 200439 - DNA, 1083 bp, Artificial Sequence
  Description of Artificial Sequence: Synthetic coding sequence
atggccggccacctggccagcgacttcgccttcagccccccccccgggggcggcggcgatggcccaggggggccggagccaggctgggtagaccctagaacatggctctcctttcaagggccccctgggggaccaggaattggacccggtgtgggccctggctctgaagtgtggggaatccccccctgcccccccccttatgagttttgtggcggaatggcgtattgtggtccgcaggtgggagtcggcctggtgcctcaggggggactggaaacttctcagccagaaggggaagccggggttggggttgaatcaaacagcgatggcgctagcccagaaccatgcacagtgacccccggagccgtcaaactagaaaaagaaaaacttgagcagaaccccgaggaatcgcaagatataaaggctctacaaaaggaactcgaacagtttgctaaactgttaaaacagaagaggatcaccctcggatatacccaggcggatgtgggcctcaccctgggagttctgtttggaaaggtctttagccagacaactatctgtcgtttcgaggccttgcaactaagcttcaaaaatatgtgtaagctgcgccctctgctgcagaagtgggtcgaggaagctgataacaatgaaaacctccaagaaatatgcaaagccgagacattagtgcaggcccggaagcgaaagcggacaagtattgaaaacagggtccgaggaaacctcgagaacctgtttctacaatgccctaaacctacacttcagcaaatttcccatattgcccagcagctcggattggagaaggatgtggtccgagtttggttctgtaatagaaggcaaaaaggcaaacgcagctcatctgattatgctcaaagagaggacttcgaggccgccgggtctccgttctctgggggaccagtttccttccccctggcacctggccctcatttcggcacccctggctacgggagccctcattttacagctctgtacagttccgtacctttccctgaaggcgaggcctttccaccagtgtccgtgacaacattagggtcaccaatgcattccaactag

SEQ ID NO: 200440 - DNA, 372 bp, Artificial Sequence
  Description of Artificial Sequence: Synthetic coding sequence
atggccggccacctggccagcgacttcgccttcagccccccccccggcggggggggcgatggcccagggggacctgagccaggctgggtggatccaaggacttggctgtcctttcaggggccccccgggggtcccgggatcgggcctggagtgggtccgggtagtgaggtgtggggaattcctccctgcccacccccttatgagttctgcggcggcatggcgtattgcggaccacaagttggcgtcggactggtcccccagggtggcctggaaacctcccagcccgaaggggaagccggggtcggtgtagagacaccaatggggcctccacgatcaccagccccgcatccctttcctttcccattgctatag

SEQ ID NO: 200441 - DNA, 558 bp, Artificial Sequence
  Description of Artificial Sequence: Synthetic coding sequence
atggccggccacctggccagcgacttcgccttcagccccccccccggggggggcggcgatggacccgggggccccgagcccggatgggttgatccaaggacctggctaagcttccagggccctccggggggccctggaatcggaccgggtgttggtccaggtagcgaggtgtggggcatacctccgtgcccccctccctacgagttttgtggcggaatggcatactgcggcccccaagtgggagtaggtctggtgccccagggcggtttagaaactagccagcccgagggtgaggctggagttggggtggagagcaattcagatggcgcttctcctgaaccttgcacagtcacacccggggcggtgaagttggaaaaagaaaaactcgaacagaaccctgaagagagtcaggatattaaagcacttcagaaagaactggaacagttcgctaaactcctcaagcagaaacggatcacacttgggtatacccaggcggacgttcatcccggcgggagcatctgggaaggcatacagcctaatgatcacctccccctctag

SEQ ID NO: 200442 - DNA, 558 bp, Artificial Sequence
  Description of Artificial Sequence: Synthetic coding sequence
atggccggccacctggccagcgacttcgccttcagccccccccccgggggaggcggcgacggacctggcgggcccgagcccggttgggtggatccgcggacgtggctctcctttcagggtcctcctggtggcccgggaatcggacctggcgtgggccccggatctgaggtgtggggtattcccccttgtccgcctccttacgaattttgcggaggcatggcctattgtggaccccaggttggagttggactggtgccccaaggagggcttgagacatctcaacccgaaggtgaggccggagtgggagtcgagtctaactctgatggagcgtctcctgagccctgtactgtgacacctggggccgtaaagttggaaaaagaaaagctggagcaaaacccagaggaatctcaggacatcaaagccttgcagaaagagctggaacagtttgccaaactattaaaacaaaagcgcatcacactgggttatacacaggccgatgttcaccccggtggatctatttgggaaggtatccaaccaaatgaccacctcccactctag

SEQ ID NO: 200443 - DNA, 495 bp, Artificial Sequence
  Description of Artificial Sequence: Synthetic coding sequence
atgtgcaagctgcggcccctgctgcagaagtgggtggaggaggccgataataatgagaatttgcaagaaatctgcaaagccgaaaccctggtgcaggcccggaaaagaaagcgcaccagtatcgagaaccgggtgaggggtaatttggaaaatctgttcctccaatgccccaagccaactttgcaacagatctcgcacatagcccaacagctgggtctggaaaaggatgtggttagggtgtggttctgtaacagacgccagaagggcaaacgctcaagtagcgattacgcccagagggaggattttgaagccgctggatctccattcagcggcggccctgtgagtttcccattggctccgggacctcactttggcaccccagggtatggaagccctcacttcacggctctgtacagctcagtgcctttcccggagggcgaggcctttccaccagtctccgtgaccaccctggggtcaccgatgcacagcaattag

SEQ ID NO: 200444 - DNA, 495 bp, Artificial Sequence
  Description of Artificial Sequence: Synthetic coding sequence
atgtgcaagctgcggcccctgctgcagaagtgggtggaggaggccgacaataatgaaaatctgcaagagatttgcaaggcggaaacgctggtgcaagcacgcaagagaaaacggaccagcatcgagaaccgagtgcgagggaacctcgaaaacctctttttacagtgccccaaacctactctgcaacagatctctcacattgcccagcaattaggcctcgagaaagacgtagtaagagtgtggttctgcaatcggagacagaaaggcaaaaggtcctcctcagattacgcccagcgggaagacttcgaggcagctggcagccctttcagcgggggaccagtttcattccccctcgcgccaggaccacattttggcaccccagggtatggaagcccacactttaccgcgctctactcgtctgtgccttttccagagggggaggctttcccacctgtatccgttactaccctcggttccccaatgcactcaaattag

SEQ ID NO: 200445 - DNA, 2076 bp, Artificial Sequence
  Description of Artificial Sequence: Synthetic coding sequence
atgagcgccctgctgcaggaccccatgatcgccggccaggtgagcaagcccctcctgtccgtgaggtccgagatgaatgccgagctgcgcggagaagataaggccgctacgtcagattcggagttgaatgagccactgctggcccccgtcgaatctaacgacagtgaagataccccttcaaagctgttcggcgctcgcggaaacccggcccttagcgaccccggtacgcctgatcaacatcaggcttcccagacacatccgccatttccggtgggcccacagcccctcttgacagctcaacagctcgcctccgccgtggccggcgtcatgccaggagggccaccagccttgaaccagcccatcttgatcccattcaatatggcagggcagttgggagggcagcagggcctggtattgacacttcccactgccaacctgactaacattcaggggttagtggccgcggctgctgcaggaggcattatgactctcccccttcaaaacctccaggctaccagcagtctgaattcccagctgcagcagctgcagctgcaactgcagcagcagcagcagcagcagcagcaacaacctccaccatcaaccaatcaacacccacaacccgccccccaggcacccagccagagccaacaacagcccctgcaacctactcctcctcagcagccaccaccagcatcacagcagccacctgcccccacctcccaactgcagcaggcacctcaaccccagcagcaccagcctcattctcattcccaaaaccagaaccaacccagtccaacacaacaatcatcttcacctcctcagaagccatcacagtctcctgggcacggcctgccatctcctctgacccctcctaacccactccagcttgtcaataatccccttgcgtcacaggccgctgccgccgccgccgccatgagcagcatcgcatcaagtcaggctttcggtaacgcgctgtcctcactacaaggagtgacaggccagctcgtgaccaatgctcagggacagataattgggactatccccctcatgcctaatccaggcccctcaagccaggcggcgtccgggacacagggcttgcaggtacagccaataaccccacagttactgacaaacgcccagggccagattatagccaccgtcattggcaatcagatccttcctgtcattaatacccaagggattactttaagccccataaaacctggccagcagctccaccagccatctcagacctccgtgggacaagcagcgagtcagggtaatctgctgcatcttgcacactctcaggcaagtatgagtcagtcccctgtgagacaagcttcatcaagttcgagctcttcttcaagttcctctgcattgagtgttggccagctcgtctctaatcctcaaacagctgcaggggaagtggacggggtcaacctggaagagatcagggagttcgccaaggccttcaagataagacgtctgtctctggggctcacacagacgcaggtgggtcaggcgctttccgcaaccgagggtccagcttatagtcaatctgccatctgccggcacacaatcctgcgcagtcatttcttcttgcctcaagaagctcaggaaaatacaattgcctcctcgctcactgctaagctgaaccctggattgctataccccgcgcgttttgaaaaactggacatcactccaaagtccgctcagaagattaaacccgtcctggagcggtggatggcagaggcagaggcccgccaccgagctggcatgcaaaatctcacagagttcattggatccgaacccagcaagaaaaggaaacgacggaccagcttcactccccaggccttagagatcctgaatgctcacttcgaaaagaatacacacccaagtggccaagaaatgaccgaaattgctgagaaactcaactacgatcgggaagtagtccgtgtttggttctgcaacaaaaggcaggccctcaaaaacaccatcaagagactgaaacagcatgagcctgctacagcagtcccgttggagcccctcactgatagcctcgaggaaaatagctag

SEQ ID NO: 200446 - DNA, 1968 bp, Artificial Sequence
  Description of Artificial Sequence: Synthetic coding sequence
atgagcgccctgctgcaggaccccatgatcgccggccaggtgagcaagccactgctctcagtccgttctgagatgaatgcagaactccgcggcgaagacaaggcagctacaagcgacagtgagctcaatgaacctttactggctcctgtggaaagcaatgattctgaagacacaccatctaagctgtttggcgcccgcggaaaccctgccttgagcgatcccgggacgcccgaccagcaccaagcctcacagacacatccaccgtttcctgtgggccctcagccacttctcacagcccagcaattggcgtctgctgtcgccggggtgatgccaggcggtccacccgctctcaaccagccgatactcatccctttcaatatggctggacaactgggcggtcaacagggtttggtcttgaccctacccactgctaacctgacaaacattcagggcttggtggccgctgctgccgccggagggataatgactctgcccttgcagaacttacaggctacctcatccctgaactcccagctgcaacaactgcagttgcagctgcagcagcagcagcagcagcagcaacagcagccacctccatctacaaaccagcatccccaacctgcaccccaagcgccttctcaaagccagcagcagcccttgcaacctacgcctccccagcagcctcctcctgcttctcagcagcccccagcccctacgtcacaactgcagcaggctcctcagccccaacaacatcagccacacagccactcacagaaccaaaaccagccttctcccacacaacaatcctcgtcccccccccaaaaaccctctcagtcccccggacacggccttcccagcccactgactccacctaacccgctgcaattggtgaacaatcccctcgctagtcaagcagcagccgcagcagccgccatgtcttccatcgcttccagccaggcatttggcaatgcactgtcaagccttcagggcgtgactggtcagctcgtcactaacgcccagggtcaaatcatcgggactattccactgatgccgaacccaggccccagcagccaggcggcttccgggactcaaggcttacaggtacagccaatcaccccccaactactcaccaacgcccagggacaaattatcgcaaccgtgatcggtaaccaaattttgcctgtgattaacactcaggggatcaccctgagcccaattaaacctggccaacagctacatcagccatcacaaacgtcagtcggacaagctgcctcccagggaaacctgttgcatctcgcccatagccaagcctcaatgtctcagagcccagttcgccaggccagcagctcatccagttctagctctagttcatcggcccttagcgtgggtcagctcgtcagcaatccacagacggccgccggcgaggtagatggtgtgaatctggaggaaatccgagagtttgccaaagcattcaaaattcggcgcctgagcctaggactgacacagacacaagtcggacaggccttgagtgccacggaagggccagcctactcacagtcagccatttgcagatttgaaaagctggacattacacctaaatcagctcagaagataaagcccgtccttgagcgctggatggcggaagccgaggcccgccatcgggcaggaatgcagaatcttaccgagttcattggttcggagcccagcaagaagcgcaaaagacgcaccagcttcacacctcaggcgttagagatactgaatgcacattttgagaaaaacacacacccatcggggcaggagatgacggagattgccgagaagctgaactacgaccgtgaggtcgttagggtatggttctgcaataaaagacaagcgttaaagaatactattaagcgactcaagcaacatgagcccgccacagccgtgccgctggaaccactcacagactccctcgaagaaaattcatag

SEQ ID NO: 200447 - DNA, 2076 bp, Artificial Sequence
  Description of Artificial Sequence: Synthetic coding sequence
atggagaagatctacagccggggcgagctgcaccacttcatcgacggtttcaacgaagagaagagtaactggatgcgttacgtaaaccccgcgcactcaccaagagagcagaacctcgcagcctgtcagaacggaatgaacatctacttttacactatcaagccaatacctgctaaccaggagctgctcgtctggtattgtcgcgattttgctgaacggctccactacccttaccccggggagctcacaatgatgaatctgacacaaactcagagctccctgaaacagccttctacagagaaaaacgaactgtgtcccaagaatgtgccaaagagggaatattctgtgaaagagattctcaagctcgatagtaatccatcaaaagggaaggacctttatagaagtaatataagtccactgacatccgagaaagatctcgatgatttcagaagacgcggcagtcccgagatgccattctacccgagagttgtctaccctattagggctcccttacccgaggacttcctgaaagcctcactcgcatatggcatcgaaaggcctacctacatcacccgaagccctattccatcgtccacgactccaagcccctcagcccgttcgtcccccgatcagtcactcaaatctagcagtccacatagcagccctggcaataccgtctcacctgtgggccccgggtctcaggagcatagggattcctacgcttacctcaacgcatcctacggaaccgagggactgggaagctaccctggctatgcacccctgccccacctgccccctgcgttcattccttcatacaacgctcactaccccaagttcctgctcccaccgtacgggatgaactgcaatggactgtcggccgtgagctccatgaacggcatcaacaacttcgggcttttcccccggctgtgcccagtttactctaacctattaggcggcggttcattgcctcatccgatgctgaatccgacctctcttccatccagtctccctagcgatggggcccggaggctcctgcagcccgagcatccccgggaggtgttggtgccagccccccattctgccttcagctttactggcgccgcagcgtccatgaaggataaagcatgcagtccaacatctgggtcaccaaccgctggtaccgccgctactgcagaacacgtggtgcaaccgaaggccacttctgctgcaatggcagcgccctcgagcgacgaagcgatgaatctgatcaagaacaagaggaacatgacagggtataagaccctgccatacccccttaagaagcagaacgggaagatcaagtacgaatgtaacgtttgtgctaagacattcggacaattatctaatctcaaggttcacctccgtgtgcattccggcgagcggccttttaagtgccagacctgcaacaagggattcacacagttggcacatctccagaaacattacctggtgcacaccggagagaaaccgcacgaatgccaggtgtgccacaagagattttcaagtactagtaatctgaagacccatctgcggctccacagcggcgagaagccatatcagtgcaaagtgtgtcccgctaaattcacccagttcgtccatctcaagcttcacaaaaggttgcatacacgcgaacgcccgcacaagtgtagccagtgccataagaactacattcacttgtgctccttgaaagtacacctgaagggcaactgtgcagctgctcctgccccaggtttaccgctggaagacctcactaggataaatgaggagattgaaaagttcgatataagcgataacgccgataggctggaggacgtcgaggacgacatctccgtgatttcggtggtggaaaaggagattttggcagttgtcaggaaggagaaagaagaaactggtctgaaggtgtctctgcagcggaatatgggcaacggtctcctgtcatccggatgtagtctgtacgagtcaagtgatctgcctctaatgaaactgcctccctccaacccactgcccctggtcccagtaaaagtgaagcaggaaaccgtcgaacctatggatccatag

SEQ ID NO: 200448 - DNA, 2370 bp, Artificial Sequence
  Description of Artificial Sequence: Synthetic coding sequence
atgaagatggacatggaggacgccgacatgaccctgtggaccgaggccgaattcgaggagaagtgcacttacattgtcaatgatcacccctgggacagtggagccgacggaggtacttctgtgcaagccgaagcaagccttcctcgcaatctgctatttaaatacgcaactaacagcgaggaggtgatcggagtgatgagcaaagaatacattcctaagggtactcgtttcggccccctcattggcgagatatataccaacgacactgtgccgaagaatgcaaacagaaagtacttttggagaatctactcccgcggcgaactgcatcacttcatcgatggctttaatgaggaaaagtccaattggatgcgttacgtgaaccccgcccattcaccaagggagcaaaatctggctgcttgccagaatgggatgaacatctatttttacaccatcaagcctattcctgctaaccaggaactccttgtgtggtactgccgcgactttgccgagagactgcactacccttacccaggtgagctgacaatgatgaacctgacccaaactcagtcgtccttgaaacagccgtctaccgagaaaaacgaactctgccccaagaatgtgcccaaacgagagtactctgtcaaggaaattctcaagttggactctaatccttcaaagggcaaagatctctaccgcagcaatattagccccctcactagcgaaaaggaccttgacgactttagaagacgtggatccccagagatgccattctatccccgagtagtgtaccctatacgggcacccctgcctgaggattttctcaaggcctctctcgcatacggcatagagagaccaacatatatcactcggtctcccatacctagttctaccaccccttcaccatccgcgcgcagctctccggaccagtcgctaaagtctagctctccacacagctctcctggaaataccgtttcacctgttgggcctggttcacaggagcatagggactcctacgcctatctcaacgctagttacggaaccgagggtttaggttcttatcccggctacgccccgctgccgcatctgcctcccgcattcattcctagttataacgcccactatcctaaattcctgctgccaccttatggcatgaactgcaacggcctcagcgctgtgtcttctatgaacggcatcaacaatttcggattgttccctagactgtgccctgtatactccaatctgctgggtgggggcagtttgcctcaccctatgctcaatccgacgagtctcccatcttccttaccaagtgatggtgctagacggttgctgcagcctgagcatccccgcgaggtgcttgtgcccgcaccccactcggccttttcattcactggagctgctgcctcaatgaaggacaaagcttgcagccccactagcggatcccccaccgcaggaacagccgccacagcagagcatgtggtccagcctaaggctacatctgctgccatggccgctccgtcctctgatgaagccatgaaccttattaagaataagcggaatatgactggttataagactttaccataccccctgaaaaaacagaacggcaagatcaaatacgagtgtaatgtgtgtgctaagacattcggacagctgtccaatttgaaggtacacctaagagttcacagcggtgagcggccattcaagtgtcagacttgtaacaagggcttcactcagctggcccatttgcagaagcactacctggtgcacacgggtgaaaaaccccatgagtgtcaagtctgtcataagagattctcgagtacgtcaaacctcaagacacatcttcggctgcatagcggtgagaaaccctatcagtgcaaagtttgccccgccaaattcactcagtttgttcacctcaagttgcacaaaagactgcatacacgggagcggccacacaagtgctcgcagtgtcataagaactacattcacctgtgcagtcttaaggttcatctgaaaggaaactgtgccgccgcacccgcacccggtctgcctctggaggacctcacccgcatcaatgaagagatagagaagtttgatatctctgacaacgcagatcgcctcgaagacgtagaagacgacatctccgtgatttctgtggtggagaaagagatcctggccgttgttcgtaaggaaaaggaggaaacaggactgaaggtttctctccagcggaacatgggcaacggactgctcagcagcggttgtagtttgtatgaatcctccgacctccctttgatgaagttacccccaagcaacccactccctcttgtgcccgtgaaagtgaagcaggaaaccgtcgagcctatggatccgtag

SEQ ID NO: 200449 - DNA, 2478 bp, Artificial Sequence
  Description of Artificial Sequence: Synthetic coding sequence
atgctggacatctgcctggagaagcgggtgggcaccaccctggccgcccccaagtgcaactcctcaacggtgagattccagggactcgccgaggggaccaagggaacaatgaagatggacatggaggatgccgacatgacactttggacagaggcagaattcgaagagaaatgcacttacattgtgaacgaccacccttgggacagcggagctgacggcggtaccagtgtgcaggctgaggcttcgctgccacgtaacctcttgtttaagtacgccacgaattcagaggaggtgataggcgtcatgagcaaggagtacatccccaaaggcacccgcttcgggccacttataggcgagatctataccaacgatactgttccaaaaaacgcaaaccgcaaatatttttggagaatctattcccgcggggagctgcatcactttattgacggctttaacgaggagaagagcaactggatgcggtacgtaaaccccgcccacagccctagggaacagaacctggctgcatgtcagaacggcatgaatatttacttctatactataaagccaattcccgcgaatcaggagctcctcgtgtggtactgcagagacttcgccgagcggctgcactacccttatcccggcgaactgacaatgatgaacctgactcagactcagagcagccttaagcagccttcaactgagaagaacgaactctgcccaaaaaatgtcccaaaaagagaatactctgtgaaggaaattctgaaattggactccaaccctagcaaagggaaagacctgtatcggagcaatatatccccattaactagtgaaaaagatctcgacgactttagaagacgtgggtccccagaaatgcccttttatcccagggtggtctaccctatccgcgccccccttccggaggacttcctgaaggccagccttgcatatggtatcgagagacccacatacatcacgcgctcccctattcccagcagcactactccttccccaagcgctcggtcctcccctgaccagtctctgaagtcctctagccctcactcaagtcccgggaatacagtatcacctgtcggccctggcagccaagagcaccgggactcgtatgcgtatcttaacgcaagctacggaactgaaggcctcggctcatatccagggtatgcgcctcttccacacttgccacccgcctttattccttcctacaatgctcactacccgaagtttcttttgcccccctacgggatgaactgtaacggtctgagtgctgtgtcctctatgaatgggatcaataatttcgggctgttcccgaggctctgtcccgtgtatagtaacttgcttggcggtgggagcctgccacaccctatgctaaacccgaccagtctgccaagttctctgccaagcgacggggcgcggcgactacttcagccagaacaccctagggaagtcctggtgcccgccccgcatagtgctttctctttcactggagccgcggcctctatgaaggacaaggcgtgtagtccgacctcaggaagccccacagctggaacagccgccactgccgagcatgtggtccagcctaaggccactagtgcggccatggccgccccaagcagtgatgaggctatgaaccttatcaaaaataagcggaatatgacaggctataaaacactgccttatccgctgaagaaacaaaacggaaaaatcaagtacgagtgcaatgtatgcgccaagacttttggacagctgtcaaacctgaaggttcatttgcgcgtgcactctggcgaacggcccttcaagtgccagacttgcaataaaggcttcacccaattagctcacctgcagaagcattacttagtacacacaggagagaagccccatgagtgccaggtgtgccataagagattctctagtacttccaatctgaagactcaccttcgcctgcacagcggggagaaaccctatcagtgtaaggtctgtcctgccaaattcacacagtttgtccatcttaaactccacaagcgtctgcacacccgggagcgacctcataagtgctctcaatgccacaagaactacatccatctgtgttccctcaaagtccacttaaagggtaactgtgctgccgcacctgcccccggtctgcctctagaggatctgacccggatcaacgaagagatcgaaaagtttgatatttccgataacgccgatagactggaggacgtggaagacgacattagcgtgattagcgttgtagaaaaagagatcctggctgtggtgcgaaaggagaaggaggagactggtctgaaagtttctctccaaagaaacatgggcaacggcttgctgtcaagtgggtgcagcttgtacgagtccagcgatctgccactcatgaagttgcctccttccaaccctttgccactggtgccagtcaaggtcaaacaggaaaccgtcgaaccaatggatccatag

SEQ ID NO: 200450 - DNA, 192 bp, Artificial Sequence
  Description of Artificial Sequence: Synthetic coding sequence
atgaagatggacatggaggacgccgacatgaccctgtggaccgaggcggaattcgaagaaaagtgcacgtatattgtgaacgatcacccgtgggactccggtgccgacggtggcacaagcgttcaggctgaggctagtttgcccaggaaccttctctttaaatatgcaacaaattccgaggaggtaatttag

SEQ ID NO: 200451 - DNA, 2367 bp, Artificial Sequence
  Description of Artificial Sequence: Synthetic coding sequence
atgaagatggacatggaggacgccgacatgaccctgtggaccgaggccgagtttgaagaaaaatgcacgtacatcgtcaacgaccacccgtgggactccggcgccgacggtggcacctccgtccaagcggaagcgtcgctccctcggaaccttctgttcaaatatgcaactaattccgaagaagtcatcggggttatgtccaaggaatatattcctaagggaacacgattcggacccttgataggcgagatatacaccaacgatactgtccctaaaaatgccaatcgaaaatacttttggagaatttactcgagaggtgaactgcatcactttatcgacgggttcaacgaagagaaatccaattggatgcgctacgttaatccagcccatagccctagggagcagaacctagctgcatgtcagaatgggatgaatatttatttctacaccataaaaccgatacccgctaaccaggagcttcttgtttggtactgccgggatttcgccgaaaggctccactatccctatccaggcgagctaactatgatgaatctgacacagacacagtccagcctgaagcagccaagcactgagaagaacgaactctgtcctaaaaacgtgccgaagcgtgagtatagcgtcaaggagattctgaagctggactccaacccttctaaggggaaggacctgtacagatctaacatctcgcccctcacgtccgagaaggatctggacgattttaggcgtcggggtagcccggaaatgccattctatcctcgtgtggtatatccaatccgggcaccgctgcccgaggacttcctgaaggcttccctggcctacggtatcgaacgacccacatatatcactagaagcccaataccatcatcaacaacaccttcaccctctgcgaggtcgagccctgatcagtccctgaagagttcatctccgcattcctcaccaggcaatacggttagtccggtaggtcctgggagtcaagagcatagagactcatatgcctatcttaatgccagctatggcaccgaaggactcgggagttatcctggatatgcaccactgccacatctgcctcctgcatttattccttcgtacaatgcccactatccgaaattccttctccccccatatgggatgaactgcaatggactgtccgcggtcagctccatgaatggcatcaacaattttggtctgtttccccggctctgccccgtgtactcgaacctgctgggtgggggctctctaccgaccccctgttccactccactgttgccgtcaagtctgcctagtgacggcgctagacggttgctgcagccagagcaccctagggaagtcttggttcctgcacctcactctgctttctcttttacaggagccgctgcttcaatgaaagataaggcgtgctcacccacatccggaagccccacagccggaaccgccgcgacggccgagcatgtggtgcagcccaaggcaacaagcgccgccatggccgctccctcttcggacgaggcgatgaacctgatcaagaataagagaaacatgactggttacaagacattaccctatccactcaagaagcaaaacggaaaaattaagtacgagtgcaatgtctgtgccaaaacatttggacagctcagtaacctgaaagtgcacttaagggtgcacagcggcgagagacctttcaagtgccagacgtgcaacaaagggttcacccagctggcacacctgcaaaagcattacttggtgcatacaggcgagaagccgcacgagtgccaggtgtgtcacaagagattcagctctacctctaatctgaaaactcatctgcgtctacacagcggagagaaaccatatcagtgcaaagtgtgcccagccaagttcactcaattcgtgcacctgaaactgcataagcgactccacacccgggaacgcccacacaaatgctcccagtgccataagaattatattcatttgtgttcgctgaaagtgcatctcaaaggaaattgcgccgccgcaccggcaccggggttaccactggaggacttaactcgcattaatgaagaaatagagaaatttgatatctctgacaacgcagaccgtctcgaggacgtggaagacgacattagcgtgatatccgttgtggaaaaggagattttggccgtcgttagaaaggagaaggaagagaccggactcaaggtatccctgcaaaggaacatgggcaacggcctgctaagcagtggatgttcactctatgagagtagcgacctccccctaatgaaattacctccatctaatccgctgcccctggtgccagtcaaggtaaaacaggagacagtggagcctatggatccttag

SEQ ID NO: 200452 - DNA, 1716 bp, Artificial Sequence
  Description of Artificial Sequence: Synthetic coding sequence
atggccctgccccggcccagcgaggccgtgccccaggacaaggtgtgctatccccctgagtcttctccacaaaacctggctgcatattatacacccttcccatcctacggccattacagaaattccctggcaaccgtggaagaagattttcagccatttcgccagctagaagcagccgcaagtgcagcacctgccatgccccctttcccttttcggatggcgcctccattgctttccccgggactgggactgcagcgcgaaccactttatgacttgccctggtacagtaagcttcctccctggtaccccatccctcacgtcccacgagaggtacctccatttctgtctagttcacatgagtacgctggggcatcttccgaagacctgggacatcagatcattggcggagataacgagagcggcccatgttgcggccctgacacactgatccctcctcctccggccgacgcaagcctgcttccagaaggcctgagaacttcacagctgctcccttgtagtccttcaaagcaatccgaggacggcccgaagccttccaaccaggaaggcaaatcacccgcccgttttcagttcactgaagaagacctccattttgtgttgtacggtgttactccttcactggagcatccggcctccttgcaccacgcgatatcagggctcctcgtgcccccggattccagcggcagtgacagcctacctcagacgcttgacaaagattccttacaactgcccgagggtctgtgtcttatgcagacggtgtttggggaggtcccacatttcggagtcttttgctcttcatttattgccaaaggagtgaggttcgggccgtttcagggtaaggtggtgaatgcctcggaggtgaagacttacggcgataattcggttatgtgggagatcttcgaggatggtcatctgtcccattttatagacgggaagggcggcacaggcaactggatgtcttacgtgaattgtgctagattccccaaggaacagaacttggtggccgtccagtgtcagggccacattttttatgagtcctgtaaggagatccaccagaaccaagaattgctcgtatggtacggggattgctatgaaaagttcctggacatccccgtgtcattacaggttacagaaccaggaaaacagccttccggacccagcgaggagtccgctgagggatatcgctgtgaacgctgtggcaaggtcttcacctataaatattaccgcgacaaacacctgaaatacaccccctgcgtggataagggtgaccgaaaattcccttgcagcctttgcaagcgatccttcgagaaacgagacagactgagaatccacatccttcatgttcacgagaaacatcgaccccataagtgttcaacctgcggcaaatgtttttcccagtcgtcttccctcaacaagcatatgcgagtgcacagcggggacaggccctaccagtgcgtctattgcaccaagagatttacagcttcgtccattctgcgtacacatattagacagcacagtggcgagaaaccttttaagtgcaagtattgcggaaaaagtttcgctagccacgcagctcatgactcacacgtcagaagatctcacaaggaggatgatggctgctcttgctcaatttgcgggaagatattttcggaccaggaaaccttctactcccatatgaagttccacgaagattactag

SEQ ID NO: 200453 - DNA, 303 bp, Artificial Sequence
  Description of Artificial Sequence: Synthetic coding sequence
atggccctgccccggcccagcgaggccgtgccccaggacaaggtgtgttatccccctgaatcctcccctcagaatctcgccgcctactacactcccttcccatcctacgggcattataggaattcattagctaccgttgaggaggatttccaaccttttcggcagctggaggccgcggccagtgctgctccagctatgcctccgtttcccttcaggatggcaccaccccttctctcccctggtctgggcctgcagagggaaccactttacgatttgccgtggtactccaaattacccccatag

SEQ ID NO: 200454 - DNA, 3831 bp, Artificial Sequence
  Description of Artificial Sequence: Synthetic coding sequence
atgcggagcaaggcccgggcccggaagctggccaagagcgacggcgacgtggtgaataatatgtatgagccaaatagagacctgctggccagtcactccgccgaggatgaagcagaggattccgcgatgagccccattccagttggacctccctctccctttcccaccagtgaagatttcactccaaaggaggggtccccttatgaagctcccgtttacatccccgaggacatccctatccctgctgactttgaactccgcgaatccagtatccctggagcaggcctgggcgtctgggcaaagagaaagatggaggcaggagagagactaggtccgtgtgtggtcgtgccacgtgcagctgctaaagagacagattttggatgggagcagatcctgacggatgtggaggtgagtcctcaagaaggttgtatcacaaaaatctctgaggacctgggctcggaaaaattttgtgtggatgctaaccaagccggtgcgggcagctggctgaaatacattcgcgtggcctgcagttgcgatgaccaaaacctgacaatgtgccaaatcagcgagcagatctattacaaagtgatcaaggacatcgaaccgggtgaagagctgttggtccacgtgaaagaaggagtctatcccttggggactgtgccacccggtctggacgaggagcctacctttaggtgcgacgagtgtgatgagctattccagagtaaactggacctccggagacacaagaagtatacctgtggctcagtcggtgccgccctctacgagggcctggccgaggaactgaaacctgaagggctgggaggagggtccggccaggctcatgagtgtaaggactgcgaacgcatgtttccgaataaatattccctcgagcagcacatggtgatccacactgaggagcgggagtacaagtgcgaccagtgtccaaaagcattcaactggaagagcaatcttattcgtcaccagatgtcacatgactccggcaaaaggtttgaatgtgagaactgcgtcaaagtctttacggaccctagtaaccttcagcggcacattcgcagtcagcatgtcggggcccgagcacacgcttgtcccgactgcgggaaaacatttgctacctcttctggcctgaagcagcacaagcatatacacagcaccgttaagccttttatttgcgaagtctgtcataagagctacacgcagtttagcaatctgtgccgccataagcgcatgcatgccgattgccgaacccaaatcaagtgcaaggattgcgggcaaatgttcagcactacatccagcttgaataagcaccggagattctgcgagggtaaaaatcattacacaccaggcgggattttcgcgcctgggctgccactgaccccaagtcccatgatggacaaggccaagccttctccaagtttaaatcacgcttccctggggtttaatgagtacttcccttctcgaccccaccctggctccctgccgttttccacggcgcctcctaccttcccagctcttacccctggattccctggaatttttcctccctcactttatccaaggcctcctctactgccccccacttctctgctaaagtcaccccttaaccatacccaagacgcaaagctgccttcgcctctggggaatcctgcactaccactcgtctccgccgtgagcaattctagtcagggcaccacagctgcagcaggccctgaggagaagttcgagtcccgactggaggactcgtgtgttgaaaaactcaagacaagaagtagtgacatgtctgacggtagtgattttgaggacgtgaacaccaccaccggcacagatttggatacaacaacggggactggatccgatctggatagcgatgtcgacagcgaccctgacaaagacaaaggcaagggcaaaagtgccgaagggcagcccaaattcggcggtgggctggctccaccgggcgcacccaatagcgtggcagaagtacctgtgttttatagccagcacagcttttttccccctcccgatgaacaactgctgactgcaactggagcagccggagatagtataaaggcaatcgcctcaatagccgagaaatacttcggacccggatttatggggatgcaagaaaagaagctcggctcgctgccatatcatagtgccttcccattccagttcctccccaattttccccacagtctgtaccctttcacagatcgggcactggctcacaatttacttgtgaaggctgagccgaaatccccacgcgacgcgctgaaagtggggggtccttctgctgaatgtccatttgatttaactacgaagccaaaagacgtcaagcctatcctgccgatgccaaagggacccagcgcgcccgcaagtggggaagagcaacccctggacctgtccattggtagcagagcaagggcttctcagaacggggggggcagagagccacgtaaaaatcatgtgtatggcgagcggaaactgggcgcaggcgagggtctgccccaggtctgccctgccaggatgccacagcagccaccattacattatgcaaagcccagtccattctttatggaccccatctactcgagagtggagaagaggaaagtcactgaccctgtgggggcactaaaagagaagtacctccgcccatcaccgttactgttccacccacaaatgagtgcaattgagactatgaccgaaaaactcgagtctttcgctgctatgaaggctgatagtgggagttcattgcaacccttgccccatcacccttttaacttcaggtccccaccacccactctatctgatcctatccttcgaaagggtaaggaacggtatacatgtcggtattgtggcaagatctttccacgtagcgcgaatctgacacggcacttgcgaacgcacactggtgagcagccttatcgctgcaaatactgtgacaggagcttttccatatcttcgaatctgcaacgacatgtgaggaacatccataataaggagaaaccgttcaaatgccacctatgcaacaggtgcttcggacagcagactaatcttgaccgacatctgaagaagcacgaacatgagaacgctcctgttagccaacaccccggcgtgcttaccaaccatttgggaacaagtgcttcaagccctacctctgaaagtgataatcatgctttgctcgatgagaaggaggattcgtatttcagcgaaattaggaacttcattgccaactctgagatgaaccaagccagtacgcgcactgagaagcgagcagatatgcagattgtggatgggagcgctcagtgtcccggcctagcgtccgaaaagcaagaggatgtggaggaagaagacgatgacgacctggaggaggacgacgaagatagcctcgcaggtaaatcccaagatgatactgtgtcacccgcaccagagcctcaggccgcgtatgaggatgaggaagacgaggagccggcggcgagcttagcagttggcttcgaccataccaggagatgtgccgaggaccacgaagggggcttgctggcactggagcccatgccgactttcggcaagggactcgatctgcgacgagccgctgaggaggcttttgaggtcaaggacgttttaaactctactctggatagtgaggctctgaagcataccctgtgccgtcaagccaagaatcaggcctacgccatgatgctatccctgagtgaggatacccctcttcacaccccatcacagggctccttggacgcctggctcaaggtcactggggctacctccgaatccggcgccttccaccctataaatcatctatag

SEQ ID NO: 200455 - DNA, 3831 bp, Artificial Sequence
  Description of Artificial Sequence: Synthetic coding sequence
atgcggagcaaggcccgggcccggaagctggccaagagcgacggcgatgtagtcaacaacatgtatgaaccaaatcgggatctccttgcaagccacagtgcagaggatgaagcggaggatagtgccatgtcacctattcccgtgggacccccctctccttttccaacaagtgaggacttcactcctaaggaagggtccccctatgaggcaccagtgtacatcccagaggacattcccatacccgccgatttcgagttgagggagtcttccattcctggcgctgggctgggcgtttgggctaagcgcaagatggaagctggtgagcgacttggtccctgcgtggtggtccccagagccgctgccaaggagactgacttcggttgggaacagatccttactgacgtagaagtgtcaccccaggaaggatgtatcactaagatcagcgaggatctcggaagcgagaagttctgtgtggacgccaatcaggcaggagctggctcctggttaaagtatatccgggttgcctgttcttgtgatgaccagaacctgacaatgtgtcagattagcgagcaggtgatctactacaaagtcatcaaagacatcgagcctggcgaagagcttctggtccatgtgaaggagggagtgtatccactaggaactgttccacctgggctggatgaggaaccgacttttcggtgtgatgagtgtgacgaactgtttcagtccaagctggacctccgcagacataagaaatacacttgcggatccgtgggagccgctttgtacgaggggctggctgaagagctgaaaccggaggggctggggggcgggagtggccaagcgcatgagtgtaaagactgcgaaagaatgtttcccaataaatacagcctcgagcagcatatggtgattcacactgaggagcgggaatataaatgtgatcagtgccccaaggccttcaactggaagtctaatttgatacggcaccaaatgagtcatgactctgggaaaaggttcgagtgtgagaattgtgtcaaagttttcaccgacccgtccaatctccagcgccatattcggtcgcagcatgttggcgcacgggctcacgcctgtcctgattgcggcaaaaccttcgccactagctccgggttgaaacagcataaacacatacactcaacagtaaaaccattcatctgcgaggtgtgtcataaatcttatactcaattttctaatctctgtagacacaagagaatgcatgccgattgcagaacacaaatcaaatgcaaagattgcggtcagatgttctccactactagttcactgaacaagcacaggaggttctgtgaaggaaagaaccactacacccccggtggtattttcgccccggggctgccactgacaccatcccccatgatggataaggcaaagccatctccgtcactgaaccacgcgtccctgggctttaacgaatacttcccctcacgtcctcatccaggttccctccccttctctacggcaccccccacatttcccgccctgactccagggttcccagggatattcccccccagtctttaccctagaccacccctgttgcccccgacgagtctcctgaaatctcctcttaaccacacccaggacgccaaactgccttccccgctcggaaatccagcccttcccttggtctctgcagtgtcaaactccagccaaggtacaactgccgccgcggggccagaggagaaatttgagagtcggcttgaagactcttgcgttgaaaaactcaaaactaggtccagtgacatgtctgatggatcggacttcgaggacgtcaacactacaactggcaccgatctagacactaccactgggactggatcagacctagactcagacgtcgatagtgatcctgacaaggacaagggtaagggcaagagcgcagaggggcagcccaaattcggaggcggcctcgcccccccaggagctccgaacagtgttgctgaggtccccgtgttctattcacaacactccttctttcctcctccagacgagcaacttctgacggccactggggcggctggcgattccatcaaggctattgcatcaatcgcagaaaagtatttcggcccaggctttatgggcatgcaggaaaaaaagctggggagcctgccatatcacagtgccttcccctttcagtttcttccaaacttcccacactctctgtaccccttcactgaccgcgccctggcgcataatctattggtgaaggctgaacccaagagcccaagggacgccctaaaggtagggggtccttccgcagagtgcccctttgaccttacgaccaaacccaaagacgtgaagcctatcctccccatgcctaaagggccctctgcgccggcctcaggcgaggagcagcctttagatttgagtatcggcagtcgcgcacgtgcatctcagaatggaggaggccgagaaccacgcaagaaccacgtctacggtgagcggaaactgggggccggcgaaggcctcccgcaggtgtgccctgcacgcatgcctcagcagcctccattacactacgccaagccgagccctttctttatggaccccatttaccgtgtggaaaaacggaaagtcacggacccagtgggagccctcaaagagaagtacctccggccttccccactcctgtttcatccgcaaatgtctgcaatagaaacgatgaccgaaaagctggaatccttcgccgccatgaaagctgacagcggatcctctctgcagccactcccccaccatccgtttaatttcaggtcccccccgccaactttatctgatcctatactgcggaagggtaaagaacggtatacttgcagatactgtggcaaaatcttccccagatctgcgaaccttacccgacatctgcgaacgcatactggggaacagccctacaggtgcaagtactgcgaccgttcatttagtatctcttccaatttacagcgacatgtgaggaatattcataacaaggaaaaaccttttaaatgccatctgtgcaataggtgtttcggccaacagacgaacttggaccggcatcttaagaaacatgagcatgagaatgcgccagtatcccaacatcccggcgttttgactaaccacctgggtaccagcgccagttcccccacctccgaatctgataaccatgcccttctggacgaaaaggaagattcctactttagcgaaattaggaattttatcgccaactcagagatgaatcaagcttctacaagaacagagaagagggcggacatgcaaatcgtagacggttccgcccagtgccccggcttggcaagcgagaagcaggaagacgtggaggaggaagacgacgatgatctagaggaggatgatgaggacagcttggcgggcaaatcccaagatgacactgtctcaccagcacctgagccacaggccgcttacgaggatgaggaagatgaggagccagccgcttctctcgccgtcgggtttgatcacacccgcaggtgtgcagaagaccacgagggcggtcttctggcactggagcccatgcctaccttcggaaagggcctggacctgcgccgcgcggctgaggaagcgtttgaggtgaaagatgtgctgaactccacactggacagcgaggctcttaaacatactttgtgcaggcaggctaagaaccaggcctacgccatgatgctgagcctgtcagaagacacccctctccacacccccagccaagggtcattagatgcctggctgaaggtaactggggcaactagtgagagcggtgcctttcacccaatcaatcatctgtag

SEQ ID NO: 200456 - DNA, 3279 bp, Artificial Sequence
  Description of Artificial Sequence: Synthetic coding sequence
ttctgcgcctacagcgccaagatctactacaaggtgatcaaggacatagaacccggggaagaacttctggtccatgttaaggaaggcgtctatcctttggggacagtccccccaggacttgacgaggaacccacattcaggtgtgacgagtgcgacgagttgttccagtccaagcttgacctgcgccgccataagaagtacacatgtggatcagtgggtgcagctctttatgagggactggctgaagagttaaagcccgagggcctgggaggaggtagcggacaggctcacgagtgcaaagactgcgaaagaatgttccctaataagtacagccttgagcagcatatggtaattcacacagaggaaagagagtacaagtgcgaccaatgtccaaaagcttttaactggaagagcaatctgatcagacaccaaatgtcgcacgatagcgggaagagattcgagtgcgagaactgcgtgaaagtcttcactgacccgtcgaatctgcagcggcacatccgctctcagcatgtgggggcaagggcccacgcttgccccgattgcggcaaaaccttcgccaccagttcaggcctcaagcagcataagcatatccatagtactgttaagccgttcatctgcgaggtctgccataagtcatacacacagttttcgaacttgtgtaggcataagcggatgcacgccgattgtcgcacacagattaagtgtaaggactgtggtcagatgtttagcacaactagctctcttaacaagcacaggcgcttttgcgaggggaagaatcattacactcccggtggcattttcgctccaggactgccattaaccccaagtcctatgatggacaaagccaagcctagtccatctctcaaccatgcctctcttgggttcaatgaatacttccccagccggccacatccaggaagtcttccattttccaccgcaccacccaccttcccagctctgacaccagggttcccaggcattttcccacccagcctgtatccccgaccaccattgcttcctcctacgtccctcctaaaatcccctctcaaccatactcaagatgcaaagcttccctccccactgggaaatcctgccctcccattggtgagcgccgtgagcaactcatcccagggtactacagcggccgctgggcctgaggaaaagttcgagtccagattggaggattcttgcgtcgagaagctcaagacacgttccagtgacatgagcgatgggtccgattttgaagacgtgaacaccactactggaacagatttggacacaacaacaggcaccggctcagacttggactctgacgtggatagcgaccctgacaaggataaggggaaggggaaatcagcagagggccagccaaagtttggtgggggcctcgctcctccaggcgccccaaacagtgtggcagaagttccggtgttctatagccagcattcctttttccctcccccagatgagcagctgctgaccgccactggcgcggccggcgatagcataaaagccatagcctccattgccgaaaagtatttcggacccgggttcatggggatgcaagaaaaaaagctcgggagccttccgtaccattcagcatttccctttcaatttctgcctaatttcccacatagtctttatccctttaccgatagggcactcgcacacaatttgctcgtgaaagctgagcctaagagccctcgggacgctctgaaagtgggcggcccaagcgcagagtgcccctttgatctgacaacaaagcccaaggatgtgaaacccatcttaccgatgcccaaaggcccatcggcgccagcctccggggaagagcagccattggatttgtcaattggcagcagggctagagcttcccagaacggtggtgggcgtgagcctcgcaaaaaccatgtgtacggagagagaaagctaggagcgggggaaggcctgccccaagtctgccccgccaggatgccccagcagccccctcttcactatgcgaaaccttccccttttttcatggaccccatttactcccgagtggaaaaacgaaaagtcacggatcctgtgggagctttaaaggaaaagtatttacgtccgtctccactcttgttccatccccagatgagcgcaatagaaaccatgacagaaaaactggagtcattcgccgcaatgaaggccgacagcgggagttccttacagcccctcccccaccaccctttcaatttccgaagcccaccaccgactttatctgatccaatattaaggaagggaaaagagcggtatacttgtcgctactgtgggaaaattttccccaggtcagccaatttgacacggcacctgcgtactcataccggggagcagccataccggtgtaaatactgtgatcggagcttttcaattagttccaaccttcagagacatgtaaggaatatacacaataaggaaaagccttttaaatgccatctttgcaataggtgcttcggtcagcagacaaatctcgatcgccaccttaagaagcacgaacacgaaaacgctcctgtgtcacagcatccaggcgttctgactaatcatcttggtaccagcgctagcagtcccacttccgaaagcgataaccacgctctgctggatgagaaagaggacagttatttcagtgaaatcagaaactttattgccaattcagagatgaatcaggcctccacccgaacagagaaaagagcagacatgcagatcgttgatggatcggcccagtgcccagggctggcgtccgaaaagcaggaggacgtcgaggaagaagacgacgacgatctcgaggaagatgacgaggatagcttagctggcaagagccaagatgataccgtgtctcccgccccagaacctcaagccgcttacgaggacgaagaagatgaggaaccagctgcttcactcgcggttgggtttgaccacacccggcgttgtgcagaagaccacgaagggggccttctggccctggaaccaatgccaaccttcgggaaagggttggacctgcggcgggcagctgaagaagcctttgaggtgaaagacgtgcttaacagcacgctggattcagaagcccttaagcatactttgtgccgtcaggcgaaaaatcaagcatatgccatgatgttatccctgtcggaagacactcctcttcataccccctcccagggttcactagacgcctggctgaaagtgacaggggccacgtctgaatcaggggcattccatcctatcaaccatctatag

SEQ ID NO: 200457 - DNA, 3828 bp, Artificial Sequence
  Description of Artificial Sequence: Synthetic coding sequence
atgcggagcaaggcccgggcccggaagctggccaagagcgacggcgacgtggtcaacaacatgtacgaacccaacagagatttgctggcatcccacagcgccgaagacgaggccgaggacagtgccatgagccccatccctgtgggcccgccatccccattcccaaccagcgaggatttcacgcccaaggaagggtctccctacgaggcaccagtgtacataccggaggacatccccatccccgctgacttcgagctgcgggaatcaagcatacccggggccggccttggtgtgtgggcgaaacgcaagatggaagctggagaaaggctcggaccatgtgtcgtggtaccgcgggcagccgccaaggagacagacttcggatgggaacagatccttactgatgttgaagtctcgcctcaggagggttgcataacgaaaattagcgaggatctgggttccgaaaaattttgcgtcgatgcaaatcaggccggggccgggagctggctgaagtacattcgggtggcatgttcttgtgacgaccagaacctcactatgtgccagataagcgagcaaatttactataaagttatcaaagacatagagcccggagaagagctgcttgtacatgtgaaagaaggtgtctatccactaggaaccgtcccacctggactggacgaagaaccgaccttcaggtgtgacgagtgcgacgaactcttccagtccaagctggatctgagacgccacaaaaagtatacctgtggctcagtgggcgctgcgctctatgaaggattggccgaggaactgaagcccgagggcctgggaggaggttccggccaggctcacgagtgcaaagactgcgaaagaatgttcccgaacaagtacagccttgaacagcatatggtgattcacaccgaggaacgcgagtacaaatgtgaccaatgtcccaaagcttttaactggaagtcaaatctgatacgccatcagatgtctcacgactccggtaagcgcttcgaatgtgaaaactgcgtcaaagttttcaccgatccatctaacctgcagcggcacataagaagtcagcatgtgggcgcccgcgcccacgcgtgtcccgactgcggcaagacttttgccacctctagtgggctgaaacagcacaagcacattcattctacagtgaaaccattcatctgcgaagtgtgccacaagagctacactcagttctccaacctctgtcggcataagagaatgcatgctgattgtagaactcagattaaatgtaaagactgcgggcagatgtttagcacaactagtagcttgaataagcaccgcaggttctgcgaaggaaaaaatcactatacccccggaggaatctttgccccagggctgcccttgacaccaagcccaatgatggataaagcaaaaccctcgccaagtcttaatcatgcttcgctggggttcaatgagtacttccctagtcggccccaccccggtagtctccccttttcaactgccccacccacattccccgcactgacacccgggttccccggtatctttccgccttcactgtatcctcggcctccactcttgccccccacctccctgttaaagagccctttaaatcacacccaggacgccaaactgccttctccactgggcaacccggcactgccccttgtgtcagctgtgtcaaattcatcccagggaacaacagctgccgccggtccagaggaaaaatttgagagtaggctcgaggatagctgtgtggagaagctgaaaacgcgtagcagcgatatgagcgatgggagtgactttgaggatgtcaatactactaccggaacagatctagataccactacagggacaggtagcgatctggactctgacgttgactccgaccccgataaagacaagggcaaggggaaatccgccgaaggacaaccaaaattcgggggaggactagcacctcccggagctcccaattcagtagccgaagttccagttttctactcccagcatagtttctttccgcctcctgacgagcagctgttgacggctacaggggctgctggcgattccatcaaggcaatagctagtatcgccgaaaagtattttgggcctgggtttatgggaatgcaagagaaaaaacttggatctctgccctaccacagtgcctttccttttcaattccttccaaactttccccacagcctctaccccttcaccgatcgtgctctggcccacaacctcttggtgaaagctgaacctaagtccccccgcgatgcccttaaagtcggaggccctagcgccgaatgtccattcgacctgacgacaaaaccaaaggatgttaaacccatacttcctatgcccaagggaccaagcgcacctgcctccggcgaagagcaacccttggacctctcgatcggttccagagcgagagcctcccagaatggcgggggccgcgagcccagaaagaatcatgtgtatggcgagcgaaaactgggggccggcgaaggccttccacaggtttgtcccgcccggatgcctcagcagcctccgttgcactacgcgaaaccatcgcccttcttcatggaccctatctaccgcgtggagaaacggaaggtaacagatcccgtcggggcactaaaggagaagtatctaaggccgagccccttgttgttccacccacaaatgtcggccatcgaaactatgactgagaaactggagtcttttgccgccatgaaggccgattccggttcctccctccagccactccctcaccacccttttaattttaggtcaccaccgcccactctttctgacccaatattacggaagggcaaggaacggtacacctgtaggtactgtggaaagatcttcccgagaagtgctaatctcactcgccatcttagaactcataccggggaacaaccatatcggtgcaaatactgcgaccggtcgttcagcatcagtagcaacttgcagcggcacgttcggaacattcataataaggagaaaccctttaagtgtcacctctgcaaccgctgtttcggtcaacagacaaatttggatcgtcatctcaaaaagcatgagcacgaaaacgcgcccgtgagccagcacccgggcgttctgactaaccatctgggaacttcagcttcaagtccaactagcgagtcagataaccatgcgctcttagacgaaaaggaggattcatacttcagcgagattcgaaattttatagccaattccgaaatgaatcaagcatccacccggaccgagaaaagagcggatatgcagatcgtcgacggaagtgcacagtgcccaggcctcgcatcggaaaaacaggaggacgtggaggaggaggatgacgatgacctggaggaggacgatgaggacagcttggctgggaagagtcaggatgacaccgtgagccccgcacccgagccccaggctgcttatgaagatgaagaagacgaggagcctgccgcctccctcgccgttggctttgaccataccaggagatgtgccgaggatcacgagggaggcctcctcgcattggaacctatgcccacattcggtaaaggactcgatctccggcgggctgcagaagaagctttcgaagttaaagacgttctcaattccactctggatagcgaagctctcaaacataccttgtgccgacaggctaaaaatcaggcctatgcaatgatgctgagcctctcagaagatacacctctacacaccccatctcagggatctctggatgcctggcttaaggtaaccggagcaacaagcgagtctggagcctttcatcccattaaccatctctag

SEQ ID NO: 200458 - DNA, 3771 bp, Artificial Sequence
  Description of Artificial Sequence: Synthetic coding sequence
atgcggagcaaggcccgggcccggaagctggccaagagcgacggcgacgtggtcaacaacatgtacgagcccaaccgcgatctgctggcctcccacagtgctgaggatgaggccgaggattccgcaatgagtcctattccagtgggtccaccgagtccattcccgactagcgaggacttcacgcctaaagagggcagcccttacgaggcaccggtttacattccagaagacatccctatccctgcggactttgaactgcgggagtcatctatccccggcgccggcctgggcgtctgggctaaaaggaaaatggaagcaggggaaaggcttggaccctgtgtggtcgtccctagggcagccgctaaggagacagactttggctgggagcaaattttgactgacgtagaagtgagccctcaggaaggatgcataacaaaaattagtgaggatctggggtccgagaaattctgtgtggatgccaatcaggccggcgccgggtcatggctcaagtatattagggtagcctgtagttgcgacgaccagaacttgacaatgtgtcagatcagcgaacagatctactacaaagttatcaaagacatcgaacccggcgaggaattattggtccatgtaaaagaaggcgtgtatcctttgggaaccgtgcccccgggcctagatgaggaacccacttttcgctgcgatgagtgcgatgaactgttccagtctaagctagatttgcgtaggcataagaagtatacttgcggctccgtcggagcagcgctctacgaggggcttgccgaggaattgaagcccgaaggattgggcgggggatccgggcaggcccacgaatgcaaagactgcgaaaggatgtttccgaataaatatagcctggagcagcacatggttattcacacagaggagcgggagtacaagtgtgaccagtgtccaaaagcattcaactggaagtctaatctgatccggcaccaaatgtcccacgacagcggcaaacgctttgagtgtgagaactgtgtcaaagtcttcacggatccaagcaacctccagcgccacatccgctctcagcacgtgggtgcccgggctcacgcatgccccgattgcggcaagacattcgctaccagtagtggattaaagcagcacaagcatatacacagtactgtgaagccgttcatttgtgaggtttgtcataaatcttacacgcaattcagtaatctctgtcgccacaaacggatgcacgcagactgccggacccagatcaaatgtaaagattgcgggcagatgttctctaccacttctagcttaaataaacatcgccgcttttgcgaaggcaaaaaccattacactcctggcggaatatttgcgccggggctgccactgactccttcaccaatgatggacaaagcaaagccttctcctagtctgaatcacgcatctctcgggttcaatgagtacttcccttcacggcctcacccaggttcgctgccattttcgaccgcacccccaacctttcccgctctaaccccgggttttcctggcatcttccccccctctctgtatccccggcctccactgctgcctccgaccagcttacttaagagtcccctcaatcacactcaggatgctaaattgccctcacctctaggtaaccccgccctgccactcgtgtcagctgtgtctaacagtagtcagggcactactgccgccgcaggaccggaggagaagttcgaaagccgtttagaggatagttgcgttgagaagttaaagacacgcagttcagacatgtcagatgggtcggactttgaagacgtgaataccaccactggcacagacctggatacgacaacagggaccggctcggacctggatagcgatgtggattctgaccccgataaagataaaggtaagggcaagtccgcagaaggacagcccaagtttggcggcgggctggccccgcccggcgccccaaacagcgttgccgaggttcctgtcttttattcccagcatagtttctttcctccacccgatgagcagctcctgacagccaccggagctgcaggtgacagtattaaggctattgccagcatcgcagagaaatactttggccccggcttcatggggatgcaggagaaaaagttgggaagcctgccctaccatagcgctttccctttccaattcctgccaaactttccacattcactctatccttttactgaccgagcacttgcacataatttgctggtgaaggccgagcccaaaagtccccgagatgccctgaaggtcgggggcccttcggccgaatgtccgttcgacctgaccaccaagcccaaggatgtaaagccaattctccctatgcccaaggggccttccgcccccgccagtggcgaggagcaacctttggacctctctattgggtccagggctcgggcaagtcagaacggcggtggacgggagcccaggaaaaatcacgtgtatggagaaaggaaactaggagcaggggagggcctgccgcaggtatgccctgccagaatgcctcagcagcccccactgcactacgctaagcccagccccttcttcatggatccaatataccgagttgagaagcggaaagtgactgatcctgtgggggctttgaaggagaaatacctgcgcccttcgccgctgctctttcatcctcagatgagcgctatcgagacaatgactgagaagctggagtcctttgccgccatgaaagccgactcgggcagtagcttgcagcctctaccccaccacccgttcaactttcgctcccctccacctacactgagtgatcctattctgagaaagggaaaggagcggtatacctgtcggtattgtggaaaaatctttcccagatctgcgaacctgactcgtcacttgcgcacccacaccggcgaacaaccttatagatgtaagtattgtgataggtccttctcaatctcttccaatctgcaacgacacgtgcgcaacatccataacaaggagaagcccttcaaatgtcatctgtgcaatagatgcttcggacaacagaccaacctggatcgccacctgaaaaagcacgagcatgagaatgctcccgtctctcagcatccaggggtgttgaccaatcacctgggaacaagcgcttcctcccccacctcagaatcggacaaccacgccttgttggacgagaaggaagattcatatttcagcgaaatccggaatttcattgctaacagtgaaatgaatcaggcttcgaccaggactgagaagagagccgatatgcaaattgtcgatggctctgcccagtgccctgggcttgctagcgaaaaacaggaagatgtcgaagaggaagatgacgacgatctggaggaagacgacgaggattctctggctgggaagagtcaggatgacacagtcagccccgctccagaacctcaggccgcttatgaagacgaagaggatgaagaaccggctgcatccctggccgtagggttcgaccatacaagacggtgtgccgaagaccacgaggggggcctccttgcactggagcccatgcccacctttggcaaggggctcgatctgagaagagccgctgaggaagcctttgaagttaaagacgtccttaactctaccctagattcagaggcgcttaagcataccctgtgtcggcaagcgaaaaaccagggttctctagacgcctggcttaaggtgaccggagccacgtcagagagtggagccttccatcctatcaaccacctgtag

SEQ ID NO: 200459 - DNA, 3255 bp, Artificial Sequence
  Description of Artificial Sequence: Synthetic coding sequence
atctactacaaggtgatcaaggacatcgagcccggcgaggagctgctcgtgcacgtgaaggagggggtgtatcccctgggtactgtgccccccggactggatgaggaaccaaccttccgctgtgatgagtgtgatgagctctttcagagcaaactggaccttcggagacacaagaaatatacctgcggttcagttggtgccgcactgtatgagggacttgccgaagagctcaaacccgagggccttgggggcggttccgggcaggcccacgaatgcaaggactgtgaacgaatgtttcctaataaatacagcctcgaacagcacatggtcatccatacagaggagagggagtataagtgcgaccaatgtcctaaagccttcaactggaaatctaatcttatcagacaccagatgtcacacgacagtggaaaacggttcgagtgtgagaactgcgttaaggtctttaccgacccctctaatctacaaagacacatcaggtcacaacacgtgggagcccgggcccacgcctgccccgactgcggcaaaacatttgctacttccagcggccttaagcaacacaaacacatccatagcaccgttaagccattcatatgcgaggtgtgccacaagtcgtacacacagttctccaatttgtgtcgccacaagcggatgcacgctgactgtcgcacccagatcaaatgcaaggactgtggacagatgttctcaacaacctcctctttaaataagcatcgccggttttgcgaggggaaaaatcattatacaccaggcgggatcttcgccccaggtctgcccttgacaccatcccctatgatggacaaggccaaaccatctccgtctctgaatcatgctagcctcggattcaatgagtacttcccatctagaccccacccaggatccctccctttttctaccgcccctcccacattccctgctttaacacccggttttcctggaatcttccccccttccctgtaccctcgtccaccacttctcccacccacttccctgctgaagtctcctctcaatcatacccaggatgctaagctaccatctccactcggaaatccagccctccccttggtgtccgcagtcagcaattctagccagggaacgaccgccgccgccggccctgaagaaaaattcgagtcaagattggaggacagttgtgtagagaaacttaagactaggtccagcgatatgagtgacggatctgattttgaagatgtgaatactactaccgggacagatctggacacgacaactgggaccggaagcgacttggatagcgacgttgacagtgaccccgataaggacaaggggaaaggcaagtccgccgagggacaaccgaagtttggcggggggctcgcaccacctggagcccctaattccgttgccgaagtccccgtcttttactcccaacactcatttttcccaccaccagacgagcagctgttaacggccactggggcagcaggcgattccattaaggctatagcctctatcgccgagaagtacttcggacccgggtttatgggcatgcaggagaagaaactgggatccctgccataccattccgcttttcccttccagtttctacccaattttcctcactccctgtacccgttcaccgatagagctctcgcacacaacttactggtaaaagcagaaccaaaatccccaagggatgcgctcaaggtcggcggaccatccgctgagtgtccattcgatctgaccactaagcccaaggacgtgaagcccattctccccatgccaaagggcccctccgcccctgcttcgggcgaagagcaaccactggatctgagtatcggcagccgggcccgagccagccagaacgggggaggtcgcgaacctcggaaaaaccatgtgtacggtgaacggaagctaggtgcaggagaagggctgcctcaagtgtgtcccgctcgtatgccacagcagccgcctttacattacgctaagccctctcctttcttcatggatcctatataccgggttgagaaaaggaaggtgacagatcctgtgggtgcccttaaggaaaaatatttgcgaccctcccctctgctgttccatccccagatgtcagcaatcgagactatgacagagaagcttgagtcttttgccgccatgaaagccgatagcggctcgtctctccagcctctccctcaccacccgttcaacttccgcagtccacctcctacactgtccgatcctatcctgcggaaagggaaagagaggtacacctgtaggtactgcggaaaaatctttccacgaagcgcgaacctcaccagacacctgaggacgcacaccggggagcagccttaccgctgtaaatattgtgatagaagcttcagcatatcgtcgaacctgcagcggcacgtccgcaatattcacaacaaagagaagccttttaagtgccatctgtgcaacaggtgtttcggccagcagaccaacttagatcggcacctgaaaaagcacgagcacgagaatgcccccgtctcacagcaccctggcgtcctgaccaatcatctgggaacctctgcgtcttcccctacaagcgaaagcgacaaccatgctctgctggatgagaaagaagactcctactttagtgagatcaggaactttatagcaaactcagaaatgaaccaggcctcaacacggaccgaaaagcgggccgatatgcaaattgtggatggttcagcgcaatgtcccgggttggctagtgaaaaacaggaggatgtggaggaagaggacgatgatgacctcgaagaagatgacgaggattcgttagccggtaagagccaggacgatacggtgtcacccgcaccagagccacaggcagcatacgaggacgaagaagacgaagagcccgctgcatccctggcagtaggcttcgatcacacgcgacgctgtgcggaggatcatgaaggagggctcctcgcactggagcccatgccaaccttcggtaagggtctcgatcttagacgcgccgctgaggaggcatttgaggtgaaagacgtgctgaattccacccttgattccgaggcgctcaagcacaccctctgcagacaggctaagaatcaggcatacgcgatgatgctgtctctgtctgaggacacacccttgcacactcctagccaaggcagcttagacgcttggctgaaggttactggcgcaacatcagagtctggggcttttcacccgattaaccacctgtag

SEQ ID NO: 200460 - DNA, 3774 bp, Artificial Sequence
  Description of Artificial Sequence: Synthetic coding sequence
atgcggagcaaggcccgggcccggaagctggccaagagcgacggcgacgtcgtgaacaatatgtacgaaccaaacagagacctgctagcatctcactccgccgaggacgaggctgaggactcagcaatgtcaccaattcctgttggccccccgtcccccttccccacaagcgaggactttacgcctaaagaagggagtccatacgaagccccggtgtacattccagaggacatccccattcccgccgacttcgagctgagggaatcttctatcccaggcgccggcctcggagtgtgggccaagcggaaaatggaggctggagagcgtctgggcccctgcgtagtcgtcccccgggcagctgctaaggaaaccgacttcggttgggagcagattttgactgatgtggaggtgtctccacaggaaggatgtattacgaagatcagcgaagatttagggtccgaaaaattttgcgtcgacgcaaaccaagctggcgcaggcagttggctgaaatacatccgggtcgcctgcagttgtgacgatcagaatctgacaatgtgccaaattagtgaacagatttactataaggtaatcaaagacatcgaaccaggcgaagaactgttagttcatgtgaaggagggcgtttacccactgggtaccgtaccccctggccttgacgaggaaccaacatttagatgtgatgagtgcgacgaactgttccagtctaaactggacctaagacgccacaagaaatacacttgcggttctgtgggggctgcgctttacgagggcctagctgaggagttaaagcctgagggtctaggcgggggatcaggccaggctcacgagtgcaaggactgtgagagaatgttccctaacaagtatagcctggagcagcatatggtcattcacaccgaagagagagagtataagtgtgaccagtgtcctaaggctttcaattggaaatcgaacctgatccgccaccagatgagtcacgacagcggaaaacggtttgaatgtgaaaattgcgttaaggtgttcactgaccccagcaacctccagagacacattcgaagtcagcacgtgggagctcgcgcacacgcttgtcctgactgcggcaagaccttcgccacttcttctggacttaaacagcacaagcatatccactcaaccgtcaaaccctttatctgcgaggtgtgtcacaaaagctatacacagttcagcaacttgtgcaggcacaaacgcatgcatgctgactgtcggacgcaaatcaagtgtaaagactgcgggcagatgttctccacgaccagctctctgaacaaacatcgccggttctgcgaaggaaagaaccactatactccaggaggcatcttcgctcccggcctgccgctgaccccctcccctatgatggataaagccaaaccctcgccgtcccttaaccacgcttctttaggtttcaacgagtattttccctccaggccacacccagggagtctcccgttttcaaccgcacccccaacctttccagctctcactcccggctttccgggaatttttccaccaagcctttacccgcgcccccccctactgcctcccacctctctactgaaaagtcctcttaatcacacccaggatgcaaaattaccctcccccctcgggaacccagcccttccgttggtctccgctgtaagcaacagctcccagggaaccactgcagccgccggtcctgaagaaaagtttgagagcaggcttgaggattcctgcgttgagaaactgaagacaaggtccagcgatatgtctgacggtagcgattttgaggacgtgaacaccactaccggaaccgatctcgacaccaccactggaaccggctcagacttggactccgacgtggactccgaccctgataaggataagggcaagggtaaatctgccgagggtcagcctaaattcgggggcggacttgcgccacccggcgcccctaatagcgtcgcagaagtgccagtgttctatagccagcacagttttttccccccacccgatgaacagctgcttaccgccacaggcgccgctggcgacagtatcaaggctattgcttctattgctgagaaatatttcggacccggctttatgggcatgcaggaaaagaagcttgggtcactgccctaccactccgcatttccgttccagtttttgccgaattttcctcatagcctttacccgtttacagaccgggccctggcccacaacctgctggtcaaagctgagccaaagtcaccccgcgatgccctgaaagtgggaggcccctcggccgagtgtcccttcgacctgactaccaagccaaaggatgtgaagcctatactgccaatgccaaaaggtccttccgcaccagctagcggggaggaacaaccgctcgacctctctattggctctcgcgcaagggctagtcagaacgggggcggcagggagccgcggaaaaatcacgtgtatggagaaaggaaattgggggcaggggagggattgccccaggtgtgccccgcgcgtatgcctcagcagccccctctgcactacgcgaaacctagtcccttcttcatggatccaatttactctcgcgtggagaagcggaaggtgaccgatcctgtgggcgcactgaaggagaagtacctccggcccagtcctcttctctttcacccccagatgagcgcaatagaaacaatgacagagaaactggaatcatttgcagcaatgaaggcggattcaggctcatccctccaacctctgcctcaccacccttttaatttccgaagtcctccccctacactgtccgaccccatcctgcggaaaggaaaagaaagatacacttgtcgctactgtggcaaaatttttcctaggtccgcgaacctgaccaggcatctgaggacccatactggcgagcagccatatcggtgtaaatattgtgaccgttcttttagcatttcttccaatctacagcgccacgtgcgaaacatccataacaaggagaaaccattcaagtgtcacctctgcaacagatgcttcggccagcagacaaatctggatcgacacttaaaaaaacacgagcacgaaaacgctccagtgagccaacatccgggagtgctcacgaaccatctaggcacctctgcctccagccctacctcagagtccgataatcacgccctcttagatgaaaaggaagatagttacttcagtgagattcgcaatttcattgccaattccgaaatgaaccaagccagcacacgcacagagaagcgcgctgacatgcagatagtggatggaagtgcccaatgtccgggtcttgcgtcagagaagcaggaggacgtagaagaggaggacgacgatgacctggaagaagacgatgaggactctctggccgggaagagccaggatgatactgtctccccggcccccgagccccaagccgcgtacgaggacgaggaggacgaagaaccagctgcctcgttagcggttggattcgaccacacacggcgctgcgctgaagatcacgaaggaggcctgctggcccttgagccaatgccaacttttggcaagggcctggatctgcgccgcgcggctgaggaggctttcgaggtgaaggacgtcttgaattccaccctcgattcagaggcccttaaacatacattgtgtagacaagccaaaaatcaaggatccctggacgcatggctgaaggttacaggtgccacttcggaatctggcgcttttcacccaattaatcatttgtag

SEQ ID NO: 200461 - DNA, 600 bp, Artificial Sequence
  Description of Artificial Sequence: Synthetic coding sequence
atgagcagcgagaactgcttcgtggccgagaacagcagcctgcaccctgaatctgggcaggagaacgatgcaaccagtccccacttctctacaaggcacgaaggctcatttcaagtgccggtgctttgcgccgtaatgaacgtagttttcatcaccatcctgattatagctctgattgccctctcagtggggcagtacaattgccccggccaatacactttcagtatgccttccgattctcacgtttcgtcttgtagcgaagactgggttggctaccagcgcaagtgttactttataagcacagtcaagagaagctggaccagcgcacagaacgcatgctccgagcacggcgcaactttagccgtcatcgactctgagaaggacatgaacttccttaagcgatacgccggccgggaagagcactgggtcggacttaaaaaagaaccagggcacccctggaagtggagcaacggtaaagagtttaataactggttcaatgtgaccggctctgacaagtgcgtttttctcaagaacacagaagtgtcctccatggagtgtgagaaaaacctctactggatctgcaacaagccctacaaatag

SEQ ID NO: 200462 - DNA, 228 bp, Artificial Sequence
  Description of Artificial Sequence: Synthetic coding sequence
atgcaccaccggatgaacgagatgaacctgagccccgtgggcatggaacagctcacgtcttcctctgtcagcaacgcgctgcccgtgagtggatctcacttggggctggccgcttcgcccacccatagtgccatcccagctcccgggcttcccgtcgctattcccaacctgggcccttctctgagcagcttgccatctgccctgtcactcatgctcccaatgggttag

SEQ ID NO: 200463 - DNA, 1893 bp, Artificial Sequence
  Description of Artificial Sequence: Synthetic coding sequence
atgctgggcatgtacgtgcccgaccggttcagcctgaagagcagcagagtacaggacggtatgggcctgtatactgctagacgcgtccgtaaaggagaaaagttcggccccttcgccggtgaaaagagaatgcctgaagacttagatgaaaacatggattaccgacttatgtgggaggtgcggggatccaaaggagaagtcctgtacatcctggacgctactaacccaagacattcaaactggctgcggtttgtgcacgaagctccttctcaggaacagaaaaacttggccgcaatccaggagggggaaaacatcttttatctagccgtggaggacatagagactgataccgagctactcattggatatctggactcagacatggaagcagaggaggaggagcaacagatcatgacagtcattaaagagggcgaggttgagaacagccggcgacagtctacagcaggccgaaaagacaggcttggatgcaaagaggattacgcttgtccacagtgcgagtcttctttcaccagcgaagacatcctggccgaacacctgcaaaccctccaccagaaacccacggaagagaaggagttcaagtgcaaaaactgtggcaaaaaattccctgttaagcaggccttacagcgccacgtgctgcaatgcaccgcaaaaagttcactgaaggaaagctcaagaagctttcagtgttccgtctgcaactcttccttctcctcggctagttctttcgagcagcatcaagaaacatgtaggggggatgcccgcttcgtatgtaaagctgattcctgcgggaaacgacttaagagcaaggacgccctcaagcgtcaccaagaaaatgtgcacacaggagaccccaaaaagaaattaatctgcagcgtgtgtaacaaaaagtgtagtagtgcgtcttccctccaagagcaccgaaagattcacgagatattcgattgtcaggagtgtatgaagaaatttatctcggccaatcaactgaaaaggcacatgattactcacagtgaaaaaaggccttacaattgcgaaatctgtaataagtccttcaaacgactcgaccaggtgggagctcataaggtgatccactcggaagacaagccatataagtgcaaactctgcggaaagggttttgcacaccgtaatgtctataagaatcacaaaaaaacacatagcgaagagcgtcccttccagtgtgaggaatgtaaggccctcttccgaacaccgttctccctgcaacgtcatctgctcatccacaactccgaaagaacatttaaatgtcaccattgcgacgcgacctttaaacgtaaggacacacttaatgtccacgtgcaggtagtgcacgaacgccacaaaaagtacagatgcgaactgtgtaacaaagcttttgtaacaccaagcgtgctgcgcagccacaaaaaaacccataccggcgagaaggagaagatttgtccatattgcggtcagaaattcgcgtcctcaggcaccctgcgcgtccacattcgaagccatacaggtgagcgcccctaccagtgcccgtactgcgaaaagggcttttccaagaatgacgggctcaaaatgcatataagaactcacacccgcgaaaagccgtacaagtgcagtgagtgcagcaaagctttcagtcagaagcgaggtttggacgaacacaagcggacccacacaggagagaagcccttccaatgtgatgtatgcgaccttgcattctctctgaagaaaatgctcattcgccacaagatgactcacaaccctaacaggccccttgccgagtgccagttctgtcacaagaagtttaccaggaatgactatctcaaggtgcacatggacaatattcacggagtcgccgattcttag

SEQ ID NO: 200464 - DNA, 336 bp, Artificial Sequence
  Description of Artificial Sequence: Synthetic coding sequence
atgctgggcatgtacgtgcccgaccggttcagcctgaagagcagccgggtacaggacgggatgggcctatacacagctcgaagagtgcggaagggagagaaattcggtcccttcgctggcgaaaaaaggatgccagaggacctggacgagaacatggactatcgactgatgtgggaagtgaggggtagtaagggcgaagtcctgtacattcttgatgccactaatccgcgacatagcaattggctcagattcgtgcacgaagcgcctagccaggagcaaaagaatctggcagccattcaggacaaaaacctggggcctgctgaatggagagggtag

SEQ ID NO: 200465 - DNA, 1800 bp, Artificial Sequence
  Description of Artificial Sequence: Synthetic coding sequence
atgctgggcatgtacgtgcccgaccggttcagcctgaagagcagccgggtccaggatggcatgggtttgtacactgcccgacgggtgaggaaaggggaaaagtttggcccgttcgccggagaaaaaagaatgccagaggacctggatgagaatatggactaccggctcatgtgggaggtaagggggtctaagggagaggtactctacatattggacgccaccaacccccgacattctaattggctgcggttcgtgcacgaggccccatcccaggagcagaagaatttggccgccattcaggagggtgagaatatattctatctcgcagttgaagacatcgagacagatacagaactcctcatcggctacctcgatagcgatatggaagcggaggaggaggagcagcagatcatgacagtcatcaaggagggggaggttgagaacagtcgtcgccaatcgaccgcaggtagaaaggataggctggggtgcaaagaagattacgcttgtccgcaatgcgaaagttcctttacttcagaagatatcctggccgaacacctgcagacattgcatcaaaagccgacagaagagaaggagttcaagtgcaagaactgcggaaagaagttcccagtgaaacaggctctgcaaagacacttcgaacagcaccaggagacctgcaggggagatgccagattcgtttgtaaagccgattcttgtggaaaacgcctgaagtccaaggacgctcttaaacggcatcaggagaacgtgcacaccggtgatcctaagaaaaagctgatctgtagcgtctgtaacaaaaagtgcagctccgcgagttcattgcaggaacaccgcaaaattcacgagatctttgattgtcaagagtgtatgaaaaagtttatttccgctaatcagttgaaaagacacatgattacacacagcgaaaagagaccgtataactgtgaaatctgcaataaatccttcaaacggctggaccaggtaggcgctcataaggtgatacacagcgaagacaagccttacaagtgcaagctctgcggcaagggcttcgcacatcggaatgtgtacaaaaaccataagaaaacacacagcgaggagcgccctttccaatgcgaagaatgcaaggccctcttccgtaccccattcagtcttcaacggcacctgctgattcataactctgaaaggacatttaaatgccatcactgcgatgccacatttaagcggaaggataccctcaatgtgcacgtgcaagttgtgcacgaaagacacaagaaatatcgatgcgagctgtgcaacaaagcgtttgtgactccatctgttctgagatcccacaaaaagacccacaccggcgaaaaggaaaaaatctgtccatactgcggacagaaattcgcttccagcgggactctgcgggttcacatacggtcccacacaggtgagaggccatatcagtgcccttattgcgagaagggtttctccaagaacgacgggctgaaaatgcacatacggactcacacacgggagaagccctacaagtgttccgaatgctctaaagccttctcccaaaagcgaggcttagatgagcataagcggacccacacaggagaaaaaccattccagtgtgatgtttgcgacctggccttctcactcaagaagatgcttattaggcataagatgacccataacccaaatcgaccattagcagaatgtcagttctgtcacaagaaattcacccggaatgattatctcaaagtgcatatggataatattcacggggtggcggatagttag

SEQ ID NO: 200466 - DNA, 1506 bp, Artificial Sequence
  Description of Artificial Sequence: Synthetic coding sequence
atgctgggcatgtacgtgcccgaccggttcagcctgaagagcagcagagtgcaggatggtatgggtttgtataccgcacggcgcgtccgaaagggcgagaagtttggcccgtttgccggcgagaaaaggatgcctgaggacctagatgagaacatggactacaggttgatgtgggaggtccgggggagcaaaggagaggtgctgtacattctggacgccactaacccccgccacagtaactggcttcggttcgtgcatgaggctccttcccaggaacagaagaatctcgccgcaatccaggagggggaaaacatattttatctggccgttgaagatattgaaacagacaccgaactcttaatcggttacctggactccgatatggaggctgaagaggaagagcagcaaatcatgaccgttattaaggaaggcgaggttgagaatagtcgtcggcagtctactgcaggcagaaaggataggctgggctgcaaggaagactacgcttgcccccaatgtgaatcttcgttcactagtgaggatattctggctgaacacttgcagacgctgcaccagaagcccacggaggagaaggaatttaagtgcaaaaactgtggaaaaaagttccctgtgaagcaggcccttcagagacactttgagcagcatcaggagacttgccgaggagatgctaggtttgtctgcaaagcagactcttgtggcaagcggcttaagtctaaggatgctcttaaaaggcaccaggagaatgtccacactggtgacccaaagaaaaagcttatatgttccgtgtgtaataagaagtgttcatctgcttcttcattacaggagcaccggaagatccatgagatttttgactgccaggagtgtatgaagaagtttatatcagccaatcagctaaaacggcacatgataacgcacagtgaaaagaggccatacaattgcgagatctgtaacaaaagtttcaagcgtctggaccaagtcggcgcccacaaggttatccattctgaagataagccttacaaatgtaaattatgtggcaaggggtttgcacacaggaatgtgtataaaaatcataaaaagacgcatagcgaggagagaccatttcagtgtgaggagtgtaaagctctttttcgaacccccttctcacttcaaagacacctgctgattcacaattctgagcgcactttcaaatgccaccattgcgacgctacttttaaaaggaaggatacactcaacgtgcacgtgcaggtcgtccatgaaagacataaaaagtaccggtgtgaattatgtaataaggctttcgttacgcccagcgtgctgagatcccacaagaaaacccacacaggcgaaaaagagaagatctgtccttattgtggccagaagttcgcctcatccggcactctccgcgtccacatcagatctcacacaggggaggctgtgcaggttctacgggtccaacagggtctgcaacccgaggccaggccaggctag

SEQ ID NO: 200467 - DNA, 1227 bp, Artificial Sequence
  Description of Artificial Sequence: Synthetic coding sequence
atgtgccagaacttcttcatcgacagctgcgccgcccacggcccccccacgtttgtgaaggacagcgcagtggataagggccacccaaataggagcgctttaagcctgccacctgggctaaggatcggaccaagcggaattccacaggcagggctcggcgtttggaacgaggcaagtgacctccctttagggctgcatttcgggccctatgagggccgcataacagaggatgaggaagccgcgaataatggctattcttggctaataacaaagggccggaactgctatgagtacgtcgacggcaaggacaaatcgtgggcaaactggatgaggtacgtcaattgcgctcgggatgatgaggagcaaaatctggtggcatttcaatatcaccgccagatcttttacagaacctgcagagtgattcgccccggatgcgagctcctggtgtggtacggcgatgagtatggacaggagctgggtataaaatggggttctaaatggaagaaggagttgatggcaggacgtgaacccaagccggaaatacacccctgtcccagctgctgtctggcattttctagccaaaagtttctgagccagcacgttgagcgcaatcatagcagccagaactttccaggaccttccgcgcgcaaacttctgcagccagaaaacccctgccccggcgatcagaaccaggagcaacagtacccggacccccactcccgcaatgataagaccaaagggcaggaaatcaaggagcggagtaagctactcaacaagcgaacatggcagcgggagatttctcgcgcattctcatcccctccgaaaggccaaatggggtcatgccgggtcggaaagcgtattatggaggaagaaagtagaacaggtcaaaaagttaaccctggaaacacggggaagttattcgttggggtgggcatcagtcgaatagccaaagttaaatatggtgaatgtggccaaggcttctccgtgaagagcgatgttatcacacatcagcgcactcacactggcgagaaaccctacgtctgtcgagaatgtgggaggggattttcctggcagtccgttttgctaacacaccaaaggacacatactggtgagaagccttacgtgtgcagggagtgtggacgaggcttttctaggcagtcagttctcctcacacatcagagaactcatacgggtgagaaaccgtacgtctgccgtgaggacgagtag

SEQ ID NO: 200468 - DNA, 2685 bp, Artificial Sequence
  Description of Artificial Sequence: Synthetic coding sequence
atgagccccgagaagagccaggaggagagccccgaggaggacaccgagagaaccgagcgcaagcccatggtgaaagatgccttcaaagacataagcatttacttcacaaaggaagagtgggccgagatgggtgattgggaaaaaacacgatatcgcaacgtcaagagaaactacaacgctctgatcacaatcgggctgagggccacgcgacccgccttcatgtgccatcgccgccaagctattaaactccaggtggacgataccgaggattccgatgaggagtggacgcctcggcagcaggtcaagcccccctggatggccctccgggtggaacagcgcaaacaccagaaaggaatgcctaaagctagcttctccaacgaatcttcactaaaagagttgagcaggactgctaacttactgaacgcgagcggcagcgaacaggctcagaaacccgtgtcacccagcggcgaggcaagcacttcagggcagcacagccggttgaaactggagctgcggaaaaaggagacggagaggaagatgtattcccttcgggagagaaagggccatgcgtacaaagaggtctccgagccacaggacgatgactatctgtactgtgagatgtgtcaaaatttttttatcgactcctgcgctgctcatgggccacctacctttgtgaaggattccgctgttgataaaggacacccaaatcgctctgcgctatccctgccccctggtctgcgtatcggcccgagtggaattcctcaagctggactcggggtgtggaatgaggcatccgaccttcctctgggcctgcacttcggaccatacgaaggtagaataactgaggacgaggaggccgcaaataacggctactcatggctcatcaccaagggacggaattgttacgaatatgtagacggcaaggataaatcctgggctaattggatgcggtacgtaaactgcgcacgagacgacgaggagcagaacctggttgcgtttcaataccaccggcaaatcttttaccgcacgtgccgggtcatccgaccaggatgtgaactcctggtctggtacggcgacgaatacggccaggaattaggtatcaagtgggggagcaagtggaaaaaagaattgatggccggccgtgaacccaaacctgaaattcacccttgtccttcatgctgtctcgcattctcttcccagaagtttctgtcccaacatgtagagcggaaccattcctcacagaactttccagggccatcggcacggaagctgcttcagccagaaaatccgtgccctggtgatcaaaaccaagaacagcagtatcctgatccgcattctaggaatgataagaccaaggggcaggaaatcaaagagcgttcaaagctactgaacaagaggacctggcaacgtgaaatctccagagcattcagctcgccaccaaagggtcagatggggtcttgccgggtggggaaaagaatcatggaggaggagtcacgaacaggccagaaagtgaatcccgggaacacgggaaaactgtttgttggcgtcgggattagtcgcattgccaaagtcaaatatggggaatgtgggcaggggttcagcgtaaaatccgatgtgatcacccatcagcggactcacacaggagaaaagctgtatgtctgtcgcgagtgtgggagaggcttctcttggaagtctcacctgctcatacatcaaaggattcacaccggcgagaagccttatgtgtgtcgcgagtgcggtagaggattctcttggcagagcgtcctattgacccaccagaggactcacacaggggagaaaccatacgtgtgccgcgaatgtggcaggggattctcgcgacaatctgtgttgctcacccatcaacggcggcacactggcgagaaaccatacgtgtgcagagagtgcggacgcggtttttctcggcaatccgtgctgttgacacaccagcgcaggcacaccggagagaagccttacgtatgtagagagtgcggaagaggttttagctggcagagcgttctcctgactcaccagcggacccacactggtgaaaaaccatacgtgtgcagggagtgtggcagaggattcagctggcagtcagtgttactgacccatcagaggacgcacaccggcgagaagccttacgtgtgtagagaatgtggccgcggcttcagtaataagtcccatctgctgagacaccagaggacacatacaggagaaaaaccatatgtgtgtagggagtgcggtagagggttcagagacaaaagccatctgcttagacatcaaaggacccacaccggagagaaaccctatgtgtgccgcgaatgcggcaggggatttcgagacaagtctaacctcctgtcacatcaacgcacccacaccggcgaaaagccgtacgtgtgccgtgaatgcggaagaggcttcagtaataagtcacacctactgagacaccagaggacacatactggcgagaagccttatgtatgtcgcgaatgcgggcgagggttccgcaacaagagccaccttctgagacatcagcgtacacacaccggggagaaaccgtacgtatgtcgggagtgcggaaggggtttttctgatcggagctccctgtgttaccaccagagaacacacaccggagaaaaaccatacgtctgccgcgaagacgagtag

SEQ ID NO: 200469 - DNA, 303 bp, Artificial Sequence
  Description of Artificial Sequence: Synthetic coding sequence
atgagccccgagaagagccaggaggagagccccgaggaggacaccgagcgcactgagcggaagccaatggttaaggacgctttcaaggatatctcgatttattttacaaaggaggagtgggccgaaatgggagactgggagaaaacccgctatcgcaacgtgaaaaggaactacaacgccctgattactatcggtctgagagctacacgcccggctttcatgtgccacagaaggcaggcgattaagctccaggttgatgatactgaagactccgacgaagaatggacaccccgccagcagtag

SEQ ID NO: 200470 - DNA, 537 bp, Artificial Sequence
  Description of Artificial Sequence: Synthetic coding sequence
atgagcgaggtgcggctgccccccctgcgggccctggacgacttcgtcctgggatcagcccgccttgcagcccccgatccctgcgatccccagaggtggtgtcatcgagtgatcaataatctgctatattaccagaccaactaccttttgtgttttggtatcgggttagctctagcaggatatgtgaggcctctgcacactctcctgagtgcactggttgtcgcagtcgcgctgggggtgttggtctgggccgccgagactcgggcggctgtccgccgttgcaggcgttcccatcccgccgcctgtttggcggcagtactggctgtcgggctgctcgttctgtgggttgctggtggtgcctgtacattcctgtttagtatagctggacctgttttgctgattctggtacacgcgagccttcggcttcgcaatctgaagaacaaaattgaaaacaagatagagtccatcggtctgaaacgaacccctatggggctgctgcttgaggccttaggccaggaacaagaggcagggtcttag

SEQ ID NO: 200471 - DNA, 846 bp, Artificial Sequence
  Description of Artificial Sequence: Synthetic coding sequence
atggccggcacctggctgctgctgctgctggccctgggctgccccgccctgcctactggggtgggcggcacccctttcccttccctggctccaccgattatgcttcttgttgacggaaagcagcagatggtggttgtgtgcctcgtcctggacgtcgctcctcccggcctggacagtcctatctggttcagtgccggcaatggtagcgccctggatgcctttacctatgggccctcaccggcaactgacgggacttggactaatctggctcatttatcattgcccagtgaggagctcgcgtcttgggagccactcgtgtgtcataccggaccgggcgccgaagggcacagtcgtagtacacagcctatgcacctttccggggaggcaagtaccgcacgcacgtgtcctcaggaaccactccgaggaaccccagggggcgcactttggctaggggtactgcgcctgctgctgtttaagctgcttctgttcgacctattgctgacttgctcctgtttgtgcgatcccgctggccccctgccctcccctgcaaccacgacccggctcagggcgctggggagccaccgcctgcatccagctactgagaccggcggcagagaagccacttcttccccacggccccagcctagggataggcggtggggcgatacgccaccaggccggaaaccaggcagcccggtttggggcgaagggtcatacctgagtagttaccccacatgtccagcacaggcctggtgctccaggtctgccctgcgggctccctccagcagcctgggggctttcttcgcaggcgacttacccccccctctgcaggctggcgcggcgtag

SEQ ID NO: 200472 - DNA, 384 bp, Artificial Sequence
  Description of Artificial Sequence: Synthetic coding sequence
atggccgccaccagccccggcccctgggtgagcagccccacccacaggtcatgcttcttgccgttcctgactcggggttgtcacaaccgggtctgggctgcccatcctttcctcctgtggcctcaccaaagctgttgctggtggatggagtcttctaggtggtggtggtcagcgtggtctctgatgcttcaccctttggctcttactgcgcccggaaggaagccgggcagcccagtctggggcgaagggtcatacctgtctagctacccaacatgcccggctcaggcgtggtgttcaagatccgcactgagggcaccctcttcatctttgggggcgtttttcgccggcgacctgccacctccacttcaggcaggcgctgcatag

SEQ ID NO: 200473 - DNA, 771 bp, Artificial Sequence
  Description of Artificial Sequence: Synthetic coding sequence
atggccggcacctggctgctgctgctgctggccctgggctgccccgcactccctacgggccccgtctccttcccaagctcccctgaggcagctactaccggtcctatctggttcagcgctggaaacgggagcgctctcgatgccttcacatacgggccatctcccgccaccgacgggacctggacaaacttggcgcatctgagtttaccctccgaagaactggcttcctgggagcccctggtctgccatacaggcccaggagcagaaggccactcccgaagcactcagcccatgcacctatccggtgaggctagcacggctagaacttgcccccaggagcccctaagaggcaccccaggaggagcactctggctgggcgttctgcggctgctgctatttaagctactgctttttgacctgctgctgacttgttcttgcctgtgcgacccagctggtccactgccaagccccgccaccacaaccagactgagagctctcggctctcaccggctccaccccgccaccgaaaccggcggtcgggaagccacttcctccccccgcccccagccgagggatcgcagatggggagataccccccccggccgcaagccagggtccccagtctggggtgaaggctcctatctaagttcttatcctacgtgcccggctcaggcatggtgtagccggtctgctctgcgagcacccagctcctctctgggggccttcttcgctggcgacctccctccaccccttcaagcaggagccgcttag

SEQ ID NO: 200474 - DNA, 525 bp, Artificial Sequence
  Description of Artificial Sequence: Synthetic coding sequence
atggccggcacctggctgctgctgctgctggccctgggctgccccgctttgccaaccggcgaggccagcacagcacgcacgtgcccccaggagccattgcggggcacgccagggggagctctgtggctcggcgttcttaggctccttctgttcaaattgctgctctttgacctgttgcttacatgtagttgcctgtgtgatcctgccgggcccctcccatcaccagcaacaactacacgcctgcgcgctctaggttcacataggttgcacccagctactgagaccggtggacgggaggctacatcgagtccccgtccccaacccagggatcgtagatggggagacaccccaccaggccgcaagccgggaagccctgtgtggggtgaagggagttatctgagttcatatccaacatgtccagcacaggcttggtgctccagatccgcgctgcgagcaccatcctcaagcctgggagccttcttcgctggcgatttgcccccccccttacaagccggagctgcctag

SEQ ID NO: 200475 - DNA, 438 bp, Artificial Sequence
  Description of Artificial Sequence: Synthetic coding sequence
atgagctgggcccccgtgctgctgatgctgttcgtgtactgcaccggatgtgggccacagccagtcctgcatcagcctcctgcaatgagttctgcactcggaacaacaatcaggctcacgtgtaccctgcgtaacgaccatgacattggtgtgtattccgtatactggtatcagcaaagacctggacacccaccccgatttctgcttcgctatttctcacagtccgacaaatctcaaggtccccaggtgccccctcggttttccggctcgaaagacgtggcacggaaccgtggctaccttagcatttcagagctgcagcctgaggacgaagcaatgtattattgcgcgatgggtgccagatcctcggaaaaggaggaacgcgaaagggagtgggaagaggagatggaacctaccgcggctagaacccgagtcccatag

SEQ ID NO: 200476 - DNA, 372 bp, Artificial Sequence
  Description of Artificial Sequence: Synthetic coding sequence
atggcctgccggtgcctgagcttcctgctgatgggcaccttcctgagcgtgtcacaaacggtattagcccagctggacgcgctactggttttccccgggcaggtggcccagctgagttgtaccctgtccccccagcatgtgacgatacgggactatggggtgagctggtaccagcaacgggctggtagcgctccaagatatctcctttactaccgctccgaggaagaccaccaccggccagccgacatcccagatcgcttttcagctgctaaggacgaagcccacaacgcttgtgtgctgacaatctctccagtgcagccagaggacgatgccgactactattgctcagtcggttatggatttagtccttag

SEQ ID NO: 200477 - DNA, 513 bp, Artificial Sequence
  Description of Artificial Sequence: Synthetic coding sequence
atggacgagcagccccggctgatgcacagccacgccggcgtgggcatggccggacaccctggcctcagccagcacctccaggacggcgccggaggtaccgagggcgagggtggccggaagcaggatataggcgacatactgcagcagattatgactataactgaccagagcctcgatgaggcccaggcacgcaagcatgccctgaattgtcatcggatgaagcccgctctcttcaacgtcttatgcgagatcaaggagaaaactgttttatctatcaggggtgcacaagaagaggagccaaccgatccacaactcatgcggctggataatatgctgctggcagaaggtgtagctggcccagagaaaggcgggggcagtgcagccgccgctgcggccgccgcagcctcagggggggcagggagtgataactccgtagagcattcggactatcgagctaagctctcccaaattcggcagatttaccatacggaattagaaaagtatgagcagtag

SEQ ID NO: 200478 - DNA, 1044 bp, Artificial Sequence
  Description of Artificial Sequence: Synthetic coding sequence
atggacgagcagccccggctgatgcacagccacgccggcgtgggcatggctggtcatcctgggctgtctcagcacctgcaggatggcgccggaggaacagaaggcgaaggaggtcggaaacaggatatcggtgacattttgcagcagatcatgacaatcacggaccaaagtctggacgaagcccaggcacgcaaacatgcactcaattgccaccggatgaaaccagccctgttcaatgttctgtgtgaaatcaaagaaaagaccgtgctatctattcgtggggcccaggaggaagagcctaccgatcctcagctgatgagactggacaacatgttactggccgaaggagtcgccgggcccgagaaggggggagggtcagcagctgccgccgcagccgctgccgccagcggaggagcgggatcggataactcagtggagcattccgattacagggctaagctatctcaaattcggcagatctaccacacagagctggaaaaatacgagcaggcttgtaacgaatttaccacccacgttatgaacctgctcagggaacaatcacgtacccgacccatttctcctaaggaaatcgagagaatggtgagtatcatccaccggaagttcagctccatccagatgcagctaaaacaaagtacttgcgaagcggttatgatcctgcgatcccggtttcttgatgcacggcgcaaaagacggaatttcaataagcaggctaccgaaatactcaacgagtacttttattctcacctttcaaatccctatcctagtgaggaagccaaggaagagctagccaagaaatgtgggatcaccgtcagccaggttagcaactggttcggcaacaagaggataaggtacaagaagaatatcggaaaattccaagaggaagcaaatatatacgccgcaaagactgcagtgacagctacaaatgtctccgcccatggaagccaggccaacagtccttctaccccgaactccgcaggagggtatccatctccatgttaccagccggataggcgcattcaatag

SEQ ID NO: 200479 - DNA, 1044 bp, Artificial Sequence
  Description of Artificial Sequence: Synthetic coding sequence
atggacgagcagccccggctgatgcacagccacgccggcgtgggcatggccggacaccctgggctctcccaacatcttcaggatggcgccggtggaacagagggggagggtggaaggaaacaggacattggtgatattctgcagcaaatcatgacaatcacggatcagtccctggacgaagcacaggccagaaaacacgcacttaactgtcaccggatgaaacctgcactgtttaacgtgctgtgtgaaataaaggaaaaaaccgtacttagcatccggggcgcgcaagaggaggaaccgacagacccacagttaatgaggctagacaacatgcttctggccgagggcgtggcaggacccgaaaaaggcgggggctccgccgccgccgctgcagccgcagccgcctctggaggcgcgggcagtgacaattcagtggaacactcagattaccgtgccaagttgtcccagatacgccagatctaccatactgaactggagaaatacgagcaggcgtgcaatgaattcacaacacacgttatgaatttgctacgggaacagtctcggacgagacctattagccccaaagaaatcgagcgaatggtgtccatcatacacagaaagttctccagtattcaaatgcagctgaagcagtccacctgtgaggccgtcatgatccttcgctcaaggtttttggacgcaagacgaaagcgcaggaacttcaataagcaagcgacagagatattgaatgagtatttctattcccacctgagcaacccctacccatctgaagaggccaaggaagagctggcaaaaaagtgtggcattaccgttagccaggtctctaactggtttggaaacaaaaggatccgctataagaagaacatagggaaatttcaggaggaagccaatatctacgctgctaagaccgccgtgaccgcaacaaacgtctctgcacacggctctcaggctaacagtccatccacccccaactcggctggtggatacccctctccctgttaccagccggatcgccggattcagtag

SEQ ID NO: 200480 - DNA, 1293 bp, Artificial Sequence
  Description of Artificial Sequence: Synthetic coding sequence
atggacgagcagccccggctgatgcacagccacgccggcgtgggcatggcgggtcacccgggcctgtcccagcatctccaagacggagccggcggcaccgagggcgagggcggaaggaagcaggatatcggcgatatcctccagcagataatgactataaccgaccagagtctcgacgaggctcaggctcgaaagcatgcgttaaactgtcatcggatgaaacctgcattatttaatgtactgtgtgaaatcaaggagaaaaccgtgctttccattcggggggctcaagaggaggaaccaacagatccacagctgatgaggttagataacatgctgttggccgaaggcgtcgcgggaccggagaaaggaggaggatccgccgccgctgcggctgcagccgctgcaagcggtggcgcgggaagcgataactccgtcgaacacagtgattaccgagccaagctgtcacagatcaggcagatctatcataccgaactcgagaagtacgaacaagcctgtaatgaattcacaacgcacgttatgaatctcctccgtgagcagtcgcggacccgacccatatccccaaaggagatcgaaagaatggtttcaataattcatcgcaagttttcctcaattcagatgcagctgaagcagtccacctgtgaggccgtcatgattctacggtctaggtttttggatgcccgccgcaaaaggcggaacttcaacaagcaggccacagagatcctgaacgaatacttttactctcacctgtctaacccctatcctagtgaagaggcgaaggaagagcttgcaaagaaatgtggtatcacagtgagtcaggtcagtaactggttcggcaacaaaagaattcgatacaaaaaaaacatcggcaagttccaagaggaggccaatatttacgctgccaaaacagccgtcactgcaactaatgtgagcgcacacggttcgcaggccaactctccctctactcctaattcagcgggtagctcttcatcatttaatatgtccaattccggagacctgtttatgtcggtgcagtcccttaatggagacagctaccagggcgctcaggtgggagccaacgttcagtctcaagttgatactctgcggcacgtaatttctcagacgggcgggtattctgacggccttgccgccagccaaatgtattcgccccaggggatttccgcgaacggaggctggcaggatgctacgactccctcttccgtcactagcccaaccgaggggcccggatctgttcattctgacacatccaattag

SEQ ID NO: 200481 - DNA, 978 bp, Artificial Sequence
  Description of Artificial Sequence: Synthetic coding sequence
atgcggctggacaacatgctgctggccgagggcgtggccggccccgagaaaggcggagggtctgccgccgccgctgcagcagcagccgccagtggaggagctggttcggacaatagcgtggagcattcggattacagggccaaactgtctcaaattcgacaaatttaccataccgaacttgaaaagtatgagcaggcatgtaatgaattcaccacacacgtgatgaacttgctacgcgagcagtcaaggaccagacctatatctcctaaagaaattgagcggatggtgtcaatcatacaccgtaagttctcaagcatccaaatgcagctcaagcagtcaacgtgcgaggctgttatgatcttgcgatcacggttcttggacgcccggcgcaaacgcaggaattttaataagcaagctactgagatcctgaacgagtacttctactcccacctgtctaatccatacccctccgaagaagctaaagaggaactggccaaaaagtgtggaattaccgtgtctcaggtgtctaattggtttggcaataagcggatccgctataagaagaatattggcaagttccaggaggaagccaacatatatgcggcaaaaactgcagtcactgccacaaacgtctcagctcacgggagccaggcaaactctcctagcacgcctaattctgccgggtcgtcatcttcttttaatatgtccaatagcggggatttgttcatgagcgtgcagtctctaaacggagacagttaccaaggggctcaggtgggcgccaatgtccagagccaagtagacacgcttagacatgttatctcccagactggcggatacagcgacgggctggcagctagccagatgtattcgcctcagggtatttctgcgaatggaggatggcaggatgctactacaccatcttcagtaactagccccaccgaaggtcctggctcggtgcacagcgacacttcaaattag

SEQ ID NO: 200482 - DNA, 1113 bp, Artificial Sequence
  Description of Artificial Sequence: Synthetic coding sequence
atgctgctggtgttcttcgtgctgtggacctgcagcctggccctgctggccagcagccaaagccccccgccaccatgtgctagcgtgcttagtatacggggtgctcaggaagaggagcccaccgacccccaattaatgcgcttggacaacatgctgctggctgagggagtggccggaccagaaaagggtggggggtctgccgccgccgcggcagccgctgccgcgtcaggcggagccgggagcgataacagcgtggaacactcagactaccgggcaaagctctcacagattcgacagatttatcatacagagctggagaaatatgagcaagcttgcaacgagtttactactcacgttatgaacctgctgagggaacagagcaggaccaggccaatttcaccgaaggaaatcgagaggatggtgagtattattcatcgcaagttttcttccatacaaatgcagctgaagcagtcgacttgcgaagccgtaatgattcttcggtctcgatttttggacgcgaggaggaaacggcgcaatttcaacaagcaggctacagagattttgaacgagtacttttattcccacttatccaatccgtatccatctgaggaggcaaaagaggagttggcaaagaagtgcggcattacagtctcccaagtgagcaactggtttgggaacaagcgtattcgatataaaaagaatatagggaaattccaggaagaggccaacatctatgcggcgaagactgcagtcacagctaccaacgtttcggcacatggcagccaggctaacagcccttctacaccaaacagtgccgggagctccagttcgttcaacatgtccaactcgggggatctgtttatgtccgtacagtctctgaacggggactcctaccagggcgcccaggtcggagctaatgttcagagccaggtcgacacgctacgccacgtcatatcccaaactggaggctattctgatggactcgccgccagccagatgtactcgccccagggcataagtgcaaatgggggctggcaggacgcaactacacctagcagtgtgacatcacccaccgagggacccgggtctgtgcacagtgacacctctaactag

SEQ ID NO: 200483 - DNA, 1263 bp, Artificial Sequence
  Description of Artificial Sequence: Synthetic coding sequence
atggacgagcagccccggctgatgcacagccacgccggcgtgggcatggcgggacacccgggcctgagtcagcatctgcaggatggggctggcgggaccgaaggggagggagggagaaagcaagatatcggggatattctccagcagataatgactattaccgatcagtccttggacgaagcccaagcaaggaaacacgcgctgaactgccaccgtatgaagcctgccctgttcaatgtcctctgcgaaatcaaagagaagaccgtcctgtccatcagaggcgcccaggaggaggagcccaccgacccgcagctgatgcggctggacaacatgcttcttgctgagggcgtcgccgggcctgagaagggcggggggtcagcagccgcggctgccgccgccgctgccagcggcggcgctggatctgacaactcagtcgagcattccgactacagggcgaagctctcacagattagacagatctaccatactgaactggaaaaatacgagcaggcttgtaacgagttcaccacacatgtcatgaacctactgagggagcagtcgcgaactcggcccattagtccaaaggagatcgaacgcatggtcagcatcattcacagaaagttcagctcgatccaaatgcagctaaaacaatccacttgcgaagccgtgatgattctgcgatctaggttcctcgacgccaggagaaaacgccgcaattttaacaagcaggcgactgaaatcctaaacgaatacttctactcacatctgagcaacccatacccttccgaagaggctaaagaggagctggcaaaaaagtgcggtattactgtcagtcaggtttcaaactggttcggaaataaacggattagatataagaagaatatcggcaagttccaggaggaggcaaacatctatgccgccaaaacggctgttacggcaaccaacgtgtctgctcacggaagccaggcaaacagcccttcaacccccaactctgctgggtcctccagcagttttaacatgagcaacagcggcgacctctttatgagcgtgcagtcactcaatggcgacagctaccagggcgcccaggttggcgccaatgtgcagtctcaggtggataccttacgacatgtgatttcacagacaggaggctacagcgatggcctggccgcttctcagatgtattctcctcaggggataagtcaccttccccgacatcctcgtcaggcccattaccattttagactccctacctggcacccatag

SEQ ID NO: 200484 - DNA, 906 bp, Artificial Sequence
  Description of Artificial Sequence: Synthetic coding sequence
atgcggctggacaacatgctgctggccgagggcgtggccggccccgagaaggggggcggaagcgctgccgccgctgctgccgctgctgcgagtggcggggccggtagtgataattccgtggagcatagcgattacagagccaaattgtctcagatacgacagatctaccatacggagctggagaagtacgaacaggcctgcaacgaatttactacccatgtcatgaacctcctccgcgaacagtccagaacccggccgatcagccccaaagaaatcgagcggatggtatccatcatccacagaaagtttagctctattcagatgcagctgaagcaatcaacctgtgaggcggtgatgatactgcggagtcgattcctggatgctcggcggaagaggagaaatttcaataaacaagctacagagatcctgaacgagtacttctattcccatctctccaatccttatccgtccgaagaggccaaggaggagcttgccaagaaatgtggcatcaccgtcagccaagtctcaaactggtttggcaacaaacggattcgctataagaagaatataggtaagtttcaggaggaggcaaacatctatgccgcaaagactgcagtgactgctaccaacgttagtgctcatggaagccaagccaacagcccctccactcctaatagtgcaggaagcagcagcagcttcaatatgagcaatagtggtgatctgtttatgtcggtccagagtctgaatggtgactcctatcagggggcccaggtgggggctaacgtgcagtctcaggtggacacattgcgacatgttatcagtcagaccggggggtattccgacgggctggcagcatctcagatgtatagcccgcagggcatttccgaaatcgcaagaacgtactag

SEQ ID NO: 200485 - DNA, 1020 bp, Artificial Sequence
  Description of Artificial Sequence: Synthetic coding sequence
atggacgagcagccccggctgatgcacagccacgccggcgtgggcatggcgggccatccagggctttcccagcatcttcaggatggagccggaggcaccgaaggcgaggggggccgcaagcaggatatcggagatattctccaacagatcatgaccatcactgatcagtccctggacgaagctcaggctagaaagcatgcactgaactgtcatcggatgaagcctgctttattcaatgtgctatgcgagattaaggagaagactgttctgtccattcgtggggctcaagaagaggagccaactgacccgcagcttatgcggctggacaatatgctcttagcagagggagtggcggggcccgaaaaaggtggaggaagtgctgcggccgctgccgctgcagctgccagtggcggtgcaggatcagacaactcagtagagcattcagactacagagccaaactgtctcaaatccggcaaatctatcacaccgaactagagaagtacgagcaagcctgtaacgagttcactacccacgtgatgaacttgctgcgggagcagtctagaaccaggccaattagtcctaaagagatcgagcgcatggttagcatcatccacagaaaatttagctctatccagatgcaattaaagcagtccacctgcgaagccgtcatgattcttagatcgaggttccttgacgccaggagaaagaggcgaaattttaataagcaagcaacagaaatcctgaacgaatatttttacagccacctgtccaacccgtacccaagcgaggaggctaaggaggagctcgctaaaaaatgcggcatcaccgtcagtcaagtcgatacactgcggcacgtcatatcccaaacaggcggatattcggacggcttggctgcgtcccagatgtattcacctcaagggatctcagccaatggtggctggcaggatgccactacaccctcctctgtgacttccccaacagagggtccagggtcagtccacagcgatacctctaactag

SEQ ID NO: 200486 - DNA, 978 bp, Artificial Sequence
  Description of Artificial Sequence: Synthetic coding sequence
atgcggctggacaacatgctgctggccgagggcgtggccggccccgaaaagggtggcggaagtgccgcagccgcggcagctgccgccgcctcgggtggcgcgggcagcgacaactcggtggagcattctgactatcgggccaagttgtcacagatacgccaaatttatcataccgagttggaaaaatacgaacaggcctgcaacgagttcacaacacatgttatgaaccttttgagagaacagagccggacacggcccatttcgccaaaggagatcgaacgaatggtgtcaattatccaccgcaagttttcttctatccagatgcagctgaaacagagtacatgtgaggccgtaatgatacttaggtcaaggttcctggacgcccgcaggaagcgcagaaatttcaataagcaggctacggagatactcaatgaatatttctactctcatctctcaaatccgtatccttccgaagaggccaaggaggaattagcaaagaagtgcggaatcaccgtgagtcaggtcagcaattggttcggcaacaaacgcatcaggtacaaaaagaacatcggcaagttccaggaggaggccaatatatacgcagctaaaacagctgtaacagctactaatgtatctgcgcacgggtcccaggccaacagtccttccaccccaaactctgctggcagcagcagttcattcaacatgtctaattcaggggacctgtttatgtcggtccagagcctgaatggggatagttaccaaggggcccaggtgggagcaaacgtccagtcccaggtagacaccctgcggcacgtcatttcgcagacagggggctacagcgacggactcgctgcttcccaaatgtactccccacaaggcatctctgctaatggggggtggcaggacgccactacaccttcaagcgttacctcaccaactgaggggcccggttcagtacattcagacacttcaaactag

SEQ ID NO: 200487 - DNA, 978 bp, Artificial Sequence
  Description of Artificial Sequence: Synthetic coding sequence
atgcggctggacaacatgctgctggccgagggcgtggccggccccgagaaggggggagggtctgcagctgccgccgcagccgccgccgcttccgggggcgctggctccgacaacagcgtagagcattccgattatagggctaagcttagtcagatcaggcagatctaccatacagagcttgaaaagtacgaacaggcctgtaatgaattcactacacacgtgatgaatttgctcagggaacaatcaaggacccggcctatttctcctaaggagatagaaaggatggtgagtattattcaccggaagttttctagtatccagatgcaactcaagcaatccacctgtgaagcggtcatgatactcagatcccgcttccttgatgcacggcggaaacgcagaaactttaacaaacaagccactgaaattttaaatgaatacttctatagtcacttgtcgaacccttatcctagtgaggaagccaaagaggagcttgcgaagaagtgcgggattactgtctcgcaggtctccaactggtttggcaataaaagaatccgttataagaaaaatatcgggaaattccaagaggaggcaaacatttatgccgcgaagacagcagtgaccgccaccaatgttagcgcccacggttcccaagccaactccccttctacacctaacagtgcagggagttcatccagcttcaacatgagcaactctggtgatctgttcatgtcagtgcagtcgcttaatggcgacagctaccagggggcccaggtgggcgccaatgtgcagagccaggttgacacattgagacatgttatttcacaaactgggggctactccgatggactggccgcctctcaaatgtattcacctcagggaattagcgccaatggagggtggcaggacgccaccactcccagctcagtgacttctcctacggagggacccggaagtgtccacagcgacactagcaattag

SEQ ID NO: 200488 - DNA, 1293 bp, Artificial Sequence
  Description of Artificial Sequence: Synthetic coding sequence
atggacgagcggctgctgggcccccccccccccggcggcggccggggagggctcggcttggtctccggggaaccaggtggcccaggtgaaccccccggcgggggtgatccaggagggggtagtgggggtgtcccaggaggacggggcaagcaagacatcggcgatattctccagcagattatgactatcaccgatcaaagcctcgatgaagcccaagcaaaaaagcatgccctgaactgccacaggatgaaacccgccctgttttccgtgctctgcgagataaaggagaagacaggactcagtatccggagcagtcaggaggaggagccagtggatcctcagcttatgcggctggacaatatgctgctggcggagggggttgcagggccagaaaaaggggggggtagtgccgctgcagcagccgccgccgccgccagcgggggcggagtgtcacccgataactccatcgagcatagcgactatcggagcaagcttgcgcaaatccgtcatatctaccactcagaactagaaaagtacgaacaagcctgtaatgagttcaccacacacgtcatgaatcttctgagggaacagagcagaacccggccagtagccccaaaggaaatggagcggatggtcagtatcattcataggaagttctctgccattcagatgcagctgaagcaatccacgtgtgaagccgtcatgatccttcgcagtcgctttttagatgctcgtaggaagcgcaggaacttctcaaaacaggctactgaagtcttgaatgagtacttttattctcacctatcgaacccgtatccatccgaggaagcgaaggaggaactagctaagaagtgcgggatcacagtgtctcaagtttctaactggttcggcaataaacgcattagatataaaaagaacatcggtaagtttcaggaagaggccaacatctacgcagtgaaaacagctgtgagcgtgacacagggcggacacagcagaacttcaagtcctaccccaccatcgtccgcgggcagtggaggctcctttaacttgtcgggcagcggagacatgttccttggtatgcccggccttaacggcgattcctacagcgccagccaggtcgaaagcctgcgccactctatggggcccggaggttacggcgacaacctaggtgggggccaaatgtactctccaagggaaatgcgcgccaatggatcatggcaggaggcagtgaccccgtccagtgttacctctccaaccgaggggcccggctcggtgcacagcgacaccagtaactag

SEQ ID NO: 200489 - DNA, 1293 bp, Artificial Sequence
  Description of Artificial Sequence: Synthetic coding sequence
atggacgagcggctgctgggcccccccccccccggcggcggccggggtggtctcgggttggtatccggggaacccgggggcccaggcgagcctccaggcgggggagatcctggtggcggttcaggaggagtccctggaggccggggaaaacaagatatcggggacatactccagcagataatgaccatcactgaccaaagcctcgacgaggcgcaggccaaaaaacacgcactcaattgccatcggatgaaacctgcgctattctctgtactttgtgaaataaaggagaaaactggcctctctatccggtcgagccaggaggaggagccagttgatccacagttgatgcggctggataatatgctgctcgccgaaggagtggccggcccagagaaaggcggcgggagcgcagccgcagccgccgctgcagccgctagtggaggaggcgtgagccctgataattccatcgagcacagcgactatagatccaagctggcccagatccggcatatttatcatagtgagctcgagaaatacgagcaagcctgcaacgaatttactacccatgtgatgaatcttctgcgtgaacaatctaggacacgacctgtagcaccgaaggagatggagaggatggtgagcataatacatcggaagttcagcgccattcagatgcagttgaaacagagcacctgtgaggccgtaatgatccttaggtcccgattcctggatgcacggagaaagcggaggaacttcagcaaacaggccactgaggtcctgaatgaatatttctatagccatctgagcaatccctacccgtctgaggaggcaaaggaagaacttgccaagaagtgtgggattaccgtgtcccaggtgtccaattggttcggcaacaaaagaattcgctacaaaaagaatattggcaagttccaggaggaagcaaatatctatgctgtcaagacggcagtcagcgtcacacaaggcggacatagcagaacatcatcacccactccaccatctagtgcaggctctggcggaagctttaatttatcaggctcaggcgatatgtttttaggcatgcctggattgaacggagactcgtacagcgctagccaggtcgagtcattgaggcattcaatgggcccaggcggttacggcgacaatctcggaggaggacaaatgtattctcctcgagaaatgagagccaacgggtcatggcaggaagcggtgacacctagcagcgtcacaagcccgactgaggggcctgggtctgtacattccgatacaagtaattag

SEQ ID NO: 200490 - DNA, 1293 bp, Artificial Sequence
  Description of Artificial Sequence: Synthetic coding sequence
atggacgagcggctgctgggcccccccccccccggcggcggccggggcggtctcggtctggtttccggcgagcctggtggtcctggtgagcctccgggcggtggagatcccggtggcgggagcggaggagtccccgggggacgcggtaagcaggacatcggcgacatcctgcaacaaatcatgacaataactgatcagtcacttgacgaagcacaagccaagaagcacgcactgaactgtcatagaatgaaaccagccctgttttcagttctgtgcgagattaaggaaaaaacaggcctctcaatcaggtcaagccaggaggaggagcccgtggacccacagctgatgaggctggataacatgctgcttgccgagggggtggccgggccagaaaagggcggaggctctgccgccgccgctgctgctgctgcggcctccggcggcggggtgtcccccgacaacagtatagagcactccgactataggtcgaagttagcacagatccggcatatttatcactcagaactggaaaagtatgagcaggcctgcaatgagtttaccacccacgtgatgaatctgttgcgtgagcagtcccgtacccgcccggtggcaccaaaagaaatggaaaggatggtgtccataattcataggaagttctctgccatccagatgcagctgaagcagtcgacctgtgaggcagtgatgatcctgcgctcgcgcttcctggatgccaggcggaaacggagaaatttttctaagcaagctacggaggtgctgaacgagtacttttatagtcacctttctaacccctatccctccgaagaagcgaaggaagagttggccaaaaagtgcggtataactgtcagccaagtgagtaattggttcgggaacaagcgcatccgttacaagaaaaacatcggaaagttccaagaagaggctaatatttatgcagtgaagactgccgtgagtgtaacacagggcggtcactctaggacctcctctcccaccccaccaagcagcgccggctcgggtggctcctttaacttgtccggaagcggcgacatgtttctgggaatgccaggactgaacggagattcctattcggcctcccaggtggaaagtttgcgccactctatgggacccggaggctacggcgacaacctggggggtggccagatgtatagccctagagaaatgcgagcaaatggcagctggcaggaggccgttactccgtcatcagtgacctcacccacagaaggtccgggctcagtacacagcgatacaagcaattag

SEQ ID NO: 200491 - DNA, 1293 bp, Artificial Sequence
  Description of Artificial Sequence: Synthetic coding sequence
atggacgagcggctgctgggcccccccccccccggcggcggccggggcggcctggggcttgttagcggcgagccagggggacctggcgagcctcctggcgggggtgaccccggcggcggttccggtggcgtacccggtggaaggggaaagcaggatatcggcgacatcctgcagcaaattatgaccataaccgatcagtccctcgatgaggcccaggctaaaaaacacgccctaaattgccacaggatgaaacccgccctgttctcggtgctctgcgagattaaagaaaagaccggactcagcatcagatcctcacaggaggaggaacccgtggaccctcaacttatgagactagataatatgcttcttgccgagggggtcgcagggcccgaaaaaggcggagggtctgccgcggcggccgctgcagctgccgcttccggcggaggcgtatccccagataactccatagaacactcagactatcggtcgaaactcgcccagattaggcatatctatcattcagagttggagaagtatgaacaagcatgtaatgagttcactacacatgtaatgaacctgctgagggaacagagtcggactagaccagtggcgcctaaagagatggagaggatggtgtccattatccacagaaaatttagcgctatccaaatgcagctcaagcagtctacctgtgaagctgttatgatactaagaagccggttcctggatgcacgccgcaaacggaggaatttcagcaaacaggccaccgaagttttgaacgagtacttctactcacacctttcaaatccctacccttcagaggaagcaaaagaagaactcgcgaagaagtgcgggattacagtcagccaagtgagtaattggttcggtaataagaggatcagatacaagaaaaacatcggtaaattccaggaagaggccaatatatatgcggtaaagactgcagtgagcgtcacccagggcggacatagccgcacgagttctcctaccccaccctctagtgccggtagtggaggatcttttaatttgtcgggcagcggcgacatgttcctcggcatgcccggcctgaacggtgactcatatagcgcttctcaggtagagtcactccgtcattcaatggggcccgggggatatggggacaatctgggtggcggccagatgtattcaccccgggagatgcgggcaaatgggagttggcaggaggccgtcactcccagcagcgtcaccagccctaccgagggccccggctccgtgcatagtgatacctccaactag

SEQ ID NO: 200492 - DNA, 1293 bp, Artificial Sequence
  Description of Artificial Sequence: Synthetic coding sequence
atggacgagcggctgctgggcccccccccccccggcggcggccggggcggtctgggtctcgtcagcggggaacccgggggacctggcgagcctcctgggggtggcgaccccggtgggggctccggcggcgtgccaggcggtcggggaaagcaggatatcggggatatactgcagcaaattatgaccatcacggatcaatccttagatgaagctcaagccaaaaagcacgctctcaattgccatcggatgaagcctgctctgttctctgtgctgtgtgagattaaggagaagactgggctgagcattcgcagttcacaggaggaagagccagtcgatccgcagttgatgagactagacaacatgctgttggctgaaggcgtcgcaggacccgagaaggggggagggagcgccgcagctgccgcagcagctgcggcctccgggggaggcgtctccccggataacagcattgaacatagcgattatagatccaaactggctcagataaggcacatctaccattcagaattggaaaaatacgaacaggcctgcaacgagtttactacacatgtgatgaatctcctgcgggagcagtcgagaacaaggcctgtcgcacctaaggagatggaacggatggtctcaatcattcatcggaagtttagtgcgatccaaatgcaactgaagcagtccacctgtgaagccgtaatgattctccgatcccggtttctcgatgctagaaggaaaagaaggaactttagcaaacaggcgacggaggtcttaaatgaatacttctattctcacctttcgaatccttacccgtccgaggaggccaaagaagagctggcaaagaagtgtggcatcaccgtgagccaggtgtccaattggtttggcaacaagcggattaggtacaagaaaaacattggaaagtttcaggaggaggcgaacatttatgctgtaaagactgcggtgtccgtgacccagggaggccattcacgaacgtcaagcccgactcctcctagctctgccggtagcggcggctccttcaacctcagtgggtctggagacatgtttctgggtatgcctgggctgaacggggactcatactcagctagccaggttgagtcgcttcgccattccatggggccaggaggctatggagataacctaggggggggtcagatgtattctccccgcgagatgcgggctaatgggtcatggcaggaggcagtcacaccctctagcgttactagcccaactgaaggacccgggtctgtgcacagtgatacctccaattag

SEQ ID NO: 200493 - DNA, 1293 bp, Artificial Sequence
  Description of Artificial Sequence: Synthetic coding sequence
atggacgagcggctgctgggcccccccccccccggcggcggccggggggggcttggtttggtctctggagagcccggtggacccggagagccgcctggagggggggacccaggaggcgggagtggcggcgttccgggcggcagggggaaacaggacatcggcgatatcctacagcaaataatgacaatcacagatcagagcctggatgaagcccaagccaagaagcatgcgctgaactgtcacagaatgaaaccagccttattctctgtactctgcgaaatcaaggaaaagacagggctaagcatcaggtcttcacaggaggaggagccagtggatccccagctcatgcgcctggataatatgctcctggcagagggggtggccggacccgagaaaggtggaggaagcgcggccgccgctgccgctgctgcagcctccggcgggggcgttagcccagataacagtattgagcacagtgattaccgctcaaaactggcccagattagacatatttaccactccgagctggaaaaatacgagcaggcctgtaacgagtttactacacatgtcatgaatctcttgagagaacagagccgtacccggcccgtcgcccctaaagagatggaacgaatggtctctatcattcatagaaaattcagtgcaatacagatgcagctcaaacaatccacctgtgaggcagtgatgatactgcgaagcaggttcctcgacgctaggcgtaaaaggcgaaacttcagcaagcaggcaacagaagtcctgaatgagtacttctactctcatttgtctaacccatacccttctgaggaggccaaggaagaactcgccaaaaagtgtgggataacagtatcgcaggtcagtaattggttcgggaataagcggatccgatacaaaaaaaacatcggcaagttccaggaagaagccaatatttacgccgtcaaaacggcagtttccgtgacgcagggcgggcatagcaggacgtcttcaccaacccctccaagctctgcgggcagcggagggagcttcaatctgagcggttctggagacatgttcctcggtatgccaggccttaatggcgacagctattctgcatcccaggtggagtccctaagacacagcatgggtcccggaggttatggggataatttggggggcggccagatgtactcaccgcgcgagatgcgggcaaacggaagctggcaggaggcagtcaccccctccagcgtcacatctccaaccgaagggccgggttctgtgcactctgatacgtccaattag

SEQ ID NO: 200494 - DNA, 1293 bp, Artificial Sequence
  Description of Artificial Sequence: Synthetic coding sequence
atggacgagcggctgctgggcccccccccccccggcggcggccggggcgggttaggactcgttagtggagagcctggcggccctggggagccgcctggaggtggtgacccaggcggcggatcagggggggtccctggggggagggggaagcaggatataggcgacatcctacagcaaattatgaccattacagaccagagcttggacgaggcgcaggccaagaaacacgctctgaactgccatcggatgaaacctgcacttttttctgtcctgtgcgaaataaaagagaaaaccggcctctcgatccggtctagtcaggaagaggaaccagtcgatcctcagcttatgaggcttgataatatgttgttagcagagggcgtggcgggccctgagaaaggaggcggatctgcagcagccgccgctgctgcggccgcgagcggaggcggggttagccctgataactcaatcgaacattccgactatcgaagcaagctggctcagatcagacacatataccactccgagcttgagaagtacgaacaagcctgtaacgagtttacaactcacgtaatgaacttattgcgtgagcagtcccgcacacgacctgtggcacctaaggagatggaaaggatggtgtcgattatccaccgcaaattcagtgccatacagatgcagctaaaacagagcacctgtgaggcggtgatgattctacgaagtagattcctggacgctcggaggaagaggagaaacttctctaagcaagcaacagaggtcctgaatgagtatttctacagccatctgtcaaatccgtaccctagcgaggaagccaaggaggaattggccaagaaatgcggaattactgtgtcacaggtgtcaaactggttcggcaataagagaatacggtacaagaagaacatcgggaagtttcaggaagaggcaaacatctacgctgtgaagaccgctgttagcgtcacacaaggcggccactcacggacctcttctccaacccccccaagttccgctggatccgggggctcattcaatttaagcgggtcaggagacatgttcctgggcatgcctgggttgaatggcgactcctactccgcctcccaggtggagtcactacggcactccatgggacccgggggctatggggataatcttggtgggggccagatgtattcgccaagggagatgcgagctaatggatcatggcaagaggctgtgaccccaagctctgttacatcacctaccgaaggcccaggtagcgtccacagcgacacgtcgaattag

SEQ ID NO: 200495 - DNA, 1392 bp, Artificial Sequence
  Description of Artificial Sequence: Synthetic coding sequence
atggacgagcggctgctgggcccccccccccccggcggcggccgggggggcctaggtttagtttccggtgaacccggcggaccaggagagccgcccggggggggcgatcctggcggcggaagtggaggtgtgccaggaggaagggggaagcaagacatcggagacatcctccagcaaataatgaccatcactgatcagtccctggatgaggcgcaggcaaagaagcacgccctgaactgtcatcgaatgaagcctgctttgttcagcgtgctctgcgaaattaaagaaaaaacagggctgtcgatccggtccagtcaggaagaagagccagttgatcctcagttgatgcgactggataacatgctacttgccgaaggggttgccggccccgagaagggcggaggctccgcagccgccgccgccgccgctgcagcgagtggtggtggcgtctccccagacaactcaattgaacacagcgattataggtctaagttagcccaaattagacatatctatcacagcgaattggaaaaatacgaacaagcatgcaacgagtttacaacccatgtgatgaatctgttgagggaacagtcccgcacgcgaccagtggcccccaaggaaatggagcgaatggtgtccattatacataggaagttctccgctattcagatgcagttgaagcagagtacatgtgaggccgtgatgattctcagatcccgctttctcgatgccaggcgcaaacggcgcaacttctccaagcaggccacagaagtgcttaatgagtacttttactcgcatttatcgaatccgtacccgtcagaggaggcgaaggaggaactcgctaagaaatgtggcattaccgtgagtcaggtcctctggagattaagggaagaactgagcggcaaggtccatgcatcccagctcggagccgtggtgagtaactggttcggcaataagcggatcaggtacaagaagaatatagggaagttccaagaagaggctaacatttacgcagtaaagaccgctgttatcatcgccgagagagggccttttggcgtgaggggcactgagttgagccttccatctctcccaccccagggatcaggaggttcattcaatctgtcagggtccggagatatgtttctgggcatgcccggactcaatggtgacagctatagtgcgtcccaggtaagatgcccaagtcccttgcaggtagagagtctcagacatagtatggggccaggcgggtacggggacaacctcggaggcggacagatgtacagtccaagagagatgcgagccaacggttcatggcaggaagcagtaactccatcgtcagtaactagccccacagaagggcctgggagtgtgcactctgatacctcaaactag

SEQ ID NO: 200496 - DNA, 1392 bp, Artificial Sequence
  Description of Artificial Sequence: Synthetic coding sequence
atggacgagcggctgctgggcccccccccccccggcggcggccggggaggtctgggcctcgtctcaggcgaacccggcgggccgggggagccgcccggtggcggggaccccggtggaggctcaggcggtgtgcccggcggtcgcgggaagcaggatattggagacatcctgcagcagatcatgaccattaccgaccaaagtttggacgaggcacaggcgaagaagcatgccctgaactgtcaccgtatgaagccagcattgttctcggtgctgtgtgagatcaaggaaaagacgggattgagtatcagaagttctcaggaagaggagcccgtggatccccagctcatgcgcctggataatatgcttctcgccgaaggtgtcgccgggccagagaagggaggcgggagtgccgcagccgccgccgccgcagccgccagcggcggtggagtttccccagacaactctattgagcattccgactaccggtcaaagctagcccaaatccgacacatttaccacagcgagctggaaaaatacgagcaggcgtgtaacgagttcaccacacatgttatgaatctgctccgggagcagagtcgaactaggcccgtcgcgccaaaggagatggaaagaatggtgtccataatacaccgaaagtttagcgctatccagatgcagttgaaacaaagcacttgcgaggccgtcatgatcctgaggtctaggttcctggatgctcgaagaaagcgacggaatttcagtaaacaagccacagaggtcctcaatgagtatttctactctcatctgtcaaatccatatcccagtgaagaggctaaggaggagctagctaaaaagtgcgggattacagtctcccaagtcctctggcgactgcgagaggagttgtctgggaaagtccacgcttcacagctgggtgcggtcgtctccaactggttcgggaataagaggataaggtacaaaaaaaacataggtaagtttcaagaagaggccaatatttacgcagtaaagactgcagttataatcgccgagcgaggcccattcggcgtaagaggtacggaattgagcctgcctagtctgccccctcagggctccggagggtcctttaatctgtccgggtctggggacatgtttcttggaatgccaggcctcaatggtgatagctacagcgcttcacaggtgagatgcccatctccattacaggtggagagcctgcgccatagcatgggccctgggggctacggagataatcttggaggcggccagatgtatagtccccgtgaaatgagagccaatggaagttggcaggaggccgtgactccctcctccgtcactagcccaaccgaaggcccgggatctgtgcactctgacacttcgaactag

SEQ ID NO: 200497 - DNA, 1317 bp, Artificial Sequence
  Description of Artificial Sequence: Synthetic coding sequence
atggacgagcggctgctgggcccccccccccccggcggcggccgggggggactggggctcgtgtccggagaacctggcggacctggggagcccccagggggcggcgatcccggggggggcagcgggggggtgcccggagggaggggcaaacaggatattggtgacattctgcagcagattatgacaatcaccgaccaatccttggatgaggctcaagccaagaaacacgcattaaattgtcatcgtatgaaaccggccctgttttccgttttgtgtgagattaaagagaagaccggcctctccattcggtcctcacaggaagaggagccagtggatccccagctgatgaggcttgataacatgctccttgctgagggagtggccggccctgaaaagggggggggtagcgcagcagcagcagctgccgcggctgcttccggaggcggtgtgtccccggacaattctatcgagcacagtgactaccggtctaaactggctcaaattagacatatctatcattccgaattggagaaatacgagcaagcatgtaacgaattcactacacacgtgatgaacctgctcagggagcaatccagaacccgtcctgtcgcccccaaagagatggaaagaatggtcagtataattcaccgaaagttttccgccatacaaatgcaactgaaacaatcaacctgcgaagcagtaatgattctcagatcacggttcctagacgcccgccggaagcgcagaaacttttccaagcaagcgaccgaagtactgaacgagtacttctattcccacctgagcaacccgtatcctagtgaagaggccaaggaggaactggccaaaaagtgcgggataacagtgtcacaagtgtccaattggttcggaaataagcgcatccggtacaagaaaaacatcggtaagttccaggaggaggctaacatttacgcggtgaaaaccgccgtgtccgtaactcaagggggtcattcccgcaccagtagcccaacacccccttcctccgccggttctgggggcagtttcaacctctcaggatcgggagacatgtttctggggatgccaggcttgaatggcgacagttatagcgcctcccaggtgcggtgcccaagtcctctgcaggtcgaatcactgcgtcatagcatgggccctggaggctacggagacaatttgggcgggggacagatgtactccccaagagaaatgagagcgaacggttcctggcaggaggctgtcaccccctcttccgtgacatcccccacagagggccccggctccgtgcactcggacactagcaattag

SEQ ID NO: 200498 - DNA, 1317 bp, Artificial Sequence
  Description of Artificial Sequence: Synthetic coding sequence
atggacgagcggctgctgggcccccccccccccggcggcggccggggagggttgggcctagtcagtggcgagcccggcggtcccggagaaccgcccggtggtggggacccgggaggaggctctggaggggtccccgggggcagaggaaagcaggatatcggagatattctccagcagatcatgacaattactgatcagagtctcgatgaagcccaggccaagaaacatgccttgaattgccacagaatgaaacccgcgttattttccgtgctgtgcgaaatcaaagagaaaaccggactcagcattagatccagccaggaagaggagccagttgatcctcagctaatgcggctggacaacatgttactagcagagggcgtggctggcccagaaaaggggggtggctccgccgctgcggcagcagcagctgccgcaagtggcgggggcgtctccccagacaacagtatagagcacagcgactacagatcaaagttagcccagatccgccacatttaccactctgaactggagaaatacgagcaggcatgcaacgagtttacaacacacgtgatgaatctgctgcgcgaacaatcgagaactcggccagtggctccgaaggagatggagcggatggtctctatcatccacagaaagttctcggcaattcagatgcagctaaagcaaagcacctgcgaagctgttatgatcctcaggagccggtttctggatgcccgaaggaaaaggcgcaacttctccaaacaggctaccgaagtgctgaatgagtacttctattcccacctgagtaatccgtatccatcagaagaggctaaagaagaactagctaagaaatgtggcatcacggtgtcccaggtgagcaattggttcgggaataagcgcatcagatataagaaaaacattggaaagtttcaagaggaggcaaacatttacgccgtgaaaaccgccgtttctgtgactcaagggggacattcacggacctcctcaccaactccccccagctcagctgggagtgggggaagctttaacctgagcggcagcggcgacatgttcctggggatgcctggtcttaacggtgactcatactccgcaagtcaggtgcggtgcccatctcctttgcaagtcgaaagcttacgacactccatgggaccgggcgggtatggagacaacctgggcggcggacagatgtactcaccgcgtgagatgcgggccaatggcagctggcaagaggctgtcactcccagcagtgtcacgtcacctaccgaagggcctggatcagtccacagtgatacaagcaattag

SEQ ID NO: 200499 - DNA, 1392 bp, Artificial Sequence
  Description of Artificial Sequence: Synthetic coding sequence
atggacgagcggctgctgggcccccccccccccggcggcggccgggggggcttaggactagtgtctggggagcctggtggtccaggcgaacccccggggggcggagatcctggtggaggcagtgggggggttccaggcggccgcggtaaacaggacataggcgacatcctgcagcaaataatgacaattaccgaccagagcctagatgaggctcaggctaagaaacacgcactgaattgccaccgtatgaaacccgctctgtttagcgtgctgtgcgaaataaaggaaaaaaccggcctctccattcggtctagccaggaagaggagccagttgacccgcaattaatgcggttagacaatatgctcctggcggaaggagtggcgggccccgaaaaaggtgggggctctgccgccgccgccgccgcagccgccgcaagcggcggcggcgtctctcccgataacagcatagagcatagcgactataggtcaaagctggcacagatccgccatatctaccattctgaattggaaaagtatgagcaggcctgtaatgaattcactacacacgttatgaacctgcttcgagaacagtctaggacccgtccggttgcccctaaggagatggaacgcatggtctctattatccaccggaagttcagcgctatacagatgcagcttaaacaatctacctgcgaagccgtcatgatcctcagatctcgctttctagacgcccgccgaaaacggcggaatttttcaaaacaagccacagaggtgctgaatgagtacttctactcccacctctctaacccttaccccagcgaagaagctaaggaggagttagcaaaaaagtgtgggattacagtctcccaggtcctttggcgattaagggaggagctctctggcaaagttcatgcatcccagctaggagccgtggtctctaactggtttggaaacaagaggatccggtacaagaaaaatattgggaaattccaggaggaggccaatatatacgccgtcaaaacagccgtcattatcgctgagcgtgggccattcggagtgcggggaaccgagctgagcctgccgagcttgcctccccagggatccggcggtagttttaacctaagtgggagcggtgacatgtttctcggaatgcctggactgaacggagattcttatagcgccagtcaggtgagatgcccttccccactccaggtcgaaagcctgcgccactccatgggtccgggaggctacggagacaaccttggcggagggcaaatgtatagccctcgcgaaatgcgagccaatggatcgtggcaggaagccgtgactccaagcagtgttacttcccctacagaggggcccggaagcgtacacagtgatacttctaactag

SEQ ID NO: 200500 - DNA, 1392 bp, Artificial Sequence
  Description of Artificial Sequence: Synthetic coding sequence
atggacgagcggctgctgggcccccccccccccggcggcggccggggcgggttggggctggtttctggcgagccagggggcccaggggagccgcctgggggaggtgaccctggtggtggctctggtggcgtgccgggtgggcgcggcaagcaggatattggcgacattttgcagcaaattatgacaatcacggatcaatccttggatgaagcccaggccaaaaaacatgcacttaattgtcatagaatgaaacctgccctgttctcggtgctgtgcgagatcaaagaaaagactggactgtcgatcagaagctcccaagaggaagaacccgtcgacccccaactcatgaggttggacaatatgcttctcgcagaaggtgtggccgggcccgaaaagggcggggggtctgcggccgccgctgcggcggccgcggcttctgggggtggagtgagtcctgataattcgatcgagcactctgattatcggtctaagctggcccaaattagacatatctaccatagtgaattggagaagtatgaacaggcatgcaacgagttcaccacccacgtgatgaatctcctgcgcgagcagagccgaacgcggcctgtggcacccaaagaaatggaaaggatggtaagcattatccacagaaagttttccgctatccaaatgcagctgaagcagtctacctgtgaagccgtaatgattctgcggtcccgctttctcgacgctagacgcaagagacggaatttcagcaagcaggcgaccgaggtcctcaacgaatacttctactctcatctgtccaatccatacccaagcgaggaagccaaagaggaactagcaaagaagtgcggcattactgtgagtcaggtactgtggcgcctgcgagaggaactcagcggtaaggtgcatgcttcacaacttggcgctgttgtgagtaattggttcggaaataagagaatacggtacaagaaaaacatcggaaaatttcaagaggaggccaatatctacgcagtgaagaccgcagtcataatcgccgagcgaggtccgttcggggtgagagggaccgagctgtccctgcctagtcttcctccacagggttctgggggttcatttaatctctctggttcaggggacatgttcttgggtatgcctgggttgaatggagacagttacagtgccagccaggtacgatgcccctctccccttcaggtcgaatctctcaggcacagcatggggcctggcggctacggagacaatctgggaggcggacaaatgtattcccctcgtgaaatgagggcaaatgggagctggcaagaggctgttactccttcaagcgtgacatctccaactgaaggaccaggatctgtgcactcagacacctcaaattag

SEQ ID NO: 200501 - DNA, 1332 bp, Artificial Sequence
  Description of Artificial Sequence: Synthetic coding sequence
ggcgccgagcagggcggcggcctgcgggcccccccccagctgtggactaacggatactggggcaggcctctccaggctggggccggaggactgggcttggtgtctggcgaacccggcggacccggggagccaccgggaggaggagaccccgggggcggctccggaggagtgccagggggacggggtaaacaagatattggggacatcctacagcagatcatgacaattacggaccaaagcctcgatgaagcacaagccaaaaaacatgctctgaactgccatagaatgaagcccgcgcttttcagtgtgctatgcgagatcaaggagaaaaccgggctctcaataagatcaagccaagaggaagaacctgtggacccccagttaatgcgcctcgacaatatgctgctagcggagggtgttgctggtcctgagaaaggcgggggctctgccgcggctgctgcagccgctgccgcgtccgggggcggtgtgagccctgataattcgattgaacatagcgattacaggtcaaagctagcccaaatccggcacatttaccactcagaattagagaagtacgagcaggcgtgcaacgagttcaccacccacgtgatgaacctgctgcgcgaacaatctcggacgcgtcctgtcgccccaaaagaaatggagagaatggtgtcaattattcaccggaaattctcggctatccagatgcagctgaagcagtcaacatgcgaggccgtgatgattctgcgctctaggttcctggatgcacgaaggaaacgacgaaacttttccaaacaagcaactgaggttctgaacgaatatttttattctcacctgagcaacccatatccgtccgaggaggccaaggaggagcttgcgaaaaaatgtggtatcaccgtgtctcaagtgtctaactggtttggcaataaaagaatcagatataagaaaaatatcggaaagtttcaagaagaagccaacatatatgccgtgaaaactgccgtgagcgtaacccagggggggcactccaggacgtctagcccgacgcctcccagcagtgctgggtcgggcggatctttcaacctgagcggctccggggatatgtttctggggatgcccggacttaatggcgacagctatagcgccagtcaagtagaatctctcaggcacagtatggggccgggagggtacggggataatctaggaggtggccagatgtacagcccaagagagatgagagccaatggatcttggcaggaagctgtaaccccgtcaagcgtcacatcaccgacagaaggccctggttcagttcatagtgacacctctaattag

SEQ ID NO: 200502 - DNA, 1332 bp, Artificial Sequence
  Description of Artificial Sequence: Synthetic coding sequence
ggcgccgagcagggcggcggcctgcgggcccccccccagctgtggacaaacgggtactggggccgacccctccaggctggcgctggcgggctgggcttagtctctggagaaccaggggggcctggcgaacccccggggggcggtgaccccggtggtgggtcagggggagtgcccgggggcagaggcaagcaggacattggtgatattttacaacagatcatgaccattaccgaccaaagcctggatgaggcacaagctaaaaagcacgctctgaattgccaccggatgaagccggctttgttcagcgtcttgtgcgagatcaaagaaaagacgggactgagcattcggtcctctcaggaagaggagccagtcgaccctcagctgatgcggctggacaatatgctcctggccgagggtgtcgccggcccggagaagggtggcgggtccgcagcggccgcggcagcagccgcagcctcaggcggcggcgtatcccctgataatagcattgagcactcagactaccgctctaaacttgcacagatacgccacatttatcactccgaattggaaaagtacgagcaagcctgtaacgaattcacaactcatgtgatgaatttacttcgagaacaatctcgcacgcggccggttgctccaaaagagatggagcgaatggtgagcataattcaccggaagttcagcgccatccaaatgcaacttaagcagtccacttgcgaagccgttatgatcttacgaagccggtttctggacgccaggcggaaacggaggaatttcagtaagcaggcaacggaggtgctgaatgagtacttctacagccatctaagcaacccatatccgagcgaggaggcgaaagaagaactcgcaaagaagtgcgggataactgtctcccaagtgtccaactggttcggtaataagagaatcaggtacaaaaagaacattggtaaatttcaggaagaggccaacatctacgctgtgaagacagcagttagcgtcacacagggaggccacagccgtacttcatccccaacacctccctcctcagccggtagcggcggatctttcaacctatctggtagcggcgacatgttcctgggcatgcctggcctcaacggggattcatacagcgcctcccaggtggagtctcttcgccacagtatgggacctggcggatatggagacaatttggggggcggacagatgtactccccacgagaaatgcgagctaacggatcctggcaggaggccgtgaccccgtcaagtgtcacttcccccactgagggccccggctcagtacattctgatacatccaactag

SEQ ID NO: 200503 - DNA, 1317 bp, Artificial Sequence
  Description of Artificial Sequence: Synthetic coding sequence
atggacgagcggctgctgggcccccccccccccggcggcggccggggcgggctgggtctggttagtggcgagcccggcgggccaggcgagccccccggaggtggcgaccccggcggcggctccggcggcgtgcccgggggacgggggaaacaggacattggagacatactccaacagatcatgaccattaccgatcaaagcctggatgaagcccaagccaagaagcacgcccttaattgtcacagaatgaaaccagcgctattctccgtcttatgcgaaatcaaggaaaaaacaggactcagcataagatcatcacaggaggaagagcctgttgatccccagctcatgaggctggataatatgctcctcgcagagggggtcgccggccccgaaaaagggggagggagtgccgccgctgcagccgccgcggcagctagcggtggtggcgtaagtcccgacaatagtatcgagcatagtgactacagaagtaaactggcccagattagacatatatatcacagcgaactggagaaatacgagcaagcctgtaatgaattcaccacccatgtcatgaacctgctcagggagcagagccggacacgcccagtagctcccaaggaaatggagagaatggtctcaattatccacaggaagttctctgccatccagatgcagctgaagcagtctacctgcgaggcagttatgatccttcgatctcgatttctggatgctcggcgtaagcggagaaatttttccaaacaggccaccgaggtgctgaatgaatacttttattcacatttgagtaacccctatccttctgaagaggcaaaggaagagctcgcaaaaaaatgtggaattacagtgtcccaggtatctaactggttcggaaacaaacgaatacgctacaagaagaatatcggcaaattccaggaagaggccaacatttacgcagtgaaaactgcggttagtgtgacccagggcggacactcacgcacatcctctcctacacctccgtcctctgctgggtcaggcggaagtttcaacctctcaggatcaggggacatgtttttgggtatgccagggctgaacggggattcttacagtgcctctcaggtcagatgtccatcgcctttgcaggttgaatctctccgccattcaatggggcccgggggatacggcgacaacctagggggcggccagatgtattcaccaagggagatgagggccaatggatcctggcaggaggccgtgacgccttcttccgtgacttcgcccactgaagggccaggatctgttcactcagatactagcaactag

SEQ ID NO: 200504 - DNA, 1380 bp, Artificial Sequence
  Description of Artificial Sequence: Synthetic coding sequence
atggacgagcggctgctgggcccccccccccccggcggcggccggggtggcctaggtctggtttccggcgagcccggggggccgggggaaccccctggaggtggggacccaggcggagggagcggcggggtacctggtggccgaggcaagcaggacataggcgatattctgcagcagattatgacaattacagatcaatcactggatgaagcacaggccaaaaaacacgccctgaactgtcatcgcatgaagcctgcactgttcagtgtcctgtgtgagatcaaagaaaagactggcctgagtatccggagttctcaggaggaagagccggtggacccccagctgatgcgcctggacaatatgctgctggccgagggcgtggcaggcccagaaaagggcgggggaagcgctgctgccgcagcggccgccgccgcatccggaggaggtgtgagccccgacaattccatcgaacactctgattacaggtcaaagttagcccagatacgtcacatctaccactccgaactggaaaaatatgagcaagcctgcaacgagttcaccacgcacgtcatgaatcttctccgtgaacaaagccgtacccgccccgtggcgccaaaggagatggagagaatggtctcaattattcaccgtaagttctccgcaatccagatgcaattaaaacagtccacgtgtgaggccgtgatgattctccgctccaggttcctggatgccaggcggaagcggcgaaacttcagcaagcaggctaccgaagtgctgaacgaatacttttattcccacctatcaaacccttacccaagtgaagaggccaaggaggaactggcgaagaagtgtggaatcacggtgagccaggtgctgtggaggctcagggaggaactgtccggcaaggtacacgcatctcagctgggagctgtggtgagtaattggttcggaaataaacgtattcgctacaagaaaaacatcgggaagtttcaggaggaggccaacatttacgccgtgaaaacagcggtgtccgtgactcagggaggacactcgaggacctcaagcccaacccctccaagcagtgcgggctcaggcggcagcttcaatctcagcggttccggcgatatgttcctggggatgccagggctaaatggcgacagctactccgcatcacaggtgcgttgccccagcccccttcaggtcgagagcttgcgccactccatgggccctggcgggtatggtgacaatttaggtgggggccagatgtatagcccacgggagatgcgcgcaaacggatcttggcaggaggcagtaactccatccagtgtcacttcccctaccgaaggtcctggatctgtccattctgatacatcaaattag

SEQ ID NO: 200505 - DNA, 1332 bp, Artificial Sequence
  Description of Artificial Sequence: Synthetic coding sequence
ggcgccgagcagggcggcggcctgcgggcccccccccagctgtggacaaacgggtactggggccgcccacttcaagccggagccgggggacttggcctggtgtcaggcgagcccggcggacccggcgaaccacccggcggtggcgatcccggcggtggctctgggggagtgcccggggggcgggggaagcaagatatcggagacatactgcagcagattatgaccatcacagaccagtctcttgacgaggcccaggccaaaaagcacgctctgaattgccacaggatgaaaccagcgcttttcagtgtgctctgtgaaatcaaagaaaagacggggctgtccattaggtccagccaggaagaggaacctgtcgaccctcagctcatgcgtttagataatatgcttttagcagaaggagtagcggggcctgagaagggaggcgggtctgctgctgccgccgccgccgctgctgcttccggcggcggggtgtctcctgacaattcgatagagcattcagattatagatccaaacttgctcagatccgtcacatctaccactccgaacttgagaaatacgagcaggcctgtaacgagttcacaacccacgtcatgaatctacttcgagagcaatcaaggacaagaccagtggcgccaaaagagatggagcggatggtctccattatccaccggaagttctcagccattcaaatgcaactgaaacaaagtacatgcgaggccgtcatgatccttcgatcccgattcctagacgcacgtagaaaaagacgaaacttttctaagcaagctactgaagtgctaaatgagtacttttatagtcatctctctaatccctatccttccgaagaggccaaggaggaactggccaagaaatgcggtattaccgtctctcaagtcagtaactggtttggaaataagagaattcggtacaaaaagaatataggtaagtttcaagaagaagctaacatatacgctgtaaagaccgcagtctccgtgactcagggcggccacagccgtacttcgtctcctactcccccctcttctgccggaagcggcggctctttcaatctctcaggaagcggtgacatgttcctcgggatgccaggccttaatggggactcctactcagcctctcaggttgagtctctccgacattctatggggcctggaggctacggggacaacctgggcggaggtcagatgtatagtccccgagaaatgagagctaacggatcttggcaggaagcagtgaccccatcttccgtcacttcgccaactgaggggcctggctcagtgcactctgacactagcaattag

SEQ ID NO: 200506 - DNA, 1317 bp, Artificial Sequence
  Description of Artificial Sequence: Synthetic coding sequence
atggacgagcggctgctgggcccccccccccccggcggcggccggggcggacttggcttggtcagcggggagcctggaggacccggagagccaccgggcggcggagatcccggcggtggctccgggggcgttcccggagggcgcggcaaacaggatatcggggacattttacagcaaattatgaccatcactgaccagtctcttgatgaagctcaggccaaaaagcatgctctcaactgccaccggatgaagcccgctctcttctctgtcttgtgcgaaatcaaagagaaaaccgggctgtcaatcagaagtagtcaggaagaagaaccagttgacccccaactgatgagattggacaatatgctcttggctgagggggttgccggccccgagaagggaggtggaagtgcagcagcagcagccgctgctgctgctagcggaggtggagtgagtcctgataattccatcgagcattctgactaccgaagcaaattagcccagattcggcatatctaccatagcgagcttgaaaagtacgagcaggcatgcaacgaatttacaactcacgtcatgaacctcctgagggagcagtcacgcactagaccagtcgcccccaaggagatggaaaggatggtaagcatcatacaccgcaaattctctgccattcagatgcagctgaagcagtccacctgcgaggcagtcatgattctcaggtcccggtttctggacgcccggagaaagaggagaaacttcagcaagcaggctactgaagtgttaaatgagtacttttatagtcacctctctaatccttatccttctgaagaagcgaaagaggaattagcaaagaaatgtggcattacagtctcacaggtaagtaactggtttggcaacaagcggatcaggtacaagaagaatataggcaagttccaggaggaggctaacatctatgctgtgaagactgccgtgagtgtgacgcagggggggcattctcgaacttcatctccgacccccccctcctcagcagggagtggcggcagcttcaatctgtccgggtctggggacatgtttcttggcatgccaggtctaaacggggattcttattccgcttcccaggtgaggtgcccatcgcctctgcaagttgagtcactgcgacactccatgggacccggaggctatggggataacctgggggggggacagatgtattccccaagggaaatgcgcgcgaatgggtcttggcaggaagccgttacaccttcctcagtgacatcccctacagagggtccagggtcagtacattccgatacaagcaattag

SEQ ID NO: 200507 - DNA, 1317 bp, Artificial Sequence
  Description of Artificial Sequence: Synthetic coding sequence
atggacgagcggctgctgggcccccccccccccggcggcggccggggcggcctcggactggtctctggagagcccggcggacccggcgagccacctgggggcggggaccctggtggaggaagtggcggcgtgcccggagggagagggaaacaggacattggagatattcttcagcaaattatgacaatcaccgatcaatcgttagacgaggcacaagctaaaaaacatgcactcaactgccatagaatgaagcccgcccttttctccgtcttgtgcgaaataaaggaaaagactggactctcgattcggtcaagccaggaggaggagcccgttgacccccagcttatgcggctggacaatatgttgctggccgagggcgtcgccggccccgaaaagggggggggctccgctgcagcagcggcagccgccgctgcctctgggggtggcgtctcccctgataactcgatcgagcactcagattaccggagcaaacttgcccagatcagacatatctaccatagtgagttggaaaaatacgagcaggcctgcaatgagttcacaactcacgtgatgaaccttcttagggagcagtcacgcacaagacctgtggcgcccaaggagatggagagaatggtcagcattatccatcgcaagttttccgccattcagatgcagttaaaacagagcacctgtgaagccgtaatgatactccgctcccggttcttagatgcgagacggaaaaggagaaatttttcaaaacaggccacagaagtgctgaatgagtacttctacagtcatctgagcaatccatacccaagtgaagaggcaaaggaggagcttgccaagaaatgcgggatcaccgtaagtcaagtttcaaactggttcggcaacaagaggatacgatacaaaaaaaatattggcaagttccaggaagaagccaatatttacgctgtgaagaccgcagttagcgtgacccagggcggacactctagaacttccagcccaacccccccctccagcgccgggtccggaggcagcttcaatttgagtggctccggtgacatgtttctcggcatgcccggcttaaacggggacagttacagcgcaagtcaagtacggtgtccctctcctttacaagtggagagcctcagacacagtatgggtccgggcgggtacggagataacctggggggcggtcagatgtactcaccccgcgaaatgcgggccaacggcagttggcaggaggctgttacgccctcctcagtgacttccccaaccgaaggtcccggctccgttcactccgatactagcaactag

SEQ ID NO: 200508 - DNA, 1332 bp, Artificial Sequence
  Description of Artificial Sequence: Synthetic coding sequence
ggcgccgagcagggcggcggcctgcgggcccccccccagctgtggactaatggatactggggtagaccactgcaggcaggcgccggcggactaggcctggtgagcggtgagccaggcggacctggtgagcctccgggcggtggtgaccctgggggcgggtctggaggtgtgccaggaggcagaggcaaacaggacattggagatattttacagcagatcatgaccatcaccgatcagagccttgacgaggcacaggccaaaaaacacgcactgaactgccaccgtatgaaaccggccctcttctcagtgctgtgcgaaattaaagaaaagaccgggttgagtattaggtcttcccaggaggaagaaccggtagaccctcagctgatgagactggacaacatgctgctcgccgagggggtggccgggccggagaaaggagggggcagcgccgcagctgcggcagctgccgccgcttctggggggggggtgtccccagataactcaatcgaacacagcgattaccgaagtaaactcgcccaaatacgacatatttatcactctgagttggaaaagtacgaacaagcatgtaacgagttcaccactcatgtgatgaacctgctgcgggagcagtctagaactagaccggttgccccaaaagagatggagagaatggtttccataattcacagaaaattctcagccatccagatgcaacttaaacagtccacctgtgaagcggttatgattctgagatcgagatttctagatgcgcgtcggaagcggaggaacttcagcaaacaggctacggaagtgctgaatgagtacttttacagccatctttccaacccataccccagcgaagaagcaaaagaagagctggccaagaagtgtggcattacagtgtcccaagtaagcaactggtttggtaacaagcgcatccgctacaagaaaaacatcggtaagtttcaagaggaagccaacatttatgcagtgaaaacagcagtatcagtcacacagggtggacatagccggacttcatcacccacaccccccagctcggccggctccggtggatcattcaatttgtctgggtcaggcgacatgttcttagggatgcctggattgaatggcgattcttattctgcttctcaagtggagtctctgcgccacagcatggggcccggcggctatggcgataatcttgggggaggccaaatgtactcccctcgtgaaatgcgagcaaatggctcctggcaggaggctgtgacgcccagctcagttacgtctcctacagaaggacctggttccgttcactccgatacctccaactag

SEQ ID NO: 200509 - DNA, 1392 bp, Artificial Sequence
  Description of Artificial Sequence: Synthetic coding sequence
atggacgagcggctgctgggcccccccccccccggcggcggccggggaggattaggccttgtgagcggcgagccagggggacccggggagccacccggtgggggggaccccggcggcggcagcggaggcgtgccaggaggccgtggaaaacaggacattggcgatatcttgcagcagattatgactattaccgaccagtccctagacgaagcccaagccaaaaagcacgccttgaattgtcacagaatgaagccagctttgttcagcgtcctgtgtgaaatcaaagagaagaccgggctgtcaattcggagttcccaggaagaagagcctgtcgatccacagctgatgagattggacaatatgttgctggctgagggcgtggctggcccagagaagggtggcggatcagccgcggccgccgccgccgcggccgcctctggtggcggcgtcagcccagacaactctattgagcattccgattatagatccaagttagcccaaatacggcacatttatcactccgaactggagaagtatgaacaagcatgcaatgaatttaccactcatgtcatgaatttactgagagaacagagccgcaccagacctgtggctccaaaagagatggaacggatggtaagcatcatacacagaaaattttcagcaatccagatgcaactaaaacagtcaacctgcgaggccgtcatgatcttgagaagcaggttcctagacgctagacggaagcggagaaacttttccaagcaagctaccgaagtgctgaacgaatacttttacagccaccttagcaatccctacccgagcgaggaggctaaggaagagctggccaagaaatgtggtataaccgtatctcaggtcctttggagactgagagaagaattgtccggcaaggtccacgcgtcacagctgggggccgttgtctctaactggttcggtaataagcggatccggtacaagaagaacatcggcaaatttcaagaggaggccaacatttacgctgtgaaaacagcagtcattattgctgaacgcgggcccttcggggttcggggcacggaactttctctacctagcctgccgccgcagggcagcggaggcagtttcaatctaagtggctccggcgacatgtttctcggtatgcctggcctgaatggtgatagctatagcgcctcgcaggttagatgcccaagtccacttcaggtggagtcactgaggcactctatgggccccggaggttatggcgacaatctcgggggcggtcagatgtactctcccagggagatgagggcaaatggcagctggcaggaggccgttaccccatctagtgtgacttccccaaccgagggccccggaagcgtccactctgataccagcaattag

SEQ ID NO: 200510 - DNA, 1332 bp, Artificial Sequence
  Description of Artificial Sequence: Synthetic coding sequence
ggcgccgagcagggcggcggcctgcgggcccccccccagctgtggacgaacggctactgggggcgccccctccaggctggggccggagggctgggacttgtgtcaggagaaccaggagggcccggcgaacctcctggagggggcgaccccggcggcgggagtgggggtgttcccggtgggaggggcaaacaggacatcggtgatatcctgcaacagatcatgaccatcactgaccagtctctggacgaggcacaggctaagaagcatgccctcaattgccaccgcatgaagcctgccctcttttcagtgctttgtgagattaaggagaaaacgggcctatccatccggtcctctcaggaggaggagcccgttgacccgcagctgatgagattggataatatgctgctggctgaaggggtcgccggcccggagaaaggcggggggagcgcagcggccgctgcagcagctgctgctagcgggggcggggtgagtccagataatagcatcgagcactcagactacaggagcaaactggctcagattaggcacatttatcactccgagctcgaaaagtatgagcaggcttgcaacgagttcactacccatgtgatgaacctgctgagggagcagagtagaacacggccagtggccccaaaagagatggagaggatggtctcaatcatccatcgcaagttctcagctatccaaatgcagctcaagcaaagcacatgcgaagcagtgatgatactgcgcagtcgttttctcgatgcaagaagaaaacggaggaatttttcgaagcaggcaacggaggtacttaatgaatacttctattcacacttatccaatccttaccccagcgaggaggccaaagaggagctcgcgaagaaatgcggaataacagtgtcccaggtctcaaattggttcggcaataagagaatccgatacaagaagaatataggaaagttccaggaggaagcaaatatctacgccgtaaagaccgcagtatctgtcacccagggaggacactcacggacatcatccccaactccaccttcctctgccgggagcggcgggtctttcaatttgtccggatccggcgatatgttcctgggaatgcccggcttaaatggagattcctacagtgccagtcaggtggagtccctgagacattccatgggaccaggaggttatggggataaccttggcggcggccagatgtactccccaagagagatgagggctaatggttcctggcaagaggctgttactcccagcagcgtgacttctcctacagaaggacctggctccgtacattccgacacctctaactag

SEQ ID NO: 200511 - DNA, 1332 bp, Artificial Sequence
  Description of Artificial Sequence: Synthetic coding sequence
ggcgccgagcagggcggcggcctgcgggcccccccccagctgtggacgaatgggtactggggaaggccactgcaagcaggagctggggggctaggacttgtctctggcgaacccggcgggccaggggagccacccgggggcggcgaccccgggggtgggagtgggggcgttcccgggggtcggggtaagcaggacatcggggacattctacagcagatcatgacaatcacagaccaaagcctggatgaggctcaagcaaagaagcacgcactaaactgtcatcgtatgaaaccagcacttttctcggtgttgtgcgaaataaaagagaaaacgggtctgtccatacgcagttcacaggaagaagagccggtggatcctcagctgatgcggctggataacatgctactcgccgagggagtggctggacccgagaaaggcggcggatcagcggctgcagctgccgctgccgctgctagcggcggtggagtctcacccgataacagtatcgagcactcggactaccgctctaaattggctcagatacggcacatttaccatagcgaactcgaaaagtatgaacaggcgtgcaacgagtttaccacccatgtgatgaacctgctaagagagcagagtagaactcggccagttgcacccaaggaaatggagaggatggtgagtatcatacatagaaagttctccgctatccagatgcagttgaaacaatccacatgtgaggcagtgatgatcctgagatcgaggtttcttgatgcaagacgcaagagacgcaatttttccaagcaggctaccgaagtgctgaatgagtacttttatagtcacctgagtaacccatacccaagcgaagaggctaaggaggagctggccaagaagtgcggaattacagtgtcacaggtgagcaattggttcggtaacaagcgcattagatacaagaaaaacatcgggaagtttcaagaggaggcaaacatctacgctgtgaaaactgccgtgtcagtgacacaaggagggcacagtcgcaccagttcccctacacctccctcctccgctggtagcggcggttcattcaacctctctggcagtggtgatatgtttcttggaatgcctggtctcaatggagattcttattctgctagccaagtagagtccctccgccacagcatggggcctggcggatacggcgacaatctgggtggtgggcaaatgtactcaccacgcgaaatgagagcaaatgggtcctggcaggaggccgtaacccccagctccgtgacatcccccactgagggcccgggtagtgtgcatagtgatacaagcaactag

SEQ ID NO: 200512 - DNA, 1056 bp, Artificial Sequence
  Description of Artificial Sequence: Synthetic coding sequence
atggacgaccagagccggatgctgcagaccctggccggcgtgaacctagcgggccactccgttcagggagggatggccctccctcctcctccacacggccacgagggagctgatggggacgggcgaaaacaggacataggagacatccttcaccaaataatgacaattactgaccaaagcctggacgaagcgcaggccaaaaaacatgctctgaactgccaccggatgaaaccggccctattcagtgtgttatgtgaaattaaggaaaaaactggcctctccatccgtggagcacaagaagaggaccctcctgacccccagctaatgcgactcgataacatgttactcgctgagggcgtttccgggcccgagaaaggggggggatcagccgccgcagccgcagccgcggccgcttccggtggcagttccgataattccattgagcacagtgattaccgggctaaacttacacagattcggcaaatctaccacacagaactcgaaaagtatgaacaggcatgcaacgagttcacaacgcacgtcatgaatcttctcagagaacagtctcggactaggcctatcagcccaaaagaaatcgaacgcatggtggggattatccacagaaagttctccagtatccagatgcagttgaaacagtccacctgtgaggccgtgatgatcctcaggagtcgattcctggatgcaaggcgcaagagacgaaattttagcaagcaggccactgagatccttaatgagtacttctactcacacctttccaacccatatccctcggaagaggctaaagaagaactggccaagaagtgcagcatcacagtctcacaggtctccaactggttcggcaacaaacgcatccgatataaaaagaacatcggaaagtttcaggaggaagccaatctctacgctgccaagactgccgttaccgcagcacatgccgtagccgccgccgttcagaataatcagaccaacagcccaaccacaccaaactctggaggctatccgccctcttgttatcaaagtgacggtagactacagtag

SEQ ID NO: 200513 - DNA, 762 bp, Artificial Sequence
  Description of Artificial Sequence: Synthetic coding sequence
atgaacctgctgcgggagcagagccggacccggcccatcagccccaaagagatagagagaatggttggcattatccacagaaaattctccagtatccagatgcagttgaaacaatccacttgtgaagcagtgatgattctcagaagccgattcttagatgcccggcgcaagaggcgcaatttctcgaaacaggccactgagattctcaacgagtacttctactcccacctcagtaatccataccctagcgaagaggccaaggaggaactcgcgaagaagtgttccatcacagtcagccaggtgtctaattggtttggtaacaagaggattcgttacaagaagaacatcggaaaatttcaggaggaggccaatctttacgctgctaagacggccgtgaccgctgctcatgccgtcgctgcagccgtgcagaacaaccagacaaactccccgaccacccccaacagcggttcatcagggagcttcaacctgcccaacagcggcgatatgtttatgaatatgcaaagcctgaatggagattcatatcagggctcccaagtcggagctaatgtgcaaagccaggtggacactctgcggcacgtcatcaatcagaccggtggttactctgacggactgggtggcaattctttatattccccacacaatctcaatgctaacggggggtggcaggacgctaccactcccagctctgttacttcgcccactgaggggcctggtagcgtgcactcggacacctcaaattag

SEQ ID NO: 200514 - DNA, 1368 bp, Artificial Sequence
  Description of Artificial Sequence: Synthetic coding sequence
atggacgaccagagccggatgctgcagaccctggccggcgtgaacctcgccggacacagcgtccagggaggaatggcactccccccccccccccatggacacgagggggccgacggggatggtcggaagcaagacatcggggacatcctgcatcaaattatgactatcacggatcaaagtctcgacgaagcccaggccaaaaagcacgccctgaactgccataggatgaagccagcattattttctgttctgtgtgagattaaagaaaagacaggactctctataaggggagcccaggaggaagaccccccggatccacaattgatgcgcttagacaacatgctgctggcagagggggtcagtgggcccgagaagggtggcggctctgcagctgcagccgctgcagccgcggcttcggggggttccagtgataactcaattgagcactcagattaccgggcgaaactcacacagattaggcagatttaccacacagagctcgaaaagtacgagcaggcctgcaatgaattcactacacatgtcatgaacttgctacgcgaacagagcagaacaagacccatcagtcctaaagaaatcgaacggatggtcggtatcattcaccgcaaattcagtagcattcagatgcagctaaaacagtcaacatgtgaggctgttatgattctcaggtcccggtttctcgatgcccgaagaaagcgaagaaatttcagcaaacaagccacagagattttgaacgaatacttctatagtcacctttcgaacccgtaccctagcgaagaggcaaaggaggagttggctaaaaagtgcagtatcacggtgtcccagtccctcgtaaaggatccaaaagagcgaggcagcaaaggcagtgacatccagcccacatcagttgtgagcaattggtttggaaataaaaggattcgttataaaaaaaacattgggaagtttcaagaggaggcgaatttatatgcggccaaaacggctgttacagctgcgcacgcagtggccgcagccgtccaaaacaaccagactaactcacctactacccctaacagcggttcgagcggaagctttaacctccctaattccggggatatgttcatgaacatgcagtcactcaacggcgatagttaccaggggtcacaggtcggcgctaatgtgcagtctcaggtggatactctgagacatgtgattaatcagacaggcgggtactcagatggactgggtggtaattccctgtatagcccacacaatctcaacgccaacggtggttggcaagacgctactacgccatccagcgtcacatcgcctaccgagggaccaggaagtgtacatagcgacacgagtaactag

SEQ ID NO: 200515 - DNA, 1305 bp, Artificial Sequence
  Description of Artificial Sequence: Synthetic coding sequence
atggacgaccagagccggatgctgcagaccctggccggcgtgaacctggccgggcactcagtgcagggcggcatggccttacccccccccccgcatggccacgaaggcgccgatggggatggccgaaagcaagacattggcgatattctacatcagatcatgactatcaccgatcagtctctagacgaggcgcaggctaaaaaacacgccctaaactgtcatcgtatgaaacctgccctgttcagcgttctctgcgagattaaggagaagactggcctgtcgatccgcggcgcccaggaagaagacccccccgatcctcaactgatgcggctggacaacatgctgttggccgagggagtgtcaggccctgagaaggggggcgggagtgccgctgcagccgcagcagcggcagccagtggaggatcttctgataacagtatagagcactccgactaccgggcaaaactgactcagattagacagatctaccacaccgaactcgaaaagtacgaacaagcctgcaatgagttcacaacacatgtcatgaacctgcttagagagcagtcgcgcacacgcccaatttctcccaaggaaatcgagagaatggttgggatcatccacagaaaattctccagcattcaaatgcagctgaaacagtctacctgtgaggcagtgatgattctcaggtccagattcctcgacgcccgccggaagcggcgcaacttctctaaacaagctacagagattctgaacgagtacttctattctcatctgtccaacccgtacccatcggaagaggccaaagaggagctagctaaaaaatgttcaatcacagtgtctcaggtgagcaactggtttggcaataagcgcattcgctataaaaagaatattgggaagttccaggaagaggcaaatctttatgctgcaaaaaccgctgtgacggctgcacacgccgtcgcagcagccgtgcagaataaccagaccaatagccctaccacccccaattccggatccagcgggagttttaatcttcccaactcaggtgatatgtttatgaatatgcagtcactgaatggcgactcctaccaggggtcccaggtgggcgctaatgttcagtcccaggtggatacactgcgtcacgtgattaaccaaacggggggatattctgatggactcggaggaaattcactgtactccccccataatcttaatgccaacggcggttggcaagacgcaactactccatcctcagtgactagcccgacggaagggcctggatccgtgcactcagacacaagcaactag

SEQ ID NO: 200516 - DNA, 789 bp, Artificial Sequence
  Description of Artificial Sequence: Synthetic coding sequence
atgcggggcctgagcatccggggcgcccaggaggaggacccccccgatccacaactgatgcgcctagataacatgttgctggccgaaggcgtgtcgggtccggagaaggggggagggtccgctgccgcagctgccgcagccgctgcttccggcggaagctccgataattccatcgaacattctgactaccgggcgaaattgacacagattaggcaaatctaccacacagagttggaaaagtatgaacaggcgtgtaatgaatttacaacgcatgtgatgaatctgctgagggagcagagccgcactcgccccattagccccaaggagatcgaacgaatggtcgggattattcaccgcaagtttagctccatacagatgcagctgaaacagtcaacatgtgaagctgtcatgattttgagatctaggtttctagacgcgcgccggaagcgccggaatttttctaagcaagccacagagatcttgaacgagtatttttactcgcatctgagcaacccttatccctcagaagaagctaaggaggagctcgctaaaaagtgttctataactgtgtcccaggtcagcaactggtttggaaacaaaagaatccgctataagaagaatattggaaaattccaagaagaagccaatctgtacgcagccaaaacagccgtgacagccgcccacgccgtagcagccgccgtgcagaataaccagacaaattcccccaccaccccaaacagtgggggctatcctcctagttgctaccagtccgacgggaggttgcagtag

SEQ ID NO: 200517 - DNA, 1080 bp, Artificial Sequence
  Description of Artificial Sequence: Synthetic coding sequence
atgaagcccgccctgttcagcgtgctgtgcgagatcaaggagaagaccgggctctccatacgcggagcgcaggaggaagatccccctgatcctcagctaatgcgactggataacatgcttcttgctgagggagtgtcagggcccgagaaggggggcggcagcgcggcagctgcagcggcggccgcagcatctggcggctcctctgataacagtatcgagcattccgactaccgcgccaagttgacccagatccggcagatttatcacactgaattagaaaagtacgagcaggcttgtaatgagttcaccacacacgtgatgaacttgctgagagagcaatctcggacgagacccatctctcccaaagagatagagaggatggtgggcataatccatcggaagttctcctctatccagatgcaactcaagcaatccacctgcgaggccgtgatgattctgaggtctcggttccttgatgctagacggaagcgccgtaacttcagtaagcaggccactgagatcttaaacgagtatttttatagccatctatctaatccttatccatccgaagaggccaaagaggagctggctaaaaaatgctctataaccgtgtcacaggtttcaaactggttcggcaataagcgcattcgctacaagaaaaatatcggaaaatttcaggaggaagccaatttatacgctgccaagactgctgttaccgcagcccatgctgttgcagccgctgtgcagaacaatcagaccaactcacctactaccccaaacagtggcagctccggatcattcaacctgccaaactccggagacatgttcatgaatatgcaaagcctaaacggggacagttatcaaggttctcaggtcggtgcaaacgtgcagagtcaggttgacacacttaggcatgtgattaatcagactggaggatattcggatggattagggggtaactccctgtactcaccacacaatctaaatgccaacggtggctggcaagacgcaaccactccaagctctgtcacatcccccacagagggtccagggtccgtgcactctgacacttccaactag

SEQ ID NO: 200518 - DNA, 1530 bp, Artificial Sequence
  Description of Artificial Sequence: Synthetic coding sequence
atggagcggcggcggctgtggggcagcatccagagccggtacatctccatgtcagtatggacctccccccgaagactggtggaattggccggacagagcctattgaaggatgaggcactggccattgctgccctcgagctgctgccacgagagttgttcccaccgttgttcatggctgcttttgacggccgccattcccagaccctaaaggcaatggtgcaagcctggccattcacgtgcctcccgcttggggtattgatgaagggacaacaccttcacctggagaccttcaaagctgtgctggatggactggatgttctcctggcccaggaggttaggcctagacggtggaaactgcaggttctggatctgagaaaaaactcccaccaagatttttggaccgtttggtccggcaaccgtgcctccttatactccttccctgagccagaagctgcgcaacctatgaccaagaagcgcaaagtggacgggctgtctaccgaagccgagcagccctttattccagttgaggtacttgttgatctcttcttaaaggagggggcctgtgatgaactatttagctacctaattgagaaggtgaagagaaaaaaaaacgtgctgcgcctctgctgtaagaagctgaagatcttcgctatgccaatgcaagacattaaaatgattctgaagatggtgcagttagattccatcgaagacttagaggtcacatgcacgtggaagctacccaccctcgcgaaattttcgccttatttgggtcagatgatcaatctgaggcgcctgctgctcagccacatccacgccagctcttatatctctcctgagaaggaagagcaatacatagcccaattcacctcacaattccttagtttacagtgcttgcaggccctttatgtcgattctctgtttttccttagaggacggctggaccagttgctccgccatgtgatgaatcctctggaaactttgtctattaccaactgtcgcctgagtgagggagacgttatgcatctgtcacagtctccttccgtctcacaactttcagtgttgagtctctcaggggtgatgctgacagatgtgtccccagagccacttcaggccttgctcgagcgggcctccgctactcttcaggatcttgtgttcgatgagtgcgggatcaccgatgatcaactgctcgctctgttgcccagcctgtcccactgttcgcagttaacaacactctcattctacggcaattcaatctctatcagcgccctccagagcctactccaacatctcataggcctctcgaaccttacacacgtgttatacccagtgcccttagaaagttatgaagacatccacggaacattacacctggagagattagcatatctacatgcacgcctgagggagctgctctgtgagctggggagaccctctatggtatggttgtcagcaaatccgtgcccgcactgtggcgatagaactttctacgatcccgaacccatattgtgcccttgcttcatgcccaattag

SEQ ID NO: 200519 - DNA, 1530 bp, Artificial Sequence
  Description of Artificial Sequence: Synthetic coding sequence
atggagcggcggcggctgtggggcagcatccagagccggtacatctctatgagtgtgtggacaagcccacgccggctagtggagctggcaggccagagtttgctgaaagacgaggctctagccatcgccgcgcttgagttgctgcccagagagctttttcctccactcttcatggctgcttttgacggtcgccatagccaaacactgaaggcaatggtccaggcctggccattcacctgcctccctctgggcgtgctgatgaaagggcaacatctgcacctcgaaacttttaaggccgtgctcgacggcctagatgtgcttctagcccaggaggtgcggccccgccgctggaaactgcaagtcctggatctgcgaaaaaacagtcaccaggatttttggaccgtgtggagcggcaacagagccagcctttattcatttccagagcccgaggccgctcaacctatgactaagaagcggaaagtcgatgggctaagcaccgaagccgaacagccatttattcctgtggaggtgctggtggatctgtttcttaaggagggggcatgtgatgaactgttctcatatttaattgaaaaggtgaagagaaaaaagaacgtgcttcggttatgctgcaagaagctgaagatctttgcaatgcctatgcaggatattaagatgatattaaaaatggtccagctggatagcattgaggatctcgaagtcacctgcacgtggaagctcccaacgctggcaaagttttccccctacttaggccagatgatcaacctacgtcggttgttgcttagtcacatacacgctagttcttacatcagtccagaaaaggaggaacagtacattgctcagtttacgtcacaatttctaagcctgcagtgcctgcaagccctgtatgtggactccctgttttttcttcggggtcggctggatcagctactgaggcatgtcatgaacccactggaaaccttgtccataacaaactgccgactgtctgagggagacgtgatgcatttaagtcagagcccctcagtttcacaattatctgtgttaagcctttcaggtgtaatgctgactgatgtctcgcccgagcccctccaagcacttctggaaagagccagcgcgaccctgcaggacctggtctttgacgaatgcggcatcacggatgaccagctgctggcactgctgcctagtcttagtcactgctctcagctcacaacactgtccttctacggaaattctattagcattagtgccctccaatctttgctgcaacacttgataggcctctcaaatttgactcatgtcctatatcccgtgccccttgagtcatacgaggacattcacggcactctgcatttggaacgcttagcctacctccacgcaaggttacgcgaactactgtgtgaactgggacggccaagtatggtttggctctcagcaaatccatgcccgcattgcggggatagaacattctacgatcctgaacccatactgtgcccatgttttatgccaaactag

SEQ ID NO: 200520 - DNA, 1530 bp, Artificial Sequence
  Description of Artificial Sequence: Synthetic coding sequence
atggagcggcggcggctgtggggcagcatccagagccggtacatcagtatgtctgtgtggacctcaccacgtcggcttgtggagttagcggggcagagcctcctgaaggacgaggcactcgccattgctgcgttagagctcctgcccagggagctttttccacctctattcatggctgcatttgatggtagacacagccagacactcaaggccatggtccaggcttggccttttacctgccttcccctgggcgtgctcatgaaggggcagcacctgcacttggagacgtttaaagccgtgctcgacggcttggacgtcttactagcccaggaggtgcggccccgtcgctggaaactgcaagtcctcgatttgagaaaaaactctcaccaggacttctggactgtgtggtcaggaaacagagcttcgctgtatagttttcccgagcccgaggccgcacagccgatgaccaaaaaacgcaaagttgatggactgtctaccgaggccgagcaaccttttattcccgtcgaggtgttggtggacctgtttctgaaggaaggcgcgtgtgacgaactctttagctatcttatcgagaaggttaaacgcaagaagaacgtgttgaggttgtgctgtaaaaaactaaagatttttgctatgcccatgcaagatataaaaatgattctgaagatggtgcagcttgactccatcgaggacctggaggtgacgtgtacttggaaactgcccaccctcgctaagtttagtccatatctcgggcagatgattaacctgcgtcgcctactcctttcacatattcacgcctccagttacatttctcccgagaaagaggagcaatacatcgctcagtttacatcccaattcctgagtcttcagtgtttacaggccttatacgtggactctctgttctttctgcgcgggaggctagaccagttgctgagacatgtcatgaatccactggaaacattgagcatcacaaattgtcggttatctgagggagatgtgatgcacctgagtcagtcccccagtgtgagccagctctctgtgctctcgttgtccggggtgatgttaacagatgtcagcccggagccgctgcaagctctgctggagagggctagcgctacgctccaggacctggtttttgatgagtgtgggattacagatgaccagctgctggcattactcccctctctcagtcactgcagccagttaacaaccttgtctttttatggtaactcaataagcattagcgcactgcagtccctgctccagcatttaatcggccttagcaaccttacacacgttctgtacccggtgccgcttgagagttatgaggatattcacgggacactgcacctcgaacgcctggcttacctgcacgccagattgcgggagctgctttgcgagttaggacgaccatcaatggtgtggctgtcggcgaatccttgtcctcattgtggtgaccgaaccttctatgaccctgaacccatcctctgcccatgcttcatgcccaattag

SEQ ID NO: 200521 - DNA, 261 bp, Artificial Sequence
  Description of Artificial Sequence: Synthetic coding sequence
atggagcggcggcggctgtggggcagcatccagagccggtacatcagcatgagcgtctggacatcgcctaggaggctagtagaattagctggacagagcctcctgaaggacgaagctctagcgattgccgctctggaactgcttccgcgcgaactctttcctccgctgtttatggccgcatttgatgggaggcacagccaaacgctgaaagctatggtgcaagcatggccattcacatgcctccccttgggcgtcctgtag

SEQ ID NO: 200522 - DNA, 1530 bp, Artificial Sequence
  Description of Artificial Sequence: Synthetic coding sequence
atggagcggcggcggctgtggggcagcatccagagccggtacatctctatgtccgtttggacctccccccgcagactggtggagttagcaggacaaagtctgctgaaggatgaggctctagctatcgcagctctggaactccttccaagagaactgttcccacctctgttcatggccgcattcgacggacggcattcacagacactcaaagcaatggtgcaagcctggccttttacctgcctacctcttggcgtactgatgaaggggcagcatctccatctagaaacctttaaggccgtactcgatggtctagacgtgctgttggctcaggaggtacgccctcggagatggaaactgcaagtgctcgaccttagaaaaaatagccaccaagatttctggacagtgtggagcggcaatcgcgctagcttgtacagctttccggaaccagaggctgcacagccaatgaccaaaaagcgtaaagtggacggtctgagcacagaggctgagcagccatttatcccggttgaagtcctcgtggatttattcttaaaggaaggcgcctgcgacgaactgttctcctatctcatcgagaaggttaagagaaagaagaacgtcctacgcctatgttgcaaaaaactcaaaatttttgccatgccaatgcaggacataaaaatgattttgaaaatggttcagctggactctattgaagacctggaggtaacttgtacctggaagctcccaacattggccaagttctccccttatctggggcagatgataaacctgcgcaggcttctgctgtcccacatccacgctagttcttacatctctccagagaaagaggagcagtatatcgctcaatttaccagccagtttctttccctgcagtgcctccaggccttgtacgtggacagcttattcttcttgcgaggacgtttggatcagctcctccggcacgtgatgaacccactcgagaccctgtctattacaaattgcaggctttcagaaggagacgttatgcatctatctcagagcccctcagtaagtcagctatccgttctatccttatcaggagtgatgttgaccgacgtgagtccagagcctctgcaggccctactggagcgggctagtgccaccctacaggatctggtatttgacgagtgtgggatcactgacgatcagctgctggcactgctgcccagcctaagccactgttcgcagttgactactctcagcttctacggaaacagtatttcgatctcggcgctacagtccctgctgcagcacctcattggactgagtaatctgacacacgtcctctacccggtccccctggaaagttatgaggacatccacggaactcttcacctagaacggctggcatatctccatgcacgacttcgggaactcctttgcgaactcgggaggccaagtatggtctggttaagcgccaatccatgtccccactgtggagatcgcactttctacgaccccgagcctattctctgcccctgcttcatgccaaattag

SEQ ID NO: 200523 - DNA, 348 bp, Artificial Sequence
  Description of Artificial Sequence: Synthetic coding sequence
atggagcggcggcggctgtggggcagcatccagagccggtacatcagcatgagcgtctggactagcccgcgcagactggtggagctcgctgggcagagtctcctgaaggacgaggctctggcaatagccgcactggagctgctgccccgcgagctgtttccccccttgttcatggctgcctttgacggacgccattctcagaccttgaaagctatggtccaggcctggccctttacatgcctcccgctcggagtgctgatgaaaggacagcaccttcacctggagacatttaaggcagtgctcgacggactagacgtgctactggcccaagaagtgcggccccggtag

SEQ ID NO: 200524 - DNA, 459 bp, Artificial Sequence
  Description of Artificial Sequence: Synthetic coding sequence
atggagcggcggcggctgtggggcagcatccagagccggtacatctcaatgagcgtgtggacaagcccacgccgtttggtggaactcgctggccaatcgctgcttaaagatgaggccctggcaatcgcagcattggaactgctgcccagagagcttttccccccactgttcatggcggcattcgacgggaggcattcacaaacactgaaggccatggtacaagcatggccatttacatgtctgcccctgggtgtgttgatgaagggacagcatctacatctggaaacgtttaaagccgtgttggacggcctggatgtgttgctcgcccaggaagttcgccccaggaggtggaagctacaggtccttgacttaaggaagaacagccatcaagacttttggaccgtctggtccggaaatagggctagtctgtatagtttccccgagcccgaagctgcttag

SEQ ID NO: 200525 - DNA, 1482 bp, Artificial Sequence
  Description of Artificial Sequence: Synthetic coding sequence
atgagcgtgtggaccagcccccggcggctggtggagctggccggccagtcactcctgaaagacgaagcattggcaattgcggctctggagctactgccgagggagctgttcccacccctgttcatggcggctttcgacggccgccactcccagactcttaaggccatggtccaggcttggccctttacctgcctgcccctgggggttctgatgaaggggcaacatctccacctcgaaacatttaaggctgtgctggacggattggacgtgctactggctcaggaagtcaggcctcggcgctggaaactacaggtcctggacttgagaaagaacagtcatcaggacttctggactgtgtggtctggtaaccgtgcttccctctacagcttccctgaaccagaagcagcacagcccatgaccaaaaaacgtaaggtggatggattgtccaccgaagccgagcagccctttatacctgtggaggtgttagtggacctgttcctcaaagagggcgcttgtgacgaactctttagctacttgatcgaaaaagtaaagcggaaaaaaaatgtgctgcgtctgtgctgtaaaaagctcaagatcttcgcaatgccgatgcaggacatcaagatgattctgaagatggtgcaactggacagcatagaggacctcgaagtaacttgtacatggaagcttccaaccctcgcaaagttctcaccctacctggggcagatgattaacctccgaaggctgctgttaagccatatccacgcctcttcgtatattagcccagaaaaggaagaacagtatattgcccagttcaccagtcagttcctctctctccaatgcctacaggcactgtacgtcgatagcttgtttttcctgaggggtcgactagaccaactactgagacacgtgatgaatcctctcgagactctttctatcactaattgtcggctctccgagggggacgtgatgcatctcagtcaaagtccaagtgtatcccagcttagcgtgctgtctctttcaggggtgatgctgacggacgtgtcccctgagcctctgcaggccctcctggagcgcgcgtctgccactcttcaggacctggtgtttgacgagtgtggcatcaccgacgatcagctcctggccctgttgccttccttgagtcattgctctcagctgactaccttgtctttctacggaaattcaataagcatcagtgctctgcaatctctgcttcagcacctgatcggtctgagcaacctgacacatgtgttgtaccccgtgcctcttgagtcctatgaggacatccacggtactctacatctggaaaggctcgcatatttgcacgcccgattacgggagctgctgtgtgaactggggaggccatccatggtgtggctgtcagctaatccatgtccccattgcggcgacaggactttttatgacccggagcctatactgtgtccctgctttatgcctaactag

SEQ ID NO: 200526 - DNA, 606 bp, Artificial Sequence
  Description of Artificial Sequence: Synthetic coding sequence
atggagcggcggcggctgtggggcagcatccagagccggtacatctctatgtcagtgtggaccagtccccggagactggtcgagctggctgggcagtcactcctcaaagacgaggctctagctatcgccgccttagaacttctgcctagagagttatttcctcctctgtttatggccgccttcgacggacggcactcgcagacactgaaagctatggtgcaggcctggcctttcacctgtctgcctttgggagttttaatgaaggggcagcatctgcacctggaaacatttaaagctgtgttagatgggctggacgttcttttggcacaggaagtcagaccacgccggtggaaactccaggttcttgatttgcggaaaaattctcatcaagatttctggactgtatggtctgggaacagagcttctttgtacagcttccccgagcctgaggccgcccagcccatgaccaagaaacgaaaggtggatgggctttcaaccgaggccgagcagcctttcattccagtggaagttctcgtggacctctttctcaaagaaggggcctgtgatgagctgttcagctatctcatcgaaaaagtgaagagatag

SEQ ID NO: 200527 - DNA, 1482 bp, Artificial Sequence
  Description of Artificial Sequence: Synthetic coding sequence
atgagcgtgtggaccagcccccggcggctggtggagctggccggccagagcctcctgaaagatgaggcactcgccattgctgccctcgaactcctgccccgcgagctgttccctcccttattcatggccgctttcgatggacgacatagccagacactgaaagcaatggtgcaggcatggcctttcacttgccttccgctcggggttctgatgaaaggccagcatctgcatctcgagacattcaaagcggttttggatggattggacgtcctcttagctcaggaggtcaggcccagacgctggaagttgcaagttctggatctgaggaaaaatagccaccaagacttctggacggtatggtctggcaaccgtgcgagcttatattctttccccgagccggaagcggctcagccaatgaccaagaagcgcaaagtcgatggcctttcaaccgaggctgagcagccattcatccctgtggaagtcctggttgatttgtttctgaaggagggggcatgcgatgaactattttcctacctcattgagaaggtgaaaagaaaaaaaaacgtcttgaggctctgttgcaaaaagctgaaaatctttgcaatgcctatgcaggatattaagatgatcctgaaaatggttcagctcgattctatagaagacctggaggtgacttgcacgtggaagttaccaactcttgctaaattctccccttacctcggacaaatgattaacctgcgccggctacttctgtctcacatccatgctagctcatacatctcaccagagaaggaggagcagtacattgcccaatttacaagtcaatttttaagccttcagtgcctgcaggcactttacgtcgacagtctgttcttcctcaggggacggttagatcagctcctgagacacgttatgaatcccctagagacgctgagcattacaaactgtcgcctatccgagggcgatgtgatgcacctaagccagtccccaagcgtctcccaacttagcgtgctgagcctgtccggagtcatgcttaccgatgtctcaccagaacctttgcaggccttattggaaagagcctctgccaccctgcaggacctggtatttgatgagtgtggaatcacggatgatcagttactggcgctcttgcccagcttgtcccactgctcacagctgacaaccctatcattttatggaaactctatctcaatctctgcgcttcagtccctgctgcaacatctgataggacttagcaatctcacacatgttttgtatccagtgcctctggaaagctatgaggatatccatggcacactgcatttggaaagattggcctacttgcacgccagactgcgagagcttctttgtgaattgggtcgtccctcgatggtgtggctttccgccaatccatgtcctcactgtggtgataggacattctacgaccccgaacccatcctgtgcccttgtttcatgcccaactag

SEQ ID NO: 200528 - DNA, 1530 bp, Artificial Sequence
  Description of Artificial Sequence: Synthetic coding sequence
atggagcggcggcggctgtggggcagcatccagagccggtacatcagcatgagtgtgtggacttcgcctcgcagactggtggaactggccggacagtcactactgaaagatgaagctctggctatcgccgctctggaactgctgcctcgggaactttttcctccattgtttatggccgcgtttgatgggagacatagccagacattaaaggcaatggtacaagcgtggccttttacctgtctacctttgggagttctgatgaagggtcagcacctgcacctggaaaccttcaaagctgtattggacggactggatgttctactggcccaggaggtgagaccacgtcggtggaagctgcaagtgctcgatctcagaaaaaactctcatcaggacttttggactgtttggagtggcaacagggcaagcctgtactctttcccagagcctgaggcagcacagcccatgacaaagaaaaggaaagtcgacggcctcagcacagaggccgagcagccttttattcctgtggaggttctcgtagatcttttcctcaaggaaggagcttgcgatgaactgttctcttatctcattgaaaaggtgaagcgcaaaaagaacgttctccggctctgctgtaagaaactgaagatctttgcgatgcctatgcaagatataaagatgatcctgaaaatggtgcagctcgacagcatcgaggaccttgaggtcacttgcacctggaaactgcctacactagccaagttctcaccctatctcgggcaaatgatcaacctccgacgacttctactgagccatatacatgcctcaagctatatcagccctgagaaagaggagcaatatattgcccagttcacatcccagttcctttccctgcagtgcttgcaggcactatacgtcgatagtttgttcttcctgcggggcagattggaccaattgcttagacatgtgatgaatcccctggaaactttgtctataaccaactgccggttatccgagggggacgtcatgcatttgtcccagagcccatcagtgtcccaactgtccgttctgagcctgtctggcgttatgctgactgatgtgagccccgaacccctgcaagctctgctggagcgggcatctgcgacacttcaggatctcgtgtttgatgaatgtgggattactgacgatcagcttctcgccttgctgcctagcctctcccactgttcacagctgacgacgttgagtttctacggaaactcaatctcaatttctgcattgcaaagcttgctgcagcacctcattggcctctccaatctgacacacgtcctgtatcctgtacctctggagagctatgaagatatacacggtaccctccacctcgagcggctggcttaccttcatgctaggttacgggagttgctgtgtgagcttggacgtccgtcaatggtatggctcagcgccaatccctgcccacactgtggggatcggaccttctatgaccctgaaccaattctttgtccctgctttatgcccaattag

SEQ ID NO: 200529 - DNA, 369 bp, Artificial Sequence
  Description of Artificial Sequence: Synthetic coding sequence
atggccgcccccgtggacctggagctgaagaaggccttcaccgagctgcaagccaaagttatcgacactcagcaaaaagtcaagctggccgacatacagatcgagcagttaaaccgaactaagaaacatgcccatctcactgacaccgagattatgactctagtcgacgaaacaaacatgtacgaaggagtgggaaggatgtttatcttgcagagcaaggaggctattcatagccaattgcttgagaagcagaagattgcagaggaaaaaatcaaggaattggagcagaagaaatcctacctggagagaagtgtgaaagaagctgaggacaacatcagggaaatgctaatggcccgtcgggcccagtag

SEQ ID NO: 200530 - DNA, 465 bp, Artificial Sequence
  Description of Artificial Sequence: Synthetic coding sequence
atggccgagaacagcggccgggccggcaagagcagcggcagcggcgctggtaagggagcggtcagcgctgagcaggtgatcgccggattcaaccgacttcgtcaggaacagcgtggacttgcctcgaaagcagcggagctggaaatggaattaaatgagcattctctggtaatcgacactctgaaggaagtcgacgagacaaggaaatgctacagaatggttggtggcgtgctggtggagcgcacggtgaaagaagtcctgcctgccctggagaacaacaaggaacagatccagaagatcatcgaaacccttactcagcagctgcaggcgaaggggaaggagctgaatgaattccgtgagaagcataatatcaggctgatgggtgaagacgagaagccagccgccaaggagaattccgagggcgccggagccaaagccagctcagcaggggtcttggtgtcttag

SEQ ID NO: 200531 - DNA, 405 bp, Artificial Sequence
  Description of Artificial Sequence: Synthetic coding sequence
atggccgccaccatgaagaaggccgccgccgaggacgtgaacgtgacattcgaggaccagcagaagattaacaagttcgctaggaacacatctcgaattaccgagctcaaggaggaaatcgaggttaagaagaaacagctacaaaacctggaagacgcctgcgacgatattatgctggccgatgatgactgtctcatgatcccatatcagatcggcgatgttttcatcagtcatagccaggaagaaacacaagaaatgctggaagaagctaagaaaaacttacaggaggagatcgacgctctcgagagcagagtggagtccatacagcgggtgctggccgatttgaaagtacaactgtatgcaaagtttggctcaaatattaacctcgaggcagacgagtcttag

SEQ ID NO: 200532 - DNA, 465 bp, Artificial Sequence
  Description of Artificial Sequence: Synthetic coding sequence
atggcccagagcatcaacatcaccgagctgaacctgccccagctggaaatgcttaagaatcagttagatcaggaagtggagttcctttctacctccatagcccaactgaaggttgtgcaaactaaatatgttgaagctaaggactgtttgaatgtcctcaacaagtctaatgaaggaaaggagctgctggttcccctgacttccagtatgtatgtgcctgggaagctgcacgacgtggagcacgtgctcatagacgtgggtaccggttactacgtcgagaaaacagccgaagacgccaaagattttttcaagagaaagatcgactttctgacaaagcagatggaaaaaatccagcccgcgttacaagagaaacatgcaatgaaacaagctgtgatggaaatgatgtctcagaagatccaacaacttactgccctcggcgctgcgcaggcaacagctaaggcctag

SEQ ID NO: 200533 - DNA, 330 bp, Artificial Sequence
  Description of Artificial Sequence: Synthetic coding sequence
atggcccagagcatcaacatcaccgagctgaacctgccccagctggaaatgctgaagaatcagctggaccagatgtacgtcccgggcaaattgcacgatgtggagcacgtgctgatagacgttggcacgggctactacgtggagaagaccgctgaggatgctaaagacttctttaaaaggaagattgatttcttgacgaaacagatggagaaaatccagccagcactccaggagaagcacgccatgaaacaggccgtaatggagatgatgtcccagaaaatacaacagctaacagcactgggtgcagctcaggcaacggccaaggcatag

SEQ ID NO: 200534 - DNA, 465 bp, Artificial Sequence
  Description of Artificial Sequence: Synthetic coding sequence
atggcccagagcatcaacatcaccgagctgaacctgccccagctggagatgcttaaaaatcaattggaccaggaagtcgaattcctttccacctccatcgctcaactgaaggtggtgcaaacaaaatacgtcgaagctaaggactgcttgaacgtccttaataagtcaaatgagggtaaagagcttcttgtgcctttgacctcatccatgtacgtccctgggaagctccacgatgtcgagcatgtactgatcgacgtgggaactggttattacgtcgagaaaaccgcagaggacgcaaaggattttttcaaacgcaaaatcgactttctgaccaaacaaatggaaaagattcaacccgccctgcaggaaaagcacgcaatgaagcaagctgtaatggaaatgatgagtcagaaaattcagcagctgacagctcttggggccgcacaggccactgcaaaagcatag

SEQ ID NO: 200535 - DNA, 1281 bp, Artificial Sequence
  Description of Artificial Sequence: Synthetic coding sequence
atgggcaccctgagcgcccccccctgcacccagcggatcaagtggaaggggctcctccttaccgcgtcactgctaaacttctggaacctcccaaccacggcccaggtaactatcgaagccgaacccaccaaggtatcagaaggcaaagacgtcttgcttctggtgcataatctcccccagaatctaacagggtacatctggtacaagggacagatgcgagacttgtatcactatattacgtcgtatgtcgttgacggtgaaatcatcatctacgggccggcttacagcggaagagagacagcttactccaacgcctcactgctcatccagaatgtgacccgcgaggatgccggcagttacacccttcatattatcaagggagacgacggtacccgtggcgtgaccgggaggtttaccttcaccctgcatcttgagactcccaaaccaagcatctcgtcttcaaacctgaacccacgagaaaccatggaagccgtgtcactcacctgcgaccctgagactccggacgcatcttacttgtggtggatgaatggccagagtctcccaatgacgcactccctcaagctatcagaaacaaatcggactctgtttctactgggcgtgaccaaatatactgcaggaccttacgaatgtgagatacgaaaccccgtgagcgccagtcgatcagatccagttacattaaatctgctcccgaagctgcccaagccatacatcaccatcaacaacctgaaccccagagaaaataaagatgtgctgaactttacctgtgaacccaagtccgagaattatacctacatctggtggctcaatgggcagtcactaccagtgtctccacgagtgaagagacctatcgaaaacagaatcctgattctgccatcagttacacgaaacgagaccggcccttaccagtgcgagatcagggatcggtatggaggaatccgaagtgaccctgtaaccctgaacgtgctttacggaccagacttgccccgaatatacccgtccttcacgtactaccgaagcggagaggtcttgtacctgtcctgttccgccgatagtaatccccctgcccagtactcctggacaatcaatgaaaagttccagcttccaggccaaaagcttttcatacgccacatcactactaagcactccggcttgtacgtttgttctgtcagaaactcagccaccggcaaagagagcagcaagagcatgacagtggaggtaagcggtaaatggatacctgcaagccttgccattggattttag

SEQ ID NO: 200536 - DNA, 432 bp, Artificial Sequence
  Description of Artificial Sequence: Synthetic coding sequence
atgggcaccctgagcgcccccccctgcacccagcggatcaagtggaaaggcctcttgttaacggcgtctttattgaatttttggaatctgcccacaacggctcaggtcactattgaagcagagccgaccaaggtgtcagagggcaaagatgttttgctgctcgtgcacaatttgccccagaacctgaccggttacatctggtacaaaggccaaatgagagatctgtaccattacattacaagctacgtggtcgacggagagatcattatctatggacctgcctattccggacgcgagactgcttattccaatgcatctcttctcatacaaaatgtgacgcgagaggatgccggttcttatactctgcatatcattaaaggcgacgacggtacgcgcggggttacaggcagatttactttcacgctgcactag

SEQ ID NO: 200537 - DNA, 1287 bp, Artificial Sequence
  Description of Artificial Sequence: Synthetic coding sequence
atgggcaccctgagcgcccccccctgcacccagcggatcaagtggaaaggcctgcttctgacagcctctttgttgaacttctggaatctgcccaccactgctcaagtgactattgaagccgaacctacgaaggttagtgaggggaaagacgtgctgttacttgtgcacaaccttccccagaatttgacaggttacatctggtacaaaggccagatgcgcgatctataccactatatcacatcttatgtggttgacggggaaattatcatttatggacctgcctactctgggagggagacagcatattcgaacgcttctctattgatacagaatgtcacaagagaagatgctggttcttatacgctccatattataaagggtgatgatggaaccagaggcgttaccggcagatttacttttactctgcacctggagactcctaaaccctcgatttccagttcaaatctgaatcctcgggagacaatggaagctgtgagcttgacgtgcgaccctgaaactccggatgccagttatctgtggtggatgaacgggcagagtctaccaatgacacactcacttaagctttctgaaacgaatagaacacttttcctgctgggcgtcacaaaatacacagccgggccctatgaatgcgagatcagaaacccagtttccgcttccagaagcgaccctgtcacccttaatctccttccaaagcttcccaagccttacatcaccatcaacaacctcaatccaagggagaacaaggacgttctcaactttacgtgtgaaccaaagtcagagaactacacatacatctggtggctgaacggacagtctctgcccgtgtccccacgcgtcaaaagacctatagagaatcggatcctaatcctgccgagtgttacaaggaacgagactggcccataccaatgcgagatcagagaccgttatggcggtatccgctctgaccccgtgactctgaatgttctctatggacccgatctaccaaggatctaccctagctttacctattataggagtggagaagtgctttacctctcgtgtagcgccgactcaaatcctcctgctcagtattcctggactataaacgagaagttccaactgccgggacagaagctcttcatccggcatattaccacgaaacatagcggattatacgtttgttcagtgagaaacagtgctacaggaaaggagagctctaaaagcatgaccgtggaagtgtcggcatactcctctagcataaattatacaagtgggaataggaattag

SEQ ID NO: 200538 - DNA, 1260 bp, Artificial Sequence
  Description of Artificial Sequence: Synthetic coding sequence
atgggcaccctgagcgcccccccctgcacccagcggatcaagtggaagggtctgttgctgacagcaagtctcttgaacttctggaacctaccaacgacagcccaggttactatcgaggccgaacctactaaggtttctgagggtaaggatgtcttgctcctggtccacaacttgccccagaatctgactggatatatctggtataaagggcaaatgagggacctgtaccactacataacttcctatgtcgtggatggggagatcatcatctatggccctgcatattccggaagagagactgcgtactccaacgctagtctgctgattcagaacgtcactcgggaagatgctggctcgtacacactgcacattatcaagggagacgacggcacacgcggggttaccggtcgattcacattcacactacacctggagactccaaagccttccattagttcgagtaatctgaaccctagagagaccatggaggccgtcagtctcacctgtgatccggagacacccgatgctagctatctgtggtggatgaacgggcagtcgctcccaatgactcattccctgaaattgagcgaaaccaacagaactctgttcctgctaggtgtcactaagtataccgcaggaccctatgagtgcgagattcgcaaccccgtctcagcctcccgatctgatccagtaactttaaacttgctgccgaagctgccaaaaccttacatcacaattaacaatcttaatccaagagagaataaggacgttctgaatttcacttgtgagccaaagtcagaaaactatacctacatctggtggttaaatggacagtcactgccagtcagtccgcgcgtcaagcgccccatcgagaatcgcatcttgatcctgccaagcgtcaccagaaatgagaccggcccctatcagtgcgagatccgtgaccgctatggcgggatccgaagtgaccccgtgacactgaatgtgctgtacggccctgatctgccacgaatttatccatcttttacttactatcgcagtggagaagtcttgtatttatcttgtagcgcagattcgaatccaccagctcagtactcttggactattaatgaaaaattccaattgcctggtcagaaattgttcattaggcatatcactaccaaacactcgggtttatacgtgtgtagcgtgcgtaatagtgccaccggcaaggaatcgtctaagagcatgaccgtcgaggtttcagattggacggtcccttag

SEQ ID NO: 200539 - DNA, 1254 bp, Artificial Sequence
  Description of Artificial Sequence: Synthetic coding sequence
atgggcaccctgagcgcccccccctgcacccagcggatcaagtggaagggactcttgctcaccgctagcctgctcaatttctggaacctgcctacgacggctcaggtgactatcgaggctgagcccaccaaagtgagcgagggcaaggacgtgcttctcctggtccataacctgccccagaacctgaccggatatatctggtataagggacaaatgagggacttgtatcactacatcacatcctacgtcgttgacggggaaatcataatctatggcccagcttactccgggagagagaccgcctactccaatgcttccctgctgatacagaacgtgactcgggaagacgccggatcctatactcttcacattatcaagggggatgatggcacacggggagtcaccgggaggtttaccttcacactgcatctggagacccccaaaccctcaatatcatcatcaaacttgaaccccagggagaccatggaggcagtgagtctcacttgcgatccggagacacctgatgcttcatacctgtggtggatgaatggccagtcattgccaatgacccacagcctaaaactttcagagacaaacaggactcttttcctcctcggggtgacaaagtacaccgccggcccatacgagtgtgagattagaaatcccgtcagcgcatcccggtctgacccagtgactttaaacctccttcccaagcttccaaagccctatatcacaattaataaccttaatcccagggaaaacaaggatgtcttgaatttcacctgcgagcctaagagtgagaactacacctatatctggtggctcaatggccagtcactgcctgtctcccctcgggtgaaaagacccatcgaaaatcgcatccttatcctacccagcgtcaccaggaacgagactggaccctaccaatgcgagatcagggatcggtatggcggcatacgctccgaccccgttactctgaacgtcctgtacggaccagatctgccacggatttatccttcattcacatactacagaagcggtgaggtcctgtacttatcatgctctgcagattccaatccacccgcgcaatatagttggaccatcaacgaaaagttccaactgcccggccagaaattatttattcggcacattacgaccaaacactccggactgtatgtatgctcagtcaggaactccgcaactgggaaggagtcctcaaaatccatgacggtggaagtgagcgaagccctttag

SEQ ID NO: 200540 - DNA, 642 bp, Artificial Sequence
  Description of Artificial Sequence: Synthetic coding sequence
atgggccccctgagcgcccccccctgcaccgagcacatcaagtggaaaggcctgctgctgactgtggagaccccgaaaccgagtatttctagctccaatctgaatcctcgtgaagccatggagacagtcatcctgacctgcaacccggaaacccctgacgcttcctacctgtggtggatgaatggacagagtctgccaatgactcaccggatgcaactctcagagaccaatcgcacactgttcctgtttggcgttacaaagtacactgcggggccttatgagtgcgaaatctggaactcaggctctgcaagtcgtagcgaccctgtaaccctgaacctgctgcacggccccgatctgcctaggatcttcccgtccgtgacatcctactattcaggagagaacctagatctgagctgctttgcaaactcgaatcctcctgcccagtacagttggacgatcaacggcaagtttcagctcagcgggcagaaattgttcatcccacagatcacgcccaagcacaacggcctatacgcctgtagtgccagaaatagcgctacaggcgaggagtcatccactagtctgaccattagagtgatcgcccccccaggcctgggcacctttgccttcaataacccaacctag

SEQ ID NO: 200541 - DNA, 1008 bp, Artificial Sequence
  Description of Artificial Sequence: Synthetic coding sequence
atgggccccctgagcgcccccccctgcaccgagcacatcaagtggaaggggctgctgctgactgccctacttttgaatttctggaacctgcccacaacagcccaggtgatgattgaggctcagcctccaaaggtgtccgagggcaaagacgtgcttctgctggttcacaacctaccccagaatctgactggatatatctggtataaaggtcagatcagggatttataccactacatcacttcctatgttgttgacggccagataatcatctacggacccgcttattcaggaagggaaactgtgtactcaaacgccagcctgctcattcaaaatgtgaccagggaggacgccggctcctacacactgcatatcataaagaggggagatgggactcgcggagtgacaggttactttacgttcaccctctacctggagacaccaaagccatccataagctcatctaatttgaatccccgcgaagcgatggagacagtgatcttaacatgtaatccagaaacacccgatgccagctatctttggtggatgaacgggcagtctttacccatgacgcaccgcatgcaactgtcagaaacaaacagaaccctctttctgttcggcgtgacaaaatacaccgccggcccgtatgagtgcgagatctggaatagtgggtccgcctcccggagcgacccggtcacactgaatttactgcacgggccggacctgcccaggatttttccttccgtgacatcttactactctggcgagaacttagacctgtcctgctttgctaactcaaacccaccggcacagtactcatggaccatcaatgggaagttccagctgtccgggcagaagcttttcattccacagattacccctaagcacaatggcctctacgcttgtagcgcacgaaacagcgcgacaggcgaggaatcttctacgtcactgacgatcagggtgatagctccacctggcctaggtacgtttgcgtttaataaccctacgtag

SEQ ID NO: 200542 - DNA, 1008 bp, Artificial Sequence
  Description of Artificial Sequence: Synthetic coding sequence
atgggccccctgagcgcccccccctgcaccgagcacatcaagtggaagggcctgctgcttaccgcacttctgctgaacttttggaatctccccacaacagcgcaggtaatgatcgaagcgcagcccccaaaggtttccgaaggcaaggatgtgctgctgcttgtgcacaacctgccccagaatcttactggttacatctggtataagggccagatccgggatctctaccattacatcaccagttatgtggtcgacggtcagatcatcatttacgggcccgcttattctggacgggagacagtctattcgaacgcatccctcctgatccaaaacgtgacgagggaggatgcaggatcatacaccctgcacatcatcaaacggggtgacggaactagaggagttactggctatttcacattcacactttatctggagacaccaaagcctagtatttctagctctaatttgaatcctcgggaggcgatggaaacagtcatactgacctgcaaccccgaaacgccagatgcctcctacttgtggtggatgaacggtcaatcgctgccaatgacacatcgtatgcagttgagcgaaacaaataggacactgttcttgttcggcgtgactaagtacacagccggaccgtatgagtgcgagatctggaattccggatctgcgtccaggtcggacccagtgactctcaatcttttacatgggcccgacctgcctcggatctttccatcggtgacaagctactattccggtgaaaatctggatctcagctgcttcgcaaacagcaacccacctgcgcagtatagctggactatcaacgggaagttccagctgtctggccaaaaactcttcatcccacagattacacccaagcacaatggtctatatgcatgcagcgccagaaatagcgcaacaggcgaagaatccagtaccagtctgaccatccgggtgatagcaccgcccggtctaggaacttttgctttcaataatcctacctag

SEQ ID NO: 200543 - DNA, 642 bp, Artificial Sequence
  Description of Artificial Sequence: Synthetic coding sequence
atgggccccctgagcgcccccccctgcaccgagcacatcaagtggaaggggctgctgctcaccgtcgagacgccaaagccctcaattagcagtagtaacttgaatccacgggaggctatggaaactgtcatcttgacgtgcaaccctgaaacgcctgatgcctcctacttatggtggatgaacggccagtcccttccaatgactcatcgcatgcagctatccgagacaaacagaacgctgttcctgttcggggttacaaaatatactgccggcccatacgaatgtgaaatctggaactctgggtcggcatctcgaagtgatcccgtgacactgaatctccttcacggacccgatttaccacgtatttttccttctgtgaccagttactactcgggtgaaaacctagacttaagctgttttgctaatagcaacccacccgcccagtacagctggacaattaacgggaagtttcagctctccgggcagaagctgtttatcccccagataaccccaaaacataacggcttgtatgcatgtagcgcacggaattccgccactggagaggagagcagtacaagtcttaccattcgggtcatagcccctcctggacttgggaccttcgccttcaataatccaacctag

SEQ ID NO: 200544 - DNA, 1008 bp, Artificial Sequence
  Description of Artificial Sequence: Synthetic coding sequence
atgggccccctgagcgcccccccctgcaccgagcacatcaagtggaagggactgctggtaactgctagtctgctcaatttctggaacctcccgaccaccgcccaggtgacaattgaagcgcagccgcccaaagtgtccgaagggaaggacgttctgttacttgtgcacaatcttccccagaacctgacaggctatatttggtataaagggcaaatccgcgatttgtatcactacataaccagttacgtcgtggatggtcagataatcatctacggtccagcctactcgggcagagaaacagcatactcaaatgccagtctcctgatccagaatgtcacacgtgaggacgccggttcgtacacactgcacattatcaagcgaggggatggaacgagaggggtaacagggtactttaccttcacactctacctcgaaacaccgaaacctagcatcagcagctccaatctgaatccgagggaggccatggagaccgtcatacttacatgtgaccctgagacaccagatacatcctaccagtggtggatgaacgggcagtctttaccgatgactcataggttccagctgagtgaaaccaatcggaccttattccttttcggtgtgaccaagtacacagccggaccttacgagtgcgaaattagaaattccgggtctgcctctcggagcgatcctgtcacattaaacctgttgcacggacctgatttgccaaggatccatccctcctataccaactaccgtagcggtgacaatttgtacttgtcttgcttcgcaaattccaatcctcccgcccagtactcctggacgatcaatggcaaattccagcagtctggccagaatctgtttataccccagattaccactaaacactcagggctgtatgtgtgttcggtgagaaattccgccaccggtgaagaaagctcaacgtctctgactgttaaggtgtccgcttcgacacggattggcctgctgcccctacttaatcccacatag

SEQ ID NO: 200545 - DNA, 1008 bp, Artificial Sequence
  Description of Artificial Sequence: Synthetic coding sequence
atgggccccctgagcgcccccccctgcaccgagcacatcaagtggaaaggcctgttggtcactgccagcctgctgaacttttggaacctccccacaactgcacaggtgaccatcgaggcacagccgccaaaggttagtgagggcaaggatgtgttactgctcgtgcacaatcttcctcagaatcttaccggctacatttggtataagggccaaattcgcgacttatatcattacataacctcatatgtcgtcgacggccaaattatcatctacgggcctgcctattctggacgagaaaccgcttacagcaatgcaagtcttctcatccagaacgtgacgcgagaggacgcaggatcttacactctccacatcatcaaaagaggtgacggcaccaggggcgttactggctattttaccttcactctgtatctcgagacccctaagccatcaatttcttccagcaatctgaacccaagggaggcaatggagacagtaatacttacctgtgatcccgagacacccgacactagttaccagtggtggatgaacggacaatccctgcctatgacacatcgcttccagttatcagagactaacaggacgctctttttgtttggcgtgacgaagtacaccgcaggaccatatgaatgcgaaattcgcaacagcggctctgcatctaggtctgacccagtcacactgaacctgctccatggtcctgatctaccaaggatccatccaagctataccaactaccggtccggtgacaatctttatctcagctgttttgctaatagcaaccctcctgcacaatacagctggaccatcaatggcaaattccaacagtcgggacagaatctgttcatcccccaaatcacaaccaaacattccgggctgtatgtatgcagtgtgcgcaatagcgcgaccggggaagaaagtagcactagtctaactgtcaaagtatccgcatcgacccgcattgggttgctcccactcctgaatccaacgtag

SEQ ID NO: 200546 - DNA, 1008 bp, Artificial Sequence
  Description of Artificial Sequence: Synthetic coding sequence
atgggccccctgagcgcccccccctgcaccgagcacatcaagtggaaggggctgctggtgaccgctagtttgctgaacttttggaacttacccaccactgcccaggtgactatcgaggcgcaaccacctaaggtgtcagagggaaaggacgtgctgctactggtacataacttgccacaaaacctgaccgggtacatctggtacaagggtcaaattagagacctgtatcactatattacctcttacgtcgtggacgggcagattattatctacggccccgcttactcaggccgggagacggcctactctaatgcctctcttctgattcagaatgttactcgggaggacgccggaagttacactctgcatataattaaaaggggggatggcacaaggggcgtaacaggctatttcacgtttactctgtatctcgaaactccaaaaccatcgattagtagcagcaatctgaaccctagggaagccatggaaacagtcatcctgacctgtgaccctgaaactccggacacctcatatcagtggtggatgaacggacagagcttgccgatgacccatcgtttccagttgagcgagaccaaccgaactctctttttatttggtgtgaccaaatacaccgccgggccatacgagtgtgaaattcggaattcaggtagcgccagtagatcagaccctgtgacactgaatctgctgcacgggcccgaccttccacgtattcacccttcgtacaccaattacagatcgggcgataacctgtatttgagttgtttcgcgaacagtaatcctccggcacagtacagctggactattaatgggaagtttcagcaatcaggtcagaacctctttattccacagattaccacaaagcactccggcctgtatgtctgtagcgttcggaactccgccaccggagaagagagcagcacttcccttacagtcaaggttagcgcatctaccagaatcggactgctgcctcttctcaaccccacatag

SEQ ID NO: 200547 - DNA, 1287 bp, Artificial Sequence
  Description of Artificial Sequence: Synthetic coding sequence
atgggccccctgagcgcccccccctgcacccagcggatcacctggaaaggattacttctgacggctctgcttcttaacttctggaatctgcccaccaccgctcaggttactattgaagcggaaccgaccaaggtctccaagggtaaggacgtgttgctgctggtgcacaaccttcctcagaatttggcagggtacatttggtacaaaggccagatgaaggacctttatcattacatcaccagctatgtcgtcgacggccagatcattatctatgggcccgcttactccggcagagagactgtttactctaatgcctctctgttaatacagaacgtaactcgtgaggacgccggatcttataccctccacatcgtaaaacgcggcgacggtaccagaggtgagacaggacacttcacatttacattgtacctcgagactcccaagcctagtatttcatctagcaacttatatccccgcgaagacatggaagctgttagcttgacctgcgatccggaaacacctgatgccagttatctgtggtggatgaacggccagagtctgccgatgacacacagtcttcagttaagcaaaaacaagaggacactgtttttattcggtgtcactaaatacacagccgggccctacgagtgcgaaatcagaaatcctgtttccgcctcccgaagcgatcccgtaaccctgaacctgctgcctaaactgccaaagccttacattacaatcaataacctgaatccaagagaaaacaaggatgttcttgctttcacctgcgagcctaagagcgaaaactacacctatatctggtggctgaacgggcagtctcttcccgtgagtccacgggtgaaacgacccatagaaaacagaatccttatcctgcctagcgtgactagaaacgaaacaggaccgtaccaatgtgagatccaggatcgatatggtggaattcgcagctatcccgtgacactgaatgtgctctatggaccagatctgcctcggatatatccttcctttacctactaccacagcggagagaacctgtatctgtcttgtttcgcagattccaacccacccgctgaatactcatggaccatcaacgggaagtttcagctgtccggacaaaagctctttattccccagattactaccaagcatagcggtttgtatgcatgtagcgtacgtaattctgcaactggtatggaaagctcaaagtctatgactgtgaaggtttccgcaccaagcggtaccgggcatctgcccggactgaacccactttag

SEQ ID NO: 200548 - DNA, 981 bp, Artificial Sequence
  Description of Artificial Sequence: Synthetic coding sequence
atgggccccctgagcgcccccccctgcacccagcggatcacctggaaaggcgttctcctcaccgccagtttgctcaatttctggaatcctccaactacagcgcaagtgaccattgaggcacagccgcccaaggtttcagagggaaaagatgtcctgctgctcgttcataacctgcctcagaatcttgctggatatatctggtacaaaggtcagatgacctatctctatcactatattacaagttatgtagtagatggccagaggatcatatatggcccggcgtacagtggccgggagcgggtctacagcaacgcatctctcctcatccagaacgtgacacaggaagacgcaggctcttacaccctgcatatcatcaaaagacgtgacggaactggaggcgtgacggggcatttcaccttcacattgcacctcgaaacccctaaaccttctattagctccagtaacttaaatccgagggaagccatggaagctgtgatcctgacgtgcgaccctgccacccccgctgccagttaccagtggtggatgaacggacagtccctgcctatgactcaccgattacaattgtccaaaacaaacagaaccctgttcatcttcggagtcacaaaatacatcgcaggtccctacgagtgcgagataagaaaccccgtctccgctagtaggagtgatcctgtgacgttgaatcttctacacggtcctgatctccccagcatatacccttcgtttacgtactaccgtagcggcgagaacctgtatttgagctgtttcgctgagagcaatccccgcgcccaatacagctggacaattaacggtaagttccagctgagtgggcagaagctgtccattccacagattaccaccaaacatagcggcttatacgcgtgttctgttcgtaacagtgcgacaggaaaagaaagttctaagagcattaccgtgaaagtgtccgattggattctaccatag

SEQ ID NO: 200549 - DNA, 1260 bp, Artificial Sequence
  Description of Artificial Sequence: Synthetic coding sequence
atgggccccctgagcgcccccccctgcacccagcggatcacctggaagggagttctgctgaccgcatctctcttgaacttttggaatccccctactactgctcaggtgactatagaggcccagccccccaaggtgtccgaagggaaagatgtgctattacttgttcacaatttacctcagaatctggctggttacatctggtacaaggggcagatgacatatctctaccactacattacatcttatgtggtggacgggcaaagaataatttacgggcctgcatactccggacgtgagagagtctattcaaatgcaagcctccttatacaaaatgtaacacaggaggatgcgggttcttatacactccatataatcaaaaggagggatgggactggaggggtgaccggccactttacttttaccctccacctggagaccccaaaacccagtatcagctcttctaacctgaacccccgagaggcgatggaggctgtaatcctaacgtgcgaccctgccactccagccgcctcctaccaatggtggatgaacgggcaaagtctaccaatgacacatcgattgcaattgagtaagactaaccgaacattgtttatattcggggtaaccaagtatatcgccggcccttatgaatgtgaaatccgaaatcccgtctctgcatcacggtctgatcctgtgaccctcaatttgttgcccaagttatctaaaccctatattaccatcaataatctgaaccctagggagaataaagacgtcctgactttcacctgcgagcccaaatctaagaactacacctacatatggtggttaaacggccaatcattgcctgtgagtccgcgtgtcaaaagacccatcgagaacaggatcctcatcctgccaaatgtgacaagaaatgagaccggcccttaccaatgcgagatcagggaccgctatgggggcatacggagcgaccctgtcacactgaatgtcctgtatggacccgatctgccaagcatttacccttcgtttacatactacagaagtggagagaacctgtacctgagctgctttgccgagagcaatccccgtgctcaatactcctggacaattaatggaaaattccaactttccgggcaaaaactgtcgatcccacagataacaaccaaacactctggcctctacgcgtgttctgtgagaaactctgccaccgggaaagagtccagcaaatccatcacagtaaaggtctctgactggattctgccctag

SEQ ID NO: 200550 - DNA, 981 bp, Artificial Sequence
  Description of Artificial Sequence: Synthetic coding sequence
atgggccccctgagcgcccccccctgcacccagcggatcacctggaagggcgtactcctgaccgcctcccttctgaatttttggaatccccctaccactgctcaggtgacaatcgaggcacagccaccaaaggtttccgagggcaaggatgtgctcctacttgttcacaatttgccacaaaatctggccggatacatatggtacaaaggccagatgacgtacctctatcattatattaccagctatgtcgtcgatggccaaagaataatctacgggcccgcttattctggacgggaaagagtgtactcaaacgccagtttgctcatccaaaacgttacacaggaagacgccggtagctacacactgcacatcatcaaaagaagggacggcacaggcggggttactggtcattttacattcacactgcaccctaagctgtccaagccctatatcactatcaataatcttaaccctagagaaaataaagatgtcctgacgtttacttgcgaaccgaaatccaagaattatacctatatttggtggttgaacggtcagtcactgccagtgtctcctcgggtgaagagaccaatagagaacagaatcttgatcctcccaaacgtgacacgcaacgagactgggccttaccagtgcgaaatcagggaccgttatgggggtattagaagtgacccagtcactttgaacgtcctctatggtccggatctccccagcatctatcctagtttcacttactaccgaagcggtgaaaacttgtacttgtcatgcttcgctgagtctaatcccagagctcagtactcctggaccatcaacgggaagtttcaactgagtggacaaaaattatcgatcccgcagatcactactaaacattccggactttatgcctgctcagtcaggaattccgccactggaaaggaaagctcaaagagtattaccgtaaaggtgtccgattggattctgccttag

SEQ ID NO: 200551 - DNA, 1008 bp, Artificial Sequence
  Description of Artificial Sequence: Synthetic coding sequence
atgggccccctgagcgcccccccctgcacccagcacatcacctggaaaggcttgttgctcacagcctcactccttaacttctggaacctgcccataacggctcaagtgacaatcgaagccctgccaccaaaggtgagtgagggcaaggatgtgctgctgctagtccataacctacctcaaaacctcgccggctacatctggtataaaggacagctgatggacctatatcattatattaccagctatgtggtggacggtcagattaacatctatggtccagcttacaccggcagagaaaccgtgtacagtaacgccagcttgctcattcagaacgtgacgcgagaggatgcaggaagctatacccttcatatcataaagagaggtgatcgcactcgtggcgtcactgggtactttacatttaatctgtatctgaagcttccgaagccatacattactattaataactccaagccacgcgaaaataaagatgttttggccttcacgtgcgagcctaaatcggaaaactacacttatatctggtggctcaacggacagagcctgcctgtgtctcctcgggtcaaacgaccaattgagaaccggattctcatactgccgtcagtcacccgaaacgagacaggcccctatgagtgcgagatccgggatagagatggcggtatgagatcagaccccgtcacactgaatgtcctgtacggccccgatctcccctcaatctacccctcattcacgtattataggagtggagaaaatctctacctgtcctgcttcgccgagagcaaccctccagcggagtacttctggactatcaacggtaagttccagcagtccggccagaagctgagcatcccccagataacaacgaaacaccgaggtctgtatacatgcagtgtccgcaattccgcaacaggaaaggaatcatcaaagtcaatgacagtggaggtgagcgccccttctgggatcggccggctgccactgcttaaccctatctag

SEQ ID NO: 200552 - DNA, 1008 bp, Artificial Sequence
  Description of Artificial Sequence: Synthetic coding sequence
atgggccccctgagcgcccccccctgcacccagcacatcacctggaagggtttacttcttactgcttccctgctgaacttctggaacctgcctataaccgcccaggtcacgatagaggccttaccgccgaaggtatccgagggcaaggatgtgcttctactggtgcacaacttaccccagaatctagcaggatatatctggtataagggacagctaatggatctctaccactacatcactagttatgtggtggatggacaaataaatatttatggaccggcctatactggccgcgaaaccgtgtatagtaatgctagccttctgattcagaacgtgactcgcgaagacgccgggtcctatactcttcacatcatcaagagaggtgatcgaacgaggggggtgactggttactttacatttaacctctacttgaaactgcccaaaccatacatcactatcaataattccaagccccgtgagaacaaggacgtcctcgcgtttacctgcgaaccgaaatctgagaattacacatacatttggtggttaaacggacagtctctgccagtgagtccacgcgttaaaaggcccattgagaataggatcctgatcctccccagcgtgacccgcaacgagacggggccttacgaatgcgagatccgagatagggacggggggatgcggagtgaccctgtcaccctcaatgtcctctacggaccagacctgcccagcatctatccctctttcacctattatagaagtggggagaacctgtatctctcatgttttgccgagtcaaatccgcctgccgagtacttctggactattaacggaaaatttcagcagagcggccagaagcttagcatccctcagattaccacaaaacatcgaggcttatatacatgtagtgtgcggaactctgccactgggaaagagtcctcaaagtcaatgacagtagaggtgtctgcgccaagcggaatcggccgcctgcccctgctcaaccccatttag

SEQ ID NO: 200553 - DNA, 1008 bp, Artificial Sequence
  Description of Artificial Sequence: Synthetic coding sequence
atgggccccctgagcgcccccccctgcacccagcacatcacctggaagggcctgcttctgacagcttcgctcctcaatttctggaatttaccaattaccgcacaggtcactattgaggcactccctccgaaggtctccgaaggcaaagatgtccttctactcgtacataatctccctcagaaccttgccgggtacatatggtataaaggccaactcatggacttgtatcactatatcacaagctatgtcgtcgatgggcagattaacatttacgggcccgcatacacaggtcgagagacggtctacagcaatgcatctcttctgatccagaatgttacacgcgaggacgccgggtcttacacgctgcacattataaagcggggcgaccgaactagaggggtgacaggttattttacgtttaacttgtatctcaagctgcctaagccttacatcacaatcaataattccaaaccaagggaaaataaggacgtgcttgcattcacctgcgaaccaaaatcagaaaactacacgtacatctggtggctgaatggacagtcactgcccgtgagccctcgggttaaacgccccatcgaaaaccggatcctaatactcccgagtgtgacacgaaacgaaacaggtccatacgaatgcgagattagagacagagacgggggaatgaggtccgatccagtaacactcaacgtgctctatgggcctgatctaccctcaatctacccttcatttacctactatagatcaggcgaaaacttgtacctatcttgtttcgccgaatcgaaccctcctgcagagtatttctggacgataaatggtaaattccagcaatctggtcagaagttatctataccccagattacaactaaacaccgtggattgtatacttgttctgttcgcaactcagcaactggcaaagaaagctccaagtcgatgaccgtggaggtctccgcccccagcgggattggtcgtcttcctctcctcaaccccatttag

SEQ ID NO: 200554 - DNA, 1275 bp, Artificial Sequence
  Description of Artificial Sequence: Synthetic coding sequence
atgggccccctgagcgcccccccctgcacccagcacatcacctggaaaggtctgctgcttaccgcaagccttctgaacttttggaacttgcctacaacggcccaggttatcattgaagccaaaccacctaaggtgtcagagggcaaggatgtgctgctgctggttcataaccttccacagaacctgactggatacatatggtataagggccagatgaccgacttgtaccattatataaccagttacgtggtgcatggccagatcatctatgggccagcatactcaggtagagaaaccgtatatagcaatgcctctctgttaatccaaaatgttactcaggaagacgcgggcagctatacgctgcacattattaaacgaggcgatggcactggaggggtgacaggatacttcacggtaaccctgtattctgagacacccaagccttcaataagtagttctaatttgaatcctagagaagtcatggaggcggtcagactaatctgtgaccctgagacacccgatgcatcatatctgtggctgttgaatggtcagaatctcccgatgactcatcggttgcaactctccaagacaaataggacattgtacctcttcggagtgactaagtatatcgccggaccttacgagtgtgagattaggaacccagtctcggcctcaaggtccgaccctgtaaccttgaacctgcttcccaagcttccaatgccctatatcaccattaataatctgaatcccagagagaagaaggacgtgctcgcttttacctgtgagcctaagtcacggaactacacgtatatctggtggctgaacggccagagtctgcccgtgtcaccacgggtgaaaagacccatagagaaccgtatcctcatcctcccaagcgtgactcggaacgagacagggccctatcaatgcgagattagagaccggtatggcggtatacgtagtaatcctgtgactcttaatgtgctgtacggacctgatctcccgcggatctatccttcttttacatattatcgctctggcgaaaatttggacctctcctgcttcgccgattctaatccccctgccgagtacagttggaccatcaacggcaagttccagctgtcgggacaaaagctgtttatcccacagatcaccacaaatcactctgggctttacgcatgctcggtgaggaatagcgctactggcaaagaaatcagcaagtccatgatcgtgaaagtcagcggaccctgccatgggaaccaaacagagagtcactag

SEQ ID NO: 200555 - DNA, 1308 bp, Artificial Sequence
  Description of Artificial Sequence: Synthetic coding sequence
atgggccccctgagcgcccccccctgcacccagcacatcacctggaagggcctactcttgactgcaagtttgctgaatttctggaacctgcctacaacagcgcaggtcatcatcgaagccaagcctcccaaagtctccgaaggaaaagacgtcttgctgctcgtccataacctgccacagaatctcaccggctacatctggtataagggccagatgacagacttgtaccactatatcacatcatatgtggtgcacggtcaaatcatttacggccccgcgtatagcgggcgggaaactgtgtactccaacgccagtcttttgattcagaacgtgacccaggaggacgctggctcctacacacttcatattattaagagaggggatggtacaggaggtgtcaccgggtactttacagtcacactgtactctgagacgcccaaaccgtccatttcctcatctaatctgaaccccagggaggtgatggaggccgtgcggctcatctgcgacccagaaactccggacgcaagctacctatggcttctcaatggccaaaacctaccgatgacccataggcttcagctatctaagaccaatcgaacactctatctgttcggagtgacaaagtatattgctggaccatatgagtgcgagatccggaaccccgtgagcgcttcacggagtgatccggtgaccttaaacctcctgcctaaactgccaatgccttacattacgattaataatttgaacccaagagaaaagaaggacgtgctggcttttacttgcgaacctaaatctagaaactatacctacatctggtggctgaatgggcagtctttacccgtttcgccacgggtgaagaggcctatagagaacagaatcttaatcctgccatccgtgacacggaacgagactggaccctaccagtgcgagattcgggatcgttatggaggcatccgatcaaacccagtgaccttgaacgtcctctatggacccgaccttcctcgtatttacccaagttttacatattaccgaagcggtgaaaatttggacctgagctgcttcgctgactcgaatccaccagcagagtattcttggacgattaacggcaagtttcagctctctgggcagaagctgttcatcccacaaataaccaccaatcatagcggtctgtatgcgtgtagtgttaggaacagtgctactgggaaggagatttctaaaagtatgattgtgaaagtgtccgagacggcgtctcctcaggtgacatatgccggcccgaacacttggtttcaagagattctgctcctgtag

SEQ ID NO: 200556 - DNA, 606 bp, Artificial Sequence
  Description of Artificial Sequence: Synthetic coding sequence
atgggcggcgacgagaaccggggcgtgaccggccacttcaccttcacattatacctcgagactcccaagccaagcatatcctccagtaagctgaatcctcgggaggccatggaggctgtgtcactcacttgcgatcccgaaacccccgacgcgagttatctgtggtggatgaacgggcagagcctgccgatgtctcaccggctgcagctgagcgagaccaatcggacactgttcctgttaggagtgactaagtataccgctggcccttacgaatgcgaaatacgcaatcctgtgtcagcctctcggtccgacccctttacacttaatctgctgcatggtcccgacctaccaagaatttacccctcatttacatactaccggagcggcgaggtgctgtacctaagttgctcagcagacagtaaccccccagcccaatattcttggacgattaacggtaaatttcaactgtcaggccagaagctcttcatccctcagatcactacaaagcattcaggcctatacgcatgttctgtccgaaactctgcaacagggaaggagagcagcaagtcaatgactgtgaaggtctctgactggactctcccttag

SEQ ID NO: 200557 - DNA, 1281 bp, Artificial Sequence
  Description of Artificial Sequence: Synthetic coding sequence
atgggcctgctgagcgcccccccctgcacccagcggatcacctggaagggcctgcttctcaccgcaagtcttctgaatttctggaacccacctaccacggcacaggtcacaattgaagcgcaacccacgaaggtaagcgagggcaaggacgtgttactgttggttcacaatctgccacagaacctgaccggttatatctggtacaaagggcagatcagggacctgtatcactacattacctcttacgtggttgatggccaaatcattatttatggacctgcctatagtggccgcgagaccatctacagcaatgcctcattgctcatccagaacgtgacacaggaagacgccggatcctacacacttcatattattatggggggcgacgaaaaccggggcgtgacgggccacttcacttttaccctttacttggagacacccaagccgtcaattagtagctcaaagctgaacccaagagaggccatggaggcggtctcattgacttgcgaccctgagacccctgatgcgagctatctgtggtggatgaacggacagtctctgccaatgagccacaggctacagttgagtgagacaaacagaaccctcttccttctcggggtaacaaaatatactgcaggtccctacgaatgtgagattcgaaaccctgtcagcgcaagccgatccgatcctttcacactgaatcttctccctaaactccccaaaccctacatcactatcaataacctcaagccgcgggagaacaaagacgtgttgaattttacctgcgaaccaaagagtgagaactacacatatatctggtggttgaatgggcaatccttaccggtttccccgagggtgaaacgtcccattgagaatcgcattctaatactgccttccgtcactagaaacgagactggaccctatcaatgcgaaattcgtgaccaatatgggggcatccggagttatccggttacactgaatgtgctatatgggcccgatctgcccagaatctacccatcattcacatactaccggagcggggaggtcctctacctgtcgtgttctgcagatagcaatcctccagcccagtactcttggaccatcaatggcaagttccagcttagcgggcagaagctcttcatcccccagattactacgaaacattctggactgtacgcctgcagtgtacgcaactctgccaccggcaaagagtctagcaaatctatgactgtcaaagtttccggaaagcgcataccggtcagtctggcgatcggcatttag

SEQ ID NO: 200558 - DNA, 717 bp, Artificial Sequence
  Description of Artificial Sequence: Synthetic coding sequence
atgagccaccggctgcagctgagcgagaccaaccggaccctgttcctgttaggagtcaccaagtacacagcgggcccctacgaatgtgagatccggaaccctgtgtccgcctccaggtccgatccatttactctgaatctgcttcctaagctccccaagccttacatcactatcaataaccttaagccgagagaaaataaagatgtgctcaattttacctgtgagcctaaaagcgaaaactatacctacatatggtggctgaacggccagagcttacccgtttccccacgagtgaaacggcccatcgagaacaggattctgatcctgccatcagtcaccaggaacgaaacaggtccctatcaatgtgagatcagagatcagtacggcgggattcgaagctatcccgtcacactgaatgtgttgtacgggcctgatctacccagaatttatccgtcattcacctactacaggagcggggaagtcctatatctttcttgctcagccgactctaatccgcccgcacagtactcgtggaccatcaacggcaagttccagttgagtgggcaaaaactctttattccccagattaccacaaaacatagcggcctgtacgcatgctcagtcagaaatagcgcgacaggcaaagagagcagtaaatccatgacagtgaaagtaagtgcctactcttcatccattaactacaccgctgtatactag

SEQ ID NO: 200559 - DNA, 1260 bp, Artificial Sequence
  Description of Artificial Sequence: Synthetic coding sequence
atgggcctgctgagcgcccccccctgcacccagcggatcacctggaagggactgcttcttacagcttcgctgctaaacttctggaatcctccaaccactgcccaggtgacaatcgaagcgcaaccgacaaaggttagtgaaggaaaggacgtgctgctcctggtccataacctgccccaaaatctcacaggatacatctggtataagggccagatccgcgacttgtatcattacatcacctcgtacgtggtcgacggccaaattattatctatggccccgcctattcagggagggagaccatctatagcaatgcatccctgttaatccaaaacgtcacacaagaagatgccggttcttataccttgcacataatcatggggggagacgagaacaggggggtgacgggccacttcacattcaccctgtatctcgaaacgcccaaaccgagcatctcttcaagcaagctgaatccccgagaggctatggaggctgtgtccctcacctgtgacccagagacccctgacgcttcctacctgtggtggatgaacggacagagccttcctatgagtcacaggttgcagttgtccgagacaaatagaactctcttcttgctaggcgtcactaaatacacagcaggcccctatgaatgcgaaatccgcaatcccgtaagtgcttcccgctccgaccctttcacactaaacctgctccccaagcttcctaaaccctatattaccattaataacctgaagccacgcgagaacaaagacgtgctcaactttacatgcgagccaaagagcgaaaattatacctacatttggtggctcaacggccagtccctacctgttagccccagagttaagaggcccatcgaaaatagaatcctcatcctgccaagcgtgaccagaaatgaaactgggccctaccagtgtgaaatccgggaccagtacggcggcattagatcctatccggtaacactcaacgtcctttacggcccagacctgcctagaatttaccctagcttcacctattatagatctggagaggtgctatatctgagctgcagcgccgatagtaatccccctgcccaatactcatggaccatcaatggcaagtttcagctgagtggccagaagctcttcatcccccagatcaccacaaaacactcggggctgtatgcatgtagtgtgcgaaactctgctacaggcaaggagagttcgaagagcatgacagtgaaagtctcagattggacactgccctag

SEQ ID NO: 200560 - DNA, 894 bp, Artificial Sequence
  Description of Artificial Sequence: Synthetic coding sequence
atgggcctgctgagcgcccccccctgcacccagcggatcacctggaagggcctgctactgaccgttgagacacccaagccatccatcagctctagcaagctgaatcctcgggaggccatggaggcagtttctctgacctgcgacccggaaacccccgacgcaagctatctgtggtggatgaacggccagtcgctgcccatgtctcacaggctgcagctgtcagaaaccaaccggacactcttcctacttggtgtcaccaaatacactgcgggaccttacgagtgtgaaatacgaaaccccgtgagcgcatcacggagcgacccgtttacgctgaacctcctgccaaagctcccgaagccttatattacgatcaacaaccttaagcctagggagaataaagacgtgctcaattttacctgtgaaccgaagagtgagaattatacgtacatctggtggttaaatgggcagtccctgcccgtaagccctagggttaagcgtccaatcgagaaccgaattctcatcttaccctctgtgacccgcaatgaaacaggtccttaccagtgcgaaataagagaccagtatgggggaattcgtagctaccccgtgacactgaatgtcctgtacggtccggatttgccccgcatctacccatcattcacctactatcgatctggagaggtcctttacttgtcctgctctgccgactccaacccccctgctcaatattcctggacaatcaacggcaagttccaattgtccgggcagaaactgttcataccacagattaccacaaagcacagcgggctttacgcctgcagcgtccgaaactctgccacaggaaaggagagcagtaagtctatgactgtgaaggtgagtgactggacattgccatag

SEQ ID NO: 200561 - DNA, 1209 bp, Artificial Sequence
  Description of Artificial Sequence: Synthetic coding sequence
atgggccccctgcccgcccccagctgcacccagcggatcacctggaaagggttgctgctcactgccagtcttctcaacttttggaacccgcccactacagccgaggtgaccatcgaggcccaacctcctaaggtgtccgaaggcaaggacgtgcttcttctcgtgcataacctcccccagaacttgcccgggtacttttggtacaagggcgagatgacagatctgtatcactatattattagttacatcgtcgacggaaaaatcataatttatggaccagcctatagcggcagggagacagtatatagcaacgcttcactgctcatccagaacgtgaccaggaaagatgctgggacgtacacactccatattataaagcggggggacgagacaagggaggagattcgtcattttacatttacactgtatctggagactcccaaaccctatatttccagctccaatttgaatcccagagaagccatggaagccgtccgcctgatctgtgatcccgagacattagacgctagctatctctggtggatgaatggacagtctcttccggtaacacaccgacttcagttgtccaaaaccaatcggacattatatctgtttggggtcactaaatacatcgcaggtccttatgagtgtgaaatacgtaatccagtatcagcctctaggtccgatccggtcacccttaacctcctgcacggacccgatctccccaggatatacccatcctttacttactataggtctggagaaaatctcgacctttcttgcttcaccgagtctaatcctccggcagagtacttttggactataaatgggaagttccagcagtcgggccagaagctattcataccccaaatcacccgtaatcacagcggcctctacgcgtgctcagttcacaatagtgccacagggaaagagataagcaagtctatgactgtcaaggttagcgggaaatggattcctgcgagcctggccgtggggttctatgttgagagtatttggttgagcgagaagtcccaggaaaatattttcatcccctctctgtgcccaatgggcacatctaagtctcagatcctgttacttaaccctcctaacctgtctctccagacgcttttcagtctgttcttctgcttccttatggccgacttagtttctgggctcaaaaaagtgggtcgggggctttaccagccctag

SEQ ID NO: 200562 - DNA, 1281 bp, Artificial Sequence
  Description of Artificial Sequence: Synthetic coding sequence
atgggccccctgcccgcccccagctgcacccagcggatcacctggaaaggactgcttctcacggcgtcactgcttaacttttggaaccccccaacaacagcagaggtgactattgaggcgcaacctccaaaagtgagcgaagggaaggacgtgttgctccttgttcacaatctaccacagaatttgcctgggtacttctggtacaaaggcgaaatgaccgatctgtaccattatattatttcgtatatcgttgacggtaagatcatcatctatggcccggcctactccggccgtgagacagtttacagtaacgcctcgctcctgatccagaatgtgacacggaaagatgctggtacttacacactccatattattaaacgcggtgatgaaacccgagaagagattagacactttacgtttacattgtacctagagaccccaaaaccgtacattagctcaagtaacctcaatcctcgggaggccatggaggctgtacgcctcatttgcgatccagaaaccctggacgcatcatatctctggtggatgaacgggcagagtttacctgtgacacatcgactgcagctatctaagacaaatcgtaccctatacctgttcggagtgacaaagtacatcgcaggtccgtacgagtgtgaaatccggaaccccgtttcggcttcaaggtcagacccggtgacacttaacctcctgcccaaactgcccattccctacattaccatcaataatctgaatcccagggaaaacaaagacgtgctcgcattcacctgcgagcccaaatccgagaattatacttacatttggtggctcaatggacagtcgctcccagtgtcaccaggcgtgaagcgtccaatcgagaatcgcatcctaatcctcccttccgtgacgagaaacgaaactgggccctatcaatgcgaaatccgtgatagatacggtggtctgcggagcaaccctgtgatccttaatgtactgtatgggcccgacctccctcgtatctacccatcttttacatactacagaagtggggagaatctcgacctgagctgcttcacagagtccaatcctccagccgagtacttttggacaatcaatggaaagttccaacaatccgggcaaaaactgttcatcccccagattactagaaatcattccggcctctatgcttgctccgtgcacaacagcgcgactggaaaagagatctctaagtctatgactgtaaaggtttccggaccatgccacggagatctgactgagtctcagtcttag

SEQ ID NO: 200563 - DNA, 723 bp, Artificial Sequence
  Description of Artificial Sequence: Synthetic coding sequence
atgggccccctgcccgcccccagctgcacccagcggatcacctggaagggcctattactgaccgctagccttctgaacttctggaatccaccaacaacagctgaggtgaccattgaagctcaaccacccaaagtgagcgagggaaaagacgtcctcctcctggtacacaatctgccacagaatctgcctggttatttttggtataaaggtgagatgaccgacctttatcattatatcataagttacatcgttgatggcaaaattattatctacggccccgcctattccggaagggagactgtgtactcgaacgcatcactacttatccagaatgttacgagaaaagacgctggcacgtacacactacatatcatcaagaggggggatgagacgcgagaagaaatccggcatttcacattcactctgtattatgggccagacctgcccaggatttatccctccttcacctactaccgttcaggggagaatttggacctcagctgttttacagaatcaaatcccccagctgagtatttttggacgatcaacggcaaattccagcagtctgggcagaagttattcatacctcagatcacaaggaaccactccggcctgtacgcttgcagcgtacacaattccgccaccgggaaagagatatcaaagagcatgacggtcaaagtctcaggtccatgccacggggatctaactgagtcacagtcgtag

SEQ ID NO: 200564 - DNA, 1164 bp, Artificial Sequence
  Description of Artificial Sequence: Synthetic coding sequence
atgggccccctgcccgcccccagctgcacccagcggatcacctggaagggcctcctgctcactgccagtttgctgaatttctggtataaaggggaaatgaccgatctctaccattacatcatttcctacatcgtggacgggaagatcatcatctacggacctgcatactccgggcgagaaactgtgtactccaacgcgtcactgctcatacaaaatgtgactaggaaggacgccggaacttataccttacacatcattaaacggggagatgagactagagaagaaattcggcactttacatttacgctgtacctggaaaccccgaagccttacatctcaagctcgaaccttaacccccgtgaagccatggaggccgtgcgcctcatctgtgaccctgagactctcgatgccagctacttgtggtggatgaatgggcaatccttgcctgttacccaccgtcttcagttatcaaaaaccaatcgtactctatacctcttcggagtgactaagtacattgcaggaccgtacgaatgcgaaataaggaacccggtgtcagctagtaggtctgaccctgtcacactaaatctgctgcccaagctgccaatcccctatattaccatcaataacttaaacccgagggagaacaaagacgtcctggcgttcacctgtgagccgaagtcggagaattatacctatatttggtggctgaatggacaaagtctccccgtgtccccaggggtcaagagaccaatagagaacagaattcttatactaccttccgtgacacgcaacgagactggaccctaccagtgcgaaattagggataggtatggcggcctccggtctaacccggtgattctcaacgtcctgtacgggccggatttgcctcggatatacccgtcattcacatactaccgcagtggggagaatctggatttgtcctgcttcacggaatccaatcctccagctgagtatttttggactattaatggcaagtttcagcaatctggacagaaacttttcatcccccagatcacaagaaatcacagtggtttgtacgcctgctccgtgcacaattcagccacaggcaaagaaatcagcaagagcatgaccgttaaagtcagcggaccctgccacggggacctgactgagtctcagtcctag

SEQ ID NO: 200565 - DNA, 1002 bp, Artificial Sequence
  Description of Artificial Sequence: Synthetic coding sequence
atgggccccctgcccgcccccagctgcacccagcggatcacctggaaggggctcctactgaccgcatctttgcttaacttttggaacccacctacgactgctgaagtcaccatcgaagcccagccccccaaagtgagcgaaggaaaagatgtactgttgctagttcacaaccttccccaaaacctgcccggatatttctggtacaagggtgagatgaccgatctgtaccactatatcatctcatacattgttgatggcaaaattatcatttacgggccggcatattccgggcgggagaccgtctactccaacgcctctttgctgattcagaacgtgacacggaaggatgctggtacgtatacgctgcacattatcaagcgaggcgacgagacccgcgaggagatccgccactttacctttactctgtactcaaagcttccaatcccgtatataaccataaacaacctgaaccccagggagaataaggatgtgttagctttcacgtgcgaacccaagagcgaaaattacacatacatttggtggcttaatggccagtcgttacctgtgagcccgggtgtcaagaggcctatcgaaaaccgtatcttgatacttccgagcgtgaccagaaacgagaccggaccttaccagtgcgagattcgggatcggtacggcggactgagatccaatccagtgatcctgaacgttttatatggacccgatctgccccggatttacccatccttcacgtattacaggtccggagagaatcttgatttgtcatgtttcacggagtctaatcctcctgccgaatatttctggacaatcaacggaaaattccagcaatctggccagaagctgttcataccacagatcacccgaaaccattcaggcctttatgcctgctccgtacacaattccgcgacagggaaggagatcagcaaaagtatgacggttaaagtgagtgggccttgccacggcgacttgacagaatcacagtcgtag

SEQ ID NO: 200566 - DNA, 1032 bp, Artificial Sequence
  Description of Artificial Sequence: Synthetic coding sequence
atgctgctgctgaagaagcacaccgaggacatcagcagcgtgtacgagatccgggaacggctgggctctggggctttctctgaggtggtacttgcccaggagcggggctctgcacatctggtggctttaaagtgtatccccaagaaagcactgagaggcaaagaggctcttgtcgagaacgaaatcgccgtcctcaggcgcatctctcatcccaatatcgtggccctagaggacgtgcacgaaagtcccagccacttatacttggccatggaactagtgactgggggcgagctctttgatcggataatggagagaggtagttatacagagaaggacgcgtctcatctcgtgggacaggtcttgggggctgtcagctacctgcacagtttggggatcgttcacagagacctgaagccagaaaatctcctgtacgcaacaccatttgaagattccaagataatggtgagtgacttcggattgtcgaagatccaagccggcaatatgttggggacagcctgcggcacacccggatatgtggcacccgagcttctggaacagaaaccttatggcaaggcagttgacgtgtgggcattaggcgtgataagttatattctgctatgcggatacccccccttttatgacgaaagcgatcctgaactcttttcacaaatcctacgcgccagctatgaatttgattcccccttttgggacgacattagcgagtctgcgaaagacttcatccgtcaccttttggagagagacccccaaaagaggtttacttgtcagcaggcgcttaggcacctttggattagtggagacaccgccttcgaccgcgatatcctcggctctgtgagtgaacagatcaggaagaactttgcgaggacccactggaagcgtgccttcaacgctacaagtttcctccgccatatcaggaagttgggccagatccccgaaggggaaggcgccagcgagcagggcatggcacgtcacagccacagcggtttgagagcaggacagcctccaaagtggtag

SEQ ID NO: 200567 - DNA, 1101 bp, Artificial Sequence
  Description of Artificial Sequence: Synthetic coding sequence
atgctgctgctgaagaagcacaccgaggacatcagcagcgtgtacgaaatcagagaacgattaggatctggagcattctcggaggtggtactcgctcaggagcgcgggtctgcacatctggtcgccctgaagtgcattcctaagaaggctctcagagggaaggaagcgctggtcgaaaatgagatcgccgtcttgagaagaattagtcatcccaatatagtggccctggaggatgtgcatgaatcccccagtcatctgtatctggccatggagttagtgactggcggagagctgtttgacaggattatggaacgggggagttacacagaaaaagatgctagtcatctggtgggccaggttctcggagctgttagctatcttcatagtttgggcatcgtgcaccgagacctgaagcccgagaatctgctgtatgcaacccccttcgaggattccaaaatcatggtaagcgactttggtttgagcaaaattcaggccggcaatatgctgggtactgcttgtgggacgcctggttatgccgaacccgtcaccctctccggaatggccgcatgcgtacctgtgcgcgcttcagtgtgtctctggcctccagcaccagagctgcttgaacagaagccatacgggaaggccgtcgacgtgtgggccctcggcgttattagctatatcctcctgtgcggctaccctccgttttatgacgagagtgatcccgagctctttagccagatactgagagcctcttatgagtttgattcccctttctgggatgacataagcgagtcagccaaggattttatccgacatctactggagcgcgacccccagaaacggttcacttgccaacaggccctccgccatctgtggattagcggagacactgcgtttgaccgtgacattttaggtagcgtctcggagcagatcaggaaaaacttcgcgaggacccactggaagagagcattcaatgctacttcctttctgaggcatattcggaagctgggtcagataccagagggcgaaggcgcaagcgagcaggggatggcaaggcactcccactctggcttgcgggccgggcagcctccaaagtggtag

SEQ ID NO: 200568 - DNA, 1083 bp, Artificial Sequence
  Description of Artificial Sequence: Synthetic coding sequence
atgtggcggcgggtgtgcggcggcctggccggccggcggcccagcggcgatatgctgctcctcaagaagcataccgaagatataagcagtgtgtacgaaatccgcgagaggctgggcagtggcgctttcagcgaggtggtgctggcacaggagcgtgggagcgctcatttagttgcactcaagtgcatccccaagaaagctctgcgcggcaaggaagcgctggtggagaacgagattgccgtacttcgccgcatttcccatcctaacatcgtcgctctagaggacgtgcacgagtcacctagtcatctttacttggctatggagctggttaccggtggagaacttttcgataggatcatggaacgcggctcttataccgaaaaggacgccagtcacctggtgggccaagtgttgggagccgtgtcctatctacattcacttggaattgtgcatcgcgacttaaagccagagaatcttttatacgccaccccttttgaagactccaaaataatggtgagtgatttcggactttctaaaatacaggcgggtaatatgctgggtaccgcgtgtggaactcccggctatgtcgcacccgaactactggaacagaagccatatgggaaggctgtggacgtttgggcactgggggtcatcagctacatcctgctctgtgggtatcccccattttatgacgaatcggacccagagcttttctcccaaattctccgcgcctcgtacgagtttgatagccctttctgggacgacatcagcgaatccgcgaaagactttattagacatcttctcgagcgagacccgcagaagcgatttacatgccaacaggcactgcgccatctgtggatctccggtgacacagcattcgatagggacatccttgggtcagtctctgagcagattcgtaagaactttgcccgtacccattggaagcgcgcatttaacgccacctccttcctaaggcatatcagaaaactgggccagattcctgagggggagggggcatccgaacagggcatggctagacacagtcattctggactgcgcgccggccagccaccaaagtggtag

SEQ ID NO: 200569 - DNA, 1032 bp, Artificial Sequence
  Description of Artificial Sequence: Synthetic coding sequence
atgctgctgctgaagaagcacaccgaggacatcagcagcgtgtacgaaatcagagagagactgggcagtggggccttttcagaagttgtgctcgcccaggaacgtggctctgcccatctggtggcgcttaagtgcatcccaaagaaggcccttaggggcaaagaggccctggttgaaaacgagattgcagtccttaggcgcatttctcatcctaacatagtggctcttgaggacgtgcacgaatccccaagccacctctacctagctatggagctggttaccggtggtgaactgttcgataggattatggaaagggggtcctatacggagaaggacgcttcccacctggttggccaggtcttgggggctgtatcataccttcactctctgggcatcgttcaccgagacttgaagcccgagaacctgctgtatgcaactcccttcgaagacagcaagatcatggtgagcgactttgggctatcaaaaattcaggccggaaacatgttgggaactgcctgcggaacccctggctacgtggcccccgagctgttggagcagaagccctacggtaaggctgtcgatgtgtgggccctgggcgtgatctcctatatactgctgtgcggctacccccccttctatgatgagtccgacccagaactcttctctcaaatactgcgggcaagttacgaattcgattctcccttctgggacgacatttccgagtctgctaaagacttcattcggcatttactggagagggatcctcagaagcggttcacctgtcagcaagccctgcggcacctttggatctcaggggatactgctttcgacagggacattctggggtctgtatccgagcagattcgcaagaacttcgcacggacccactggaagcgggccttcaacgcaaccagcttcttgcgacacatccggaagctgggccagataccggaaggggagggagcaagcgagcagggaatggctcgacattcccacagtggcctccgggctggtcagcctcctaagtggtag

SEQ ID NO: 200570 - DNA, 1101 bp, Artificial Sequence
  Description of Artificial Sequence: Synthetic coding sequence
atgctgctgctgaagaagcacaccgaggacatcagcagcgtgtacgaaattcgggagagactgggatcgggcgcatttagcgaggtggttctggcacaagagcgcggaagtgcacacctggtggcacttaagtgcattcctaaaaaggcactaagggggaaggaggcactggtcgagaatgagattgccgtgctgcgaagaatatcgcacccaaacatcgtcgccttggaagacgttcatgagtctccatcccatctgtacctcgctatggagttagttacgggcggcgaactgttcgaccggatcatggagagagggagttacaccgagaaagatgcctcccacctggttggccaggtgcttggcgcagtgtcctatcttcacagcctggggatcgtgcacagggacctgaaacccgagaatcttctgtatgcgacgccatttgaagactctaaaatcatggttagcgactttggcctatcgaagattcaggcgggtaatatgctcggcactgcctgtggcactcccgggtacgctgagcctgtgacattatccgggatggccgcctgcgtgcccgtgcgggccagcgtctgcctatggccacctgcccctgagctgctggaacaaaaaccctacggtaaggctgtagacgtgtgggcgctcggcgttataagttatattctgctttgtggataccctcctttctatgacgaaagcgatcctgagctgttttctcaaatcttgcgagcgagttatgagtttgacagccccttttgggacgatatctccgagtccgctaaagatttcatcaggcacctgcttgagcgagatccacagaagcgattcacgtgccagcaagctcttcggcacctgtggattagcggagataccgcttttgaccgtgatatattggggtctgtgtctgaacaaattcgaaaaaacttcgcccgcacacactggaagcgggccttcaacgccacaagctttttacgtcatattcgtaaactgggacagattccagagggcgaaggagcctcagaacagggcatggcacgacactcccactccggcctcagggcaggccagccacccaagtggtag

SEQ ID NO: 200571 - DNA, 132 bp, Artificial Sequence
  Description of Artificial Sequence: Synthetic coding sequence
atgctgctgctgaagaagcacaccgaggacatcagcagcgtgtacgagattcgcgaaaggttgggctcaggggccttcagcgaggtcgtgctcgcgcaggaaagaggttctgcccacctggtggcgctctag

SEQ ID NO: 200572 - DNA, 675 bp, Artificial Sequence
  Description of Artificial Sequence: Synthetic coding sequence
atgctgctgctgaagaagcacaccgaggacatcagcagcgtgtacgagattcgcgaacggctgggcagcggagcctttagtgaggtggtactggcgcaggagagggggtccgcgcatctggtggcgctcaaatgtattccaaagaaggctctccgggggaaggaagctctggtagagaatgagattgcagtgttgcggcggatctctcatccgaacattgtggcattggaagacgtgcacgagagtccgagccatttatacctcgcgatggaactggtaactggcggtgaactgttcgatcgtattatggaaaggggaagctacacagaaaaggatgcctcacacctcgttggccaggtacttggtgccgtctcataccttcactcacttggtatcgttcatcgagacctcaagcctgagaatctgttatatgccacccccttcgaagatagcaagattatggtgagtgattttggactgtctaagatacaggcaggtaatatgctaggaactgcttgtggtaccccaggatacgtggcacctgagctcctcgaacaaaaaccctacggcaaagccgtcgacgtttgggccctgggagttatcagctacattctgctgtgtggctacccgcctttctatgacgaatctgaccctgagctgttttcccaaatttag

SEQ ID NO: 200573 - DNA, 132 bp, Artificial Sequence
  Description of Artificial Sequence: Synthetic coding sequence
atgctgctgctgaagaagcacaccgaggacatcagcagcgtgtacgaaatacgagagcggctcggaagcggtgccttttccgaggtggtgctcgcacaagagcgtggaagtgcgcatctggttgccctatag

SEQ ID NO: 200574 - DNA, 132 bp, Artificial Sequence
  Description of Artificial Sequence: Synthetic coding sequence
atgctgctgctgaagaagcacaccgaggacatcagcagcgtgtacgaaattcgggaacgcctcggctctggggcattcagtgaagtggtgctggcccaggagagagggtctgcacacctggtcgccctgtag

SEQ ID NO: 200575 - DNA, 261 bp, Artificial Sequence
  Description of Artificial Sequence: Synthetic coding sequence
atgctgctgctgaagaagcacaccgaggacatcagcagcgtgtacgagatcagggagaggctaggaagcggagctttctccgaagtagtgctggcccaagagagaggttcagctcatctggtggccttaaaatgtatccccaagaaggcacttaggggcaaagaagccctggtcgaaaatgagatcgcagtcttgagacgaatatcacatccaaatattgtggctctggaagacgtgcacgaatctccctctcatctctag

SEQ ID NO: 200576 - DNA, 246 bp, Artificial Sequence
  Description of Artificial Sequence: Synthetic coding sequence
tgaatcagcggcgacaccgccttcgaccgggacatcctgggcagcgttagtgaacagatcagaaaaaacttcgccagaactcactggaaaagggccttcaatgcaacctctttcctgcggcacatccgcaagttaggccagattccagagggcgagggcgcttctgagcaaggtatggcaagacactcacattctggcggcccacaaggtctgtcctttctgcatggttgttgcgttctgcgctag

SEQ ID NO: 200577 - DNA, 681 bp, Artificial Sequence
  Description of Artificial Sequence: Synthetic coding sequence
atgctgctgctgaagaagcacaccgaggacatcagcagcgtgtacgagatccgcgagcgactaggatcgggtgctttttctgaggtcgtgttggcccaggagcgcggctcagctcatctcgtcgccctcaaatgtattcccaagaaagccctacgcggaaaagaggccctagtcgagaacgagattgccgtactgcgcaggatcagccaccccaacattgtggcattagaggacgtccacgaaagcccctcccacctgtatctggctatggagctggttactggcggcgaactcttcgatcggataatggaacgcggctcctataccgagaaagatgcctctcacctcgttggccaggtcctgggcgccgtgagttaccttcatagcctgggaatcgtccaccgggatctcaaacctgaaaacctgctgtacgcgactcccttcgaggactctaagatcatggtgagcgattttggcctgagcaagatccaggcgggaaatatgcttggcaccgcctgtggcacaccaggctatgttgcccctgaactgcttgagcaaaaaccatacggaaaggctgtagacgtttgggccctgggggtaatcagttatatactactttgtggctaccctcccttctacgatgaaagcgaccctgaattgttttcccagatcctgcggtag

SEQ ID NO: 200578 - DNA, 1281 bp, Artificial Sequence
  Description of Artificial Sequence: Synthetic coding sequence
atggaggccgccttcggccaggtggccggcagcgcctgcccccggcgtggtggtgaaggtcgcgactggaaggccgaatccctggctgatctgtggccaaaatcctcaccaggcgactctcacaggtggtgcaaaggacctggtgccgggccagcaggtcctcagctgagagaggccgcacgtgcgtcttctggccttggtgggggaggaaggcacccaagccgcatcccagcgattgccctgcaggacatgctccttctcaagaagcacacggaagatatcagcagcgtttatgagatccgggagcggctcggttctggagcattttcagaagtggtgctggctcaggaaaggggaagtgctcaccttgtggcgctcaagtgtatacctaaaaaggccctccgggggaaggaagccctcgtcgagaacgaaatagcagttctgagaagaattagccaccctaacattgtggccttggaagatgttcacgaaagtccgtctcacctttacctcgccatggagcttgtgacggggggtgagctcttcgataggattatggaaagaggctcctatacggaaaaggacgcaagccatctcgtcggtcaggtcctgggcgcagtatcgtacctacattctcttggaatagtccatcgtgatctgaagcccgaaaatctcctgtatgcaacgccttttgaggatagtaaaataatggtgtccgactttggcttgagcaaaatccaggctgggaatatgctcggcacggcctgtggcacccccgggtatgtggcccccgagctactggagcagaagccatacggaaaggcagtcgatgtgtgggcattgggggtaatttcttacattcttctctgtggatacccacccttctacgacgagagcgatccagaactgttttctcagatactgcgcgcctcgtatgagtttgacagtcccttctgggatgatatcagcgagtccgccaaggatttcatcaggcatttactcgaaagggaccctcaaaagcggtttacttgtcagcaggccttgagacatctatggatctctggcgacaccgcatttgatcgcgacatactgggatccgtttcggaacagattcgaaaaaactttgccaggacacattggaaacgcgctttcaacgccacctccttcctcagacacatccgtaagctcggccagatccccgagggggagggggcttccgagcaggggatggctcggcattcacactcaggcctgcgggccggacaacccccaaagtggtag

SEQ ID NO: 200579 - DNA, 132 bp, Artificial Sequence
  Description of Artificial Sequence: Synthetic coding sequence
atgctgctgctgaagaagcacaccgaggacatcagcagcgtgtacgagatacgcgaaaggttgggcagcggcgcctttagcgaggttgtcctcgcgcaagagagaggaagcgctcacctagttgccttgtag

SEQ ID NO: 200580 - DNA, 4884 bp, Artificial Sequence
  Description of Artificial Sequence: Synthetic coding sequence
atgcggctgtggagctgggtgctgcacctgggcctgctgagcgccgccctgggttgcgggttggcagagaggccccggcgagcacggcgcgatcctagggccgggagacccccaagaccggctgccggaccagcgacctgtgccaccagggctgcacggggaagacgcgcttcgcctcccccccccccccctccaggcggggcctgggaagcagtccgagtcccaaggagaagacaacagcgggaggccaggggagcaaccgaagagccttccccgccttcccgcgccttgtactttagtggcagaggtgaacagctgaggctgcgggccgatctggagctacctcgcgatgccttcacactacaggtgtggctgcgggcggaggggggacaaagatcaccggctgtgataacaggattgtacgacaagtgctcttatatctcaagagatcgtggctgggtggtggggattcatacgattagcgatcaagacaacaaggatcccaggtatttttttagccttaaaactgaccgtgcacgtcaggttacgacgatcaacgctcatagatcctacctgccaggccaatgggtgtatctcgctgccacctatgacggccagtttatgaaactgtacgtgaatggagcccaggtagctacgtccggggagcaagttggcggaattttctcccctctaacccagaaatgtaaggtgctgatgttaggaggttccgcactcaatcacaactacaggggttatattgagcatttcagtctatggaaggtggctcgtacccagcgcgagattctctccgacatggaaacccatggcgctcacacggctctcccccaactgctcctgcaggagaattgggacaacgtgaagcatgcatggtcccctatgaaggacggatcatctcctaaggtggagttttccaatgcccatggtttcctgttggacacttcactggagcctccactttgtggccagacgctctgtgacaataccgaagttatcgccagttacaatcagctgagctcttttagacaacctaaagtggtgcgctatagagtcgtgaacctctatgaagatgaccacaagaacccgaccgtcacgagggagcaagtggattttcaacatcaccagttagcagaagcattcaaacagtataatatctcatgggaattggacgtgcttgaggtctctaactcttccctgcggcgacggttgatcctggccaactgtgacatttcaaagataggagatgagaactgcgacccggaatgtaaccacactctcaccggccacgatggaggggattgccgacacctgcggcaccctgctttcgtcaagaaacagcataacggagtgtgtgacatggattgtaattacgagcgtttcaatttcgacggcggcgaatgctgcgacccagagattacaaacgtcacccagacatgcttcgatccggactcaccacatagggcttatcttgacgtgaacgagctcaagaacatcttgaagctcgatggctccacccacttgaacatcttcttcgccaagtcttccgaagaagagctcgctggtgtggcgacctggccatgggacaaggaggcactcatgcacctgggcggaatcgtgctgaacccctccttttacggcatgccgggacacacccataccatgattcatgaaataggccattcactggggctctaccatgtttttagagggatcagcgaaattcaatcctgcagcgatccgtgtatggaaaccgagcctagttttgagaccggtgatctttgcaatgatactaatcctgctccgaaacacaagtcttgcggagatcccggccccgggaatgatacctgtggctttcactcatttttcaataccccttataacaatttcatgtcttatgcggatgatgactgtaccgattcctttacccccaatcaggtcgcccggatgcactgttatcttgacctagtctaccaggggtggcagccgtctcgcaagccggcccccgtggctctggccccacaggtcctgggccacacaacagactcagtcactctcgaatggttcccaccgatcgacggacacttttttgaacgggaattggggtcagcctgtcatctgtgtttggaaggccggattctggtccagtatgcctctaatgcttcatcccccatgccttgcagcccttccgggcactggtctccgcgcgaggccgaaggacaccctgacgtggagcaaccatgcaaatcctccgttcggacctggagccccaacagcgctgtcaacccccacacggtcccccccgcttgccccgagccacaggggtgctatctggaactcgagttcctgtatccactggttcccgaaagcctcacgatttgggtgacttttgtgagtacagattgggatagctctggggcagtgaatgatatcaagctgctagcagtaagcggtaagaacatctccttaggtccccagaacgtgttttgcgacgtgccattaaccattaggctctgggacgtgggggaggaggtctatggcatccagatctacactctcgacgaacatctggagattgacgcagccatgctgacatccaccgccgatacccctctatgcttgcagtgtaagccccttaagtacaaggtggtcagggaccctcctttacagatggacgtcgcttccattttacacttgaatcgcaagttcgtggacatggacctgaatttgggctctgtctatcagtattgggtgattaccatcagcggaactgaggaatctgagccaagccccgccgtcacatatatccacgggagcggctactgtggagatggtattattcagaaggatcaaggagaacagtgtgacgacatgaacaaaatcaatggcgacggctgcagtctcttctgtcgccaagaggtcagttttaactgtatcgatgaaccatctcgctgttacttccacgatggcgacggcgtatgcgaagagttcgaacagaagacaagtataaaagactgtggggtctacacaccccagggatttctggatcagtgggcatcaaatgcgagcgtaagtcaccaagatcagcagtgtccaggatgggtaattatcgggcaacccgccgcatcccaggtttgccgcacaaaagtgattgatctgtctgagggcatttcccagcacgcatggtatccctgcacgatttcttacccctactctcagctggctcagactacgttttggctgagggcctattttagtcagcccatggtggcagcagcggttatcgttcatctggtgaccgacgggacatactacggcgaccaaaaacaggaaaccataagtgtgcagttgcttgacaccaaagaccaatcccatgatctgggtctgcacgtattgtcctgtagaaacaaccctttgatcatccctgtggtgcacgacctgtctcagcccttctatcattcccaagccgtgagagttagcttcagctcgcctcttgtggcaatctcaggcgtcgccctgcggagtttcgataatttcgatcctgtgacacttagcagttgccagcggggcgagacgtattcacctgctgagcagagttgtgtccatttcgcatgcgaaaaaacagattgtcccgaactggcagtggagaacgcctcgcttaattgcagcagctcggacaggtaccacggagctcagtgtactgtcagctgcagaactgggtacgttctgcaaatacgtagggacgacgaacttattaaatcacagaccggcccctccgtaaccgtcacatgcacggaagggaagtggaataaacaggtggcctgcgagcctgttgattgcagcatccccgaccaccaccaggtgtatgctgctagtttctcctgtccagaagggaccacatttggttctcaatgctcctttcagtgccggcatcccgctcagctgaagggtaacaacagcctgctgacttgcatggaggatgggctgtggagttttcctgaagctctttgcgagctcatgtgtctggcacctcccccagtgcccaacgcagaccttcagacagcccggtgccgcgagaacaaacataaagtgggcagtttttgcaagtataaatgcaagccagggtaccatgtacctggctcctcgaggaagagtaaaaaacgagcctttaaaacccagtgcactcaggacgggtcatggcaggaaggcgcctgtgtacccgtcacctgcgaccctccgcccccaaaatttcacggcctgtatcagtgcacaaacggattccaatttaattccgagtgccgaatcaaatgtgaagacagcgatgcctctcagggcctcggatccaatgtgattcattgcagaaaagatgggacctggaacggatccttccatgtatgccaggagatgcaaggccaatgttctgtgccaaacgaactcaactcaaacctgaagcttcagtgtcctgacggatatgccatcgggtctgagtgtgcaacgagttgcctggaccacaactctgagtctatcatcttgccaatgaacgtaacggtgagagacattcctcactggttgaatccaacaagagtcgaaagagtggtgtgtacagctggactgaaatggtatccacatccagcactgatccattgtgtgaaaggatgtgaaccattcatgggtgataactactgcgatgctatcaataatcgggccttttgtaactatgacggcggtgattgttgtacttctaccgtaaaaacgaagaaagtcacacctttccctatgagctgcgacttgcaaggtgactgtgcctgccgggatccccaggcccaggaacattctcgcaaggacctgcgaggctacagtcacggatag

SEQ ID NO: 200581 - DNA, 1701 bp, Artificial Sequence
  Description of Artificial Sequence: Synthetic coding sequence
atggactgcaactacgagcggttcaacttcgacggcggcgagtgctgcgaccctgaaataactaatgtgacccagacttgcttcgatcctgactcaccgcaccgggcttacctcgatgtaaatgagctgaagaacatccttaaattggacgggtcgacccacctgaacattttctttgccaaatcctccgaggaggagctcgccggggtggccacttggccatgggataaggaggctctgatgcatctcgatgatgattgcacagattcgttcacccccaaccaggtagcccggatgcattgttacttggatctagtgtatcagggctggcagccctctcgcaagcccgcccctgtggccctcgccccacaggtgctgggacacacaaccgactctgtaaccctggagtggtttccgcctatagatggacactttttcgagagagagctcggctcagcatgtcatctgtgcttggagggtcgaattcttgtccagtacgccagcaacgcttcatccccaatgccctgctctcctagcggccattggagcccacgcgaggctgaaggacatcccgacgtagagcaaccttgtaagtccagtgtgcgaacatggagccccaatagcgccgtgaacccccacactgtcccccctgcctgccccgaaccacaagggtgctacctggaattagaattcttataccccctggtgcctgaatccctgactatttgggtaactttcgtgtccacagactgggactcaagcggggccgtgaacgatatcaagttactggccgttagcggcaaaaacatcagcctgggaccacagaacgttttttgtgacgtgcctctgaccatccgcctatgggacgttggagaggaggtctatgggatccagatttatactctggacgagcacttagaaatcgatgctgctatgctgacgtccactgctgacactcccctatgcctgcaatgcaagcctcttaagtataaggtagtacgcgacccccctctgcaaatggacgtggcttcaattctgcacctcaacaggaaatttgtggacatggacctcaatctagggagcgtgtatcagtactgggtcattacaatcagtggcacggaggagtccgagccctctccggccgttacctacattcatggctctggttattgtggcgacgggataatacaaaaggaccagggagagcagtgcgatgacatgaacaagatcaacggcgatggttgttcactcttttgcagacaggaggtgagctttaattgcatcgatgagccctcacgatgttacttccacgatggggatggcgtgtgcgaggagtttgagcagaaaacttcaatcaaggattgcggtgtttataccccacagggctttctcgatcaatgggcttccaatgcctcggtctctcaccaggaccaacaatgccccggctgggtcatcataggccagcccgcggcttcccaggtttgcaggacaaaggtcatcgacctgagtgaagggatcagtgcctgtctggtgcccctgcaccatcagctgcctatcttccccgccggatctgaccacttcctggctcccggcgtgtttttcagcactaacgggtgcaggtcctgccactgtccccctggcgacggctgggacatactctggggtcccaaagccggagatcaccagcgcgcagccgcttag

SEQ ID NO: 200582 - DNA, 1998 bp, Artificial Sequence
  Description of Artificial Sequence: Synthetic coding sequence
atgaacaagatcaacggcgacggctgcagcctgttctgccggcaggaggtgtcctttaactgtattgacgaaccatctcgttgttattttcacgacggggatggcgtgtgcgaagaattcgagcagaaaacttcgattaaagactgcggagtctacactccccaaggtttcctggatcagtgggcctccaatgcatccgtatcacaccaagatcaacagtgcccgggctgggtgatcatcggacagcctgctgccagtcaggtatgcaggacaaaggtgatcgatctgtcggaaggaatttcacagcatgcttggtatccttgtacaattagctacccatacagccagctggcgcaaaccaccttttggcttagggcttacttttctcaacctatggtggcagcagccgtgatcgtgcacctcgtgacagatggtacctattacggcgatcagaagcaagagaccatcagcgtgcaactcttggataccaaagaccagtcgcacgaccttggcctccatgttttgtcatgtcgcaacaatcccttgattattcctgttgttcacgatctctcccagcctttttatcattctcaggctgttcgggttagcttcagctcccccctggtcgcgatttctggcgtcgccctccgctcttttgataactttgaccctgtgaccttgtcatcctgccagcgcggagagacttattcacctgctgaacagagctgtgtgcactttgcttgtgaaaagaccgactgccctgagctcgccgttgaaaatgcttcattgaactgttcgagcagcgaccgttaccatggggctcagtgtaccgtatcatgtcggacaggatatgtcctccagatcaggagggatgacgagctgattaaatctcagaccggcccctcagtcactgtgacatgcactgaagggaaatggaataagcaagttgcctgcgaacccgtagattgctccataccagaccaccatcaggtatacgccgcatcttttagttgtccagaaggcaccacgtttgggtcccaatgcagcttccagtgtcgacaccccgcccagctcaagggaaacaacagcctcctgacgtgcatggaagatggcttatggtctttccccgaagcactgtgcgaacttatgtgtctggcccctccgcctgtgcccaacgccgatctgcaaacagccagatgccgagagaacaagcacaaagtcggctcgttttgcaagtacaaatgcaagccaggataccatgttcccggatcttcccgaaaatctaagaagcgggctttcaaaacccagtgtacgcaggatgggtcatggcaggagggtgcctgtgtccctgttacatgcgatccacctcccccgaaattccatgggctttaccagtgtacgaacgggttccagttcaatagtgaatgtcggatcaagtgtgaggattctgatgcttctcagggcctcgggtctaacgtcatccattgtcgcaaggacgggacctggaacggatcctttcacgtttgccaagaaatgcaggggcagtgtagcgtgccaaacgaactgaactccaacctgaagctgcaatgtcccgacggctatgcaattgggagcgaatgtgccacgagctgcctggatcataactccgaatccattattctgccaatgaacgtgactgtgcgtgacataccccactggctgaatcctactcgtgtggagagagtcgtgtgcaccgctgggctaaaatggtatccacaccccgccctgattcattgtgtgaagggctgcgaacccttcatgggcgacaactactgcgatgccattaataaccgtgccttctgcaattatgacggcggggattgctgcacaagcacagtgaaaactaagaaagttactcctttcccaatgagctgcgaccttcagggggactgcgcatgccgggatccccaggcccaggaacattctagaaaagatttaagagggtactcccacggctag

SEQ ID NO: 200583 - DNA, 4449 bp, Artificial Sequence
  Description of Artificial Sequence: Synthetic coding sequence
atgcggaaggaccggctgctgcacctgtgcctggtgctgctgctgatcttgctgtccgctagcgatagtaattcaacagaaccccagtacatggtgctggttcctagcctgctgcacaccgaagcgccaaagaaaggctgtgtactactatctcatctgaacgaaacagtcactgtttctgcatcactcgagtccgggagggagaataggtccctgttcaccgaccttgtcgctgagaaagacttatttcactgcgtgtcgttcacactgccaagaatttctgcatcctctgaggtggcctttctttctattcagatcaaaggcccaacacaggacttcagaaagagaaacaccgtgctggtgctgaatactcaaagcctcgtcttcgtgcagactgataaacccatgtacaagccagggcagactgtacgatttcgtgtggtaagtgtcgacgagaacttccggcccaggaacgaactgattcccctaatctatctggaaaaccctcgcagaaaccgcattgctcagtggcaaagcctcaaactggaggcgggcataaatcaactgagtttccccctcagcagcgaaccaatccagggctcataccgcgtggtggtgcagactgagagtgggggcaggatccaacacccatttactgtggaggaattcgtcctgccaaaatttgaggtcaaggttcaggttcccaagataatctccattatggatgaaaaggtcaatatcaccgtgtgtggtgaatatacatacggaaagcctgtgcccggactggctacagtatctctgtgcaggaaactgtccagagtcctgaactgtgacaaacaggaggtgtgtgaggaattctctcaacagttgaactccaacggttgtatcacacagcaggttcataccaagatgctgcaaattacaaataccgggtttgagatgaagcttcgagtcgaagccaggatcagggaagaaggcacggatctggaggtgactgctaaccgcatttccgagattaccaatatcgtctctaagctgaagtttgtgaaagtggattctcacttccggcagggcatccccttcttcgctcaggtgctgcttgtggacggaaaaggcgtccctatccctaacaagctgttcttcatttccgtgaacgatgcaaattactatagtaacgcaaccactaacgagcagggattggcccagttcagcatcaatacaacttcaatcagtgtgaataagctctttgtgcgcgtatttaccgtacaccctaacctatgttttcactactcttgggtcgcggaagatcaccagggagctcagcacaccgccaaccgagtcttttccttgtctggaagttatatccacctggaaccagtggcaggaactctgccctgcggtcatacagagacaataactgcacattatacactcaatagacaggccatgggagagctgagcgagctgtcatttcactacctgatcatggctaaaggcgtgatcgtacgcagcggcacccataccttgcctgttgaatcaggagatatgaagggtagttttgcactctccttcccagtggagagcgacgtcgctccgattgcaagaatgtttatcttcgcaattctcccagacggagaggttgtgggggactctgagaaatttgaaatagagaattgtctggccaacaaggtggacctctctttctcacccgcccagtcaccgcctgcaagccatgcccacctgcaggtggccgctgcgccacagagtctgtgcgcattgcgcgccgtcgatcagagcgtactgcttatgaagcccgaagctgaactgtctgtaagctccgtttataacctcctgacagtgaaagatcttacaaacttcccagacaatgttgaccagcaggaagaggagcagggtcactgccccagacccttctttatccacaacggagccatatatgtgccactgtcaagcaacgaggcagatatttatagctttctgaaggggatgggcctaaaagtgttcacaaattcaaaaatccgtaaacctaaatcttgtagcgtcatccccagcgtgtcagcaggcgccgttggtcaggggtactatggcgctggcctcggtgtggtagagaggccttacgtacctcagctcggtacgtacaatgtgattcctctcaacaatgaacagtcatctggtccagtccccgagaccgttcgatcctattttcccgagacatggatatgggagctcgttgccgtgaactcctctggcgttgccgaagttggggttaccgttccagacacaattactgaatggaaggccggagctttctgtcttagtgaagacgcagggctgggcataagcagtaccgccagtctgcgggccttccagccttttttcgtagagctgaccatgccttacagtgtcatacggggcgaggtctttactcttaaggctacagtgctcaattacctgccaaagtgcataagagtcagtgtgcagctgaaggccagccccgcctttctcgcctcccagaacacgaagggtgaggaatcttactgcatttgcggcaacgagcggcagaccctttcatggacggtcacccctaaaacactcggaaacgttaacttttccgtttccgccgaggctatgcagtccctggagctgtgtggcaacgaagtggttgaggtaccagaaattaagcgtaaggataccgtcattaagaccctgctggtcgaagccgaggggattgaacaagaaaagaccttcagttctatgacctgcgccagcggagccaatgtgagcgaacaactgagtctgaagctgccatctaacgtggtcaaggaaagtgccagagcctccttctccgtgctcggcgatatcctggggagtgctatgcaaaatattcagaacctgctgcaaatgccttatggttgtggggagcagaacatggttctgtttgcgccaaacatttatgtgctgaactacctgaacgagacccagcagctgacgcaggagatcaaggcaaaggcagtgggatacctcatcaccgggtaccaacggcagcttaattataaacaccaggatgggtcctacagcacattcggagagcgctacggcaggaatcaaggtaacacctggctaacagcttttgtactcaaaacctttgcccaggcgcggtcatacatttttatagacgaggctcacattacacagtccctgacctggctctcacagatgcagaaagataacggatgctttaggagcagcggaagtctcctcaacaacgcgatcaaaggcggcgtggaggatgaagctactctttctgcttacgtcacgatcgcactactggagatccccctcccagtcacaaatcctatcgtccgcaatgcccttttttgtctggagagcgcttggaatgtggctaaggaagggactcacggcagtcatgtctataccaaggcgttgctggcttatgcctttagtctgctgggcaagcagaaccagaaccgcgagattctcaactctcttgataaggaagcggtgaaagaggacaacttggtgcactgggaacgaccccagagacctaaagcacctgtgggtcatctttaccagactcaagcaccgtccgctgaggtggagatgacttcttacgtacttctggcttatctcactgcccaaccagctccaacctctggcgaccttacctcagccaccaacattgtaaagtggatcatgaagcaacagaatgcccagggcgggttctctagcacacaggacacagtcgtcgccttgcatgctttatcacgctacggggcagcaaccttcacacgcacagaaaagaccgcccaggttaccgtgcaagacagccagacattcagtacaaatttccaggtcgataataacaatcttttgctgctacagcagattagcctgcctgagctgccaggagaatacgtaatcacggtcaccggtgagagatgtgtctacctccagacgagtatgaagtacaacatcttacctgaaaaggaggacagtcccttcgcgctaaaggtccagacagtacctcagacctgcgatggacacaaagcacacacgagtttccagattagcttaacaatctcctataccggtaaccgccccgcatcaaatatggtcatcgtcgatgtgaagatggtcagcgggttcattcccctgaagcctaccgtgaagatgctggagagaagtagctctgtaagcagaacggaggtaagtaataatcatgtgttaatctacgtagaacaggttacaaaccagacactgagcttctcttttatggtgctacaggatatccctgtcggagacctcaaacctgccatagtgaaggtgtatgattactacgagaccgatgagtcagtggtggcagagtacatagccccttgttccaccgacactgagcacgggaatgtgtag

SEQ ID NO: 200584 - DNA, 3807 bp, Artificial Sequence
  Description of Artificial Sequence: Synthetic coding sequence
atgagcgagagctaccggcggaccaccttccccgtgcggttccgggtcgtgtctgtggacgaaaacttccggcccaggaacgagctgattcctctaatctacttggaaaaccccaggcgaaaccggattgcacaatggcagagcttaaagctggaagctggaattaatcagttatcattcccgttgtcatcggagcccatacagggaagttaccgggtagtggtccagaccgaaagtgggggccgcatccagcacccattcacggttgaagagtttgtcctgcctaaattcgaggtgaaagtccaggtccctaagatcatttctattatggacgagaaagtcaacattaccgtttgtggagaatacacctatggcaagcccgttccagggctggcaacagtaagcctttgccgaaagttgtcccgggtgctcaactgcgacaaacaggaagtttgcgaggagtttagccagcagctcaactctaacgggtgcataacacagcaagtgcatacaaagatgctgcagattacaaacaccgggtttgaaatgaagctgagggtggaagcccgcattagggaggagggcactgatctggaggtgaccgctaatagaattagtgaaatcaccaatatcgtgagtaaattgaagtttgtgaaagtggactcacacttccgacagggtatcccgttctttgcacaggtcctgctagtcgacggaaagggtgttcccatccctaataaactcttcttcatttcggtcaacgatgctaactattacagcaacgctaccactaatgaacagggtctggcacagttcagtatcaatactacctccataagcgttaataagttattcgtcagagttttcacagtgcaccccaacctatgctttcactactcctgggtggctgaagatcaccagggagcgcagcacacagccaaccgcgtgtttagcctctctggatcctacattcaccttgagcctgttgccgggacactgccttgcggacacactgaaaccatcaccgctcactacaccctgaatcgccaggccatgggcgaactgtccgagctcagtttccactacctgataatggccaagggagtcatcgttagatctggaacacacactctccccgtcgaaagcggcgacatgaagggctctttcgccctgtccttcccagtggaaagtgatgtcgcccctatagcaaggatgtttatttttgcaatcttgcctgatggggaggttgtcggggactccgaaaagttcgagatcgaaaactgcctcgcgaacaaagtggatttatcatttagccctgctcagtctcccccagcatcccacgcccacctccaagtagctgctgctccccagtcactctgcgccctccgtgctgtggaccagagcgtgctgttgatgaagcctgaggcagagttgtctgtcagctccgtctacaatctcctgaccgtgaaggatctgacgaatttccctgacaacgtcgatcaacaggaggaggaacagggacattgccccagacccttcttcatccataatggtgcaatttatgtccccctctcttcaaacgaggcggatatatacagctttctcaaagggatgggcctcaaggtctttaccaattcaaaaatacggaaaccaaaaagctgttcagtgatcccatccgtgtccgccggcgcagtcggtcagggctactacggtgctgggctgggcgttgtggagagaccttatgtcccgcagctcggaacgtataatgtcattccgctcaacaacgaacaatctagcggcccagtgcccgagacagtcagaagctattttccagaaacctggatctgggaacttgtagctgtcaacagctctggcgttgcggaagttggcgtcactgtgccagacacaatcacagaatggaaggccggcgctttttgtttgtctgaggatgccggactgggaatcagtagcacggctagtctaagagcctttcaacccttttttgtcgaattaaccatgccgtacagcgtgatacgaggcgaagtgtttacccttaaagcaacagttctgaattatctaccgaagtgtatcagggctgagggcatcgagcaggaaaaaacattctctagtatgacctgtgcatcaggggcaaacgtgagcgagcagcttagccttaaactcccttccaacgtggtaaaggaaagcgctcgtgcgagcttcagcgtgctgggggacattctagggtcagccatgcagaatatccaaaatctgctccagatgccttatggctgcggggaacagaatatggttctctttgcacctaatatctatgtgctgaattatttaaacgagactcagcagcttacccaggagataaaggcaaaggcggtgggataccttattaccgggtatcaacgacagctcaattacaaacaccaggacggtagttattcaaccttcggagagcggtatggccgtaaccaagggaatacatggctgacagcctttgtgcttaagactttcgctcaggctaggtcttacatttttattgacgaagcccatataacgcagtccctgacttggttgtcccagatgcaaaaggataatgggtgcttcagatcctctggatctttgctaaacaatgctattaagggaggcgttgaggacgaggccacactctctgcatatgtgacaattgccctgttggagatcccgctgccagtcaccaatcccattgtccggaacgcgctcttttgccttgagtcagcctggaacgtagcaaaggagggaacacatggttctcacgtgtatacaaaggcattgttggcgtatgcgttctcattgctcggcaagcagaatcaaaacagagagatcctgaatagcttggataaagaagccgtcaaggaggacaatcttgtccactgggagagaccacaacgcccgaaagctccggtggggcatctctaccagactcaagcgcctagcgccgaggtcgagatgaccagctacgtgctgctcgcctatctgaccgcgcaacccgcccccaccagtggtgatctgacatcagccacaaacatagtgaagtggatcatgaaacagcagaacgctcagggcggattcagctcaacacaagataccgtggtagccctgcatgcgctgtcccggtatggggcggcgacattcaccagaaccgaaaaaaccgcccaggttacagtgcaagattctcaaacgttcagtacgaacttccaggtcgataataataatctcctgcttctccagcagatctcgctcccagaactgccaggggagtatgtcataacggtcaccggcgagcgatgcgtgtatctgcagacgagtatgaagtacaacattctgcctgaaaaggaagacagcccttttgctttaaaagtccagaccgtgcctcagacatgtgatggccataaggctcatacatccttccaaatttcactaaccatcagttacacaggaaatagaccggcatcaaatatggtcattgtggatgttaaaatggtgagtgggtttattcctctcaagccaacagttaaaatgctcgagcgctcttcttcagtgtcgcggactgaagtcagtaataaccatgtgcttatttatgtggagcaagttacgaaccagaccctgagctttagctttatggttctccaggatatcccagtgggtgacttgaaaccggcaatcgtgaaggtgtacgactactatgaaaccgatgaaagcgtggtcgccgagtacattgccccgtgttcaaccgacaccgagcacggcaatgtgtag

SEQ ID NO: 200585 - DNA, 660 bp, Artificial Sequence
  Description of Artificial Sequence: Synthetic coding sequence
atggtgaagtacttcctgggccagagcgtgctgcggagcagctgggatcaggtttttgccgccttctggcagcgctacccaaacccatattccaagcatgtactgaccgaggatatcgtgcacagagaagtcacccctgatcagaaacttctctcccgacgcctcctgactaaaaccaataggatgccacggtgggccgagcggctgtttcctgcaaatgttgctcattccgtctatgtgctggaggatagtattgttgaccctcagaatcaaacaatgaccactttcacttggaacataaaccacgcccgtctgatggtggtcgaggagcggtgtgtctactgcgtgaattccgataactcaggctggactgaaattcgtcgcgaggcatgggtatccagctcactttttggcgtgtctagggccgtccaagagtttggcctagcaagatttaaatctaatgtaacaaagacaatgaaagggttcgagtatatattggcaaagctccagggcgaggcacctagtaagaccctcgtcgagaccgccaaagaagcaaaggagaaagccaaagaaactgccctcgccgctacagaaaaggcgaaagacctggcatctaaagcggccaccaagaagcagcagcagcaacagcagtttgtttag

SEQ ID NO: 200586 - DNA, 1770 bp, Artificial Sequence
  Description of Artificial Sequence: Synthetic coding sequence
atgagcagcagctactggagcgagaccagcagcagcagctgcggcacccagcagcttcccgaggtgctgcagtgccagccccagcactaccattgttatcatcagtcctcacaggcccagcagccaccagagaagaatgttgtgtacgaacgcgttcggacttactcaggccccatgaataaggtggtgcaggccttggatcccttcaatagtagggaagtgttgtccccactcaagacaaccagcagctatcagaatcttgtgtggagtgaccactcacaagaactgcattctcccaccttaaaaatttctacctgcgcaccgagtacgttgcacatcacacagaacaccgaacaggagctgcactctcccaccgttaagttgacgacttaccctcagactactatcagaaagtatgtggtgcagaaccccgagcaagagcctcttagtcagttcttgcgaggttcccatttcttccccggaaacaacgttatttatgagaagaccattaggaaagtcgagaaactcaatactgaccaggggtgccatcctcaggcgcagtgccatcaccatattatccagcagccacaggtcatccattccgctcactggcagcagcccgacagctcgcagcagattcaggccatcactggaaacaatccaatttctactcacatcgggaacgaactgtgtcattccggatccagccaaatatgtgagcaagtcatcatccaggacgacggacccgagaaactagatccgaggtattttggcgagctgctggcagatctttcgaggaagaatacagatctctaccattgcttactagagcatctgcaaaggatcggcggttctaagcaggattttgaaagtacagacgagtctgaggacatcgaaagtctgattccaaaggggttgtccgagttcactaaacagcagattcgctatattctgcagatgcgtgggatgtctgacaagtcgttgcgtttagtgctttcaactttttctaatattcgagaagagctaggccatttacagaacgacatgacatccttagagaacgacaagatgcgacttgaaaaagatctgtcattcaaagacacgcagttgaaagagtatgaggagctgctggccagtgttagagccaataatcaccaacaacagcaaggcctccaggacagctcctcaaagtgtcaggctttggaggagaacaacttatccctccgccacaccctgtccgacatggagtaccgactcaaagagctcgaatattgcaaaaggaacctggagcaagaaaaccagaacctgagaatgcaggtcagtgaaacctgtaccggcccgatgttacaggcgaagatggacgagatcgggaatcattatactgagatggtgaagaaccttaggatggaaaaggatcgcgaaatctgtcgcctgagatcccaactgaaccagtaccacaaggacgttagcaaaagagaaggatcttgtagtgacttccaatttaagctccacgaacttacttcactcttggaagaaaaagatagtttaatcaaacggcagagcgaagagctgagtaagctgaggcaggagatctactcttcccataatcagcccagcacgggcggacgaacgaccatcacaacaaagaagtatcgcacacagtacccaatcctggggctgctctacgacgactatgagtacatccccccgggatcggagacacagacaattgtcatcgagaagactgaggacaaatacacgtgtccttag

SEQ ID NO: 200587 - DNA, 921 bp, Artificial Sequence
  Description of Artificial Sequence: Synthetic coding sequence
atgagcagcagctactggagcgagaccagcagcagcagctgcggcactcagcagttgccggaggtcttgcagtgccagccccaacactaccattgctaccaccaatcatcccaagcacagcaaccacccgagaaaaatgttgtgtatgagcgtgtcagaacctattcgggacccatgaataaagtcgtgcaggcattagatcccttcaattcaagggaagtactgtctccgctaaagacaacgtcatcctaccaaaatctggtctggagcgatcattcccaggagttgcattcccctacactaaaaattagtacttgtgcaccctctaccctgcacatcactcagaataccgaacaagagcttcacagcccgaccgttaagctgacgacctacccacagaccaccattagaaagtacgtggtgcagaatccagagcaagagccgctgagccagtttctccgcggcagccacttttttccaggcaacaatgtcatatatgaaaagacaatcaggaaagtggagaagctgaacacagaccagggctgtcatccccaggctcaatgccaccatcatatcatccagcaacctcaggtcatccactcagcgcattggcagcagccagatagtagtcagcagattcaagctatcacagggaacaacccaatttctacccatatcggtaacgagttgtgccattctggaagcagccagatttgtgagcaggtgatcattcaagacgatggccccgaaaaactcgacccaagatatttcggcgagctcttagccgatctctctcggaaaaacaccgatttgtaccactgcctcctggagcacctgcagaggattggacgcaagcaatcactctcttctacatacacaattcgacatggtattcagactaaacgtaccggtattctgtag

SEQ ID NO: 200588 - DNA, 1788 bp, Artificial Sequence
  Description of Artificial Sequence: Synthetic coding sequence
atgagcagcagctactggagcgagaccagcagcagcagctgcggcacgcagcagttgccagaagtcctgcaatgtcagccccaacactaccactgctaccaccagagcagtcaggcccagcagcctccagaaaagaacgtggtctatgaacgagttagaacttattctggtccaatgaacaaggtcgtacaagcactggatcctttcaacagccgcgaggtgctgtctcctttaaaaacaacttcgtcttaccaaaatctagtttggtccgatcactcccaggagctgcattcccctaccctgaagattagcacatgcgcgccctctactctccacattacccagaacacggagcaggagctgcattccccgacggttaaactgaccacttacccgcagaccaccatcaggaaatatgttgttcagaaccctgagcaggagccactctcacaattccttaggggtagccacttttttcccggtaacaacgtaatatacgaaaagacaattcgcaaggtggagaagctcaacacagatcagggatgtcacccacaggcccagtgtcatcatcacataattcagcagccacaggtcatccattccgcccattggcagcaaccagactcaagccaacagattcaggcaattactggaaataacccaatctccacccacatagggaatgaactctgtcatagcggatcaagccagatttgtgaacaggtcatcatccaggatgatggcccagaaaaattagatccacgctattttggggaactactggctgacctgagccgcaagaacacagacctgtatcattgtctgttggagcacctacagcggattggcgggagcaaacaggacttcgagtcaactgatgaatctgaagacatcgagagcttgatacccaagggcctgagtgagtttacaaagcagcagataagatatatcctgcaaatgagagggatgtccgacaaatccctgcggctggtcctgtccacgttctccaacatcagggaggaactcggccacttgcagaatgatatgacctcactggagaacgacaagatgcggcttgagaaagatctgagcttcaaggacacacaacttaaagagtatgaagaactactggccagcgttagagcaaataatcatcagcagcaacaggggctccaagacagtagcagcaaatgccaggctctggaggaaaacaacctgtcactgcgacacaccctgagtgacatggagtacaggctcaaagaactggagtactgtaagcgaaatcttgagcaggaaaatcaaaatcttagaatgcaggtgagcgagacatgcacgggtccaatgctccaggcaaagatggatgaaatcggaaatcactacaccgaaatggtaaaaaatttacgcatggagaaagatagggagatttgcagattgaggagccaactgaaccagtaccataaagacgtgagtaaacgggaaggttcatgttctgattttcagtttaaactgcacgaactgacctccctcctggaagagaaagactccctcatcaaacgccaatctgaggagttgtccaaactgagacaagaaatctattcatcacacaaccagccaagtactgggggcaggactacaatcactacaaagaagtatcgaacacagtacccaattcttgggctactgtatgacgattatgagtacatcccccctgggtccgaaacccagaccattgtgattgagaagactgaagacaagtacacctgtgtctctagcttgggacatttttag

SEQ ID NO: 200589 - DNA, 921 bp, Artificial Sequence
  Description of Artificial Sequence: Synthetic coding sequence
atggccagccggtggtggcggtggcggcggggctgcagctggaagcccgcggcgagaagtcccggccccggatccccgggcagagctggccctttagggccatcagctgcggcggaagtacgggcccaggtgcatagacggaagggtctcgacttgagtcagataccttatattaatctggtgaaacatctcacgtctgcgtgccctaacgtgtgtagaatcagtcgattccaccacacaacccccgactccaagacacactccggcgaaaagtatactgaccccttcaaactggggtggcgggacctgaagggtctatacgaagacataagaaaggaactgcttattagtacttctgaactgaaggagatgagcgaatactacttcgatgggaaaggaaaggcatttcgccctatcatcgtagcgttaatggcgcgtgcatgtaatatacaccacaacaattcacggcatgtccaggccagtcaacgcgccattgccttgatcgctgagatgatacatacagcaagcttagtgcacgatgatgtgatcgatgatgcttcgagcagacgaggcaagcacacggtgaacaagatttggggcgagaagaaggccgttctagctggagatctgatcctgtctgccgctagtattgccttagctcggattggtaacacgacagtgatttcaatcttgacacaagttattgaagacctagtgaggggagagttcttgcagcttggaagtaaggagaacgagaatgagagattcgcccactatctcgaaaagaccttcaagaaaaccgcaagtctcattgcaaactcgtgcaaggctgtttttcctcgtaacgaatgttatgaccacgccaccgtgcagttcgcctggcgctgtcgacagagtagtaccgtgtgtaccacagaatag

SEQ ID NO: 200590 - DNA, 1248 bp, Artificial Sequence
  Description of Artificial Sequence: Synthetic coding sequence
atggccagccggtggtggcggtggcggcggggctgcagctggaagcccgctgctcggagcccaggacctggaagcccaggacgcgccggccccctgggtccatccgctgccgcagaagtgcgggcgcaggtccaccgccggaaaggattagacctatcccagataccttacatcaatctagtgaagcacctgacgtccgcgtgccccaacgtgtgcagaatctctcggttccaccacaccacacctgattctaagactcattccggcgaaaagtatacagaccctttcaaactggggtggcgtgatctgaaaggcttgtacgaggacatcagaaaagaactgctgatctcaacgagcgaactgaaggagatgtctgagtactactttgatggtaaaggcaaggccttcaggccaattatcgtggccttgatggccagggcgtgtaatatccatcacaacaacagtcgtcacgtccaggcatcccagcgggctatagccctgattgccgagatgattcacactgcgagcctggtgcacgatgacgtgatcgacgacgcttctagcaggcgaggtaagcacaccgtcaacaagatctggggggaaaaaaaggccgtgctggcgggagacctgatcctaagcgccgcctctatagcgctggcccgcattggcaatacaaccgtcatcagcatccttactcaggtgattgaggatctggttcggggcgagttcctccaactaggcagcaaggagaacgagaacgaacggttcgcccattacctcgagaaaacttttaaaaagactgcatcattgatagcaaatagctgtaaggcagtgagtgtgctaggctgccctgatcccgtagtgcacgagatagcctaccaatacgggaaaaacgtgggaattgctttccaactgatcgacgatgtgctggattttacctcctgttccgaccaaatgggcaaacctacatcagccgacttaaaattaggtctcgccactggcccggtgctgttcgcatgccaacagttcccggagatgaatgcaatgattatgcgtagattcagcctgccgggggatgtggatagggcaagacaatacgtgctccagtctgatggggtccagcagactacgtatctagcccagcagtactgtcacgaggctattcgagagatttcaaaacttcggcctagtccagagagggacgcgctgatccaattgtctgagatcgtgctcacccgagacaaatag

SEQ ID NO: 200591 - DNA, 1131 bp, Artificial Sequence
  Description of Artificial Sequence: Synthetic coding sequence
atgcccgcccacgtgcaccggcggaagggcctggacctgagccagatcccctatataaacctggtgaagcatctcactagtgcctgcccaaatgtctgcagaatttccaggtttcaccacaccactcccgactccaagacacacagcggcgagaagtacactgacccgttcaagctgggttggcgcgatttgaagggcctttacgaagatatccgaaaggaactgttaatcagtacatcagaactcaaggagatgtccgaatactacttcgacggtaagggaaaagcgttccggcctatcattgtggctcttatggcacgggcatgcaatatccaccacaacaactcccgccacgtgcaggcttcccagcgagctatagctttgatcgcagaaatgattcatactgcgagcctcgtgcacgatgacgtcattgacgatgcctccagcaggaggggaaagcatactgtgaacaaaatctggggcgagaagaaagctgtgctggccggcgacctgatactgtccgcggcttctattgccctggccaggattggcaataccaccgtgatcagtattctcacacaggtaatagaagatctcgtgcggggggaattcctacagctcgggtctaaagaaaatgaaaacgagcgattcgcccattatttggaaaagacctttaagaagaccgcttcgctgatcgctaattcttgcaaggccgtttccgtactgggatgccctgaccctgtggtgcacgagatcgcataccaatatgggaaaaacgtgggaattgcctttcagttgattgacgacgtgctcgactttacatcctgtagcgaccagatgggaaagcctacctctgctgatctcaagttaggcttggcaactggtccggtcctgttcgcctgccagcagtttccagagatgaatgccatgatcatgcgcaggttttctctgccaggcgacgttgaccgtgcccgccagtatgtgctgcagagtgatggcgttcagcagaccacttacctggcccagcagtactgtcacgaggccattagagagattagcaagcttcgacctagccctgagcgggatgcccttatccagttgtccgagattgtcctgacgcgggataagtag

SEQ ID NO: 200592 - DNA, 723 bp, Artificial Sequence
  Description of Artificial Sequence: Synthetic coding sequence
atgaacttccggcagctgctgctgcacctgccccggtacctgggcgcctcaggctccccccgaagactgtggtggagcccttccctcgatactatatcctccgtaggctcctggagaggcaggtcttccaagtcccctgctcattggaatcaagttgtgtctgaagccgaaaagatcgttgggtaccccacgtccttcatgagtctgcggtgccttctgagcgacgaactgtctaacatcgccatgcaagtccggaaactggtgggaacccagcatccattgctcacaacagcccgaggcctggtacacgactcttggaattccctccaattgcgtggactggttgtgctgctgatttccaaagcggcgggtccttccagcgtgaacacctcttgtcaaaactatgatatggtgagcggcatctacagctgccagagaagcttggccgagattaccgaactgattcacatcgcactgctcgtgcaccgaggtatagtgaatctgaacgagttacagagctctgacggcccgctgaaagatatgcagttcgggaataagattgctatcctttctggagattttctgcttgctaacgcctgcaacgggttggcacttctccagaacactaaatcattttcattcaatggccctatagcaatttatcagatgggggactgtgagtcagcctggattctcagcaaacatccccgagccctgtcatag

SEQ ID NO: 200593 - DNA, 270 bp, Artificial Sequence
  Description of Artificial Sequence: Synthetic coding sequence
atggagctggccaagcacgacgccgaggtgcagaacatggccttccagtacggtaagcacatggctatgtcacacaaaatcaactccgacgtgcagcccttcatcaaggaaaaaaccagtgactctatgaccttcaacttgaacagcgcacccgtggtcctccaccaggagttcctggggagagacctctggattaagcagataggcgagtcaagcagtacagaagtccaactgagtaatttccagcagatgctgcttagtaccctgtag

SEQ ID NO: 200594 - DNA, 1200 bp, Artificial Sequence
  Description of Artificial Sequence: Synthetic coding sequence
atgaacttccggcagctgctgctgcacctgccccggtacctgggcgcctctgggagtcccaggcgattatggtggtcaccatccttggacacaatctcatcagtcggaagctggaggggtaggtcgtccaagtcgccagctcactggaatcaagtggtgtctgaagctgaaaagatcgtcggctaccctacatctttcatgagcctcaggtgtctgctctcagacgaactcagcaatatcgcgatgcaggtgagaaaactcgtgggcacacagcaccccttactaaccacagcccgaggtctcgtgcatgattcttggaattcacttcaactgcggggcctcgtggtgctgctgattagcaaagcagctggcccttcatccgtcaatacatcatgccagaattatgacatggtgagcggcatttactcttgccagcgttcattggccgagattacagagctcattcatatcgcactgttggtgcacagaggcatagtgaacttaaatgaactccagagcagcgacggccctctgaaggatatgcagtttggcaataagattgccattctatccggagattttctcctggccaatgcatgtaacggccttgctctgctgcagaataccaaggtggttgagttactcgcttccgccttaatggatctcgtccagggcgtctatcacgagaacagtacttcaaaggagtcttatataaccgacgatatcggtatttctacttggaaggagcagaccttcctttcacacggggcactactcgcgaagtcctgccaagctgccatggagcttgcgaagcatgatgctgaggtgcagaatatggcttttcagtatggaaagcatatggcaatgtcccacaaaatcaacagtgatgtgcaacctttcatcaaggaaaagacatcagacagcatgacctttaatctgaatagtgctcctgtcgttctgcaccaggagttccttggtagggatctgtggataaagcagattggcgaggcacaagaaaagggcaggcttgattacgccaagctgcgcgagaggataaaagcgggaaagggcgtgacatccgccattgatctttgccgctaccacggcaataaagctctggaagccctggagagctttccaccttcagaagccaggtccgctctggagaatatagtttttgccgtgacacgattcagctag

SEQ ID NO: 200595 - DNA, 243 bp, Artificial Sequence
  Description of Artificial Sequence: Synthetic coding sequence
gtgcagaacatggccttccagtacggcaagcacatggccatgagccataaaattaattcggacgtgcagcctttcataaaggaaaagacgtctgacagcatgacattcaacctaaactccgcccctgtcgttctgcaccaggagtttctggggagggacctgtggatcaagcaaattggtgagtcctctagtacagaggttcagctgtccaatttccaacagatgcttctgtctacactgtag

SEQ ID NO: 200596 - DNA, 894 bp, Artificial Sequence
  Description of Artificial Sequence: Synthetic coding sequence
atgaacttccggcagctgctgctgcacctgccccggtacctgggcgcttccggttcaccacggcgcctgtggtggtcaccctccctcgacacaatcagttctgtggggagttggcggggaagatcttccaagtcccctgcccattggaaccaggttgtgtctgaggccgagaagattgttggttatccaactagctttatgtcactgcgctgcttgctctccgatgaactgtctaatatagcaatgcaggtgagaaagttggtgggaacacagcaccctcttttaaccaccgcacgtggcttggtccacgacagctggaactcactgcagctgcgcggactcgtggtcttactgatttccaaagctgccggacctagcagcgtgaacacttcttgccagaactacgatatggtgagtggaatttacagctgtcagagatcactggctgaaatcacagagctgattcacatagccttgctggtgcacagaggaatcgtaaacttgaatgagctccaaagctctgatgggccactcaaagacatgcaatttggcaacaagattgccattctgtctggtgacttcttgcttgccaatgcctgcaacggcctcgcacttctgcagaacaccaaagttgtcgagctcctggcctctgctcttatggatttggtgcagggcgtatatcatgagaacagcaccagcaaggcccaagagaaaggccgactggactacgccaaacttcgtgaacggataaaagctgggaagggtgtcacaagcgcaattgatctgtgtcggtaccacggcaataaagccctcgaggcactggagagctttccccccagcgaagctagaagcgcccttgagaacattgtgttcgccgttactcgattttcctag

SEQ ID NO: 200597 - DNA, 882 bp, Artificial Sequence
  Description of Artificial Sequence: Synthetic coding sequence
atgggccgggtggtggccgagctggtgagcagcctgctgggcctgtggttgttactgtgttcctgcggatgtccagagggggctgaactgagagccccccccgataagatagccataattggcgctggaattggtgggacatccgccgcctactaccttcgccagaaatttggaaaggacgtgaaaatagaccttttcgagagggaagaagttggtggccggctggcaaccatgatggttcagggccaggagtatgaagccgggggcagtgtgatccaccccctgaatctgcatatgaagcgcttcgtcaaagacctaggcctctctgcagttcaggccagcggtggactgctggggatttacaatggggaaaccctggtctttgaggagtctaattggtttattatcaatgtgatcaagttagtgtggcggtacgggtttcaaagtctgcgtatgcacatgtgggtggaagacgttctagacaaatttatgcggatttacaggtaccagtctcacgattatgcatttagcagcgtcgaaaaacttcttcatgcactaggaggagacgacttccttggaatgcttaacaggacccttctagaaacactccaaaaggccggcttttccgaaaagttcctgaatgagatgatcgctcctgtaatgagagtgaactatggccaaagtactgacatcaacgctttcgtcggggccgtgtccctgtcctgcagcgattcggggttgtgggccgtggagggcgggaacaagctggtatgctccggattgctccaggcctccaagtccaatctcatctcgggtagcgttatgtacattgaagaaaagactaagacaaagtacaccgtactgggcctgtgcccactgtag

SEQ ID NO: 200598 - DNA, 1518 bp, Artificial Sequence
  Description of Artificial Sequence: Synthetic coding sequence
atgggccgggtggtggccgagctggtgagcagcctgctgggcctgtggcttttgctttgttcatgtggatgccccgaaggagcggaactcagggcccctccagacaagatcgcgatcatcggcgccggcatcggtggcacctcggcagcatattacctgcgtcagaagtttggcaaggacgtgaagatagacctgtttgagcgagaggaagtaggtggcaggctggcaactatgatggtgcagggtcaggagtacgaggccggggggagtgtcatccacccccttaacctgcatatgaaacgatttgtgaaggacctcggtctgtccgccgtccaggcgagcggaggtttattaggcatctacaacggcgaaactctcgttttcgaggaaagtaactggtttattattaatgtcatcaaacttgtttggaggtacggattccagtcactccgaatgcacatgtgggtcgaggacgtcttagacaaattcatgagaatctatcgttaccagtcacacgactacgcgttctcaagtgtggagaagcttctgcacgctctcggtggagacgacttccttggtatgctcaatcgcaccctactggagacccttcagaaagccggtttctcggagaaatttctgaacgaaatgatcgctcccgtaatgagggtgaattacgggcagtccacagatatcaatgccttcgtcggcgccgtgtcgctgagctgctccgactcgggtctgtgggctgtggagggcggtaataaactggtgtgctccgggctcctccaggctagcaagagtaacctgataagtggctctgtcatgtacattgaggaaaagactaagacaaaatacactggcaaccctacaaagatgtacgaggtggtgtatcagatcgggactgagacgaggagcgatttttacgacatcgtcttagtcgccacaccgctcaatcgcaagatgagcaatatcaccttcctgaacttcgatcctcctattgaggagttccaccaatactatcaacacatagtaaccaccctggttaagggtgagctgaacacaagtatatttagcagtcgaccgatcgataaattcggcctcaacacagtactaaccaccgataattccgacctgtttattaattccataggcatagtcccatctgtgcgggaaaaagaggaccccgagcctagcacggacggcacttacgtgtggaaaatctttagccaggaaaccctgaccaaagcccagatcctgaagctgtttctaagctacgactacgctgtgaaaaagccctggctggcctatccccactataagccgcctgaaaagtgcccgtccatcattctgcacgatagactgtactaccttaatggcattgagtgcgctgcgtctgcaatggaaatgagtgcaattgcagcacacaacgccgccctgctcgcgtaccaccgctggaacggacatacggacatgattgatcaagatggtctgtacgagaaattgaagaccgagctgtag

SEQ ID NO: 200599 - DNA, 1287 bp, Artificial Sequence
  Description of Artificial Sequence: Synthetic coding sequence
atgatggtgcagggccaggagtacgaggccggcggcagcgtgatccacccacttaacctacacatgaaacgcttcgtgaaagatctcggattgtccgcagtccaagccagcgggggcctcctaggaatatataacggagagactctggtgtttgaagagagcaattggttcattattaacgtgatcaagctggtttggaggtacggatttcagtctttgcgcatgcacatgtgggtggaggatgtgctggacaagttcatgcgtatctataggtaccagtcccatgactatgccttcagctccgttgaaaagcttcttcacgctttgggtggggatgacttcctgggcatgctcaacagaacactgctcgaaacgctgcagaaggcaggcttttccgaaaagttcctgaatgagatgatcgcacctgtcatgagggtgaattacggacagtctactgacataaatgcgtttgttggcgccgtttctctgtcgtgctcggactctggtctgtgggctgtggagggcggaaacaagctggtgtgcagcgggctcctacaggcatctaagtccaacctcatcagcggcagtgtgatgtacattgaagagaaaacaaagaccaaatacaccggtaacccaaccaaaatgtacgaagtagtctaccagatcggaacagagacgagatccgatttctacgacattgtgttagtcgcaacgcccctcaaccgcaagatgtcaaacataacatttctgaacttcgaccccccgattgaggagtttcaccagtactatcaacacatcgtcactaccctcgtgaaaggtgagctgaatacttctattttcagttctcgcccaatcgataagtttggcctaaacacagtgctcactaccgacaatagcgatctgtttatcaattcaattgggatcgtcccttcagtgcgagagaaggaagatccagaaccgtctacggatggtacttatgtgtggaagattttctctcaggagacacttacgaaggcccagatcctgaaactcttccttagctatgactatgccgtgaagaagccctggctggcttatcctcattacaagcctcctgaaaagtgcccctccataatcctccacgaccggctgtattatctgaacggcatcgagtgcgctgcgtccgccatggaaatgtctgccattgctgcccacaacgccgccctgctcgcctaccacaggtggaacgggcacactgatatgatagatcaagatgggctgtacgaaaagttgaagacagaactctag

SEQ ID NO: 200600 - DNA, 1284 bp, Artificial Sequence
  Description of Artificial Sequence: Synthetic coding sequence
atggtgcagggccaggagtacgaggccggcggcagcgtgatccaccctctgaatcttcatatgaaaaggtttgtgaaggacctcgggcttagtgccgtgcaagcaagcggaggattgcttgggatttataacggcgaaactctcgtattcgaggagtcaaactggtttatcatcaacgttataaaactggtttggcgatatggtttccaatccctccggatgcacatgtgggtcgaggacgtactggacaaattcatgcggatctatcgataccagtctcacgattacgcgttttccagtgtagagaaactgctgcatgccctaggaggcgatgatttcctcggaatgctaaataggactctcctagagacccttcagaaagctggcttcagcgaaaagtttctaaatgagatgattgcacctgtaatgagggtgaactacggacaatccaccgatatcaatgcattcgttggagccgttagcctgtcatgctcggactccgggctatgggctgtggaaggcggcaacaagctggtgtgcagtgggctgttgcaggcctccaaatctaacctgatttccggcagcgtgatgtacatcgaggaaaagaccaaaactaaatacacgggaaacccaacgaagatgtatgaagtggtgtaccagatcggcactgagacccgctcagacttctacgatattgttctggtggcaacccctcttaaccgcaaaatgagcaacataacctttctaaactttgatccgccgatcgaagaattccaccaatattatcagcacattgttaccacattagtcaaaggcgaactcaacacttcaattttcagttctcgtccgatcgataagttcggattgaacaccgtgctgacgacagataactcagatctctttatcaattccatcggcatcgtcccaagcgtgagggaaaaagaggatccagaacctagtacagacggcacttacgtgtggaaaatcttctcgcaagagacattgacaaaagcccagatactcaagctctttctgagttacgactatgcagtgaagaagccctggctggcctatccccactataagccccctgagaagtgtccttccattattttgcatgatcgcctgtactacctaaatggaattgaatgtgctgctagcgcgatggaaatgtcagccattgccgcacacaatgctgcactcctagcttatcatcggtggaatggtcatactgacatgattgaccaggacggattatatgaaaagctgaaaacagagctatag

SEQ ID NO: 200601 - DNA, 1485 bp, Artificial Sequence
  Description of Artificial Sequence: Synthetic coding sequence
atggcccgggccgcccccctgctggccgccctgaccgccctgctggccgccgcagcggctggcggagatgctcctccgggaaaaatcgcagtggtgggggcaggcatcgggggcagcgccgtcgctcactttctgcagcaacattttggtcctagggtccagattgatgtctacgagaaaggcactgtgggtggccgcttggcgacaattagcgtaaacaagcagcactatgaatctggggctgcgtcattccactccttgtctttgcatatgcaagactttgtgaagctgcttggacttcggcaccgccgggaggttgtcgggcgcagcgcgatatttggaggcgaacacttcatgctggaagaaaccgattggtacctgctgaatctcttcagattgtggtggcattacggcatctccttcctgagattgcagatgtgggttgaagaggtgatggagaaattcatgcgcatatataaatatcaagcccatggctacgcttttagtggcgttgaggagcttctgtactcattaggcgagagcaccttcgtgaatatgactcagcatagcgttgcagaatcactgctgcaggtgggagtgacgcagcgcttcatcgatgacgtcgtgtcagctgttttgagagcctcttatggccaatctgcggctatgcctgctttcgctggtgctatgtcccttgccggcgcgcaaggctccctctggtctgtggagggtggcaacaaactggtgtgctccggcctcctcaagcttaccaaagccaacgtgatccacgcgacagttacctccgtgaccctgcacagcacagaagggaaggctctgtaccaggtggcttatgagaacgaagttggcaattcctctgacttttatgatatcgtcgtgatcgccaccccattgcatctggacaattccagcagcaatctgaccttcgccggctttcaccccccaatagacgatgttcaggggtccttccagcccacagttgtgtccctggtgcacgggtatctgaactccagttatttcggctttccggacccgaaactgtttccatttgctaacattttaaccactgacttcccctccttcttttgcacccttgacaacatctgcccggtgaacatctccgccagctttagacggaaacagccccaagaagcagccgtctggagagtgcagtctcctaaaccgttattcaggacccagctgaaaaccttgttccggtcctattactcagttcagaccgccgaatggcaagcccatcctctttatggcagtagacccacattgcctagattcgccctccacgaccaactgttttatctgaacgcgctcgaatgggcagcctcttctgttgaggtgatggccgtagccgctaaaaacgtggctctgctggcatataataggtggtaccaggatctggacaagatcgaccagaaggacctgatgcacaaagtaaaaactgaactgtag

SEQ ID NO: 200602 - DNA, 531 bp, Artificial Sequence
  Description of Artificial Sequence: Synthetic coding sequence
atgaaggtgctgctgtgcgacctgctgctgctgagcctgttcagcagcgtgttctcctcttgccagagagattgcctcacctgccaagagaagcttcatcccgctctcgactctttcgacctggaggtgtgcattctcgaatgcgaagaaaaggtgtttccctctcccctttggactccttgcacgaaagtcatggctcgctcatcatggcaactctcccccgctgcgccggagcatgtggcggccgccctgtaccagccgcgtgcctccgagatgcagcacttgcggagaatgcctcgagtcaggagtctctttcaggagcaggaggagccagagcctggtatggaagaagcaggggaaatggagcagaagcaactgcagaaacggttcggggggttcacaggggcgaggaaatcggccagaaagctggcaaaccagaagcgattttcagagttcatgaggcagtacctcgttctttccatgcaatcctctcaacggaggagaactctacatcagaatggcaacgtctag

SEQ ID NO: 200603 - DNA, 465 bp, Artificial Sequence
  Description of Artificial Sequence: Synthetic coding sequence
atgaaggtgctgctgtgcgacctgctgctgctgagcctgttcagctccgtcttttcctcctgtcaacgtgactgcttaacctgccaggaaaaactgcatccagccctcgatagttttgatctagaggtctgcatactggagtgcgaagaaaaggtgttcccatctcccctgtggacaccctgcacaaaagtaatggctagatcctcttggcagctttctcctgcggcccccgaacacgtagccgctgcactttaccagccccgggctagcgaaatgcaacatctccggcgcatgccacgggtccgcagtctgttccaagagcaggaggagcctgaacctggtatggaggaagccggggagatggagcagaagcagctgcagaagagattcggcgggttcactggtgctagaaaaagcgctagaaagctcgccaaccagaagaggttcagtgaatttatgagatag

SEQ ID NO: 200604 - DNA, 1230 bp, Artificial Sequence
  Description of Artificial Sequence: Synthetic coding sequence
atgaccgagctgcccgcccccctgagctacttccagaacgcccagatgagcgaggacaatcatttgtccaatactgtgaggagtcagaacgataaccgcgaacgccaagaacacaatgacaggcgcagcctcggtcacccagagccactgagcaatggcaggccccaggggaactctcggcaggtggtggaacaagacgaagaggaggatgaagagctgaccctcaaatacggggccaagcacgtcataatgctcttcgtgcctgtgacgttatgcatggtggtggtggtcgctaccatcaaaagcgtgtccttctatacacggaaggatggccaattaatctacacccccttcactgaagatacagagaccgtgggccaacgggcacttcattccatcctcaacgctgccattatgatcagcgtgatcgtggtgatgacgatactgctggttgtgttatataagtaccggtgttataaggtgattcacgcatggctgatcatttcctctctccttttgcttttctttttcagctttatttatcttggcgaggtgttcaaaacatacaacgtagctgttgattatatcaccgtggcgctacttatttggaattttggagtggtgggaatgatcagcatacattggaagggtcccctgagactccagcaagcctacctcattatgatctcagccctgatggcccttgtgtttattaaatacctgcccgagtggaccgcatggctgattctagctgtgatttctgtctacgatctggtcgccgtcttgtgccccaagggccctctgcgcatgcttgtggagacagcacaggaacggaacgaaacactttttccagctctaatatactcctctacaatggtctggctggtaaatatggctgaaggcgaccccgaagcccaacggcgagtgtctaagaactctaaatacaacgcagaaaggggagtgaaactgggactgggtgatttcatcttctacagtgtgctggtgggaaaagccagcgcgacggctagtggcgattggaacaccactattgcctgctttgtggccatactcatcggattgtgtctgactcttcttcttctggccatttttaagaaggctctccccgcgctgcccattagcatcacgtttggcctggtcttttattttgcaaccgattatctcgtgcagccatttatggaccagctggccttccaccaattttacatctag

SEQ ID NO: 200605 - DNA, 1404 bp, Artificial Sequence
  Description of Artificial Sequence: Synthetic coding sequence
atgaccgagctgcccgcccccctgagctacttccagaacgcccagatgtctgaagataatcaccttagcaacacggtacgcagccagaatgataaccgggagcggcaggaacataatgacagacgaagcctgggacaccccgagcctctgagcaatggccgtcctcaaggtaattctagacaagtggtggaacaggatgaggaagaagatgaagagctaaccttaaagtacggcgccaaacacgttattatgctctttgtgccggtgaccctgtgtatggtagtggtggttgccactataaaaagcgtatccttttacactcgcaaggacggtcaactgatttacaccccatttaccgaggatactgagaccgttgggcagcgcgccctgcactcaatcctgaacgccgctatcatgatctcggtgatcgtagtcatgacaatactgcttgtggtgctctataagtacagatgctacaaagtgatccatgcgtggttgattattagctccttattactgctgttctttttttcctttatttacttgggcgaggtttttaagacgtacaacgtcgccgttgattacataaccgttgccttgctgatctggaattttggcgttgttggcatgatctcaatccattggaagggacctttgagacttcagcaggcatacctgatcatgatatcagctttaatggcactggtctttatcaaatacctgccagagtggacagcctggctgatcctcgccgtgatctcagtgtacgatctcgtcgcagtcttatgtcctaagggtcctctgaggatgctggtggaaacagctcaggaacggaatgagaccctcttccccgccctgatttattcatccacgatggtttggctggtgaacatggcagaaggagatccagaggcgcagcgccgcgtgtcaaagaactcaaaatacaatgccgagagcactgagagagagagtcaggatacagtcgcagaaaacgatgacggcgggttcagtgaagagtgggaagctcagcgcgacagccatctgggtcctcacaggagcacacctgaatctagggcagcagtccaggaactgtcttccagcatacttgccggcgaagatcccgaggagcggggagtgaagctgggtctgggcgactttatattctattcagtcctggtgggcaaggcgagtgccaccgctagcggagactggaacacaacgatcgcatgtttcgtagctattctgattggactgtgcttgactcttctcctgttagcaatctttaagaaagccctcccagccctgccgatcagtatcacattcggcctcgtgttttacttcgcgacagattatctcgtgcagccctttatggaccaacttgcatttcaccaattttacatttag

SEQ ID NO: 200606 - DNA, 1137 bp, Artificial Sequence
  Description of Artificial Sequence: Synthetic coding sequence
atgaccgagctgcccgcccccctgagctacttccagaacgcccagatgagcgaggataaccatttgagcaacacggtccgttcccagaacgataatagggagcgtcaggaacataacgatagaagatctttgggacatccagagccactgagtaatgggaggccacagggcaactctcgacaggtcgtggaacaagacgaggaagaagatgaggagctaacgctgaagtacggagccaagcacgtgatcatgctttttgtgccagtcacgctctgtatggtcgttgtggttgcaacgatcaagagcgtgagtttctacacacggaaagacggccagttaatctacacacctttcacggaagacaccgagaccgtggggcagagagctttacactccatcctgaacgctgcgatcatgatctctgtgatcgttgttatgactatactcctggtggtcttgtacaaatatcgctgttataaagtcatccacgcttggctaatcatttcaagcttactactccttttctttttctctttcatatacctgggagaggtgttcaaaacttacaacgtagccgtggactatatcacggtggctctgctaatatggaatttcggtgtagtgggcatgatctctattcattggaaggggcctcttcggctgcagcaagcttacctaattatgatctcggcactgatggccctggtttttatcaagtacctcccagagtggaccgcttggcttattctggcagtgattagcgtatatgacctggtggcagtcctgtgtccaaagggcccgctcagaatgctggtggagacagctcaagagagaaatgagactttattcccagccctaatctacagcagcacgatggtatggctggtgaatatggcagaaggagaccccgaggcacaaaggagagtttcaaagaactcgaaatacaacgcagagcgcgcctgcttgcccccagccgccatcaatctgctcagtattgcccctatggcacctagactgttcatgcctaagggcgcctgcagacccacagcccagaagggcagccataagacgctgttgcaaaggatgatgatggccgggagcgtaagaaatgggaagccaagaggtacggttatctag

SEQ ID NO: 200607 - DNA, 1392 bp, Artificial Sequence
  Description of Artificial Sequence: Synthetic coding sequence
atgaccgagctgcccgcccccctgagctacttccagaacgcccagatgagcgaagataatcatctgagcaacacaaacgacaatcgagagcggcaggaacacaacgacaggaggtcccttggtcatcccgagcctctcagcaacggtcggcctcagggcaacagtcgtcaggttgtagagcaggacgaggaagaggatgaggagctcactctgaagtatggcgcgaaacacgtaataatgctgttcgttccggtaacactttgcatggtagtagtagttgcgacaatcaagagtgttagcttctatacgagaaaagacggccagctgatatacaccccttttactgaagacaccgaaactgtgggccaacgggctctgcacagtattctgaacgcagctatcatgatatcagttatcgtagtgatgacaatactgctcgttgttttatacaaataccgatgctataaggtcatccacgcttggctgataatatctagcctattgctgctgtttttcttctcgttcatttacctgggcgaggtgttcaagacttacaacgtcgctgtggactacattacagtggcccttctgatctggaattttggtgtggtgggtatgatctccatccactggaagggacctctcagacttcaacaagcctatctaataatgatctcagccttgatggccttggtattcattaaatacttgcctgagtggaccgcgtggttaattcttgctgtgatttcggtctatgacctcgtcgctgttctgtgccccaaaggacctctacgtatgctggttgagaccgcccaggagcgtaacgaaactttattccccgctttgatatattcaagcacaatggtctggctcgtgaacatggctgagggtgaccctgaggcacagaggagagtctcaaagaactctaagtataacgccgagagcaccgaaagggaaagccaagatactgttgccgagaatgacgatgggggcttttcagaggaatgggaggcccagcgcgacagccacctgggaccacacagaagcacacccgagtccagggcagcagtccaagaactgagctccagtatactggcaggggaagatcctgaggaacggggcgtaaaactcggcttgggcgactttatcttttattcggtgcttgtggggaaggcctctgccactgcatccggcgactggaataccacaattgcatgcttcgtagctatcctcattggcctctgtctaaccttgcttctgcttgccattttcaagaaggcccttcctgctttacccatctctatcacctttggactcgttttttacttcgccaccgattatctggtgcagcccttcatggaccagctggcctttcatcagttttacatctag

SEQ ID NO: 200608 - DNA, 555 bp, Artificial Sequence
  Description of Artificial Sequence: Synthetic coding sequence
atgaccgagctgcccgcccccctgagctacttccagaacgcccagatgagcgaagataaccacctgtctaataccgtgcgctcacagaacgataatcgcgagcgccaagaacacaacgatcgtcggagtcttggacacccagaacctctctcgaacggtagaccacaaggaaactctcgccaagtggtggaacaggatgaggaagaggacgaggagctgacgcttaaatacggcgcgaaacacgttatcatgctgtttgtgcctgtgactctgtgtatggttgtcgttgttgctacaataaagtccgtcagcttttataccagaaaggatggccagctgatctacactcccttcactgaggacaccgagactgtaggccaaagggctctgcatagcattctcaacgctgctattatgatatccgtgatagtggtgatgacaattcttttggtggtgctgtacaagtacagatgttacaaagtttccatgcggcacaggagtctactgtccactctcttcttcttgtggctcggcatcctcgttaccgtaacctag

SEQ ID NO: 200609 - DNA, 1392 bp, Artificial Sequence
  Description of Artificial Sequence: Synthetic coding sequence
atgaccgagctgcccgcccccctgagctacttccagaacgcccagatgtcagaggataatcaccttagcaataccaatgataatagagaaaggcaagaacacaatgaccgtcgctcactgggtcatccagaaccactgtccaacggccgaccccagggcaacagccgccaggtcgtggagcaagacgaggaggaggatgaggaattgactctcaaatacggggcaaagcacgtcatcatgttgtttgtcccagtcacgttgtgtatggtggttgtcgtcgcaactattaagtctgtaagcttttacaccaggaaggatggccagcttatttacacacccttcaccgaggatactgagacagtcggacaacgggctttacactccatcctcaacgcagctattatgatttctgttatcgtggtaatgaccattctcctggtggtgctctacaagtaccggtgttacaaagtgatccatgcctggctgatcatctccagcttgctgctgctgtttttcttcagtttcatctatctgggcgaagtatttaagacctacaacgtcgcggtggattatatcaccgtggccctgcttatttggaacttcggcgtggtaggaatgatctcaatacattggaagggcccgctgagactgcagcaagcctatcttattatgattagcgcactgatggcgttagtttttattaaatacctgcccgagtggaccgcctggttgatccttgctgtaatcagcgtttatgacctggtggcggttctgtgtcccaaagggcccctccgaatgttggtcgagaccgcccaggagaggaacgagacactctttcctgcgctcatctactcaagtacgatggtctggcttgtcaatatggccgagggagaccccgaggctcagaggcgcgtgagtaagaatagcaaatataacgcagagtcaaccgagcgagagtcccaagacactgtcgcagagaacgatgacggcggcttttcggaagaatgggaggcgcaaagagactctcatctgggaccccatagatcaacacccgagtcacgcgccgcagtccaagagctcagctcaagcatcctggctggagaggaccctgaggagcgtggggtcaagctgggcctgggagacttcatcttctacagcgtgttggtggggaaggcttcggccaccgctagcggagactggaatacaactattgcgtgctttgttgcaatcctcatcgggctctgtctgaccttgcttttactcgcaatatttaaaaaggcccttcctgccctgcccatcagcatcacttttggcttggtgttctactttgctacggactacctggttcaacccttcatggaccagttagcctttcaccagttttacatctag

SEQ ID NO: 200610 - DNA, 279 bp, Artificial Sequence
  Description of Artificial Sequence: Synthetic coding sequence
atgaccgagctgcccgcccccctgagctacttccagaacgcccagatgtccgaggataatcatctgagcaacactaacgataatagggaacgccaagaacataatgatcgacgtagcctcgggcaccccgagccgctcagcaacggacggccacagggcaattcaagacaggtagttgagcaggacgaagaagaagatgaagaactgacattgaaatatggcgctaagcacgtcatcatgctatttgtccctgtgactctctgcatggttgtggtgtag

SEQ ID NO: 200611 - DNA, 444 bp, Artificial Sequence
  Description of Artificial Sequence: Synthetic coding sequence
atgaccgagctgcccgcccccctgagctacttccagaacgcccagatgtctgaagacaaccacctatccaatacaaatgacaacagagagaggcaggagcacaacgacaggcgcagcctgggccacccagagcccctttctaacgggaggccacagggcaattctagacaggtcgtcgagcaggacgaggaggaagatgaagaattaactctcaaatatggcgccaaacacgtgataatgctgttcgtaccagtgaccttatgcatggtggtggtggtcgcaaccatcaagtccgtctctttttatacgcgcaaggacggtcagttgatttatacacccttcacggaggacacggagaccgtcgggcagcgtgccctgcacagtattctaaacgctgcaataatgataagcgtgatcgtcgtgatgactattcttttggtctag

SEQ ID NO: 200612 - DNA, 330 bp, Artificial Sequence
  Description of Artificial Sequence: Synthetic coding sequence
atgaccgagctgcccgcccccctgagctacttccagaacgcccagatgtccgaagacaatcacctttccaacactgtcaggtcacagaatgataatcgggagcgccaagaacacaacgaccgaaggtctttggggcatcccgaacccctgtctaacggtcgaccgcagggcaacagcaggcaagttgtggaacaagacgaagaagaagacgaagaacttacccttaaatatggggccaagcacgttatcatgctgtttgtccctgtcacactttgtatggtggtagtagtcgccacaatcaagtccgttagtttttacacccgcaagtag

SEQ ID NO: 200613 - DNA, 468 bp, Artificial Sequence
  Description of Artificial Sequence: Synthetic coding sequence
atgaccgagctgcccgcccccctgagctacttccagaacgcccagatgagtgaagacaatcacctgtcgaacacagtgcggtctcaaaacgacaaccgtgagcgccaagaacacaatgaccgccgctcgttaggccatccagagccgctgtccaacggccgaccccaggggaattctcggcaagtagtggagcaggacgaagaggaagacgaagagctcaccctcaaatatggtgctaagcacgtcataatgctgttcgtccctgtgacactttgtatggtggttgtggtggctacaattaaaagcgtatccttttatacacgtaaggatggtcaattgatctacactccattcacagaggacaccgaaacagtgggacagagagctttacactctatcctgaacgctgctatcatgatctctgttatcgttgtgatgacaatactcctggtggttctgtataagtag

SEQ ID NO: 200614 - DNA, 177 bp, Artificial Sequence
  Description of Artificial Sequence: Synthetic coding sequence
atgaccgagctgcccgcccccctgagctacttccagaacgcccagatgtccgaagataaccacctgtcgaacacaaacgataacagggagcgccaggaacacaacgaccggaggtctctcggccacccagaaccattgagcaatggacggccacagggtaacagtcgacaagtttag

SEQ ID NO: 200615 - DNA, 279 bp, Artificial Sequence
  Description of Artificial Sequence: Synthetic coding sequence
atgaccgagctgcccgcccccctgagctacttccagaacgcccagatgagtgaggacaaccacctctcaaacaccaatgacaaccgggaacggcaggagcacaatgaccggagatcccttgggcaccccgagccactgtctaatgggagaccccagggtaatagtcgccaggttgttgagcaagacgaagaggaggatgaagagctgacattgaaatatggcgcaaagcacgtcatcatgctgtttgttccagtaacattatgcatggtggtggtgtag

SEQ ID NO: 200616 - DNA, 192 bp, Artificial Sequence
  Description of Artificial Sequence: Synthetic coding sequence
atgaccgagctgcccgcccccctgagctacttccagaacgcccagatgtcagaagacaaccatctgtctaatacaaacgataaccgggagcgacaggagcacaatgacaggcgcagcctaggacatcccgaacccctgagtaacggtcggccacaaggcaatagcagacaggtcgtggagcaggacgaatag

SEQ ID NO: 200617 - DNA, 276 bp, Artificial Sequence
  Description of Artificial Sequence: Synthetic coding sequence
atgaccgagctgcccgcccccctgagctacttccagaacgcccagatgagtgaagataatcatctgtcaaacacgaacgacaatcgggagcgccaggagcacaatgacagaaggagcttggggcaccctgagccattatcaaatggcagaccgcaagggaactctaggcaagttgtggagcaggatgaagaggaggacgaagaactaaccctgaagtatggtgcaaagcacgttattatgcttttcgtcccagttacgctctgcatggtcgtgtag

SEQ ID NO: 200618 - DNA, 189 bp, Artificial Sequence
  Description of Artificial Sequence: Synthetic coding sequence
atgaccgagctgcccgcccccctgagctacttccagaacgcccagatgagcgaggacaatcatttgtccaacaccaacgataatagagagaggcaggagcacaacgacagacgcagtttaggccatccggagccactctcaaatggacgtcctcagggcaacagtcgccaagtggtggaacaggactag

SEQ ID NO: 200619 - DNA, 300 bp, Artificial Sequence
  Description of Artificial Sequence: Synthetic coding sequence
atgaccgagctgcccgcccccctgagctacttccagaacgcccagatgtctgaggataaccatctatcaaacactgtgcggtcgcagaacgacaatcgggagcgtcaagaacataacgacagacgttctctcggacaccctgagcctctctccaacgggcggccccagggaaactctaggcaggtggttgagcaggatgaagaagaggacgaggaattaaccctgaagtacggcgcaaaacatgtaataatgttgttcgttccggtgactttatgcatggtggtagttgtggccacgtag

SEQ ID NO: 200620 - DNA, 408 bp, Artificial Sequence
  Description of Artificial Sequence: Synthetic coding sequence
atgaccgagctgcccgcccccctgagctacttccagaacgcccagatgagcgaagacaatcacctaagtaacaccaacgacaatagggaacgtcaggagcataatgacagacgatcccttggccacccagagccattgagcaacgggcggccccagggcaattcaagacaggtcgtggaacaggatgaagaggaagacgaggagttaactctgaagtacggagcgaagcatgtcatcatgcttttcgtacctgtcactctgtgtatggtggttgtggtagctacaatcaaaagtgtgtctttctatactcggaaggacggccaacttatctacacaccatttaccgaggacacagagacagtgggccagcgcgctctccattctattttgaatgccgcaatcatgtag

SEQ ID NO: 200621 - DNA, 330 bp, Artificial Sequence
  Description of Artificial Sequence: Synthetic coding sequence
atgaccgagctgcccgcccccctgagctacttccagaacgcccagatgagtgaagacaaccacttgagcaacaccaacgacaaccgtgagaggcaggaacataatgatagacgatctttgggccatcctgagcctctctccaacggacggccacaggggaattcccgacaggtggtggagcaggacgaggaggaagacgaggagctgaccctgaaatacggggccaaacacgttataatgctatttgtcccagtgacgctgtgcatggttgttgttgtggcaaccataaaatctgtttcattttacacacgcaaagacggccaattatag

SEQ ID NO: 200622 - DNA, 1248 bp, Artificial Sequence
  Description of Artificial Sequence: Synthetic coding sequence
atgctgaccttcatggccagcgacagcgaggaggaggtgtgcgacgagcggacttctttgatgtctgccgagtcccctacaccacggtcttgccaggagggccgccaaggccccgaagacggcgaaaataccgcccagtggagaagccaggagaacgaagaagatggcgaggaggacccggatcggtacgtgtgtagtggagtcccggggaggccccctggactggaggaagagctgacactgaagtacggagccaagcatgttataatgctctttgtccccgtaaccctttgtatgattgttgttgttgcaactatcaaatccgtccgattttacacagaaaagaacggccagctcatttacaccccttttactgaggacacccccagcgttggacagaggctgctgaattcggtgctgaacacgctgatcatgatttctgtcattgtagttatgaccatcttcctcgtggtgctttacaaatatagatgctacaaattcattcacggctggctcattatgtctagcctcatgctgctattcctcttcacatatatttatctaggtgaggttctaaaaacttataacgtagcaatggattaccctactctgttgctcaccgtatggaattttggcgcggtagggatggtttgcatccactggaaggggcctttggtgctgcagcaggcctacctgattatgatatcagcgctaatggcactcgtttttataaagtacctgcccgagtggagcgcatgggtgatactcggtgccatcagtgtgtatgctgcaatggtgtggaccgtgggaatggccaaactggacccatcatctcagggagcacttcagctgccctatgatcctgagatggaagaagacagctacgactcctttggtgaacccagttatccggaggtctttgaacccccgctgacaggatatcctggtgaggagcttgaggaggaggaggaaagaggtgtaaagttgggtctaggggactttatcttttacagtgtgttggtcgggaaagctgcagccactggaagcggggattggaacaccacactagcttgtttcgtggctatcctcatcggactgtgtctcacacttctcctgctggccgtctttaagaaagctcttcctgccctgcctatcagtatcactttcggtctcatcttttacttctcaaccgataacctagtgagacctttcatggacaccctggcttcccaccaactgtacatctag

SEQ ID NO: 200623 - DNA, 1446 bp, Artificial Sequence
  Description of Artificial Sequence: Synthetic coding sequence
atgctggccggcaccgtgcggttcgcccggcactgcctgaagttcttcccagctcagaaaccagcctgtgtcgacttcggcgcaagtaggggcagggccatgctaacctttatggcatccgactctgaagaggaggtgtgcgacgaaagaacgtcgttaatgtctgccgaatccccgacgccacggagctgtcaagagggacggcagggacctgaagacggggaaaatacggcacagtggaggagtcaagaaaacgaagaggacggagaagaagatccggaccgctatgtatgttccggtgtcccaggccgtccgcctgggcttgaggaagaactcacgctgaaatacggggccaagcatgtcataatgctcttcgttcctgtcacactgtgcatgatcgttgttgttgctactattaagtcagttaggttttacacggagaagaacgggcaactgatctacaccccatttacggaggatactcctagcgtgggtcagagactactaaactctgtcctgaatacacttatcatgatcagtgtgattgtggtcatgaccatctttttggtcgtcctctataagtatcgatgctacaaatttatccatggatggctgattatgagttccctgatgctactgttcctatttacatacatctatctgggagaggtcctcaaaacttacaacgttgccatggattaccctaccctgctgctgactgtgtggaatttcggtgcagtcgggatggtctgcattcactggaaaggaccgctagttttacagcaggcttatctaattatgattagcgctttgatggccctagtctttattaagtacttacccgaatggtcagcttgggttattctgggcgcaatttccgtttatgatttggtagccgtgctttgccccaaggggcctttgcgcatgctggtcgaaacagcccaggaaaggaatgagcctatctttccggccctgatttatagtagcgcaatggtctggacagttggcatggcgaagcttgatccttcatcccaaggagcactacagctaccctacgatccggaaatggaagaagactcctatgattccttcggcgagcccagctatcctgaggtctttgaaccacccctgactggctaccctggtgaagagctagaagaggaagaagaaagaggtgtgaaacttggcctcggagacttcattttctacagtgtcctcgtgggcaaggcggccgcgactgggtcaggcgattggaatacaactctggcctgctttgtcgcgatccttatcggtctctgtctgacgctgctgttgttagcagtgtttaaaaaggccctccccgcactgcctatctcaattacatttggtctgattttctactttagcaccgacaacctggtgagaccttttatggacacccttgcatcacaccagctctacatatag

SEQ ID NO: 200624 - DNA, 1347 bp, Artificial Sequence
  Description of Artificial Sequence: Synthetic coding sequence
atgctgaccttcatggccagcgacagcgaggaggaggtgtgcgacgaacgcacctccctgatgtcagcggaaagtccaaccccacggagctgtcaggagggtcggcagggtccagaagatggagagaacaccgcacagtggcggtctcaggagaacgaggaagatggcgaggaggaccctgaccgttacgtttgcagcggagtgccaggtcggccgccagggctggaagaagagctcactctgaagtatggcgctaaacatgtgatcatgctgtttgtgcccgtgactttatgtatgattgtagtggtcgccacaatcaagtcagtccggttctacaccgaaaagaatggacagctaatctatacccctttcactgaagataccccgagtgttggacagaggcttctgaattctgttctaaatacccttatcatgatcagcgtaattgttgttatgacgatcttcctggtggtcctctataaatatagatgttacaagttcattcacgggtggttgataatgagctctcttatgctgctgtttcttttcacatacatctacttgggggaggtcttgaagacatataatgtcgccatggattatccaaccctgttactcaccgtgtggaatttcggcgctgtaggaatggtctgcattcactggaaaggcccgctcgtactgcagcaagcgtacttgataatgatctctgcactgatggcgctggtatttatcaaatacctgcctgagtggagcgcttgggtgatactgggtgctatcagcgtgtacgacctcgtggctgtgctttgtccaaaaggaccattgagaatgctcgttgagacagctcaggagcgcaacgaaccgattttcccagccctgatttactcgtctgccatggtgtggactgttggcatggccaagctggacccttcctcacagggagccctgcagcttccatatgaccctgaaatggaagaggactcatacgatagctttggggagccttcctaccctgaggtattcgagccaccactaactgggtacccgggcgaggagctcgaggaagaggaggagcggggtgttaagttgggtctgggggacttcatcttttatagtgtactcgtcggcaaagcggccgccaccggcagtggcgattggaatactaccttggcgtgtttcgttgcaatcctgattggcctgtgtcttaccctcctgcttctcgcagtctttaaaaaggctcttcctgctcttcctattagcatcacgtttggtctgatcttctatttcagtaccgataacctcgtacggccttttatggacactctagcgagtcaccagctttacatttag

SEQ ID NO: 200625 - DNA, 1446 bp, Artificial Sequence
  Description of Artificial Sequence: Synthetic coding sequence
atgctggccggcaccgtgcggttcgcccggcactgcctgaagttctttcctgcacagaagccggcctgtgtcgattttggagctagcagaggccgagctatgttgacgtttatggcctccgattctgaggaagaagtgtgcgacgagcggacgtcactcatgagcgctgaaagccctacgcctcgcagttgccaggaggggcgccaggggccagaagatggggagaacaccgcgcaatggagaagccaggaaaacgaggaagatggggaggaggatccagaccgttacgtctgtagtggagtgcctggaagaccacctggtctggaggaagagctaaccctgaaatacggggctaaacacgtcatcatgctgtttgtgcccgtaactctctgcatgattgtggtggtggcaacaataaagagtgtgaggttttataccgagaagaatggccaattaatttatacgcctttcacagaggacaccccttcagtgggacaaagactccttaattccgtcctgaatactctcataatgatatcggtgatcgttgtcatgaccatctttctcgtggtcctgtacaaataccggtgttacaagtttatccatggatggctgatcatgtcttcactgatgctgctgttcctctttacttacatttacttaggggaagtcttgaaaacctataatgtggcgatggattatcccacactgctgctgaccgtgtggaatttcggggctgtgggaatggtctgcattcactggaaaggacccctggttctgcagcaggcctatctcatcatgatatcagctctcatggctctggttttcatcaaatatctgccggagtggagtgcctgggttattctgggtgcgataagtgtgtatgatctggtcgctgtgctgtgccctaaggggcccctcaggatgcttgtcgaaaccgctcaggagagaaacgaacctatttttcctgccctgatttactcgtccgctatggtgtggaccgtagggatggccaagttggatcccagcagccaaggtgctctgcagcttccatatgacccggaaatggaggaggattcgtatgactcattcggcgagccttcgtacccggaggtgtttgagccacctctgacgggatatcccggcgaggagctggaggaagaggaggagaggggcgttaagctgggactgggagatttcatattctacagtgtattggtgggaaaggctgccgccaccggcagcggagactggaacaccaccttagcgtgtttcgtggccattctgattggtctttgcttgacccttttgttgctagccgtgtttaagaaggcactgcctgccctaccaatctctattaccttcggcctgattttctacttctcaaccgataatttagtgcggcctttcatggataccctcgcgagccaccagctatatatttag

SEQ ID NO: 200626 - DNA, 1344 bp, Artificial Sequence
  Description of Artificial Sequence: Synthetic coding sequence
atgctgaccttcatggccagcgacagcgaggaggaggtgtgcgacgaacgcacttccctcatgagcgcggaaagcccaacccccaggtcctgccaggagggccggcagggccccgaggatggagagaatacggcccaatggagatctcaggagaacgaagaagacggcgaagaggatcccgaccgatatgtgtgctctggggtgccgggcaggccaccaggactggaagaagaactcactttgaagtacggagctaaacatgtgatcatgctgtttgtgccagtcaccctgtgcatgatcgtggtggttgcaactattaaatccgtgcggttttatacggaaaagaatggacaattaatctacacacccttcacagaagatacgccaagcgtggggcagaggctgttgaactcagtgctcaatactctcatcatgatatccgtaatcgttgtgatgaccatctttctggtagtgctctataagtatcggtgctataagttcattcatggctggctgataatgagtagtctgatgctgctgttcctctttacctacatttacctgggcgaagttttgaaaacttacaacgtcgcaatggattaccctactctcttgcttaccgtctggaacttcggagccgtgggcatggtctgcattcattggaaaggccccctggtgcttcagcaggcatatctgatcatgatttcggccctgatggctctggttttcattaaatacctgccggagtggagtgcctgggtgattcttggggctatctccgtctatgatctcgtggccgttttatgtccaaaagggccacttagaatgttagtcgagactgcgcaagagcgaaatgaacccatttttcctgccttgatctactcctccgcaatggtgtggacagtaggaatggccaaactggacccctctagccagggcgccctgcagttgccttatgaccctgagatggaggattcatacgattccttcggcgaaccttcatacccggaagtattcgaaccacctctgacaggatatcccggcgaggaactggaagaagaagaggaacgaggagtgaaactgggtctaggggacttcattttctacagcgtgcttgttgggaaggctgcagccacgggttcgggcgactggaacacgaccctggcctgtttcgttgccattctgatcggtctttgcctaaccctcctcctcctggccgtttttaagaaggccctcccagcactccccataagtattaccttcggactgattttctacttcagtactgataatctggtgagaccctttatggatacactggcgtcacaccaactctatatctag

SEQ ID NO: 200627 - DNA, 390 bp, Artificial Sequence
  Description of Artificial Sequence: Synthetic coding sequence
atgctgaccttcatggccagcgacagcgaggaggaggtgtgcgacgagcgcacgagtcttatgtcagccgagagcccaacccctcggtcctgccaagaggggcgccaaggcccagaagacggcgaaaacaccgcacaatggcgcagccaggagaatgaggaggacggagaggaagatcctgacaggtacgtgtgtagcggagtgccaggtaggccacccgggctggaagaggagctcaccttgaaatacggcgcaaagcacgttatcatgctgtttgtgccagtcactctttgcatgattgtggtagtagccaccatcaaatccgttcgattctacactgaaaagaacggacagttaatatataccccttttacagaagacacaccatag

SEQ ID NO: 200628 - DNA, 66 bp, Artificial Sequence
  Description of Artificial Sequence: Synthetic coding sequence
atgctgaccttcatggccagcgacagcgaggaggaggtgtgcgacgagagaactagccttatgtag

SEQ ID NO: 200629 - DNA, 990 bp, Artificial Sequence
  Description of Artificial Sequence: Synthetic coding sequence
atggcctggcggggctgggcccagcggggctggggctgcggccaggcttggggcgccagcgtgggtggacgtagctgcgaagaactcactgcagtactgaccccccctcaactcctcggacgccgttttaacttttttatccagcagaagtgcggattcagaaaggccccgcggaaagtcgagccccgtcggtcagaccccgggacaagcggcgaggcatacaaaaggagcgcgttaattccccctgtagaagagacagtcttctatccgagcccttatcctataaggtccctcatcaagccccttttctttactgtggggttcaccggctgcgcgttcggctccgctgccatctggcaatacgagtctctcaagagtcgcgttcaaagctatttcgatggcatcaaggccgattggctggactctattcgtccacagaaagagggcgactttcgcaaggaaataaacaagtggtggaacaacttgtcggacgggcagaggacagtgactggaattattgccgcaaacgtgctggtcttttgcctgtggcgcgtgccttcactccagcggaccatgattcgttactttacctcaaatccggcgtcttctgtgatctccaacttcgtaagttacgtaggaaaggtggccaccggccgatatggccccagcctaggggctagcggggcaattatgactgtattagccgcggtttgtacaaaaatcccagaagggcggttggctatcatatttttaccgatgtttaccttcacagccggaaatgccttgaaagccattatcgctatggatacggctggtatgatactggggtggaaatttttcgaccatgctgcccacttgggaggagcactgttcggtatttggtatgtaacttatgggcacgaactcatatggaagaatcgggaaccccttgttaagatctggcacgaaattagaacgaacgggcccaaaaaaggcggaggatcaaaatag

SEQ ID NO: 200630 - DNA, 1140 bp, Artificial Sequence
  Description of Artificial Sequence: Synthetic coding sequence
atggcctggcggggctgggcccagcggggctggggctgcggccaggcttggggcgcaagtgtgggggggagaagttgcgaagaactgacagccgtacttaccccacctcaactgctcggcaggaggttcaacttcttcattcagcagaagtgtggatttcgaaaagcgccccgcaaggtggagcctaggcgctccgatccaggcacttcaggggaggcttacaagagaagcgccctaataccacctgtggaggagacggtgttttacccctcaccctaccccattagatcgcttattaagcccctgttcttcacagtcggctttactgggtgtgcatttggctccgctgcaatttggcagtatgaaagtctgaaaagccgtgtacaatcctactttgatgggatcaaagcagattggctagattcaattagacctcagaaggaaggcgattttcgcaaagaaatcaacaagtggtggaacaacctctccgatggccagcggacggtgacagggattatcgcggccaacgtgcttgtgttttgtttgtggagagtaccatcactccagagaactatgatccggtacttcacaagcaaccccgcttctaaagtgctgtgttcccccatgctgctgtctacattcagccatttctcgctctttcacatggcagctaacatgtacgttctgtggtctttctcgagctcaatcgtgaacattctgggacaagagcaattcatggctgtctaccttagcgctggtgtcattagtaactttgttagctacgtcggaaaggtggctactgggcgctacgggcccagtttgggggcttcaggcgcaatcatgactgtgctggctgccgtgtgtacaaagatccccgaagggcgactcgccatcatctttctgccaatgtttacgttcaccgccggcaacgcattaaaggccattatcgccatggacacagctggcatgatactcgggtggaagttctttgatcatgccgctcacctgggcggcgcactcttcggtatttggtatgtgacgtacgggcatgagctgatttggaaaaatagggaaccacttgtcaagatatggcacgaaattagaaccaatggtcctaagaagggcggtggatccaaatag

SEQ ID NO: 200631 - DNA, 663 bp, Artificial Sequence
  Description of Artificial Sequence: Synthetic coding sequence
atggccagcgccaccgacagccggtacggccagaaggagagcagcgatcaaaattttgactatatgtttaaaatcctgatcattggcaatagtagtgtgggtaaaaccagtttcctgtttcggtatgcggatgatagcttcactccggcttttgtgtcaactgttggcattgatttcaaggtcaaaaccatttacagaaacgacaagcggattaagctccagatctgggacacggctggacaggagcggtacagaacaatcactacagcatactacaggggcgcaatggggttcatcttgatgtatgatattaccaatgaagagtcctttaacgcggtgcaggattggtctacacaaatcaagacatacagctgggacaacgcacaagtgttactagtgggaaacaaatgcgacatggaagacgagcgagtggtcagctccgagcgggggagacagttggcagaccatctcggttttgaattctttgaagccagcgccaaggataacataaatgtaaagcagacgttcgagaggctcgtggacgttatctgcgaaaaaatgtcagaatctctcgataccgccgatcccgcggtgaccggagctaaacagggcccacagctgagtgaccaacaagttcctccccatcaagattgtgcgtgttag

SEQ ID NO: 200632 - DNA, 306 bp, Artificial Sequence
  Description of Artificial Sequence: Synthetic coding sequence
atgaacctggagcgggtgagcaacgaggagaagctgaacctgtgcagaaaatattatcttggcggctttgcattcttaccttttttatggctcgttaatattttttggtttttcagagaggcgtttctggtccctgcttacacagaacagagccagattaaaggttacgtctggcgatctgcagttggattcctgttctgggtcattgtactgacttcctggataacgatcttccagatttatcgtccacggtggggtgcattgggtgattatctttcattcacaatccccctaggaactccctag

SEQ ID NO: 200633 - DNA, 378 bp, Artificial Sequence
  Description of Artificial Sequence: Synthetic coding sequence
atggccaagtacctggcccagatcatcgtgatgggcgtgcaggtggtgggacgtgctttcgccagggccttacgtcaggagtttgctgcgtccagggctgccgccgatgcacgcggacgcgccggccacaggtctgcagccgccagtaacctatcagggctgtcccttcaagaagcccagcagatcctgaatgtgtcaaaactcagtcccgaagaagtgcagaaaaattacgagcacctatttaaggtgaatgataagtcagttggtggctccttctacctgcagagtaaggttgtgcgggcaaaggaacgcctcgatgaagaactgaaaatccaggctcaggaggatcgagagaaagggcagatgccccacacgtag

SEQ ID NO: 200634 - DNA, 2496 bp, Artificial Sequence
  Description of Artificial Sequence: Synthetic coding sequence
atgcccctggagatggagcccaagatgagcaagctggccttcggctgccagaggagcagcaccagtgatgatgattccggttgtgcattggaggagtacgcgtgggtccccccagggttaaggcccgaacagatccagctgtacttcgcttgcctgcctgaggagaaggtcccttacgtgaatagccccggcgagaaacacagaataaaacagctgctataccagctcccaccgcacgacaatgaagtgagatattgccagtcgctgtccgaagaagagaaaaaggaactccaggttttctctgcacagcgcaagaaagaggctttggggcgcggtactatcaagctattgagcagagccgtgatgcacgccgtctgtgaacagtgtggattaaaaatcaatgggggtgaggtcgccgtgtttgcgtcacgggcgggccccggggtctgttggcacccttcttgcttcgtttgctttacgtgcaacgaactgctggtggatctgatctatttctatcaggatgggaaaatccactgcggtcgccaccatgccgagttgctgaagcctcggtgttctgcctgtgatgaaatcattttcgctgacgagtgcacagaggccgaaggcaggcactggcacatgaaacatttctgctgcttggaatgtgaaaccgtgctgggcggtcagagatatattatgaaagacgggaggccattttgctgtgggtgctttgagtccctctatgccgagtattgtgagacatgtggcgaacacatcggagtagaccacgcacagatgacttacgacgggcagcattggcatgcgaccgaggcttgcttctcgtgtgctcagtgcaaggcctccctcctaggttgccctttcctacctaaacagggtcagatttattgctccaagacctgctcactgggggaggatgtccatgccagtgactccagcgattcagcctttcagagtgcacgcagtcgtgattccagaagaagtgtgaggatgggtaagtcctcgcggtctgcagaccagtgccggcagtccttgctcctctcccctgctctaaactacaaatttcccgggctgagcggtaatgcagatgatacgctgagccgcaaactagacgatctcagtctctctcggcaggggactagcttcgcctcagaggaattctggaaggggcgggtcgagcaggaaacgccagaggacccagaagaatgggccgaccatgaagactacatgacacagttattgctcaaatttggagacaagtccctcttccagccccagccaaacgaaatggatataagggcctctgaacattggatcagcgacaacatggttaagagcaagaccgagcttaagcagaacaaccaatcattggccagcaaaaaataccaaagcgatatgtattgggctcagagccaggacggtctgggagactctgcctacggatctcaccctggaccagcgtccagcaggcgactgcaggaactggaactggatcacggcgctagtggctacaatcacgatgaaacacagtggtatgaggacagtcttgagtgcttgagcgatctgaaacccgaacagagtgtgagagacagcatggactcattggctctcagtaatattaccggcgcctccgtcgatggggaaaacaagccgcggcctagcctgtattccctacagaatttcgaagagatggagaccgaggactgtgaaaaaatgtcgaatatgggcactctcaacagctccatgctccacagaagcgcagagagcctgaagtctctgtcaagtgaactgtgccctgagaaaatccttcccgaggaaaaaccagtccaccttccagtactcaggcggtccaaaagccagtcacgtccacagcaagtgaaattttcagatgacgtcattgataatggcaactacgacatagaaattaggcagcctccgatgagtgaaaggacgagacggcgcgtttacaattttgaggaacgggggagtcgatcgcaccaccacaggcgacgacgcagtagaaagtcaaggtccgataatgcactcaacctcgttacagagaggaagtactcacctaaggaccggctccgactgtatacaccggataactacgaaaagtttattcagaacaagtcagctagagagatccaggcttacattcagaacgctgacctttacggacagtatgcccacgccacctccgactacggactccagaaccctggaatgaatcgcttcttgggcctgtacggggaagatgatgatagttggtgtagtagtagcagcagttccagcgatagtgaagaagaggggtatttcctcgggcagccaattccccagccgcggccacaaaggttcgcgtactatactgatgacctgagctctcccccatccgccctccctactcctcagttcggccagagaacaacaaaaagcaagaagaagaagggacacaaaggaaaaaattgcatcatatcctag

SEQ ID NO: 200635 - DNA, 2496 bp, Artificial Sequence
  Description of Artificial Sequence: Synthetic coding sequence
atgcccctggagatggagcccaagatgagcaagctggccttcggctgccaacggtcaagtacaagtgacgatgacagcggctgcgcgctcgaggaatatgcttgggtgccgccagggctcagaccagaacagatccagctgtattttgcatgcctgcccgaggagaaagtcccttacgtgaatagccctggtgaaaagcacaggattaaacaactgctgtaccagctcccccctcatgacaacgaggttcgatattgccaatccctgagtgaggaggaaaaaaaagagctgcaggtgttctctgcacagaggaagaaggaagccctggggagaggaactatcaagctgctgtcaagagcggtcatgcacgctgtgtgtgagcagtgcgggttaaagattaatggtggcgaggtggccgtcttcgcaagtagagcaggccctggcgtgtgttggcacccgagctgttttgtttgcttcacttgcaacgagctcctggtcgatttgatctacttttaccaggatggcaagattcattgtggtcggcatcacgccgagttgctgaagcctcggtgtagcgcctgcgacgagatcatattcgccgacgagtgcactgaggctgaaggtcgccattggcatatgaaacacttctgctgcctggagtgtgagaccgtattgggcggacaacgatacattatgaaagacggccgccccttctgctgcggctgctttgagagtctatatgcggaatactgcgagacgtgcggagagcacattggggtggatcacgcacagatgacctatgatggccagcattggcatgccacggaggcctgcttctcatgtgctcagtgcaaggcgtccctcctgggatgtccctttctacccaagcaggggcagatttactgtagtaagacttgctccctaggagaggacgttcatgcatcagacagttccgactccgcctttcagagcgctagaagccgggactccagaaggagcgttaggatgggaaaaagtagtagatcagcagaccagtgcaggcagagtctgctgctgtctccagctttgaattataagttccccggactgtcgggtaatgcagatgatacactgtcaaggaagctagacgatctgagcctgtccaggcaggggaccagctttgcgtctgaggaattctggaagggccgagtcgaacaggaaaccccagaggatccagaggagtgggctgatcatgaggactatatgacacaactattgttgaaatttggcgacaagagcctctttcagccacaacccaacgaaatggatattcgagcttcggagcattggatcagcgacaacatggtaaagtctaagacagagttaaagcagaataatcagagtctggccagtaagaaatatcagtctgatatgtattgggctcaatcccaggacggtctaggggattcagcatatggttcccaccccgggcctgcgagctcccgccggctgcaagagttagaacttgaccatggtgcatccggttataatcacgatgagactcagtggtacgaggattcgctcgaatgtctttcggatctgaaacctgaacaatcggtgagagactctatggattccctggctctatctaacatcactggagcatccgtcgatggggaaaataaaccgcggccctcattgtatagcctgcagaactttgaggagatggagaccgaggactgcgagaagatgtcaaatatgggcaccctcaatagcagcatgcttcatcgatctgcagaatccctgaagtcactcagtagcgagttgtgtcccgagaaaattcttcctgaggagaaacccgtgcatttgcctgtgctgaggagaagcaaaagccagtcgcggccacaacaggttaaatttagtgatgatgttattgacaatggaaactacgatatagagatcaggcagccacccatgtccgagaggacaaggcggcgcgtgtataatttcgaggagagaggatctcgttctcaccatcatagacggaggcgaagcaggaagagccgctctgacaatgccttaaacctggtgactgagagaaaatatagtcctaaagacagacttcggctgtacacaccagataactatgagaaattcattcagaataagtccgcgcgcgagatacaggcatatatacagaatgctgatctttacggccagtacgcccacgccacctccgattatgggctgcagaaccccggtatgaaccgatttttgggattatacggggaagacgatgattcctggtgctccagtagttcttcctctagcgattctgaggaggagggctatttccttggccagccaattcctcaaccaagacctcaaaggtttgcctattacaccgacgacttgtccagtcccccgtccgccctccccacaccccagtttggccagcgtacaaccaaatctaagaagaaaaaggggcataaagggaaaaactgcatcatcagttag

SEQ ID NO: 200636 - DNA, 2496 bp, Artificial Sequence
  Description of Artificial Sequence: Synthetic coding sequence
atgcccctggagatggagcccaagatgagcaagctggccttcggctgtcaaaggtcatctacatcagacgatgactctggatgcgctctggaagagtatgcgtgggtacctcctggtttacggcccgagcagatccaactatacttcgcctgccttccggaagagaaggtgccctacgtcaactcccctggcgaaaagcatagaatcaaacaactgctatatcagttgccccctcatgataatgaagtaagatactgtcagtcgctctcagaagaagagaaaaaagaactgcaagttttttccgcacagagaaaaaaagaggctttggggcggggcaccatcaaactgctgtcccgggccgtgatgcatgccgtttgcgaacagtgtggcctcaaaatcaatggcggagaggtggccgtgtttgcttcaagagctggccctggtgtctgttggcatcccagctgttttgtgtgttttacatgtaacgaactgcttgtggacctcatttacttctatcaggacggaaagattcactgcggcaggcatcacgctgagctgttgaaacctcggtgcagtgcctgtgacgagatcatcttcgctgatgagtgtactgaggctgagggccgacactggcatatgaagcacttctgctgtcttgagtgtgaaacagtgttaggtggtcaacgttacatcatgaaagacggcagacctttctgctgcgggtgcttcgagtctctttacgccgaatattgtgagacatgcggcgagcatattggggttgaccacgcccagatgacctacgatggccagcattggcacgctacggaagcttgcttctcttgtgcgcagtgtaaagccagcttgctgggatgtcccttcctgccgaagcagggccagatttattgctccaaaacctgctcactgggcgaagatgtgcatgcatccgatagctctgactcagcctttcagtccgcacggagccgcgattccaggcgctcggtgcgcatgggaaagagctcccgctcagctgatcagtgccgtcagtctttgctactgtccccagccctcaactacaagttccccggactgagcggcaacgcagacgatacgttaagtagaaagttagatgacttatccctgtctaggcagggcacatcctttgcaagcgaggaattctggaaggggagagtggagcaggaaacccccgaggatccagaggaatgggctgatcacgaggactacatgacgcaattgctgctgaaatttggggacaagagtctgttccaaccacaacctaatgagatggacatacgggcatccgaacattggatcagcgacaacatggtgaagtcgaagacggaactcaaacagaataatcagtctttagcctccaagaaatatcagtctgatatgtattgggcgcagtcacaggatggacttggcgactccgcctatgggtcccatcccggcccggcgagttcccgtcgtctgcaggagctcgaacttgaccacggagcatccggctataatcatgatgaaacccagtggtacgaggatagtctggaatgtttgtctgacttgaaacctgagcagtccgtgcgcgattctatggactctctggcactctcaaatattaccggggcctctgtggatggcgagaataagcccaggcctagtctgtactctttgcagaacttcgaggaaatggagaccgaggactgcgaaaagatgagcaatatggggacccttaatagttccatgctgcaccgatccgccgagagcctgaagagcctgtcatccgagctgtgtccagagaaaatcctccccgaagagaaacctgtgcaccttcccgtgctcagacgttccaaatcacagagcagacctcaacaggtgaaattctcagatgacgtcattgacaacgggaactatgatatcgaaatacgtcagccacctatgtctgagcggaccaggcgtagagtatacaactttgaagagagggggtctcgctctcatcaccacaggcgacgccggtccaggaagtcccgctcagataacgccctgaatttggtcaccgagagaaagtacagtcccaaagatcgactcagactatatacaccagataattatgaaaagtttatccagaacaagtccgcgagagagattcaagcttatattcagaatgctgatctgtacgggcagtatgcgcatgctacctcggattacggcttgcagaacccaggaatgaacaggttcctggggctttatggcgaggacgatgatagttggtgctcttcttcctctagcagtagcgattccgaggaagagggttactttctcggacagcctatcccccaaccacggccccaaagattcgcatattacacagatgatttgtcgagccctccgtcagcattgcccacaccacagtttggccagcggaccactaagagtaaaaagaaaaagggacacaagggcaaaaactgtatcatttcatag

SEQ ID NO: 200637 - DNA, 333 bp, Artificial Sequence
  Description of Artificial Sequence: Synthetic coding sequence
atgcccctggagatggagcccaagatgagcaagctggccttcggctgtcagcggagcagtacaagcgacgacgatagtgggtgtgccttagaggagtatgcctgggttccacccggcctgcggcccgagcagatccaactgtattttgcttgcttgcctgaagagaaagtgccgtacgttaacagccccggagagaaacatcgaattaaacagctattatatcagctcccaccacatgataacgaagtgcgctactgtcaatctctgtcagaagaggagaaaaaagagttgcaagtttttagcgctcagcggaaaaaagaagcgctcggctag

SEQ ID NO: 200638 - DNA, 2496 bp, Artificial Sequence
  Description of Artificial Sequence: Synthetic coding sequence
atgcccctggagatggagcccaagatgagcaagctggccttcggctgtcagcgtagcagcacatcagacgacgactctggctgcgcactggaagagtatgcttgggtgccacctggtcttcggcctgagcagatccaactctatttcgcctgtttgccggaggaaaaggtgccctacgtgaattcaccgggagagaagcacaggatcaagcagctgctctaccaactgcctccccacgacaacgaagtcaggtactgccagtctttgtcggaggaagaaaagaaggagttgcaggtgttcagcgcccagagaaaaaaggaggctctgggacgcggtaccattaagctgctttcccgcgccgtgatgcacgccgtctgtgagcaatgtggactgaaaatcaacggtggagaggtagccgtgttcgcatctcgcgccggcccgggggtgtgttggcacccctcgtgcttcgtgtgttttacctgcaatgaactcctcgtcgatctgatctacttttaccaggatgggaagatccactgtggcaggcatcacgctgaactgttgaagcctaggtgttctgcctgtgacgaaatcatcttcgccgacgaatgcaccgaggccgaaggaagacattggcatatgaagcatttttgttgcctcgaatgtgaaaccgtgctgggggggcagcggtatattatgaaggacgggcgacctttttgttgtgggtgttttgaatccctttacgccgaatattgcgagacgtgtggtgaacacattggtgtggaccacgcccagatgacctacgatggacagcactggcacgctaccgaagcatgcttcagttgtgcccagtgtaaggcttccttactcgggtgcccctttttgcccaagcagggtcagatctattgctccaagacatgctccctcggcgaggacgtccacgcctcagacagtagtgactcagcatttcagtcagcccggtctagggacagccgtcgaagcgtgaggatgggcaaatcgagtcgaagtgccgatcagtgcaggcagtcgcttctcctctctccagcgttgaattacaaatttccagggctgagcgggaacgccgacgatacattgagtcggaagctcgacgacctgtccctcagtcgccagggcacttcatttgccagcgaggaattttggaagggccgggtcgaacaggaaactcccgaggatccagaggagtgggctgatcacgaagattacatgacccaattgctgcttaaatttggcgacaagtccctgtttcagccacagcctaatgagatggacatccgagcctccgagcattggatttctgataacatggttaaaagtaaaacggagctgaaacagaataaccagtcactggcatcaaagaaataccaatcagacatgtattgggcacagtcgcaggacggtctgggggacagcgcctatggttcccatccaggccctgcatcctcgaggcggctgcaggagttggaactggaccatggcgcttccggctataatcacgacgagacccaatggtatgaggactccctggagtgtcttagtgatttaaaacccgagcagagcgtgagagacagcatggatagcttagcgctgtctaacatcaccggcgcctcagtggatggagaaaacaagccccgtccctctctgtactccctgcagaacttcgaagaaatggagaccgaggattgcgagaaaatgagcaacatgggaacccttaattcttcaatgctccacaggtccgctgaatcactgaaatctctttcttccgagctctgtcctgaaaaaattctccctgaagagaagcccgtgcaccttcctgtcctgagacggtccaagtctcagagtagacctcagcaggttaagttctccgatgatgtgatcgacaacggaaactacgacattgaaatccggcaaccccctatgagtgagcgtacacggaggcgcgtgtacaactttgaagagcgcggaagccggtcacaccaccatcggagacgtaggtctcggaaatccaggagcgataacgctctcaacctggtgaccgagagaaaatactcccccaaagaccggttgcggctatacactcccgataactatgaaaagtttatacagaataaatctgcgagggaaattcaggcctacatccaaaacgcagacctgtacggccagtatgcacatgccacaagtgattacggcctgcagaacccaggcatgaataggttcctggggttatatggtgaagatgatgactcctggtgctcatcgtcctcctcttcatcagacagcgaggaggaaggttattttctggggcaaccaatcccgcagccccgtccacagcggttcgcatactacacagatgatctatcgtcccccccctctgccttgcccactcctcagtttggacaaagaaccaccaaatcgaaaaagaagaaaggccacaagggcaagaactgcatcattagctag

SEQ ID NO: 200639 - DNA, 360 bp, Artificial Sequence
  Description of Artificial Sequence: Synthetic coding sequence
atgcccctggagatggagcccaagatgagcaagctggccttcggctgccagcgctcctccacaagtgacgacgactccggctgtgctctagaggagtatgcctgggtccctccgggactgaggcccgagcagattcagctatactttgcttgtctccccgaggaaaaagtcccctacgtgaatagccccggagaaaaacatcgcatcaaacagttgctgtatcagctgcccccacacgacaatgaagtccgttattgccagtccttaagtgaagaggaaaaaaaagaactgcaggtcttctctgcacagcgaaagaaggaggccctgggccggggcaccattaagctgctgagcaggtag

SEQ ID NO: 200640 - DNA, 480 bp, Artificial Sequence
  Description of Artificial Sequence: Synthetic coding sequence
atgcccctggagatggagcccaagatgagcaagctggccttcggctgtcaacgaagttccacgagcgacgatgattccggttgtgctctggaggagtacgcctgggtaccccccgggctgcgtcccgaacaaattcagctctatttcgcctgtctccctgaagagaaggtaccttacgtcaactcgcctggcgagaagcaccgcatcaagcagctgctataccagctcccaccacacgacaacgaagtacgttactgccagagccttagcgaggaggagaaaaaggaactgcaagtattctccgcccaaagaaagaaggaagccctggggagaggaactatcaaacttctgagccgagctgttatgcatgcagtgtgtgagcagtgtgggctgaaaattaacggaggggaggtggccgtgttcgcctcccgagctggaccgggagtatgctggcatccttcttgttttgtgtgcttttag

SEQ ID NO: 200641 - DNA, 2496 bp, Artificial Sequence
  Description of Artificial Sequence: Synthetic coding sequence
atgcccctggagatggagcccaagatgagcaagctggccttcggctgccaacgttccagcacctctgacgatgactcagggtgcgcacttgaggagtacgcctgggtgcctcctggcctacggcccgagcagatccaattgtactttgcatgtctgcctgaggagaaggtgccctatgtcaattcccccggtgagaaacatcggatcaagcagctcctgtaccagctgcctccacacgacaacgaggtgagatactgccagagcctgtcagaggaggagaaaaaagagctgcaagtcttcagcgcccagcggaagaaagaagccttaggccgagggactataaaattactttctcgcgcagtcatgcatgccgtgtgtgagcagtgtggcctcaaaatcaatgggggcgaagttgccgtattcgcaagcagggctggacctggggtgtgctggcatccgtcttgttttgtgtgttttacttgtaatgaacttctggtggacctcatctacttctatcaggatggaaagatccactgcggaagacatcatgccgagctgctgaagcctcggtgctcagcctgtgatgagatcatttttgctgatgagtgcacagaggctgaagggcgtcactggcacatgaagcatttctgctgtctggaatgcgagaccgttcttggaggccaaaggtacataatgaaggacgggaggcccttttgttgtgggtgttttgagtcgctgtacgcggaatactgtgaaacttgtggcgaacacataggcgtcgatcacgcgcagatgacctatgatggccagcattggcatgccacagaggcctgtttttcatgcgcccagtgtaaagcatccctgctcggctgtccttttctccccaaacagggccagatatattgttccaagacctgttccctgggcgaagacgtccacgcatccgactcatccgactccgctttccagtcagccaggtctagagactcccggcggagcgtgcgcatgggaaagtcctcaagaagcgcggatcaatgtcggcagagtctcctgctgtctccggctctcaattataagttcccgggactgtctggaaacgcagacgacaccttaagtcgcaaactggatgatttgtctctgagtcgccagggtacttcctttgcttccgaggaattctggaaggggcgggtggaacaagagacgcctgaggacccggaagagtgggcagaccacgaggattacatgacccagctgctgctcaagttcggcgacaagtcacttttccaaccacaaccgaacgaaatggacatcagggcatctgaacattggatcagtgataatatggtgaagagcaaaaccgagctcaaacagaataatcagagtctggcctccaagaaatatcaaagtgacatgtattgggctcagtcgcaggacggactgggcgacagcgcctacgggtctcaccctggaccggctagctctcgaaggctgcaggagctcgagttggaccatggagctagtggatacaaccatgacgaaactcaatggtacgaggacagcctcgaatgcctgagcgacttgaagcccgaacagtccgtgcgcgattctatggactcactcgctctgtccaatatcactggggctagtgtggatggcgagaacaaacctagaccttctctttactctctgcagaactttgaagaaatggaaaccgaggattgcgagaagatgagcaatatggggacactcaacagcagcatgctgcacagatctgccgagagtctgaagtccctcagctctgagctctgtccggaaaaaatactgcccgaggagaaacccgtccatttacctgtgttgagaaggtctaagagtcagtctagaccacagcaggttaagttcagtgacgatgtgattgataacggcaattacgatatagaaatccgccagccacccatgagcgagcgcacgagaagacgtgtttataactttgaggaaagggggagccgttcccatcatcaccgtagacggcgatcccgtaaatctcggagcgataacgccctaaacctcgtcacagagcgaaaatattcccccaaagatcggctgcgtttgtacacccctgataattatgagaagtttattcaaaacaagagcgcccgggagatacaagcttatattcagaacgcggatctgtacggccaatacgcacacgccacttccgactacggcctgcaaaatcctgggatgaacagatttctcggcctctatggggaggatgacgactcctggtgttcctcgagctccagcagtagcgatagcgaagaagaaggctactttctaggacagccaatcccccagcctcggcctcagaggtttgcctactatactgacgacctgtcctccccgcccagtgcgcttccaacaccgcagtttggacaacgcactactaagtccaaaaagaagaaaggacataaaggcaagaattgtattattagctag

SEQ ID NO: 200642 - DNA, 2535 bp, Artificial Sequence
  Description of Artificial Sequence: Synthetic coding sequence
atggtgaccgtgatgcccctggagatggagaagaccatcagcaagttgatgttcgactttcaacgcaactctaccagcgacgatgactctggatgcgctctggaagagtatgcctgggtgccgcctggactgaagccagagcaggttcaccagtattacagctgcctgcccgaggagaaagttccctatgtcaacagcccgggcgagaaactgcgaatcaagcagctgctgcatcagctgcctccccatgacaatgaggtcagatattgcaatagcctggatgaagaggagaagagagaactcaaattgttctctagccagaggaagcgagagaatttggggagagggaacgtaagaccgttccccgtgacaatgacgggtgccatctgtgagcagtgtggtggtcagatcaacggcggcgacatagctgtttttgcctcccgcgctggccacggcgtatgctggcatccaccttgttttgtatgtacagtgtgcaacgagctgctcgttgacctgatttacttctaccaggacggtaagatttattgcggacggcaccacgcagaatgcctaaagcctcggtgtgctgcctgtgacgagattatattcgctgatgaatgtaccgaggcagaaggcaggcactggcacatgaaacacttttgctgcttcgaatgtgagactgtactgggcggtcagaggtatatcatgaaagaagggaggccatattgttgccactgtttcgaatccctgtacgctgagtattgcgatacctgcgcccagcacatcgggatcgaccagggccagatgacctatgacggtcagcattggcacgcgaccgaaacttgcttctgttgtgcgcattgcaagaagtcactgctggggaggccgttcctgcccaagcaggggcagatcttttgctcccgcgcgtgcagcgctggcgaagatcccaacgggtctgatagttccgacagtgcttttcagaacgcccgagcaaaagagagtcgcagatctgccaaaattggaaagaacaagggcaagaccgaggagcctatgttaaaccagcacagtcagctacaggtgagctctaatcggctgtcagccgacgtggaccctctttcgctgcagatggatatgctgtcattgtcatcccagactccatctctcaatcgagaccccatctggcggagtcgcgaagagccataccattacggtaataaaatggagcagaaccagacacagtctcctctgcagctactttcacagtgcaacatccgcacaagttattctcctggtggacaaggtgcgggggctcagcccgaaatgtgggggaagcacttctccaaccctaagcggagcagctcccttgcgatgaccgggcatgcaggcagtttcattaaagagtgtagggaggactactatccgggccgccttcgcagtcaagagagctattcagacatgagttcccagtctttttcagaaacccggggtagcattcaagttcccaagtatgaagaagaggaagaagaagagggaggcctctcaactcaacaatgcagaactcgacaccctatctcctccctgaagtacactgaggatatgacacccacggaacagactccacgtggcagtatggaatcgttagccttgagcaatgcgaccggactctcagctgacgggggggctaaacgccaggagcatctttctaggttttccatgccagacttgtcaaaggattccgggatgaatgtgtctgaaaagctgtcaaacatgggcactctgaattcgtcaatgcagtttcggtctgctgaatccgtcaggtctctgttatcggcacagcaatatcaggagatggagggaaaccttcatcaactgtccaacccaataggatacagagacctgcagtctcatggccgcatgcaccagtcctttgattttgacggcggcatggcagggtcaaaactccctggtcaggagggcgtgcgcatccaacccatgagtgagcggacacggcgccgagcaacaagtagagatgataatagacgcttccgccctcaccggtcaagacgctcccgccggagtcggagcgacaatgcactccatttggccagcgaacgggaggccatatcacgcctgaaggatagaccgccgctgcgggctagggaggactacgaccagtttatgagacaacgctccttccaggaatcaatgggccacgggtcacgcagagatctgtacgggcagtgtcctagaacagtgtccgatctggcgctgcagaacgctttcggtgatcgatggggaccatacttcgctgagtatgattggtgtagcacctgttcttcctcaagcgagtcagacaacgagggttatttccttggtgaaccgatcccccagcccgcacgtctgagatacgtgacatcagacgagttactgcacaaatactcttcatacggcttacctaagtccagtactctgggtggcaggggacagttacacagccgcaagaggcagaaaagtaaaaactgtataatttcttag

SEQ ID NO: 200643 - DNA, 453 bp, Artificial Sequence
  Description of Artificial Sequence: Synthetic coding sequence
atggtgaccgtgatgcccctggagatggagaagaccatcagcaagttgatgtttgacttccaaaggaattcaacatcagatgacgatagtggatgtgcactcgaagagtatgcctgggtgccaccagggctgaagcctgaacaggttcaccagtactacagctgcttgcctgaagagaaagtcccctatgtgaacagtcctggagagaagctgcggattaagcagcttctacatcagctgcctccacatgacaatgaggtgcgctactgcaattccttggatgaggaagagaagcgagagctcaaactgttcagctctcagcgcaaaagggagaacctgggccgtggtaatgttcggccgttccccgtgaccatgaccggcgccatctgtgagcagtgtggcggtcaaatcaacggtggcgacattgcggtctttgcgtccagggcaggatag

SEQ ID NO: 200644 - DNA, 1263 bp, Artificial Sequence
  Description of Artificial Sequence: Synthetic coding sequence
atggagaccttcgaccccaccgagctgcccgagctgctgaagctgtactaccggcggctgttcccttactcacagtattacagatggctgaattacggaggcgtaatcaaaaactacttccaacatagggaattctcctttacactcaaggatgacatttacatacggtaccagtcctttaataaccagagcgacctggagaaggaaatgcagaaaatgaacccctacaaaatcgacataggggctgtgtattctcacagacccaaccagcacaataccgtaaaattgggcgcctttcaggcacaggaaaaggaactggttttcgatattgacatgacagactatgacgacgtaaggaggtgttgctcgagcgctgacatatgcccaaagtgctggacgttaatgacgatggcaatccgcatcattgaccgggccttgaaggaggatttcgggtttaagcatcggctgtgggtctacagcgggaggagaggagtacattgctgggtctgcgacgagtccgttagaaaactgagcagtgctgtcaggtccggaatagttgagtacttgtctttggtgaagggcggacaggatgtgaagaagaaggtgcacctgtcggagaagatccacccatttatcagaaagtcaataaacataataaagaagtactttgaggaatacgccttggtgaaccaggatattttggaaaacaaggaatcctgggataagattctggcgctggtcccagagactatccacgatgagctccagcagagttttcagaaaagccacaactcgttgcagcggtgggaacatcttaaaaaggtcgcatcccggtaccaaaacaacatcaagaacgacaagtatgggccctggctggagtgggaaattatgctgcagtactgtttccctaggctcgatatcaatgtctcgaaaggcattaaccatctgctgaagagccccttttctgtgcaccccaaaactggacgcatctcagtgcccatcgatttgcagaaagtggatcaattcgacccatttacagttccaaccatcagcttcatatgtcgggaactcgacgcaatttctacaaatgaggaggagaaagaggagaatgaagcggagtccgacgtgaagcatcgcaccagagactataagaagaccagccttgcaccttatgtgaaagttttcgaacactttttggagaatctggataaaagtaggaagggcgagcttttgaagaaatcagacttgcagaaggacttctag

SEQ ID NO: 200645 - DNA, 1284 bp, Artificial Sequence
  Description of Artificial Sequence: Synthetic coding sequence
atggagaccttcgaccccaccgagctgcccgagctgctgaagctgtactaccgtcgtctgtttccttactcccaatactatagatggctgaactatggtggggtgattaaaaactattttcaacaccgcgaatttagcttcacgttaaaggacgacatctatattaggtatcagtctttcaataatcaatctgacttagagaaggagatgcaaaagatgaacccctataagattgatattggcgcagtgtatagtcaccgacccaaccagcataatactgttaaactcggcgcttttcaggcgcaggagaaggagctcgtgtttgatatcgatatgactgattacgacgacgtcagaagatgctgtagcagcgctgatatttgtcctaagtgctggaccttgatgaccatggctataaggataatcgatcgtgctttgaaaggcaaagattttggcttcaaacatcgcttgtgggtctattcaggtagacgcggagtccactgctgggtatgtgacgagagtgtccggaagcttagcagtgcagttagaagcgggattgtggaatacttgtctctcgttaaaggaggacaggacgtgaaaaagaaagtgcacctgtcagagaaaatccacccctttattaggaagagcattaacatcattaaaaagtatttcgaggaatatgccttagtcaaccaggacattctcgagaataaagagtcatgggacaaaatcttagcactgatggggctgttcctaaacgacccatctcctatccatgacgagctccagcagagtttccagaaatctcataacagtctgcagcggtgggagcacctgaagaaggtggcatctaggtatcagaacaatatcaaaaacgataaatatgggccatggttggagtgggaaatcatgcttcaatattgttttccgagactcgatatcaatgtgtcaaaggggatcaatcacctgctgaagagccctttttcagtgcaccctaagacaggacgaatctccgtgccaatcgacctccagaaggtagatcaattcgacccttttaccgtgcccacaatatcatttatttgcagagagttggatgctataagtacgaacgaggaagagaaggaggaaaatgaggctgaatctgatgtgaagcacagaacccgggactacaagaagacttcgctggctccgtacgtgaaggtctttgaacatttcctggagaatttagataagagtcggaaaggggaactgctaaagaagagcgacctccagaaggatttctag

SEQ ID NO: 200646 - DNA, 762 bp, Artificial Sequence
  Description of Artificial Sequence: Synthetic coding sequence
atggccaacctgggctgctggatgctggtgctgttcgtggccacctggtctgatttaggcttgtgcaaaaaacggcccaaaccaggcggctggaacacaggcggaagccgctaccctggacagggatcccccggggggaataggtatcctcctcaagggggaggaggctggggccagccacatggcggcgggtgggggcaaccccacggtggcggctggggccagccgcacgggggaggatggggccagccccatggcgggggctggggtcaggggggaggaactcactcacaatggaataaaccatctaagcccaaaaccaatatgaagcacatggctggagccgctgccgccggagctgttgtgggagggctcggtggatacatgctggggagcgccatgtcccgacccattatccacttcggaagtgactatgaggacagatactatcgggagaacatgcatagatacccaaaccaggtgtactatcggccaatggacgaatactccaaccagaacaactttgtgcacgattgtgtgaacattactatcaagcaacacaccgtgactactacgacaaaaggggaaaacttcactgagaccgacgttaaaatgatggaacgcgtggtcgagcagatgtgtatcactcaatatgagagggagagccaggcatactatcagagagggagctcaatggtgctttttagctctcctcctgtgatcctcctgatatcatttctgattttcctgatagtcggctag

SEQ ID NO: 200647 - DNA, 750 bp, Artificial Sequence
  Description of Artificial Sequence: Synthetic coding sequence
atggccaacctgggctgctggatgctggtgctgttcgtggccacctggagtgatctgggtctgtgtaaaaagcggccaaaacctggcggatggaatactggagggtccagataccccggacagggatcaccgggtggcaacaggtaccctccacaggggggcggtggatggggacagccacacggtggaggatggggccagccccacggggggggatggggccagccacacggaggggggtggggacagcctcacgggggcggctgggggcagggcggggggacccacagccagtggaacaagccttcaaaacccaaaactaacatgaaacacatggctggcgccgccgccgctggcgctgtggttggcggactggggggttatatgctggggtctgcgatgtctcgccccatcattcacttcgggagtgattacgaggaccgatattaccgtgaaaacatgcatcggtaccctaatcaggtttattaccgccccatggatgagtattctaaccaaaacaacttcgtccacgactgtgtgaatattactattaaacaacacacagtgactacaactaccaagggggagaatttcacggaaaccgacgtgaaaatgatggagcgtgtggtagaacaaatgtgtatcactcagtatgagcgtgagtcacaggcgtactatcaacgaggctcaagcatggttctgttttcaagtccgccagtcatcctgctgatctcatttttgattttttag

SEQ ID NO: 200648 - DNA, 762 bp, Artificial Sequence
  Description of Artificial Sequence: Synthetic coding sequence
atggccaacctgggctgctggatgctggtgctgttcgtggccacctggagcgacctcggattgtgcaagaaaaggcccaaaccaggcggatggaacaccggaggaagccggtatcctggccagggaagcccaggcgggaacagataccccccccaggggggaggaggatgggggcagccccacggagggggttggggacagccacacgggggtggatggggacagcctcacggcggcgggtgggggcagccccatggcggaggctggggacagggtggagggacacatagtcaatggaacaagcctagcaagcccaagacgaatatgaagcacatggccggggcagccgccgccggcgcggtggtggggggtttgggtggctatatgttagggagtgccatgtcacgaccaatcatccacttcggtagtgactatgaggacaggtactaccgggaaaatatgcataggtatcccaaccaggtgtattaccggcccatggatgaatactccaatcagaacaacttcgtgcacgattgtgtcaatatcactatcaagcaacataccgtaaccaccacgaccaaaggggagaattttacggagacggatgttaagatgatggagcgtgtcgtcgagcagatgtgcataacacagtacgaacgggagtctcaggcgtattatcagcgcggatccagcatggtgctcttcagctcccctcccgtgattctgctcatcagcttcctcatctttctgattgtgggatag

SEQ ID NO: 200649 - DNA, 579 bp, Artificial Sequence
  Description of Artificial Sequence: Synthetic coding sequence
atggagcactggggccagccccacggcggcggctggggccagccccacggcggaggctgggggcaaccacatgggggtggatgggggcagggtggtgggacacatagccagtggaataagcctagtaaacctaaaacaaatatgaaacacatggctggggctgcggcagccggggccgtggtggggggccttgggggatatatgcttgggtccgcgatgtcacgacctatcattcactttggtagcgactatgaagacaggtactaccgggagaacatgcatcggtatccgaatcaagtgtattaccggcccatggacgagtatagcaaccagaataatttcgtacacgactgcgtgaatatcacaatcaaacaacacaccgtaactactacaaccaaaggggagaacttcactgagacagatgtgaagatgatggaaagggtggtggaacaaatgtgcattacccaatacgagcgtgagagccaggcctactaccaaaggggatccagtatggtgctgttcagctcaccgcctgttatcttactaatttctttcctgatctttctgatcgtgggctag

SEQ ID NO: 200650 - DNA, 654 bp, Artificial Sequence
  Description of Artificial Sequence: Synthetic coding sequence
atggccaacctgggctgctggatgctggtgctgttcgtggccacctggagcgacctgggcctttgcaagaagcgccctaagccaggcggatggaacacaggaggtagccgctaccccgggcagggatcacctggcggtaacaggtatcctccacaaggtggtgggggatgggggcaaccacatggtggcgggtggggacagcctcatggaggcggttggggtcagccacacggtgggggatggggacagccgcatgggggcggatgggggcagggcggcgggactcacagccaatggaataagccatccaagcctaaaacaaacatgaagcacatggctggagctgccgcagccggcgctgtggtcggcgggctcggaggatacatgctgggtagcgccatgtcccggccgattattcattttggaagcgattatgaggaccggtactatcgcgagaatatgcacagatacccaaaccaggtatactacaggcctatggacgaatactctaatcagaacaattttgttcacgattgcgtgaacatcacaatcaagcaacataccgttaccacaaccactaaaggcgagaacttcacggagacagacgtgaagatgatggagagggtggtggagcagatgtgtattacgcagtag

SEQ ID NO: 200651 - DNA, 531 bp, Artificial Sequence
  Description of Artificial Sequence: Synthetic coding sequence
atgcggaagcacctgagctggtggtggctggccaccgtgtgcatgctgctatttagtcacctgtctgctgtgcagaccagaggaattaagcataggattaaatggaatagaaaggccctgccttcaacggcgcagattacagaggcacaagtcgccgagaacaggccgggcgcttttatcaagcaaggtcggaaactggacattgatttcggcgccgaagggaaccgctactacgaagctaattactggcagttccctgacgggatccactataatggttgcagtgaagcaaacgtgacaaaagaagccttcgtcacaggatgcattaacgctactcaggcagccaaccagggagagttccagaaacctgacaacaaactgcatcaacaggtgctatggcgtctggtacaggagctgtgctccctgaaacattgcgaattctggctggaaagaggggcggggctgagagtgacaatgcaccagccagtcttgctgtgcctgctggcattgatatggctcacagtcaaatag

SEQ ID NO: 200652 - DNA, 1023 bp, Artificial Sequence
  Description of Artificial Sequence: Synthetic coding sequence
atggccaccggcggctaccggaccagcagcggcctgggcggcagcaccacagacttcctggaggagtggaaagcgaagcgtgaaaaaatgcgggctaaacagaatcctccagggcccgccccacctggaggaggttcctcagacgccgcagggaagcctcccgctggagccctgggaacaccagcagctgctgctgctaatgagctcaacaataatctgcccgggggtgcccccgctgcacctgctgtgccaggccccggcggcgtgaactgcgcggtcggcagtgccatgttaacacgcgcagctccaggccctcggaggtccgaagacgaacccccggccgcttccgctagtgcagccccccctccccagcgggatgaggaagaaccggatggagttccagagaaaggcaaaagcagtggcccttctgcccgcaagggtaaaggccagatcgaaaaacgaaaactgagagaaaaacgacgcagtactggagtagttaacatccccgctgcggaatgtcttgatgaatacgaagacgatgaagccggccagaaagagcggaaaagagaagacgctatcacacagcagaatactatccaaaatgaagctgtaaatcttcttgaccccgggtctagctacctgctgcaggagcccccacgcaccgtgagcggacggtataaatccacaacttcagtgagcgaggaggatgttagtagtcggtattctcgtaccgaccggtcaggatttccccggtacaatcgcgacgccaacgttagtgggaccctagtgtcctcctctactctggagaagaagatagaggatctagagaaagaggtagttagagagaggcaggaaaatttgcgccttgttcgactgatgcaggataaggaggagatgatcggcaagctgaaagaggaaatcgatctccttaatagggatttagacgacattgaggatgagaatgagcagctgaagcaggaaaacaaaaccttgttgaaagtggtcggtcagctaacccgttag

SEQ ID NO: 200653 - DNA, 231 bp, Artificial Sequence
  Description of Artificial Sequence: Synthetic coding sequence
atggccaccggcggctaccggaccagcagcggcctgggcggcagcaccaccgactttctggaggaatggaaagctaagcgagagaagatgagagccaaacaaaacccaccaggacctgccccacctggcggaggatcatctgacgccgccggcaaacctcccgccggggccctgggaacacctgcagcagcggcggcaaacgagttgaacaacaacctgcccggagggtag

SEQ ID NO: 200654 - DNA, 195 bp, Artificial Sequence
  Description of Artificial Sequence: Synthetic coding sequence
atggccaccggcggctaccggaccagcagcggcctgggcggcagcaccactgacttcctcgaagaatggaaggccaaaagagagaaaatgcgagcaaagcagaatcccccaggacctgccccacccggaggcggatcatctgacgccgcaggaaagcccccagccggggcgctaggaacgcctgccgctgcctag

SEQ ID NO: 200655 - DNA, 663 bp, Artificial Sequence
  Description of Artificial Sequence: Synthetic coding sequence
atgaagagcgtgatctaccacgccctgagccagaaggaggccaacgatagtgacgtgcagccatcaggggcccaacgagcagaggctttcgtacgcgcttttttgaaacgatcaaccccccgtatgagccctcaggccagggaggaccagctgcagaggaaggcagttgtgctggaatattttactaggcacaagaggaaagagaaaaaaaagaaggctaaaggcctgagcgctaggcagcgacgggaactccgcctatttgacattaagcctgagcagcagcgctactcactctttctgccgttacacgagctctggaagcaatacatacgcgacctctgctccggcctcaagcctgacacccagccacagatgatccaagccaagcttctcaaggccgatctacacggcgccattatatccgttactaaatctaaatgcccaagttacgtgggcattaccggtattctgctgcaggaaactaaacatatctttaagattataactaaggaagatcgcctcaaggtaatccccaaattaaactgtgtcttcacagtcgagacagatggattcataagctatatttatggaagcaagttccaattacggagcagtgagcgttccgctaagaaattcaaagccaaaggtactatcgatctgtag

SEQ ID NO: 200656 - DNA, 1695 bp, Artificial Sequence
  Description of Artificial Sequence: Synthetic coding sequence
atgagcagccacggcaacagcctgttcctgcgggagagcggccagcgcctaggcagagtaggatggctgcaacgtcttcaagaaagtctccagcaaagagcgctgcgtacacggctgcgtctccaaactatgaccctcgagcatgttctccgcttcttgcgaagaaatgcgtttattctgctgacggttagtgctgtggtgattggtgttagtcttgcattcgccttgcgaccctaccaactgacttatcgacagattaagtacttttcctttcctggggaattactaatgcgcatgctccaaatgctggtccttccacttattgtttccagcctggtcactgggatggcaagtctcgataataaagctacaggtaggatgggcatgagagccgcagtttactacatggtcacgaccattatcgcagttttcatcggcatcctgatggttaccattattcaccctggcaaaggatcgaaagagggattgcaccgcgaaggtaggatagagacaatcccaacggctgacgctttcatggacctcatccggaacatgttccctccgaacctggtggaggcatgcttcaaacaatttaagacacagtactccactagagttgtgacgcgaacaatggttagaacagagaacgggtcagaacccggtgcgagcatgcctccccccttcagcgtcgagaatggtacctcattcctggaaaacgtgacccgcgcactgggaacactgcaggagatgttaagtttcgaggaaactgtgcctgtccctggttctgcaaacggcattaatgccctggggctcgtagtttttagcgtcgcgttcggtctggtaatcggcggcatgaaacataaaggaagagtgttgcgggacttttttgactctctgaacgaagccatcatgaggctggtgggtattatcatttggtacgccccagtcggtattctgtttctgatcgcaggcaaaatcttggagatggaggatatggcagtcctaggcggacagctcggcatgtacactctgactgtgattgtcggactatttctgcacgcaggaattgtactccccttgatctacttcctcgtgacccaccggaatccatttcccttcattggaggcatgctgcaagctctcattacagcaatgggcacatccagttcctccgcgacattacctataacatttcggtgtctcgaggaggggttgggcgtagaccgccggatcacgagatttgttttgcccgtgggagcgaccgtgaacatggatggcaccgccctatacgaagctctggccgcaatattcattgctcaggtcaacaactatgaactcaacctgggtcagattaccaccatttccattaccgccacagcagcatctgttggcgcagccggcatacctcaggcagggctcgtgaccatggtgattgtgctcactagcgtcggattgccaactgaagacatcactctcataattgctgtcgactggtttcttgatagacttcgcaccatgacgaatgtcctgggcgactccatcggtgcagccgtgatcgaacacctgtcccagagagagctggagctgcaggaggctgagctgactctgccctcattgggtaagccttataagagcctgatggcgcaggagaagggcgcctctcggggtaggggcggaaatgagtccgctatgtag

SEQ ID NO: 200657 - DNA, 420 bp, Artificial Sequence
  Description of Artificial Sequence: Synthetic coding sequence
atgcactgcctgcggaagcggcggatgacccccatgagccggtactccctgttcctaccactgcacgaactctggaagcaatacatccgtgacctctgtagcggccttaaacctgacactcagccgcagatgatacaagcgaagttactgaaagccgatctgcatggagccataatttctgttacaaaatcaaaatgtccctcctacgtggggatcacaggcatcctgctccaagaaacaaaacatatctttaagatcatcacaaaagaagaccggctcaaagtcatccccaaactaaattgtgtgttcacggtggaaaccgatgggttcatttcatacatttacggatccaagtttcagctcaggagctcggaacggtcagccaaaaagtttaaggccaaaggcactatcgacctgtag

SEQ ID NO: 200658 - DNA, 342 bp, Artificial Sequence
  Description of Artificial Sequence: Synthetic coding sequence
atggtgcggttcaagcaccggtacctgctgtgcgagctggtgagcgatgatccaaggtgccgcttgagcctggacgatagagtgctgtccagcctggtgagggacactatcgctcgggtacacggcacgtttggggccgctgcctgctcaatcggattcgcgggaaccatcaggacctgccaaaagttcctgattcagtataatcgacgacaactgttgatccttctccagaactgtacagatgagggggagagagaagctatacagaagagcgtgacaaggtcctgcctgctggaggaggaagaggaaagcggggaggaagccgctgaggctatggaatag

SEQ ID NO: 200659 - DNA, 492 bp, Artificial Sequence
  Description of Artificial Sequence: Synthetic coding sequence
atggtgcggttcaagcaccggtacctgctgtgcgagctggtgagcgatgacccgcgatgccgcctgtccttggatgaccgcgtgctgtcctcgctggtgcgagacaccatcgcccgcgtgcatggaacctttggggccgccgcctgctccattggctttgccgtgagatatcttaacgcctatactgggatcgtgctgctgagatgcaggaaagaattttaccaacttgtgtggtctgccctgccctttattacttatctcgaaaataaaggccaccgctatccatgcttttttaatactttacacgtcggaggaacgatcaggacctgtcagaaatttttaatccagtataatagaagacagctgctgatcctgctccaaaactgtacagacgaaggtgagagagaggctatccagaaatcggtcacaagaagctgtctcttagaagaagaggaggagagcggcgaggaagctgcagaagccatggagtag

SEQ ID NO: 200660 - DNA, 423 bp, Artificial Sequence
  Description of Artificial Sequence: Synthetic coding sequence
atggccgagaaccgggagccccggggcgccgtggaggccgagctggacccggtggaatatactctgcgaaaacgcttgccatcaagactgcctcgcaggccaaacgacatttatgtcaacatgaaaaccgacttcaaggcccagctggctcgctgccagaaactgctcgacggaggcgctaggggacagaatgcatgttcagaaatctacatccatggtctgggattggctattaacagagcgatcaatatagccttgcaactacaggctggaagcttcgggtcactgcaggtggccgcaaatacatcaacagtggagctggtggacgaactggagcctgaaacagatacaagagaaccgctcacccgcatcagaaataactcagccatccatatccgtgtgtttagagtgacccctaaatag

SEQ ID NO: 200661 - DNA, 414 bp, Artificial Sequence
  Description of Artificial Sequence: Synthetic coding sequence
atggccgagaaccgggagccccggggcgccgtggaggccgagctggatccagtggaatataccctgaggaaacgattaccttccagacttcctagacggcccaacgatatctatgtgaatatgaagaccgatttcaaggcccagctggctaggtgccagaagcttctggacggaggagctcgcggacagaatgcttgctctgagatatatattcatggcctcggcctcgctataaaccgggccattaatatcgcccttcagcttcaggcaggctctttcggatcattgcaggtcgccgcaaacacaagcaccgtagagctggtggacgaactggaaccagagacagacacgagagaacctttaactaggatccggaacaactctgcaatccacatccgggtatttagagtgtag

SEQ ID NO: 200662 - DNA, 708 bp, Artificial Sequence
  Description of Artificial Sequence: Synthetic coding sequence
atgcggcggggcgccccccaggaccaggagctggtgggccccggccctccagggcgcgggagccgcggcgcgcccccacctctgggacccgtagtgcccgtgttagtgttccctcctgacctcgtgttcagagctgaccaaagatccggcccaaggcagcttctgacactgtataacccaacaggaaccgccctgagattccgtgtgctgtgtactgctcctgccaagtatactgtcttcgacgccgaaggctacgttaagcctcaatcatgtatagacatagttattaggcatgtcgcgcccattccttcacactacgacgtgcaggataggttccggatcgaacttagcgaagagggtgccgaaggccgtgttgtgggccgcaaggatattactagcatcctccgggctccagcctatcctctggagctccaaggccaacccgatcccgctccacgccccggacccccggctggcactcccccacctactgcccgccacttccaggagcacccgcggcagcagctggccaccagttcgtttctcctgttccttcttactggaattgtttccgttgcgttcctgctgttgcccttgcccgatgagctcggcagtcagttgccacaagtcttgcatgtttccttgggccagaagcttgttgctgcctatgtgctagggctccttacgatggtgttcctgcgtacctag

SEQ ID NO: 200663 - DNA, 1248 bp, Artificial Sequence
  Description of Artificial Sequence: Synthetic coding sequence
atgcggggcgccaacgcctgggcccccctgtgcctgctgctggccgcagccactcagttatcccggcagcagagtcctgagaggccagtattcacatgtgggggcattctgacaggggagagcggtttcatcgggtctgaggggttccctggcgtgtaccctccaaattccaagtgcacttggaagattaccgtgcctgaaggcaaggtagtggtgctgaatttcaggtttattgatttggagtcagacaacctttgccggtacgacttcgttgacgtgtataacggccatgccaacgggcagcgtatcggtagattctgcgggacgttccgccccggggctctggtgtcttccggcaacaagatgatggtccagatgatctccgacgcaaatactgcagggaatgggtttatggctatgttttccgcagcagaacccaatgagaggggcgaccaatattgcgggggcctgcttgaccgcccctctggaagcttcaaaacacccaactggcccgacagggactatcccgctggcgtgacttgcgtctggcatattgtcgcccctaagaatcaacttattgagctgaaattcgagaaattcgatgtggaacgcgataactattgtcgctacgactacgtggcagtattcaatggaggtgaggtcaacgatgcccggcgtatcggtaagtactgtggcgactcaccgccggcccctattgtgtccgaaagaaacgaattattgattcagttcctgtccgacctgagcttgaccgcagatggattcatcggacattacatcttccgtcccaagaagcttcccacaacaacagaacaaccagtgacaacaacgttcccagtgacaacaggattgaaacccaccgttgctctctgtcaacagaaatgtcggcgcactggcacgctggagggaaactactgtagttccgatttcgtgctcgcaggcaccgtgattactacgatcactcgcgacggaagtctccacgctaccgtctctatcattaacatctataaggagggtaacttggctatccagcaggcggggaaaaatatgagtgctcgccttacagttgtttgcaaacaatgtcccctcctgcgccggggcttgaactacatcattatggggcaagtgggggaggatgggcggggaaagatcatgcccaattctttcattatgatgtttaagactaaaaaccaaaagttgctggacgctctgaaaaacaagcagtgttag

SEQ ID NO: 200664 - DNA, 2184 bp, Artificial Sequence
  Description of Artificial Sequence: Synthetic coding sequence
atgcggcccctgctgctgctggccctgctgggctggctgctgctggcagaggccaagggcgacgcgaagcccgaagacaatctgctggtgctgactgtcgctactaaggaaactgaagggttccgcagattcaagcgcagcgcacagttcttcaattacaagatccaggctctgggcctcggcgaggactggaatgtagagaaaggcacttctgctggagggggccagaaggtaagactcctaaaaaaggcgcttgaaaagcacgccgacaaagaagatcttgtcattttgttcgccgactcttacgacgttctgtttgcatccggccccagagagttgttgaaaaaattcaggcaggcaagaagccaggttgtcttcagcgccgaggagctcatctaccccgatcgtcgtctggagacgaaataccccgtggtatccgacggaaaaagatttcttggctccggggggtttattggatacgctccgaacttgagtaaactggttgccgaatgggagggtcaggattccgatagcgaccagctgttttacaccaaaatcttcctggatcctgagaagcgcgagcagataaacatcaccctcgaccatcgctgtcggatattccagaacctcgatggcgctctagacgaagtcgtactgaagtttgagatggggcatgtacgagctcggaatctcgcctacgatacccttccggtactaattcatgggaatggcccaaccaaactacagctgaattaccttggcaactatattcctcgattctggacatttgagactggatgtactgtgtgtgacgaggggcttcgtagcctcaaaggtattggcgatgaagctttaccaaccgtcctcgtgggggtgttcatcgagcagccaaccccatttgtttctttgttctttcagaggctgctgcggctgcactatccccagaaacatatgcggctgtttattcacaaccatgaacagcatcacaaggcgcaagtggaagaattcctcgcccagcatggaagcgaataccagagtgtgaagctggtagggcccgaggtgaggatggccaatgctgatgcgcgaaatatgggcgcggacctatgtcggcaggatagatcatgtacctactactttagcgtggacgccgatgtggcactgactgaaccgaatagtcttcggttgcttattcagcagaacaaaaatgttatagcgccactcatgacacggcacggccggctgtggtctaatttctggggggccctgtccgctgacggatattacgcacgctccgaggactacgttgatattgttcaagggcggcgggttggggtgtggaacgtcccctacatttccaacatctatctgattaaagggagtgccctgcgcggcgaactgcagagttctgacttattccatcacagtaagttggatcccgacatggctttttgcgcgaatataaggcaacaggacgtgttcatgttcctcaccaacaggcataccctgggacacctgttaagcttggactcctaccggaccactcacctacacaatgacttgtgggaggtgttctcaaaccccgaggactggaaggagaaatacatacatcaaaactataccaaggcgcttgctggaaaattggttgagacaccctgtccagatgtgtattggttcccaatcttcactgaggtcgcatgtgacgaactcgtggaggagatggagcattttggccaatggagcttaggtaacaacaaggataaccgaatccagggaggttacgaaaatgtgcccactattgacattcacatgaatcaaatcggtttcgaaagagagtggcataaattcttgctggagtacatagccccgatgacagagaaactctaccccggctactatactagagctcagttcgatctcgcctttgtggtcagatacaaaccagacgaacagccttcacttatgccgcatcacgacgccagcactttcacaatcaatatcgccctgaatcgggtgggagtggattatgaaggagggggatgtaggttcttgaggtacaattgtagcattcgggcaccacggaaaggctggactctcatgcatccggggcgactgactcattatcacgagggcctcccaacgacaagaggcacgcgctacattgcagtgtcattcgtagacccttag

SEQ ID NO: 200665 - DNA, 600 bp, Artificial Sequence
  Description of Artificial Sequence: Synthetic coding sequence
atgcggcccctgctgctgctggccctgctgggctggctgctgctggcagaggctaagggggatgccaagcccgaggataatctgctagttctcacggtggcaaccaaggaaacagaaggatttaggcgctttaagcgctctgcccaattcttcaactataagatccaggcgctgggactgggagaggactggaatgtggagaaaggcacctccgccgggggaggtcaaaaagtcaggctgcttaaaaaagcacttgaaaaacatgccgataaagaagatttggttattctgttcgccgatagctacgatgtgttgttcgcatcaggtccccgggagctgctgaagaagttcaggcaagctaggagccaggtggtgttttctgcagaagagcttatttatcccgataggcgcctggaaactaagtacccggtggtctccgacggaaaaaggttcctggggtctgggggtttcatcggttatgcccctaacttatccaagcttgttgcagaatgggaaggacaagacagtgatagcgatcagcttttctatacaaaaatttttcttgaccctgagaaaagagtctctagactacactcatag

SEQ ID NO: 200666 - DNA, 2325 bp, Artificial Sequence
  Description of Artificial Sequence: Synthetic coding sequence
atgcggcccctgctgctgctggccctgctgggctggctgctgctggccgaagccaagggtgacgccaaacccgaggcaccctgttgccaggagggcctgagggctggaggctctggatctctccatctgggaagagacttcacggtattggcaggcgcccgcggctcgccatcaccctcagtcagcagtatacctcgcttttggatacctggatcagacaacttgttggtcttaaccgtggctaccaaagagacggagggtttccggcggttcaagcgcagtgcacaattcttcaactacaagatccaggcactaggcctgggagaagactggaatgtcgaaaagggaacgtctgctggtggcggccagaaagtcaggctcctcaagaaagcgctggagaagcacgccgacaaggaagacctcgtgattctattcgcggacagttacgacgtgctgtttgcttccggccctcgggagctcctcaagaaattcaggcaggcaaggagccaggtagtgttctccgcggaagaactgatctatcccgacagacggttagaaaccaaataccccgtcgtctctgacggaaagcgctttctgggttcagggggtttcataggctatgcacccaacctgtccaagctagttgctgagtgggaggggcaagacagtgacagtgatcaactgttttacacgaagatctttctggaccccgaaaaacgggagcagattaacatcaccctggaccatcggtgccggattttccagaatttagacggtgctcttgacgaggttgtgctcaaattcgaaatggggcatgtgcgagcaagaaatcttgcctacgatactctgcctgtgctgattcatggcaatgggcccaccaaactccaactcaactatctgggaaactacatcccccgattctggacatttgagactgggtgcaccgtgtgcgacgagggactgaggtctctcaagggaatcggtgatgaggcccttcctaccgtgcttgtgggagtgtttatagagcagccgactcccttcgtatctctgttttttcagcgattgctgcggctgcactaccctcagaaacacatgaggctgtttatccacaatcacgaacagcaccacaaggcccaggtggaagaatttctggcccagcacgggtctgagtatcagtctgtcaagctggtcggcccagaagtgagaatggcgaatgctgacgcgcgcaatatgggcgccgacctgtgtcgccaggaccgctcttgcacttattacttcagtgttgacgctgatgtcgcgttgactgaacctaattcgctgagactgttaattcagcagaacaaaaacgtgatagcccccctgatgacgcggcatggtaggctttggtccaatttttggggtgcgctctccgcagatgggtattatgcacggtccgaagattatgtggacatcgtgcagggcaggcgcgtcggagtttggaacgtaccatacatcagcaacatataccttatcaaggggtccgccctacgcggggagctgcaatcatctgatcttttccaccactccaagctagaccctgacatggcattctgtgccaacattcgacagcaagacgtttttatgtttcttacgaatcgccacacgcttggccacctcctgtcgttggactcctatcgcacaactcacctccacaacgacctctgggaagtgttcagtaatcctgaagattggaaagaaaagtatatacatcagaattacacaaaggctctggctgggaaactggtagaaaccccgtgtcctgatgtgtattggttccctattttcacagaggtcgcctgcgatgagctcgtggaagaaatggagcactttggccagtggtcactcggaaataataaggacaaccggatccagggcggctacgagaacgtgcctacgatcgatatccacatgaaccagattggctttgagagagaatggcacaagtttttactggagtatatcgctccgatgactgagaaactctatcctggctattatactcgggcccagttcgatcttgccttcgtggtgcggtataagcccgacgaacagccttccctgatgccccaccacgatgcctcaactttcacgatcaacatcgccctgaacagagtgggggtggactatgaaggaggaggttgtagatttctgcgctacaattgtagtattcgcgcccctcgtaaaggctggacacttatgcatcctgggcggcttacccactatcacgagggtctgcccactactcggggaacacgctacatcgctgtatcctttgttgatccttag

SEQ ID NO: 200667 - DNA, 1176 bp, Artificial Sequence
  Description of Artificial Sequence: Synthetic coding sequence
atgcggcccctgctgctgctggccctgctgggctggctgctgctggccgaagccaagggtgacgctaagccagaggataaccttctcgtactgacagtcgccaccaaggaaactgaaggctttaggcggttcaaacggtccgcacagttcttcaattacaagatccaggcactggggctgggagaggattggaacgttgaaaaagggaccagcgccggcgggggccagaaagtccgtctcctaaaaaaggctcttgaaaaacatgccgacaaggaggacctggttattctgttcgccgattcctatgacgtcttatttgcctctggcccccgagagctgctgaaaaaatttagacaggccaggtcacaggtcgtattttcagctgaggagctgatctaccccgatcgcagactggaaacaaaatatcctgttgttagtgatggcaaaagatttctgctggaagacgtctttatgtttctgacgaacagacataccttggggcacttgctgagcctcgatagttacagaaccacacacttgcacaatgacctttgggaggtgttctctaacccagaggattggaaagagaaatatatccaccaaaactacacgaaggccctcgcaggcaaactggtggagacaccctgcccagatgtgtattggttcccaattttcacagaggttgcttgtgacgaactggtggaggaaatggaacactttggacagtggagcttaggcaataacaaggacaacagaattcagggcgggtacgagaatgtcccaacaatagacatccacatgaatcagatcggctttgaaagggagtggcataaattcctgcttgagtatattgctccaatgaccgagaaactgtatcctgggtattacacccgggctcagttcgatctggcattcgtggtgagatacaagcctgacgagcaaccatctcttatgcctcaccatgacgcctctacatttactataaatatagccttgaatagagtgggcgtcgactatgaaggaggaggttgcaggtttctccgttataactgttccattcgcgcccctcggaaggggtggacgctcatgcatcctggcaggctgacacattatcacgaaggattgcccactactcgcggcactaggtacattgccgtatccttcgtcgatccatag

SEQ ID NO: 200668 - DNA, 852 bp, Artificial Sequence
  Description of Artificial Sequence: Synthetic coding sequence
atgcggcccctgctgctgctggccctgctgggctggctgctgctggcggaagcaaagggagacgccaagccagaggataatctgctggtcctgaccgttgcaacgaaggaaactgaggggttcagacggttcaagcgatccgcgcaattctttaattacaagatccaggcgctgggcctgggcgaggattggaacgtggagaagggaacatccgccgggggaggccagaaggtgagactcctgaagaaagctctcgagaagcacgccgacaaagaggacttagtcattttgttcgccgactcctacgatgtcctctttgcctcagggcctcgggagctccttaagaagttccgacaggccagaagtcaggtcgtgttcagtgctgaggagctgatttatcccgaccgcagattggaaaccaagtaccctgtggtctccgacggaaaacgctttctgggatctggcggattcattggatatgctcccaatctaagtaagctggtggcagagtgggagggccaggactccgactcagatcagcttttctacacaaaaattttccttgatcctgaaaaacgggaacagattaatatcacactcgaccacaggtgtaggatcttccagaatttggatggggccctcgtgtccccttgggggcagggacacttgcccggcgcctgctatgagctcacagcaagcgttctgactagtgagttgagtgtgatgccgtccttcccggctgtcgtcctgcaactcaactacttaggcaattacattcctcggttctggaccttcgaaaccggctgtacagtgtgcgatgaaggcctgagatcactgaagggtatcgggtag

SEQ ID NO: 200669 - DNA, 678 bp, Artificial Sequence
  Description of Artificial Sequence: Synthetic coding sequence
atgcggcccctgctgctgctggccctgctgggctggctgctgctggccgaagccaagggggatgcaaagcctgaagcaccgtgttgccaagaaggactgagagctggggggtccggctctttgcacctgggtcgtgattttacagtgctggctggggcgaggggctctccatcacccagtgtgagtagtattccccgattctggattcctggctctgataatttgctggtgctcaccgtagctaccaaggagactgaggggttcagacggtttaagcggtccgcccagttctttaactataaaatacaagccctgggccttggtgaggattggaacgtcgaaaaagggacctcggccggtggcggtcaaaaggtccgcttgctgaagaaggctttggagaaacacgccgacaaggaggatctggttatcctcttcgcagactcatacgatgtgctgtttgcctctggacccagagaactgctgaagaaattcagacaggccaggtctcaggtcgtgttttcagctgaggagttaatctatccagaccgacgattggagacaaaatatcccgtggtgagcgacggcaaacgctttttgggctccgggggattcattggatacgcaccaaacctgagcaagctggtcgccgaatgggaagggcaagacagtgacagctag

SEQ ID NO: 200670 - DNA, 2277 bp, Artificial Sequence
  Description of Artificial Sequence: Synthetic coding sequence
atgggcggctgcaccgtgaagccccagctgctgctgctggccctggttctgcacccgtggaacccatgcctgggcgccgacagtgagaagcccagtagcatcccgacagataagctgctggtcatcactgttgccacaaaggaatcagatgggtttcaccggtttatgcagtctgccaagtactttaattatacagtcaaggttctggggcaaggtgaggagtggaggggcggcgacggcatcaacagcatcggcggcgggcagaaggtgcgcctaatgaaggaggtcatggagcactacgcggaccaggacgacctggtggttatgttcactgagtgtttcgacgtgattttcgccgggggacctgaggaagtgctcaaaaagtttcagaaggcaaatcacaaggtcgtgttcgccgccgatggcatcctctggcctgacaaacggctggccgacaagtatcccgtggtgcacatagggaaacgatacctgaactctggggggtttatcggttacgcaccatatgtaaaccggatcgtccaacaatggaatctgcaagacaatgatgatgatcaattattctacaccaaagtttacattgaccccctgaaaagagaggcgattaacatcaccctcgatcacaaatgcaagatatttcagacacttaacggtgcagtggatgaggtggtgctgaaatttgagaacggcaaagccagggccaaaaacacattctacgagactttaccagtggctatcaatggtaatggcccaacgaagatccttctaaactactttggcaactatgtgcctaattcatggacacaggacaacggctgcaccctttgcgagtttgatacagttgacttgagcgcagtggacgtccaccctaatgtgagcatcggagtgtttattgagcaacctaccccctttctgccaagattcctagatattctgctcacactggactaccctaaggaagccctgaagttgttcattcacaataaagaggtgtatcacgagaaggacatcaaagtcttctttgataaagcaaaacacgagatcaaaacgatcaaaattgttggcccagaggaaaacctctcccaagccgaagcaagaaacatgggaatggacttctgccgacaagatgaaaaatgcgactactatttctccgtggatgctgacgtagttctaacaaatccaaggacactgaaaatacttattgaacagaatcgtaagattatcgctcccctggttacgagacacggaaagttatggtcaaacttctggggagcactgtcccctgatggctactacgcgagatccgaggattatgtcgatatcgttcagggcaatagagttggcgtttggaacgtgccttacatggcaaacgtctatctcatcaaggggaagactctacgcagcgaaatgaacgagagaaattacttcgtgagggacaagctggaccccgatatggccttatgtcggaacgccagagagatgacacttcagcgggagaaggattcgcccacacccgagacttttcaaatgctgagccccccgaagggggtgttcatgtatatttcaaaccgccatgaattcggacggctcctatccacggccaattacaacacctctcactacaacaatgatctgtggcagatcttcgagaaccctgtggactggaaggagaaatatattaatagggactactcgaagatttttaccgagaacatagtcgaacagccctgcccagacgttttctggtttcccatcttttcagagaaggcatgtgacgagctcgtggaggagatggaacattacgggaaatggagtgggggcaagcaccatgattcccgcatttcgggcggctacgagaacgttccaaccgacgacattcacatgaagcaggtggatctagagaacgtatggctacattttatccgggaattcatcgcacccgtgacgctgaaagtgtttgcaggatattacaccaagggttttgccttattaaacttcgttgttaaatactcccctgaacggcagcgttctctgaggccccatcacgacgcatctacatttaccataaatatagccctgaacaatgtgggggaagacttccaggggggtggatgcaaattcctgcgctacaactgtagcattgagtctccacgaaagggctggtcattcatgcatcccgggagactgacgcacctgcacgaggggctgcccgtaaaaaatggcacaagatatattgcggtgtcctttatcgacccctag

SEQ ID NO: 200671 - DNA, 2214 bp, Artificial Sequence
  Description of Artificial Sequence: Synthetic coding sequence
atgggcggctgcaccgtgaagccccagctgctgctgctggccctggtactgcatccatggaatccttgtctgggcgccgattctgaaaagccctcttcaattcctacagacaagctgctcgtgatcacggtggcaacaaaagaaagcgatggcttccaccggttcatgcagtccgctaagtattttaactacaccgtgaaggtcctgggacaaggcgaagagtggcgcggaggcgacggcattaactccattggcggaggacagaaggttcgcctgatgaaagaggttatggagcactacgccgaccaggatgacttggttgtaatgttcacagaatgttttgacgtaatttttgccggcggacccgaggaagtattaaagaagtttcagaaagccaatcacaaagtggtcttcgcagctgacggcatactctggcctgataagaggctcgccgacaaatatcccgtggtgcacattgggaagcggtacttaaatagcggtggctttatcgggtacgctccttatgtgaatcgaatcgtccagcagtggaaccttcaagataacgatgacgatcagctattctatacaaaggtgtatattgatccgctcaagagggaggccatcaacattacactggatcacaaatgcaaaatcttccagactttgaacggtgctgtagatgaggttgtgttgaaattcgagaacggaaaagcccgcgctaaaaataccttctacgaaaccctccccgtggctattaatggaaatggacccacgaagatcctgctgaactatttcggaaattatgtcccgaactcctggacccaggacaacggttgcacattgtgcgaattcgacacagtggatctgtcagccgtggacgtccaccctaacgtgtcaattggggtgtttattgagcagcccaccccctttctcccccgctttctggacattctgctgacgttggattaccctaaagaggctttaaagctgttcattcacaacaaggaagtctaccacgagaaggacattaaggttttctttgataaagctaaacacgagattaagaccatcaaaatcgtagggcccgaggagaatctctcacaagctgaagctcgcaatatgggcatggatttttgccgacaggacgaaaagtgcgactactacttttctgtggacgctgacgttgtgcttactaacccaagaaccctcaagattttgatagaacagaacagaaagatcatcgcccctctggtgacaaggcatggcaagctgtggtctaatttctggggggccctctcacccgacgggtactacgcccgatcagaggattatgtcgatattgtccaggggaaccgcgtcggcgtgtggaatgtaccgtatatggccaatgtttatttaatcaaaggtaagacgctccgttccgagatgaatgagcggaactacttcgtcagagacaaactcgatcccgacatggcactgtgcagaaatgctagggaaatgggcgtgttcatgtatatcagcaaccgccacgaattcggaagacttttgagtacagccaactataatacgtctcactacaacaacgacctctggcagattttcgagaatcccgtggattggaaagagaagtacataaaccgtgattattcgaaaatttttacagaaaacatcgtcgaacagccatgccctgacgtcttctggttcccaattttttctgaaaaggcctgtgatgaactggtggaagagatggagcattacggaaagtggtccggaggtaaacaccatgattctaggataagcggagggtacgagaatgtgcccacagacgatatccacatgaagcaggtggacttggaaaacgtttggttacacttcataagagaatttattgcccctgtgaccctgaaggtgttcgcagggtattatacaaagggctttgctctcctgaatttcgtggtcaagtactcccctgaaagacaacggtccctgcggcctcatcatgatgcaagtacgttcaccattaatatcgctctcaacaatgtcggagaagacttccaagggggagggtgtaaattcctgcgatacaattgtagcatcgaaagcccacgaaaagggtggtctttcatgcaccctgggaggctaactcacctccacgagggactgcccgtcaagaacggcacccgctacatcgctgtcagcttcatcgacccctag

SEQ ID NO: 200672 - DNA, 1257 bp, Artificial Sequence
  Description of Artificial Sequence: Synthetic coding sequence
atgctggagaaccacatcctgcacaagcggatctacatcctgaccttcttcagccagcaaatattcattctgtgccacgcacatttcatcttcttcttcacagtgagggacttctgtcggcaggatgaaaagtgcgactactatttctcagttgacgcagacgtggtgctgacgaatccaagaactttgaaaattctcattgagcaaaacagaaaaatcatcgcacccctcgtgacccggcatggcaagctgtggagtaatttctggggggcccttagccccgacggctattacgcccgcagcgaggactacgttgatattgttcaagggaaccgggtgggcgtgtggaacgttccctacatggctaacgtgtatctcatcaaggggaaaaccttgcgcagcgaaatgaatgagcgcaattattttgtgagggacaagttggaccctgacatggctttatgccgcaacgcccgcgaaatgaccctccagagagagaaggactccccgacaccagagaccttccagatgcttagcccccctaagggtgtgtttatgtacatctccaatcgccacgaattcgggcggctgttgagcactgcgaactataatacctcccactataataacgatttgtggcaaatcttcgagaaccctgtggattggaaggaaaaatacattaatagagattactccaagattttcacagagaacatcgtggaacagccgtgccccgatgtcttctggtttcctatatttagtgagaaggcttgcgatgaactggtggaagagatggaacattatggaaaatggagcgggggaaaacaccacgactcgcggatctctggcgggtacgagaacgttcccactgacgacatccatatgaaacaagttgatttggagaatgtctggcttcatttcattcgcgagttcatagctcccgttacactgaaggtattcgccggctactacacaaaggggttcgcgctgcttaacttcgtggtgaagtatagcccggaaaggcagcggtccttgaggccccatcacgacgccagtacgttcaccatcaacatcgccttaaacaacgtaggcgaggatttccagggcgggggctgtaaatttctgcgctataactgcagcattgagagccccaggaaaggctggagttttatgcatccaggccgtctaacccatctgcatgagggcctacccgtgaagaacggtacccgctacatcgccgtatcattcatcgacccctag

SEQ ID NO: 200673 - DNA, 2112 bp, Artificial Sequence
  Description of Artificial Sequence: Synthetic coding sequence
atgcagagcgccaagtacttcaactacaccgtgaaggtgctgggccagggcgaagagtggaggggtggagacggtattaattcaataggcggtgggcagaaggttcgattgatgaaggaagtgatggagcactatgccgaccaggacgatctcgtagttatgttcactgagtgctttgacgtgatcttcgccggaggcccggaagaggtgctcaaaaagttccagaaggcgaaccacaaggtggtcttcgctgccgatggaatcttgtggccagacaagcgcttagcagacaaatacccagtggtgcacatagggaagaggtatctcaattcaggtgggtttatcggctacgctccctatgtcaataggatcgtgcagcagtggaatctgcaggataacgacgacgatcaactattttacaccaaagtttacatcgatcccctgaagagagaagccattaatataaccctggatcacaaatgtaagatattccagaccctgaatggcgccgtcgacgaggtagtgctgaagtttgaaaacggcaaagcacgtgcaaagaataccttttatgagaccctcccagtggccatcaatggcaacggtcccaccaaaattttgctgaactattttggcaattatgtgccaaattcttggacccaggacaatggatgtaccctttgcgagttcgacaccgtggatctgagcgccgttgatgtgcatcccaatgtgagtattggtgtgttcatcgaacaaccaacacccttcctgccccgcttcctggacattctattgactcttgactaccccaaagaagccttgaaactattcattcacaataaagaggtgtaccatgaaaaggatattaaagtgttttttgataaggccaaacacgagattaaaactatcaaaatagtgggccctgaagaaaatctgagtcaggccgaagcccggaacatgggtatggatttttgtcggcaagacgagaaatgtgactactatttctctgtggacgcagatgtggtccttaccaatcctagaaccctcaagattcttatagaacagaataggaaaattatagctcccctggtaacacgacacggtaagctctggtcaaacttttggggggcactctctccggatgggtattacgctcgttctgaagactatgtagacattgtccagggcaacagggtgggagtctggaacgtgccatacatggcgaacgtctacctcattaaaggcaagaccctgcggagcgaaatgaacgagcggaattactttgtgagggataagctggacccggacatggcactttgcagaaatgccagggagatgacactacaacgcgagaaagactctcctactcccgagacatttcagatgctgagtccaccgaagggagtctttatgtatataagtaatcgccacgagtttggcagattactcagcaccgccaattataacacttcccattataataatgatctctggcagatcttcgagaatccagtcgattggaaagaaaaatatattaatcgggactactcaaaaatatttacagagaatatagtggaacagccatgtcccgacgtgttctggttccccattttcagcgaaaaggcctgcgatgagttggtggaggagatggagcattacgggaagtggtccggagggaaacaccacgattcccggattagcggcggatatgagaacgtaccaactgacgatatccatatgaagcaagtcgacctggaaaacgtctggttacacttcatccgcgagttcatcgcgcccgtgaccctgaaggtgttcgccggctactacacaaaaggatttgctctgttgaattttgtcgtgaagtacagcccagagaggcagcgatcactgagaccacaccatgatgccagtactttcactataaacatagccctgaacaacgtgggagaggacttccaaggcggtgggtgtaaattcctccgctacaactgctcaatcgagtcaccccggaaaggctggtcattcatgcacccaggcagattaacccacctgcacgagggcctgccagttaagaacggcactcggtacatcgctgtgagctttatagatccctag

SEQ ID NO: 200674 - DNA, 1092 bp, Artificial Sequence
  Description of Artificial Sequence: Synthetic coding sequence
atggccagcaagagctggctgaacttcctgaccttcctgtgcggctcagctatcggatttctattgtgcagtcagctgttctcaattctgctgggtgaaaaggtggacacccagccaaacgtgctccacaacgaccctcatgcacgacatagtgacgacaacggtcagaaccatctggaaggacagatgaactttaatgccgactcctctcagcataaagatgaaaacactgacattgctgaaaatctgtaccaaaaagtgcgcattctatgttgggtgatgaccggtccccaaaatttagagaagaaagccaagcacgtgaaggccacttgggcacagaggtgcaataaggtcttgttcatgtcaagcgaggaaaataaggatttccccgcggttggcctcaagaccaaagagggacgcgatcagctgtattggaagaccataaaggccttccagtacgtgcacgaacactatctggaagatgcagattggtttctgaaggctgacgacgatacatatgtgatcctggacaatctgcgttggctgctctctaaatatgaccccgaggagcccatttatttcgggcgcagattcaaaccttacgtaaaacagggatacatgtcaggcggagctggatatgttctctcaaaagaagcgctgaaacggttcgttgacgcctttaagaccgacaagtgtactcattctagttccattgaagacttagctcttggccgctgcatggaaataatgaacgttgaggcaggtgattcaagggatactatcgggaaggagaccttccacccttttgttccagagcaccatctcatcaagggatacttgccgcggaccttttggtactggaactataattattaccctcccgttgagggaccaggctgttgcagcgatctcgccgtctccttccactatgtagacagcacgactatgtacgagctggagtaccttgtgtaccatttgagaccctacggctatttgtatcgttatcagccaaccctacccgagagaatcctgaaggagatcagccaggcaaataaaaacgaagatacaaaggtaaaactaggcaacccgtag

SEQ ID NO: 200675 - DNA, 231 bp, Artificial Sequence
  Description of Artificial Sequence: Synthetic coding sequence
atgaccagcagcggccccggcccccggttcctgctgctgctgcccctgctgttgccgcctgctgccagtgccagcgaccggccaagaggtagagatcccgtgaacccagaaaagttgctggtgattacggtggccactgccgagacggaaggatacctgcggttcctgaggagtgctgagttttttaattataccgtccgaacattgggcctgggtgaggaatggaggtag

SEQ ID NO: 200676 - DNA, 732 bp, Artificial Sequence
  Description of Artificial Sequence: Synthetic coding sequence
atggagaagtacgccgaccgggaggacatgatcatcatgttcgtggacagttatgatgtgattctggccgggtcgcctacagaattactgaagaagtttgtgcagtctggatcgagactgctgttttctgcagagtcattttgttggcccgagtggggtctggctgagcaatacccggaggtgggtaccggcaagcgatttctgaattctggtggttttatcggattcgccacaactattcatcagatagttcgacagtggaaatacaaggatgacgacgacgaccagctgttctacacgcgcctttacctcgacccaggcctgcgagagaagctttctttaaatctggaccacaagtcacgaatcttccagaatcttaatggggctctcgacgaggtggtgcttaaatttgacaggaatagagtgaggatcagaaacgtggcctacgacacactcccaatagtagttcatgggaacggcccaactaaattgcaacttaattatctggggaattatgtacccaacggttggactccagaggggggatgtgggttttgcaatcaggaccggcgcacactcccaggcggtccagccagccctcctggcgtgtccgggagagtatgtgggactgcttatagcgtgtccgctccgttacctgccgctgccgccaccccagggctttctcctcggcaggggcatccgtttcctgcccagcagcgtggcctaccctag

SEQ ID NO: 200677 - DNA, 1740 bp, Artificial Sequence
  Description of Artificial Sequence: Synthetic coding sequence
atggccgccaagagcgacggcgccgccgccagcgccagccccgacccggaaggcgccgctggtggcgctcgcggctccgctggaggacggggggaagcagcagcggcagccggcccaccaggggtggttggtgcaggggggcctggaccacggtacgaactgcgggactgttgctgggtgctgtgtgccttgcttgtgttcttctccgacggcgccacagacctctggctggccgcctcctattacctccagaaccaacacacatatttctcattaacgctactgttcgtgttgcttccaagtcttgttgtgcagctactcagcttccgttggtttgtatacgattattctgagccagctggaagccctggccctgccgtgtctaccaaggacagcgtggccggaggagccgctatctcaacaaaggactcagccggcgcctttcggactaaagagggctctcccgaacctgggcctcaaccggctccttcttcagcctcggcctataggcggcgatgctgcagactgtgtatctggttactgcagacactagtccatctgctgcagcttgggcaggtatggcggtatctgagagcgctctacttaggtttgcagagccgctggagaggtgaaaggctccgcagacacttttactggcagatgctgttcgagtcagctgatgtctctatgctccgtctgctcgagacgttccttaggtcagccccgcagcttgtgctccagctgagcctcctggtccacagagggggtgcccccgatcttcttcccgctttgagcactagtgcgtctctggtgtccttggcatggaccctggcctcgtaccagaaagttcttcgtgattccagagatgacaaacggcctctttcctacaaaggcgcagtcgctcaggtcttgtggcacttattttcaattgcagcccggggccttgccttcgcccttttcgcatctgtgtacaaactgtacttcgggattttcattgtggcccactggtgcgtgatgacgttctgggtgattcagggcgagaccgatttctgcatgagtaagtgggaggagattatctacaacatggtcgttggaatcatctatattttttgctggtttaacgtcaaggagggcagaagcaggcgtagaatgacactgtaccattgcatagtactactagaaaatgcagctttgaccgggttctggtactcctctcggaacttcagcacggatttctattcactgatcatggtttgcgtggttgcctcatcattcgcactgggtattttcttcatgtgcgtttactactgtctccttcacccaaacggtcccatgctcggaccgcaagccccaggctgtatctttaggaaggcttccgagccttgcgggccacctgctgatgctataacttcgcccccaagaagccttccgcgcaccactggtgccgagcgggacggagccagtgccggcgagcgggcagggacaccaactccccctgtcttccaggttcggcccggtttaccgcctaccccggtggccaggactctgaggacagagggaccagtgatcaggatcgacctgcctcggaagaagtacccagcttgggacgctcatttcatagacaggagactcagaaaaactatcttggccctggaatactctagccccgctacgcccagactgcagtaccgtagcgtgggcacctcacaagagcttctggaatatgagacgacggtatag

SEQ ID NO: 200678 - DNA, 765 bp, Artificial Sequence
  Description of Artificial Sequence: Synthetic coding sequence
atggcctggcagggcctggtgctggccgcctgcctgctgatgttcccatctaccactgccgattgcctctctcgttgcagcttatgcgccgttaaaacacaggacggacccaagcctataaatcctctgatctgtagcttacagtgccaggcggcattactgccatctgaggagtgggaacggtgccagagctttctctcttttttcaccccttctactttgggtctgaacgacaaggaggaccttgggagtaagagcgtgggtgaaggaccttacagtgaattggcaaaactgagcggctcatttctgaaggagctcgagaagagcaagttcctgccaagcatctcaacgaaagaaaacaccctgtccaaatccctggaagagaagctccgagggctgagtgacggctttcgcgagggggctgagtcagagctaatgcgagacgcacagctgaacgacggagcaatggaaactggcacattgtacctcgcggaggaagaccccaaggagcaggttaaaagatacgggggcttcctgagaaagtaccccaagcgctcttcagaagtggctggagagggagacggtgacagtatgggtcacgaagatctgtacaaaaggtacggcggattcctccgccgcattcggccgaagctcaaatgggacaatcaaaagcgctatggtgggtttcttagacgccaatttaaggtggtcaccaggtctcaggaggatcccaatgcatattctggcgaactgttcgatgcctag

SEQ ID NO: 200679 - DNA, 765 bp, Artificial Sequence
  Description of Artificial Sequence: Synthetic coding sequence
atggcctggcagggcctggtgctggccgcctgcctgctgatgttccctagcaccaccgctgattgtttaagcaggtgctcgctctgtgccgttaagactcaggatggaccaaagcctatcaaccccctaatctgctctcttcagtgccaggccgctttgttgccttccgaggaatgggagcgctgccagagcttcttgtcttttttcaccccctccaccttgggcctaaatgacaaagaggatctcggctcgaagagtgtgggggaggggccgtatagtgaattagctaagcttagcggtagtttccttaaggagctggagaagagcaagttcttacccagcatctctacgaaagagaatactctttcaaagtcgctcgaagagaaacttcgaggactgagtgacggctttagggagggcgctgagtccgaacttatgagagatgcccagcttaacgatggggccatggagactggaactctatacctcgccgaggaggaccccaaagagcaggtcaagcgttatgggggtttcctgagaaagtacccaaaacggtcttccgaagtggctggcgaaggcgatggtgatagcatgggtcacgaggatctctacaagcggtatggtgggtttctcaggagaatacgcccgaagctcaagtgggataaccaaaagcgctatggtggctttttgagaagacagttcaaggttgtaacaaggtcacaggaagaccctaacgcatattcaggcgagctcttcgacgcctag

SEQ ID NO: 200680 - DNA, 804 bp, Artificial Sequence
  Description of Artificial Sequence: Synthetic coding sequence
atggcccggttcctgaccctgtgcacctggctgctgctgctgggccctggattacttgccacagtgagggctgagtgctcccaggactgcgctacttgctcgtacagactcgtaaggcctgccgacatcaactttttggcgtgtgtgatggagtgcgagggcaagctgccttctctcaaaatttgggaaacttgcaaggaattgttgcagctcagtaaacctgagttgccgcaggatggaacctccaccctcagggagaatagcaaacccgaagagtcacacctcctagccaaacggtacggcggtttcatgaaaagatacggtgggtttatgaagaagatggacgaactgtaccccatggagcccgaagaagaagcaaacggtagcgagattcttgccaaacgttatggtggtttcatgaaaaaagacgccgaggaggatgattccctggcaaactcttctgacctgctcaaggagctgctcgaaacaggtgacaatagagagagaagccaccaccaggacggttctgataatgaggaagaggtatctaagcgatacggcgggttcatgcgcggcctgaagcgaagcccacagttggaggatgaggccaaagagctgcagaagcgctacggagggtttatgcgccgggtcggtcgccccgaatggtggatggactaccagaagcggtatggaggcttcctgaagcggttcgcagaggcccttccttctgacgaggaaggcgagagttatagcaaggaggtaccggagatggagaagagatacggtggtttcatgcgcttttag

SEQ ID NO: 200681 - DNA, 804 bp, Artificial Sequence
  Description of Artificial Sequence: Synthetic coding sequence
atggcccggttcctgaccctgtgcacctggctgctgctgctgggccctggactccttgcaaccgttcgcgccgagtgcagccaagattgcgcaacctgctcgtacaggctggtgagacctgccgacatcaacttcctagcttgcgtcatggagtgcgaaggaaagctgccctccctgaagatctgggagacgtgtaaggagctcttgcagctttccaagcctgagctgccacaggatggaacctctacactcagagagaacagtaaaccagaggagagccacctgctggcgaaaaggtatgggggttttatgaagcggtacggagggtttatgaaaaagatggatgaactgtaccctatggaacccgaagaggaagcaaacgggagtgagatactggctaagcgctatggtggatttatgaaaaaagacgccgaggaagatgattcattggcaaacagctcagacctgctcaaggaactacttgagactggggacaatcgagaacggtcgcatcaccaggacgggtcagataatgaagaagaagtgtcaaagcgatacggaggttttatgcgtggccttaaaaggtccccacagctggaggatgaagctaaggaactacaaaaacgatacgggggttttatgagaagagtgggcagacccgaatggtggatggattatcagaagcgatacggaggcttcctcaaacggttcgctgaggcactcccttcagacgaggagggggaaagttacagtaaggaggtgcctgagatggagaagcgctacgggggcttcatgcggttttag

SEQ ID NO: 200682 - DNA, 318 bp, Artificial Sequence
  Description of Artificial Sequence: Synthetic coding sequence
atggcccggttcctgaccctgtgcacctggctgctgctgctgggccctggtctacttgccacagtccgggcagagtgcagccaggactgtgcaacctgtagttatcgtctggttaggccagcagacatcaactttctcgcatgtgtgatggagtgcgaaggaaaacttccctcactcaaaatatgggaaacctgtaaggaactcttacagttatccaaaccagagctgccgcaagacggcacatcgacgctgagagagaacagcaaacctgaagaatcccatttgcttgcgaaacgctacggggggttcatgaaatag

SEQ ID NO: 200683 - DNA, 570 bp, Artificial Sequence
  Description of Artificial Sequence: Synthetic coding sequence
atggcccggttcctgaccctgtgcacctggctgctgctgctgggccctgggctactcgcaacagtgagagctgagtgtagccaagactgcgccacctgtagttacagactggtccgacctgccgatataaattttttagcttgcgtgatggagtgtgaggggaaactgcctagtctgaagatctgggaaacatgtaaggagctgctgcagctgtctaagcctgaactcccccaggatggaactagtaccttgcgggagaactcaaagccggaggaatctcacctactcgctaaaaggtacggcggtttcatgaaacgatatggcgggtttatgaagaagatggatgaactttaccctatggagcctgaggaagaggccaatggatccgagattctagcaaaacgctatggtggcttcatgaaaaaagacgctgaagaggacgacagcctggctaatagtagtgacctgctcaaggagctcctcgagactggggataaccgggagcgatcccaccaccaggatggctccgataatgaagaggagaagaagaaaaaaaagagaaaagagtag

SEQ ID NO: 200684 - DNA, 423 bp, Artificial Sequence
  Description of Artificial Sequence: Synthetic coding sequence
atggccggctggcagagctacgtggacaacctgatgtgcgacggctgctgtcaggaagcagccatagtgggatactgcgatgcaaaatacgtttgggccgccacagccggtggggttttccagtctattactccgatcgaaatcgatatgattgtcggcaaggatagggaggggttttttaccaacgggctgactctaggtgctaagaagtgttcagttatccgggattccctctacgtggatggcgactgcactatggacatcagaaccaaaagccagggcggagagcccacatataatgtggctgtaggacgcgccggcagagtcctagtgtttgttatgggcaaggagggcgtccacgggggcggtttgaacaagaaggcctactccatggcgaaatatctcagagacagtggattctag

SEQ ID NO: 200685 - DNA, 423 bp, Artificial Sequence
  Description of Artificial Sequence: Synthetic coding sequence
atggccggctggcagagctacgtggacaacctgatgtgcgacggctgctgtcaagaggccgctatcgtaggttattgtgatgctaagtatgtgtgggctgccacagccggcggagtgttccagagcatcacgcccatcgaaattgacatgattgttggaaaggatagagaaggcttcttcaccaacgggctgactctcggggccaaaaagtgcagcgtgataagagactccctttatgtagacggcgactgtaccatggatatcagaaccaagagtcaggggggggaacctacttataatgtggcggttggtcgggccggacgtgcacttgtgattgtcatgggtaaagagggggtacatggcgggacactaaataaaaaggcttatgagctggctctttatctccggcgcagcgacgtgtag

SEQ ID NO: 200686 - DNA, 414 bp, Artificial Sequence
  Description of Artificial Sequence: Synthetic coding sequence
atgggcgactggaaggtgtacatcagcgccgtgctgcgggaccagcgtattgacgacgtcgctatcgtgggccacgccgataattcatgtgtttgggcatcaagacctggtggcctgctcgcggcgattagcccccaggaagtaggcgtcctgacaggcccagacagacacaccttcttgcaagccggtctgagtgtggggggtaggagatgctgtgtgatcagggaccacctgctggccgagggcgacggtgttctagatgcacggacaaaaggactcgatgccagagcagtgtgcgtggggagagcgccacgagccttactggtgcttatgggacgtaggggagtgcatggcggaatcctcaacaagacagttcacgagctgatccggggcctccgcatgcaaggggcctag

SEQ ID NO: 200687 - DNA, 1167 bp, Artificial Sequence
  Description of Artificial Sequence: Synthetic coding sequence
atgaagtggatggtggtggtgctggtgtgcctgcagctgctggaggctgccgttgtgaaggtccccctcaaaaagttcaagtccatacgtgagaccatgaaagagaaaggactcctgggggagtttctccgtacccacaagtatgatccagcgtggaagtatagatttggcgacctgtcagtcacatatgagcccatggcttacatggatgccgcctatttcggagagatcagcatcgggactcccccccagaattttctagtgctgttcgataccggaagttcgaatctctgggtcccatctgtatactgtcaatcccaggcctgcacgagtcacagcagatttaacccttctgagtcctctacttatagcactaatggacaaaccttcagcctgcagtacggatcaggatccctcactggcttcttcgggtacgacacacttaccgtgcagtccatccaggtccctaaccaggagttcgggctgtccgaaaacgagcctggaacaaatttcgtatacgcacagtttgatggaatcatgggcctggcctatcccgccctcagtgttgacgaggcgactacagcaatgcaaggcatggtacaggagggcgctctgacatcccctgtgttcagcgtgtatcttagcaaccagcagggcagtagcggaggtgctgtagtgttcggaggggtggatagcagtctctacacagggcagatctactgggctccagtgactcaggaactttactggcagattggcattgaagagtttttgatcggtggtcaggctagcggctggtgctctgaaggctgtcaggctatcgtcgacaccggcacctctcttcttactgtaccccagcagtatatgagcgctctccttcaggccactggagcccaagaagacgaatatgggcaattccttgtcaactgcaactctatccagaatctaccaagcctgaccttcataataaacggagttgagtttcctctccccccatccagctatattctgagcaacaatggatattgcaccgtgggagtagaaccaacatacctctcaagtcagaatggtcagcccctttggattttgggggatgtgttcctgagaagttattattccgtgtacgacctcggcaataacagggtggggtttgcaacggcagcatag

SEQ ID NO: 200688 - DNA, 315 bp, Artificial Sequence
  Description of Artificial Sequence: Synthetic coding sequence
atgaagtggatggtggtggtgctggtgtgcctgcagctgctggaggcagccgtcgtgaaggtcccactgaaaaaatttaagagtattcgcgaaaccatgaaggagaaaggcctgctgggggagtttcttcggacccacaagtacgacccagcctggaagtataggtttggagatttgagcgtcacatatgagccaatggcctatatggatgcagcttactttggtgagattagcattggaacacctcctcaaaacttcctcgtactgttcgatacaggctctagccctctgcccctggaccccgcgccctcctag

SEQ ID NO: 200689 - DNA, 411 bp, Artificial Sequence
  Description of Artificial Sequence: Synthetic coding sequence
atgaagtggatggtggtggtgctggtgtgcctgcagctgctggaggcggcagtggtgaaggtgccactgaaaaagttcaaaagtatccgcgaaacaatgaaagaaaagggcctgctgggagaattcctcagaacgcataagtacgacccggcatggaagtaccgctttggggacctctcagttacctacgagcccatggcctacatggatgtccaaagcattcaagttcctaatcaggaatttggtctgtccgagaatgagccaggaacaaatttcgtgtatgcccagtttgacggtatcatgggcctggcctatcccgccctctccgtcgacgaagctaccacagcaatgcagggcatggtccaggagggcgctctaaccagcccagtgttcagtgtatacctcagttag

SEQ ID NO: 200690 - DNA, 948 bp, Artificial Sequence
  Description of Artificial Sequence: Synthetic coding sequence
atgaagtggatggtggtggtgctggtgtgcctgcagctgctggaggccgccgtggtgaaagtgcccctgaaaaagttcaagtccatcagagagaccatgaaagaaaaagggcttctcggagagtttctcagaacccacaagtatgatcctgcctggaaatatcggttcggtgacctttcggtgacctacgagcccatggcttatatggacgccgcatatttcggtgagatctcaatcgggacgcccccccagaattttttagttctgtttgatacaggaagctcaaacctttgggttcccagcgtgtactgtcagtcccaggcctgtactagccacagtcgattcaaccctagcgaatctagcacatactccactaatggtcagactttctctctccagtacggctctggctctctaaccgggttctttggatatgacaccctgaccgtgcaaagcatccaggtgcctaatcaggagttcggtctgagcgagaacgaacccggaaccaactttgtttatgctcaatttgatggaatcatgggcctggcctaccctgcactgtccgtcgacgaggccaccacagcaatgcagggcatggtgcaggaaggggcactcacctctccggtgttcagcgtgtatctgagtaatctggttcttgaaagttccggtctgggtcctctgctcactccctcccgggctgcacccccctcttcaacgctgcagttacctgagaagccgctcgagcagacttggaacatcctgaccccttttacaaagacgctgccagtttccaatcttagtcgtaaagtcacatcttgggcgggcgtgggtattccagtgacgtgcctgcctgaagccggttctggtggtgaacgacgcgccgagtgcgggctgggggtaccaacaacacgaggacctccccgttctcagcatcactccggcgcttag

SEQ ID NO: 200691 - DNA, 543 bp, Artificial Sequence
  Description of Artificial Sequence: Synthetic coding sequence
atgctgtgcctgctgctgaccctgggcgtggccctggtgtgcggcgtccccgctatggacatcccccagactaagcaggatttagagctgccgaaacttgctggcacatggcatagcatggccatggccaccaataatatttcactgatggccactttgaaagcccccttacgggtgcatattacatcactcctcccgaccccggaggataatctcgagattgtcttgcataggtgggaaaataattcatgtgtggagaagaaggtgcttggagagaaaactgaaaaccccaagaaatttaagatcaattacaccgtagccaatgaagcaaccctgctcgacacggactacgataatttcctgtttctttgtctgcaggatacgacaactcctatccagagcatgatgtgccagtatctcgcacgcgtcttggtcgaagatgacgagattatgcagggatttatccgggcgttccggcccctaccacgacatctgtggtacctgcttgatttaaaacaaatggaagagccttgtcggttttag

SEQ ID NO: 200692 - DNA, 261 bp, Artificial Sequence
  Description of Artificial Sequence: Synthetic coding sequence
atgctgtgcctgctgctgaccctgggcgtggccctggtgtgcggcgtccctgctatggacatccctcagacaaagcaggacctcgagttaccaaaggacactaccacccccatccaaagtatgatgtgccagtatttggcacgcgtcttggtggaggacgatgagatcatgcaaggtttcatccgggcctttcgccccctgccaaggcacctgtggtacctcttggacctgaagcagatggaagccccgtgttggctttag

SEQ ID NO: 200693 - DNA, 543 bp, Artificial Sequence
  Description of Artificial Sequence: Synthetic coding sequence
atgctgtgcctgctgctgaccctgggcgtggccctggtgtgcggcgtcccggctatggatatcccccagactaagcaggatcttgagctgcctaagctggcgggcacatggcactctatggctatggcaactaacaacatcagcctgatggctactcttaaagctccgctgcgcgtgcatataacatccctgctccctacaccagaagataacctggagattgtgctccatcgctgggaaaacaacagttgcgtggagaaaaaagtgttgggagagaaaaccgagaacccaaagaaattcaagataaactacaccgtcgcaaatgaggcaacgctgttggacacggattatgataattttctttttctgtgcctgcaggacacaactacccctatccagagtatgatgtgccagtacttggcaagagtcctggttgaggacgatgagatcatgcaagggttcatcagagccttccggccactgccccgccacctttggtatctccttgatctgaaacagatggaggaaccttgtcggttctag

SEQ ID NO: 200694 - DNA, 438 bp, Artificial Sequence
  Description of Artificial Sequence: Synthetic coding sequence
atgctgtgcctgctgctgaccctgggcgtggccctggtgtgcggcgttccagcgatggatatacctcagacgaagcaggacctggaactgccaaaggcccccctgcgggtgcacattacctctctgctgcccacccctgaagataacctagaaatcgttctccatagatgggagaacaactcatgcgtggagaagaaagtgctcggagagaaaaccgagaatcctaaaaagttcaagatcaactgcaaggcctcgggggctcctcagctgtcatggaaaccgcaggggccgaggacggaccccgccagctccaccgcccgagttctggttgaagacgacgaaatcatgcagggctttatcagggcttttcgtcccctgcctagacacctctggtacttattggacctgaagcagatggaggaaccttgccgcttttag

SEQ ID NO: 200695 - DNA, 399 bp, Artificial Sequence
  Description of Artificial Sequence: Synthetic coding sequence
ctgatggccaccctgaaggcccccctgcgggtgcacatcaccagcttgctgccaaccccagaggacaacttagaaatcgttctgcataggtgggagaacaacagctgtgtggagaaaaaggtgctcggagagaagaccgagaacccaaagaaattcaaaataaactatacagtggccaacgaggccacacttctggacaccgactacgataacttcctctttctctgtctccaggacacgaccaccccaattcaaagcatgatgtgccagtaccttgccagggtgctagtagaggatgacgagattatgcaagggtttatccgcgcattccgccccctcccccggcacctatggtacctgttagacctgaagcagatggaagaaccatgcaggttctag

SEQ ID NO: 200696 - DNA, 396 bp, Artificial Sequence
  Description of Artificial Sequence: Synthetic coding sequence
tgagtgcccgccatggacatcccccagaccaagcaggacctggagctgccaaaggcccctcttcgcgtgcacatcacctcactattgcctactccagaggacaatctggaaatcgtcctgcaccgatgggagaataactcctgtgtagagaaaaaggtcctgggcgaaaaaacagaaaacccgaagaagtttaaaatcaattgcaaagcttcaggtgcaccacaactgagctggaagccccagggccctcggactgatcccgcctcctctacggcaagggttctggtggaggacgacgagattatgcaggggtttattcgagctttccgcccactgccccgtcatctgtggtaccttctggatctgaagcagatggaagaaccttgcagattctag

SEQ ID NO: 200697 - DNA, 381 bp, Artificial Sequence
  Description of Artificial Sequence: Synthetic coding sequence
tgacccctgcgggtgcacatcaccagcctgctgcccacccccgaggataatctggagatcgtcctgcacaggtgggaaaataatagctgtgtcgagaagaaggtgctgggcgaaaaaaccgaaaacccaaaaaaatttaaaatcaactacaccgtagccaacgaggcaacgctccttgatacagactatgacaacttcctgtttctctgtctgcaagatactaccacacctattcagtccatgatgtgtcagtatctggcccgcgtattggtcgaggatgacgaaattatgcagggttttatcagagcattccggccactgcctagacacctatggtacttactagatctgaagcagatggaggagccctgtagattttag

SEQ ID NO: 200698 - DNA, 102 bp, Artificial Sequence
  Description of Artificial Sequence: Synthetic coding sequence
tgagagatcatgcagggcttcatccgggccttccggcccctgcccagacacctctggtatctcctggacctgaagcagatggaggaaccatgcaggttttag

SEQ ID NO: 200699 - DNA, 543 bp, Artificial Sequence
  Description of Artificial Sequence: Synthetic coding sequence
atgctgtgcctgctgctgaccctgggcgtggccctggtgtgcggcgtgcctgctatggacattccccaaacgaagcaggatctggagctccccaaactcgcgggaacatggcacagcatggccatggccactaacaatatttctttaatggccactcttaaggcacctttgcgggtacatataacctctctcctcccaacgcctgaagataacctcgaaatcgttctccaccgttgggagaataacagttgcgttgaaaagaaagtgttgggtgaaaagactgaaaacccaaagaaattcaaaattaattacaccgtggctaacgaagcgacactgcttgatactgattacgacaacttcttgtttctgtgtcttcaggatacaacaacacccattcagtcaatgatgtgccagtacttggcacgcgtgttggttgaagacgatgagattatgcagggattcatcagggcgtttcgtcctctcccgcggcatttatggtacctcctggatttgaagcaaatggaagaaccgtgtcggttctag

SEQ ID NO: 200700 - DNA, 510 bp, Artificial Sequence
  Description of Artificial Sequence: Synthetic coding sequence
atgctgtgcctgctgctgaccctgggcgtggccctggtgtgcggcgtgccagctatggatattccacaaacaaagcaggatctggaactcccaaagttggcaggaacctggcattcaatggccatggctacgaataacattagtctcatggcaaccctcaaggccccactcagggtgcatattaccagcctcctgcctactcctgaggataacctcgagatcgtgctgcaccggtgggaaaataacagctgcgtcgagaaaaaggtgctcggtgagaaaaccgagaacccaaagaaatttaagataaactatactgtcgctaatgaggccaccctgctcgacaccgattatgataacttcctgttcctgtgcttgcaggacactacaacaccaattcagagtatgatgtgtcaatacctcgaatcctggtggcggacaatgagatcttgtcgtgactcctcggggctgagcggtccatgccccggtacttacggcacctgttggacctag

SEQ ID NO: 200701 - DNA, 2274 bp, Artificial Sequence
  Description of Artificial Sequence: Synthetic coding sequence
atgagccggaagatcagcaaggagagcaagaaggtgaacatcagctccagtcttgaatcagaggatatcagcttggaaactacagtgcctaccgacgatatcagctccagcgaggaacgtgaggggaaagtgcgtattactcggcagctcatagagaggaaggagctattgcacaatatacagctgctgaaaattgaactgagccagaaaaccatgatgatagataacctgaaggttgactacctgaccaagatcgaggaactggaggagaaattgaatgatgctctgcatcagaagcagctcctgactctgcgtctggataatcagcttgccttccagcagaaggacgcaagtaagtaccaagaactgatgaagcaggagatggaaacgattctcctacgccagaaacagctcgaggagaccaacctacagctgagggaaaaagcgggcgacgttcggagaaatctccgggatttcgagctgaccgaggagcagtacatcaaactcaaagcgttcccagaggatcaattatccattccagagtacgtatctgttagattttatgagctcgttaaccccctgagaaaggaaatctgcgaattacaggtgaaaaaaaacatccttgccgaagagctctccaccaataagaatcagctgaagcaactgactgagacctatgaggaggatagaaagaactactccgaggtgcagatccggtgccagcggcttgctctcgaactggcagacactaagcagctgattcaacagggggactatagacaggagaattacgacaaagtgaagagcgagcgcgatgccctcgaacaggaagtgatagagctccggcgtaaacatgaaatcctggaggcatcacatatgatccaaacaaaggagcgaagcgaactgagcaaggaggttgtcactcttgaacagaccgtcacactgctccagaaagacaaagaatacctcaacaggcagaatatggaattgtctgtgcgctgcgcccacgaggaggaccgactcgagcgactgcaggcgcagctggaggagagcaagaaagctcgcgaggagatgtacgaaaaatacgtcgcctctcgcgaccactataaaacagaatacgaaaataagttgcacgacgaactggaacagatcaggctgaagacaaatcaggaaatcgatcagctgagaaacgctagccgtgagatgtacgagagggagaatcgcaatctccgggaggctagagacaatgccgtggcagagaaggagcgcgccgtgatggccgagaaagacgctctggagaaacatgatcagctcttggaccgttaccgcgagttgcagttatcaaccgagagtaaagtcaccgagttccttcatcagagtaagctaaagagtttcgagagtgagcgagtccagctgctgcaggaggaaacagcaagaaatctgactcagtgtcagctcgaatgtgagaagtaccaaaagaagttggaggtactgaccaaagaattctactcccttcaggcatcctcagaaaagcgtattacagagcttcaagcgcagaactccgagcatcaggcccgcctagatatctacgaaaaactagagaaggagctagatgagatcattatgcagacagccgaaatcgagaacgaggacgaggccgagagggtactattttcctacgggtacggcgccaatgtgcccaccactgccaagaggcgcctgaaacagagcgtgcacctagcccgccgcgtcctccaactcgagaaacagaacagtctcatactaaaagatctggagcacaggaaagatcaagtaacccagctaagtcaggagctagaccgagcaaattcgttgttgaaccagacccagcaaccatacagatacctgattgagagcgttaggcagcgggatagcaaaatcgactccctgacagagtccattgcccagctcgagaaggacgtttccaacttgaataaggagaagtcagctcttctccaaactaagaaccagatggcactggatttagaacagcttctcaaccacagggaggagctcgctgcaatgaagcagattctcgttaagatgcactcaaaacacagcgaaaatagcttacttctcactaagacggagcctaagcatgttacggagaatcagaaatcaaagaccttaaacgtcccgaaagagcatgaagacaacatcttcaccccaaaaccgaccctattcactaagaaagaagccccagaatggagcaagaagcagaagatgaagacatag

SEQ ID NO: 200702 - DNA, 651 bp, Artificial Sequence
  Description of Artificial Sequence: Synthetic coding sequence
ttccggaccgccaaggtggagaacgaggacgaggccgagcgggtgctattctcttatgggtatggagcaaatgtgcctacaactgccaagaggcgcctcaagcagtcagtacacctcgccaggcgcgtgctccagctcgagaagcaaaacagcctcatcctgaaagatctcgagcatagaaaggaccaagtgacgcagctgagtcaggagttagaccgggcgaactctctgttaaatcagactcagcagccatatcgctatctgattgaatccgttagacagcgcgatagcaaaatagactctctcactgagagtatcgctcagctcgaaaaggacgtttcgaatctcaataaggagaagagtgcgttactgcagaccaagaatcagatggcactggacctggagcagttgctaaaccatcgggaggagctggctgcaatgaaacagatacttgtcaagatgcacagtaagcatagcgaaaacagtctgctgctaacgaaaactgagcctaaacacgtgaccgagaaccaaaaaagcaagactctgaacgtgcccaaggagcacgaagataatattttcactccaaagcctacccttttcaccaagaaagaggctccagagtggagcaaaaaacagaagatgaagacctag

SEQ ID NO: 200703 - DNA, 1245 bp, Artificial Sequence
  Description of Artificial Sequence: Synthetic coding sequence
atgagccggaagatcagcaaggagagcaagaaggtgaacatcagctcatctctggagagtgaggacatttccttggagacaaccgtgccaacagatgacatctccagctccgaggaacgcgagggaaaggttcgtattacaagacagttgatagagcgcaaggagctcttgcacaacatccagctcctgaaaatcgaactttcccagaaaaccatgatgatcgacaatctgaaggtcgactatcttacgaaaatcgaagagctagaggagaaacttaacgacgccctgcatcaaaagcagctgctcacattgaggctggataatcagttagcctttcaacagaaggatgccagcaagtaccaggagcttatgaagcaggagatggagacaattctgctcagacagaagcagctggaggagactaaccttcagttacgggaaaaagcgggagacgtgcgcagaaacctccgagactttgagctgacagaagagcaatatatcaagctgaaggctttccctgaagatcaacttagcatccctgagtacgtttcagtacgattttacgagcttgtgaatccactgcgcaaggaaatctgtgaactgcaggttaagaagaacattttggcagaggagttgtcgacgaataagaatcaactgaaacagctgaccgagacgtacgaggaggacaggaaaaactattccgaagtgcaaatacgctgtcagcgacttgcattggagctagcagatacgaaacaattgatccagcaaggggactatcgtcaggaaaattatgacaaggtaaagtctgagagggatgctttagaacaggaggtgatcgagctgcgcaggaagcacgagatactggaggcgtcacatatgatccagacaaaagaaaggtccgaactgagtaaagaggtggttacgctggagcagactgtcaccttgctacaaaaggataaagagtacctaaatcggcagaacatggaactcagcgtccggtgcgcgcacgaggaagatagactcgagagattgcaagcccagctggaggagagcaagaaggctcgcgaggagatgtacgagaagtatgtggcttccagagatcattataaaactgagtatgagaataaactccacgatgagttggagcagatccggctgaaaacaaatcaggagatcgatcagttgcgcaacgcttcccgagaaatgtacgaaagggaaaatcgtaagaagcggaaaaagaaatag

SEQ ID NO: 200704 - DNA, 1734 bp, Artificial Sequence
  Description of Artificial Sequence: Synthetic coding sequence
atgaccgagctggccggcgccagcagcagctgctgccaccggcccgctggccgcggcgccatgcagtcggtccttcatcattttcaacgcctcagagggcgtgagggtgggagtcacttcattaatactagttccccacgcggagaggccaagatgtcaataacctccgatgaggttaacttcttggtgtacagatatcttcaggaatctgggttctcccactccgcttttacattcggaattgaaagtcatatttctcagtcgaacatcaacggtacgctggtccctccagccgccttaatctctatccttcagaagggcttgcagtacgtggaagctgaaatctccatcaatgaggacggtacagtgttcgacggtagaccaatagaaagcttgtccctcatcgatgccgttatgccagacgtcgtccagactcgtcaacaagcattcagggaaaaactggcccaacaacaagcatctgccgcggcggcagctgccgctgcaaccgccgcggccaccgcagctaccacgacctctgcaggagtaagtcatcagaatccatcaaaaaatcgggaggccacagtcaatggcgaagaaaacagggcccacagcgtcaataatcacgccaaacccatggaaatcgatggtgaagtagaaattccatcaagtaaagccaccgtgctgagaggacatgagtccgaagtttttatctgcgcgtggaatcctgtctccgacctcctagcttcaggttccggggacagcaccgcccggatctggaacctgaatgagaactccaacggcggatcaacccagctagtcctacgccactgtatcagggagggagggcacgatgtgccgtccaataaggacgtcacaagtctcgattggaacactaatggcaccttgctggcaactggctcctacgatggatttgccaggatctggactgaggatggtaaccttgcgtctactctgggtcagcacaagggcccaattttcgcactgaaatggaacagaaagggcaactacatactgtctgccggcgttgataagacgaccatcatttgggatgcccacactggcgaggctaagcaacagtttcctttccacagcgcccccgcgttagacgtggattggcagaataacacaaccttcgcttcctgtagcaccgacatgtgcatccacgtttgccgcctagggtgcgataggcccgttaaaaccttccagggacatacaaatgaggtgaacgccatcaaatgggatccatccggcatgctgttagcctcttgctctgatgacatgacactgaagatttggagtatgaagcaggaggtgtgtattcacgacctccaagcacataataaggagatctatacaatcaaatggtctccgactggacccgccacgtccaacccaaattcaaacataatgctggcctccgcttctttcgattcaacagtcagactctgggatatcgagaggggcgtgtgtactcataccttgacgaaacatcaggagcccgtgtacagcgttgcgttcagcccggatggaaaatatctggccagtggaagcttcgataaatgcgttcatatctggaacacccagtccggcaatctcgtgcattcctatcggggaaccgggggaattttcgaggtgtgttggaacgcacgcggcgataaagtaggggcctcggcttccgacggaagcgtgtgcgtcctggatttacgaaaatag

SEQ ID NO: 200705 - DNA, 432 bp, Artificial Sequence
  Description of Artificial Sequence: Synthetic coding sequence
atggccgccgaggacgtggtggccaccggcgccgaccccagcgacctggagtctggcggcctcctccatgaaatttttacaagtcccctgaacttacttttgttaggattgtgcatcttcttattgtataagatcgtcaggggagaccagccagctgccagcggtgattctgatgatgatgagccccccccgctcccccgcctcaaacgaagggattttactcctgctgagctgaggcgctttgatggcgtgcaggaccctcgtattctcatggccatcaacggtaaggtattcgatgtcactaaaggcagaaagttttacggacccgtgaagtaccatcacgtcggaaaacttctgaaggagggtgaagaacctaccgtctacagtgatgaggaggagccaaaggacgagagtgcccgtaagaatgactag

SEQ ID NO: 200706 - DNA, 672 bp, Artificial Sequence
  Description of Artificial Sequence: Synthetic coding sequence
atggccgccggcgacggcgacgtgaagctgggcaccctgggcagcgggtctgagagctcaaatgacgggggctccgagtctcccggcgacgccggcgcagctgcagaggggggcggatgggcagctgccgcgttggccttgctgaccggtggaggagaaatgctgcttaacgtggccttggttgcgctggtgttgcttggggcttacaggttgtgggtccgctggggcaggaggggcttgggtgctggcgccggcgccggggaagagagccccgctacctccctgcctagaatgaaaaagcgcgatttttcacttgaacagctgcggcaatacgacggcagtaggaacccacggattctgctggcggttaacggaaaggtgtttgacgtaacgaaagggtccaaattctacggccccgcaggaccctacgggatctttgcaggtcgggatgcatcgcgtggtctggccaccttttgtctagataaggacgccctccgggatgaatatgacgatctgagcgatcttaacgccgtgcagatggagagcgtcagagaatgggagatgcaattcaaggagaagtacgactatgtcggccgactcttgaagccgggtgaggagcccagtgagtacacagatgaggaggacacaaaggatcacaataaacaggactag

SEQ ID NO: 200707 - DNA, 402 bp, Artificial Sequence
  Description of Artificial Sequence: Synthetic coding sequence
atggccgccggcgacggcgacgtgaagctgggcaccctgggcagcggctctgagagcagcaacgacgggggatcggaatctccaggagacgctggtgccgcggctgagggagggggttgggcagccgcggcactcgccttgctaacagggggaggggaaatgctactgaatgtggccttggtggccttagtactccttggagcataccggctctgggtgaggtggggacgtagaggattgggagctggagccggggcaggccttcagctgggcgcagccgcccctgtgcgacgcctgcctcagcctgctcatcctgctcggggtcagtgggaatccctccggcgggaccaacggcagcaggttcttcggcccggcggctctatttggaacatttgttggtag

SEQ ID NO: 200708 - DNA, 744 bp, Artificial Sequence
  Description of Artificial Sequence: Synthetic coding sequence
atgggcggcgccggccggggcgtgggcgagggccggggccggggcgggggcggcaggcgatggcgagctgttatggccgctggtgatggagatgtgaagctgggtacactcggttcaggcagcgagagctccaatgatggtgggtctgagtcgccaggggatgccggggcggccgccgaagggggcggctgggctgcagccgctctcgccttgttgaccggtggtggggagatgctgcttaatgtcgctttggtggctctggtcctgctcggggcttacaggctgtgggtgaggtggggaaggcgtgggcttggggccggcgccggtgctggcgaagagtcgccagctaccagtctgccacggatgaagaaacgcgatttctccctggagcagctgcggcagtacgatggctctaggaacccccgcatactgttggcagtaaacggcaaagtatttgacgtaacaaaaggctcaaaattctacggccccgctggaccctacggtatcttcgcaggacgagatgcctctagggggttagccacattttgcttagataaggatgcattgagagatgaatatgatgatctgtctgacctgaatgcagtccagatggagagtgtgcgggagtgggaaatgcagtttaaagaaaaatacgattacgtgggtcgcttgttgaagcccggagaagagcccagcgaatatacagacgaagaggacactaaggatcacaataaacaggattag

SEQ ID NO: 200709 - DNA, 1041 bp, Artificial Sequence
  Description of Artificial Sequence: Synthetic coding sequence
atggccatggcccagaagctgagccacctgctgcccagcctgcggcaggtgattcaggagccacagctgagccttcaacctgaacccgtgttcacggtggatagggccgaggtgccccctttgttctggaagccctacatttacgcgggataccggccattacaccagacatggcgattttacttccggaccctctttcagcaacacaacgaagcagtcaacgtttggactcatttactggctgcgctggtgctactgctccgtctagccctgttcgtcgagaccgtcgacttctggggggatccacacgcattgccactattcataatagtgctcgcttctttcacctacctgagtttttctgcacttgcgcacctgcttcaggccaaatcagagttctggcactattctttcttcttcttagattacgtgggtgtagccgtgtatcaattcggatctgcccttgcccacttttattatgcgattgagccagcctggcatgcccaggtccaagctgtttttctcccaatggcagcattcctggcctggttatcatgtatcgggagttgctacaacaaatatattcagaaacctggactgcttgggcggacctgccaggaggtccctagcgtgctggcctacgctctggacatcagccctgttgtgcaccgcatcttcgtttcaagcgaccctaccacagacgatcccgcgctgctttaccacaagtgtcaggtggtgttttttctactggcagccgcctttttctcgaccttcatgcctgaacgctggttccccggctcctgtcacgttttcggtcaaggccatcaactctttcatatcttcctggtgttgtgtacactggcccaactggaggcagtggctttagactatgaagcccgacgaccgatttacgagcctctgcacactcactggcctcataattttagtggactgtttctcctgaccgttggctcctctattctcaccgctttcctcctcagccagctggtacagcgcaaattagatcaaaaaaccaaatag

SEQ ID NO: 200710 - DNA, 867 bp, Artificial Sequence
  Description of Artificial Sequence: Synthetic coding sequence
atgcagatcccccaggccccctggcccgtggtgtgggccgtgctgcaactaggttggcgaccagggtggttcttggactctcccgacagaccttggaacccccccaccttctcccctgcactcctggttgtcacagagggagacaacgccacatttacctgtagtttcagcaacacttcagaatcgtttgttctgaattggtatcgtatgtcaccgtcaaatcagactgataaattggccgcattccctgaagataggagtcagcctgggcaagactgtcgctttcgtgtcacacagctcccaaacggtcgagacttccatatgagtgtggtcagggcccggcgtaatgacagtggaacatacttatgtggcgctattagccttgccccaaaggcacagattaaggagtccctccgggcagagctgcgagtgactgaacgcagggccgaggtcccgactgcccatccctcccccagtcctagacccgctggccaattccagacactggtagttggcgtagtgggagggctccttggcagcttggtattgctggtgtgggtgttagccgtaatatgtagtagggccgcccgaggcactatcggggcccgacgcacagggcagccactcaaggaagatccgtcggcagtccccgtgttcagcgtggactatggagagttagatttccagtggcgggagaagactcccgaaccgcccgtgccatgtgtgcccgaacagaccgaatacgctacgatcgtatttccctccggcatgggaacttcaagtccagcacgccgcgggagcgccgatgggccgaggagcgcgcagcctctccggcctgaggatggtcattgctcttggcctctctag

SEQ ID NO: 200711 - DNA, 540 bp, Artificial Sequence
  Description of Artificial Sequence: Synthetic coding sequence
atgcagatcccccaggccccctggcccgtggtgtgggccgtgctgcaattaggctggcggccaggatggtttctggactcacccgaccgcccttggaaccctccgactttctctccagccctgctcgtggttaccgaaggcgacaatgctacgttcacttgtagcttcagcaacacctcggagtcttttgtgctgaattggtaccgcatgtcgcctagcaatcagactgacaagctcgctgccttcccagaagacagatcccagcctgggcaagattgcagattccgcgtgactcagctgccaaatgggagggattttcacatgagcgtggtgagagcaagacggaacgactctgggacttatttatgcggggcaattagtctggctcccaaagcacaaattaaggagtcccttcgcgccgagcttagggtaacaggaaccattggggcacgcaggaccggtcagccattaaaagaggatccaagcgccgtaccagtgtttagtgttgactacggcgagttggacttccagtggcgctag

SEQ ID NO: 200712 - DNA, 639 bp, Artificial Sequence
  Description of Artificial Sequence: Synthetic coding sequence
atgcggatgaccatggaggagatgaagaacgaggccgagaccacctctatggtttcaatgcctctgtatgccgtgatgtacccggtgtttaacgagctcgagagagtgaacctgtctgctgctcagaccctccgagctgccttcatcaaggccgaaaaagagaaccctggactcactcaggatatcatcatgaaaatcctcgaaaagaaaagcgttgaggtaaactttactgaaagcttgcttaggatggccgctgatgatgtcgaagagtatatgatcgaaagacccgaacctgagtttcaagacttgaacgagaaggcccgagccttaaagcaaatactgtcaaaaatacccgatgagatcaacgaccgcgtccggttcctccagaccattaaagacatcgcgtctgccataaaggagttactggacaccgtgaacaacgtcttcaagaaatatcagtaccagaaccgacgggcacttgagcaccagaagaaagagtttgtcaagtacagtaagtcattttcagacacattaaaaacctacttcaaagacggtaaggctatcaacgtctttgtttctgcgaaccggttgattcaccagaccaatctcatactccagactttcaaaacggtggcttag

SEQ ID NO: 200713 - DNA, 639 bp, Artificial Sequence
  Description of Artificial Sequence: Synthetic coding sequence
atgcggatgaccatggaggagatgaagaacgaggccgagaccacctccatggtgtccatgcccctgtatgcggtcatgtatcccgtttttaacgaactggagcgggtgaatctctccgcagcccagaccctcagagctgcttttattaaggcagaaaaagaaaatccagggttgacccaggatatcattatgaaaatcctcgaaaagaagtctgtggaagtcaacttcacggagagccttctgagaatggctgcagacgatgtggaggagtacatgatagagcggcctgagcctgagtttcaagacctgaatgaaaaagctagggcactgaaacagattctcagcaaaattcctgatgagattaacgacagggtgcgattcctgcagaccattaaggacattgctagcgcaatcaaggagcttctggatacagtgaataacgtcttcaagaagtaccagtaccaaaaccgcagagctctggaacatcagaagaaggaattcgtcaagtactccaagagcttctcagatacattgaagacatactttaaggacggaaaggcaataaacgtctttgtgagcgccaaccgcctgatccatcaaacaaatctaatactgcagacattcaagactgtcgcttag

SEQ ID NO: 200714 - DNA, 441 bp, Artificial Sequence
  Description of Artificial Sequence: Synthetic coding sequence
atgcggatgaccatggaggagatgaagaacgaggccgagaccacctctatggtctcaatgccactgtatgccgtcatgtatcctgtctttaatgagctagagcgggtgaacctctcagctgcccagaccctgagggccgctttcatcaaggctgaaaaagagaaccctgggctgacccaggacattatcatgaaaatcctagagaagaagtccgtggaagtcaattttactgagtctctcttacggatggcagcggacgacgtcgaggagtacatgatcgagcgacctgagccagagtttcaagacttgaatgagaaggctagggccttgaaacagattcttagtaagattccagatgagatcaacgaccgggtccggttcttgcaaaccatcaaagatattgcttcggccataaaagagctgctggacactgtgaactag

SEQ ID NO: 200715 - DNA, 240 bp, Artificial Sequence
  Description of Artificial Sequence: Synthetic coding sequence
atgcggatgaccatggaggagatgaagaacgaggccgagaccacctcaatggtgtcaatgcccctctatgccgttatgtatccagtctttaacgagttggaacgagtgaatctgtccgctgctcagacacttagggccgctttcattaaggcagagaaggagaatccaggccttactcaagacattatcatgaaaattctggagaagaaatcagtggaagttaactttactgagagctag

SEQ ID NO: 200716 - DNA, 639 bp, Artificial Sequence
  Description of Artificial Sequence: Synthetic coding sequence
atgcggatgaccatggaggagatgaagaacgaggccgagaccaccagcatggtgagcatgccgctctatgccgttatgtaccctgtattcaacgagcttgaacgggtgaacctaagcgcagctcagacactgagagcggcatttatcaaagccgagaaagaaaaccccggattgacacaggacatcatcatgaaaatcctcgagaaaaaatccgtggaagtgaattttaccgaatctctgttgcggatggccgccgatgacgtggaggagtacatgatcgagcggccagaacccgagttccaggatctgaacgagaaggcaagagcactaaagcaaatactgagtaaaattccagacgagatcaatgacagggtgcggttccttcagaccattaaggatattgccagcgccatcaaggagctgctggatacggtgaataatgtttttaagaagtatcagtaccagaatagaagagcgctggaacatcagaaaaaggaatttgttaagtatagtaagtctttctccgacacactaaagacttactttaaggacggtaaagcaatcaacgtctttgtgagcgcaaaccgcttaatacaccagaccaaccttatcctccagacctttaaaacagtggcttag

SEQ ID NO: 200717 - DNA, 639 bp, Artificial Sequence
  Description of Artificial Sequence: Synthetic coding sequence
atgcggatgaccatggaggagatgaagaacgaggccgagaccaccagcatggttagcatgccactgtacgctgtcatgtatccggtctttaatgaattggaacgggttaacttatcagcggcacaaactttaagggccgccttcataaaggcagaaaaagagaatcctggcctgacccaggacatcattatgaaaatactggaaaagaaatctgtcgaagttaattttaccgaaagtctgctacgtatggctgcagacgacgttgaggagtacatgatcgagaggcccgagcccgaatttcaggaccttaacgagaaagctcgagctcttaagcagattctttcaaaaatacccgatgaaataaacgaccgcgtccgttttctccaaactatcaaagacatagcaagtgcaatcaaagagctgttagacaccgtcaataacgttttcaaaaagtatcaataccaaaacagacgcgctctggagcaccagaaaaaggagtttgtcaagtacagcaagtcattttccgacactctaaagacctattttaaggacggaaaggcgatcaatgtgtttgtcagcgctaatagactcatccaccagactaacctgatcctccaaactttcaaaacagtcgcttag

SEQ ID NO: 200718 - DNA, 609 bp, Artificial Sequence
  Description of Artificial Sequence: Synthetic coding sequence
atgcggatgaccatggaggagatgaagaacgaggccgagaccacctcaatggtgagcatgccattatacgccgttatgtacccggtcttcaatgaactggaacgggtgaatctctctgctgcgcagactctccgcgctgcttttattaaggctgagaaggagaacccaggccttacacaggacattatcatgaaaatcctggagaaaaagagcgttgaagtaaactttaccgaatccctgttgcgtatggccgccgacgatgtggaggaatatatgatcgagcggccagagccggaatttcaggatttaaatgagaaggcgagagcgttgaaacagatcctctctaaaatccccgatgaaatcaacgatcgagtgagatttctgcaaacgattaaagatatcgcttcagcaatcaaggagcttctagacaccgtgaacaacgtgtttaaaaagtaccagtatcagaacagaagggctctcgagcatcagaagaaggagtttgtgaagtactctaagtcattcagcgacacactgaagacatattttaaggacggcaaagctatcaatgtgttcgtttcagccaatagattaatccaccagaccaactag

SEQ ID NO: 200719 - DNA, 561 bp, Artificial Sequence
  Description of Artificial Sequence: Synthetic coding sequence
atgcggatgaccatggaggagatgaagaacgaggccgagaccacctccatggtgtcaatgcctctctatgcagtgatgtacccagtatttaacgagctggagcgagtgaacctttctgcagcacaaactctgagagcggcctttatcaaggctgaaaaggagaatcctggtttaacccaagatatcatcatgaagatactggaaaaaaagagcgtggaggtcaactttaccgagtccctgctgcgtatggccgccgatgacgttgaagaatacatgattgagcgtccagagcctgaattccaagacctgaacgagaaggctagggctctgaagcaaatcctgtccaagattcctgatgagattaacgatagggttagattcctccagacaatcaaggatattgcatccgctattaaagagttgctcgataccgtgaacaatgtgttcaagaaataccagtaccagaatagacgagccctggaacaccagaagaaagaatttgtgaaatacagtaagagcttcagtgacacgctcaaaacatactttaaagatggcaagtag

SEQ ID NO: 200720 - DNA, 405 bp, Artificial Sequence
  Description of Artificial Sequence: Synthetic coding sequence
atgcggatgaccatggaggagatgaagaacgaggccgagaccaccagcatggtgagcatgcctctgtatgccgttatgtatccagtgttcaatgagctggagcgggttaatctgagtgccgcacagacactccgcgccgctttcattaaggctgagaaagagaacccaggtctgactcaggacatcatcatgaaaatccttgagaagaaatccgtagaggtgaatttcaccgaaagcctccttaggatggctgctgacgacgtggaagaatacatgatcgaacgacctgaacccgagttccaggatctcaacgaaaaggcaagggcactgaagcagatactctcaaaaatcccagacgagattaacgacagagtccggtttctgcagaccatcaaggatatctag

SEQ ID NO: 200721 - DNA, 639 bp, Artificial Sequence
  Description of Artificial Sequence: Synthetic coding sequence
atgcggatgaccatggaggagatgaagaacgaggccgagaccacctcgatggtgagcatgccgctatatgctgttatgtatccagtctttaacgaactagaaagagtaaacctcagcgccgcacagaccttaagagcggcttttattaaggctgaaaaggagaaccctggcttgacacaggacatcatcatgaagattctggagaagaaatcggtagaagtcaactttaccgaatctctgctgcgcatggctgccgacgacgtcgaggaatacatgatcgagagacctgaacctgagttccaagatctcaacgagaaggccagggctttaaagcagatcctgtcaaaaatccctgacgagatcaatgatcgagtcagatttttacaaacgatcaaagatattgcgagcgccattaaggaactactcgatacagtgaacaacgtgttcaaaaagtatcagtatcaaaataggcgcgcgctggagcaccagaaaaaagagtttgtgaagtattcgaaatcttttagtgacactctaaaaacttacttcaaggacgggaaggctatcaacgtctttgtaagtgctaacagactcatacatcaaacgaatctgattctgcagacctttaaaaccgtggcttag

SEQ ID NO: 200722 - DNA, 5616 bp, Artificial Sequence
  Description of Artificial Sequence: Synthetic coding sequence
atggccaacctggaggagagcttcccccggggcggcacccggaagattcacaagcccgaaaaggccttccagcagtctgtcgaacaggacaacctgttcgacattagcacggaggagggctctaccaaacgcaaaaaaagtcagaagggccccgctaagacaaagaaactaaagatcgaaaaacgagagagctctaaaagtgcccgcgagaaattcgaaattttgtcagtcgagtctttatgcgagggtatgagaattttaggctgtgtaaaggaggtcaacgagcttgaattggtcataagcctgcccaacggcctgcagggatttgtacaagtaacagagatctgtgatgcctatactaaaaagctcaatgagcaggtcacacaggagcaaccactgaaagacctgctacaccttccagagctgttttccccgggcatgctagtccgttgcgtggtctcttccttgggaatcaccgacaggggcaaaaaatcggtgaaactgtccctaaatccaaagaatgtgaatagggttttgtccgctgaggcgctcaaacctgggatgctgttgactggcacggtcagcagcctggaagaccacggctatctggtggacataggggttgatggcactcgagcctttctgcccctgctgaaagcccaggaatacattcggcaaaagaacaaaggcgctaaactcaaggtgggacagtatttaaactgtattgtggagaaggtgaagggcaatgggggcgtcgttagcctctcagtgggccatagtgaagtgtctaccgcgattgctaccgagcagcagtcctggaacttgaataacttattacctggactggtggtcaaagcccaggtccagaaagttactcccttcggcctgacgctgaacttcttgaccttcttcactggggtggtggatttcatgcacttggatcccaagaaggctggaacatacttttccaatcaggctgtacgagcatgcattctttgtgtgcacccaagaactcgggtcgtgcatctgtccttacgtcccatcttcttgcagcctggtcgaccactgaccagactgtcctgccaaaacctgggcgctgtattagatgacgtgccggtgcaaggattcttcaaaaaggctggcgcaaccttccggttaaaggacggggtcctggcctatgcccgactttcccacctgagcgatagtaaaaatgtgttcaaccccgaagcctttaaacccggaaatacacataagtgtcggattattgattacagtcaaatggacgagttggctctgctgtcactgcgaacttctattatcgaggcccaataccttcgttaccatgacattgagccaggggccgtagttaaagggacagtgctgactataaagtcctacggcatgctcgttaaggtgggggaacagatgagagggttggtccccccaatgcacctggctgatatactgatgaagaaccctgagaagaaatatcatatcggcgatgaagtgaaatgccgtgtgttgttgtgcgatcccgaggctaagaagctgatgatgaccctaaaaaaaactctcatagagtccaagttacctgtgattacatgttatgccgacgcaaagccaggactgcaaactcacggattcattatccgtgtaaaagattacggttgtattgttaagttttacaataatgtgcaagggctggttcctaaacacgagctgtcaaccgagtacattcccgacccagaaagagtgttctatactggacaggtggtcaaggtggtggtacttaattgcgagccttctaaggagagaatgctgttatcgttcaaattatcctcagaccccgagcctaaaaaggagcccgcaggacattcccaaaaaaagggtaaggctatcaacattgggcagctggtagacgtaaaggtcctggagaaaacaaaagatgggctggaggtagcagttctgccccataatatcagggcatttctcccaacaagccacctgagcgaccacgtggctaacggccctctcctgcatcactggctgcaagccggcgacatcctccatcgggtcttgtgtctgtctcagtccgagggcagggtgctgctctgtcggaagcccgccctcgtatccaccgtagaaggtggccaggatcccaagaactttagcgaaatccacccaggaatgctcctgattggcttcgtcaagtcaatcaaggattacggggtgtttatacagttcccctcaggcttgagcggcttagctcccaaggccatcatgtccgataaatttgtgacctctacaagcgaccacttcgtggaaggccagaccgtggctgcaaaggttacgaatgtggacgaagaaaagcagaggatgttgttgagcctgaggttgagtgactgcggccttggggacctggccataacatcacttttactgctgaaccagtgtcttgaagagctgcagggtgtgagaagtctcatgtcaaatagagattcagtgctaattcagactctggccgaaatgactccgggcatgtttctggacctggtagttcaagaggtcctggaagatggctctgtagtgttcagcggtggtccagtgcccgacttggtactgaaggcgtctcgctaccatagagccggccaggaagtggaatccggccaaaaaaaaaaagtcgtgatcctgaacgtggatcttctgaagctcgaggtgcatgtatctcttcaccaggacctggtcaacaggaaggcccgcaaactgagaaaaggatccgaacaccaggctatcgtccagcacttagagaagtcctttgctatcgcctcccttgtggagacggggcatcttgctgccttttctctgacctcccatctgaacgataccttcagattcgacagtgagaagttacaggtggggcagggagttagtcttacgctgaagacaacagaacctggcgttacaggcttgctccttgcggtcgaagggccagctgccaaacggaccatgagacctactcaaaaggacagcgagacagtagatgaggatgaggaggtcgatcctgcgctgacggtgggcaccattaaaaagcatacattatctataggagatatggtgaccgggactgttaaatctatcaaacccactcatgttgttgtaactctcgaagacggcataataggctgcattcatgcctcccatatcctagatgacgtccctgagggcaccagccccacaaccaaactcaaggtcggaaaaaccgttacggctcgggttattggggggcgcgatatgaaaacctttaaatatctgccaatatcccaccctaggttcgtacggaccatccctgaactcagtgtccgtccgagcgagctggaagacgggcacacggcactcaatacacacagcgtgtctcctatggagaagataaagcagtaccaggctggccagacagtgacctgctttctgaagaagtacaatgtggttaaaaagtggctggaagtggagatcgctcccgatatccggggcagaatccccctcttattgacttcacttagcttcaaggttctgaagcatccagacaaaaagtttcgggtagggcaggctttacgcgccactgtggtgggtcccgattccagcaagactttactctgtctctcattaaccggtccccacaagttggaagagggcgaagtggctatgggccgggttgttaaggtgaccccaaatgaaggcttgaccgtgtcttttccttttggcaagattgggaccgtcagcatctttcacatgtctgacagctactcggagactcctcttgaggatttcgtgccacagaaggtggtacggtgctacattctgtcaactgctgataatgtgctgacattatccctcaggagtagcaggaccaaccctgagacgaaaagcaaggtggaagaccctgagattaactctatacaagatataaaggagggtcaactcttgaggggctacgtgggctctatccaaccacatggcgttttctttcgcctgggcccctccgtagtaggtctggcaaggtactctcacgtgagtcaacattcaccaagcaagaaggcactgtacaacaaacatctccctgaaggaaagctccttacagcccgcgtgctgcgcctgaaccatcagaagaacctggtggagttgtccttcttgccgggggacaccggtaagcctgacgtgttgtctgctagcctcgagggacagctgactaaacaggaggagaggaaaaccgaggctgaggagcgtgatcagaagggagaaaagaagaatcagaagcgaaacgagaagaaaaaccagaagggacaagaggaggtggaaatgccatcaaaagaaaagcaacagccccagaaaccccaggcacagaaacgcggcggacgagagtgccgagagtctgggagtgagcaggagcgtgtgtctaagaaacccaagaaggccggcctgtccgaggaagacgattccctcgtcgacgtctactatagggaaggcaaagaggaggctgaggaaaccaacgttttgccaaaagaaaagcagaccaagccagcagaagccccgcgtcttcagctttcctccggctttgcctggaatgtgggacttgactcattaacccccgccttgccaccactggccgaaagttccgactcagaagaagacgaaaaaccccaccaggcaactataaagaagtcaaagaaggagcgggaactggagaaacagaaagccgaaaaggagctttcgagaatcgaagaggcactcatggatccaggccgccagcctgagagcgccgacgacttcgacagactggtcttatcctcccccaatagctctattttgtggctgcagtatatggccttccacctgcaggcgaccgagatcgagaaagcccgtgctgttgcagagagggctcttaaaacaatttctttccgggaggagcaggagaaactgaacgtgtgggtagcactgctgaaccttgagaatatgtatggctcccaggagtccctgactaaggtgttcgaaagagcggtgcagtacaatgaaccactcaaagtcttcctccacctggccgatatctatgctaagagtgaaaagttccaggaggccggcgagctgtacaatagaatgttgaaacggtttcgacaggaaaaggcagtctggattaaatacggggcgtttctgcttcgcaggagtcaggccgctgcatcgcacagagtgctgcagcgggctctggaatgcctgcctagtaaggaacacgtggacgtgattgccaaatttgcacaactggaatttcagttgggggatgccgagcgggcgaaagccattttcgaaaatactctgagcacatatccaaagcgcacggacgtttggagtgtctatattgacatgactatcaagcatggatctcagaaggacgtcagggacatatttgagcgagtgatacatttgagcttagcccccaagagaatgaagtttttctttaagagatacttagactatgagaagcagcacggaacagagaaggatgtccaggccgtaaaagccaaggctttggaatacgtagaagctaagagctcagtcctcgaggattag

SEQ ID NO: 200723 - DNA, 3705 bp, Artificial Sequence
  Description of Artificial Sequence: Synthetic coding sequence
atggccaacctggaggagagcttcccccggggcggcacccggaagatccacaagccagaaaaggccttccagcaaagcgtagagcaggataatcttttcgacatctctacggaggagggctcaaccaaaagaaagaagtcccagaagggccctgctaagacaaaaaagctcaaaatcgagaagcgagagtcatctaaatcagcacgagagaagttcgaaattctgtccgttgagtctctgtgcgaaggaatgaggatcctgggctgcgttaaggaagtgaacgagctggagttagttattagcctgccgaacggcctgcaggggtttgtgcaggtgacagaaatttgtgatgcttataccaaaaaactcaatgaacaggttacccaggaacagcccctgaaggatttgctgcacctgcctgagttattcagccccgggatgctcgtaaggtgcgtggtctccagccttggcattacggataggggcaaaaagtcagttaagctgtccttaaaccctaagaatgttaatcgagtcctgagtgcggaagccctgaaaccggggatgttgttgactggcactgtgagcagcttagaagatcatggatatctggtggacatcggcgtggatgggactagagcattcctgccattgctcaaggcccaagagtacatcaggcagaagaacaaaggcgccaaactcaaagttgggcagtacttgaattgcattgtggagaaggttaaaggaaatggaggagtggtctctctaagtgttggtcacagcgaggtttccacggcaatcgctaccgaacaacagagctggaacctcaacaatttgctgccagggttggtggtaaaagcgcaagtgcagaaggtgacaccgtttgggctgactctgaacttcttgacctttttcaccggcgtggtcgacttcatgcatctagaccccaaaaaagccggtacttatttcagtaaccaggccgtgcgggcctgcatcctctgcgtgcaccccagaactcgggttgttcatctctccctgcggcccatcttcctgcagccaggacgtcccctgactcggctgtcatgtcaaaacctgggagctgtgctggatgacgtgccggtgcagggatttttcaagaaagcaggtgccacattccgcctaaaggatggagttcttgcctatgctcggctgtcccacctgagtgactctaaaaacgtgtttaacccagaggctttcaaaccaggcaacacccacaagtgccggatcattgactactctcagatggatgagcttgcccttctctccctgcgcacctccataatcgaggcccaatacctgaggtatcatgacatcgagcccggggctgtcgtgaagggtacagtgcttactattaagtcctatggtatgttagttaaggtgggtgaacaaatgcgaggtctggttccgccaatgcatctggctgatattttgatgaaaaatcctgagaaaaagtaccatatcggagatgaggtgaaatgcagagtgcttctttgtgatcccgaagccaaaaaactaatgatgacactgaagaaaacactgatcgaatctaagttaccagttattacatgctatgccgacgcgaaaccaggtctccaaactcatggcttcatcatccgagttaaagattacgggtgtatagtgaaattttacaacaatgtgcaggggctcgttcccaagcatgaactctctactgagtatattcccgacccagagagggtgttttacacaggtcaagtggtgaaggtggtcgttctgaactgcgaaccctctaaggaacgcatgcttcttagtttcaagttgagttccgatcccgagcctaagaaagagccagccgggcatagccaaaaaaagggtaaagccatcaatattgggcagcttgtggatgtgaaggtactggagaagactaaggatggcctggaagttgcagtgttgcctcacaatattagggcctttcttcctacatcgcacttgtcagaccacgtggcaaatggaccgctcctgcatcactggcttcaggcaggcgacattcttcatcgtgtgctctgcctaagccagagcgaggggcgcgttcttctgtgtaggaagcctgctctggtttccactgtcgaagggggtcaggatccaaaaaacttcagcgagatccatcctgggatgctcctgatcggcttcgtaaagagtataaaagactacggtgttttcattcagtttcccagcggattaagcggactcgctccgaaggcgattatgtcggacaaatttgttaccagtactagcgatcatttcgtggagggacagacggtagccgcaaaggtaaccaacgtagatgaggaaaaacagagaatgctgctttcacttcggctctcggattgcggcctgggggatttggctattacttctctgctattgctcaaccaatgtcttgaggagctgcagggagtccgctcactaatgtccaatagagactcagttttgattcagacattagccgagatgacgcccggcatgttcctcgatctagtcgttcaggaggtgctggaggacggaagcgtggtgttttccggaggccctgtgcctgacttggtactcaaagcatctcgatatcaccgggccggccaagaagtagagtccggccagaagaaaaaagttgttattttaaacgttgacttgctgaaactggaggtgcatgtctccctacaccaagacttagtgaaccgcaaggctagaaaacttaggaagggaagtgagcatcaggctatagtccagcaccttgagaaatcgtttgcaattgcgtcactggtggaaaccggacaccttgcggcattcagcctgacctcccacttgaatgatacctttcggttcgatagcgagaaattgcaggtcgggcagggcgttagtcttactttgaaaacaactgaacccggtgttaccgggctgctcctagcagtagagggaccagccgcaaagagaacaatgcggccgacgcaaaaggattctgagacagtagatgaggacgaggaagtggacccagcactcacagttggcacgataaagaaacataccctatctatcggggatatggtgacaggaacagtgaaatcaatcaagcccacccacgttgtagtaaccctagaggacggcattatcggctgcattcacgctagccacattttggacgacgtccctgagggcacctcaccaactacaaagcttaaggtcggcaaaaccgtgacagccagggtgatagggggaagagacatgaaaacatttaaatacctgccaataagccatccacgatttgtgaggacaatcccagaactatctgtaagacccagcgagctcgaagacggacatactgccctcaacacccactccgtatctcccatggagaagatcaagcaataccaagccggtctttcggaagaggatgacagcctcgtggacgtttattatagggaggggaaggaagaagccgaagaaactaatgtacttccaaaggaaaagcagactaaacctgctgaggcgccgcgtcttcagctgtcctctggctttgcatggaacgtgggcctcgactccctaactcccgctctgccacccctggccgagagttccgactccgaggaggacgagaaacctcatcaagccactcagatcaaaaagagtaagaagtag

SEQ ID NO: 200724 - DNA, 936 bp, Artificial Sequence
  Description of Artificial Sequence: Synthetic coding sequence
atggccgccgccggcgcccggcccgtggagctgggcttcgccgagagcgcccctgcctggcgcctgcgatccgaacagtttccgagtaaggtctacgcacctctgcctgggcggcctgatgcatttcacagatgtatctttctcttctgctgtagggaacagccttgttgtgctgggttgcgagttttccgcaatcagcttcctaggaaaaacgacttttatagctacgaaccccctagtgaaaaccccccccctgagactggagaatcggtttgcctgcaactgaagtctggtgctcacctgtgccgcgtctgtggctgcctcggccccaagacgtgcagccgatgtcacaaggcttactactgtagcaaggagcaccagactctcgactggcgactaggacacaaacaggcttgcgctcagccggatcatctggaccacatcatccccgaccacaatttcctgttccctgaattcgaaatagttatcgaaactgaggacgagatcatgcctgaagttgtcgaaaaagaagactattctgagattatcggctctatgggcgaggccttggaggaggaactagattccatggctaaacatgagtcaagggaagacaagatattccagaagttcaagactcaaatcgcattagaacccgagcagattctcagatacggacgcggaatcgcacccatttggataagcggcgaaaatattccccaggagaaggatataccagactgcccgtgcggcgctaagaggatcctggagtttcaagtgatgccacagctgctgaactatctgaaggctgatcgcctgggcaagagtatcgactggggaatcctggcagtgttcacctgtgcagaatcttgcagcctgggcactggttatacagaagaatttgtctggaagcaggacgttactgacaccccctag

SEQ ID NO: 200725 - DNA, 687 bp, Artificial Sequence
  Description of Artificial Sequence: Synthetic coding sequence
atggccgccgccggcgcccggcccgtggagctgggcttcgccgagtccgctcccgcttggaggctgagaagcgagcagtttcccagtaaggtggggggtcgacctgcatggcttggtgccgcagggctgcctggaccacaagcattagcatgcgaactgtgcggacgccccctctctttcctgttgcaggtgtacgcaccacttccgggcaggccggatgccttccatcggtgtattttcctattctgttgcagggagcaaccttgctgtgctggcctgcgagtattccgcaatcagctgccgagaaaaaatgacttttactcctacgagccaccaagcgaaaatccccctccagagaccggggaatcagtctgcttacaacttaaaagtggcgcccacctgtgtagggtctgtgggtgcctgggacctaaaacgtgttctaggtgtcacaaggcctactattgctctaaagaacatcaaacgcttgattggcgacttggccataaacaggcatgcgcgcagcctgaccacctcgaccacatcattccagaccacaacttcctcttccccgaattcgaaattgtaatcgaaaccgaggacgaaataatgcctgaagtggtcgagaaggaggactattccgagatcatcggttccatgggtaagcagttccaagacttcatccactag

SEQ ID NO: 200726 - DNA, 1035 bp, Artificial Sequence
  Description of Artificial Sequence: Synthetic coding sequence
atggccgccgccggcgcccggcccgtggagctgggcttcgccgagagtgcaccagcctggagactgcgcagcgagcaattcccttccaaggtgggaggacggcccgcatggctcggagcagccggactgcccggacctcaggctttggcctgtgaactgtgcggtagaccactgtcattcttactccaggtttacgcccctctccccggccgacccgacgctttccatcgttgcatcttcctcttttgttgcagagagcaaccgtgctgtgctggcttgagagtatttcgcaaccagttacctcgaaagaacgatttttatagctacgagccaccgtccgagaaccctcccccagaaactggtgaaagtgtgtgtttgcaactgaagtccggagcccacctctgcagagtgtgtggatgtctgggccctaaaacctgctccaggtgccataaggcctattactgcagtaaggagcaccagactttagactggaggcttggccacaagcaggcatgtgcacagcccgatcatcttgatcatatcattccagaccacaattttctatttccggagttcgaaattgtcatcgaaacagaagatgaaatcatgcctgaggttgtagaaaaagaagattacagcgaaattatcggtagtatgggagaggctttagaagaagagcttgacagcatggcgaaacacgagagccgcgaggataagatcttccaaaagtttaagacccaaatcgcactggagccagaacaaatacttcgatacggccgggggatcgcccccatctggattagcggagagaacattcctcaggagaaggacattccagattgtccctgcggggccaagaggattcttgagtttcaagtcatgccccaactcctgaactacctcaaggcggacagattgggtaagagcatcgattggggcatcctggctgtgttcacatgcgctgaaagctgcagtctgggtaccgggtacaccgaggaattcgtatggaagcaggatgtaaccgacacaccatag

SEQ ID NO: 200727 - DNA, 588 bp, Artificial Sequence
  Description of Artificial Sequence: Synthetic coding sequence
atggccgccgccggcgcccggcccgtggagctgggcttcgccgagtccgcgccagcttggcgactccggtcagaacagtttcccagcaaagtctacgcccctttgcctggacgtcctgatgctttccaccgctgtatcttcctgttctgttgtcgggagcagccttgctgcgctgggcttcgggtgtttagaaaccaactgcctcgcaaaaacgacttctactcttacgagccaccttcggagaaccccccgcccgaaacaggcgagtccgtgtgcttacaactaaagtccggcgcccatctttgtcgtgtgtgcgggtgcctcgggcctaagacttgttcccggtgtcacaaagcttattactgcagcaaggaacaccagacacttgattggagactcgggcataaacaagcctgtgcccagcctgaccacctggaccacataatccccgaccacaatttcttgtttcccgagttcgagattgtgatagagactgaggacgagatcatgccggaagtagtggagaaggaggattactccgaaataatcgggagtatgggaaaacagtttcaggactttatccactag

SEQ ID NO: 200728 - DNA, 567 bp, Artificial Sequence
  Description of Artificial Sequence: Synthetic coding sequence
atggccgccgccggcgcccggcccgtggagctgggcttcgccgagtctgctccggcatggaggctgaggtccgaacaatttccgagtaaggtgtatgccccactcccagggaggcccgacgccttccataggtgcatattcctcttttgctgccgagagcagccatgttgtgccggcctgcgcgtgttcaggaaccaactgcctcgcaaaaatgacttctacagctacgagcctcccagtgagaacccgcctcccgagacaggcgagagcgtgtgcctgcagctgaaatctggggcccatctctgcagagtgtgtggatgtttgggacctaaaacatgttcgcgctgtcataaggcttactattgcagcaaggagcaccagacacttgactggaggctgggacacaaacaggcctgcgctcagccagatcaccttgaccacatcattcctgatcacaactttctgttccccgagtttgaaatcgtaatcgagacagaggacgagatcatgcctgaagtggtcgagaaggaggattatagtgaaattattggaagcatgggcatctag

SEQ ID NO: 200729 - DNA, 2607 bp, Artificial Sequence
  Description of Artificial Sequence: Synthetic coding sequence
atggccaccttcatcagcgtgcagctgaagaagaccagcgaggtggatctcgctaaaccactggtcaagttcattcagcaaacctatccaagtgggggcgaggaacaagcgcagtattgtcgcgccgctgaggaactgtccaagctcaggcgggctgccgtggggcgacccctggataagcacgagggagccctggagacactgctgaggtattacgaccagatctgctctattgagcctaaattccctttcagtgaaaatcaaatctgcctgactttcacctggaaagacgcattcgacaagggaagcctatttggcggaagcgtaaagttggccctggctagtcttggatacgaaaaaagttgtgtcctctttaattgcgctgcactcgcctcacagatcgcagctgagcagaatctggataacgatgagggattaaaaattgctgccaaacactatcagttcgcctctggtgctttcctgcacattaaggagaccgtgttgtccgccctgagccgggagcccaccgtggacattagcccggatactgttgggaccctgtctctcattatgctggctcaggcccaggaagtcttcttcctcaaagccacaagggacaaaatgaaggatgcgatcatcgccaagttagccaatcaggcagccgattacttcggcgacgcgttcaaacagtgtcagtataaggacaccctccccaaggaagttttcccagttcttgccgcgaagcactgtatcatgcaagctaatgccgagtaccaccagtccatactggcaaaacagcaaaaaaagttcggtgaagagatcgctagactgcaacatgccgctgagcttatcaagaccgttgcatctcgatacgatgagtacgttaacgtgaaagacttcagcgataagatcaatagggccttggccgcggccaagaaagacaatgattttatctatcacgatagagtgcctgacctgaaggatctggaccccattggcaaagcaacactggtgaagagtacgcccgtcaacgtaccaatttcccaaaagttcacagatttgtttgaaaagatggtgcctgtaagcgtacagcagtcactggcagcctataaccaaagaaaggcagacctagtcaatcgctcaattgcacaaatgcgcgaagcaacaaccctagctaatggcgtactggcatcactaaaccttccagcggccatcgaagatgtcagcggcgatacagttcctcaatccattctgaccaagtctcgctcggtcatagaacagggcgggatccagacagttgatcagctgatcaaagagctccctgaactgttgcagagaaaccgagagatcctcgatgagtcgctccgactgctcgacgaggaggaagccaccgataacgatctgcgcgccaagtttaaggagcgctggcagcgaactccatcgaatgaactgtataagcccttgagagccgaaggaacaaactttcgcacagtgctcgataaggccgtacaggctgacgggcaggtcaaagaatgctatcaaagtcaccgcgacaccatagtgctcctgtgtaaacccgaacccgaactcaacgccgccattccatcggccaatcctgcaaagaccatgcaaggttcggaagtggtgaatgtgctcaagagtctgctgtcaaacctcgatgaggtgaagaaagaacgtgaaggccttgaaaatgatttgaagtccgtgaattttgacatgacttcaaagtttttgactgctctggctcaagatggcgtcatcaatgaggaagctctgagcgtaactgaactggatcgggtctacggtggactgactacgaaagtgcaggaaagcttaaagaaacaggagggcttgctgaagaacatacaggtgagccatcaagagtttagcaaaatgaagcagtctaataacgaggcaaacctgcgggaggaggttctcaagaacttggctactgcatacgataatttcgtggaactggtggcaaacttgaaggaaggtacaaagttctacaatgaactgacagagattcttgtcagattccaaaacaaatgttccgacatagtctttgcacgcaagactgagcgggatgaactgcttaaggacctgcagcagagcatagcaagagagccctccgctccaagtatcccaactcccgcctatcagtcgagcccagccggcggtcacgcgccaacaccacccacaccagcacctcggaccatgcctccgaccaagcctcagccgccagctcggccccccccaccagtgttaccagctaatcgggccccctctgcgacagctccctctccagtgggggctggaacagctgccccagctcctagccagactcccgggtcagccccccctccacaagcgcagggaccaccttacccaacatatcccgggtacccggggtattgccagatgcctatgcccatgggctataacccctacgcctatgggcagtacaatatgccgtaccccccggtctaccatcagagccctggtcaagccccttatcccggcccacagcaaccctcatatccctttcctcaaccgcctcagcagtcttactacccccagcagtag

SEQ ID NO: 200730 - DNA, 2622 bp, Artificial Sequence
  Description of Artificial Sequence: Synthetic coding sequence
atggccaccttcatcagcgtgcagctgaagaagaccagcgaggtggacctcgctaaacccttagtgaagttcatccagcagacttacccctccggtggagaggagcaagcccaatattgcagagctgccgaagagctgagtaagctccggcgggcggctgtcgggagaccccttgataagcatgaaggggctctggagactttactgagatattatgatcagatctgctcaatagagccaaagtttccatttagcgaaaatcagatttgtctcaccttcacttggaaagacgctttcgacaaaggctcgctttttgggggttccgtcaaactcgccctcgcatctttgggatatgaaaaatcctgcgtgttgttcaactgcgcggccctggcatctcagattgcagctgaacagaatttagataacgacgaggggctgaaaatagctgcaaaacattatcagtttgcttctggtgcattcctgcatattaaggaaacagtactctccgctctgagtcgggagccaacagtggatatctccccggacactgtgggtactcttagtctgattatgcttgcccaggcccaggaagtgtttttcttgaaagcaacaagagataagatgaaggacgccatcatcgccaagttggctaaccaagccgctgactattttggcgacgccttcaaacagtgccagtacaaagatactcttcctaagtacttttactttcaggaggtgttcccagttttagcagcaaaacactgtattatgcaggccaacgctgaatatcaccaaagcatcctcgcgaaacagcagaagaagtttggggaagagatcgccagacttcaacatgcagccgaactgatcaagacagtggcttcccggtatgacgagtacgtgaacgtaaaggacttcagcgacaagatcaaccgcgccttggctgccgctaagaaggacaatgacttcatataccatgaccgggtacctgacctcaaggatttagatccaattggaaaagctaccctagtaaagagtacccctgtgaacgtgccgatatcccagaaatttaccgatctgttcgagaagatggtacctgttagcgtgcagcagtctttggccgcatataaccaaagaaaagccgacctggtgaacagaagtatcgcacagatgcgcgaagctactacactcgccaacggcgtcctagctagtttgaacctgcctgccgctatagaagacgtgtcgggagacaccgtcccacagtctatactgacaaaatctcggtcggtcattgagcaaggggggatacagaccgtggatcagcttataaaagagctaccagagctgttgcagcgcaatcgtgagatactggatgaaagcttgcggttgctagacgaggaggaggcgactgataatgatttgagagccaaattcaaggagcgctggcagaggacgccaagcaacgaactgtataaacctctccgtgctgaaggcactaacttccggactgtgctggataaggccgtacaggctgacggccaggtaaaagagtgctatcagtcacacagagatacgatcgttcttctctgcaagcctgaacccgagttgaacgccgcaatcccgagtgcaaatcccgctaagaccatgcaggggagcgaagttgtgaacgtgttgaaatcacttctgtctaacctggatgaggtgaagaaggagagagagggacttgaaaatgacctgaaatctgtcaatttcgatatgacgagcaagttcttaaccgcccttgcccaggacggagtaatcaacgaagaggccctgagcgttaccgagctggacagggtgtatggtggtctcaccacaaaagttcaggagagccttaagaagcaggagggactactcaaaaatattcaagtatctcaccaggagtttagtaagatgaaacagagcaacaatgaggccaatctgcgtgaagaggtattaaagaacttggccactgcatatgacaacttcgtggaactcgtggcaaaccttaaggaggggacaaaattttataacgagctgaccgaaatacttgtacggttccagaataaatgcagcgacatcgtgttcgctaggaagaccgaacgggacgagctcctcaaagatctccagcagagtattgcccgggagcctagcgctccctctattccaacgcccgcatatcagagcagccccgcaggcggacatgctcccactccacccacacctgcacccagaactatgccgccaaccaagccgcaacccccggccaggcctcctcctcccgtgctgcctgcaaatcgcgcaccgtcagccaccgccccatcaccagttggagctggcactgcagccccggcgccgtcacaaaccccaggctctgctcccccaccccaggcacaggggcctccttatcccacatatccaggctatccgggctactgtcagatgccaatgccaatggggtacaatccgtacgcttacggacagtataacatgccttatccacctgtttatcaccagagcccaggccaagcaccctatcctggacctcagcagccatcatacccttttccccagcctcctcagcagagctactacccacaacaatag

SEQ ID NO: 200731 - DNA, 1458 bp, Artificial Sequence
  Description of Artificial Sequence: Synthetic coding sequence
atggccctgccccccttcttcggccagggccggcccggccccccccctccccagccccctccacccgcaccttttggatgcccaccgccccccctcccttctccagcttttccaccaccattgcctcagcggcctggccccttccccggcgccagcgcgccctttctgcagcccccactggcgctccagccacgcgccagtgcagaagcctcccggggcggcggcggggcaggggcattttacccggttcccccaccacccctccccccgccacctccccagtgtcgcccctttccgggaaccgacgcaggtgagcggcctcggccccctccacccggtccaggcccaccatggagcccacggtggcccgaagctccacctccaccagctgacgtgctaggtgacgctgccctgcagagattacgcgacagacagtggctggaggcggtgttcggaaccccgcgtagggccggatgtcctgtgccacaacgaacccacgcaggacccagtctgggcgaggtgcgcgcgcgattactcagggcactgcgcctcgtacgccgtttgagagggttgtcccaggctttgcgcgaggccgaagccgatggagccgcctgggtcctgctgtacagccagactgctcctctgcgggctgagctcgcggaaagattgcaacccctgactcaggcagcatacgtgggcgaggctcgccgacgtctggagagggtgaggagacgtcgcctgagactcagggaaagagctcgagagagagaagctgaacgggaggccgaggccgccagagctgtggagcgcgaacaagaaatcgataggtggcgggtgaaatgtgtgcaggaagtggaggagaagaagagggagcaggagctcaaagccgccgctgacggagtgttgtccgaggtgagaaagaagcaagccgacacaaagcggatggtagatattctgcgcgcccttgagaagctgaggaaactccgaaaggaagcggcagcccgaaagggagtttgcccacccgctagtgcagatgaaactttcacacaccacctgcaaagactgagaaaactaataaagaagcgttcagagctatatgaggcagaggaacgagcattgcgggtgatgctggaaggcgagcaagaagaggaaagaaagagagagctggagaaaaagcagcggaaagagaaggagaaaatcctgttgcagaaacgagagatcgagtctaaattattcggtgaccccgacgagtttcctttggcacatcttctcgagccattcagacaatactatctccaggctgagcattcactccccgcccttatacagatccggcatgactgggatcagtatctggtgccatcagaccatcccaagggcaacttcgtgccccagggttgggtgctgcctcccctcccttctaatgacatctgggccaccgccgtgaagctgcactag

SEQ ID NO: 200732 - DNA, 840 bp, Artificial Sequence
  Description of Artificial Sequence: Synthetic coding sequence
ctgatgcggagccacagcgacagctgccacttcagcaagcacctgaggcgggagcacggcccagcgactatcctgcgtccaggctcaccacgtcccccgccaccccctagtttcagtttgagacggttgagggagagggcaagagaaagggaggctgaacgagaggccgaagcagcaagggccgtggagagggagcaggaaatcgacagatggcgtgtgaaatgcgtgcaagaggtggaagaaaaaaagcgagagcaggagctgaaggccgctgctgacggtgtactgagcgaagtgcgcaagaaacaggcagacactaagaggatggtagacatcctgcgcgccttagaaaagctacgtaagctgcgaaaggaagcggccgcccgcaagggggtatgcccacctgctagcgccgacgaaacatttactcatcatctacagcggctgaggaagcttattaagaagaggagtgagctgtatgaagcagaagaaagggcacttcgcgttatgctagaaggcgagcaggaagaggaacgtaaacgcgagttagaaaagaagcagaggaaagagaaagaaaaaattctactacagaaacgcgagattgaatctaaactgtttggcgacccagacgaatttccgctggcacacttgctcgaaccattcagacagtattacctccaagctgagcactccttgccggccctgatccagataaggcacgattgggaccagtatctggtgccctcagatcaccctaagggcaactttgtgccccagggttgggtactgcccccacttccttccaatgatatatgggcaaccgcagtgaagctgcactag

SEQ ID NO: 200733 - DNA, 813 bp, Artificial Sequence
  Description of Artificial Sequence: Synthetic coding sequence
agccacagcgacagctgccacttcagcaagcacctgcggcgggagcatggacctgctaccatcctacggcccggctctcctcggagacgtcgcctcaggctgagagaacgcgcccgtgagagagaggcagaacgcgaagcagaagcggcacgcgctgttgaaagagagcaagagatcgacaggtggcgggtgaagtgcgtccaggaagtggaggagaagaaacgggagcaggaattgaaagccgccgccgatggtgtactgtccgaggttcgaaagaagcaggctgatactaagcgaatggtggacatccttagagccctcgagaaactacgaaaactgagaaaggaggccgctgccaggaagggcgtatgcccacctgctagcgccgatgagacgttcacccatcatctgcaacggctgcgcaagctgataaagaaaagaagtgaactatacgaggctgaggagagggcactacgggtgatgttggagggggaacaggaggaagagaggaaacgtgagctggaaaaaaagcagcggaaggagaaagaaaaaatcctgcttcagaagagagagatcgagtccaagcttttcggcgatcctgatgagtttcctctggctcatctgctcgagccttttaggcagtattatctccaggccgagcactctctccccgcattgatacagatccgccacgattgggatcagtacctcgtgcctagcgaccacccaaaagggaacttcgtgccacagggttgggttctcccaccactgcccagcaatgacatctgggctacagccgttaaactacactag

SEQ ID NO: 200734 - DNA, 165 bp, Artificial Sequence
  Description of Artificial Sequence: Synthetic coding sequence
atgtgcaccaccctgttcctgctgagcaccctggccatgctgtggcgtcgcaggtttgcaaatagggtccagcctgagccatccgatgtggatggggccgctaggggcagttcccttgacgctgatcctcagagcagcggccgcgaaaaagaacccctcaaatag

SEQ ID NO: 200735 - DNA, 246 bp, Artificial Sequence
  Description of Artificial Sequence: Synthetic coding sequence
atgacccggaccgagagccccgccacctggatgggccagctgggcgccgctgcgtggatgcgtactctctccccacaggccgcacaggtcttagtgcggccactagcacaggaggacgccgtgggcgccgccgcagcagctcggggccggatgggaggatctagcacccgggaagtgccaagagcccaccccgtgaccggctgttccgctgagattatcaataagaagtgtcagctggatctgtag

SEQ ID NO: 200736 - DNA, 819 bp, Artificial Sequence
  Description of Artificial Sequence: Synthetic coding sequence
atggccgccaaggtgttcgagagcatcggcaagttcggcctggccctcgcagtcgccggcggcgtcgtgaatagcgcgctgtataacgtcgacgccgggcatagagccgtgattttcgaccgctttagaggcgtgcaggatattgtggttggcgagggaacacattttttgataccctgggtccagaaacccataatattcgattgtaggtcaagaccacgaaacgtccccgtgatcaccgggtctaaagaccttcagaatgttaatatcacattacgaattctgttccgcccagtggctagccagttgccacgcattttcactagtattggcgaagattatgatgagcgtgtgctgccatccattactactgagatcttgaagagtgtggtagctagattcgatgctggcgaactaatcacacaacgcgagttggtatcaaggcaagtaagtgacgatctgactgagagggcagcaactttcggtcttatcctggacgatgtgtctctcactcatttgaccttcgggaaggaatttacggaagccgtggaggccaaacaggtagctcaacaggaagctgaacgagcccgattcgtcgtggagaaagctgagcaacagaaaaaagctgctattatatcagccgaaggtgattccaaggccgcagaacttattgcaaactctttggcaactgccggtgacgggcttatcgaactgaggaaactggaggctgctgaggacatcgcctatcaactatcaaggagtcggaacattacttacctgcccgctggacagtctgttctgttgcagcttccacagtag

SEQ ID NO: 200737 - DNA, 741 bp, Artificial Sequence
  Description of Artificial Sequence: Synthetic coding sequence
atggccgccaaggtgttcgagagcatcggcaagttcggcctggccctggcagtggctggaggtgtagtcaactctgctctgtacaatgtggacgcaggtcatagggctgtgatctttgaccgattccgcggagtgcaggatatcgttgtaggcgagggtactcacttcctgattccgtgggttcagaagccaatcatctttgattgccgatcaagaccgcgtaacgttcctgtgattacaggcagcaaggatctgcaaaatgtgaatattaccctccgaatcctgtttcgtcctgtcgcctcacaactgcctagaatttttacctcaattggagaagattacgatgagcgcgtcttgccttctatcacgacagagattcttaagagcgtcgtagctcgctttgacgccggggaactaatcacccaacgtgagttggtgagtaggcaagtgagcgacgacctgacagagcgggccgccacatttgggctcatcttggacgatgtgtcacttacacacctgacgtttggcaaggagtttaccgaagccgtggaagcgaaacaggttgctcagcaggaagccgaacgcgcgcgatttgtggtggaaaaggctgaacagcaaaagaaggcggcaattatttccgccgaaggagattccaaagcagctgaactgatcgccaacagtttggccacggccggagacggacttatcgagctccgaaagctcgaggcggcagaagattag

SEQ ID NO: 200738 - DNA, 375 bp, Artificial Sequence
  Description of Artificial Sequence: Synthetic coding sequence
atggccgccaaggtgttcgagagcatcggcaagttcggcctggccctggccgtggccggaggggtcgtgaactccgccctttataacgtggacgcggggcatcgggcagtgattttcgaccgtttccgaggtgtccaggacatagttgtgggcgagggaacacatttcctgatcccgtgggtgcagaaacccatcatcttcgattgcagatcacggcccagaaacgtaccagtcattactggtagtaaggacctgcaaaatgttaatataaccctgaggattctttttcggccagtagcatcacagctcccccgaatcttcactagtatcggggaggactacgatgaaagagtgctaccatctattaccacttag

SEQ ID NO: 200739 - DNA, 606 bp, Artificial Sequence
  Description of Artificial Sequence: Synthetic coding sequence
atggccgccaaggtgttcgagagcatcggcaagttcggcctggccctagccgtggcaggaggcgttgtgaattctgccttatataatgtggacgctggacatcgggccgtcatttttgataggtttagaggggtgcaggatatagtggtaggagagggcacacactttctcattccatgggtccagaagccgattatctttgactgtagaagcaggccccggaacgtgccagtgatcacaggatcaaaagacctgcagaacgtaaatataactctccggatcctctttagacctgttgcgtcacagttgccccggatattcacctccattggagaggactatgacgagagagtgttgccatcaattactaccgagatcctcaagtccgtcgttgcccgattcgacgcgggcgagctcatcacgcaacgggagctcgtgagtcgccaggtgtccgatgatctgactgagcgagctgccaccttcggcctgatactggacgacgtgagtctgacccacctgacattcggaaaggaattcactgaggccgtcgaagcaaaacaggtcgcccagcaagaggccgagcgggcacgctttgtggtggaatag

SEQ ID NO: 200740 - DNA, 645 bp, Artificial Sequence
  Description of Artificial Sequence: Synthetic coding sequence
atggccgccaaggtgttcgagagcatcggcaagttcggcctggccctcgccgtagcaggaggggtcgttaattccgctctctataacgttgacgcggggcatagagcagttatcttcgaccggttccgaggtgtgcaggatattgtggtcggcgaggggacgcatttcttaattccatgggtacaaaaacccattattttcgactgccgttcccgaccccggaacgttcccgtgattaccggctccaaagatttgcagaacgtcaacattactctgcgcattcttttccgaccagtggcatcccaactgccacggatttttacatcaatcggcgaagactatgacgaaagggtgctgccttctataaccacagaaatactcaagtcagtggtggcccgattcgacgctggggaactgataacccaacgtgaactggtgagtcgccaggtgtccgacgatctcactgagagggccgctactttcggccttattcttgacgatgtgtccctaacacacctgacatttggcaaggaattcaccgaagccgtcgaagcgaaacaagtggcgcagcaggaggcggaaagggcaagattcgtggtggaaaaagcggaacaacaaaaaaaggccgcaatcatctctgcatag

SEQ ID NO: 200741 - DNA, 468 bp, Artificial Sequence
  Description of Artificial Sequence: Synthetic coding sequence
atggccgccaaggtgttcgagagcatcggcaagttcggcctggccctcgccgtcgccggcggggtggtcaacagcgctttgtataatgtggatgccgggcaccgtgctgtgatcttcgacagatttcggggggtacaggatatagtagtgggggaagggacccattttttaataccatgggttcagaagcccatcatcttcgattgtagaagtagaccccgcaatgtaccagtaattacaggttctaaggatctgcagaatgtgaacatcacgttacgcattctctttagacccgttgcaagccagttgcctagaatttttacttctatcggggaggattacgatgagcgagtgctcccatcaattacaaccgagattctaaagagtgtggtggctcgtttcgatgcaggcgagctgatcacctacttacccgctggacagtcagtgctacttcaactgcctcagtag

SEQ ID NO: 200742 - DNA, 615 bp, Artificial Sequence
  Description of Artificial Sequence: Synthetic coding sequence
atggccgccaaggtgttcgagagcatcggcaagttcggcctggccctagctgtggctggcggagttgtcaatagtgccctatataacgtggatgctggccatagggcagtgatctttgatcgtttccgcggcgttcaggatatcgtggtgggcgaaggtacccactttctaatcccttgggttcagaagcctattatttttgattgcagatcacgtccccgcaatgttccagtgatcaccgggagtaaagatctccagaatgtcaatatcacactgcgtatcttgttccgtcccgtcgctagccaacttcccagaatctttacttccattggggaggactatgatgaaagagtcctgcccagcattacaacagaaatcctgaagagcgtggtggccagatttgatgctggagaactgatcacacagcgcgaactcgtcagccggcaggtcagtgacgatctaactgagcgggcggccactttcgggcttatcctggacgacgtctcactgactcacctgacattcggcaaagagttcacagaggcagtagaagctaaacaagtggctcagcaagaggcggagcgggcgcgttttgtcgtagagaaggtaagctag

SEQ ID NO: 200743 - DNA, 900 bp, Artificial Sequence
  Description of Artificial Sequence: Synthetic coding sequence
atggcccagaacctgaaggacctggccggccggctgcccgccggcccgcgtgggatgggcaccgccttaaagctgcttttaggagcgggtgctgtcgcatatggtgtaagagagagtgttttcaccgtcgagggaggtcaccgggccatcttctttaatagaatcgggggggtccagcaggacacgatcttggccgaggggctccattttcggattccatggtttcaatatccaataatctatgacatccgtgctagacctcgaaagatttcctctcctactgggagcaaggaccttcaaatggtcaatatcagcttgcgagtgctctcacgccccaacgctcaagaacttccttctatgtaccagcgccttggactcgactacgaagagcgtgtgctgccttctatcgtgaacgaagttctgaagtctgtggtggctaaattcaacgcttcacaacttatcacccagagggcacaagtatcactgctcataagacgggagctcaccgaacgagccaaagatttttccctgatccttgacgatgtggctatcaccgagctgtccttttctcgcgagtacactgccgccgtcgaggctaaacaggtcgcccagcaggaggcgcagcgagcgcagtttctcgtggagaaagctaaacaggagcagaggcaaaagatcgtgcaagccgagggcgaggccgaggcggctaagatgctgggtgaagctctttccaagaatcctgggtacatcaaacttcgtaagatacgagccgcacagaatatcagcaagactattgccacatcacagaaccggatttaccttaccgcagacaatttggtattgaatctccaggacgagagttttacccgctactcagattccttgataaagggcaagaaatag

SEQ ID NO: 200744 - DNA, 786 bp, Artificial Sequence
  Description of Artificial Sequence: Synthetic coding sequence
atggcccagaacctgaaggacctggccggccggctgcccgccggccctaggggaatgggtactgctcttaagctgctcctaggagctggcgccgtcgcctacggcgtcagggaaagcgtctttactgtggagggcggccaccgggccattttcttcaatcggatcggtggagttcagcaggatactatcctggccgaaggactccactttcgcattccatggtttcaatatcccataatttacgatatccgcgcccgaccacgcaagatttcttcccccactggttccaaagatcttcagatggtgaatatctcactaagggtactttctcggccgaacgctcaggagcttccctcaatgtaccagaggctgggtttggactatgaggaaagagtcctgccatcgatagtcaatgaggtgttaaaatccgtggtggctaagtttaacgcctcacagcttattactcagagggctcaagtttcccttcttatccggcgtgagctcacagagcgagccaaggattttagtcttattctcgacgatgtggcaatcacggagctctctttttctagggagtatacagccgcggtggaagcaaaacaggtggccctttctaaaaatccgggttacattaagctgaggaagatccgcgctgctcagaacatttccaagaccattgccactagccagaaccgcatatacttgacagccgacaatctggtcctgaacctgcaagatgagtcctttacacgagggtccgacagtcttattaagggtaaaaagtag

SEQ ID NO: 200745 - DNA, 900 bp, Artificial Sequence
  Description of Artificial Sequence: Synthetic coding sequence
atggcccagaacctgaaggacctggccggccggctgcccgccggcccacgggggatgggaacagccctcaaacttttgcttggtgctggcgcagttgcctatggagtccgggaatcggtgtttactgtagagggcggacatagggccatatttttcaataggatcggtggtgtgcagcaggacacaattctggccgagggactccactttagaatcccatggtttcagtatcccattatatacgacattcgggctagacccagaaaaatatccagccccactgggagcaaggatttacaaatggtgaacattagtctacgggttctctcccgccctaacgctcaggagttgccttctatgtaccaacggctcggtctcgattatgaggagcgggtcctgccatctatcgttaacgaggtgctcaagtcagtggtggctaaatttaacgctagccagctcattacacaaagagcacaggtctcgctgctgattagacgtgaactcacagaaagggccaaggattttagcctaatcctcgacgacgtagccatcaccgaactaagcttttcccgcgaatacaccgcagcggtcgaggcgaaacaagtggcccagcaggaagctcagagagcgcagtttctggtggaaaaggctaaacaggaacagcgccagaaaattgttcaggccgaaggcgaggctgaggccgcaaagatgctgggagaggccctctcgaaaaatcctgggtacatcaagctccgcaagattagggccgcgcagaacatctcaaagactatcgctacttctcagaatcgcatctacttaaccgcagataacctcgtgctgaacctgcaggatgagtctttcacacgcggaagtgattccctgatcaagggtaagaagtag

SEQ ID NO: 200746 - DNA, 642 bp, Artificial Sequence
  Description of Artificial Sequence: Synthetic coding sequence
atggcccagaacctgaaggacctggccggccggctgcccgccggcccgagggggatgggtaccgccttgaagctgctactgggcgctggggctgtcgcttatggcgttcgcgagagtgttttcacggtggaaggtgggcacagggccatcttctttaacaggatcggtggcgtacagcaggataccattttagccgaagggttgcactttcgcattccatggttccagtacccgattatctatgacattcgggcccgccctaggaagatcagctccccaacgggttcaaaagacttgcagatggtcaacatctcactaagggtcctctctagaccaaatgcgcaggaactgccttccatgtatcagcggcttggcttggactatgaggagcgagtcttgccctctatagtgaacgaggtcctcaagagtgtggtggctaagttcaacgccagtcagctgatcacgcaaagggctcaagtcagtttactgatcagaagggaactcacggaacgcgcaaaagattttagccttatactggatgatgtggctatcacagagctgagcttcagtcgggaatatactgctgccgtggaggcaaagcaggttggtgagtcccaggagccatggggtgagggtttctag

SEQ ID NO: 200747 - DNA, 318 bp, Artificial Sequence
  Description of Artificial Sequence: Synthetic coding sequence
atgcggggcgccacccgggtgagcatcatgctgctgctggtgaccgtgtcagattgcgcagtaatcaccggcgcctgtgagcgggatgtccagtgcggcgctggtacatgctgtgccattagcctgtggttacggggactgcgcatgtgcactccccttggtagagagggagaggaatgtcatcccggcagtcataaggttcccttcttcaggaagagaaagcaccatacctgcccctgtcttccaaacttactgtgtagcagattcccggacggacgatacaggtgctccatggacctgaagaatatcaacttctag

SEQ ID NO: 200748 - DNA, 390 bp, Artificial Sequence
  Description of Artificial Sequence: Synthetic coding sequence
atgcggagcctgtgctgcgcccccctgctgctgctgctgctgctgccccccttactgttgactcccagggctggcgatgccgccgtcattacaggggcatgtgacaaggactcccagtgtggcggcggcatgtgctgcgccgtcagcatctgggtgaagtccatcaggatctgtactccgatggggaagctaggggattcctgtcatcctctcacacgcaaaaataattttgggaacgggcgccaggaacgtcgcaagagaaaaagatcaaagaggaaaaaagaagtacccttttttggtagacgaatgcaccacacctgcccctgcctcccagggctggcatgtttgcgcacctcctttaaccgcttcatttgtctggcacagaagtag

SEQ ID NO: 200749 - DNA, 327 bp, Artificial Sequence
  Description of Artificial Sequence: Synthetic coding sequence
atgcggagcctgtgctgcgcccccctgctgctgctgctgctgctgcccccactcttattgacgccaagagctggagatgctgcagtgattacaggcgcatgcgacaaagatagccaatgtggcggaggcatgtgttgcgcagtcagcatttgggtgaagtctatcagaatttgtacaccaatgggcaagcttggtgactcctgccaccccctcactagaaaggttcccttttttgggagaagaatgcatcatacgtgtccatgtcttccaggactcgcttgtctgagaacaagcttcaacagatttatttgcctcgcccaaaagtag

SEQ ID NO: 200750 - DNA, 705 bp, Artificial Sequence
  Description of Artificial Sequence: Synthetic coding sequence
atgcgggcccccctgtgcctgctgctgctggtggcccacgccgtggatatgcttgcactgaataggcgaaagaaacaggtgggcaccggcctggggggaaactgcaccggatgcatcatttgttcagaggagaatggctgctctacctgccagcaaaggcttttcctctttattcgccgggaaggaatccgccagtacggcaaatgcctgcacgactgcccaccagggtattttgggattcggggccaggaggtgaacagatgcaagaaatgtggtgcgacatgtgagtcctgcttctcgcaggacttctgtatccgttgcaaacggcaattttatctctacaaaggaaaatgcctacccacgtgcccccctggaaccctggcacatcagaatactcgggagtgtcagggcgagtgcgagcttggcccgtggggggggtggtcgccgtgcactcataacggcaaaacctgcggcagcgcctggggcttagagagcagagttagagaagccggcagagcagggcacgaggaggccgctacctgccaggtgctaagtgagtcaaggaaatgcccaattcagagaccatgtcctggggagcgatcccccggtcaaaagaagggccggaaggacaggcgccctcgaaaagaccgtaagctggaccgcaggctggatgtgcggccaaggcaaccaggcctgcagccatag

SEQ ID NO: 200751 - DNA, 1155 bp, Artificial Sequence
  Description of Artificial Sequence: Synthetic coding sequence
atggccgcccagaacggcaacaccagcttcacccccaacttcaaccctccacaggaccacgcatcgagcctgtctttcaatttttcttatggggattatgatctgcccatggatgaagacgaagacatgaccaagactcggactttctttgctgccaaaattgtgattgggattgctctcgccggcatcatgctcgtctgtggaattgggaatttcgttttcattgccgccttgacgagatataagaaacttcgcaacctgactaatctcctgatcgctaacctggctattagcgattttctcgtggcaattatctgctgccccttcgagatggattactatgttgttcggcagctgtcctgggaacatggacacgtgttatgcgctagcgttaactacctgcgcacagtcagcctgtatgtgagtaccaatgcactgctcgcaatcgccattgaccgctatctggcaatcgtacacccacttaagcctcgtatgaattaccagactgcgagcttcttaatcgcgctagtatggatggtctcaatcctgattgccatcccctccgcgtacttcgctaccgaaacagtgttattcatcgtaaagagccaagagaaaatcttctgcggccaaatttggcccgtggaccagcaactgtactacaagagttacttcctctttatcttcggcgtggaattcgtcgggcccgttgtaactatgacgctgtgttatgccagaattagccgagaattatggtttaaggcagtgcctggctttcaaaccgaacagatccgaaaaaggctgcggtgtaggaggaaaacagttctggtgcttatgtgcatcctgacagcatatgtgctgtgttgggctccattctacggcttcactattgtccgggattttttcccaaccgtgtttgtgaaagagaaacattatctcactgcattttacgtcgtcgaatgcattgccatgagcaactcaatgattaacaccgtatgctttgtgacggtcaaaaataacactatgaaatattttaaaaagatgatgctgctgcactggcgaccgagtcagcgcggatccaaaagcagcgccgacctcgacttaagaactaacggcgtgcccacaaccgaggaagtcgactgtatccgcctgaaatag

SEQ ID NO: 200752 - DNA, 684 bp, Artificial Sequence
  Description of Artificial Sequence: Synthetic coding sequence
atgaacatcaagggcagcccctggaagggcagcctgctgctgctgttagtgtcaaaccttttgctatgtcagtccgttgcccccctgcccatatgtccgggaggcgccgcccggtgtcaggttactctgagagacctcttcgatagagccgtggtgttaagtcactatatccacaacctgtcctcggagatgttttctgaattcgataagagatatacccatggtcgcggattcatcactaaggccatcaattcgtgtcacacttcttcactagcgactccggaagacaaggagcaagctcagcagatgaatcaaaaagacttcttgagcctcatcgtgagcattctgagatcatggaacgagccactataccatctggtaacggaggtacgcgggatgcaggaagcccccgaggccattctgagtaaagcagtggaaatagaggaacagaccaaacgcttgttggagggcatggagttaatcgtatcccaggtccaccccgaaactaaggagaatgaaatctatcctgtgtggagcggactaccttcacttcagatggcagatgaggaatcacgcctgagtgcgtactataatttgctgcattgtctgcgacgggattcccataaaatcgacaactacctcaaactgctgaaatgccggattattcataacaacaactgctag

SEQ ID NO: 200753 - DNA, 591 bp, Artificial Sequence
  Description of Artificial Sequence: Synthetic coding sequence
atgaacatcaagggcagcccctggaagggcagcctgctgctgctgctggtgagcaaccttctcttaagccattatattcataatttgagcagcgagatgttctctgaattcgataaaaggtatacacatgggagggggtttattacgaaggcaatcaactcttgccacacatcaagccttgctacacccgaagataaggaacaggcccagcagatgaatcaaaaggattttctctcacttatcgtcagtatccttcgcagctggaatgagcctctctaccacctcgtgactgaggttagagggatgcaggaggcacccgaagccattttatctaaggctgtagaaatagaagaacagaccaagcggctcctcgagggtatggagctcatcgtgagccaggtgcaccctgagacaaaagagaacgagatctatccagtctggtccggcctgcccagcctgcagatggccgatgaggagtctcggttgagcgcatactataacctcctgcattgtttgagaagggacagtcataaaattgacaattaccttaagctcctaaagtgccgtatcattcataacaataactgttag

SEQ ID NO: 200754 - DNA, 1545 bp, Artificial Sequence
  Description of Artificial Sequence: Synthetic coding sequence
atgaccctgatctggcggcacctgctgcggcccctgtgcctggtgacatccgccccgcgcatcttggagatgcaccctttcctgagtctgggtacatctaggaccagcgttaccaagctgtctcttcacactaagccccgcatgcctccttgtgacttcatgcccgagcgctatcagtcgctgggatacaatcgggtgttagaaattcataaggagcatctcagcccagttgtaaccgcttatttccagaagcctttgctgttacatcaagggcatatggagtggctttttgatgccgagggcagcagatatctggatttttttagtggcattgtgaccgtcagtgtcggccattgccatcccaaggttaacgcagtggcacaaaaacaactgggacggctctggcacacatcaactgtgttctttcaccctccaatgcatgagtacgccgagaaactagcagctctgttgcctgagccactgaaggtaattttcttggtgaatagcggcagcgaagcgaacgagctggccatgctgatggcaagggctcacagcaacaacatcgacattatcagctttagaggagcttatcatggatgcagcccctacacattggggctcactaacgtaggtacatacaaaatggagcttcctggcggtacaggttgccagcccacaatgtgtcctgacgtgttccgggggccctgggggggctcacattgtcgcgacagtcctgtgcaaacaatacgcaagtgctcttgcgcgccagattgttgtcaggctaaggatcagtatatcgagcagtttaaggatactctgtctacaagcgtggcgaagtccatagccgggttctttgcagaaccgattcaaggggtgaacggcgtagtgcagtacccgaaaggcttccttaaggaagcttttgagcttgtcagggcgcgcggcggcgtgtgtatcgccgatgaagtgcagacaggattcggtcgattgggctcccatttttggggctttcaaactcatgacgtgttacccgatatcgtgacaatggcaaaggggattgggaatggctttcctatggcggccgtcattacaacaccagagattgctaaatctctagcaaaatgtctacaacatttcaacacgttcggcggcaatccaatggcttgtgccatcggctcggcagtgctggaagtgatcaaagaggagaatctccaagagaacagtcaagaggtgggtacttacatgttgctgaaattcgccaaattaagggacgaatttgagatcgttggtgatgtgagaggcaagggtcttatgatcgggatagagatggtccaggacaagatctcatgccgaccactaccacgggaggaggtgaaccagatccacgaggactgcaagcacatgggcctgctcgtgggacgcggcagtatcttttcgcagacatttagaatcgctcctagcatgtgcatcacaaaacccgaggttgattttgccgtggaagtatttcggtcagctcttactcagcatatggagcgcagagctaagtag

SEQ ID NO: 200755 - DNA, 1050 bp, Artificial Sequence
  Description of Artificial Sequence: Synthetic coding sequence
atgaaggagaacgtggccagcgccaccgtgttcaccctgctgctgttcctgaacacatgcttactgaatggtcagctccctccaggaaaacccgagatctttaagtgccgcagcccaaataaggaaacttttacctgttggtggcggcctggaactgacggaggcttgcctaccaactatagcttaacataccacagagaaggcgaaactctaatgcatgaatgtccagattacatcacaggaggccctaattcgtgtcattttggcaaacaatacacgtccatgtggcgcacatatatcatgatggtgaatgccacaaatcaaatggggagtagtttttctgatgaactgtacgtggatgtaacgtacattgtgcagccagatccacccctggaattggctgtggaggtgaagcagccggaggaccgcaagccatacttgtggatcaagtggtctccacccaccctcattgacctaaaaaccggttggtttacactgctttatgaaattcgcctaaagcctgagaaagctgctgagtgggaaatccacttcgctgggcagcagaccgagtttaagatcctctctctgcacccaggacagaaatacctcgtgcaggtgagatgcaaaccggaccacggctattggagcgcttggagtcccgcaacattcattcagatcccatccgattttaccatgaatgatactacagtctggatctccgtggccgtactgagtgcagttatttgcctgattattgtctgggctgtcgccctcaagggttacagtatggtgacatgtatattccccccggtaccaggccccaaaattaagggcttcgatgcacacctcttagaaaaaggaaaatccgaggagctcctgtcagctctcggctgccaagacttccccccaacttccgactatgaagacttgctagtggagtacttagaagtcgatgactccgaggaccagcacctgatgtctgttcactccaaagagcacccttctcaggaacgcgagcaacgacaggcacaggaggcgcgagattcatag

SEQ ID NO: 200756 - DNA, 1566 bp, Artificial Sequence
  Description of Artificial Sequence: Synthetic coding sequence
atgaaggagaacgtggccagcgccaccgtgttcaccctgctgctgttcctgaacacctgcctgctgaatgtgcagccggatcctccactcgagctcgcagtggaggtgaaacagcctgaggaccgcaaaccttatctctggatcaaatggagcccaccgacactgatcgacctcaagaccggatggttcaccctattgtatgagataagactcaagcccgagaaagccgccgaatgggagattcatttcgccggccagcagacagaattcaaaatcctgtcgttgcatccaggtcagaaatacctcgttcaggtcagatgcaaacccgatcacggctactggagcgcatggagccccgcaacattcatccagatccccagcgactttacaatgaacgataccaccgtatggataagcgtagccgtccttagcgcagttatatgtctgattatcgtgtgggctgtggccttaaaagggtacagtatggtgacttgtatttttccccctgttcccggaccaaaaatcaagggttttgacgcacacctgctagagaaggggaaaagtgaagagctgctgtcagcactcggatgtcaggactttccgcctacaagtgactacgaggatctcttggttgagtatctagaagtggatgactcagaggaccagcacctgatgagtgttcatagtaaagagcacccatcgcagggcatgaagccgacctacttagaccctgataccgactccggcaggggcagctgcgactcacccagcctgctgagtgaaaagtgtgaggagccgcaggctaatccctctaccttctatgaccctgaggtcattgagaaacccgaaaacccagagaccacacacacgtgggatcctcagtgtatcagtatggaaggcaaaataccatactttcacgccggaggtagcaagtgcagcacatggcccctaccccagccatcccaacacaatccacggtcctcatatcacaatatcacagacgtgtgtgagctggcagtgggacccgccggggccccggccacactactgaatgaggccgggaaggacgcactgaagagcagccagactatcaaatcaagggaggagggtaaagccacccagcagcgagaagtcgaatctttccatagtgagaccgaccaagacactccatggcttctgccccaagagaagactccattcggcagtgccaagcctttagattatgttgagatacacaaagtcaacaaggatggcgctctctctctcctccccaaacagcgggaaaactccgggaagccaaaaaaaccgggtacccctgaaaataataaggagtacgctaaggtgtctggcgtgatggataacaatattctggtgctggtgccggacccccacgcaaagaacgtggcctgctttgaggagagcgctaaggaagctccacccagcctggagcagaaccaagccgaaaaagcactggcgaattttactgccacttcatctaaatgtcggctccagctgggcggtctcgactatttggaccctgcctgcttcacccacagtttccactag

SEQ ID NO: 200757 - DNA, 807 bp, Artificial Sequence
  Description of Artificial Sequence: Synthetic coding sequence
atgaaggagaacgtggccagcgccaccgtgttcaccctgctgctgttcctaaacacctgcctgctcaacggtcagttgcctccaggcaagccagagatctttaagtgtagatcgcccaacaaagaaactttcacatgttggtggcgcccaggcacagatggcggtctgcccacaaattattctcttacctaccatcgcgagggtgagaccctgatgcacgaatgtccagactacatcaccggtggtccaaacagttgccactttgggaaacagtacaccagcatgtggagaacgtatattatgatggtgaacgccactaaccagatgggctctagcttctcagacgaactttacgttgacgtgacctacatcgtacaaccagacccaccgctcgagctggctgtggaggtgaagcagcccgaagataggaaaccatacctctggattaaatggtcgcccccaacgcttattgacctcaagaccgggtggttcacactgctttacgagatcaggctgaagcctgagaaagccgcggagtgggaaatccacttcgctggtcaacagacagagttcaagatcctcagcctccaccccggacaaaagtacctggttcaggtgagatgtaaacccgaccacggttattggagcgcgtggagtcccgccacattcatacagataccgagcggggaccccctgatgctcggagcgtcacactataaaaatctgaagagttataggccaaggaaaatttcttcccagggaagactggccgtgttcaccaaagctactctgactaccgtgcagtag

SEQ ID NO: 200758 - DNA, 1869 bp, Artificial Sequence
  Description of Artificial Sequence: Synthetic coding sequence
atgaaggagaacgtggccagcgccaccgtgttcaccctgctgctgtttctcaatacctgccttcttaatggacaactaccccctggcaaacctgagatctttaaatgcagatcacccaacaaggaaacatttacctgttggtggcggccagggacagatggagggctgccaaccaactattccctgacatatcatcgcgaaggagagacactgatgcacgaatgtcctgactacatcacaggcggcccaaactcatgtcactttggcaagcagtatacctcgatgtggcggacatacattatgatggtgaatgccacaaaccagatggggagttccttctccgatgagctttacgtcgacgtgacttacatcgtccagcccgaccctcccctggaactcgcggttgaagtgaagcaacctgaggatcgcaagccatacttatggatcaagtggtcaccaccaactctgatcgacttaaagacagggtggttcactctattgtacgaaattcgactgaagccagagaaagctgccgagtgggagattcactttgcgggccagcagacggagtttaagattctgagtcttcatcctgggcaaaagtatctcgtgcaggtgcgctgcaaacctgatcatggctactggtccgcctggtccccagccaccttcatccaaatcccctcagattttactatgaatgacactacagtgtggatcagtgtggccgtgctaagcgcagtgatatgtttaataattgtgtgggcagtcgcactgaagggctattcgatggtgacctgtattttccctcctgtaccgggtcctaaaattaagggattcgatgcccatctgttggagaaaggcaaaagcgaagagctcctaagcgccctagggtgtcaagacttcccacccacatccgactacgaagatctcctggttgaataccttgaagtagacgatagcgaagaccagcatctgatgagtgtgcactctaaagaacatccttctcaaggaatgaaaccaacctatctcgaccccgatacagactctggacgtggtagttgcgacagccccagtctgttatctgagaagtgcgaggagccacaggcaaatcccagcactttctacgaccctgaagtcatcgagaaacccgagaatccggagactacgcatacctgggacccccagtgtattagtatggaggggaagataccctactttcacgcgggagggtccaagtgctctacttggcccttgcctcagccctcacagcacaatcctcgatccagctaccataacattacagatgtctgtgagctggctgtgggcccggccggcgcacctgcgactctccttaatgaggcaggcaaggatgctctcaaatcttctcagactatcaagagcagagaggaaggtaaagccacacaacagagggaagtggagagttttcatagcgaaaccgatcaagatactccctggctcttaccccaggagaagacacctttcggctccgctaaacccctggattacgtggagatacacaaggtgaataaggatggggccttgtctctgctcccaaaacagcgagagaattcagggaagcctaaaaaacctgggacaccagaaaataataaggagtacgccaaggtttcgggagttatggataacaatatccttgtcctggtgcccgacccccatgctaagaacgtggcttgtttcgaggagtcagccaaggaggcacccccctccttggaacagaaccaagctgagaaggctctcgctaattttacagcaacttcttccaagtgcaggctccagctcggtggtctcgattacctggatccagcctgtttcacacactcatttcactag

SEQ ID NO: 200759 - DNA, 594 bp, Artificial Sequence
  Description of Artificial Sequence: Synthetic coding sequence
atgcacgagtgccccgactacatcaccggcggccccaacagctgccatttcgggaaacagtacaccagcatgtggcgtacttacattatgatggtgaacgccaccaatcagatgggctccagcttcagcgatgagctatatgttgatgtgacatacatcgtccaacccgacccacctctggaactcgcagtggaagttaagcagcccgaagaccggaaaccttacctctggatcaagtggagtcccccgactcttatcgatttaaaaaccggatggttcaccctactctatgaaatacgtctcaagcctgaaaaagccgctgagtgggagatccatttcgccgggcagcaaactgaattcaagatcctgagtctgcatcccggacagaaatacctggtacaggtcagatgtaaaccagaccatggatattggtccgcctggagtcctgcaacattcatccaaattccatcaggcgatcccttgatgctaggagcctcccattataagaacctgaaaagctaccgtccacgcaaaatctcatcccaggggagactggctgtcttcacgaaagcaactcttacaactgtacagtag

SEQ ID NO: 200760 - DNA, 312 bp, Artificial Sequence
  Description of Artificial Sequence: Synthetic coding sequence
atgaaggagaacgtggccagcgccaccgtgttcaccctgctgctgtttctcaatacctgtctgctcaacggacagctgccaccaggcaagcccgaaatcttcaaatgtaggagtcccaacaaggaaacctttacttgctggtggcgccccggcaccgatggcggcctgcctacaaattattcccttacataccaccgggagggtgagactctcatgcacgagtgccctgattatatcacaggcggaccaaactcctgtcactttggaaagcagtacaccagcatgtggagaacatacataatgatggtatag

SEQ ID NO: 200761 - DNA, 189 bp, Artificial Sequence
  Description of Artificial Sequence: Synthetic coding sequence
atgaaggagaacgtggccagcgccaccgtgttcaccctgctgctgtttctgaatacttgcttactcaacggccagttaccaccaggaaaacctgaaattttcaaatgcaggagcccaaataaggaaaccttcacttgttggtggcgcccagggaccgatggaggcctcccaactaattactccctctag

SEQ ID NO: 200762 - DNA, 336 bp, Artificial Sequence
  Description of Artificial Sequence: Synthetic coding sequence
atgaaggagaacgtggccagcgccaccgtgttcaccctgctgctgttcctcaatacatgcctgctgaatgggcagctccctccagggaaacccgagatctttaaatgtcgctcacctaacaaggaaacctttacatgttggtggcgtcccggcactgacggcgggctgcctacaaactatagccttacctatcatcgggagggggaaactctgatgcacgagtgtcccgactatatcacaggggggcctaactcgtgccactttgggaagcagtatactagcatgtggcgcacctacatcatgatggtcaacgctaccaatcagatggggagctag

SEQ ID NO: 200763 - DNA, 1566 bp, Artificial Sequence
  Description of Artificial Sequence: Synthetic coding sequence
atgaaggagaacgtggccagcgccaccgtgttcaccctgctgctgttcctcaatacttgtctacttaacgtgcagcccgatcccccacttgaattggcggtagaagttaagcaacccgaagatagaaagccttacctctggatcaaatggtcgccacctactcttatcgatctgaaaactggatggttcaccctgttgtatgagattagactgaagccagaaaaagctgcagagtgggaaatccatttcgcagggcagcaaacagagtttaaaatcctgtccttgcatccaggtcagaagtacctggtgcaggtccgctgcaagcccgaccacggctattggagcgcctggagtcccgcgacgttcatccagattccctctgactttacaatgaatgacacaacagtgtggatctcagtcgcagtcctcagcgcggtcatttgtctgattatcgtttgggctgtggctctgaaaggatattccatggtcacatgcatcttcccacccgtgccgggccctaagattaaaggcttcgacgcccacttgctggaaaagggtaaatcggaggaactcctgagtgctctgggctgccaggactttccacccactagtgattatgaagatcttctggtggagtacctggaggtagatgatagcgaagaccagcatctcatgtcagttcattcaaaagaacacccaagccagggcatgaaacccacctatttagacccagataccgatagcggacggggaagttgtgatagccctagcctgctgtccgagaaatgtgaagaacctcaagcgaatccaagtactttctacgatccagaggtgattgaaaagccagagaatcctgagaccacacatacctgggatccgcaatgtatctcaatggagggaaagatcccatactttcacgcaggagggtctaagtgttctacttggccactgccccagccatctcagcataatccgcggtcatcatatcacaatatcaccgacgtctgtgaactcgctgtggggcctgctggcgcacccgcaaccttgctcaacgaggctggaaaggacgcacttaagtccagtcagacaataaagtcccgagaagaggggaaggctacccagcagcgggaggtggaaagcttccactcagagacggatcaagacaccccttggctgttgccacaggaaaaaactccattcggtagcgccaagcctctagactatgtggaaatacacaaagttaataaagacggggctctctccctgctgcccaaacagcgggagaactctggaaagcccaaaaagcccggaaccccagagaacaataaggagtatgctaaggtctcaggcgtgatggacaataacatattagtgctggttccggacccacacgctaaaaatgtggcgtgctttgaggagagtgcgaaggaagcacctccttcgttagagcaaaatcaagccgaaaaggcgctcgcaaattttactgcgacgtccagcaagtgtaggctgcaacttggcggtttggattaccttgaccctgcgtgtttcactcactcgttccactag

SEQ ID NO: 200764 - DNA, 867 bp, Artificial Sequence
  Description of Artificial Sequence: Synthetic coding sequence
atgaaggagaacgtggccagcgccaccgtgttcaccctgctgctgttcctgaacacatgtctgctgaatggccagctcccacctggaaagcctgaaatctttaaatgccgatccccaaacaaggaaaccttcacatgctggtggagacctgggaccgatggcgggctgcccaccaattactccctcacctaccacagagaaggagagacactgatgcacgagtgccctgattatattaccgggggcccaaacagctgccatttcgggaaacagtataccagtatgtggcgcacctacataatgatggttaatgcgaccaatcagatggggagctctttttcagatgaactgtatgtagatgtaacttatattgtgcagcctgatcctcccttagaattggcagtcgaagtgaagcagccagaagataggaaaccttatctatggattaagtggtcccccccaacacttatcgacctgaaaacaggctggtttacactattatatgagataagactgaagccagaaaaggctgcagagtgggaaatccatttcgcgggccagcagaccgagtttaaaattctctccttgcatccgggccagaagtatctagtgcaggtgcgttgcaaacccgatcatggttactggtccgcatggtcacctgcaacttttatacaaattccctctgacttcaccatgaatgacacaacagtttggatatccgtcgccgtactgtctgccgtgatttgtctgattatcgtttgggctgtggccttaaaaggctactctatggttacttgcatcttccctcccgttcccggccctaagattaagggcttcgatgcccacctattggaggttaccccgtag

SEQ ID NO: 200765 - DNA, 363 bp, Artificial Sequence
  Description of Artificial Sequence: Synthetic coding sequence
atgaaggagaacgtggccagcgccaccgtgttcaccctgctgctgtttcttaacacatgcctcctgaatggccagctgcctcctggcaaacccgagatcttcaaatgtagatcgccaaataaagagactttcacctgctggtggagaccaggaactgacggagggttgccaactaattatagcctgacataccatagagaaggggagaccctgatgcatgaatgccccgactacatcactggcgggccaaactcctgtcactttgggaaacaatatacatcaatgtggagaacttatattatgatggtgaacgccaccaaccagatgggttcctctttttcggacgaactgtatgtggactag

SEQ ID NO: 200766 - DNA, 105 bp, Artificial Sequence
  Description of Artificial Sequence: Synthetic coding sequence
atgaaggagaacgtggccagcgccaccgtgttcaccctgctgctgttcctgaatacatgtctcctgaatggacaactgcctcccgggaagccagagattttctag

SEQ ID NO: 200767 - DNA, 930 bp, Artificial Sequence
  Description of Artificial Sequence: Synthetic coding sequence
atgaaggagaacgtggccagcgccaccgtgttcaccctgctgctgtttctgaacacctgtttgttgaacggtcagctgccgcctgggaagcccgagatttttaagtgtcggtctccaaacaaggagaccttcacttgctggtggcggcctgggactgatggaggactgccaactaactattccctcacctaccatcgggaaggcgagaccctgatgcacgaatgtcccgattatatcaccggagggcctaatagctgtcatttcgggaaacagtatacatccatgtggaggacctacatcatgatggtgaacgccacaaaccagatgggctcatcttttagtgacgaactctatgtcgacgtgacttatattgtgcagcccgatcctcccctggaactcgcagtagaggtgaagcagccggaagaccggaagccttatctttggatcaaatggagcccccctacattgatcgatctcaagacagggtggtttactttgctgtatgagattcggcttaagcccgaaaaggctgctgagtgggaaatccatttcgcaggccagcagaccgagtttaagatcctcagccttcatcccgggcagaagtacctggtgcaggtgagatgtaagcctgatcatggatactggagtgcttggtcgcctgcaaccttcattcagatcccctcggatttcacaatgaatgacactaccgtttggatttctgtggctgtcttgtctgctgtaatctgcctgattattgtatgggccgtggccttgaaagggtatagcatggtgacctgcatcttccctccggttcccggtcctaaaatcaagggttttgacgcccatcttttggaagatcggctatgtacccctgggcggtgttgtgtgtcgaccggactcactgacctggattatagttgcagcacgtag

SEQ ID NO: 200768 - DNA, 1254 bp, Artificial Sequence
  Description of Artificial Sequence: Synthetic coding sequence
atgggccggcggcgggcccccgagctgtaccgggcccccttccccctgtacgcactgcaagtcgacccaagcacaggtttgctgatagcagccggcgggggcggagcagcgaagaccggaatcaagaacggcgtgcattttcttcagctggagctaataaatgggcggctctcagcttcattgctgcactctcatgatacagagacgagggccactatgaaccttgccttggcaggggacattctcgccgccggccaagacgctcactgccaacttctgcgttttcaggcccatcagcagcagggcaataaagccgaaaaagctggcagtaaggaacagggccctcgtcagcgcaagggggcggccccagcagaaaagaagtgtggcgccgaaacacagcacgagggactggagctcagggtggagaatctgcaagccgtgcaaaccgacttttcctccgacccgcttcagaaggttgtctgctttaaccacgataacactttactggccaccggaggcacggacggctatgttcgcgtgtggaaagtgcctagcctcgagaaagtgttagaattcaaggcccacgagggtgaaatcgaagatttagccctgggcccagacggcaagctggtgacagtaggtcgggatctgaaggccagcgtgtggcagaaggaccagctcgtcacacaactgcactggcaggaaaacggtcctacctttagctctacaccataccggtatcaggcttgcagatttggacaggtgcccgatcaacctgccgggctgagactctttaccgtgcagattccacacaaaagacttcggcagcctcccccatgttatcttacagcttgggacggttccaatttcctgccacttcgcacaaagtcatgcggccatgaagtggtgtcttgcctggatgtctctgaaagcgggaccttcctgggactgggcacagttaccgggtctgtggccatatacatcgcgtttagcctccaatgcctgtactatgttcgcgaagcccatggcatcgttgtcactgacgtggccttccttcccgaaaagggccggggaccagaactgctcgggagtcatgagaccgctctcttctctgtggcggtggactcacgctgtcagctccaccttttaccctcccgccgaagcgttcccgtgtggctgcttctccttctgtgcgtaggcttgataatcgtgaccatcctgctattgcagtccgcctttcccggattcctgtag

SEQ ID NO: 200769 - DNA, 1254 bp, Artificial Sequence
  Description of Artificial Sequence: Synthetic coding sequence
atgggccggcggcgggcccccgagctgtaccgggcccccttccccttatacgcccttcaggtggatccttccaccggtttgttgattgccgccggaggcggcggggcagccaagactggaattaagaacggcgttcacttcctgcagttggagcttatcaatggtcggcttagtgcctcccttctgcactcgcatgacactgaaacaagagctacaatgaacctggccctggctggggacattctggctgctggacaagacgcccactgccagcttttgcgctttcaagcacaccaacagcaggggaataaggcagagaaggccggtagcaaggagcagggtccacggcagcgcaagggcgctgcccccgcagaaaaaaagtgcggggcagagacgcagcatgagggcctcgagctacgagtggaaaacttacaggccgttcagaccgacttctctagcgaccccctccagaaggtggtctgtttcaaccacgacaacaccttactggccaccgggggcactgacggatacgtccgtgtctggaaagtgccctcgctcgagaaggtcttggagttcaaagcgcacgagggcgagattgaagatcttgcgctggggcccgatggaaagctcgtgaccgtcggaagggatctcaaggcatctgtttggcaaaaagatcagctcgtgactcagcttcattggcaggagaacggaccaaccttttcttccacgccttaccgatatcaggcctgtagattcggacaggttccagatcagccagccggattacgcctattcacggtgcagatcccccataagagactgcgacagccccctccctgctacctcaccgcctgggacgggagcaacttcctgccccttcgtaccaaatcatgcgggcacgaagtggtgtcgtgtctggatgtgagcgaatcagggactttcctgggcctcggcacagtgactgggtcagtggcaatctacatcgctttctcattgcaatgtctgtattacgtcagagaggcacacggcatcgtggtgaccgacgtcgcgttcttacccgaaaagggacgcgggcccgagctcctgggtagccatgaaaccgctctttttagtgtggcagtcgacagtcggtgccagttacacctattgccatcaagacggagcgtcccagtgtggctgcttttactcctttgtgtgggattgatcatcgtcaccattttactgcttcagagcgcctttcccggcttcctttag

SEQ ID NO: 200770 - DNA, 441 bp, Artificial Sequence
  Description of Artificial Sequence: Synthetic coding sequence
atgcggctgctgcagctgctgttccgggccagccccgccaccctgctgctcgtgctctgtctgcagctgggggccaataaggcacaggacaacacacgaaaaataattatcaaaaattttgacatccctaagtctgtgcgtcccaacgatgaagtgactgccgtcctggccgtgcagaccgaactcaaagagtgtatggtagtaaagacttacctgatttccagtatacctctccagggtgcctttaactacaagtacacggcctgtctctgcgacgataatccgaaaaccttctactgggacttctacaccaaccgcactgtgcagattgctgccgtagtcgacgtgattcgggagcttggcatctgccctgacgatgctgcggtaatccctattaagaataatcgcttttacaccatcgagatactcaaggtcgagtag

SEQ ID NO: 200771 - DNA, 1185 bp, Artificial Sequence
  Description of Artificial Sequence: Synthetic coding sequence
atgagcggcgaggacgagcagcaggagcagaccatcgccgaggacctcgtcgttactaagtacaagatggggggagatattgccaatagagtgttgaggagcttagttgaagccagttcctctggtgtatccgtgctttccctgtgtgaaaagggagacgccatgattatggaggagaccgggaagattttcaaaaaagagaaggagatgaaaaagggaattgcatttccgacttctatctcagtcaataattgcgtctgccacttttcaccgctcaaatcagaccaggattatatccttaaagagggcgatttagtcaagatcgacctcggggtccacgtggacggatttatcgctaacgtggcccacacattcgttgtggatgtagctcaggggacacaggtgacaggacgtaaagccgacgtgatcaaggcggcacacttgtgcgctgaagctgctttgaggttagtgaagcccggaaatcagaacacacaggtaactgaggcatggaacaaggtggcccattcctttaattgtacccccatcgaaggtatgctgagccatcagctcaaacagcacgttatcgatggggagaaaacaatcatccagaaccccacagatcagcagaagaaagaccatgagaaagcggagtttgaggtgcatgaggtctacgccgtggatgtgttggtgtcaagtggtgagggcaaagccaaggatgctggccagcgcacaaccatttacaagcgggatccctctaagcaatacgggctcaagatgaaaacatctcgtgcatttttttcggaagtagagaggaggttcgatgcgatgccctttacactcagagcatttgaagacgagaagaaggctcggatgggggtggtggagtgtgcaaaacatgagttactgcagccgtttaacgttctctacgagaaggaaggcgaattcgtggctcaattcaagttcacagtcttgctcatgccaaatgggcccatgcggattacctccggtcctttcgagccggacctgtataagtctgagatggaggtgcaagacgccgaactcaaagcccttctgcagtcttcagcttcccgcaagacacagaaaaagaaaaagaagaaggcgagcaaaacagccgagaacgctacctccggggagacactagaagagaacgaagccggcgattag

SEQ ID NO: 200772 - DNA, 1218 bp, Artificial Sequence
  Description of Artificial Sequence: Synthetic coding sequence
gcctgccccgccccccagcccgcccggagccagctgctggccctggcctgtcttccagcaccactgctagctcgcgcctttgcccggcccctgctcgaagatagaggcgatagcgaccacagtcctgaagatctagtggtcactaaatacaaaatgggaggcgatattgcgaaccgggtgctgaggagcttggtcgaggcttcctcttcgggagttagcgtgctgtctctgtgtgaaaagggtgacgcaatgatcatggaggaaactggaaagatcttcaaaaaagagaaagaaatgaaaaaaggaattgcctttcccacaagtatcagcgtgaataactgcgtttgtcacttctccccactgaagtcagaccaggactacatcctgaaagagggagatttggtgaaaattgacctcggtgtgcatgtagacggattcatagcgaacgtggcccacactttcgtggtggacgtcgctcaagggacacaggtgacaggaaggaaggcggatgtgattaaggcggcgcatctgtgcgcagaggccgccctgcggctggtcaaacctggtaatcagaacactcaggttacagaggcatggaataaagtggcccatagttttaattgtactccaatcgaggggatgctttcccatcagcttaagcagcatgtaatcgatggcgagaagaccatcatccagaaccccacagaccagcagaaaaaagaccacgagaaagctgagttcgaagtccatgaagtatacgccgtagacgtgctcgtctccagcggtgaggggaaggccaaggacgccggtcagcgcactactatttacaagagggacccctcaaagcagtacggactgaaaatgaaaacgtcccgggcttttttcagcgaggttgaacggagatttgatgccatgcctttcacactaagagccttcgaggatgagaagaaagctagaatgggggtggtggagtgtgcaaaacatgagcttctacagccttttaatgtgctttacgaaaaggaaggcgagttcgtggcccagttcaagttcactgtgctcctcatgcctaacgggcccatgagaatcacaagtggaccatttgagcctgacctttacaaaagcgagatggaggtgcaggatgctgaattgaaagcgctgctacagagcagcgccagccgaaagacccaaaagaagaagaagaaaaaaaagaaaaaatag

SEQ ID NO: 200773 - DNA, 738 bp, Artificial Sequence
  Description of Artificial Sequence: Synthetic coding sequence
atgacccggatgctgcagcggatggacgtgctggccaagaaggccacagagatgggagttaggttaatggtcgacgctgagcagacttattttcagccagctataagccgcctgacgctagagatgcagcgtaagtttaatgtggaaaaaccactgatctttaatacttatcagtgctatctcaaggacgcgtatgacaatgtgacccttgacgtggagcttgcccgcagggaaggctggtgcttcggagccaaactcgtccgaggcgcatatctagctcaagagagagcccgtgctgccgaaatcggctatgaggatcccatcaacccgacatatgaagcaaccaacgccatgtatcacagatgtctggactacgtgttggaagagctcaaacacaatgcgaaggccaaagtcatggtcgccagccacaatgaagacacagtgcgctttgccctcagaagaatggaggagctgggtttgcacccagctgaccaccgcgtctatttcgggcaactgctgggtatgtgcgaccaaatcagcttcccactgggacaggctggatatccggtgtacaaatacgtgccttacggaccagttatggaggttcttccatacttatcgaggagggccttggaaaatagcagtttaatgaagggaacccatagagagagacagttgctgtggctcgagctgctgcgcagactgcgtacaggaaatcttttccacaggcccgcgtag

SEQ ID NO: 200774 - DNA, 1803 bp, Artificial Sequence
  Description of Artificial Sequence: Synthetic coding sequence
atggccctgcggcgggccctgcccgccctgcggccctgcatcccccggtttgtgcctctgagcaccgccccagcaagcagagaacagcctgcagctggcccagctgcagtccccggtggcgggtccgctaccgcagtgaggccccctgttcctgccgtcgatttcggcaatgctcaagaagcgtaccggtccaggcgcacctgggaactcgcaagatctctcctggtgttacggctgtgcgcctggcccgccttgttagctcggcacgaacaactgctgtatgtaagtcgcaaacttctggggcagcgactttttaacaaactcatgaagatgaccttctatggccacttcgtggctggggaagatcaagaatcaattcagccgttactgcgtcactatcgcgccttcggagtttcagccattttggattacggcgtagaggaggatctatctcccgaggaagccgaacacaaagaaatggaatcctgcacatctgctgcagaaagggatgggtctggaaccaataaacgtgacaaacagtaccaagcccactgggctttcggcgatcggagaaatggggtgatttccgcccggacttacttctacgccaatgaagccaaatgcgatagtcacatggagactttcctcaggtgcattgaagcaagcggccgagtgtcagacgacggcttcatagctattaaactgaccgccttgggcagacctcagttcctcctgcagttctccgaagtgctggcaaagtggcgctgtttcttccaccagatggccgttgagcaggggcaagccggtctggcggctatggatacaaagctcgaagttgccgtgttacaagaatcggttgcgaaactgggtatcgcttccagagctgaaatcgaggattggtttacagcagagaccctcggggtgagtgggactatggatctcctggattggtctagtctgatcgattctagaaccaagctttcaaaacatctcgttgtgccgaatgcacagactggtcagttggaaccactgctttctcgcttcacagaagaggaagaattacagatgacccgcatgctgcaacgtatggatgtcttggcgaaaaaagctactgagatgggcgttcgccttatggtagatgccgagcagacctatttccaacccgccatctcacggctgaccctggagatgcagagaaagtttaacgtcgaaaagccgctcatctttaatacctatcagtgttacctgaaagatgcttatgataacgtaacactggacgtggaactagcccgtagggaggggtggtgtttcggagccaagctggtgcgaggagcttacctggcccaagagcgtgcgagggccgccgagatcgggtacgaggatccaatcaaccctacatacgaggcaaccaacgccatgtatcaccgctgtctggattacgtgctcgaggagctcaaacacaacgccaaagccaaggtcatggtggcaagtcataacgaggacaccgttaggtttgcccttaggcgaatggaggagctgggcctgcatcctgcagatcacagagtgtacttcggccagctgctcgggatgtgcgaccagatctcctttcctctgggacaggcagggtaccctgtttacaaatatgtgccatacggccccgtgatggaggtgctcccgtacctgtcaagaagggccctcgaaaattccagcctgatgaagggcactcaccgcgaacgccaactgttgtggctggaattgcttaggcggctacgtacagggaacctgtttcaccgacctgcttag

SEQ ID NO: 200775 - DNA, 1479 bp, Artificial Sequence
  Description of Artificial Sequence: Synthetic coding sequence
atgaagatgaccttctacggccacttcgtggccggcgaggaccaggagtcaatccagcctctgctcaggcactatagagcttttggggtgtccgctatactcgattatggggtcgaagaggacctctcccctgaagaagcggagcacaaggagatggagagttgtacatctgccgccgaaagggacggctccggaactaacaagcgggacaagcaatatcaagctcattgggctttcggcgataggaggaatggagtgattagtgcaagaacctacttctacgcaaatgaggccaagtgcgactcgcacatggagaccttcctccgttgcatcgaagcgagcgggagggtatcggacgacgggttcattgctattaagctgaccgccctgggtcggcctcagtttctgctgcagtttagtgaggtcctcgctaaatggcggtgcttttttcatcagatggctgtagagcagggccaggctggcctggcagccatggacaccaagttggaagtcgctgtgctccaggaaagtgtcgccaaactggggatcgctagtagggctgaaatcgaggactggttcactgcagagaccctgggtgtgtctgggaccatggacctgctggactggagctccctcattgattcgaggaccaagctgagtaaacatctggtggtgcccaacgctcagaccggccagctcgagcccctgctctcccgcttcaccgaggaggaggaattgcaaatgactcggatgctacagagaatggatgtactggccaaaaaggccaccgagatgggcgtacggctcatggtggacgccgaacagacctattttcagccggccatcagccgattgacgctcgaaatgcagagaaagttcaacgttgaaaaaccattaatcttcaacacctatcagtgttacctgaaggacgcctatgacaatgtgacactggatgtggagctggcccggcgagagggctggtgttttggcgcaaagctggttcggggagcttacttagctcaggagcgtgcccgggcagccgaaattggctatgaggatcccattaatccgacttatgaggctacaaatgcaatgtatcatcgatgtctggactacgtattggaggagctgaagcataatgctaaagcaaaagtaatggtggcctcacacaacgaagatacagtgagattcgccctgcgacgaatggaagagctgggactccatccagcagatcaccgggtttattttggccagctcttaggtatgtgcgatcagatttcattcccgcttgggcaggccggctatcccgtgtacaagtacgtgccttacggccccgttatggaggtcttgccttacctcagtcgacgcgccttagagaactcttccctaatgaagggtactcaccgggagcgccagctgttgtggctggagctgcttcgtagactacgaaccggaaacctgtttcataggcccgcctag

SEQ ID NO: 200776 - DNA, 1611 bp, Artificial Sequence
  Description of Artificial Sequence: Synthetic coding sequence
atgagcccccgggtggtgagcaacagcagcgtgctggccagccagagtgttggaatcactaatgtaagaacggttttctccaatgtctttaacaacaccacagcatttccaatcttaagaggcagtaattgtcataaaatcacagcacccggcctcgggaagggccagctggtgaacctgcttccaccagagaatctcccctggtgtggcggtagccagggacctcgaatgttacgcacctgctacgtcctgtgctcccaggctggacccccatcgcgaggctggcagtcccttagcttcgatggaggtgcatttcacctgaagggtaccggggagctgactagagctcttctagtgcttagactctgtgcctggccccctctggttacccacggcctgctgctgcaagcctggagcaggcgtctcctgggcagcagactctccggagccttcctgagagcgagtgtgtatggccagtttgttgcgggcgagactgcagaggaggtgaagggctgtgtccaacaactccgaacactgagcttacgccccctgctcgctgttccaactgaggaagaacctgactctgcagccaagtcaggcgaggcttggtacgaggggaatctcggagccatgcttcgatgtgtggacctgtcacgcggactccttgagcctccaagtctcgcggaggccagtctgatgcagctaaaagttaccgccctgacgtctacacgcctgtgcaaagagttggcatcctgggttcgccgtcctggtgccagcttagaactatcacccgagcggctggccgaggccatggatagcggtcagaacctccaggtgagctgcctgaacgcagaacagaatcaacaccttcgggcgagcctgagtaggctgcaccgagtcgcacaatatgctcgggcccagcatgttagattattggtcgatgccgagtatacctctttaaatcctgcactgagcctcctagtggccgccctagcagtcaggtggaactcccctggcgaaggaggtccttgggtgtggaatacttaccaagcttgcttaaaagacacatttgaacgcctcggaagggacgcagaggccgctcacagagcagggttagcttttggcgtgaagctggtgcgcggagcctacttggataaagagcgggcagtcgctcaattgcacgggatggaagatcctactcagccagactacgaggcaacctcacagtcgtacagccgttgcttagaactcatgttgacccatgtggccagacacggcccaatgtgccatctcatggtggcttcacataacgaagagagtgtacgacaggcgaccaagagaatgtgggaactgggcatacccctggacgggacagtttgttttggacagttactgggaatgtgtgatcatgtcagcctcgcactggggcaagccgggtatgtagtgtataaaagtattccatatggcagtttggaggaggtgattccttatctgatacggcgggcacaggagaaccgctcggtcctgcagggcgcacgacgggaacaagagctgctctctcaggagctatggcggcgcctgctgcccggatgccggagaattcctcactag

SEQ ID NO: 200777 - DNA, 762 bp, Artificial Sequence
  Description of Artificial Sequence: Synthetic coding sequence
atgcccggccggaccgagggcggcagctggctgcggaacgccgccgccgctgacgtcctgcgtaatctgccggaggttgaatggagggagcctcagcactgctgccccccgactccccgcaagagaaagcaaaaccccagggtgcctttaccccattatccgccaaaccctgccgctgccatcgccgctgacactatgccaaagagaaaaaaacagaaccaccatcagccaccgacacagcagcagcccccactcccagagcgagaggaaaccggagatgaggaggacggcagccctattggccctccctcactgttgggtccacccccgatggccaatggtaagcctggggatccgaaatcagccctgcatagaggtccacctggatcaagagggccgctgattcccccattgctgagtttgccccccccaccctggggtaggggacctattaggcgcgggctggggccgaggtctagcccttatggcaggggatggtggggcgtgaatgctgagcccccgttccctggaccgggccacggaggacccacacggggatcattccacaaggaacagagaaacccccgcagactcaaaagctggagccttattaagaatacctgccccccaaaagacgacccccaggtcatggaggacaaatccgacagacctgtgtgtcgtcactttgccaagaagggccactgtcgctatgaggatctctgcgccttttatcatccgggagtgaacggccctccactttag

SEQ ID NO: 200778 - DNA, 504 bp, Artificial Sequence
  Description of Artificial Sequence: Synthetic coding sequence
atgcccaagcggaagaagcagaaccaccaccagccccccacccagcagcagccccctctgccggagcgcgaagagacaggcgacgaagaggatgggtcccctatcgctctgcaccgaggccccccaggatcaagaggtcctctgatcccaccgctcctctccctgccaccccccccatgggggaggggacccatccgccgcggcctcgggcccagaagcagcccctatggacgaggctggtggggcgtgaatgctgaaccacctttccccggccccggccacgggggaccaacaaggggcagcttccataaggagcaaagaaatccacgacggttaaagtcctggagcttgatcaagaatacctgtcctcctaaggatgacccacaagtgatggaagataagtcagatcgaccagtgtgtcgacattttgcaaaaaagggtcattgccgctatgaggatctctgcgctttctaccaccccggcgtcaacggacctccactatag

SEQ ID NO: 200779 - DNA, 567 bp, Artificial Sequence
  Description of Artificial Sequence: Synthetic coding sequence
atgcccaagcggaagaagcagaaccaccaccagccccccacccagcagcagccacctttacctgagagagaggaaacaggcgatgaagaagatggcagcccaattgggcctcctagtctgctgggccctccgccaatggccaacgggaaacctggcgatcctaaatctgccctccatcgcggccctcctggcagcaggggacctctcataccccctctactgtccctccccccacctccttgggggagggggccaatacggagaggcctcggaccgaggtcttccccgtatggtcgcggctggtggggggtgaatgccgaaccgccgttccccgggcctgggcacggcggcccaacacgaggatcatttcacaaagaacagcgaaatcctagaaggctgaaatcatggagtctgatcaaaaacacatgtcctcctaaagatgacccccaagtcatggaagataaaagtgaccgccccgtgtgtaggcacttcgccaaaaaaggacattgtcgctatgaagacctttgtgctttttaccatccaggtgtcaatggacccccactgtag

SEQ ID NO: 200780 - DNA, 567 bp, Artificial Sequence
  Description of Artificial Sequence: Synthetic coding sequence
atgcccaagcggaagaagcagaaccaccaccagccccccacccagcagcagccaccccttcctgaaagggaagaaacgggcgacgaagaagacggcagcccgattggacccccatccctgcttgggccccctcccatggccaacggtaagccaggcgacccgaaaagcgctctacatcgtggtccccctggcagcaggggccctctgatcccccccctgctcagccttccccccccaccttggggccgcggtcccatccgccggggacttggccctcggtcctcgccttacggaaggggctggtggggggtgaacgccgaacctccatttccaggacccggacatggaggacctactcgtggttctttccacaaggaacagcgcaatccgcgaagactgaaatcttggagcctcattaaaaacacgtgtcccccaaaggatgatccccaggtgatggaagataaatcagataggcccgtttgcaggcatttcgctaagaagggacattgcaggtatgaggatctgtgtgctttctaccatcctggcgttaatggacctcccctgtag

SEQ ID NO: 200781 - DNA, 504 bp, Artificial Sequence
  Description of Artificial Sequence: Synthetic coding sequence
atgcccaagcggaagaagcagaaccaccaccagccccccacccagcagcagccgcccctgcctgaacgtgaagagaccggcgacgaggaggatgggagtccaatcgctcttcaccgcgggcctccaggttcacggggcccgcttatccctcccctgctcagtctcccgccacccccttggggcaggggccctatacgcaggggcctgggaccccggtcttccccatatggccggggatggtggggggtgaacgcggaaccacccttcccaggacctgggcatgggggacccacccgcggatcatttcacaaagagcagagaaatccccggagactgaagtcctggagcctcatcaaaaacacttgtccgccaaaagacgacccccaggtgatggaagataaatctgaccggcccgtgtgtcgccacttcgctaagaagggacactgccgttacgaagacttgtgcgccttttatcacccaggagtgaacggcccccccctgtag

SEQ ID NO: 200782 - DNA, 504 bp, Artificial Sequence
  Description of Artificial Sequence: Synthetic coding sequence
atgcccaagcggaagaagcagaaccaccaccagccccccacccagcagcagcctcccctgcctgagcgcgaagagacaggggatgaggaggacggttccccgatagcgctgcatcggggacctcccggttcacgcgggccactgataccacctctgctgagcttacctcctcccccttggggccgaggccccattagaagaggcttaggtccgcgctcttccccatatggaaggggatggtggggagtgaacgctgaaccgccctttccgggacccggccacggcggacccacccgaggatccttccacaaagagcagcggaatccccgtcggctgaagagctggtcgttaattaagaatacttgcccacccaaagacgacccacaagtgatggaggataagtccgacaggccagtctgcagacatttcgccaaaaaaggacattgtaggtatgaggacctctgcgcgttctaccaccctggcgtgaacgggcctccactctag

SEQ ID NO: 200783 - DNA, 504 bp, Artificial Sequence
  Description of Artificial Sequence: Synthetic coding sequence
atgcccaagcggaagaagcagaaccaccaccagccccccacccagcagcagccaccactcccagagcgcgaggaaactggcgatgaggaagatggaagtcccattgcccttcacaggggacctccgggaagcagagggcccctcatccccccccttctgagcttgcccccaccaccgtggggtcggggaccaattcgtcggggactgggacccaggtcttccccctatgggcgcggctggtggggggttaatgcagagccgccatttccaggtccgggacacggcgggcccacacggggtagcttccataaggagcagcgcaacccacgaaggctgaagagctggagtctcattaaaaatacgtgcccccctaaggacgatcctcaagtgatggaagacaagagcgatcggcctgtttgcaggcacttcgcgaagaaaggacattgtaggtatgaggacctctgcgcgttttaccatcctggtgtgaacggcccccccttatag

SEQ ID NO: 200784 - DNA, 567 bp, Artificial Sequence
  Description of Artificial Sequence: Synthetic coding sequence
atgcccaagcggaagaagcagaaccaccaccagccccccacccagcaacaaccccctcttcccgagcgcgaggagactggggatgaggaagacggatctccgatcggaccaccgtctcttctcgggcccccacccatggcaaacggcaagcccggcgacccgaaaagcgctcttcacagaggtccaccggggtcacgcggtccactcataccccctttgcttagcctgcctcccccaccctggggacgcggaccgatcaggcgcggattaggaccgaggtcctccccatacggccgggggtggtggggggtaaatgcagaacccccctttccaggaccaggtcatggtggaccgacaaggggatcgtttcacaaggaacagaggaacccccgaaggttgaaatcctggagcttgatcaagaatacatgcccgcccaaggatgatccccaagtcatggaggacaaatctgatagacctgtgtgtcgtcatttcgctaaaaagggccactgtcggtacgaggatctgtgcgctttttaccatccaggcgtcaatgggcctcccctgtag

SEQ ID NO: 200785 - DNA, 567 bp, Artificial Sequence
  Description of Artificial Sequence: Synthetic coding sequence
atgcccaagcggaagaagcagaaccaccaccagccccccacccagcagcagccacccctgccagaacgagaggaaactggggatgaagaggacggttctcctatcgggcccccctccctgttaggcccccccccaatggcgaatggcaaacccggcgacccaaaatccgccttgcataggggtcctcctgggtctagggggcccttgattccacccctgcttagtctgccacctcccccctggggcaggggtcctatccggcgcggcttaggaccacgcagctcaccctatggaagagggtggtggggcgtgaacgccgagccaccttttcccggacccgggcatggcggacctacccgcgggagcttccataaggagcaacggaaccctaggcggctgaagagttggagtctcatcaagaatacttgcccccctaaagacgatcctcaggtcatggaggataagtcagatcggcccgtatgtcgccacttcgctaagaaggggcactgtcgctatgaggatctctgtgcattctaccatccaggcgttaacgggccaccactctag

SEQ ID NO: 200786 - DNA, 504 bp, Artificial Sequence
  Description of Artificial Sequence: Synthetic coding sequence
atgcccaagcggaagaagcagaaccaccaccagccccccacccagcaacagccaccgctcccagagcgtgaagaaacaggtgacgaggaggatggctctcccatcgccctacatcggggacctcccggttccaggggcccactgatcccccccttactcagccttccgcccccaccgtggggtcgaggcccaattaggcgggggctcggacctaggtcatctccgtatggaaggggatggtggggcgtaaatgccgaaccaccatttcctggcccaggacatggcgggccaactagagggagcttccataaggagcaacggaaccccaggcggctgaagtcctggtctctaatcaagaacacctgccctccaaaggacgacccccaggtaatggaggacaaaagcgatcgcccagtgtgccggcatttcgctaagaagggccattgccgctatgaggacttatgtgccttttatcaccccggtgtgaacgggccgcccctctag

SEQ ID NO: 200787 - DNA, 504 bp, Artificial Sequence
  Description of Artificial Sequence: Synthetic coding sequence
atgcccaagcggaagaagcagaaccaccaccagccccccacccagcagcaaccccctctccctgagcgcgaggaaacaggcgatgaggaggatgggtctcccatagcattgcaccgtggacccccagggagtcggggcccactgatcccacctctattgtctctgccgcctccgccttggggcaggggccctatccgccggggtttaggaccgagatctagcccttatggcagagggtggtggggggtcaacgccgaaccaccattccccggtccaggacatggcggccctacccgcggcagtttccacaaggagcagaggaacccaagacgactaaaatcctggtcgctaattaaaaatacttgtccgcccaaggacgaccctcaggtgatggaggataagtctgaccgccccgtctgcaggcactttgccaagaaagggcactgccgttacgaggacctgtgtgcattctatcacccaggcgtaaatggacccccactctag

SEQ ID NO: 200788 - DNA, 504 bp, Artificial Sequence
  Description of Artificial Sequence: Synthetic coding sequence
atgcccaagcggaagaagcagaaccaccaccagccccccacccagcagcagcccccattaccggaacgcgaggaaaccggcgatgaagaagacggttcaccaatcgcactgcatagaggcccccccgggtctcggggccccttgatcccccctctgctgagcctgcctccaccgccctggggaagaggcccgatcagacggggcctgggacccagaagctccccctatggccgcgggtggtggggcgtcaacgcggaaccacctttcccaggtcccggccacggcggacctaccagggggtcttttcacaaagaacagagaaacccccgccgactgaaaagctggtccctgatcaaaaacacttgtcctccaaaagacgatccccaggtcatggaggacaagagcgacagacctgtgtgtagacactttgccaagaagggacactgccggtatgaagatctgtgtgctttttatcatcccggggtgaacggcccacctctatag

SEQ ID NO: 200789 - DNA, 567 bp, Artificial Sequence
  Description of Artificial Sequence: Synthetic coding sequence
atgcccaagcggaagaagcagaaccaccaccagccccccacccagcagcagccccctcttcccgaacgcgaagagacaggggatgaagaggatggatccccaattggaccaccatcgctgctgggaccccctcccatggcaaatggaaagccaggtgatccgaaaagtgcccttcacaggggcccccccggatccagaggcccactgattccgccgcttctctcgctcccacctccgccctggggtagaggtccgataagacggggactgggccccagatcttctccttatgggcgaggctggtggggggttaatgccgagcccccctttcccggccccggccacggaggccctacaaggggctctttccataaggagcagagaaatccccgccgattaaagtcttggtcactgatcaaaaatacttgcccccctaaagacgacccccaggtgatggaagacaaaagtgacagacctgtttgtaggcacttcgccaaaaaaggacactgcaggtatgaggatctttgcgcattttaccaccccggcgttaatgggccaccactgtag

SEQ ID NO: 200790 - DNA, 567 bp, Artificial Sequence
  Description of Artificial Sequence: Synthetic coding sequence
atgcccaagcggaagaagcagaaccaccaccagccccccacccagcagcagcctcccttacctgagagagaagaaaccggcgacgaggaggatggcagtcccataggccctccttcactgctaggtccccctcccatggcgaatggaaagcccggtgaccccaaaagcgctttgcacagaggtcccccaggtagtaggggcccactgatacctcctctgctcagtctgcccccaccaccttggggccgcggacctattcgcagaggcctcggtcccagaagttctccctacggaagaggttggtggggcgttaacgccgaaccccctttccctggccctggtcacggtggacccactcgagggtcattccataaagagcagcggaacccccgacgcttgaaaagctggagtctgataaaaaacacttgtccgccaaaggacgacccacaagtgatggaggataagtccgaccgccctgtatgtagacatttcgcaaagaaaggccattgtcgttacgaagatctgtgtgccttctaccacccaggagttaatggacctccactgtag

SEQ ID NO: 200791 - DNA, 567 bp, Artificial Sequence
  Description of Artificial Sequence: Synthetic coding sequence
atgcccaagcggaagaagcagaaccaccaccagccccccacccagcagcagccacccttgccggaaagggaggagacgggggatgaggaagacggatctcccataggtcccccgagtcttcttggccctcctcccatggccaacgggaaacccggagatcccaaatccgctctccacagagggcctccaggatctagaggccccctaattccccctcttttatcactaccacccccaccatggggtcggggccccatcaggcgaggattagggcctcgttccagcccctatgggagaggatggtggggggtgaacgctgaaccacctttccctggccccggtcatggcggccccactaggggcagcttccataaagagcagaggaacccacgcagacttaaaagttggtctctgatcaagaacacgtgcccacccaaggacgatccacaggttatggaagacaagtcggatagacctgtttgccggcattttgctaaaaaggggcactgtcgctatgaggacctgtgtgcattctaccacccgggagtcaatggccctcctctgtag

SEQ ID NO: 200792 - DNA, 762 bp, Artificial Sequence
  Description of Artificial Sequence: Synthetic coding sequence
atgcccggccggaccgagggcggcagctggctgcggaacgccgccgctgcagacgtactgcggaacctacccgaggtggaatggagagagccccagcactgctgcccacccactccccgaaagaggaaacaaaatcccagggtgcccctgcctcactaccccccaaaccccgcagcagccattgctgccgatacaatgcctaagcgcaagaagcaaaaccaccaccagccccccacccagcagcagcccccacttccagagcgcgaggagactggcgacgaggaggacgggtctcccataggccccccgtcgctccttggaccgccacctatggcaaacgggaagccaggagaccccaaatcggccctccacaggggccctccagggagcagggggcccctgatccccccattgctgtcattgcccccccccccatggggacgcgggcccatccggcgtggactgggcccacgttcctccccttacggcagaggctggtggggcgtgaacgctgagccccctttccccggtccaggtcacggagggccgacacgtgggtccttccacaaggaacagcgcaatcccaggcgtctgaagtcttggagccttattaaaaacacctgtccacccaaggacgacccgcaggtcatggaggacaagagcgaccgccctgtgtgccgacacttcgcaaagaaaggtcactgccgctatgaggatctgtgcgctttctatcacccgggcgtcaacggtcccccactctag

SEQ ID NO: 200793 - DNA, 762 bp, Artificial Sequence
  Description of Artificial Sequence: Synthetic coding sequence
atgcccggccggaccgagggcggcagctggctgcggaacgccgccgctgccgatgtgcttcgaaaccttcccgaggtcgagtggagagaacctcaacattgctgccctccaacgccccgcaaacgaaaacaaaatcccagggttcctctgcctcactacccaccaaaccctgccgcagccatcgcggcagataccatgcctaagaggaaaaagcaaaaccaccaccagccccctacccaacagcagccaccactgcccgagcgcgaggaaaccggtgacgaggaggacggatcccccattggccctccatctctcctgggtcctcctcccatggcgaatggcaagcctggggatcccaagtctgccctgcataggggcccccctgggagccgaggacccctgatcccccctttactctctttgccaccccccccttggggtcgcggtcctatcagacggggtctgggtcctagaagcagcccctatggcaggggctggtggggggtgaacgcagaacccccattcccgggccctggtcacggagggccgacaaggggatctttccacaaagaacagcgtaacccccgcaggctgaaaagctggtctctgataaagaacacctgccctcccaaggatgatccacaggtgatggaggataaatcggatcggccagtttgcagacactttgcaaaaaagggacattgccggtatgaggatttgtgcgcattctaccacccaggtgttaacggcccacccctatag

SEQ ID NO: 200794 - DNA, 762 bp, Artificial Sequence
  Description of Artificial Sequence: Synthetic coding sequence
atgcccggccggaccgagggcggcagctggctgcggaacgccgccgcagcggatgttctcaggaatctgcctgaggtggagtggcgcgagccacaacattgttgtccacccacaccacgcaagaggaaacagaatccgcgggtgcccttgcctcattatcctccaaatccagccgcagccatcgctgccgatacgatgcctaagcggaaaaagcagaaccaccaccagccacccacacagcagcagccaccattacccgaacgggaggaaactggggacgaggaagatgggtcccctataggacccccatcccttctgggtcctccacctatggccaatggcaaaccaggcgacccaaagtcggccctgcacagggggcctccggggtctagggggccgctgattccaccactgttgtccttgccccctcccccatggggtaggggtccaatccggcgcggattggggcctcgaagctccccgtacggcaggggctggtggggggtcaacgccgagcctccttttccgggacctggtcatggcggccccactcgcggctcatttcacaaggagcagaggaacccaagacgactgaaatcctggtcactaatcaagaacacatgccctcctaaagatgatccacaagtcatggaggacaaatctgatagacccgtttgccgtcatttcgccaagaaaggtcactgccgctacgaagacttgtgcgccttctatcatcccggtgtgaacggtccacccctgtag

SEQ ID NO: 200795 - DNA, 762 bp, Artificial Sequence
  Description of Artificial Sequence: Synthetic coding sequence
atgcccggccggaccgagggcggcagctggctgcggaacgccgccgccgcagatgtgctcagaaacctgcctgaagtggaatggcgcgagccacagcactgctgtcctccaacccctagaaaaagaaagcaaaaccctagggtgcccctgcctcactatccgcctaaccccgcagctgccatcgctgccgacacgatgccgaagcgcaagaaacagaatcaccaccagccgcccactcagcaacagccaccccttcctgagcgagaagagaccggcgacgaagaggacggctcgcctattgggcccccttctctcctcggcccgcccccaatggccaatggcaagccgggggaccctaaaagcgccctccaccggggccctcctgggagtcgggggccactgattcctccactcctgtcactcccaccgccaccatggggaagagggccaatccgccgcggactgggacctcgttcatcgccttatggtaggggatggtggggggtgaacgcggaacccccctttcctggcccgggccacggcggaccaacacggggctcctttcataaagagcagcgaaacccccgcaggctcaagagctggagcctcataaagaatacttgtccccctaaggacgatccacaggttatggaagacaagtcagatcggcccgtttgccggcattttgcaaaaaaaggacattgcagatacgaggacctttgcgccttttaccatcctggagtgaacgggccgcctctgtag

SEQ ID NO: 200796 - DNA, 762 bp, Artificial Sequence
  Description of Artificial Sequence: Synthetic coding sequence
atgcccggccggaccgagggcggcagctggctgcggaacgccgccgccgccgacgtgctccgtaacctgcccgaggtggagtggcgggaaccccaacactgttgcccccctacacctcgtaagcgcaagcagaatccgcgagtaccgctgcctcattatcctccaaatcctgcggcggcgatcgcggccgacacaatgcccaagcgaaaaaagcagaaccaccatcagccacctacacagcagcaacctccactgcctgagagagaagaaactggcgacgaggaggacggtagtcctataggtccgccctctcttctgggcccccctccaatggcgaatggcaaacccggcgacccaaagtccgcactccataggggacccccaggaagccggggtccattaattccaccactgctaagcctgccaccaccaccttgggggcgtggcccaattcggcgggggctggggccacggtcctctccttatggacggggatggtggggagtaaacgctgagccccctttccctgggccgggccatggtgggcctacgcggggcagctttcataaggagcagcgtaatccccgacgtcttaaatcctggtccctcattaagaacacttgtccaccaaaggacgatcctcaggttatggaagataaaagtgataggccagtctgtaggcacttcgctaagaaggggcattgtaggtatgaagacctgtgtgctttctatcatccaggggtgaatggaccacctctttag

SEQ ID NO: 200797 - DNA, 762 bp, Artificial Sequence
  Description of Artificial Sequence: Synthetic coding sequence
atgcccggccggaccgagggcggcagctggctgcggaacgccgccgctgctgacgtcctgcgtaacctccctgaagttgagtggcgagaacctcagcactgttgtcctcccaccccacgcaagcgaaagcaaaatccaagggtgcccctgccgcactaccctcccaaccccgccgctgctatagccgcagacacaatgcctaaacggaagaagcaaaatcaccaccaacccccaacccagcagcagcctcccttaccggaacgggaggaaacaggggacgaagaagacgggtcacctattggcccaccatcgctcctggggcctcccccaatggctaatggaaaaccgggggaccctaagtctgcccttcatcgggggcctcccgggagccgaggaccactaatcccccctttactgagcctcccgcccccaccctggggaagagggccaatcaggcggggattggggcccaggagctccccatatgggcggggatggtggggagtcaacgcagaaccgccgttcccgggtcctggacatgggggccctactcgtggctcgtttcataaagagcagcggaacccccggcggctgaagagctggagtttaataaaaaacacatgtccaccaaaggacgatcctcaggtgatggaggacaagtccgatcgccctgtgtgcaggcactttgcaaagaagggccactgcagatatgaggatctgtgcgcattttatcaccctggggtgaacggaccacctttgtag

SEQ ID NO: 200798 - DNA, 1344 bp, Artificial Sequence
  Description of Artificial Sequence: Synthetic coding sequence
atgcggagcgtgagctacgtgcagcgggtggccctggagttcagcggaagcctgttccctcacgccatttgtctcggcgatgttgacaatgataccctaaatgaactcgtcgtcggcgatacatccggcaaggtgtcggtgtataaaaacgacgacagtcgtccatggttgacgtgctcgtgccagggcatgctgacttgcgtgggcgtgggcgatgtgtgtaacaaggggaaaaatttactggtggcggtgtcagctgaagggtggttccatttgtttgacctaaccccagcaaaggtgttggatgcttcaggccatcacgagacgcttatcggggaggaacagcgaccagtgtttaaacagcatatcccggctaacacaaaggtcatgctgatttcagatattgatggcgacggttgtcgagagttagtcgtcgggtatacagatagggtagtgcgggccttccgctgggaagaactgggcgaagggccagagcatttgaccgggcagcttgttagcctgaaaaaatggatgctcgaaggccaagtcgactccctctccgttacactgggtccgctcgggttgcctgagctgatggtgtctcagcccggatgcgcctatgcaatcctcctgtgcacatggaaaaaggacactgggagtccccccgcctcagagggcccgactgatggctctcgcgagactccagctgcaagagacgtggttctgcatcagacaagcggaagaatccataataagaatgtatctacacatttaataggaaatattaagcagggccacggaacagaaagtagcggcagtggactctttgccctgtgcacacttgacggaaccctcaagctaatggaggaaatggaggaagcggataagctcctgtggtcagttcaagttgaccatcagctgttcgcgctagaaaagttggatgttacgggaaacggacacgaagaagttgtcgcctgtgcatgggatgggcagacatatatcattgatcacaaccgcactgttgttcggtttcaggtggatgagaacatccgggctttctgtgccgggctgtatgcgtgcaaggagggcagaaattccccttgtctggtatatgtgacgtttaatcagaagatctacgtgtactgggaagtccagctggaacggatggaaagtacaaacttggtgaaattactggagaccaagcctgagtatcactccctattgcaggaactgggcgtcgatcccgacgatctgccagtcacccgcgccctgcttcaccagacattgtaccaccctgatcaacccccacagtgtgcccccagtagcttgcaggaccccacttag

SEQ ID NO: 200799 - DNA, 381 bp, Artificial Sequence
  Description of Artificial Sequence: Synthetic coding sequence
atgctgctggtgctgctgagcgtggtgctgctggccctgagcagcgcacagagtaccgacaatgacgttaactatgaagacttcactttcactattccagacgtggaggacagttaccttgatcctctggtgatcgtggtgacaaaaatgatggtgctttctagggaccaccagaaccaggaggcaataaccgcaatccttccacatctcctgttcaaaatttctaacgaccatcccgatgaggacaccgtgaactcattgtacccagactttctgctgagtgcttgtcgcaagcaccaccattctagcaggggcaccgatcaacaggacattccgcgctccaatcacagtggaaatctggaattctctgggcggaagtag

SEQ ID NO: 200800 - DNA, 198 bp, Artificial Sequence
  Description of Artificial Sequence: Synthetic coding sequence
atgctgctggtgctgctgagcgtggtgctgctggccctgagcagcgctcagagtacagacaacgacgtgaattatgaggacttcacttttaccatccctgcttgccgcaaacatcatcattcgagtagaggtactgatcagcaagatatacctcgttccaatcactcggggaacctggaattctcaggccggaaatag

SEQ ID NO: 200801 - DNA, 696 bp, Artificial Sequence
  Description of Artificial Sequence: Synthetic coding sequence
atggccgtgttcctggaggccaaggacgcccacagcgtgctgaagagatttcctagagccaatgagtttctcgaggagctgagacaggggactatcgagcgagaatgtatggaggagatttgcagttatgaggaggtcaaggaggtatttgagaacaaggagaagacgatggaattctggaaaggctaccctaacgccgtgtacagcgtccgcgatccgagtcaatccagtgacgcgatgtacgttgttgtccctcttctcggtgtagccctgctcatcgtcatcgctctttttatcatttggagatgccaactccagaaggccacccggcaccatccgtcatacgcccaaaataggtacctggcctccagagccgggcatacattgccaagagtgatggtctatcgcgggaccgtccattctcaaggggaaccgagcggtcatcgcgaagctgctaacagcccccaggtcgtactgggaccctcccgcggaggccggaccaccgtgcgcttagagtctactctgtaccttcctgagttgtcgctatcaagacttagctcaaccaccccaccccccagctatgaagaggtgaccgctccacaggaaagctcatctgaggaagcctcagtaagctactctgatcctcctcccaaatacgaggagatcgtggctgccaatcccggagccgacaagtag

SEQ ID NO: 200802 - DNA, 309 bp, Artificial Sequence
  Description of Artificial Sequence: Synthetic coding sequence
atggccggcctgagccgggccctgagcagcgtgttcctggaggccaaggacgctcattcagtgctgaaacgctttccaagagctaacgagttcctcgaagagcttcgccaagggaccattgagagggagtgtatggaggagatttgcagctacgaagaagtgaaagaggtatttgaaaataaggagaagaccgcctgtaccacccttggcctcgttctcggggtgggggtagcttcaggcatcgcgcgtacaggccctggcaatgccgaccagtcagaagcccggaaagatacccagcctaaggcttag

SEQ ID NO: 200803 - DNA, 276 bp, Artificial Sequence
  Description of Artificial Sequence: Synthetic coding sequence
gaccccagccagagcagcgacgccatgtacgtggtggtgcccctgttgggcgttgcgctgctgatagtgatcgctctcttcattatctggcgttgtcagctccaaaaggctacacggcaccaccctagctatgcccaaaacaggagatgctttgctgtgcgccttgccgcacctagtttcgcctcaaagtattctaacgtcggtgcttttccttttcggctctgggccgcatcactgtcgctagcccggatctatttgacaaatatccccaagtag

SEQ ID NO: 200804 - DNA, 159 bp, Artificial Sequence
  Description of Artificial Sequence: Synthetic coding sequence
atggccgtgttcctggaggccaaggacgcccacagcgtgctgaagaggttcccccgtgcaaacgagttcctcgaggagcttcggcaggggaccatagagcgggaatgcatggaagagatttgctcatacgaagaggtgaaggaagtctttgagaactag

SEQ ID NO: 200805 - DNA, 696 bp, Artificial Sequence
  Description of Artificial Sequence: Synthetic coding sequence
atggccgtgttcctggaggccaaggacgcccacagcgtgctgaagagatttccgcgggctaacgaatttctcgaggaattacgtcagggcacaatagaacgtgaatgcatggaagaaatttgtagctatgaagaagtaaaagaggtctttgagaacaaggagaagacaatggagttctggaaaggttacccgaacgccgtgtactctgtcagggatccgtctcagtcctcagatgcgatgtacgtggtggtaccgctgttgggagtggccctgctgatcgtaattgccctgttcataatctggaggtgtcagctgcagaaagcaacgcggcaccaccccagttatgcccagaatcgctatttagcatcaagagcaggtcatactttgccacgggtgatggtgtacagaggcacagtgcactcacagggggaaccctccggccatcgtgaggcagccaattcccctcaggtagtgcttggtccatcacgaggaggtagaaccaccgtgcggctggagagcaccttgtacctgccggagctgtcactgagccgcctttcctccacaactcctcccccttcatacgaggaggtgacagccccccaggagtcgtccagtgaagaagcctccgttagttacagtgatcccccaccaaagtacgaggagatcgtagccgcgaaccctggggccgataagtag

SEQ ID NO: 200806 - DNA, 681 bp, Artificial Sequence
  Description of Artificial Sequence: Synthetic coding sequence
atgttcaccctgctggtgctgctgagccagctgcccaccgtgaccctggggttcccccattgcgcgaggggtccaaaagctagcaagcacgcgggtgaggaagtgtttacaagcaaagaagaagcaaacttcttcatccaccggagactgctttacaataggtttgatttggaactgttcaccccaggcaatctggagcgcgaatgcaacgaggagctctgcaactacgaggaagccagggaaatctttgtagacgaggataaaacaatagctttttggcaggaatattctgcaaagggtcctaccacaaagtcagatgggaatcgagagaaaatcgacgtgatgggactgcttacaggtctgattgccgcaggtgttttcctggtcattttcggtctcctcggttattacctctgtattaccaagtgtaatcgtctccagcatccttgctcctccgcggtttacgagcgtggtcgacatacacccagcatcatctttcggcggcccgaggaggccgccctcagcccactaccaccctctgttgaggatgcaggcctgccctcttatgaacaggcagtggcgctaacccgcaaacactccgtgtccccacccccgccttatccaggccataccaaagggtttcgagtgttcaagaagtccatgagcctgcctagccattag

SEQ ID NO: 200807 - DNA, 375 bp, Artificial Sequence
  Description of Artificial Sequence: Synthetic coding sequence
atgctgctgcgggacctggtgctgcggcggggctgctgctggagctcactgctcctgcactgcgcactccaccccctttggggatttgtgcaggtcacccacggagaaccacaaaagtcgtgctccaaggtcaccgatagttgtaggcacgtctgtcagtgcagacctcccccaccactgcctcctccccctcctcctccaccacctcctaggcttctgtctgcccccgcgccaaacagtaccagttgtccaaccgaggaaagctggtggtcaggactcgtgataatcattgcagtgtgttgtgcctctctcgtcttcctaacggttctggtgattatttgttataaggccatcaaaagaaatcacgccatatag

SEQ ID NO: 200808 - DNA, 462 bp, Artificial Sequence
  Description of Artificial Sequence: Synthetic coding sequence
atgctgctgcgggacctggtgctgcggcggggctgctgctggagctcacttctactgcactgtgctcttcaccccctttgggggttcgtgcaggtgacacacggagaacctcagaaatcttgctcgaaggtcaccgatagctgtaggcacgtgtgtcagtgtaggccgccaccacctttacctcctcctccacccccacccccaccccctcgcctgctgtccgccccagctccgaattctacttcgtgtccgaccgaagagtcctggtggtcaggcctggttatcattatcgctgtctgctgtgcctctctggtgtttctgacagtgctggtgatcatttgttacaaggcaattaaacggaaacctctgcggaaagatgagaatgggacttccgtcgcggagtatccaatgtccgcctcccagagcaacaagggagtggatgtgaataacgccgtcgtttag

SEQ ID NO: 200809 - DNA, 462 bp, Artificial Sequence
  Description of Artificial Sequence: Synthetic coding sequence
atgctgctgcgggacctggtgctgcggcggggctgctgctggagcagcctgctactgcactgtgcgctgcatcctctgtggggctttgtgcaagtcacccacggcgagccacaaaagtcttgttccaaggtcaccgattcttgccgacacgtgtgtcaatgtcggcctccccccccattgcctcctccaccgccccctccaccgccacccaggctcctttccgctcctgcccctaattctacaagctgccctacagaagagtcctggtggagcggcctagtaattatcatcgcagtctgttgcgcctctctggtgtttctgacagtgctggtgatcatttgctacaaggccattaaacggaaaccccttcgcaaagacgaaaatggtacctccgtggccgagtaccctatgtccgcatctcagtccaacaagggcgtggatgttaataacgccgtagtgtag

SEQ ID NO: 200810 - DNA, 828 bp, Artificial Sequence
  Description of Artificial Sequence: Synthetic coding sequence
atgtggcgggccggcagcatgagcgccgagctgggcgtgggctgcgcattgcgagccgtaaatgagcgggtacagcaggcggtggcccgccggcctagggacttacccgccatccaaccaagactggtagctgtcagcaagaccaaaccggcagacatggttatcgaggcctatggacatggtcagcgaacctttggcgaaaattatgttcaggagcttctcgagaaggcgagtaatcctaagatactttcactctgtccggaaattaagtggcattttatcggtcacctgcagaaacaaaacgtaaacaaactgatggccgttccgaacttattcatgctggagacagttgattccgttaagcttgccgacaaagtgaatagctcctggcagaggaagggcagccccgagcggctcaaagtcatggtacagataaacacctctggagaggaatcaaagcacggtctgccacccagcgaaacaatcgcaatagtggaacatattaatgccaagtgccccaacttggaatttgtggggctgatgacgattggctcatttggccacgacctctcacaaggcccaaatccagacttccagcttcttctgtctctgcgcgaggagctgtgtaagaaactgaatattcctgccgaccaggtcgaactctctatgggcatgtctgccgactttcaacacgcagtcgaagtcggaagtaccaacgttcggatcgggagcacaattttcggagaaagagattactctaaaaagccaaccccggacaaatgtgccgctgatgtaaaagcaccactggaggtggcccaggagcactag

SEQ ID NO: 200811 - DNA, 1149 bp, Artificial Sequence
  Description of Artificial Sequence: Synthetic coding sequence
atgcggagccccctgtgctggctgctgcccctgctgatcctggcctcagtggcgcagggtcagcccactaggcgtcctcgccccggcacaggtcccggccgacgaccacggccccgacccagaccaacaccctccttcccacagcctgatgaacctgcggagccgacagatcttcctccaccactgccgcccggccccccctcaatctttcctgattgtcctcgcgaatgctattgccctcctgattttccgtctgctttatattgcgactccagaaaccttagaaaggtgcctgtgatccccccgcgcattcactacctttacctgcagaataacttcattacagaactcccagtggagtcctttcagaacgcgactggcctgcggtggataaatctcgataataaccggataagaaaaatagaccagagagtcttggaaaagctgcccggactggtgtttctgtacatggaaaaaaatcagctggaagaagtcccatccgccctgccacgcaatcttgagcaactgcgcctcagccaaaatcatatctcccggatcccgccgggcgtcttttccaaattggaaaacctcttgctgctcgatctccagcataatagactgtcggatggagtctttaagcccgacacattccacggattaaagaacttaatgcaactgaacctggcacataacattttgaggaagatgcccccaagggtccccacggcaatacaccagctctatctggacagtaacaagatcgaaactattccaaatgggtactttaagtcatttcctaatcttgcctttatcagactcaattacaataagctgaccgatcgtgggttgcccaagaattcatttaatatcagtaatcttcttgtgctccatctctcccacaaccgtattagctcagtgcctgccattaacaatagattagaacacctgtatctgaataacaacagcatcgaaaaaatcaatggaacccagatctgcccaaacgatctcgtggcgttccacgacttcagctcagatctggagaatgttccacatttacggtatttgcgactggatggtaactatcttaagccacccataccactcgaccttatgatgtgcttccgcttgttgcaatctgtggtgatctag

SEQ ID NO: 200812 - DNA, 1002 bp, Artificial Sequence
  Description of Artificial Sequence: Synthetic coding sequence
atggaggacctggaggaggacgtgcggttcatcgtggacgagacccttgacttcggcggccttagcccgtccgattctcgcgaagaggaggatatcactgtactagtcaccccggagaaacccctgagacgcggcctgagccacagaagtgaccctaatgccgttgcccctgcgccccaaggtgttaggctatccctcggacctttgagccctgagaaactcgaagagatcttagacgaagctaataggctggcagcccagcttgagcagtgtgccctgcaggacagagagagcgccggcgaaggactggggccccggcgagtgaagccctccccacgccgagagacatttgtgctgaaagatagccccgtgcgagacctcctccccaccgtgaacagccttactagaagcacccccagtcccagttccctgaccccccggctccgctcaaacgacaggaaggggtcggtccgcgcactccgcgctacctctggcaaacgccctagtaacatgaagcgcgaaagtcccacttgcaatttattccccgcatccaaaagcccagcctcatcacctctaacaagatcaacgcctccagtgaggggccgtgcaggccccagtggcagggccgccgcgtcaccacccacgccaattaggagcgtcctggcgccccaaccaagtaccagcaacagtcagcggctccctagaccacagggggccgctgctaagtcaagcagccagttgccaatcccgtcagcgatcccccggccggcatctagaatgcctcttactagccgctcagtgcctccaggcagaggagctctcccaccagattcactgtccaccagaaaaggccttccccgtcctagcacagcagggcaccgtgtgcgggagtccgggcataaggtccctgtttcccaacggctaaatctgcccgtcatgggagccactagaagcaacctgcagccccctcggaaggtcgctgtcccggggccaacacggtag

SEQ ID NO: 200813 - DNA, 933 bp, Artificial Sequence
  Description of Artificial Sequence: Synthetic coding sequence
atggaggacctggaggaggacgtgcggttcatcgtggacgagaccttggacttcggcggtctgtctccgtccgattcacgcgaagaggaggacataacagtcttagtcaccccagagaaacctctgaggcgcgggctcagtcatcggtctgacccaaatgctgtagcccccgctcctcaaggtgttcgtctgagcctgggacccctgtcccccgagaaactcgaagaaattctggatgaggctaataggctcgccgcacagctagagcagtgcgcccttcaggatagagagtctgccggtgaaggactcggtccccggagggtgaagccctcaccacggcgggagacattcgttctgaaagactctcctgtgcgagaccttttacctactgtgaattccctgacgagatccacacccagcccttcatcactgacccctagacttaggtccaatgatagaaagggtagtgtccgcgccctcagagccacatctggaaagagaccaagcaatatgaaaagagagtcgcccacctgcaacttgttccccgccagtaagtcacccgccagcagtcctttaactaggtctacacctcccgtccgcggacgggcgggcccatctggtcgtgccgctgcttccgaggagacgcgggctgcaaagctgcgcgcctgccagcccaacgcaacccaccaacccgagtgtgcaacctggcagagatgccctacgtccggttttagtgtgaactcaaagagagccagcaaaacaaagcactgtcgaacccaatcagccggcaaatggacccaaggcagctgttttccggccactaaatcaagctgccacggttgccacagccagcagtctgccgctccccaggaatctggcagtccacgcacatatcaggtgaagcgctcaggccagcaggccaggctccagtag

SEQ ID NO: 200814 - DNA, 1002 bp, Artificial Sequence
  Description of Artificial Sequence: Synthetic coding sequence
atggaggacctggaggaggacgtgcggttcatcgtggacgagaccctagattttgggggactgagcccctcagatagtagggaggaagaggacatcacagtactggtcacccctgaaaaacccctgcgcaggggcctgagccatcgctccgatccaaatgccgtcgctcctgcgccccaaggcgtccggctttctctgggaccgctcagtcccgaaaagctggaagaaatcttggacgaggcaaataggttggccgcccagctcgaacagtgtgcattacaggatcgggaaagcgctggcgaagggctcggtcccagaagggtgaaaccctcgccacggcgcgagacatttgtgctgaaagactcacctgtgcgggatttgttgccaactgtgaacagcttgacacggagcacaccatcacctagcagtcttaccccacgccttcggagcaatgatcgcaaggggtctgtgagagccctacgggctaccagcggcaagcgacccagtaacatgaaaagagagtcccccacctgtaatttatttccggctagtaaaagccctgcctcaagccctctgaccagaagcacacctccagtccggggaagagcaggccccagtggacgtgccgccgcgagtccgcctacaccaatccggagcgttctagctccccagccatctacatctaatagccagcggctcccccgcccccagggcgctgcggccaagagctcatcccagctgccaatcccgtcagcaatacctcggcctgcttctagaatgccgctaacaagtcggtctgttcctcctggccgaggcgccttgccccctgactccctgtcaacaagaaagggcctgccccgtcctagtactgcgggccaccgagtaagagagagtggccataaggttccagtctcccagaggctaaatctgcccgtaatgggagctactcgttctaatctccagcctccccgaaaagttgccgttccaggtcccacccgctag

SEQ ID NO: 200815 - DNA, 1002 bp, Artificial Sequence
  Description of Artificial Sequence: Synthetic coding sequence
atggaggacctggaggaggacgtgcggttcatcgtggacgagaccctggactttggcggcctctcacctagcgatagtcgcgaggaagaggacataaccgtgttggtcactccagaaaaacccctccggagagggctttcacaccgatccgatcccaatgcggtcgctccagccccacagggagtgagattgagcttgggtcctctaagtcccgaaaaacttgaagagattctagacgaggcgaaccgattagctgctcagctggagcagtgtgcccttcaggatcgtgagagtgccggagagggactgggacccaggcgggtgaaaccatctccgaggagagagactttcgtcctgaaggactcccccgtaagggatctgctaccaaccgttaatagcctgactcgttctacaccgtcaccttcatcactgacaccacgccttcgatccaacgacaggaaagggtcagttcgcgcgttacgggccacttcaggaaagcggccttccaatatgaagcgcgaaagtcctacatgtaacttatttccagccagtaagtcccccgctagcagtcccctgactaggtccactccccctgtcaggggccgagcagggcctagcggccgcgcagctgcgtcccctccgaccccaatccgctcagtgcttgctccccagccaagcacatcaaactcccaaaggttgcctagaccacaaggcgctgcagccaagtcttcatcccaactgcctatcccatccgctataccaagacctgccagtagaatgcccctgaccagccggagcgttcccccaggcagaggggccctgccccccgattctctgtcaacgcgtaaggggttgcctaggccctccaccgccggacaccgtgtccgcgagtccgggcataaagtgccagtatcccagcgactgaacctaccagttatgggcgcgacaaggtctaatctccagcctcctaggaaggttgcagtcccgggccctacacgctag

SEQ ID NO: 200816 - DNA, 1002 bp, Artificial Sequence
  Description of Artificial Sequence: Synthetic coding sequence
atggaggacctggaggaggacgtgcggttcatcgtggacgagaccctagactttggcgggctgtctcctagcgactcaagagaagaagaagacatcacagtgctcgtcacccccgagaagccattacgcaggggactgtcccaccgctccgacccaaacgccgtggccccagctccccagggcgtgagactgtcccttggacctctgagtccagagaaattagaggagattctcgacgaggcaaaccggctggccgcacaattagaacaatgcgcgctccaggaccgcgagagcgctggtgagggcctgggaccccgacgggtgaaaccctcccctcgacgagagacgttcgtcttgaaagactcaccagtgagagaccttttacctactgtgaactcgctgacgcggtctacaccctcaccatcaagcctaactccacggctcaggagtaatgaccgaaagggttcagtccgggctctccgagccacctctggaaaacgtccttccaacatgaaaagagagagtccaacctgtaatcttttccctgcgagtaaatcccctgcgtcatccccactgactagaagcactccacccgtgagaggcagagctggcccgtccggcagggcagcagcctcaccccccactcctattcgaagcgttttagcaccccagccctccactagcaatagtcagagactgcctagaccccaaggcgctgcggcaaaatcctcaagccagcttcctatcccatctgctattcctagacccgccagcaggatgcctctcacctcacgctctgtcccacctggtagaggagctttaccacccgacagtctgtccaccaggaagggactgccccgcccctcaacggcaggtcatagggttcgggagtccgggcacaaagtgcccgttagccagcggctcaatctaccagtcatgggagcaacgcggtccaacctccaacctcccaggaaggttgcagtgcctggtccaaccaggtag

SEQ ID NO: 200817 - DNA, 666 bp, Artificial Sequence
  Description of Artificial Sequence: Synthetic coding sequence
atggaggacctggaggaggacgtgcggttcatcgtggacgagacccttgacttcggtgggctctccccaagcgattctcgggaagaggaggacatcaccgtgctggttactccagagaagccactgagaagaggcctgtcccacagaagtgaccctaatgccgtggcgcccgctccacaaggcgtcagattgagcttggggcctctgtcccccgagaagctggaggagatcctggacgaggctaatagactcgccgcacaacttgaacagtgtgccctgcaagatagggaaagcgctggcgagggccttggccctaggcgagtgaagccgtcgccacgacgggaaacttttgtactgaaggatagtcccgtacgggatcttttaccgaccgtgaattccctcacaagatcaaccccttcaccttcttctttgacaccccggcttaggtctaacgacaggaaggggtcagttagagccctgcgcgcgacatccggcaaacgaccgagcaacatgaagagggagtcaccgacttgtaacctgttccctgcctctaagagtcccgcaagctctcccctgaccagatcaacaccccctgttaggggaagagctggaccctccggacgggcggctgcctctgaagagacgcgggctgctaaactcaggtag

SEQ ID NO: 200818 - DNA, 699 bp, Artificial Sequence
  Description of Artificial Sequence: Synthetic coding sequence
atggaggacctggaggaggacgtgcggttcatcgtggacgagaccctggattttggcgggctctcgccatccgactcaagagaggaagaagacatcaccgtcttggttacaccggaaaagccattgagacggggtctatctcaccgttcagatcccaatgccgtagcacccgctccacaaggagttcgactgtccctggggcctctatcccccgaaaagctggaagaaatcctcgacgaggctaataggctggccgctcagcttgagcagtgtgctctccaggatagagaaagcgcaggagaggggctcggtcccagaagggttaaaccatcacccaggcgagagacttttgttttgaaggactcccctgtacgggatcttctcccaacagttaatagtctcacacggtcaactccgtcaccaagctcacttactcctcggctgaggtccaacgatcgaaaaggctcagtccgggccctgcgcgcgactagcggtaagaggcccagcaacatgaaacgggaatccccaacgtgcaatctgtttccagccagcaaatcccccgcatcttcccccctcacacggagtaccccacccgttcggggccgggccggaccctcaggccgcgctgccgcctcacccccaacccctatccggtccgtactggcacctcagccctcaacttctaattcacagcgttag

SEQ ID NO: 200819 - DNA, 1092 bp, Artificial Sequence
  Description of Artificial Sequence: Synthetic coding sequence
atggaggacctggaggaggacgtgcggttcatcgtggacgagaccctggactttggaggcttaagcccttctgactccagggaagaggaagacataacagtgctggttacgcccgaaaaacctctaaggcggggactcagccaccggtctgatccaaacgccgtggcccctgcaccccagggagtgcgccttagtttaggccccttgtctcctgaaaagttagaagagattttagacgaagcgaatcggctggctgcccagttggaacagtgtgctctgcaagatagagaaagtgcaggggagggcctgggcccgaggcgggtgaaaccgtccccaaggcgggaaaccttcgtgctcaaggactctcccgtgagggacctgctgccgacagtgaacagcctgacccgctctacccctagccccagtagccttacgccacggcttaggtccaacgatcgcaaggggtccgtgagagccctgcgcgctacgtccggaaagcggccctcgaacatgaaaagagaatcaccaacttgcaacctgtttccagcaagcaaatcccccgctagcagccctttaactagaagcacacctcccgtgcgagggcgcgcgggcccctccggccgggccgccgcctccgaggaaacgcgcgctgctaagctgagagttagcgggagcggggagttcgttggcctgaccctgaagtttttacatccaagccctccaggccccccaactccaatccggtccgtgcttgctccgcaaccttctacatccaatagccaaaggctgccaagacctcagggcgccgcagcgaaatcttcctcacagctacctatcccttccgcaataccgagaccggcctcgaggatgccactaacaagtcgaagcgtgccacccgggcggggtgccctcccccctgattcgctgagcacccggaaggggttacccagaccaagcacagccggtcacagagtgcgggagagcggacataaagttccggtgtcacagagactcaacctgcccgtaatgggcgcaactaggagcaatctacaacctccccgaaaggttgcagtccctggtcctactagatag

SEQ ID NO: 200820 - DNA, 273 bp, Artificial Sequence
  Description of Artificial Sequence: Synthetic coding sequence
atgcggcggctgctgctggtgaccagcctggtggtggtgctgctgtgggaggcgggcgccgtcccagcccctaaggtgcccattaagatgcaggtgaagcactggccttccgaacaggatcccgagaaggcatggggcgctcgcgtcgtcgagccccccgagaaagacgaccagcttgtcgttttgtttcccgttcagaaacctaaactgctcaccacagaggaaaagccccgcgggacaaaagcctggatggagagtcgggctaggccttag

SEQ ID NO: 200821 - DNA, 459 bp, Artificial Sequence
  Description of Artificial Sequence: Synthetic coding sequence
atgcggcggctgctgctggtgaccagcctggtggtggtgctgctgtgggaagctggagccgtgcccgctccaaaagtacctatcaagatgcaggtgaagcattggccgtcggagcaggatccagagaatcgggcatggggggcccgtgtggtggagccaccagagaaggacgatcagctcgtggtgttatttccagtgcagaagcccaaacttctcacgactgaggaaaaacctcgcggccagggccgaggacccattctgccggggacaaaagcctggatggaaacagaggataccctcggtcacgtgctctcgcccgagccagaccacgattcgctgtatcatcccccacccgaggaagatcagggcgaggagcgccctaggctctgggtgatgcctaaccaccaagtgctgctcgggccggaggaggatcaggatcacatttatcatccgcagtag

SEQ ID NO: 200822 - DNA, 456 bp, Artificial Sequence
  Description of Artificial Sequence: Synthetic coding sequence
atgcggcggctgctgctggtgaccagcctggtggtggtgctgctgtgggaagcaggagctgtcccggcacccaaagttccaattaagatgcaagtgaagcattggccctctgaacaggaccccgagaaagcgtggggggctagagtcgtggagccccccgaaaaggacgaccagctggtcgtcctgtttcctgtgcagaagcctaaacttctgaccactgaggaaaagccaaggggtcagggacggggccccatcctgcctgggaccaaagcctggatggagacagaggacactctgggacacgtactcagcccagagcccgatcacgactccttgtatcatcctccacccgaggaagaccagggagaggagaggccgcggctgtgggtgatgcctaaccaccaagtcctgcttggtcccgaggaagaccaagatcacatttaccacccacagtag

SEQ ID NO: 200823 - DNA, 429 bp, Artificial Sequence
  Description of Artificial Sequence: Synthetic coding sequence
atgcggcggctgctgctggtgaccagcctggtggtggtgctgctgtgggaagccggggcagtgccagctcccaaggtccctattaagatgcaggtgaagcactggccgagtgagcaagatcctgagaaggcttggggcgctcgagtggtggagcccccagagaaagacgaccagctagtcgtgctcttccctgttcagaaaccaaaacttctgacaactgaggagaagccacgcggaactaaggcatggatggagaccgaggacaccctggggcacgtgcttagtcccgaaccggatcacgactccctgtaccacccacctccagaggaggaccaaggcgaagaaaggccacgcttgtgggtcatgccaaaccaccaggtcctgcttggacctgaggaggatcaagatcacatttatcatcctcagtag

SEQ ID NO: 200824 - DNA, 6474 bp, Artificial Sequence
  Description of Artificial Sequence: Synthetic coding sequence
atgagcgaccggagcggccccaccgccaagggcaaggacggcaagaaatattcctccctgaacttgttcgatacatacaaagggaagtctctggaaatccagaagcccgctgtggctccacggcacggcctgcagagcctgggcaaggtggcaattgcccggaggatgccgcctcctgccaacctccctagtttgaaggccgagaataaaggaaatgaccctaatgtctcattggttcctaaggatggtacgggatgggcctctaaacaggagcagtccgaccctaagtcaagtgacgcaagtaccgcacaacctcccgaatctcagcctctccccgcttcacagacccctgccagtaaccagcctaagcgtcccccggccgcacccgagaacaccccactcgtgcccagtggggttaaatcttgggcgcaggctagtgtgactcacggggcccacggtgacggcgggagggcatctagcctgctgtcccggttctctagggaggaatttccaaccctccaggcggctggcgatcaggacaaggccgcgaaagagcgtgaatctgccgagcagtcttcaggtccaggaccctccctcagacctcagaattccacaacatggcgggatggcggcgggcgcggccctgatgagctagagggacccgactcgaagctccatcacggccatgacccacggggcggcttgcagccctccggacctcctcaattccctccttacagaggtatgatgcctcccttcatgtatccgccctacttgccatttcctccaccctatgggccacaaggcccctataggtacccaactcctgacggtccatcccgcttcccgcgggtcgctggcccccgtggctctggcccaccgatgcgccttgttgaacccgttggccgaccatcaattctgaaggaagataatctcaaggagtttgatcaactggatcaggaaaacgacgacggctgggctggggctcacgaggaggtggactacacagagaaactcaaattttctgatgaggaggacggacgggattctgacgaggaaggggccgaaggtcatcgcgactcccagtccgcctctggagaggagaggccaccagaagcggatgggaagaagggcaattctcctaactccgagccaccaactcccaagaccgcatgggctgagacatctaggcctcccgaaactgagcctggcccccctgctcctaaaccgccattgcctcctccccacaggggccccgccggaaattggggcccacccggggattacccggatcggggtggtcctccatgcaagccacccgcacctgaagacgaagacgaagcgtggagacagaggagaaaacagagctcttcggaaatctctctggctgtggaaagggcccgcaggcgccgagaagaggaggaacgtagaatgcaggaagagcgccgtgcagcttgtgcggagaaactaaaacgcctcgacgagaagtttggagctcccgataaacgcctgaaggctgaaccagcagcccctcccgctgcaccgtccaccccagcccctcctccagctgtgccaaaagaattacctgcccctcctgcccctccccccgcatccgccccgaccccagagaccgagccagaggaaccagctcaggcacccccggcccagtctactccaacgccaggcgtggctgccgccccgactctggtaagtggcgggggttcaacatcttcaacgtcttcaggctctttcgaggcctccccggttgaaccccagctcccctccaaagagggccctgagcctccagaggaagtcccaccgcctacaactccccctgtgccaaaggttgagccaaagggcgacgggataggcccaacacggcaaccccccagtcagggactgggataccccaagtaccagaaaagtctgcctcctaggttccagcgtcagcagcaggagcagttactcaaacaacagcagcaacaccagtggcagcagcaccagcaggggagtgctcctcctacacccgtgccaccttcccccccccagccggttacacttggggccgtgcctgccccccaggccccaccacccccaccaaaagccctataccccggggcacttggccgccctcctcccatgcctcccatgaatttcgacccgcgatggatgatgattccaccctacgtggatcccagactgttgcagggacgtcccccactagatttctaccctcccggagtacaccctagtggcttagttccaagagaacgatcagattccggtgggtcctcttcagaaccctttgacagacacgcccctgctatgcttcgcgaaagaggaaccccaccagtggatcccaagctggcctgggttggggatgtgttcacagccacacccgccgaaccacgtccgctcacatccccattgaggcaggccgctgatgaggacgacaaggggatgagaagcgaaaccccaccagtgccaccgccacctccatatctggcatcgtatccagggtttccggagaacggagcaccaggccccccgatttcccgcttccccctcgaggaacccggtccgcggcctctcccatggcctcctgggtcagatgaggtggcgaagatacagacaccaccccccaaaaaagagccccccaaggaagaaaccgcgcagctgactggcccagaggccggacgcaagcccgccaggggagttgggtcgggcggacaaggccctccgccaccaaggagggagagccgcacggaaacccgatggggccctcgaccgggcagcagccgcagaggaattccacctgaagaacccggtgccccgcccagacgcgcaggcccgataaaaaaaccacccccccctacaaaggtggaggagcttccccctaaaccccttgagcagggtgacgaaacaccaaaaccccccaagcctgaccctttaaaaataactaaaggaaagctgggaggccccaaagagacaccacccaacggcaacctgtcacccgcccctcgcctgagacgcgactatagttacgaaagagttgggcctactagttgcagaggaaggggccgcggagagtattttgccaggggccggggcttccgcggaacttatggcgggcgcggcaggggggctcgatcacgcgagtttagaagctaccgcgagttccggggggacgacggcagagggggagggaccggaggaccgaatcacccacccgcccccagaggacggaccgctagcgagacacgatcagaggggagtgagtatgaagaaattcccaaacgacgcaggcagagaggaagtgaaactggatcagagacccatgaaagcgacctagccccctcagataaggaagcacctacccccaaagagggcacacttactcaggtgcccttagcgccgccaccaccaggtgcaccaccatctcctgcccccgctcgcttcacagcacggggcggtagagtgttcaccccccggggggtgccttccagacgcggccggggaggaggtcgccctcctcctcaggtgtgtcctggctggtcacctccagccaaaagcttagccccaaaaaaaccccccaccggccctctgcctcccagcaaggaaccgctcaaggagaaactgattcctgggcctctgtcccccgtcgctagaggcggttctaatggcggtagcaacgttggcatggaggacggcgaacgccctagacggagacgccatggccgcgcgcagcaacaggacaaacccccgcgctttcgtcgactgaaacaggagagagaaaatgccgctcggggctcagaaggtaaaccctctctcacactgcctgcctccgcccccggccctgaagaagccctcacaactgttaccgtggccccagctccccggcgggctgcagccaagagtcctgatctgagtaatcaaaacagcgaccaggctaacgaagagtgggaaaccgcgtcagagtcttccgattttacttccgagcgacgcggcgataaagaagcaccacctccagtgcttcttacacctaaggcagtggggacacccggcggaggtggcggaggcgctgtgcccggaatctccgctatgtcccggggtgatctctcccagagggctaaagacctctcaaaacgctcgttctctagccaacggccaggtatggagaggcagaatcgaagaccaggacccggaggtaaagccgggagttctggctcttcctccggtggcgggggtggaggccccggggggcgtacagggcccggccgcggggataagcgctcttggcctagccccaagaaccggtcacggccccccgaggagagaccccccggcctccctctccctccccctcccccctctagttccgcagtgtttcgactggatcaggtgattcattccaatccagcgggcatccaacaggcgttggcacaactttcttcacgccagggcagcgtgactgcgcccggtgggcatccgaggcacaaacccggcctgcctcaggccccacagggaccgtcgccgcgccccccaacaagatacgagccacaacgcgtgaactctggccttagttctgacccacacttcgaggaacctggacccatggtgagaggcgtggggggcaccccacgggactcagccggtgtgtcccctttccccccaaagaggagggaaaggccccccagaaagcctgaacttctccaggaagagagcctccctcccccccactcaagtggcttcctcggcagcaagccagaggggcctgggccccaagctgagtcacgggataccgggactgaagcccttactccccatatctggaaccggctgcataccgctacctcgaggaagtcttacaggccctcaagcatggaaccttggatggagcccctgagcccattcgaggatgttgccgggaccgaaatgagccagagtgattctggagtggacttgagtggagactctcaagtgagttcaggcccgtgttcccagagatcaagccccgatgggggattgaagggcgccgcggagggacccccaaagagacctggagggtcttctcccctaaatgccgtgccatgtgaggggccgccaggttcagaaccccctcgtagaccccctcctgccccgcacgatggtgatagaaaggagctgccgcgagagcagcctctcccacccggacctataggcacagaaagatctcagagaacagacaggggcacggagccaggacccatcagaccctcccacagacctgggccccccgtccagtttggaaccagtgacaaggactccgatctaaggctcgtagtgggcgattcattgaaagccgagaaggaactcacagcctccgtgactgaggcaattcccgttagccgagattgggaactgttgccatctgcggctgcctcagcggaaccacagtcaaagaacttggactccggccactgcgtccccgagccatcttcttcaggacagaggttatatcccgaggtcttttatggttcggcaggaccaagtagctctcagatcagtggaggagcgatggattcccagctgcatccgaatagcggggggtttagacctggtacccccagtctgcacccatatagaagtcaaccactgtatctcccccccggtccagctccaccatcagccctgctgtctggactggccttaaaaggacagtttctcgatttctcaactatgcaagcgacagaactggggaaactcccagccggaggcgttttatatcccccacccagtttcctatactcccccgcattttgtcccagtccgctgccagatacatccctcttgcaggtccgccaggacctccccagtcctagcgatttctatagcactcccctccagcccggaggccagtccggtttcctgcctagtggagcgcccgcacagcaaatgctcctgcctatggttgactctcaacttcctgttgtcaattttggaagcttaccccctgctccccctccagccccgcccccactctcccttctgcctgtaggacccgcactgcagcctccatccctcgccgtgagaccaccgccagctccagccaccagggtgcttccttctccggcaagacccttccccgcaagcctcgggagagctgaactgcatcccgtcgaactgaaaccctttcaagactaccaaaagctgtccagtaatctgggtgggcccggctcaagccgtacacccccaaccgggcggagcttttctggtctgaatagcaggttgaaagctaccccctctacgtacagcggggtgttcagaacacagcgtgtagacctgtatcaacaggccagtcctccagatgctctgcgctggatcccgaaaccctgggagaggaccggccctccgccccgagaaggtccttcacgacgagctgaggagcctggctcccggggggataaagagccgggccttcctcctcctcgatag

SEQ ID NO: 200825 - DNA, 4149 bp, Artificial Sequence
  Description of Artificial Sequence: Synthetic coding sequence
atgctgcgggagcggggcaccccccccgtggaccccaagctggcctgggtgggagacgtattcacggccacacccgctgagcctcgccccctgacttcacccctgcgccaggctgccgatgaggacgataagggtatgcgctctgagacccccccggttcccccacctccgccttatcttgcctcctaccctggctttcctgagaacggtgctccaggtccaccaatcagcagattcccactggaggagcctggcccaaggcccttgccatggcctccagggtctgatgaagtggccaaaatccagacacccccaccaaaaaaggagcctccaaaagaggagacagcacaactaacgggacccgaggccggccgcaagcccgccagaggtgtcgggtccggaggccagggtccacctccccctagacgggagagtcgaaccgaaacacgttggggcccacgtccaggcagttcccgacgcggcatcccaccagaagagccaggggctccacctcgcagggcaggtccaataaaaaagccaccacctccaacaaaggtggaggagctgccacccaaaccccttgagcagggtgacgaaacccctaagccaccgaaacctgatcctctgaaaataacaaaggggaagttgggtggtcccaaagagacaccacctaacggtaacctgagtcctgcccccagattgcgtcgcgattatagctacgaaagagtgggtcccactagttgtaggggtagaggacgaggagaatacttcgccaggggacgcggcttcagaggaacgtacggcgggagaggccgcggggcccggagcagagagttccgatcctaccgcgagttccggggagatgacggacgtggaggaggcaccgggggacctaatcacccgccagcccctcgcgggcgtaccgcgtctgaaacccgaagcgaagggtccgaatacgaggagataccaaagagaaggcgccagcggggttccgagactggttccgaaactcacgagtccgatctggcaccttcagacaaggaagcgccaacaccaaaagaggggacgctgacccaggtcccgctcgccccgcctcctcctggcgcgcctccatcaccggcccccgcccggtttacagccaggggaggtcgagtcttcacgccgcgcggtgtgccatcacgcagggggagaggtggcggcagaccccctcctcaggtgtgtcctggctggagtccacccgcaaagagcctggctccaaaaaagccccctacgggtccactgccacccagcaaggaacctctgaaagagaaactgattcctggtcccctgtctccggtggcacgagggggttccaatggcggatcaaacgttggtatggaggacggcgagaggcctaggcgccggcgccatgggcgggcacaacagcaagacaaacctccccgctttcgaagactgaagcaggagcgagaaaacgcagcacgcggtagtgaaggcaagccttcactgactctgcctgcttcagctcccggtccggaggaggccctcacaactgtaaccgtggcccccgcccctcggcgtgccgccgctaagtcacctgatttaagcaatcagaactcagatcaggcaaatgaggagtgggagacggcctcggagagttctgacttcacatctgaacgtagaggcgataaggaagcaccacctcccgtgctcctgaccccaaaggcagtggggacccctggggggggaggcggaggggccgtgccgggcatatccgccatgtcccggggcgacctgagtcaacgggccaaagatttaagtaaacggagcttcagctcgcagagacccggcatggaacggcaaaaccgcaggccaggcccaggtggaaaagccggcagctctgggagcagcagcggcggcggcgggggcggcccgggcgggagaactggacctggccgcggagacaagaggtcatggcctagccccaaaaacaggtcccgaccccccgaggaacggcccccaggtctgcccctcccacctcctccccccagctccagtgctgtatttagattagatcaagtgattcactctaatcctgcaggcattcagcaggccctggcccagctgtccagccgacagggcagcgtaaccgccccggggggtcaccccaggcataagcctggtctaccacaggctccccaggggccatcccccagaccaccgacccgctacgaaccacaacgcgtaaatagcggcctgtctagcgaccctcacttcgaagagcccggaccaatggtgaggggagtgggtggaacccccagggactccgcgggcgttagcccattcccaccgaagcgccgcgaacgtccaccaaggaagcccgaactcctgcaggaggagtccctaccgccaccccacagttccggattcctcgggtcaaaacctgagggacccggtccacaggcggagtcccgggacacaggcaccgaggcccttactccccatatttggaacagattgcacactgccacctcccgcaaaagttatcgccccagttcaatggagccttggatggaacctctctcacccttcgaagacgtcgccgggactgaaatgtctcagtccgactcaggtgtagatttgtcaggggactcccaggtctcaagcggcccttgttcccagagatcttcgcccgatggtgggctcaagggggccgcagagggcccacctaagcgtccggggggctcttccccgctaaacgccgttccctgcgaaggccctcctggaagtgagcccccccgcagaccgcctcccgcaccccatgatggtgacaggaaggaacttccccgggaacaacccctcccgcctgggcccatcggcacggaacggtctcagcgaacagacaggggcacggaacccggccccattcgaccatcacatagacctgggccgccagtccagtttggaacatccgacaaagattccgatcttaggctggtggttggagacagtctgaaggctgagaaggagcttaccgccagcgtgaccgaggccatcccagtcagccgggactgggagttgttaccatctgcagcggcctccgctgagccccagtccaaaaacctggattccggtcattgtgtccccgagccgtcttcctccggccaaaggctatatcctgaagtgttctacggtagtgctgggcctagcagcagtcaaattagcgggggagcgatggacagtcagctgcatcctaattctggaggctttcgtccaggcacaccttcgttacatccttacagatcgcaacctttatatctaccacccgggccggctcctccaagcgctctcttgtccggtctggctcttaagggacagtttctggatttttccacgatgcaggcaaccgagctgggaaaactgcccgccgggggagtcttatatccacctcccagctttctgtactccccagcattctgtccttctccattgccagacacttctcttctccaggtgcggcaggacctgcccagcccttcggacttctactctactccactacaacctggaggccagtccgggtttctgcccagcggcgcacccgctcagcagatgttgctgccaatggtcgacagccagttgccagtggtgaacttcggttctctgccaccggctccgcccccagcacccccaccactcagtctgctgcccgtaggtcctgctcttcagccaccgagcttggctgtacgaccccctccggctcctgcaactagggttctgccatcgcctgcacgaccattcccggccagtctcggacgcgccgaactgcacccagttgaactcaaaccctttcaagactaccagaagctcagctccaatctgggagggcccggctcatccaggacccctcctactggccgcagcttctcagggttaaatagccgattaaaggccactccgtcaacttactcgggcgtgtttcgcacacagagggttgacttgtatcagcaggcaagtccccctgatgctcttaggtggatccctaagccatgggagaggacgggcccgccccctagggaaggaccatctcgccgcgccgaggagcctggatcacgaggagacaaggagccaggtctgcctcctccccggtag

SEQ ID NO: 200826 - DNA, 6474 bp, Artificial Sequence
  Description of Artificial Sequence: Synthetic coding sequence
atgagcgaccggagcggccccaccgccaagggcaaggacggcaagaagtacagttccctcaacctgttcgacacttacaagggaaaatccctcgaaattcagaagccagccgtagcaccgcgtcacggccttcaatcgctgggcaaggtggcgatcgcccgccggatgcccccacctgccaacctgccttctctgaaggccgaaaacaaggggaacgacccgaatgtgagcttggtgcctaaggatggcaccggctgggcgtcaaagcaggaacagagcgatccgaagtcaagtgacgccagtaccgcccagccacccgagagtcagcctttgcctgcgtctcaaacccccgctagcaatcagcccaagagaccccccgcagcaccggaaaacactccgcttgtccctagcggagtcaaaagttgggcacaggccagcgtaactcatggagcccacggagatgggggaagagcaagcagccttctgtcccggttttctcgggaagagttccctaccctgcaggccgcgggcgaccaggataaagcggctaaggaaagagagtccgccgagcagtccagcggaccagggcctagccttcgccctcagaacagcaccacttggagggatgggggaggacgcggccctgatgagcttgagggtcctgatagtaagttgcatcacgggcacgaccccagaggggggttgcaacccagcggccctcctcaatttcctccatatagggggatgatgccccccttcatgtatccgccatatttaccgttcccacctccctacggcccacagggaccataccggtacccaacgcctgacggcccgagtcggtttccccgagtagccgggccgcgtggttccggcccgccaatgcgcctcgtggagccggttggccggccctcaattcttaaggaagacaatctgaaagagttcgaccagttggaccaggagaatgatgacggttgggctggcgcacacgaggaagtcgattacactgagaaactcaaattttccgatgaggaagacgggcgggattcggacgaggagggagcagagggacatcgcgacagccaatcagcaagtggggaggagcgacctcctgaagctgacggtaagaagggcaactctccaaatagtgagcccccaactccaaaaactgcttgggcggaaacatcccgcccgccagaaacagagccaggacccccagccccaaaaccccccttgccaccaccacatcgcggaccggcaggcaactggggccctccaggggattatcccgaccggggtggtcccccatgcaagcctccggcgcccgaggatgaagatgaggcctggcgccagcggcggaaacagtccagcagcgagatctctctcgccgtggagagagcacgccggaggcgtgaagaggaggaaagaaggatgcaggaagaacgacgggcggcgtgcgcagagaaacttaagagattggacgaaaagttcggcgcccctgacaaaagactgaaagcagagcccgcagctccaccagctgcaccttctacaccagcccctcctccagctgtccctaaggaactgcctgcgcctcctgcacccccccctgctagtgctccgactccggagaccgagcctgaggaacccgcccaggcgccaccagcacagtccacaccgacacctggcgtcgccgctgcaccaaccttggtaagtggagggggctcaactagttcaacttcctccgggtccttcgaagcctcacccgtggaaccacaactccccagcaaagaagggccagagccccccgaggaagtgcctcccccgactaccccccccgtgcccaaagtggagcccaagggtgatggtatcgggcctactcgccagcctccatcacaagggctagggtaccccaaataccagaaaagcctaccaccaaggttccagaggcagcaacaggaacagctccttaagcagcaacagcagcatcagtggcaacagcaccagcaaggatcagcacctccaactccagtcccacccagccccccacagccagtgaccctgggggccgttccagccccacaggcaccaccaccgccacccaaggccctgtatcccggagccctggggaggccacctcctatgccccccatgaacttcgaccccaggtggatgatgatacccccctatgttgatccccggctgctgcagggtcggccccctctggatttttacccgcccggggtgcatccctcagggttggtgccccgtgaacgaagtgactctgggggttcatcctccgaacctttcgacagacacgcacccgccatgcttagggagagaggtacgccaccagtggatcccaagctggcgtgggtgggagatgtgttcaccgccaccccagctgagcctaggcccctaacttcgccgttaagacaggcggcagacgaagacgataaaggcatgcggagcgaaacgccacccgtgcctccccctcccccttatctagcttcataccctggatttccagagaatggagcaccagggcctcctatcagtagattcccactggaggagcctggtcccagacctctcccttggcctcccggctcggacgaggtggccaaaatccagacaccacccccgaaaaaggaaccacctaaggaggagactgctcagctgacaggacccgaggctggtcgtaagccggccaggggagtgggcagcggagggcagggaccaccccctccccgtagagagagcaggacggagactagatggggaccccggccaggatcctcgcgaaggggtatccctcccgaagaacccggggcacctcccagacgggccggccctattaaaaagccaccccctccaaccaaagtggaagaactgccgccaaagccactggagcaaggcgatgagacccctaagcctccgaagcccgatccgctgaagataacaaagggaaaactgggcggaccaaaggagacccctcccaatggaaatttatcccccgcccccagactgaggcgagattatagctatgaacgagtggggcctacttcatgtaggggacgtggccgcggagagtacttcgcccgggggaggggcttcagagggacatatggtggccgcggccgaggagcgcgctcgcgagagtttcggtcgtacagagaattccgaggcgatgacggcaggggagggggcaccggagggccaaaccatccaccagccccccggggaagaacggcctccgagacccgatcagaaggttctgagtacgaagagatccccaaaagaagaaggcagcgtggctccgagactgggtcagaaacccacgaatcagatttggcaccatctgataaggaggcccctactcctaaggaggggaccctgacccaagtccccttggcacccccccccccaggtgcccctccatctcccgcgcccgcaaggtttactgcacgtggggggagggtgtttacaccccgtggcgtaccttccagacggggaagaggaggcgggcgacctccaccccaagtgtgtcctggatggtcgcctcccgccaagagcttggcccccaagaagccccctacagggcctctccctccgagtaaagagccactgaaggaaaagcttatccctgggccgctgtctccggtcgcccgcggggggtctaacggaggctcgaatgttgggatggaagatggcgaaagaccacgccggcggcgacatggaagggcccagcagcaggacaagccaccccggttccgccggctgaagcaggagagagaaaatgcagctcggggctcagaaggcaagccctcccttacactccccgcttctgcacctggtccggaggaagccttgacaaccgttacggtggccccagccccccgcagagctgcagcaaagagtccagatctgagtaatcaaaacagcgaccaagcaaatgaggagtgggagacagcaagcgaaagctccgatttcacctctgagcggaggggcgacaaggaggcgccccctcccgtgctgttgacaccaaaggccgtaggtacgccaggcggcggggggggtggagcggtacccggcataagtgctatgtcccgaggcgatctgagccagagagccaaagatctatccaaacgatccttttcaagccagcgacctggtatggaaagacagaacaggcggcctggacccggggggaaagctggctcctcaggcagctcctccggcgggggaggcggggggccaggagggcgaaccggcccaggtcgtggcgataaaaggtcatggccatcccccaaaaaccgatccagaccacctgaagagaggcctcccggactgcccctgcctcccccccccccttcctctagtgcggtatttcgccttgatcaagtgattcatagtaaccccgcgggcattcagcaagcactcgcccaactctccagccgacaaggcagtgtcacggctcctgggggtcatccacggcataagcctggactccctcaggctccccaaggccctagcccaagaccacctactagatatgagccccagcgcgtaaactcaggtctgtcatccgaccctcacttcgaggaacccggccccatggtccgcggcgtaggcggaacaccccgagattcagccggagtcagcccttttccaccaaagcgacgagagcgaccccctagaaagcctgaactcctgcaggaagagtcactgccaccccctcactcgagtggtttcctggggtctaagccagaaggtccaggccctcaggctgagagtcgtgatactggaaccgaggcactgacaccacacatatggaatcgcttacacactgcaacttcaaggaagtcttatcggcctagcagcatggaaccatggatggaacccctcagtccgttcgaagatgtagcgggcacagaaatgagccaatctgatagtggagtcgacctatctggagactcacaagtgagctcgggtccctgcagccagagatctagtccggatggcggcctgaagggcgccgccgagggacccccaaagcggcctggaggcagttcaccattaaacgcagtgccgtgcgaaggcccccctgggtccgaacctcccagaaggcctccccctgcaccacacgatggtgaccgcaaagagctgcctagagaacaacctctgccccccgggcccatcggtacagaacgctcccagcgaacggaccgcggcaccgaaccaggtcctatccgccctagtcacagaccaggacctccggtccagtttggcacttcagataaagatagcgatcttcgcctagtggtgggggatagcttgaaggctgaaaaggagctgactgcttcggtgacggaagccatacccgtctctcgggactgggagctgctgccatccgccgccgcaagcgcagagccccagtccaagaacctcgactccggccactgtgtgccagaaccctctagttccggccagagactgtatcctgaagttttttacggctcagcagggccatcttcttcgcagatctccggaggggctatggactcacagctccacccaaacagcggaggctttaggccaggcacaccatcccttcatccttatcgttctcagccactgtacctgcctcctgggcctgctcctccgtcagcgctgctgtcgggactggccctgaaaggccagtttctcgactttagcactatgcaggccactgaactgggcaaactgcctgctgggggcgtcctgtatccccctccctccttcctgtactctccagctttttgcccaagccccttgcctgatacatctttactgcaggtccgccaggatcttccctccccaagtgacttctacagcacccctctgcagccggggggccaatctggcttcctaccctctggagcgccagctcaacagatgttactccctatggtcgactcacagctgcccgtcgtcaacttcggaagccttccccccgctcccccgcccgctcccccccccctgtctttacttcccgttggccctgcactccagccccctagtctcgcagtgcgtcctccaccggcacccgccactagagtgttgcctagccccgcccgaccgtttccagcctccctaggtcgcgcagagctccaccctgtggagctgaaaccatttcaggattatcaaaagctgtctagcaatctgggcgggcctggttcaagtagaacacctcccaccggcaggtccttctccggactgaacagccgcctgaaagcaactccctccacttatagtggagtatttcggacgcagcgcgtggacctgtaccagcaggcatctccccctgatgccctgcggtggatcccaaaaccatgggaacggaccgggcctccacctcgagaaggaccatcaagacgagctgaagagccaggctctcgtggagataaagaaccagggctgccgcccccacgttag

SEQ ID NO: 200827 - DNA, 6474 bp, Artificial Sequence
  Description of Artificial Sequence: Synthetic coding sequence
atgagcgaccggagcggccccaccgccaagggcaaggacggcaagaaatattcaagcctcaatctgtttgatacatacaagggcaagtcactggagatccagaaaccggcagtggccccaagacatggactgcagtccttggggaaagtcgccatcgcaaggcggatgccaccgccagccaatctacccagcctcaaagctgagaacaaaggtaatgatcctaatgtctcactggtgccaaaggatggaaccggttgggcaagtaaacaggaacagtcagaccctaagtcatctgatgcttccactgcccagccccctgaatcgcagccactccccgcctcacagacacccgccagcaatcagcctaagcgccctcccgccgcccctgaaaatacacccttggtgcccagtggcgtcaaatcctgggctcaagcctcggtcacacacggtgcccatggcgatggtggacgggctagctctctgctatccagattttccagagaggaatttccgaccctgcaggcagccggcgaccaggataaggccgcaaaagagcgagaatcagccgagcagtctagcggccctggaccgtccctaaggccccagaactccactacctggcgggatggcggaggtcggggccctgacgaactagagggccccgatagcaaactccaccatgggcatgacccccgaggtggactgcagccaagcggccccccacaatttcccccgtaccgcggaatgatgcctcctttcatgtaccctccgtatttgccatttcctcccccgtatgggcctcagggtccatataggtaccccactccggacgggcccagccgctttccgcgcgtggctgggccaagggggtctggaccaccaatgaggctggtagaaccggtggggcggcctagcattctgaaagaggacaacctgaaagagtttgaccagctggaccaggagaatgatgacgggtgggcaggagctcacgaagaggttgattacactgagaagctgaaatttagcgatgaagaagatggccgtgatagcgatgaggaaggagccgagggccatagggattcccaaagcgcttccggcgaagagcgtccacctgaggcggatgggaagaaagggaacagtccaaacagtgagcctccaactccaaaaacagcctgggcagaaacaagcaggccaccggaaaccgagccaggacccccagcacctaagcccccactaccaccccctcacagggggcccgctggaaattgggggcctccgggggattaccccgatcgcggtggaccgccttgcaagccacccgcccccgaggacgaggacgaagcttggagacaacgtagaaagcagagcagcagcgagataagcctggcggtagagcgtgccaggagacgacgggaggaggaggaaaggcgcatgcaggaggaacgcagggccgcatgcgctgagaagttaaaaagactcgacgaaaagttcggggcaccagacaagaggcttaaggcagagcctgctgctcccccggccgccccttccacacccgctccccctcccgccgtaccaaaggaactgcccgctccccccgcccctccccccgcttccgcccccacaccagaaaaggagcccgaggagccagcccaggcaccccccgctcagagtactcctacccctggggtagcagccgcacccacactcgtttccggtggaggttctacctcctcaacgtctagcgggtcttttgaagcctccccagtggaaccacagctccccagcaaggagggtcctgaaccgccggaggaagtgcctccccctacaaccccaccggtaccaaaagtggagcctaaaggcgacggcatcggaccaaccaggcaacccccgtcccagggactaggttaccccaagtatcagaaatctttgccaccccgctttcagaggcagcagcaggaacagttactgaagcagcaacaacagcatcagtggcagcaacaccagcaggggtctgctccccccactcctgtacccccctctcccccgcagccagtaaccctgggtgcagtgcctgctccacaggctcccccgcccccgcctaaggctctttacccaggcgctctgggtagacctccccctatgccacctatgaactttgatcctcgatggatgatgataccgccttatgtggacccacgcttgctccagggacgacctccccttgacttctaccccccaggggtgcaccctagcggattagtccctcgggaaagaagcgattccggggggagcagctccgagccttttgacaggcacgcgcccgccatgctaagggagcggggcactccccctgtggacccaaagttagcctgggtgggtgacgtctttactgcaaccccagccgagcccagaccattaacctcgccattacgccaagcagccgatgaggacgacaaaggcatgaggtctgagacccctccggtgccaccgccaccaccgtacttagcctcttatccagggttccccgaaaacggagcaccagggccgccaatttcacgctttccacttgaggaacccgggccgcgtcctctaccctggcccccaggatccgatgaggttgcgaagattcaaactccacctccaaagaaagaacctcccaaagaagagactgctcagctcaccggacctgaggctggaaggaagccagcaagaggcgtggggagcggcggtcagggtcccccgcctcctagaagagagtcccggactgagacccgttggggtccacgccctgggagctccaggaggggcatacccccagaagagcctggtgctcctccccggcgtgcagggcccataaaaaagcctccacctcccaccaaagtagaagaattgccaccaaagccccttgaacaaggtgacgaaaccccaaagcctccaaaacctgatccattaaagatcacaaagggaaagctcgggggtcctaaggagacaccacccaatggtaaccttagtcctgctcctaggttgcggcgggactacagctatgagagggtagggcctacttcctgtcgggggcggggacgcggtgaatatttcgcccgtgggaggggtttccgcggcacgtacggaggcagaggccgtggggctcgttcacgtgaatttcgctcttaccgtgagttcagaggagacgacggtagaggtggcgggactggcggaccgaatcacccacctgcgcctcggggtcggaccgcaagcgaaacaaggagtgagggctccgaatacgaggagattcctaagcggaggagacagcgcggatccgaaactgggagcgagactcacgagagcgatctcgctccaagcgataaggaggcccctacccctaaggagggtacgctgacccaggtacctctcgcgccacccccacctggagcccccccaagcccagccccagcacgctttaccgcgcgcggcggaagagtgttcacgccgcgcggagtgccctccagaaggggaaggggaggcgggcggccccccccccaagtctgtcctggttggtctccccctgcgaagtcattagctccaaaaaaacctcctaccgggccgctccccccttcgaaagaaccgctgaaggaaaagctgattcctggccccttaagtcctgtcgccaggggcgggtctaacgggggtagcaacgtgggaatggaggacggcgaacgtccacgccggagaaggcacggaagagcgcagcagcaggacaaacctcctcgtttccgacgactgaaacaggagcgagagaacgctgcccgcggttcagaaggaaaacccagtctgactctgcctgcgtccgcccctgggccagaggaggccctcactactgttaccgtggccccagccccacggagggcagctgctaagagccctgatctatccaatcagaattccgatcaagcaaacgaggaatgggagaccgcaagcgaatcgtcagactttaccagcgagaggaggggggataaagaggccccaccacctgtattgctgacccccaaggcagtaggaactcccgggggagggggaggtggggccgtgccaggcatcagcgccatgtctagaggagacctgagtcaacgagccaaagatctgtctaagcggtcattcagcagtcagaggcccgggatggaaaggcaaaaccgcagaccgggacctggtggaaaggccggatcatctggatccagtagcgggggagggggcggcgggcccggaggaagaacaggaccaggccgcggggataaaagatcttggccctcacccaagaacaggtctaggccgccggaggaaagaccaccaggtctccctctcccccctccacccccttcctcctcagctgtattccgcctggaccaggtcatccatagcaacccagcaggcatccagcaagccttagcacagctctccagtcgtcagggctcagtcaccgcacctggaggccaccctcggcataaaccagggccgccgcaggcccctcagggtccaagtccccggccgcccaccaggtatgagccgcaaagggttaacagcggattatcttcagacccacactttgaagagcccgggccaatggtgcggggcgtcggagggactcccagggatagcgccggggtcagcccattcccgcctaagagacgtgaacggccaccccggaaacctgaactgctccaggaagaatccctacccccgccccatagctcagggttcttgggtagtaagcccgagggtcctgggccccaggccgagagcagggatacagggacagaagccttaacgccccacatctggaatagactgcacacagcaaccagcagaaagagctatcgccccagcagcatggaaccatggatggaacctcttagtccctttgaagatgtggccggaacggaaatgtcccagagtgatagcggggtggatctctccggggactcacaggtgagcagcgggccttgctcccagcggagctcccccgatggggggctgaagggcgccgcagagggaccgccaaagagaccaggtgggtcctcacccctcaacgcggtgccctgcgagggccctcccggctctgaacctccccgcaggccccctccagcccctcacgatggggaccgtaaagaattacctcgcgagcagcctctcccgcctggtccgatcggcactgagaggtctcagcataccgaccggggcacagagcccggacccattcgaccttctcacaggccaggacccccggtgcaatttggaaccagcgacaaggacagtgacttaaggctcgttgttggggacagcctcaaagcggaaaaggagttaacggcaagtgtcacagaggcaattcctgtgagtagggactgggagctcctcccttctgctgctgccagcgcggaacctcagagtaaaaacctggactccggacactgtgtgccggagcctagcagctccggccaaaggttatatccagaggtgttttatggaagcgccgggccctctagcagtcagatttcaggtggcgcgatggattctcaactgcaccccaacagtggtgggttccggccggggactccctcactgcatccctaccgcagccagcccctgtacctccctcccggaccggccccaccctccgccctgctttctggggtcgctctaaaaggccagttccttgacttttccactatgcaggctaccgagttgggtaaattgccggccggaggtgtgctttacccacccccctccttcctctatagcccggcattctgcccatcacctctacccgacaccagcctgctgcaagtgcggcaagacctgcccagcccttctgatttctattccactccactccagccaggtggccagagcggatttctgccatccggggccccagctcagcagatgctgctgccaatggtcgactctcagttgccagtggtgaacttcggtagccttccgccagccccacctcccgctcctccctcgttgtcgctgctgccagtggggcccgctctgcagcctccgagtctcgctgttcggcctcctccggcaccagccacacgtgtattaccctctcccgccagaccgttcccagccagcctcgggcgggccgagctccacccagtggaattaaagcctttccaggactatcagaaactgtcatctaacctgggtgggccaggctccagccgcacgcctcctaccggacggagcttttctggtctcaacagtcgattgaaagcgacacccagcacctacagcggtgtgttcaggacccaacgtgttgacctgtaccagcaggcctcgccccctgatgcactcagatggattccgaaaccctgggagagaaccggtcccccgccacgcgagggaccaagcaggcgcgccgaggaacccggctccaggggcgacaaagaacccggactgcctccccctcgatag

SEQ ID NO: 200828 - DNA, 6474 bp, Artificial Sequence
  Description of Artificial Sequence: Synthetic coding sequence
atgagcgaccggagcggccccaccgccaagggcaaggacggcaagaagtactccagcctgaacctgttcgatacatacaaaggaaagagcttggaaatccagaagccagctgtggctccacgccacggtctgcagtctctggggaaggtggctatcgccaggaggatgccccctcctgccaatctgccttctttgaaggctgaaaacaaaggcaatgaccctaatgttagtttggtaccgaaggacgggaccggatgggccagcaagcaagagcagtcggaccctaagagctctgacgcaagcacggcgcagcccccagaaagccaacctctgccagccagccagacacctgcgtccaatcagcctaaacgtcccccggctgccccagagaatacccctttggtgcccagtggtgtgaagagctgggcccaggcatccgttacccacggcgctcacggagatggcggcagggcctcttccctgctctcaagattttctcgcgaagaatttccaacactccaggcagcaggtgatcaggataaagctgctaaggaacgggagtctgcagaacaatcaagcgggcctggtccctcactcagacctcagaatagtacaacctggagagacggcggcggcaggggcccagatgaactggaggggcctgatagtaaactgcatcacggccacgatccccgcggcgggctccagccaagcggccctcctcagttcccaccgtataggggaatgatgcccccatttatgtaccctccctacctaccgttccctcctccatatggtccacaagggccatataggtacccgacaccagacggccctagtaggtttccccgggtagcaggccctagaggaagtggccctcctatgcgtctggtagaaccggtgggcagaccgtccatccttaaggaagataacctcaaagagttcgatcagctagatcaggagaatgatgacggatgggccggagcccatgaagaggtcgattacacggagaagttaaaatttagtgatgaggaggacggaagggatagcgatgaggagggcgccgagggtcacagggactcccagagcgccagtggagaagaaagaccacctgaggccgatgggaagaaaggaaattccccaaactctgaacctccaacgcccaaaactgcttgggcagaaacctcaagacccccagaaacggagcccggccctcctgcgccaaaaccacctcttccacctccgcaccgaggccctgctggtaattggggtccacctggtgattaccctgaccgcggggggcctccctgcaagccacctgcgccggaagacgaggacgaagcgtggcgacagaggcggaagcagtccagcagtgagatctcactagccgtggagagggctcgtaggcgccgggaggaggaggaaaggagaatgcaagaagaaagacgagccgcctgtgctgaaaagctgaagaggcttgacgagaagtttggagcgccagacaagcggctgaaagccgagcccgctgccccaccagcagcacccagcacacctgcaccccctcccgcagtgcccaaggagttgcctgcgcccccagccccccctcccgcatcagcgcctacacccgagaaggagcctgaggagcctgcccaggcaccacccgctcagagcacgcccacccccggggtagctgccgctcctacccttgttagcgggggcggaagcacctcatcgacgagttccggttcttttgaagcctctcccgtggagcctcagttgccctcgaaagagggaccggagcctccagaggaagtgcccccccccacaactccacccgtcccaaaagttgaacctaaaggggatggtattggccccacccggcagccaccgagccagggtttggggtacccaaaataccaaaaatcattgcctcccagatttcagcggcagcaacaggagcagctcttgaagcagcagcagcagcatcaatggcagcagcaccagcagggtagcgccccaccaacccccgtgccaccgtccccccctcaacccgtgactctcggcgcagtgccagccccccaagctcctccaccaccgccaaaagcgctgtatcctggcgcactcggcagaccaccgcctatgccacccatgaattttgatcctcgttggatgatgatccctccctacgttgacccccgcctgctgcagggccgacctcccctggatttctatcctccaggggttcatccttccggcctggtaccgagggagagatctgacagtgggggaagcagcagcgagccatttgaccggcatgctcctgccatgctccgagaacgcggaaccccaccggtcgaccctaagctcgcctgggtcggagatgtgtttacagcaacccccgcagagccccggccactcacgtctcctctcagacaggctgctgacgaggacgataagggcatgcgatctgagactcctcctgtccccccgccccctccatatcttgccagctatccagggttcccagagaatggagctcctggaccccctatttctaggtttcctttggaggagccaggacctagaccccttccctggccacccggcagcgacgaagtcgccaaaatccagacgccgccccccaaaaaggaaccaccaaaagaggaaacagcccagttgaccggtcccgaggccgggcggaagcctgcccggggcgtaggatctggcgggcaaggccccccacctccaagaagagagtctcgcaccgaaacacgctgggggccccggccaggatcttcacgtcggggaatcccccccgaggagcctggggcccctccaagaagggccgggcccattaagaaaccgcccccacctactaaagtggaggagctaccgccaaaaccgctggaacaaggagacgagacacccaaacctccgaagccggatcctctgaagattacaaaaggcaaattgggcggacctaaagaaaccccaccaaacggcaatctgagtcccgctcctcgccttcgccgagactactcttatgaaagggtgggtccgacatcctgccgcggcagggggcggggtgaatactttgctcgcggtaggggcttccgcggaacctatggaggccggggccgtggcgcgcggtctagagaattccgctcctatcgggagtttcgcggggatgatggacgggggggcgggaccggtggccccaaccacccgcctgccccccggggccggacagcttcggagacccgaagcgagggcagcgaatatgaggagatacctaagcgcagaagacaacgtggctctgagacaggtagcgagactcacgagagtgacttagctccatccgataaagaagcccctacgccgaaggaagggacactgacccaggttccattggcacctccgccaccaggcgctccgccctcaccagcccctgccagatttaccgcccgcggcggccgtgtttttacacctagaggggtcccatccagacgtggaagagggggaggcagaccaccacctcaagtgtgccccggttggagtccccccgccaagtcactggcccccaagaaacctcccacaggacccctgccacccagtaaggaaccgctcaaggagaaactgatcccggggcctcttagcccagttgcaaggggtggttcaaacggaggctccaacgtaggcatggaagatggcgaacgacctcgacggagacggcacggtagagcccagcaacaggataagccgcccagatttagaaggttgaaacaggagagggaaaacgcggctcgtggatctgagggtaaaccatccctaacattacccgcctcagccccaggaccggaggaggcactgacaacggtgacggtcgcacccgccccacgacgcgcggctgccaaatctcctgacctgagcaatcagaactccgaccaggcgaatgaggagtgggagacggcgtccgagtcgagtgacttcaccagtgagcgaagaggcgacaaagaagcaccaccccctgtccttctcacccccaaagcggttggcacccctggaggcggtggagggggggcagtgccagggatttccgccatgtcacgaggcgacctgtcccagcgcgcaaaagatctttctaagcgcagcttctcctcccagagacccggcatggaaaggcaaaacagacggcctgggcccgggggcaaagccggtagctctggatcgtcgagtggtggaggcgggggtggacctgggggccgcaccgggccaggcaggggagacaagcgttcctggccctcacccaagaacaggagccgaccccccgaagaaaggccccccggcctgccactccctccccctcctccaagctctagcgctgtgtttcgccttgatcaggttatccattctaatcctgcaggcatacagcaggccttagcccagctgagttcacggcaagggtctgtaaccgcaccaggagggcaccccagacacaaacccggccctccacaggccccccaggggccttcgcctagacctcccactcgctacgagccgcagagggtgaattctgggcttagttccgaccctcacttcgaggagcctggccctatggttaggggtgtcggcggcaccccgcgagactccgctggagttagccctttcccgccgaagcgtagagagcgtccgccacgcaaaccagaactgcttcaggaagaaagtctccctcctccccactcttctgggtttctaggatcaaaacctgagggacctggcccacaagctgagtcgagagacacgggtacagaggccctgacccctcatatttggaaccgccttcacacagcaaccagtaggaagtcatatagacctagttcgatggagccttggatggagccactttccccatttgaggacgtggccggcacagaaatgagccaaagtgactccggggtggatctgagcggcgacagtcaggtgtctagtgggccctgcagccagcggtcaagccctgacggcgggttaaaaggggccgccgagggacctccaaaacggccgggtggatccagccctctaaacgctgtgccttgtgagggcccccccgggtctgagccacccagacgccctccacccgctccgcacgatggcgatcgaaaggaactgccccgggagcagcctttgccacccggacccataggcaccgaacgcagccagcacacagacagagggacagaacctggtccaatccgcccctcacaccgccccggccctccagtgcagttcggtacgagtgataaagattctgatctgcggctggtagtgggagactcactgaaggcagaaaaagagctgacggcctccgtgacagaggccattcctgtgtcgagggattgggagctgttgcccagcgctgccgcctctgccgagccacagagcaagaacctcgacagcgggcactgcgttcctgagccttccagctccgggcagcgcctgtatcccgaggtcttttacgggtctgctggtccgtcgtcctcccagatctcaggtggagccatggattcgcagctccaccccaacagcgggggctttaggcccgggactccaagccttcatccatatcgttcacagcctctgtacctgcctcccggacctgccccacctagcgccttgctgtctggcgtggcgctgaagggccaattcctcgacttttcgaccatgcaagccaccgagctgggcaaactcccggctgggggcgtgttgtatcctcctccgagcttcctttactctcccgcattctgtccgtccccactgccggacacaagtctcctgcaggttcgccaagaccttccctcgcctagcgacttctattccaccccccttcagcccggaggccagagcggattcctacctagcggtgcgcccgcacagcagatgttactgccaatggtagattcccagctccccgtggtgaatttcggttctctacctccagcccctccacccgctcctccttctctttcactattacctgtgggtcctgcactgcaacccccctcactcgcggtccggcctccccctgcccccgccacaagggtgctgccttctcccgctaggcccttccctgcatctctggggagagctgaactacatcctgtggaactgaaaccctttcaggattatcaaaagctctctagtaacctgggaggaccaggctcatctaggacaccccctaccggaagatcgttttctggattaaactcacgcttaaaggctactcccagtacttactcaggcgtgttccgcacccagcgagttgacttgtaccagcaggcatccccacctgatgcactgcgttggatacccaagccctgggaacggaccggccctccaccccgtgaagggccctcaaggcgggctgaggaacccggatctaggggggataaggagcccgggctcccacctccgagatag

SEQ ID NO: 200829 - DNA, 6474 bp, Artificial Sequence
  Description of Artificial Sequence: Synthetic coding sequence
atgagcgaccggagcggccccaccgccaagggcaaggacggcaagaagtactcaagtctgaacctcttcgacacctacaagggaaaatccctagagatccagaagcccgccgtggcgccaagacatggcctgcagtccctggggaaagtcgctattgcccgccggatgcctccgcctgcgaatttaccctccctgaaagccgaaaataaaggcaatgatcctaacgtgtctctcgttcctaaggacgggactggctgggcgagcaagcaagaacagtccgaccccaagagtagcgacgccagcacagcgcaaccacccgaaagccagcctttacctgccagccagacccccgcctctaatcaacctaagaggccccccgccgcacccgagaatacacctttagtgccttctggcgtcaagtcttgggcccaagcgtctgttacccacggcgctcacggggatgggggcagggctagctccctgctgagtcgcttttcacgagaagagttcccgactctacaggccgcaggagaccaggacaaggccgcgaaggagcgcgagtccgcagagcagagttctggcccagggccaagcctgcgcccacaaaattctacgacatggcgtgacggagggggaagaggcccagacgagctcgagggacctgactccaagctgcatcatgggcatgatccaagaggcggactgcaaccaagtggccctccacagtttcccccctaccgaggaatgatgcctcccttcatgtatccgccatacttgccattcccaccgccatatggcccacaaggaccatataggtacccaacacccgatggacctagcagatttccacgcgtcgcgggtccccgggggtcaggacccccaatgcgcttggtggaacccgtcgggcggccgtctattctgaaagaagacaatctgaaggagtttgatcagctggatcaagagaatgatgacgggtgggccggtgcccatgaggaggttgattacaccgagaagctcaaattttccgatgaggaggacgggcgggactccgacgaggagggcgctgagggccatagagacagccaaagcgcctctggcgaggagcggccaccagaggctgatgggaagaagggtaatagtcccaatagtgaaccccccacccctaagacagcttgggcggaaacctctcggccgcctgaaacagagcccgggccccccgcgcctaaacccccattgccccctccacaccggggcccagctggaaactggggcccgccgggcgattaccctgacagaggcggaccaccttgcaagcccccagcacctgaggacgaggacgaggcttggcggcagcgcaggaagcaaagcagctctgaaattagccttgccgttgagcgcgcgaggaggcggcgggaagaggaagaacgaaggatgcaggaggaacggcgggccgcatgcgctgaaaagctgaaaagactggacgaaaagttcggggcaccagacaagagactcaaagccgagcctgctgcaccccccgcagccccatctaccccagcaccccctcctgccgtccccaaggaacttcccgcgccaccagcaccaccccccgcctccgccccaacccccgaaacagaacccgaggagcctgcccaggccccacccgctcagtccaccccaaccccaggtgtggcggcagctcccaccctcgttagcggcgggggctctacaagttccacatcttccggaagcttcgaggccagcccggtcgagccccaactccccagtaaggagggaccagagccgcccgaagaagtgccccctccaacaactcccccggtgcccaaagtcgaacccaagggagacggaatcggacccacccgccagcctccgtcgcagggcctggggtacccaaagtaccagaaaagtctacctccccggttccagcgccaacaacaggagcagctgctgaaacagcagcagcagcaccagtggcaacaacaccagcagggctcagcccctcccacacctgtccccccctcacccccgcagcctgtcacccttggggccgtcccagcccctcaagcgcctcctcctcccccaaaggcactctatcccggagccctgggaagaccgccacctatgcctccgatgaattttgatcctcgatggatgatgataccaccatacgtggaccctcgtttactccagggccgtccgcccttagatttttacccaccaggagtgcacccatccggtcttgtgccgagagagcggagcgattccggcggatctagctccgagcctttcgatcgacacgccccggcaatgctgcgggaaagaggcacaccacccgtcgacccgaaactcgcctgggtcggagatgtgtttacggctaccccagccgagccacggcccctgacgtcccctctgagacaggcagccgatgaagacgataaggggatgaggagcgagactccaccggtccccccgccccctccttacctggcttcctatcccggtttcccagagaacggcgcgccgggcccccccatctctaggttccctctggaggaaccaggccccaggcccctcccttggcctccaggcagcgatgaggtagccaagattcagactcctcccccgaagaaagagcctccaaaagaggagacagctcaactgactgggcccgaggcggggcgaaagcctgcacggggtgtggggtccggaggtcaggggccccccccaccacggagagaatctcggacagaaacgcgctggggtcctagacccgggtcaagcagacgcggcattccccctgaggaacccggtgccccaccacgccgtgctggcccaatcaagaagccaccaccacctacgaaagtggaggaactaccaccaaagccactggaacagggggacgaaaccccgaagccccccaagcccgatcctctgaaaataacgaaggggaagctgggtgggcctaaagaaacacccccgaacggaaatctctcgcctgcaccaagactgcggcgcgattactcttatgaacgggtaggcccaacaagctgccgcggtcgggggcgcggggagtactttgcgagaggccggggcttcaggggtacctatggcggccgtggccgtggcgcaagatcacgcgagtttcggagctatcgcgaattcagaggagacgacggccgcggcggcggaaccggagggcctaaccacccacctgcgccaagggggagaactgcctccgagacgaggagcgaagggtcggaatacgaagagatccctaagcggaggcgccagcggggcagtgaaactggatccgaaacacacgaaagtgatctggccccttccgacaaggaggctccgacccctaaggagggcaccttgacacaggtaccgttggcgcccccccctcctggcgctccaccgtcccccgcgcccgcccgcttcaccgcacgtggaggccgcgtttttaccccccgaggagtaccctccaggagaggaagggggggcggacgacctcctccccaggtgtgtcctggttggtcccctcccgccaaaagtcttgcgcctaagaaaccacccacaggtccactgcccccatctaaggagccactgaaagaaaaacttatccccggtccccttagcccggttgcccgcggtggatctaacggcgggtccaacgtggggatggaggatggagaacgaccgaggaggcgtagacatggccgtgcccagcagcaagacaaaccaccaaggttcagacgcctgaaacaggagcgagagaacgccgctaggggaagtgaagggaaaccttccttgacactgcctgcctctgcgcccgggcctgaggaggccttgacaaccgtcaccgtggcacctgctccaaggagagcggcagccaagagccctgatttatccaatcaaaattcagaccaagccaatgaggagtgggagaccgcctccgagtccagcgactttacgagcgagcgacgcggggataaagaagcccccccaccagtcttactgacccccaaagcagtcggaacccctgggggggggggtggaggcgcagtgcctggcatttcggctatgagtcgtggtgatctctcccagcgcgctaaggacttgagtaagaggagtttttcatcccagcgacctggaatggagaggcaaaaccgtcgacctggacctggaggaaaggctggttcaagtggatcatcatctggcggaggcgggggcggacctggagggcgaaccggtccgggacggggggacaagagatcttggccgtcgcctaaaaaccggtcgcgtcctcccgaagaacggcctccaggtctcccactgccccctccacctccgtcctcttcggccgtttttaggcttgatcaggtcatccactcgaatcccgccgggattcagcaggccctggcccagctgagcagcaggcagggttctgtgacggctcccggagggcacccaaggcataagcccgggctcccacaggcaccacaagggccatccccaaggccgcctactaggtatgagcctcagcgcgtgaatagcggtttatcctctgacccccatttcgaagagccaggacctatggttcgaggggttggtggcactcctagggactcagctggggtgagcccctttccaccaaagagacgtgagaggccaccacggaaacccgagctattgcaggaggagtctctaccccccccccattccagtgggttccttggctcaaagccagagggccccgggccccaagctgagtcccgggacacaggcaccgaggctctgactccgcacatatggaacagattgcataccgccaccagccgtaaatcttaccgcccgagcagcatggaaccttggatggagccgctctccccctttgaggatgttgccggcaccgaaatgagccagtcggattctggagtggatctctctggagacagtcaggtgagtagcgggccttgctcacagagaagctccccggatggcgggttgaaaggtgccgcagaaggccctcccaagcgccctgggggaagcagtcccctgaatgcggtcccctgtgaaggaccccctggcagcgaacctccgcggaggccgcccccagcgccccacgacggtgatcggaaggagttgcctagagagcagcctcttcccccggggcccattggcaccgagcgatcccagaggaccgaccgaggaactgagccgggtcctatcagaccttctcataggcccggtcctcccgtacaattcggtacatccgacaaagactccgatctgcgactcgtggtgggcgattccctgaaggccgagaaggaactgactgcctccgtgacagaggctataccagtctctcgagattgggaacttctgccctccgctgctgcttccgcagagccacagtccaagaatctggattcaggacactgcgtccccgaaccctcctccagcggccagaggttgtatcccgaggttttttacgggtccgctgggccgtcctcctcccaaatctcgggcggtgccatggactcacagctgcatccaaatagtgggggctttcgccccggcacacctagcttacacccctaccggagccagccattgtatctgccacccggccccgcgcccccctccgcattgctgagcggggtggctctcaaaggccagttcctggatttcagtaccatgcaggccaccgagctcgggaagctgcccgctgggggcgtgctttatccaccaccaagctttctgtacagccccgccttctgcccaagccccttacctgacacctcgctgctgcaggtccgtcaggacctcccatcgccaagcgacttttacagtacacctctgcagcctggcggtcagagcggttttctgcctagcggggctcccgctcagcagatgcttctgccaatggtggatagtcagctgccagtagtgaattttgggtcactccctcctgcacccccgccagcgcccccgccactctcattattgccagtcggcccagcactgcagccaccttcactcgcagtgaggccccctcccgcacccgcaacgcgcgtgctcccatctcccgcccgtccatttcccgcctccctgggacgagcagagcttcatccagtggaacttaagcccttccaggactaccaaaagttgtccagtaatctaggtggaccagggagctctagaacacctccaacgggccgatcatttagcggcctgaactctagactgaaggccaccccaagtacttatagcggcgtatttcgaacccagcgggttgatttataccagcaagcctcacccccagacgcattgagatggatcccgaagccctgggaacggactggtccacccccgcgtgagggtccaagccgacgcgctgaggaacctggaagccgcggagacaaggaacccggtttgcccccccccaggtag

SEQ ID NO: 200830 - DNA, 6474 bp, Artificial Sequence
  Description of Artificial Sequence: Synthetic coding sequence
atgagcgaccggagcggccccaccgccaagggcaaggacggcaagaagtattcatccctgaatctgtttgatacatacaaagggaagtctcttgaaattcagaagcccgccgtcgcccctcgtcatgggctgcagtccctgggcaaggtggctatcgctcggcgcatgcccccccctgccaatcttccatcattaaaggcagaaaataaaggtaacgatcccaacgtgtctctggtcccgaaagacggcacggggtgggcttccaagcaggagcagagtgaccccaagagcagcgacgcgagcacagcacaacctttagagagccagcctctacctgcttcccagacccctgcctcgaaccagcccaagagaccccccgcagcacccgaaaacaccccgctggtaccctctggggtcaagtcttgggcccaggcatccgtgacccatggagctcacggcgatggcgggagagcctcttccttactgagtcgcttcagcagggaggagttccctacacttcaggcagccggggatcaggacaaagcggcaaaggaacgggagtccgcagaacagtcatccggcccaggacctagcctgcggcctcagaactccactacctggcgggacggcggagggcgcggacctgatgaactcgaaggccccgacagcaagcttcaccatgggcatgatcctagaggcggcctgcagccttctgggccaccacagtttccaccttatcggggtatgatgcctccctttatgtaccctccctacttgccatttccacccccttacgggccacagggaccttatcgctatccaacccctgacgggccctcaaggttcccccgcgtggccggacctcggggttcaggccctccaatgcggctggtggagcctgtcggtcggccatccatcctgaaggaagacaatctgaaggaatttgatcagctcgatcaggaaaatgacgatgggtgggcaggcgcccacgaggaggtggactatactgagaaactaaagttcagtgacgaggaagatggtcgggattcagacgaagaaggtgccgaggggcaccgagacagtcagtcggctagcggggaagagaggccaccggaagccgacgggaagaaaggtaactcccccaacagcgaacccccgactcctaaaactgcttgggctgaaacatcccgcccccccgaaacggagcccggccctccagccccaaaaccacctctgccgcctcctcaccggggccctgccgggaattggggaccaccgggggattatcctgacagagggggccccccctgcaagccgcccgccccggaggatgaagatgaggcttggcggcaacggagaaaacagtcatcttccgagatcagcttggcggtggagcgtgccaggcgaagacgggaggaggaggaacggaggatgcaagaggagaggagggccgcttgtgcggagaagctcaagaggctcgatgaaaaattcggggctccagataagcggttgaaggccgagcccgccgccccccccgccgccccttcaactccagctccacccccagcggtgcctaaggaacttcccgccccgccagcccccccgcctgcttcagcgcctacaccggagaaggaacctgaggagcccgctcaggcccctcccgcacaatctacacccacacccggcgtggctgctgccccaaccctggtgtccgggggaggcagtaccagcagcacctcttccggctcattcgaggcaagccctgtagagcctcaactcccctcaaaggagggtcctgagcctcccgaggaggttcctcctcccactacgccaccagtcccaaaggtggagccaaaaggggacggcattgggcctactcgccagccccctagtcaaggcctggggtaccccaagtaccagaagagcttgccgcccaggttccagagacagcagcaagagcagctcctgaagcagcagcagcagcaccaatggcagcagcatcagcagggctccgcgccacctactcctgtcccgccaagccctccccaacctgttactctcggcgctgtgcccgccccccaggcaccaccaccccctccgaaagccctctacccaggcgcactgggtcggccacccccaatgccccctatgaactttgatcctaggtggatgatgatccctccttacgttgatccgaggttgctccaggggcgccccccccttgatttctacccccccggcgtgcatccaagtgggctggtgccacgcgagcggagcgactcaggaggctcatcgtcggaaccctttgatcggcatgctcccgcaatgctccgggagagaggcactcctcccgtggatccgaagctggcctgggttggcgatgtgttcactgccactccagccgagccacgacccctcacatcgcctcttcgccaggctgcagacgaagatgacaaaggcatgcgtagtgaaaccccgccggttccccctccacctccttacttagccagttacccggggttcccggaaaatggcgcccctgggcccccaattagccggtttcctctggaagaaccaggtccacggcctttaccctggccacccggaagcgacgaggtggcaaagatccagacaccccccccaaaaaaagaaccccccaaagaagagacagctcagttaactggaccagaagccggcaggaaacccgctcgtggtgtcggctctggaggccaagggccaccgcccccacggcgggaaagccgaaccgagacccggtgggggccccgccccggtagttctcggcgcggcatcccaccggaggagccgggcgcaccgccgaggagagctggcccaatcaagaaacccccacctccaacaaaggtggaagaactacccccgaagccactggaacagggcgatgagacgcccaagccacctaagccagacccattgaagataaccaaaggcaagctgggagggcccaaggagacacctcccaatgggaacctgtcgcccgctccgaggctgagacgcgattacagctacgagagggtgggacccacatcctgtcgcggaagaggaagaggagagtacttcgcgagaggccgagggttcagaggcacctatgggggaaggggacgcggagcaaggtcaagagagttcagatcatacagggaatttcgcggcgatgatggtcggggaggtggtactggaggcccgaaccacccacctgcaccaagaggaagaaccgcatctgagacccgctccgagggctctgagtatgaggaaatccctaagagacggcgccagaggggaagcgagacaggttcagaaactcatgaatccgacctcgctccctctgataaggaagctcctacacctaaggagggaaccctgacacaggtgccgcttgcgcctccaccccctggagccccaccctcacctgccccagcccgttttacagcacgaggcggacgcgtgttcacacccaggggtgttccgagtaggagaggtagaggcggcggcaggccgccgccacaagtctgccctggctggtctccccctgccaagtctcttgctcctaaaaagccacccacgggcccactgccaccttctaaagagccacttaaggaaaaactgattccaggcccgcttagtccggttgcgaggggtggtagcaatggaggctccaacgtgggcatggaggacggcgagaggccacgcaggaggcggcacggccgcgcccagcaacaggacaaaccaccaagattcaggagactaaaacaggagcgcgaaaatgctgcacgaggatcggagggaaagcccagtctaacccttcccgcctctgctcctggaccagaggaagccctgaccaccgtgaccgtggctcctgcccccaggagggctgcagctaagagccccgacttgagcaatcagaattctgatcaggccaacgaggagtgggagactgcctctgagagctccgattttacgtccgagcgccgtggagacaaagaggcacctccgccagtactgctgactcccaaagcggttggtacgcccgggggcggaggcggcggggctgtgccgggaattagtgcaatgtctagaggagacttatcacagcgagccaaggacctgtccaaaagatcctttagctctcaacgtcctgggatggagcgacagaacagacgccctgggccaggtggaaaggcaggatcgtccggtagtagttccggcgggggcggcggcggccctggagggaggaccggaccggggcggggagacaagagatcctggccctcacccaaaaatcgctcccgacccccagaggaacgaccccccggtttaccccttccacctccaccgccttcttcttccgccgtattccggcttgaccaggtaatccatagcaacccagcgggcattcagcaagctctcgctcagctcagcagtcggcagggcagtgtgacagctccaggcggacatcccagacacaagcccggccccccccaggccccccaaggcccaagcccgaggccaccgactcgctacgagcctcagcgcgtgaattcagggctgagttctgatccccatttcgaggaacctggccctatggtgaggggggtgggagggacccctagagattcagccggtgtatcaccttttccaccgaaacgccgggaacgtccacctagaaagcccgaactgctgcaggaggagagtctgcctcctcctcattccagcggattccttggatcaaaacccgaaggccccggcccgcaagctgaaagtcgggatactggaaccgaggcacttacccctcatatctggaatagactccacacagctacgagcagaaaatcatatagaccctcgagcatggagccgtggatggaacctctgtcaccttttgaagacgtcgccgggacagaaatgtcacagtccgactctggggtagacctcagcggggactctcaggtgagttctggaccttgttcacagaggtccagcccagatgggggcctaaagggtgcggctgaagggcctcctaagcgccccggtggttctagtccactcaacgcagtcccctgcgaaggcccacctggatcggaaccccccagacggcctccgcctgctccccacgacggagatagaaaggagttaccgcgcgagcagcctctgcctcctggacctattggtacagagcgttctcagaggacggatcgtggtacagagcctggtcccattcgaccctctcatagaccagggccgccagtccagttcgggaccagtgacaaagacagcgatttgagattagttgtcggagattcacttaaagccgaaaaagaacttaccgcaagtgtcaccgaggctatccctgtgtctcgcgactgggaacttctgccttccgccgcagcaagcgcagagccgcagtctaagaacttggacagcggccattgcgtgcctgagccctcaagcagtggacagcgcttgtacccagaagttttctacggtagcgccggtccttcgagctcccaaatctccggcggtgccatggattctcaactgcatcccaactccggcggtttcagacccggcacacccagcctgcatccctaccgtagccagccactatacctccctccagggccagctcctccaagtgccctcctatctggtgtagccctgaagggccaatttctggattttagtactatgcaggctactgagcttggtaaacttcccgccggaggggtgctctacccccctccaagcttcctgtattctccagcattctgtccctctcccctgccagacactagtttgctgcaagtcagacaggatctgccatccccctcggacttctattccacgcctctccagccaggtggccagtcgggctttttaccgtctggagcaccggcacagcaaatgctactcccaatggttgatagtcagttaccggttgtgaactttggttccttgccacccgcgccacctccggcaccgccgcccttgagccttctccccgtgggtccagcgctccaacccccatctttagccgtgagaccacctccagcccccgcaactagagtactgccttcccccgcccgtccctttcctgcatccttgggccgggccgagctacaccctgtggaactgaagcctttccaggactatcagaagctgagctcaaatcttgggggacctggaagctcaaggacgccacccaccggcagaagcttcagcggcctgaactctcgactaaaggcgactccctccacctattctggcgtgttcagaacccagagggtcgacctataccaacaggccagtccacccgacgcccttagatggattccaaagccttgggagcgcaccgggcctcccccaagagaaggaccatcacgtcgagccgaggaaccaggctcgagaggtgacaaagaacccggcctaccaccgcctagatag

SEQ ID NO: 200831 - DNA, 6474 bp, Artificial Sequence
  Description of Artificial Sequence: Synthetic coding sequence
atgagcgaccggagcggccccaccgccaagggcaaggacggcaagaaatattctagtttgaatctgtttgatacatacaaaggcaaaagtctcgaaatccagaaacccgctgtggctcctcggcatggtctccagtctctcggcaaagtagccatcgctaggcggatgccaccaccagcaaacctgccctctcttaaggccgaaaataagggcaacgaccccaatgtcagtctggtccctaaagacggaactggttgggcctcaaagcaggaacagtcagaccccaaaagttctgacgctagcactgcccaaccacccgagtcccagccactgcccgctagtcaaactccagccagcaaccaaccaaagcgcccgcccgccgctccggagaacaccccactcgtcccgtctggcgttaagtcctgggctcaggcgtcagtcacacacggcgcccatggagacggaggtagagcttcatctctgctcagtaggttttctcgcgaagagtttcctaccctccaagccgcaggcgaccaggataaggccgccaaagaaagggagtcagccgagcagtcctccggccctggacccagcctgaggccacaaaacagtaccacatggagagatgggggcggtagggggcccgacgagctagagggccctgactctaagctgcaccatggccacgacccacgaggagggctgcaaccatcaggacctcctcagtttcctccctatcgcggaatgatgccgccttttatgtaccctccatatctacctttcccgccaccctatggcccccagggaccgtaccgctatcccacacccgatggaccaagccgttttccccgggtggccggacctcggggctctggtccgccaatgcgtctggttgagccagtgggccggccctctattctgaaggaggataatttgaaagaatttgaccagctggaccaggagaatgacgacggctgggccggggctcatgaagaggtagattatactgagaaattgaagttttcggatgaggaggatggacgggattccgatgaggagggagctgagggccatcgagatagccagtcagcctctggtgaggaaagacctccggaagccgatggaaaaaagggtaactctccaaacagtgaacccccaacaccaaaaaccgcctgggcagagacctctcgcccaccggaaactgaacccgggcctcccgctcccaagccacccctccctccaccacatcgaggccccgcaggaaattgggggccgcctggagattaccctgacagaggaggaccaccttgcaagcctcctgcccccgaagacgaagacgaggcctggagacagagacgaaaacaatcaagttccgaaatcagtttggcagttgagagggcccggcggcgacgggaggaagaagaaaggcgtatgcaggaagaaaggagggccgcatgcgctgaaaagctgaagagattggatgaaaaattcggtgctcccgacaaaagactcaaagcggagcccgctgcccctcccgctgctccctcaacccccgcccccccccctgccgtgcccaaagagctgccggccccccccgcaccaccacccgcgtccgcacctacgccggagaaagagccagaagaacccgctcaagcgccacctgcccaatcgactcctacccccggggtggctgccgctcctaccctcgtgtctggcggaggatcaacctccagtacttcgtctggatccttcgaagcttctcctgttgagccccagctgccctccaaagagggccctgagcctcctgaggaagtgccaccccccaccaccccgcccgtgccaaaggtggagccaaaaggggatggcattggacctacacggcagcccccatcgcagggtctgggataccccaaataccagaagtccctgcctcctagattccagcgccagcagcaggagcaactgctgaaacaacagcagcaacatcaatggcagcagcaccagcagggtagcgccccgcctacccctgtgccccctagtcccccccagccagtgaccttaggtgccgtgcctgcaccacaggcacctccgccccctccaaaggctctttacccaggggcccttggacgtcctccacccatgccccctatgaattttgacccgcggtggatgatgattccaccttacgttgaccctcgtctgctgcaaggccgccccccattagatttttatccaccaggcgtgcatccctctggattggtgccaagagaacggtctgactctggtggctcttcatcagagccctttgatcgccatgcccccgcaatgttgcgcgaacgaggaacgccccctgtggatccaaagcttgcatgggtcggtgacgtatttaccgctacacccgcagaaccgaggcccttgacatcacctctgaggcaggctgctgatgaggacgataagggaatgcgttccgagactcccccagtgccacctccaccgccctatctcgcatcataccccggtttcccagaaaacggcgcccctggcccaccaatttctcgctttcctttagaggagccaggccctaggcccctgccctggcctccggggtccgacgaagtggccaagatccagacaccgcccccgaaaaaggagcccccaaaagaggagacagctcagctcaccggcccagaagccgggcgtaaaccagcgaggggagtgggttccggggggcaggggcctccgccaccccgccgagagagccggaccgagacacgctggggaccccgtccaggcagttcgcgtcggggaattcctcccgaggaaccgggagctcctcctcggagagccgggccaataaaaaagccgcctccaccgactaaggtcgaggagttgccccctaagccccttgagcagggagacgagactcctaagcctccaaaaccagacccattgaagatcacaaaaggcaaactgggcggtcctaaggagacccctcctaacggcaatctctcccctgcgccacgcctaaggagagactactcatacgagagggtggggccgacctcctgccgcggacgtggccgcggcgaatatttcgcccgcgggcgcgggttccgaggcacctacggtgggaggggtcgaggagctcggtcccgcgagtttagatcttatcgcgaattccggggcgacgacgggcgaggcggcggtaccggcggtcctaaccatcctccagccccaaggggtaggaccgcttccgagaccagatccgagggatccgagtatgaggagatacccaaaagacgccgacagagaggaagcgaaacaggctctgaaacacacgaaagcgatctcgcgccgtccgacaaggaggccccaacgcccaaagaaggcacgctgactcaagtcccccttgctcccccacccccaggcgccccaccttctcccgctccggcacgctttacagcccgaggcggtagggtctttacgccgagaggggttccatccaggcgcggccgaggcgggggtaggccacccccacaggtgtgtccaggctggtcgcccccagccaaatccctcgctcccaagaagccccctaccgggcctttgccgcccagtaaggagcccctgaaagagaaactgattcccggcccattgagtcccgtcgcgcgcggtgggagcaacggagggtccaatgtcggaatggaggacggtgagaggccccggcgtagacgtcatggccgtgctcagcaacaagacaagcctcctagattcagacgcctcaagcaggagcgtgagaatgccgccaggggctctgagggcaagccttcccttacactccctgcctcagcgcctggtcccgaggaggcgcttactacggtgaccgtcgctcccgccccccgtagggctgcggccaaaagtcctgatctctcgaaccagaacagcgaccaggctaacgaggaatgggaaacagcaagcgaaagcagcgacttcacttccgagcgcagaggagacaaggaggcaccaccgccagtgctcctgactcccaaggcagtcggaacacccggaggcggagggggaggtgccgttcccggaatcagcgctatgtctaggggcgaccttagtcagcgtgccaaggatctttcaaagcgttccttctcttcccagaggccaggaatggaacgtcagaatcgcagacctggaccaggggggaaggccgggtcgtctggttccagttcaggcggcggtggtggcggccccggtggccggactggtcctgggcgaggagataagcgcagctggccatctccgaaaaaccggagcagaccccccgaagaaaggccgcctggcctgcccctccctccgccacctccaagctcatcggccgtgttcagactggatcaagtgatccacagcaaccccgcgggcatccagcaggcacttgctcagctaagcagcaggcagggttcagtaacagcgccagggggtcatccgcgccataagccagggcctccgcaggctccccagggtccaagcccacggccgcctacccgatatgagccgcagagggtgaatagtggcctcagcagcgacccccattttgaggagccaggacctatggttaggggagtggggggaactccaagagattctgccggggtatctccctttcccccgaaaaggcgcgagaggccaccgaggaaaccggagcttctccaggaagaatcactgcctcccccccattcatccggttttctcggctctaagccggaagggccaggtccacaggcggaatcccgcgatactggaaccgaggccctcacaccccatatttggaaccggttacacactgcgacctctagaaagtcctaccgaccatcctccatggaaccctggatggaaccgctgtcccctttcgaagatgtggcagggaccgaaatgagtcagtctgactccggggtagacctttcgggagacagtcaggtgtcatctggtccttgctctcaacgtagttcacccgacggtggactcaagggggccgcagaaggcccccccaaacgacccggagggtccagccctttgaacgctgtcccatgtgaaggcccacccggttccgagccccccagaagacctcctccagcccctcacgacggggaccgcaaagagctcccccgggaacagcctctccccccaggcccaattgggacagagagatcccagcatacagatcgcggaaccgagccgggacccatcagaccatcccatcggcctgggcccccggttcagtttgggacctccgataaagattctgacctccggttggtagtcggcgacagcctgaaggccgaaaaggagctcacggcttctgtgaccgaagccataccagtctcacgagattgggaactcctcccatctgcggctgcctctgcagagccccagagcaaaaatctcgatagcggccactgtgtccctgaaccaagttcaagcgggcagcggttgtacccagaggtgttctatggatcagccggcccctcaagcagccaaatcagtggtggggcaatggactctcagttacaccccaattcgggcggcttccggccagggactccaagtctccatccttaccggtcccagcccctgtatcttccccctggacctgctcctcctagcgcattgttatccggtgtggctctgaaaggccaatttttggattttagtacgatgcaggctacagaactgggaaagcttcccgctggtggtgttctgtatccgccaccatccttcctctacagtcctgctttttgtccgtctccattgcccgacacttcattgctgcaagtgcgacaagacctgccctcaccttcagatttttactcaactccccttcagcctgggggacaatcagggttcctgccctctggcgcacccgcccagcaaatgctcctgcctatggtcgacagtcaactgccggtggtaaattttggtagcctgcctccagccccaccccctgccccaccctccctgagtctgctgcccgttggtccagcactgcagcctccatctctggcagttcgtccacctccagctccggctacccgcgtgcttccctctccggcaagaccttttccagcctccttaggcagagcagaacttcatcccgtggagctgaaaccatttcaggactatcagaaattaagctccaacttgggtggcccaggcagtagcagaacaccacccaccggccggtcttttagcggactcaactccagactgaaggcaactcccagcacctactctggtgtgttccggacacagcgcgtcgatttatatcagcaggcttcaccacccgacgccttacggtggatacctaagccctgggaacgcacaggacctcccccgcgtgagggccctagccgccgggccgaagaacctgggagtcgtggcgacaaggagccaggccttcccccaccaaggtag

SEQ ID NO: 200832 - DNA, 6450 bp, Artificial Sequence
  Description of Artificial Sequence: Synthetic coding sequence
atgagcgaccggagcggccccaccgccaagggcaaggacggcaagaaatatagtagccttaacctgttcgacacctataaaggtaagtcactcgaaatccagaaacctgccgttgcaccaaggcacgggctgcagtcactggggaaagttgctatcgcgagaaggatgccaccgcctgcaaaccttccttcccttaaagccgaaaacaaaggcaatgatcctaatgtctcgctggtccctaaggacggtacagggtgggccagtaaacaagaacagtctgaccccaaaagctctgacgccagtaccgcccaacctcctgaatcccagcccctcccagcctcccaaactccagcctccaaccaaccaaagagacccccagcagcaccagaaaatacgcctctcgtgccatcaggagttaagagttgggcccaggctagcgtgacacacggcgcccatggtgacggtggtcgagccagttctctcctcagtaggtttagcagagaagagtttcccactttgcaggcggccggggatcaggataaggcggctaaggagcgcgagagcgccgagcagtcgtccgggcctggcccaagcctgaggccacagaatagcaccacttggcgggatggcggaggtagaggccctgatgaactcgaagggccggactctaagctgcaccatggccacgacccgagaggtggcctacagccaagcggtccccctcagtttcccccatataggggaatgatgccgccttttatgtacccaccatatcttccattccctcctccatatgggcctcaagggccgtaccgctacccaactcctgacggaccatctagatttcccagagtcgccgggccacgtggctctggtcctcccatgaggcttgtggagccagtagggcggccctctattctaaaggaagacaatcttaaggagttcgaccagttagatcaggagaatgatgacgggtgggcaggtgctcacgaggaagtagattacaccgagaaactgaaattttctgatgaggaggacggtcgtgactctgacgaggaaggcgctgaagggcatcgggattcacagtccgcgtccggggaggaaagacctcctgaggctgacgggaagaaaggaaattctcccaacagcgagcccccgaccccgaaaaccgcttgggctgaaacaagtcgccccccagagaccgagccaggacccccggcccccaagccgccgcttcctcctccccatcggggtccagccgggaattggggccctcctggagattatccggaccgtggagggcccccctgcaaaccccccgccccggaggacgaggatgaggcatggcgccaaagaaggaagcagtccagctccgaaatttccctggcagtggagagagcacgccgaagaagggaggaagaggagcggcgaatgcaggaggagcgcagagcagcatgcgcagagaagctcaagagactcgacgaaaaattcggtgcgcccgacaagaggctgaaagcagaacccgctgcacctcccgccgcccccagtacacccgctccgcccccagcggtgccaaaagagctgcctgccccacctgccccaccccccgcctccgctcccacacccgaaacagagcccgaagagcccgcacaggcgcctcctgctcagagtacccctaccccaggcgtggcggcagctccgacccttgtgagcggaggaggctccacctcctctaccagctctggatcatttgaggcctcacccgtggaaccccaattaccatccaaagaggggcccgagccaccagaggaggtgccacctcctacaactccccctgttcctaaggttgaacccaaaggcgacggcatcggaccaaccagacagcctcccagccagggcttgggttatccgaaataccagaagagcctgcctcctcggtttcaacgacaacaacaggaacagttgctcaaacagcagcagcagcatcagtggcaacagcaccagcaggggtctgcaccccctacccctgtgccaccctcgcctccacagccggtgactctgggagctgtaccggctccacaagctccccccccgccaccaaaagcactctaccccggtgccctgggcagacccccccccatgcccccaatgaacttcgacccccgttggatgatgatacccccgtacgttgatccccgcctccttcaaggtaggccccccctggatttttatcctccgggcgtccacccttccggactggtaccacgtgaacgctccgacagcggagggtcatcaagcgaaccttttgacaggcacgcccctgcgatgttacgtgagcgcggcactccacccgtggaccctaagctcgcgtgggttggcgacgtgttcactgcaactcccgccgagccccgaccattaacatctcccctaagacaggccgcggatgaagacgacaaaggcatgcgcagtgagacaccccccgtccctccacctcccccctatctggcttcctacccgggcttcccagagaacggcgccccaggcccacccatcagtagattccccttggaagaacccggtcctaggcctctcccttggccaccgggttccgacgaagtcgccaaaatccaaacccctcccccaaaaaaggaaccccccaaggaagaaaccgctcaactcacagggcccgaagccggtaggaagcccgcacgcggtgtgggctctggcggtcagggaccccctcccccgcggagggagagcagaacagagactagatggggtcccaggcctgggagttcacgtcgcggaatcccccccgaggaaccaggagctccgcccagacgggcaggccccattaagaaacctcctccgcctaccaaagtggaagaattgcccccaaagcctctagaacagggagacgagacgcccaaaccccctaagccggatccgctaaagattacaaagggaaagttgggcgggcctaaagagacccccccgaacgggaacctgagccccgccccacgccttagacgcgactattcgtacgagcgcgttggacccacatcctgtcgggggcggggccgaggcgagtatttcgccaggggaagaggcttccgcggtacctatggaggacggggacgtggcgcggccggaaacagcgcggtgactgagagctttgaagaaatgatgggtgtagaggtgggccagggtgatcagacaacccttctgctgccggaggctgccttgccagcgagacacggagcaagagtgcagagtatgaggaagtccccttccggcgcaggaagcggagcccaaaaacaggctgcacgaccaatgcgggtgatttggttgttgcagacccgcagactgccccatcctcgtagggagcatagcccgaggtcccgcagtccgacaactagatcacccaccttcccggcaccagccaggtttactcccggcgtgggggagtcctcactgccagaaggtatcagcccaggaccaagacggagagaacctccacaggtgtgcccaggctggtcacccccggcaaagtctctggcccccaaaaagcctccaaccggacctcttccgccttctaaagaaccactgaaagaaaaactgattcccggcccattatcccccgtagctcgtggcggctctaacggagggtcgaatgtcggcatggaggatggcgaacggccccgcagacgccggcacgggagggcccagcagcaggacaagccccctaggttcagacgactaaaacaggaaagggagaacgccgctaggggatcagaaggaaaaccatccctgaccctccctgcgtccgcacctggccccgaagaggcactcacaacagtgacggtggcccccgcacccaggcgtgcagcagctaagagcccagacctgagtaatcaaaattccgatcaggctaatgaggagtgggagacggcaagcgaatcatctgattttacttcagagcgtaggggggacaaggaggcgccccccccagtcttactcacccccaaggcagtggggactcctggcggcggaggcggcggagccgtgccaggcatcagcgcaatgtcaagaggagacctgagccagagagccaaggatttaagtaaaagatcttttagcagccagcgccctgggatggagagacagaaccgccgcccaggaccgggagggaaggccgggagcagcggctcgtcatctggagggggcggtggggggcccgggggtcgtacaggaccgggacgcggcgataaaagatcgtggccctctccaaaaaaccgatccaggcctcccgaagagcgaccgccaggcctcccgctccctccaccacctcccagtagttctgccgtgttccgactcgaccaggttatccacagcaaccctgctggcattcaacaggccttggctcagctctcatcgcggcagggatctgtgaccgctcccggcggacacccaagacacaaaccaggcctgcctcaggcaccgcaaggccccagccccaggccgcccacgagatacgaaccccaaagagtgaacagcggcctgagtagcgacccgcactttgaagaacctgggcctatggttcgcggtgtcggcggcacaccaagagatagtgccggcgtgagtccctttccccccaaaaggagagaacggccccccagaaagccagaattgctccaagaggagagtctgcctccaccacactcatctggattccttggctccaagcccgagggtcccgggccacaggctgagtctcgcgatactggcacagaggcattaacccctcatatatggaatcgacttcataccgctacatccagaaaatcttatcgcccttcctctatggagccttggatggagcctctatcccccttcgaggacgtagctggcacagaaatgagccagtctgactcgggggtagatctctctggcgactcccaggtcagcagcggcccttgttcccagcgcagtagccctgacggaggtctgaagggtgccgccgaggggccccccaaaagacctggtggatcttcacctttgaatgccgtcccttgtgaaggccccccaggcagcgagcccccaaggcgtcccccccctgcaccacacgatggtgaccgaaaggagctgccgcgggagcagcccctgccccccggtcctattggtacagaaagatcccagcgcacagatcgcgggacggagcccggacccatccgccccagtcataggcccggccccccagtgcagtttggaactagtgataaggacagtgacctacggttggtcgtaggtgactccctaaaggccgagaaagagctgaccgcaagcgtcaccgaggcgatccccgtgtctcgcgattgggagctactcccatccgctgccgccagtgccgagccacagtctaagaacctggactcaggccactgcgtgccagaaccttcgtcgagcggacagagactctatcccgaggtgttctatggctctgcagggccaagtagttcacagattagtgggggacacggcctgtccattaccagtaaacaatggcgtaggcccgggactccaagcctgcacccgtatcggtcgcagcccctttacttacctcctgggcccgcgcctcccagtgcgctgctgtcgggcctagctctcaaaggccagttcttagatttctctaccatgcaagctaccgagcttggaaagctccctgccggaggcgtcttgtatccccctccctctttcctctactcccccgccttttgtccctctccactgcctgatacctccctacttcaggtgcggcaggacctgccaagcccgtccgatttctacagcactccattgcagccggggggtcagtctggatttttgcctagtggagcccccgcccagcagatgttactccccatggtggactcccagttaccggtagttaacttcggaagccttccacctgcacctccccctgcaccacctccgctttctcttctcccagtcgggcccgcactgcagcccccttctttagcggtccgacccccacctgcccccgcgaccagggtgttgccgagccctgcgcggcctttccctgcgagtctgggcagggcggaattgcacccggtggaactcaaacctttccaggattatcagaaactgtccagcaacctgggcggacctgggagtagccggaccccacctacaggacggtccttctccggcttgaactctcgtcttaaagctaccccgagtacttacagcggggttttccgcacccagagggtggacctgtatcagcaggcaagtccgcccgacgctcttaggtggatccccaaaccctgggaacgtaccggtcccccccccagagagggcccaagcaggcgcgccgaggaacctggttccagaggggacaaggagcccggcctcccccccccccggtag

SEQ ID NO: 200833 - DNA, 6474 bp, Artificial Sequence
  Description of Artificial Sequence: Synthetic coding sequence
atgagcgaccggagcggccccaccgccaagggcaaggacggcaagaagtactcaagtttaaatctattcgatacgtacaaggggaagagtttggagatccaaaaaccagctgtggcacctcggcacgggctgcagtctctggggaaagtggctattgcacgccggatgcctccgcctgctaacctgcctagcttgaaggccgagaataaggggaatgacccaaatgtgagcctggtaccgaaggatgggaccggctgggcgtcaaaacaggaacaaagcgatcctaagtcctcagatgctagtaccgcacaaccccctgagtcccagcctttgccagccagtcaaaccccagctagcaaccaacctaagaggccaccagccgcaccagaaaataccccactcgtcccctcgggagttaaatcctgggcgcaggcctctgtaacacatggggcgcacggagatggtggacgagcatcctcgttgctgtccaggttcagcagagaggagtttcccaccctgcaggctgcgggagaccaagataaggccgccaaagagcgggaatctgcagaacaatccagtggccccggtccatcactgcggcctcagaactctactacctggcgagatggaggcggcaggggcccagacgagctggaaggaccagacagtaaactgcaccatggacacgatccaagaggcggcctgcagccaagtggaccaccacagttccctccataccgcggaatgatgccaccctttatgtacccaccctatttaccattccctcctccttacggacctcaaggtccctaccgttatcccactcccgatggaccgtcacggttcccccgagtggccgggccgcggggcagcggaccaccaatgcgtctggtcgagccagttggcagaccgtcaatccttaaggaggacaacctgaaagagttcgatcagctggatcaggagaatgatgatggctgggcaggagcgcacgaggaagtggattacaccgaaaagctaaaattcagcgacgaggaagacggtagagatagcgacgaggagggggcggagggtcatcgggactcacaaagtgcctcaggagaggaacgacctcccgaagcggacggcaaaaagggcaatagccccaactcagagccaccgactcccaaaaccgcttgggctgaaacgagtaggcccccagaaaccgaaccaggtccgcccgcccccaagcccccactgccgcccccacatcgaggacccgccggcaattggggaccaccgggggactatcctgaccggggcggcccgccttgtaaaccaccggcccccgaagatgaggatgaggcgtggcggcagcgccggaagcaatctagtagtgaaatttccctggccgtcgaacgggccaggaggcgccgtgaggaagaggagaggcggatgcaagaggaaaggcgcgcagcctgtgccgaaaaacttaagcggctcgacgagaaattcggagcccccgataaacggttgaaagcagaaccggcagctcccccagcggctccaagcactccggccccccccccagcggttcctaaggagcttccagcacctccagccccgccgccagccagtgcccccactccagaaaaggagcccgaagagcctgcacaagcccctccggctcagagcactcccacacccggggtggcggctgctcccaccctggtgtcaggcggaggcagcacttcttccacctccagtgggagtttcgaagcatcccccgttgaaccccagctgccttctaaagagggcccggagcctccagaagaggtgcccccgcccacaacccctcccgtaccaaaggtcgaacctaagggcgacggaatcgggccgaccagacagccaccttctcaggggctgggatacccaaagtaccagaaaagcctccccccccgttttcaacgacaacaacaggagcagctactgaaacaacagcagcagcatcaatggcagcagcaccaacagggatctgcgccacctacgccagtgccccccagcccgccccagccagtcaccttgggcgcggtccccgccccacaggccccacccccgcccccgaaagccctttaccccggggctctaggtcggcctccgcccatgcctcctatgaactttgatcctagatggatgatgattcccccctacgtggatccccggctgctgcaagggcgacctcccctggacttctatccaccaggggtgcatcccagcggtctcgtgccacgcgaacggtccgacagcggtggctcctccagtgagcccttcgacagacatgccccagccatgctgagagagaggggaactccccctgtagaccctaaactcgcttgggttggcgatgtcttcactgctacacccgccgaaccgaggcctctgacaagcccccttcgacaggcagctgatgaggatgacaagggaatgcggagcgaaacaccaccagtacctccaccgcccccttacctggcttcataccctgggtttccggagaatggagcaccaggacctcctataagtcgcttccccctggaggaaccaggtcccaggcctctaccatggccgcccgggtccgatgaggttgccaagattcagaccccaccacccaagaaggagccacccaaagaggagaccgcgcaactgacagggccagaggctggcagaaagcctgctagaggtgtgggatcagggggccagggtcctcccccaccaagacgtgagtctagaacggagaccaggtggggacctcgtcccggctccagtagacgagggattccacctgaagagcctggcgcacctccccggcgcgccggccccataaagaagcccccaccccctactaaggtcgaagagctcccacccaagcccttggaacagggagacgagacacctaaacctccaaaaccggaccctctaaaaattaccaaaggcaaactgggaggcccaaaggagaccccacccaacggcaatctctcgcccgcccccaggctgagaagggattattcttacgaacgcgtgggacccacttcatgccgcgggcggggcaggggcgagtacttcgcaagaggtagaggttttcgggggacttacgggggcagaggaaggggagccagaagccgagaattccggagctatcgggaatttcgcggagatgatggtcggggcggtggcacagggggtcccaatcacccgcctgccccacgcggtagaaccgcatcagaaacccggtcagagggctctgagtatgaggaaattcccaagaggcgcagacagcggggttctgagactggctctgagactcatgaatccgatctggcgccgtccgataaggaagcacctactcctaaggagggaactcttacacaagtacctctggcccctcccccaccaggtgccccgccttcacctgcccccgccagatttaccgcccgtggcggcagagtgtttactcctaggggggtgccgtctaggcgcggacgcggaggtggaaggccacctccgcaggtctgtccgggatggagcccccctgctaagagtttggcccctaaaaaaccaccaactggcccgcttccgccatcaaaggaacctttgaaggagaagctgatccccggacccctgtccccggtggccagaggcggatccaacggcggcagtaatgtggggatggaggatggagaaaggccgaggcgaagaaggcatggccgggcacaacagcaggataaaccccctagatttcggcgcctgaagcaggaaagagagaacgctgcacgcggatccgagggcaagccatcactgacgctgccggctagcgcacccggacccgaggaagccctgactacagtaaccgtagccccagcacctcgtcgagctgccgccaaatcccctgacctgtctaatcaaaattccgatcaggcgaatgaagaatgggaaaccgccagtgagtcgtcagattttacctccgagaggcggggagataaagaagctccccccccagtgctgctcacccctaaagctgttgggacccctggcggaggaggcggcggcgctgtacccggtatctccgccatgtcaagaggagatttgtcccagcgggccaaggacctgagcaagaggtccttttcaagtcaaaggcccggaatggaacgtcagaatcgccggccaggccccggcggcaaggccggtagctctggatcttcttctggcggtggcgggggaggtcccggtggccgaactgggcccgggagaggcgacaagcggtcatggccatcccccaagaatcggagccggccgcctgaagagcggcctccaggtctacccctcccacccccccctccatcatcgagtgccgtttttcgccttgatcaggtcattcacagcaatcccgccggtatccagcaggccctcgcccaactctcatctcggcaaggctccgttactgctcccggaggtcacccaaggcacaaaccgggcccgccacaagcaccacagggccccagccccaggccaccaacccgatatgaaccccagagagttaattcaggcctcagtagtgacccgcatttcgaagaaccaggacccatggtgagaggcgttggaggcacgccgagggattccgccggcgtttccccctttcctccaaagcgtagggagcgcccaccccggaagcctgagctcctccaggaggagagcctgcctcctccacattcctcaggctttctcggaagcaagcctgagggccctggaccccaagccgaatcaagggatacaggcaccgaggccctcactccacatatttggaacaggctgcataccgcaacctctaggaagagttatcgcccttcttccatggagccctggatggagcccttatcacccttcgaggacgtggccggcacagagatgagtcagtcagactccggggtagatctgtccggggacagtcaggtttcatctgggccatgctcgcagagaagttctcctgatggaggcctgaaaggggccgccgagggtccaccgaaaagacccgggggaagctctccgctcaatgccgtgccttgtgaagggccgcccgggagcgagccgccccgtagacccccaccagcacctcacgatggcgatcggaaagagttgcccagagagcagccactgcctcccggtccgatcggaaccgaacggtctcaacataccgaccgaggcacagaacctggccccatccgcccgtcccacaggcccggcccaccggtgcagtttgggacatctgataaggattcagatctgagattggtcgttggcgatagcctgaaagcagagaaggaattaactgcatctgtgactgaggcaatcccagtgagcagggactgggagttactgccctctgcagctgcttctgccgagcctcaatctaaaaatctggacagtgggcattgcgtcccagaaccctcttcctccggacagagactctaccctgaagttttttatggctccgctggaccctcatcaagccagatttccgggggtgccatggattcccaactgcatccaaattctggcgggtttagacctggcaccccttcactccacccctaccgctctcagccactgtacctacctcctggccctgcaccccctagtgctcttctgtccggagttgccctcaaggggcagttcctggacttcagtaccatgcaggccacggagcttggtaagctccccgctggaggtgtcctttatccaccgccttctttcttgtacagtccagcattttgcccttccccacttcccgacaccagcttgcttcaggtgcggcaagacctgcctagcccatcggatttctatagcacgcctctccagcccggaggccaatctggtttcctgccgagcggagcaccagcccagcagatgttgctcccaatggtcgactcccagctgccagttgtgaattttggctcactgccgcctgctccaccacctgcacccccttccctaagtctgcttcccgttgggcctgctttacagccccctagtctcgccgttaggccgccaccagcccccgccaccagggtgcttcccagcccagccaggcccttccctgcttctctcggtagggccgaattgcatcctgtagagctgaagccctttcaagattatcaaaagctgtcaagcaatttaggtggtcccggttcaagccgcacaccacctaccggccgcagctttagcggactcaattctaggttgaaagctactccttcgacctacagtggagtgttccgcacccaaagagtcgatctgtatcaacaagcgtcccccccagatgccttgagatggatcccaaagccctgggaacgtacaggtccaccacctcgggaagggccgagtcggcgtgcagaggagcccgggtcaaggggggataaagagccaggtttgcctccgcccagatag

SEQ ID NO: 200834 - DNA, 6474 bp, Artificial Sequence
  Description of Artificial Sequence: Synthetic coding sequence
atgagcgaccggagcggccccaccgccaagggcaaggacggcaagaaatactccagcctgaatctattcgacacctataagggtaagtctctggaaatccagaagcccgccgtggcaccccgacatggacttcagtccctcggcaaagtggctatcgctagaagaatgccacccccagccaacctccccagcctgaaggccgagaataagggaaacgatcctaacgttagtctcgtgccaaaagacggcaccggatgggcatcaaagcaggaacagtctgacccaaaatcgagcgatgcctctacggcgcagccacccgagtctcagcccttgccagcatcccagacacccgcgtcaaatcagcccaagcggcctccagctgcccctgaaaatacccccctcgtgccttccggggtcaaatcctgggcccaggcttccgttacccacggcgcccacggcgatggcggacgtgcctcctccctgctgagccgtttttccagagaggaattccccaccctgcaggcagctggagaccaggacaaagccgctaaagagcgggagtcagctgagcagagcagtggacctgggccatcactcagacctcagaactccacgacctggagagacggcggaggaaggggaccagacgagctcgagggaccagatagcaagctgcatcatgggcatgatcctagagggggcttgcagccatcaggacccccccagttcccaccctatagaggaatgatgccccccttcatgtaccccccttacctgccgtttccccctccctatggcccccaagggccctataggtaccctactcccgatgggccgagtcggtttcctcgggtcgcaggtcccaggggaagtgggccccccatgcgtttagttgaacccgtcgggagacccagcattctgaaggaagataaccttaaagagtttgaccaactggatcaggagaacgacgacggctgggccggcgcccacgaagaagtcgactacacagagaagcttaaattttccgatgaagaagatggaagagattcggatgaagaaggggctgagggacaccgcgatagtcaaagtgcgagcggcgaagagcgcccgcccgaggcagatggcaagaagggaaactctccaaattcagagccaccaactcctaaaacagcctgggccgagacctcccgacctccagaaacagaaccgggcccacccgcacctaagccccccctgcccccaccccaccgcggccccgccgggaactggggaccccctggcgattaccccgatcgcggcggcccgccctgcaaaccacccgccccagaggacgaagacgaagcctggagacagcgtcgcaaacagagctctagtgaaattagtctggctgttgagcgcgctcggcgcaggagggaggaagaggagcggcggatgcaggaagagaggagagccgcctgcgccgaaaaactgaagaggctggacgagaagtttggcgcacccgacaagcgcttgaaagcggaacccgcagctccccctgccgctccctctacacccgcaccgcctccagccgtgccaaaggaacttccagcaccacccgccccacctccagcctcagcccctacaccagagaaggagccggaggaacctgcacaggccccccccgctcaatccaccccaacgcctggagtcgctgctgctccaaccctggtatccggcggcggatccacgagctcaacctcctctggcagctttgaagcttcccccgtggagcctcaactccccagcaaagaagggcctgagcctcccgaggaggtcccccctcccacaactcctccggtccctaaggtggagcctaagggggacggcatcgggccgacgcgtcagcctccgtcacaaggtttgggctaccctaagtaccaaaagagcttgccccctcgctttcagaggcagcagcaagagcagcttctgaaacagcagcagcaacaccagtggcaacagcatcagcagggaagcgccccccccactccagtacccccttcccccccgcagcctgtgaccctgggggctgtcccagccccccaggctcccccccccccacccaaagccctttatccgggggctctagggagaccccctcccatgccccctatgaacttcgatcccaggtggatgatgatacccccttatgtggatccgagacttctgcaaggtcgccctcccttggatttctatccacctggcgtccatccctccggcttggtcccacgggaaagaagcgattccggaggctcgtcatcggagcctttcgaccgccatgccccagctatgttgcgggaacgtggcacccctcccgttgatcctaagctggcatgggtcggagatgtgtttactgcaaccccagccgagcctcgtcccctgacttcgcctctcagacaggcggccgacgaagacgacaagggaatgcgatctgaaacccccccagtaccccctccgcccccatatcttgcgagctatccgggctttcctgagaatggcgcccctgggccgccgataagccggttcccactcgaggagccgggccccagacccctcccatggccaccaggctccgacgaggtggccaagatccagacaccgccacccaagaaagaaccgcccaaagaggagaccgcgcagctcaccggacctgaggccggtcgcaaaccagcccgtggagtgggatctggaggccagggcccgcctccgccacgacgcgaaagcaggactgagactcgatgggggccacgaccaggatcttcccggcgcggcattccgcccgaggagccaggggccccaccacgccgcgcaggccccatcaagaaaccaccgccacctaccaaggtggaggaactgcctcccaagccacttgagcaaggagatgagaccccaaaaccccctaagcccgatcctctgaagatcacgaaaggaaaactcggaggccctaaggagactcctcccaacggcaacctgtctccggctcccagactgcggcgggactattcctatgagagagtgggaccaacatcttgcagaggacgtggccgtggggagtacttcgctcgcggacgcggcttcagaggcacttacggcgggagaggccggggcgccaggagccgcgagttcagaagctatcgcgaatttcgcggagatgacggaagggggggcggcaccgggggccctaaccatccccccgcaccccgcggaaggactgcctctgaaacaaggtctgaggggagtgaatacgaagaaatcccaaagcgaagacggcagagggggtccgaaaccgggagtgagactcacgagagcgatctggctccatccgataaggaagcccccacgccgaaagaaggcaccctcacacaagtaccgttagcaccgccgccacctggggcacccccgtcccctgcacctgctaggtttaccgccagagggggaagggtcttcactccccggggcgtgccttcacgcagagggagaggcggcggtcgtccccctcctcaagtatgtcccggctggagcccaccagcaaaaagcctggccccgaagaaacctccaactgggcctcttccaccctctaaagagcctctgaaggaaaaacttatccctggtcccctaagtcccgtggctcggggaggttctaatggtggcagcaatgtggggatggaggacggtgaacgccctagacgcagacggcatgggcgtgcgcagcaacaggacaagccaccccggtttagaaggctgaaacaagagagggaaaatgccgcccgcgggagtgagggtaagccgagcttgaccctcccagcatcagcaccagggcccgaagaggctctaacaactgtgacagttgcccctgccccaaggcgtgcggcagccaagtcacccgatctctctaaccagaacagcgatcaggctaatgaggaatgggagaccgcttcagaatcctctgattttacatcagaacgacggggcgataaagaggcacctcccccagttcttctgactcccaaggcagtggggacccccgggggtggtgggggcggagccgtgccaggcatctcagccatgagccggggggatctgtcccagcgcgccaaagatctctctaaacgatccttttcatctcaaaggccagggatggaaaggcagaacaggaggccagggcccggcggaaaggctggatcaagtgggtcttcgagcggcggcgggggcggcggtcctgggggaagaacaggccccgggagaggggataagcgtagctggcctagtccaaaaaacaggtcgagaccgccagaggagcgcccgcccggcctaccacttccccccccaccaccaagctcatccgccgtgttcaggttggatcaggttattcacagtaaccctgccgggatccagcaggccttggcccagctgtcttccagacaagggtcggtcactgcgccaggcggccacccacgacataagcctggacctcctcaggccccacagggaccttcacctcgccccccgacacgatacgaaccccagcgagttaactctggattgtcctctgatccccactttgaggagcctgggcctatggtgcggggagtaggtggcacgcctcgggatagtgctggagtcagccccttccctccaaaaaggcgtgaacggccacctcgtaaacctgagcttcttcaggaggagtccctacctcccccacatagcagtggtttcctcggctcgaagccagagggccccggtcctcaagctgagagccgtgatacaggcactgaagccctgactccccacatatggaaccggttgcataccgctacctcccggaaatcctacaggcccagttccatggaaccctggatggaaccactgagccctttcgaggatgtggccgggacagagatgagccagtcagatagcggggtggatctgtccggcgactcacaggtttcttccggcccctgttcccagaggtcctcgcccgacggcgggttgaagggagccgccgaggggccccccaaacgacccggcgggagttcaccccttaacgctgtgccatgtgaaggcccgcccggcagcgagccaccaaggcgaccgccacctgccccccatgacggtgacaggaaggagctgccaagggagcaacccctcccacccggccccatcggtaccgaacgcagccaacatacagaccgggggactgaaccaggtcctatccgacccagccatagacctgggccacccgtgcagttcggcactagcgacaaggactccgacttaagactggtggttggcgacagcctaaaggcagagaaagaactgacagcctctgtgactgaagccatacctgtcagccgtgactgggagctgttacctagcgccgctgcttccgctgaaccgcaaagcaagaaccttgattccggtcactgcgtacccgaaccgagctcttctggtcagcggctgtatccagaggtgttttacggttccgctggaccctcttcatcccagatatctggaggagcaatggattcacagctccacccgaactctggtggattcaggcccggcactccatccctccacccatatcgctctcagccattatatctcccccccggcccagcccccccttcagctttgctttccggagtcgcgctgaagggccagttcctcgactttagtactatgcaggctactgagctcggcaaactcccagccggcggggtgctttatccaccaccatccttcctctactcacctgctttctgcccttccccactgcctgacacttcacttcttcaggtccggcaagacctcccgagccccagcgacttttattcaacccctctccaacctggggggcagagtgggttccttccttccggagctcccgcccagcagatgcttctaccaatggtcgattcacagttgccggttgtgaattttggctctctccctccagccccacctccagcccccccaagcttgagtctgctgcccgtgggacccgccctccaaccaccatctcttgcagtccggcctcctcctgcgcccgcaacccgcgtgctgccatctcccgcacgcccatttcccgcatccctgggcagagcagagcttcatccagtggagcttaagccctttcaggattaccaaaagctgtcttctaacctgggtgggcccgggtctagtagaacgccccccaccggccgaagttttagcggactaaacagtaggctcaaagcaactccttccacttatagcggagtgtttcgaactcaacgcgtagatctctaccagcaggccagcccgcctgacgcactcagatggattcccaaaccatgggagaggactggcccaccacctagagaaggaccttctcggcgtgccgaagaacccggttccagaggagacaaggaaccagggctccccccgcccagatag

SEQ ID NO: 200835 - DNA, 6474 bp, Artificial Sequence
  Description of Artificial Sequence: Synthetic coding sequence
atgagcgaccggagcggccccaccgccaagggcaaggacggcaagaaatattcatctcttaatctgtttgatacatacaagggaaaaagtctggagattcagaagccggccgttgcccccaggcacggtcttcaatccctaggcaaagttgctattgcccgccgcatgccacctcctgccaacctgcccagtctgaaggccgaaaacaagggcaatgacccaaacgttagcctcgttcctaaggacggcacaggttgggcttcgaagcaggagcagagtgaccccaagagctctgatgcatctaccgcccagcccccggagagccagcccttgcccgcttctcagacacctgcctctaatcagccgaagcgcccacccgcagcgccagaaaacacacccctggtgccctcaggtgtgaaatcctgggctcaggcctccgtaacccatggtgcacacggtgacggtggtcgtgcatcatcactgctgtcacggttctcacgcgaggagtttcccaccctgcaggctgcaggtgaccaagacaaagccgctaaggaacgtgaatccgcggaacaaagcagtggacctggaccctctctaagaccgcaaaactccaccacctggagggacggaggtggcaggggacccgatgagttggagggaccagattctaagttacaccacggtcacgacccacgagggggactccagccttctgggccacctcagttccccccttatcggggcatgatgcctccttttatgtatccaccgtatctcccttttcccccaccttacggtccccaaggcccctaccgataccccactccggacggtccttcacgattccctagggtcgccggcccacgaggatccggcccacccatgagattggtggagccagtcgggagacctagcatcctcaaagaagataaccttaaggaatttgatcaactggatcaagagaacgacgacggatgggcaggtgcacatgaagaagtggactataccgagaaactcaagttctctgatgaggaagacggtcgggacagcgacgaggagggtgctgaggggcacagagactcccagagtgcctctggcgaggagagacctcccgaagccgacggtaagaaaggtaatagccctaattcagaacctcctaccccaaagacagcctgggctgagacatctcgcccgcccgagaccgagcccggaccccccgcccccaaaccgccactgccccctccccacagggggcctgccggcaactggggaccaccaggagactatcccgatagaggcggaccaccttgtaagccacctgcaccggaggacgaggatgaagcatggcgccagcggagaaaacagtccagcagcgagatcagccttgcagtggaacgggccaggcgccggcgggaggaggaggaacgcagaatgcaagaggagaggagagccgcctgcgcagagaagcttaaaagattggatgagaagttcggtgcccccgataagcgcctcaaggcagaacctgctgcacctccagcagcccctagcactcccgccccacctcctgctgtccccaaggaactgccagctcccccggcgcctccgccggcatcagcccctacaccagaaaaagagccagaagagcctgcccaggcaccacccgcacagtccaccccaacaccaggtgtggcagccgccccaacactcgtgtccggaggcggaagtacctcctccacctcttctggctccttcgaagccagtcccgttgagcctcagctgccctcaaaagaagggcccgaaccacctgaggaagtgcctcccccaacaacaccacccgtgcccaaggtggaaccaaagggggacggaatcggtcctacccgacaacccccctcacaaggactaggatacccaaaataccaaaagtccctgccgcccagatttcaaagacaacagcaagaacagctgttaaagcagcagcagcagcaccagtggcagcaacatcagcaaggcagcgctccaccaaccccagtcccccccagccccccacagcccgttacgttgggggccgtgcctgccccacaggccccacctccaccaccgaaagctctgtaccccggggctttaggaaggccacctcccatgcctcctatgaatttcgatccacgatggatgatgatcccaccgtatgttgacccccgcctcctccagggaaggcctcccttagacttttacccacctggggtacatcccagcgggctcgtgcctagagaacgttctgattccggtggatccagttccgagccatttgaccgccatgcaccggccatgctgagagagcggggtactccgccagtggaccctaaactggcctgggtcggcgacgtgtttacagcgacaccagcggaaccaagaccattgactagtcctttaaggcaggccgcggacgaggacgataagggaatgaggagtgagactccaccggtaccacctccacccccttacttggcgtcatatcccggctttccggagaacggcgcgccgggccctccaatctccagattcccgctggaggaacccgggcctagaccacttccttggccacccggctcagacgaggttgcaaaaatccagacacctccgcccaagaaagagcccccaaaagaagagactgctcagctaactggacccgaggcaggtagaaagccagcgcgtggcgtcggctctgggggacaaggtccaccccctccccgcagggagtcaaggactgaaacacgctggggccccagacccggctcaagtagacggggaataccacccgaggagcccggcgccccacctcgccgtgcgggacctattaagaaacccccccctcccacaaaagtggaggagctgcccccgaaacctctagagcaaggcgacgagacccccaagccaccaaagccagaccccttaaagattactaaaggtaagttggggggccccaaagaaactcctcctaatgggaatcttagccctgctcctaggctgaggagggattactcttacgaacgtgtcggtccaaccagttgcaggggtaggggccgcggggaatatttcgctagggggagaggattccgggggacatacggaggtagaggcagaggggcaaggagccgagagtttcgctcctaccgtgaattcagaggggacgacggcaggggagggggaaccgggggacccaaccacccccctgcaccacgggggaggacagcctccgaaactcgtagcgaaggctcagagtatgaggagataccgaaacgccgccgccagagaggttccgaaaccggctcggagacccatgaatcagaccttgctcccagtgacaaagaagccccaacgccaaaggagggtacactgacccaggtgccacttgcccccccccctcctggggcccctcccagtccagcgcccgctcgttttactgctagaggaggaagagtcttcacaccacgcggcgtgcctagccgcaggggtcgtggaggaggccgaccaccacctcaggtttgcccagggtggtcgccgccagccaaatccctggcccccaagaaaccaccaaccgggcccctccccccctccaaggaacccctaaaagaaaaactcatcccgggtcctctctcgcctgtcgcgcgcggcggatcaaatggaggctcaaatgtgggtatggaggatggggagcgtccgaggcgcaggcggcatggacgtgcacagcagcaggacaaaccaccacggttccgacgtctgaagcaggagagggaaaatgcagcgagggggtcagagggcaaacctagcctcacactgcccgcttcagcgccagggcctgaggaagcactcactaccgttactgtggcacccgcacctaggcgcgcggcagccaaatccccagatctgtccaatcagaacagcgaccaggcaaacgaggagtgggaaactgccagtgaatcgagcgacttcaccagtgagaggcgaggtgataaagaagctccaccccccgtcctgctgacaccaaaagccgttggaaccccgggcggaggtggtggcggcgccgttccgggaatatcagcaatgtcacgaggagatctctcccaacgggccaaggatttgtccaaaaggagcttcagcagtcagcgtcctggaatggagcgccagaacaggagacctggtccaggcggtaaagccgggagttctggtagctcttctggaggcggtggcggcgggccggggggaaggactgggcccggccgcggagacaagagatcctggcccagtccaaagaatcgtagccgtcccccagaggaacgcccgcccgggcttccgttaccaccccctccaccttcctcatctgccgtgtttaggctcgaccaggtcatccattccaaccccgcaggtatccagcaggcccttgctcagctgtcttccaggcagggttcagtgacggctccaggagggcaccctcgccataagcctgggccacctcaggccccccagggccctagtcctcgcccgccaacaaggtacgaacctcaaagggtgaacagtgggctgagcagtgacccacacttcgaggaacctggcccaatggttagaggcgtgggcgggaccccacgggactcagccggggttagtccttttccaccaaagaggcgggagagacctccccggaagccggagctattgcaagaagagagtcttcccccacctcattcctccggtttcctcggttcaaagcctgaggggcccggtccacaggcagaaagccgggatacggggactgaagctcttacaccacacatctggaacagactgcataccgctaccagtagaaagtcttacagaccctcttccatggaaccatggatggagcccctgtccccgttcgaggatgtggccggaacggagatgtcacagtccgattctggcgtggacctgtctggtgattctcaggtttcctccgggccttgttctcagaggtcctctcccgacggggggctgaagggagctgcggaggggccaccaaagcgcccaggaggcagtagccccctgaacgccgttccttgcgaagggcctcctggcagtgagcctccacgtcgaccacctcctgcaccgcatgacggagaccggaaagagcttccacgcgagcagcctctccccccaggccctattggaacagagcgaagccagcggactgatagaggtacggagcccggacctatccggccttcccaccgccccgggccccctgtccagttcggcacgagtgacaaagattcagacctgcgcctggtggtgggggatagcctgaaagctgagaaagagcttactgctagcgtgactgaggctatccccgtgtcccgggactgggaactgctccctagtgcagccgcctccgccgagccccagagcaagaacctggattccgggcactgcgtccccgaaccctcttcatccggacaacgcctgtaccctgaggttttctacggatctgctggacctagttcttcgcagatatctggtggagccatggattcgcagttgcacccaaatagtggcggtttccgcccaggtacaccatcacttcacccatatagaagtcagcccttatatctgccaccaggcccggctcctccatccgccctcttgagtggggtggccctgaagggtcagttcctcgacttcagcactatgcaggccaccgaattaggcaaattacccgctggaggcgtcctgtaccctccccccagttttctgtacagccccgctttttgtcctagcccccttccggataccagcctccttcaggtccgccaggatctgccttccccatcggatttttactcaaccccactgcagcctggtggtcaaagcgggttcctgcccagcggggcgccagcacaacagatgttgttgcccatggtcgactctcagctgccagtcgtcaatttcggcagcctgcctcctgcgcctccaccagcccctcctccactgtctcttctgcccgttggacccgctctgcagccacccagcctggctgtcagacccccacctgcccctgcaacccgggtgctaccctcacccgcacgccctttcccggcttctctgggacgggccgaattgcatccagtggaactcaagccttttcaggactaccagaaactttcttccaacttgggtggtccgggaagctccaggaccccccccaccggcaggtcttttagtggccttaactctaggctcaaggctaccccaagtacctactcaggggtcttcagaacccagagggtcgatctgtatcagcaggcttccccgccagatgctcttaggtggattcccaaaccgtgggaacgaacgggccctcctccacgagagggccctagcagacgggcggaggaacctggatctcgaggagataaggagccggggctgcctccacctagatag

SEQ ID NO: 200836 - DNA, 6417 bp, Artificial Sequence
  Description of Artificial Sequence: Synthetic coding sequence
atgagcgaccggagcggccccaccgccaagggcaaggacggcaagaaatattcctctttgaatctgttcgatacctataagggcaaaagcttggaaatccagaagccagctgtagcgcccaggcatggtttacagtcattgggcaaggtagcaattgcaagaaggatgcctccccccgctaacctgccttccctgaaggcagagaacaaagggaacgatcccaacgtgtcactagtccctaaagatggaactggatgggccagcaagcaggaacagagtgatccgaagtccagcgacgcctcaacagcgcagccccccgagtctcaacctttgccagcctcccagacacctgcctcaaatcagcccaaaagaccgcccgccgctcctgaaaacaccccccttgtcccttccggcgtcaaaagttgggcgcaagcatcggtgacccacggagctcacggagatgggggtcgcgcctctagcctgctgagccgtttcagtagagaggaatttcctacgctccaggccgcgggggaccaagataaagcagccaaggagcgtgagtctgcagagcagagcagcggtccagggcccagcttgcgcccacaaaacagcacaacatggcgcgatggcggaggtcgggggcccgatgagctggaagggcccgactctaagttgcatcacggacatgacccgcgaggcggcctgcagcctagtggccctccccagtttccaccataccgcggaatgatgcctccctttatgtatcccccctacctcccattcccgcctccgtatggtccccaggggccatatcgataccctacaccagacgggcctagtcgctttccaagggtcgccggcccccgtggcagtggtccacctatgcggcttgtcgagcccgtcggcagaccaagcattctgaaagaagacaacctgaaagagtttgatcaattggaccaggagaacgatgacggttgggcaggtgcacatgaggaggtggactatacagaaaagctgaagttctctgacgaagaagacggcagagactccgacgaagagggggccgaaggacatagagattcccagtcagcctctggggaggagcgacccccggaggcagacggtaagaagggaaactccccaaatagcgagcctcctacccccaaaactgcttgggccgagaccagccgacctcccgagacggagccaggcccacccgccccgaagcctcccttgccccctcccggcgactacccggacagaggcggccctccctgcaaaccaccagctcctgaagatgaagatgaggcttggcggcaaagacggaaacagtcttcatctgagatttccctcgccgtcgaacgagctaggcgacgccgcgaggaggaggagcgtcgtatgcaggaagagagacgggctgcatgcgccgagaaactgaagcggctggacgagaagttcggagcacccgacaagcggctgaaggccgaaccagcggccccacccgcagctccgagtaccccagcacctccacccgctgtccctaaggaattaccagcacccccagcaccgccccctgccagcgccccaacaccagaaacagaaccagaggaacccgcccaagcccctcctgcacaatccacacccacacccggcgttgcagccgctcccactctcgtgtccggaggcgggtccacctcttcaacctcttccggatcattcgaggccagcccagttgaaccacaattgccttctaaggaggggcccgagcccccggaggaagttcctccccccacgaccccgcccgtccccaaggtggaacccaagggcgacggcatcgggcccacacggcaacctcctagtcaggggctgggctatcccaaatatcaaaaaagcttgccacctagattccagagacagcagcaagaacagttgctcaagcagcagcaacagcaccagtggcaacagcatcagcagggctccgctccacccacgcccgtccccccgagcccaccccagccggtaacccttggagccgtgccagccccacaggctcctccacctcctccaaaagcgctctaccccggagctctcggtagacctccgcccatgccacccatgaactttgatccccggtggatgatgatccctccttatgtggaccctaggctgctacaggggcggcctcctctggatttttacccacccggggtgcaccccagcgggctggtgccccgggagcggtctgatagcggcggctcctcctccgagccatttgaccggcatgcgccagcaatgttaagggagcgtggcacgcctcccgtcgaccctaagttagcctgggtcggagacgtcttcacggcaaccccagccgagccccgtccactaacgtcaccactccgacaggccgcagatgaggacgataaaggtatgcgcagtgagacccctccagtcccccctccaccgccttacctcgcttcctaccctggattccccgagaacggcgctcctgggccgcccatctctagattcccactggaagaaccagggcccagaccacttccgtggccccccgggtccgacgaggtggctaaaatccaaacaccacccccaaagaaagagcccccaaaagaggagaccgcccagctcaccggccctgaggcagggcgcaagccagcacggggcgtcggttcaggcggccagggacctcctccacctcgccgcgaatcaagaacagagacccggtggggacctcgccccggaagcagtcgaagaggaatccccccagaggagccgggggccccccctagaagggcaggtccgattaaaaagccacctcctcctacaaaagtggaggaactgccgcccaagcctctcgaacaaggcgatgaaactcccaagccaccgaaacctgatcctctaaagattacaaagggcaaattgggcgggcctaaggagaccccccctaacggcaatctctccccggctcccaggctccgccgcgactacagttacgagcgcgtcggccccaccagttgtcgaggacgcggcaggggagaatacttcgcccgcggaagaggctttcgagggacctacggcggacgcggccgtggtgctgcaggcaactccgccgttactgaatcattcgaggagatgatgggggtagaggtaggccagggggaccaaaccacgctgctgttaccagaggcggctctgcccgcaagacacggggccagggtgcagagtatgcgcaaatcccctagcggtgcaggctctggagcccagaagcaggccgccaggccaatgcgagtcatatggctactccaaaccaggcgtcttccccatccacgtagagaacacagcccgaggtcccgctccccaacaacccgctctccgacattccctgctcccgcccgttttacgcctggggtgggcgaatccagccttcctgaaggcattagtcccggcccccgtcggcgtgaaccaccacaggtttgcccaggatggtcacctcctgcaaagtcgctggccccgaagaagccgcccactggacctttgcccccatccaaagagcctctaaaagagaaattgattcccggccccttaagtcctgtggcacggggggggtcgaacgggggatcaaacgtcgggatggaagatggggaacggcccaggcgaaggcgacatggcagagcccagcaacaggacaaacctccacgcttcagaaggttgaaacaggagcgcgaaaatgctgctcgcggctcggagggtaagccatcgctaacccttcctgcttcagctccaggtcctgaggaggctctcactactgttacggtggcccctgcgccgaggcgggcggccgccaagtcccccgacctgagcaaccagaactcagaccaggcaaacgaggaatgggagactgccagcgaaagctctgactttaccagcgagcggcgaggcgacaaagaggctcctcctccagttctgctgacaccaaaagctgttggcacaccaggaggcggaggcgggggtgcagtgcctggcatctccgccatgagcagaggtgatctgagtcagcgggcaaaggacctgtcaaagcgcagtttctcctcccagcggcctggcatggagaggcagaataggcggcccggtcctggtggtaaagccgggtctagtggcagttcctcagggggtggcggggggggccccggcggcaggaccggtcctggcagaggcgataagaggagttggccatcaccgaagaatagaagccggcctcccgaagaaagacccccagggttgccgctgcctcctccaccaccctctagtagcgctgtgttcagactcgaccaggtcattcactctaaccccgctggcattcagcaggcgttagcccaactttcatccaggcagggaagtgtgactgccccaggcggccacccgcggcataagccaggactcccacaggcccctcaggggccttcgccaagacctcccacgcggtatgagccacaaagggtaaactctggcttatcctcagaccctcatttcgaagaaccagggccaatggttagaggcgtagggggcacaccgcgggattctgcaggcgtaagccctttccctccaaaacggcgggaaagaccaccccgtaaaccagaacttcttcaggaggagtctctccctcctccacacagctctggcttcctaggtagcaagcctgagggccctggacctcaggcagagtctagagacaccggcacggaagcgctaactccacacatatggaataggctacatacagcaaccagtagaaaatcttatcgcccaagtagcatggaaccctggatggaacctttatccccattcgaagatgtagcaggaaccgagatgtctcagtccgactcaggtgtcgacctctctggagatagccaagttagctccggcccctgttcccagcgatccagtcccgatggcggactgaagggggctgcggagggacctcctaagcgccccggtgggagctctccacttaatgctgtgccttgcgagggcccaccggggtctgagccccccagacgcccacctccagccccccacgatggtgaccgcaaagagctgccgcgggaacagcccctgccaccggggcctatagggaccgagcggagccagagaaccgaccgcgggactgagccagggccaatccgtccgagccataggcctggtccgccggtgcagttcggtacgagtgacaaggacagcgacttacgcctggtggtcggcgactcactgaaagctgagaaggagcttacagcaagcgtaaccgaggccatacccgtgagtcgggactgggagctgctgccctccgctgccgcatcagcggagccccagagcaaaaacctggactccgggcattgcgttccagaaccctccagctctggtcagagactgtaccctgaagtcttctatggaagcgccgggccctcctcctcgcagatttccggaggacacggtctgagtatcaccagcaagcagtggaggagacccgggacgccgtcccttcacccctacagaagccagccactctatctgcctccagggcccgcacccccctccgccctgctgtcgggactcgccttaaaaggccaattcctggattttagcactatgcaagccactgagttggggaagctccctgcaggaggcgttctttacccacccccctcttttctgtatagcccagccttctgcccatcccccttgcccgataccagcctgctccaggtccggcaggatctaccctctccttcggatttttactccacaccactgcagcctgggggtcagagcggcttccttccctccggcgccccagcccaacaaatgctgcttccgatggtcgacagtcaactccccgtcgtaaatttcgggagcttaccgcccgcccctcctccggccccacccccattatcactgctgcctgtgggccccgcactacagccgccgagcttggctgtgcgtcctccccctgctcctgccactagggttctgcccagccctgcacggccttttcctgccagtctgggccgcgccgagttgcaccccgtggagcttaagcccttccaggactatcaaaagctctcatccaacctcggtggccccggctcctctcggacaccccctactgggcggtctttttcggggctcaatagccggctaaaggcgacccccagtacatactctggagtgttcagaactcagagggttgacctttatcaacaagcatcacctcccgatgcactgaggtggattcccaagccctgggaaagaacaggccctcctccacgggaaggaccttcgcgcagagccgaagagcctgggagtcgcggtgataaggaacctggactgccccctccccggtag

SEQ ID NO: 200837 - DNA, 6474 bp, Artificial Sequence
  Description of Artificial Sequence: Synthetic coding sequence
atgagcgaccggagcggccccaccgccaagggcaaggacggcaagaaatatagctcactcaatctctttgacacatacaaaggaaaatccctcgaaatccagaaaccagctgtcgctccacggcatggtctgcagtcccttggaaaggttgccatcgcacgacgcatgccaccgccagcaaatctgccttcactgaaagctgaaaataagggaaatgatccaaatgtcagcctggtgcccaaggatggaacaggatgggcaagcaagcaggaacagtctgacccaaagagcagcgacgcaagtaccgcccagccgccagagtcccagcccctgcccgcctctcagacccccgcctcaaatcagccaaaacggcccccagccgcacccgaaaatacccccctcgtcccaagcggtgtgaaatcttgggcccaagcttctgtcactcacggggctcacggagatggtggcagggccagcagcctgctttcacgcttttctagagaagagtttcccaccctgcaggcagcaggtgatcaagacaaggcagctaaagagagggaatccgccgaacagagctccgggccaggtcccagcctgagacctcaaaactccaccacctggcgcgatggtgggggaaggggtcccgatgaactggagggccccgattctaagctgcatcatggccacgaccccaggggtgggctccagccttctggccctccgcagttcccaccctaccggggcatgatgcctccttttatgtaccctccctatttgccgtttccccccccatacggacctcagggcccctaccgttatccaacgcctgacggacccagtcggtttccccgcgtagccggtcccaggggcagcggacctccgatgaggttagtggaacccgttgggcgcccctcaatcttgaaggaggataacctgaaagagttcgaccaactggaccaggagaacgacgatggctgggccggtgcccacgaggaggtagattacacagagaaactgaagttctctgatgaggaagatgggcgagattccgatgaagagggagcggagggccacagagattcgcagtctgcttccggcgaagagagaccacctgaggctgatgggaagaagggcaatagtcctaattctgagccccccacccccaagacggcatgggccgaaacctccagacctccagagaccgaacccggacctcctgcccccaagccaccacttcctcccccccacaggggcccagccggaaactggggccctcccggcgattacccagaccgtggtggacccccctgcaaaccaccagcacccgaggatgaagacgaggcatggagacaaaggagaaagcagtcctcttcagagatctctttggcagtggagagggctcgaagaagacgggaagaggaggagcgccggatgcaggaagaacggcgggctgcttgtgccgaaaagctgaaacgcctagatgaaaagtttggagctcctgataagagacttaaggctgaacctgccgcaccccctgctgcaccatccactccagcccctccccctgccgtgcctaaagagctccctgcccctcctgcgccaccccctgctagcgccccgacgccagaaaaggagcccgaggaacctgcccaggcacccccagctcaatccacccccaccccaggagttgccgccgcacccacattagtgtcaggcggaggaagcacctcttccactagctccggctcctttgaggcctcacctgtcgaacctcagttgcctagcaaggaaggcccagagccacctgaggaggttccgccccccacaaccccgcctgttccaaaagttgagcctaagggggacggtatcgggccaactcgacaacccccttcccagggactgggctatcccaaataccagaaaagtctgcctcccaggttccagcggcagcagcaggaacagctgctcaaacagcagcaacagcatcagtggcaacaacatcagcagggctctgctccccccactccagtcccaccgagtccgcctcagcccgttactctgggcgctgtacccgcgccacaagcaccgcccccaccaccgaaagcgctgtacccgggggctctgggtcgtccaccgccgatgcctccaatgaatttcgatcctcgatggatgatgatacccccttacgtagatcctcgcctgttacagggcagacccccccttgatttttacccaccaggcgtgcacccatccgggctggtgcctcgggagcgttccgatagcgggggctcttcctctgagccgttcgacagacacgcccctgccatgctccgggaacggggtactccacccgtggatcccaaattggcgtgggtcggtgatgtgttcaccgcaacgccagctgaaccgcgccccctcacatctccactgcgccaggcagcagatgaagatgacaagggcatgcgctccgaaactcctcccgttcctccccccccgccgtatctggcttcttaccctggatttcccgagaatggcgcccctggcccacccatttcccggtttccactcgaggagccaggtccccgacccctaccatggcctcccggctccgacgaggtcgctaaaatccagacacctccacctaagaaggaaccgcccaaggaagaaaccgctcagctgaccggccctgaagcgggtcgcaaaccggcacgaggggtcgggtctggcgggcagggccctcccccacccaggagagaaagtcggactgagacccgatgggggccaaggccagggtcatctcggagaggaattcctcccgaagaacctggcgctccgcctcgtcgcgccggtcccatcaagaaaccaccacctccgacaaaagtggaggagttaccacccaagccactggagcagggggatgagactccgaaaccacccaaaccagatcccttaaaaatcacaaaagggaagctaggtggccccaaggaaacccctcctaatgggaacctttcaccagctccgagactgcgacgtgattactcctacgaacgggtgggaccgaccagttgtcggggtaggggccggggtgagtattttgcacgcggccgtggattccggggaacctatgggggaaggggaagaggcgcaagaagccgagagttcaggagttatcgtgaatttcgaggggatgatgggagaggcgggggcaccggcggccccaaccatccgcctgctcctcggggtcgaaccgcatccgagacacggtctgaggggtcggagtacgaagagatccccaagcggcggcgccagcgcggatctgaaaccggaagtgagacacacgagtctgacctggccccatccgacaaagaggctcccacaccgaaagaaggtaccctcacgcaggtgccccttgccccacctccccctggggctccccccagccctgctcctgcgaggttcactgcaagaggtgggagggtgtttaccccccgcggcgtccccagccggcggggccgagggggtggtagaccccccccccaagtctgccccggatggagtccacccgccaaaagtcttgccccgaagaaacccccaacggggccccttccccccagcaaggaacccctcaaagagaaattgattccagggccactgtcacctgtagctcgaggagggagtaatggaggttcgaacgtggggatggaagatggtgaacgccctcggcgcagaaggcatgggagagcgcagcagcaggataagcctcctcgatttcgcagactgaaacaggagcgggagaacgccgccagggggagtgaaggcaagcccagcttaaccctacctgcttcagccccaggccctgaagaggcgcttaccaccgtgactgtggcaccagcccctagaagagccgcagctaagagtcctgatttgtccaatcagaattctgatcaggcaaatgaggagtgggaaacagccagcgaatcctccgattttacgagcgaacgaaggggggacaaggaagcaccaccccccgtcctgctcacccctaaggccgttgggacacccggcggcggtggcggcggagctgtccccggcattagcgccatgtctaggggggatctgagccagagagcaaaggacttatcgaagaggagctttagctcacaacgacccgggatggagaggcaaaaccgtcgacccggtccaggtgggaaagccggttcatccggaagttcaagcggtgggggtgggggtgggcccgggggacgcaccggtccgggccggggggacaaaaggtcctggccgtccccaaaaaacagaagccgccctccagaggaacgaccgccggggttaccactcccgcccccacccccttcttcctcagcagttttccgcctggaccaggtgatccactctaacccagctggaatccagcaggcactggctcagctaagttctcgccagggctctgtgacagcccccgggggccacccacgccacaaaccgggtccaccccaggcccctcaggggccctccccccggccaccaacgcgctacgaacctcagcgtgtgaatagtggactcagctctgatccacactttgaagaaccaggtcctatggtgagaggggtaggaggtacacctagggactccgcaggtgttagtccgttccctcctaaaaggagagagcgcccgcctcgcaagcccgagttgctccaggaagagtctctgcccccaccccattcttcaggatttctagggtccaagccagaagggccaggccctcaggctgaaagccgggacactggtacagaagccttgacgccacacatctggaatcgacttcacaccgcaacatcacggaagtcatacaggccttccagcatggaaccctggatggagcctttgagtccatttgaagacgtcgctggaacggagatgtctcagtctgacagcggtgtggaccttagtggggacagccaggtgtccagcggaccctgcagtcagcgctcctccccagatgggggactcaaaggcgccgcagagggaccgcccaaaagaccaggaggatcatccccacttaatgccgtaccatgcgaagggccccccggaagcgaacctccacgccgacctcctccggcaccccacgatggggaccgtaaggagctgcctcgagagcagcctctgcccccagggccaataggtacagaaagatcccagcatacagaccgaggcactgaaccaggtcccatccgcccttcccatagaccagggccccccgtgcagttcggcacatcagataaggactctgacttgcgactcgtggtcggggattctttaaaggccgagaaggagctgacagcctctgtgactgaggcaatccctgtttcaagggattgggagttgcttccctctgcagctgcttctgccgagcctcagtcaaagaacctggatagcgggcattgcgtgcccgagccctcttcatcaggacaacggctgtatcccgaagtattttatgggagcgctggcccctcttcttcccaaatttctggcggcgccatggactcccagttacaccccaacagcggaggcttcagacctggcaccccctcactgcatccttacaggtcgcagcctttgtacctgccaccggggcccgcccctccctctgcactgctgagtggggtcgcgctgaaagggcagtttctggacttctctaccatgcaagctacagaactcggcaagttgccggccggcggggttctgtatcctccacctagtttcctgtatagccccgccttctgcccatcaccactgcctgatacatcattactacaggtcagacaggatttacccagcccttctgatttctactccacaccgttgcaaccagggggccagtctgggttcctgccctcaggggcccctgcacagcagatgctcctgcctatggttgacagccaactacctgtggtgaacttcgggtcactgcctccggcacctccccccgcaccacccagtctgtctctattgccagtggggcctgcacttcagccgcccagcctggcagtccgacctccaccggcccctgcaactcgggtcctccccagccccgcaagaccctttcccgccagtcttggccgcgccgagctgcatcctgtagagttaaagcccttccaggattaccagaagctctcatctaatctaggcggccccggctcatcccgcaccccccccactggtaggtccttttccggcctgaactctaggctcaaagccacgccctctacgtactctggcgtttttagaacccagagggtggacttgtaccaacaggcgtcgccacccgacgcactgcgttggatcccaaaaccctgggaacgaaccggccccccccctagggagggtccttcaaggagagctgaggaaccgggttccagaggcgataaggaacctggcctgcctcctccacgatag

SEQ ID NO: 200838 - DNA, 6474 bp, Artificial Sequence
  Description of Artificial Sequence: Synthetic coding sequence
atgagcgaccggagcggccccaccgccaagggcaaggacggcaagaaatatagctccttgaacttattcgatacgtacaaaggaaagagtctggaaatccagaagcctgcggttgctccgaggcacggcctccagtctcttggaaaggtggccattgcccgcagaatgccccctcctgcgaatttgccaagtcttaaggccgagaacaaaggaaacgacccaaacgtatccctggtacccaaggacggcacagggtgggccagcaagcaggaacagagtgaccctaaatcttcagacgcctccaccgcgcagccacttgagtcacagccgctgccggcatcccagactccagcctccaatcagccgaagaggccccctgcggctcctgagaacactcctttggttccatctggggtcaagtcttgggcacaggcttcagtgactcacggtgcccatggggacggaggaagagcctcatccctactgtcccggttctctcgagaagaattcccaacgctgcaagcagcgggtgatcaggacaaggccgccaaagaacgtgaatccgcagagcagagtagcggcccgggaccctccctccggcctcagaacagtaccacttggagagacggcggagggcggggtcctgatgagctggagggacctgattcgaaactgcaccatggacatgacccaagaggcgggctgcagccctcgggcccgccgcagttccccccctatcgcggcatgatgcctcccttcatgtacccaccctacctcccctttccacccccctacggaccacaggggccataccgatacccaacccctgacggaccatctcgatttcctcgagtagccggccctaggggaagcgggccccccatgagactggtcgagcctgtcggtcgaccatctattctaaaagaagacaacctgaaggagttcgaccagctcgaccaggaaaacgacgacggttgggcgggagcccacgaagaggtcgattacaccgagaaactgaagttttccgatgaggaggatggtagagactcagatgaagaaggcgccgagggccacagagactcccaaagcgcctcgggcgaggaacggccgccggaagccgacgggaagaaaggtaactcacccaatagcgaacctcctactcctaagacggcttgggcagagacatccagacctccagaaaccgaacccggacctcctgcaccaaaacctcctctgccgccacctcaccgcggcccagccggaaactggggaccaccaggagactatcctgacagaggcggacctccttgtaagccacccgcaccagaggatgaagacgaggcctggagacagcgtaggaagcaatcaagctcggagataagcctggcagtggagcgggccagaaggaggagagaggaagaggaacggcggatgcaagaggaacgaagggccgcatgtgcagaaaaactaaagcgactggacgagaagtttggagcgcctgacaagcggctgaaagcagaacctgccgctccgcccgcggccccatcaacacccgctccccccccggctgtccccaaagaactgccggcacccccggcccctcctccggcctctgcaccaacgccagagaaagagcccgaggagccggcccaggcccccccagctcagtcaaccccgacccctggggttgctgcagctccgactctggtatcaggtggtgggtcgacaagttcaacaagctccggatccttcgaggcttcacccgttgagccccagctgccttcaaaggaaggccccgagcccccggaggaggtaccccctcctacaaccccccccgtgccaaaagttgagcccaagggagatggaatagggccgacccgacaaccgccctcccaaggcctaggatacccaaagtaccagaaaagtctgcccccacgttttcagcgacaacagcaggagcagcttttaaagcagcagcagcaacatcaatggcagcagcaccagcaagggtctgccccccctacccctgtgcctccctccccaccccaacctgtgactcttggagcggttccagccccgcaggcgccgcctcccccccccaaagccctttatcccggcgcgctcggcagaccgccaccaatgcctccaatgaattttgatccaaggtggatgatgatacctccttatgtagacccaaggctcctccaaggcagacctcctttggatttttatccccccggagttcacccatcaggtctggtcccccgggaaaggagcgattccgggggctcatcgtcagaaccattcgaccgccatgcacccgcaatgctgagagaaaggggtacaccccccgtggaccccaaacttgcatgggtgggcgatgtgttcacagccacccctgccgagccacggcctctgacatcgccattgcgacaggccgccgacgaggacgataagggtatgaggtcagagacaccccctgttcctcctccccccccctacttggctagttacccaggcttccccgagaacggggctcccggaccgccaatttcaaggttccccctcgaagaacccggcccccgtccccttccatggccccctggcagcgacgaagtagctaaaatccagacaccccccccaaagaaagaacctccgaaggaggagaccgcacagctgaccggcccagaggcaggcagaaaaccagcccggggagtgggttctggcggacagggccctccacctccacggcgggagtcccgcactgaaacaaggtgggggccacgaccaggatcttctcgaagaggcattccccctgaagagccaggcgccccacctcgaagggcgggacccataaagaagcccccccccccaaccaaggtggaggagctgccgccgaaaccgctggaacagggcgatgaaacaccgaaaccacccaagcccgaccctctgaagataaccaaaggcaagctaggcggtccgaaagagactccgccaaacgggaacctcagccctgcgcctcggctgcgcagggactattcatacgaaagggtgggccccacttcttgccggggccgcggaaggggcgaatattttgccagggggagagggtttaggggcacatacggtggacgcgggagaggagcacggtctcgggaatttcggagttatagagagttcaggggagatgacggtcgtggcggcgggaccggaggaccaaatcacccacccgctcctcgcggccggactgcttctgaaacgcggtctgaagggtcagagtacgaagaaattcccaaacgacggcgtcaacggggcagcgagacaggaagcgagacccacgagagtgatctggctccttctgataaggaggctccgacgcctaaggaggggaccttgacacaggttccgctggctcccccaccacccggcgctcccccttcccctgcccctgccagattcactgccagaggtggaagagtgttcaccccacgaggtgtgccaagccgaaggggccggggcggaggtcgtccccccccacaggtgtgcccagggtggagcccacctgcaaagagtttggcccctaaaaaacctccaaccggacccttgccgccaagtaaagagccgcttaaggaaaagctaattccgggtcctctatctcccgtggcacgaggtggatcaaatggaggctcgaacgtgggcatggaagacggggagcggccccggaggcggaggcacggccgggcccagcaacaagacaaacctcccagattccgcagactcaagcaagaacgcgaaaatgccgccagagggtccgagggaaagccttccttaaccttgccagcttccgccccaggcccagaagaagccctcaccactgtgacggtggctcccgcgcccagaagagcagctgcgaaaagccccgatctgtctaatcagaattctgaccaggctaatgaggagtgggagacggccagtgaatcttcagacttcactagcgagaggcggggcgataaagaagcgccccccccagttctcctcaccccaaaggctgtgggcaccccagggggtggcggtggtggtgcagttccgggaatatcggctatgtcccggggcgacctgagccagagggcaaaagatttatccaagcgtagcttctcaagccaacgccccggcatggagaggcaaaaccgccggcccggtcccgggggcaaagctggatcttccggatcatcttctggggggggaggcggcggccctgggggcagaactggaccaggccggggtgacaaacgttcctggccatcccccaaaaacagatcccgcccaccagaggaaagaccccccggactcccactacccccaccaccccccagctcaagcgctgtgtttcgcctagaccaggtgatccacagcaatcccgccggcatccaacaggccctcgcccaacttagctctcgtcaggggtcagtgactgcccctggaggccatcctcggcacaaacctggccctccccaagccccacagggaccttcacctcgccctcctacccgatacgagccacagcgtgtgaatagcggactgagcagcgacccgcacttcgaggagcccggacctatggtgaggggtgtgggcgggacacctagggacagtgctggcgtcagcccctttcctcctaagcgacgcgaacggcctccgagaaaaccagaactgcttcaagaagaaagcctgccgccaccacactcctcgggatttctgggcagtaagccagaggggccagggccacaggccgaatctagagatacaggaaccgaggccctcacaccgcacatctggaaccgcctccataccgctacatcacgcaagtcctataggcctagtagtatggagccctggatggagccactctctcctttcgaggatgttgccgggaccgagatgtctcaaagtgactcaggagtcgacctctccggagactcccaggtttcctctggaccctgtagtcaacggtctagtcccgacggaggactgaaaggcgccgccgaaggccctcccaaacgacccggcgggagctcacctttgaacgctgttccctgcgagggcccacccggctccgaacctccacgcagacctccacctgccccccatgacggagatcgcaaagaactccccagagaacaaccactgccaccaggtccaatcggcactgagcggtcacagcgaacagaccgcggaaccgaacctggacccattcgaccaagtcatcgcccaggacccccggttcaatttggcacttcagacaaggatagcgatctgaggctcgtcgttggggatagtctgaaggctgagaaggaactgacggcttccgtgaccgaggcgatccccgtttccagagattgggaacttctccctagtgccgccgcctccgctgagcctcagtcaaagaatctggattcaggacactgtgtgcccgagcctagttcctctggtcagcgtctgtatccagaggttttctacggctccgccggtccatccagtagtcagatctccggcggcgccatggacagccagctgcatccaaattccggtggctttcgccccggcaccccgtccctacacccctaccgctcacagccactctacctgcccccgggcccggctcctccctcagccctgttaagtggggtggcgctgaaggggcagttcttggacttctctacgatgcaggcaaccgagttggggaagttgccagccggcggcgttctgtatccacctcccagctttttatacagtccggctttttgccccagcccattgccggatacttctctccttcaggtgagacaagacctccctagccctagcgacttttatagcacccctctccaaccaggaggccagagcgggttcctgccttctggcgccccagcccagcaaatgctactacctatggtggattcacagctcccggtggtaaactttggaagccttcctccagcgccgcctcctgcaccaccccccttgagcctcttacctgtgggccccgccctccaaccgccttctctggctgtgcgcccccctccagctcccgccacccgggtcttgcctagccctgccaggcccttcccagcaagcttgggccgcgcggaactccacccagttgaattgaagcccttccaggattaccagaagctgtcttctaacctgggcggccctggttcatcccgaacaccgccaacagggagatcattcagtggcctgaattcccgcctgaaggcgacgccaagtacctattccggcgtttttcgcacccaaagggtagatctgtaccagcaggcaagtccaccagacgcgctgaggtggattcctaaaccttgggaaagaactggaccccctcctcgcgaggggccgagccgccgtgccgaagagccaggctccagaggcgacaaggagcctgggctcccccctccccggtag

SEQ ID NO: 200839 - DNA, 6474 bp, Artificial Sequence
  Description of Artificial Sequence: Synthetic coding sequence
atgagcgaccggagcggccccaccgccaagggcaaggacggcaagaagtatagcagcctcaatctgttcgacacatataagggtaagagtctcgagatccaaaagcctgcggtggcaccccgtcacggcctgcagagtctcggaaaagtggccatcgcccgtcgtatgcctccgccagctaatctgcccagtttaaaggcggaaaataaagggaatgatcccaacgtgagcctagtgcctaaagatggaacggggtgggcgtctaagcaagagcagtccgacccaaagtcttctgatgcctcaacagcacagccgccagaatcccagccgctgccggctagccagacccccgccagcaaccagcctaagaggccacctgcagctcccgaaaacactcctctggtcccgagcggtgtgaagtcttgggctcaggcttcagtcactcatggggcccatggggatggaggcagggcaagttcactccttagcaggttctcgcgagaggaatttccgacccttcaagctgccggggaccaggacaaagccgctaaggagagggagtccgctgagcagtctagcgggccggggccctctttgcgcccccaaaacagtaccacatggagagacggcggcggacggggaccagatgagttggaaggccccgacagtaaactgcatcatgggcacgatcctcggggggggctgcagccatcaggtccaccccagttcccaccctacagaggaatgatgcctcctttcatgtatcctccttacctccccttccctccaccatacggccctcagggcccttacaggtaccccactcctgatgggcccagccggtttcctcgcgttgccggtccacgggggtcagggcctcccatgcggttggtcgagcccgttggcagacccagtatcctgaaagaggataacttgaaggagttcgatcagctggaccaggagaatgatgacgggtgggctggcgcccacgaagaggtcgattatacagagaagctgaagttctcagacgaggaggatgggcgcgactccgatgaggagggagcagagggccaccgagattcacagtccgcctccggcgaagaacggcccccagaggcagacggaaagaagggcaatagccctaattccgagcccccaacacctaaaaccgcttgggcggaaacatctaggccccccgaaacggagcctggccctccagcccccaagccccccctccccccacctcaccggggaccggctgggaattggggaccccccggcgattacccagacagagggggaccaccttgtaagccccctgccccggaagacgaagatgaggcatggcgacaacgcagaaaacaaagttcaagcgagatctctcttgctgtagagagagcccgtcgcaggagagaggaggaggagcgcagaatgcaggaggaaagacgcgcggcatgtgccgagaaattaaagcgcttggatgagaaattcggggctccagataagagactgaaggcagagcccgccgcccctcccgcagcaccctccacacctgcaccccctcccgccgtgccaaaggagttacccgccccacctgctcccccccccgcgagcgcgccaacacccgagaaggagccggaggagcctgcccaggccccaccagcccagtccacccctacccccggagttgccgctgcccccacactcgtctccgggggggggagtactagttcaacctcctcagggtcgtttgaagcatcccctgtagaaccacagcttcccagcaaggaaggtcccgagccacctgaagaagtgcctcctcctaccacacctcctgttccaaaagtagaacccaagggagacggtataggccccacgcgccaacctccatcccaaggcctcgggtatccaaagtaccagaaatctctgccccccagattccagcgtcagcagcaggagcagctcctgaaacagcagcagcagcaccagtggcagcagcatcagcagggatctgcaccacccactccagtaccaccctcaccccctcagcccgtgactctgggggccgtgcccgcaccacaggcgccacctcccccccccaaagctctataccctggcgccctagggcgaccgccaccaatgcccccaatgaacttcgacccaagatggatgatgattcctccttacgtagacccacgtctgttacagggacgcccaccactggacttctatccgcccggagtccatcccagcggcctcgtgcccagggagcgttccgatagcggcgggtcctccagtgaacctttcgatagacacgctcccgcaatgctgcgagagcgtggtacccctccagtggatccaaagctggcctgggtcggcgacgtcttcaccgccacaccggccgagcctcgccctctgaccagcccactcagacaggccgcagacgaggacgataaagggatgcgcagtgaaacgccccccgtccccccacctccaccctacttagcctcttaccctggctttcctgagaacggcgcaccaggccctcctatctcacggtttcctctggaagagcctggaccccggccacttccttggcctcccggctcggacgaagtggccaagatccagaccccaccaccaaaaaaagaaccccccaaggaggagaccgctcaacttacgggacctgaggccgggcggaaacctgcacggggggtggggagcggcggacaggggcctcccccacctaggagggagagccggacagagacccgatgggggcctcggcccggtagctcccgccgcggcatccccccagaggaaccaggagctccaccacggcgggctgggcctattaaaaagccgccgcctccaactaaagttgaggaacttcccccgaaacccctagagcaaggagatgagacaccgaaacccccgaagccagacccactgaagatcaccaaggggaaactgggagggcccaaggaaactccgcctaacgggaatctgtctccggccccccgcctacggcgggattactcatacgagcgcgttggtcctacatcttgtagggggagaggcaggggggaatacttcgctcgagggcgtggttttcgaggcacctacggcggcagaggccgtggcgcaagatctcgggagttcagatcataccgcgaatttagaggcgatgacggccgcggcggggggactgggggaccgaaccatccgcccgcacctagggggcgaacagcctcagaaaccagatccgaagggtcagaatatgaagagattcccaaacgacgacgacagagagggtcagaaacaggaagtgagacccatgagtctgacctggctcccagcgataaggaggctccaacaccaaaggagggtactttgacccaggtgccattggctccaccaccaccgggtgcccctcccagtccggcccctgctagatttacagcgagaggcggccgggtgtttactcctaggggcgttccttcaaggcggggcaggggtgggggcagaccaccaccgcaggtatgtcccggatggtccccgcccgctaagagcctggcacccaaaaagccacccaccggacccctgccaccctccaaagaaccattgaaagaaaagctcatccccgggcctctgagtccggtagctaggggcggcagtaacggaggctcaaacgtcggcatggaggatggcgagaggcctcggaggaggcggcacggtcgcgcacagcagcaggacaaaccgcctaggtttcgcagactcaaacaggagcgagagaatgccgccaggggctcagagggcaaaccctccttaacactccctgcatctgccccaggacccgaggaggcgcttacgactgtgaccgtggcacccgccccacgcagggccgcagctaagtcacccgatctttccaaccagaactccgatcaggccaatgaagaatgggaaacagcctctgagagctccgactttacttccgagagaagaggggataaggaggctccacccccagtgctcctgactccaaaggctgtggggacccccggcgggggaggcggtggggctgtgcctggaatctctgccatgtcccggggagacctctctcagagagctaaagacctgtccaagaggtccttttccagccaacgtccagggatggaaagacaaaatcggcggccaggcccaggtgggaaggcaggctccagcggctccagctctggcggtggcggaggaggaccaggcggaagaaccgggccggggaggggcgacaagagatcatggccgagtcctaaaaatagaagtcggccacccgaggagcgcccgccaggtctgcctcttccaccaccaccccctagctcctccgccgtcttcaggctcgaccaggtaatccatagcaacccagcgggtatccagcaggcgctggcacagttaagttcaaggcagggctctgtcactgccccaggcggccacccgcgacacaaaccgggccccccacaggctccccaagggccatctccacgaccgcctacaagatacgagccccagagagtgaatagcggtctgtccagtgacccccacttcgaggaacccggtcccatggtccgcggggtcggagggacccctcgcgattccgcaggggttagcccattcccacctaagagaagggagcggccacctcgcaaacctgaattgctgcaggaggagtcccttcccccaccccatagctctggattccttggctctaaacctgaaggaccaggtccccaggccgagtccagagatacgggcaccgaggcacttaccccccatatttggaatcgcctccatactgcaacaagcagaaagtcatatcgacccagctcaatggaaccatggatggagcccctgtccccattcgaggatgtggccgggacagagatgtcacaaagcgactccggggtcgatctctctggagactcacaggtttccagtggaccttgcagccaacgatcaagcccggacgggggcttaaagggggctgccgaagggccacctaaacggcctggagggagctcgcccttaaatgctgttccttgcgaaggacccccagggagtgagcccccaaggcggccaccacccgcccctcatgatggcgatcgtaaggagcttcctcgagagcaaccgctcccccccgggccgattggcacagagcgttctcagcggacagatcgaggtactgagccgggccccatacgaccatcacaccgccctggaccacccgtgcagtttggcacctcagacaaggattcagatctgaggttagtcgtgggtgattctctgaaggcagaaaaagagctcacagcgagcgttaccgaggcaataccagtaagtagggactgggagctactcccctctgccgctgcttccgccgaaccacaaagcaaaaacctggatagcggccattgtgttcctgagccatcttccagcggccagcgcttataccctgaggtgttctacgggagcgcggggccttcctccagtcagattagcggcggcgccatggacagccaactgcaccctaactcaggcggatttcgacctggtacaccctccctacatccttaccgtagtcagcccctgtatcttccacctggcccagcgccaccttccgcactgctttcaggagttgcgcttaaaggccagtttctggacttcagtacaatgcaggctacagagctggggaagttgcccgctgggggggtcctctatcctccaccctcctttctctactcgccggccttctgcccatcccctctccctgatacgtccctcctccaggtgcgacaggacttaccttctccaagtgacttttacagtactcccctccaaccagggggtcagtcaggcttccttccctcaggggctccagctcagcagatgctgttacctatggtggactctcagttacccgtggttaattttggaagcctcccccccgctccaccaccggcaccaccacctctgtctctccttcctgtgggacctgcccttcaacctccaagtctggccgtgagaccccctcctgctcctgcgacaagagtcctgccctctcccgctaggccgtttcccgcgagcctgggccgggcagagctacaccccgttgagctgaaaccattccaagattaccaaaagctgtcctcaaacttggggggcccaggatcctcgcggacacccccaactgggagaagtttcagcgggctaaactcaaggcttaaagccaccccaagtacttattcaggcgtgtttagaacccagcgggtggatctttaccagcaggccagtcccccagatgcgctgaggtggatccctaaaccctgggagcgaaccggaccgccgcctcgggaggggcctagcagacgagctgaagagcccgggtctcgtggtgacaaggagcccgggcttccccctccacgatag

SEQ ID NO: 200840 - DNA, 6474 bp, Artificial Sequence
  Description of Artificial Sequence: Synthetic coding sequence
atgagcgaccggagcggccccaccgccaagggcaaggacggcaagaagtacagctctcttaaccttttcgacacatacaaaggtaagagcctggaaatacagaaacccgcagtcgctccaaggcacggccttcagtccctgggaaaggtcgcaatcgctcggaggatgcctccccctgccaatctgccttccttaaaggccgaaaacaagggaaatgatccaaacgtatctcttgttcctaaggacggcactggttgggcttctaagcaggagcagagcgaccctaagagctcggatgcgtctaccgcacagcctcccgagagccagccactgccagcgtctcagaccccagccagcaaccagccaaaacgccctcctgccgcacctgagaacacccctctggtgccttcaggtgtgaaatcttgggcccaagcatctgtaacacatggggcacatggtgacggcggccgagcatcttcactgctcagcagattttcccgcgaggaatttcctaccctgcaagccgccggggaccaggacaaggcggccaaggagagagagagtgccgagcagtcgtctggtcctggtcctagtctgaggccacagaattctactacttggcgggacgggggggggagagggccagatgaattagagggaccggattccaagctgcaccacggacacgacccacggggaggcctacagcctagcggaccaccacagttcccaccttacaggggaatgatgcctccgttcatgtaccccccttacctcccttttcctccaccatacggaccccagggtccgtaccgctaccccactccagacggcccctcaagatttccaagggtcgcaggcccacgcggcagcgggccccctatgaggttagtggagccggtgggcagaccgagcatcctaaaagaggacaatctcaaagagttcgaccaactcgaccaggagaatgacgacggatgggcaggggcccacgaagaagtggattataccgaaaaactcaaattttcagatgaagaagatggccgagactccgacgaagagggcgcagaggggcatcgggatagccagagtgcatccggtgaggagcgaccaccagaagccgatggtaaaaagggcaactctccaaatagtgagccgcccactcctaagacagcctgggcagaaacgtcccggccaccggaaactgagcccgggcctccagcgcctaagccgcctctgccacccccacaccggggtcccgccggaaactggggccctcccggcgactacccagaccgaggggggcccccgtgtaagcctccagcccccgaggacgaggacgaggcttggcggcagcgccgcaaacaaagtagcagtgaaatatccctggctgtcgagagggcgcgcagacgacgtgaggaagaggaacgtaggatgcaggaagagcgcagggccgcatgcgcagagaaactcaagagactggatgagaagttcggtgcaccagataagcgtctgaaagcggagcccgcagctccccctgcagctccatctaccccagccccaccgcccgccgtcccaaaagaactgcctgcgccccccgctcccccgccagcatctgcccctactccagagaccgagcccgaggagccagcccaggcgccccctgcccaatccacacctactcccggcgtagcggcagcaccaaccctggtgtctggtgggggatccacctcgagcacctcaagcggatccttcgaggcaagtcccgtggagcctcagctcccttccaaagagggaccagagcctcctgaggaggtgccgccacctaccactccacccgtccccaaggttgagcccaagggagatggtattgggcccacaagacaaccaccgagccagggtttgggctaccccaaatatcaaaagtcactgcccccgcgattccagcggcagcagcaggagcaactactgaaacagcagcaacaacaccaatggcagcagcaccagcagggaagcgctccacctacacccgttcctccatcaccaccacagccagtcacattgggcgccgtgccagccccgcaagcccctccacctccaccaaaagctctctatcctggcgcccttgggaggccaccacctatgccgccaatgaattttgacccgcggtggatgatgatccccccgtatgtggacccccgcctgttgcagggccgccccccactggatttttatccccctggcgtgcaccctagcgggttggtgcctcgggagcggtctgacagcggtggaagcagttccgaacccttcgatcgccacgcacctgccatgctccgtgaacggggaacacctccagttgatcctaagctggcctgggtgggtgacgtatttacggcaacaccggctgaaccacggcctcttacatcgcctcttcggcaggctgccgacgaggacgacaaaggaatgcgatccgaaacgccgccagtgccaccaccccctccttacctggctagctacccagggttcccagagaatggagcccccggccctccaatttctcggtttccgttggaggaaccaggtccgaggcctctcccatggcctcccggaagtgacgaagttgccaagatccagacacctccacccaagaaggagccacctaaagaggaaaccgcacagctgaccggccctgaagcaggcaggaaaccggcgcgcggagtcgggagtggcggacaggggccacctcccccgagaagagagtctaggactgaaacacgctggggacccagaccaggttcgtcacgtcgaggaatacccccagaagagcccggggcccccccacgcagggctgggccgatcaagaaacccccgcctccaaccaaggtagaagagcttccgccgaagccactggaacagggagacgagacccccaaacccccgaagcctgatccgctcaagatcaccaagggcaaactgggcgggcctaaagaaactccgcctaacggcaatctctctcccgccccaaggctgcgccgcgattatagctacgaaagggttggccctacatcctgtaggggacgcggccgcggagagtatttcgccaggggaagaggctttagagggacttacggcggaaggggtagaggggcgaggagccgtgaatttagaagctacagagaatttcgcggtgacgacggacgtggaggcggcacgggcggaccgaatcatccccccgctccaaggggccggactgcgagtgagacccggagtgagggctctgagtatgaggagattcctaagagacgcaggcagagaggctctgagacgggctccgagacgcacgagtccgacctcgcccctagtgataaggaggcccccacaccgaaggaaggaaccctgacacaggtaccacttgcccctcctccaccaggggcccctccatctcccgccccagctaggttcactgcaagagggggacgcgtattcacgccacggggggtgccctccaggcgcggacggggcggaggtcggccccccccacaggtctgccccggatggagcccaccggctaagagcttggccccaaagaagcctccaactgggcctctgccccctagtaaggagcctctcaaggagaagttgattccagggcctttaagtcccgtagctagaggggggagcaatggtgggtccaacgtagggatggaggacggcgagcggccccgccggagacgacatgggagagcgcagcagcaggacaagcccccgaggttccgtagattaaaacaggaacgcgagaatgctgcccgtggtagcgagggaaagcccagcctaaccttgccggcctcagcgccgggtcctgaagaggccctgaccacagtgaccgtcgctccagcacccagaagagccgccgcaaagtcccctgatcttagtaaccagaacagcgaccaggccaatgaggaatgggagacggcgtctgaaagttcagattttactagtgaacgccggggcgataaagaggcaccgcctcctgttcttctcactccaaaggccgttggaacacctggtgggggcggaggcggggcagtgcctggcattagtgcgatgagtcgcggagacctttcccagagagccaaggacctctccaagagatcattttcctcccagaggcccgggatggaacgccaaaatcggcggcccgggcccggagggaaagccggttcatccgggtcaagctccgggggcgggggcggtggacctggcgggcgcactggtcccgggcgtggggataagcggagttggccctctcccaaaaacaggagtagacctcctgaagagaggccccctggacttcctctcccccctccccctccttctagcagcgccgtatttcgattggaccaggtgatacactcgaaccctgccgggattcagcaggccctcgcccagctgtcaagtcggcaggggtctgttaccgccccggggggccatcccagacacaaacccggcctgccccaggcaccccagggcccttctccacgcccccccacaagatatgagccccaaagggtcaattcaggtctcagctctgacccccacttcgaagagcccgggccaatggtacgcggggtcggaggcacgccccgcgactcagccggggtgtcgcctttcccacccaaacgccgtgaaaggcctcctcgaaagcccgaactgctgcaggaagaaagcctgcccccccctcatagtagtggattcttgggctccaaacccgaagggccaggccctcaggcagagagcagggacaccggaaccgaggcgctgacaccacacatctggaaccgtctgcatacggcgacaagcaggaaatcttatcggccctcctcgatggagccgtggatggagccactgtctcccttcgaggatgtggctggcaccgagatgtcccagagcgactcgggggtggatctctctggggactctcaagtgtcatccggtccgtgcagccaacgtagttctcccgacggcggattgaagggagcagccgagggcccacctaaacggccagggggatcctcccctctcaacgcagtcccctgcgagggacccccgggtagcgaacctcctagacgcccaccacccgctccgcacgatggagataggaaggagctgcctcgagagcagcctctcccccccgggcccatcggtacagaaaggagtcagagaaccgatcgcggaactgagccgggccctatcaggccgtctcatcgccccggtccacccgtgcaattcggaacaagcgataaggactctgatctgcgtctggtggtgggagatagcttaaaggcagaaaaggagctgactgccagcgtgactgaggccatacccgtgtctcgagattgggaactgttaccctctgcagccgcctccgctgaaccgcagagtaagaatttggatagtgggcactgtgtgccagagccctcctcttccggacagcgtttgtatcccgaggtcttttacgggagtgccgggccgtcttcgagccaaatcagcggcggagccatggacagtcagctacatccaaacagcggcgggttccggcctggcacgccgtctctgcatccctatcgttctcagcccctgtacctgccacctggcccagcccccccatccgccctgctcagtggcgttgctctcaagggccagtttctcgacttttcgacaatgcaggctactgagctcggaaagctgccggccgggggagtgttatacccgcccccaagctttctgtactcgcccgccttttgtccttcccccctgccggacacctctctgctgcaggttcggcaggatctgccgtcacccagcgatttttatagcacaccattgcagcctggcggacaatcaggtttcctgcccagcggggccccagctcaacagatgctactgcccatggtggactctcaactgccagtggtgaattttgggtcactgccacctgccccccctcctgctcctcctcccctgtctttactcccggtaggcccagccctgcaaccaccgagcctcgcagttagaccgcccccagctcccgccacaagagtgctgccgtctcctgcaaggccctttcctgccagcctcggccgagcggagttacatcctgtggaacttaaaccattccaagattatcagaaattatcgtccaaccttggtgggcctggctcaagccgtacccctccaacaggccggagcttctctggcttaaacagccgccttaaagcaaccccctccacttatagtggagtgtttagaacacagcgagtcgatctgtatcagcaggccagtcctccagatgcgctgaggtggatcccaaaaccatgggaacggaccggaccccctcccagagaggggcctagccgccgtgccgaggaaccgggcagccggggcgataaagaacccggtctgcctccacctcggtag

SEQ ID NO: 200841 - DNA, 6450 bp, Artificial Sequence
  Description of Artificial Sequence: Synthetic coding sequence
atgagcgaccggagcggccccaccgccaagggcaaggacggcaagaaatactcttctctgaatctgttcgacacatacaagggtaaaagcctggagatccagaagcctgctgtggccccccgtcacggactgcagtccttgggcaaggtggctatcgctcgtcgaatgcctccaccggcaaatctgcccagtttaaaggcagagaataaagggaacgaccccaacgtttccctggtgcccaaagatggaaccggatgggcatccaagcaagagcagtctgaccccaagtcttcagatgctagtacggcccagcccccggagagtcagcctctgcctgcctcccagacccccgcttccaatcagcccaagcgccctcctgccgctccagagaataccccactcgtcccgagtggagttaaatcatgggcacaggcgagcgtgacacacggagcccacggggatggaggacgggccagttccctgcttagccgattttcccgagaggagttcccaacacttcaggccgctggagatcaggataaagcagctaaggagagggagtcagcagaacaaagcagcgggccagggccatcgctcagaccgcagaatagtactacctggcgggacggtggagggcgcgggccggatgagttagagggtcccgactcaaagttacaccatggacatgaccctcggggggggctacaaccttctggacctcctcagtttcccccgtatcgggggatgatgcctccttttatgtacccgccctacttgccttttccaccgccatacggaccccaaggaccctatcgatacccaactcccgacggccccagccgcttcccccgtgtcgccggcccacgggggtccgggccacctatgcgcctggtggaacccgtgggccgcccttccattctgaaggaggataatctgaaggagttcgaccagctggatcaggagaatgacgatggttgggctggcgcccacgaagaagtggactatacggaaaaattgaaattctcagacgaggaagacgggcgagattctgatgaagagggtgctgaagggcaccgggactctcaatcggcgagtggggaggagcggccacctgaggctgacggcaagaaaggcaatagccccaactctgagcctcccactcctaagacagcttgggctgaaacttccagaccaccggagaccgagcccggtccgcctgcccctaaaccccctctgccacctcctcacagaggtcccgccgggaactggggaccccccggtgattaccctgacagaggaggaccaccatgtaagccccctgcccctgaagatgaagacgaggcctggcggcagcgtcggaagcagtccagctcagagatatctctagccgtcgagcgggcacggcgcaggagggaagaggaagagcgcaggatgcaagaggagagacgcgctgcctgcgcagaaaaactaaaacgtctggacgaaaagttcggagctccagataaaaggttgaaagccgagcccgccgcccctccggccgccccatcgacgcctgctcctccccctgccgtgcctaaggaactgcccgctccccctgcacccccgccagcaagcgctcctactcccgagactgagcccgaggagccggctcaggctcctccagcacagagtactcctactcctggtgttgctgccgcaccaactctcgtgtctggcggcgggtccactagtagcacctcctccggttctttcgaagcttcacctgttgagccacagcttccatctaaagaaggcccagaaccacctgaggaagtacccccacccacaacacctcctgttccaaaggtggagcccaaaggcgacgggatcgggcctacccggcaaccaccatctcagggcttgggttatccgaagtaccagaagagcctgcccccccgcttccagcgtcaacagcaggaacagcttctgaagcagcagcagcagcaccagtggcagcagcatcagcagggctcggctccccccactcctgtccccccctcccctccccagcctgtaaccttgggcgctgtgccagccccacaggcccccccaccccccccaaaagctttgtacccaggggcgctgggcaggccacctcccatgccaccgatgaatttcgatccaaggtggatgatgatccccccttacgttgaccccagactgctgcagggcaggccacctctggatttctatcctcccggcgttcacccttcgggattggtgccccgtgaacgcagtgatagtgggggttctagcagcgagccgttcgacagacacgccccagctatgttgagagaacgcggcactccccctgtggaccccaagttagcatgggtgggagacgtctttactgcgacacctgctgagccccggccactgacttctccacttcgacaagcagccgacgaggacgacaagggtatgcggtcagagacccccccagtcccaccgccacctccttatctcgccagttacccagggtttcctgaaaacggtgctcctgggccaccgatatccagattccctctcgaggaaccgggccctcgccccctcccctggcctcccggtagcgatgaggttgctaaaattcaaacaccaccgccaaagaaggaacctccgaaggaagaaacggcccaactgacgggccccgaggccggacggaagcccgcacgcggtgtggggtctggtgggcaggggccacctccacctagaagagaatccagaacagaaaccagatggggacctcgtcccggatcttctagacgaggaattccacccgaggaaccaggggctccgcctaggcgagctgggccaattaagaagccgcctccgcccactaaggttgaggaattacctcccaagcctttagaacagggcgatgaaacacctaagccaccgaagcctgaccctctgaaaatcaccaagggaaagctgggcggcccaaaagaaacccccccgaacggtaatctttctccagcgcctcgattgaggcgggattattcctacgaacgggtgggtccaactagttgtcgcggtcggggccgcggtgaatatttcgcccgaggacgtggatttcgcggcacatacggtggccggggtaggggcgcggcaggtaattcagctgtcactgagtcattcgaagaaatgatgggcgttgaagtggggcagggggaccagactaccttacttttgcccgaggcagcactgcccgctagacacggtgctcgggtccagagcatgcgaaagtccccctcaggtgcaggcagtggggctcagaagcaggccgcccgccctatgagagtaatctggttgctgcaaacaagaagattaccccaccctaggcgcgagcactccccccgatctaggagcccaaccacaaggagcccaacatttccagctcctgcacgatttaccccaggtgtgggcgagagctcactgcccgaggggatctcccccggcccccgccgcagggagcccccccaggtctgccccgggtggtcgcctccggcaaagagcctcgctcctaaaaagccacctacaggtccactcccgcccagcaaagaaccactgaaggagaaactgattcccgggcccctatcccccgtcgcacggggtggctccaatgggggcagcaacgtgggaatggaggatggggagcgtccaaggcgtcgcaggcacggaagagctcagcagcaggataaacctcctcgcttccgtcggctaaagcaggagcgcgaaaatgcagctcgaggctccgaaggcaaaccctctctgacgttaccagccagcgctccgggaccagaggaggcccttactaccgtcacggttgctcccgccccaaggcgcgcagccgcaaagtccccggatttgtccaaccaaaacagcgatcaagccaatgaggaatgggagacggctagcgagagcagtgacttcacctcagaacgacgcggagataaagaggccccccccccagttctgctcaccccaaaggctgtcggaacacccggtggaggcgggggcggagccgttccaggcattagcgcaatgtctagaggcgatttgtcccagcgcgctaaggatctatccaagcgcagcttcagcagccagagacctggaatggaaagacagaacaggcgacccggcccaggcgggaaggcaggttcctcgggtagtagcagcggagggggtggtggcggacctggtggcaggacaggcccgggacggggcgacaagcgctcctggccgtcgcccaaaaataggtcccggcctcccgaggaaagacctcctgggctaccattgccccccccgcctccttcttcctccgcagtctttagactggatcaggtgattcactcaaaccctgcagggattcaacaggctctggcccagctgtcttctaggcagggttcggtcaccgcacccgggggtcacccaaggcataagcctggactgccccaagctccacaggggccgtctcctcgcccccccacaagatacgagccacagagggtcaatagcggacttagcagcgatccgcatttcgaggagcctgggccgatggtaagaggggttgggggaaccccacgggattccgccggcgtgagcccatttccaccgaaacggcgagaacggcctccccgtaagccagagctgctgcaggaggaaagtctcccgccgccccacagttctgggttcctcggcagcaagccagaaggacccggacctcaggctgaatcccgggatacgggcaccgaagcacttacgcctcacatctggaaccggcttcacacggccaccagtcggaagagctatagaccatcatctatggagccttggatggaacctctgagcccttttgaggacgttgctgggacagagatgtctcagtccgatagcggtgtggacctatccggtgattcgcaagtgtcctcaggcccttgctcacagaggtcttccccagacggagggctcaaaggagcggcagaaggcccaccaaaacgtccgggcggatcaagcccgctcaatgctgtgccatgtgaaggaccccctggctccgaacctccacggagaccgccccccgccccccacgacggggataggaaagaacttccccgtgagcagcctcttccacctggtccgattggaacagaacgctctcagcggacagaccgaggtactgaacctggtcctattcgaccatcgcatagacccggacccccagtacagttcgggacctcagacaaggacagcgacttaaggctggttgttggtgatagcctgaaggccgagaaggaattgaccgcttcggtaaccgaagccattcccgttagtagggactgggagcttctgccttcagctgccgcctctgcggagcctcagtcaaaaaatctagatagcggacattgtgtgcccgagccaagctccagcggacagaggctctaccctgaggtgttctacggcagcgccggcccgtccagtagccaaatctcggggggacacggcctgtcaatcactagtaagcaatggcgcagaccgggaaccccctctttacacccctaccgctctcagcccctttatttacctcctggtcccgcaccccccagcgcactactgtccggcgttgctttgaagggacagttcctggattttagcaccatgcaggccaccgagctgggaaaactgcccgctgggggtgttctgtaccctcccccaagcttcctgtattctccagcattctgtccatcacctctccctgatacatcactacttcaggtgagacaagacctcccaagcccttcagatttctatagtacaccgttgcagccaggtggacaatcaggctttcttccctccggtgcacccgcccagcaaatgctgctgcctatggtcgatagccagttgccggtcgtaaatttcggctctctgccaccagcaccacccccagcacctccacctttatcactgctccccgtcggtccagcactgcaacccccctctctcgcagtgcgacccccaccagctcccgcaaccagagtgctaccctctcctgctagaccctttcctgcaagcttggggagggctgaattgcatcccgtcgaactaaagcctttccaggattatcaaaaactatcgtcaaacttaggaggccccggaagttccaggactccgcccacaggtaggtctttttccgggctgaattcaaggctcaaagccaccccatccacctactccggggtgttccgcacgcagagggtcgatctgtatcagcaggcgtcaccacccgatgcgctcagatggattcccaaaccttgggagcgcaccggaccacctcccagggagggtccctccaggagagccgaggaacccggcagtcgcggcgataaggagccagggctgccaccacctcgttag

SEQ ID NO: 200842 - DNA, 1650 bp, Artificial Sequence
  Description of Artificial Sequence: Synthetic coding sequence
atgagcgaccggagcggccccaccgccaagggcaaggacggcaagaagtacagttctcttaacctgttcgacacttacaaggggaagtctctcgagatacagaagcccgcggtcgcacctcgccatggcctgcaatccctgggtaaagtcgcgatcgctaggcgaatgccacctccggctaacctccctagtctcaaggctgaaaataagggaaacgatcccaatgtttcactggttcctaaggatggcacgggttgggcctccaagcaggaacagtccgatcccaagtctagcgatgcatccacagcgcagcctcccgagtcgcagcccctacccgctagccagacacctgctagcaatcaaccaaaacggcctccggctgcaccagagaatacaccactggtgcccagtggagtgaagtcatgggcccaggccagtgtcactcacggagctcatggcgatggaggtcgcgctagtagtctgttatctagatttagtagggaggagttccctactctgcaggctgcgggtgaccaagataaagccgccaaagagagagagtccgcagagcagtccagtggccccggtcctagtcttaggccacaaaatagcaccacctggcgcgacggcggaggacgcggtcctgatgagctcgaagggcccgacagcaagctacatcacggccatgacccccgcggtggtctccagccctctggacctcctcagtttccgccttatcgtggtatgatgccccctttcatgtaccctccctacctgcccttccctccaccatatggcccccagggaccatacagatatcctacgcccgacgggccttccagattcccacgggtggcgggccccaggggctccggccccccgatgaggctggtagaacctgtgggtcgaccaagcatactgaaggaggacaatctgaaagaatttgatcagctcgatcaagagaacgacgatggctgggcaggagcccatgaggaggtagactacaccgagaagctgaaattttccgatgaagaagatgggcgcgattcagatgaagaaggcgccgaaggacaccgggattcccagtccgctagcggagaggaacgtccccccgaagctgacggcaagaaaggtaattcccctaattccgaaccccccacacccaagacggcctgggccgagaccagcagacccccggaaaccgagcctggaccaccagctcccaagccccctctgccgcccccacatcgcggacctgccggtaactggggaccacccggggattatccagatagggggggtcccccatgcaagccccctgcacccgaggatgaggacgaagcctggaggcaaagacggaaacagtctagtagcgagatctctctggccgtagagcgggccagacgcaggcgagaagaagaggagcgacggatgcaggaggagcggcgcgctgcctgcgcagagaaactcaaacggctggacgagaaattcggtgctcctgacaaacggcttaaggcggagcctgccgctcctccagcagccccaagcactcccgccccgccgcctgctgcctccgaggtgcctttaatggaggacagtcggggtcaacaacgtgatccacctcggggcctggaagcaccgcacccgtag

SEQ ID NO: 200843 - DNA, 6417 bp, Artificial Sequence
  Description of Artificial Sequence: Synthetic coding sequence
atgagcgaccggagcggccccaccgccaagggcaaggacggcaagaagtactcctcactcaacttattcgatacgtataaaggaaagtctttggaaatacagaagcccgccgtggcgccccgccacgggttgcaaagcctcggaaaggtagctatagccagacgcatgccgcctccagccaatctgcccagcctgaaggcagaaaacaaaggaaatgaccccaacgtcagcttggtccccaaagatggtaccggatgggcctccaagcaggagcagtctgatcctaagtcaagtgatgccagtactgcccagcctcccgaatcccagcctctccccgcttctcagacacctgctagcaaccagcccaagcgacctccagctgcgcccgagaatacgcccttagtgcccagcggcgtaaaaagctgggctcaggcctctgtcactcacggcgctcacggggacggaggaagagctagtagcctgttaagtcgtttttcaagggaagagttcccaacactccaggcagctggagatcaggataaagccgccaaggagagggagagcgctgaacaatccagtgggcctgggccaagtttacgtccacagaactctactacttggagagatgggggagggcgcggacccgacgaactcgagggtccggatagcaagctgcaccacggtcacgaccccagagggggcctccaaccttctggccctccacaatttcccccatacaggggcatgatgcctcccttcatgtaccccccctatctgccgttcccccctccttatggccctcaagggccttaccgctatcccaccccggacggtccctcgcgcttcccccgtgtggccggacctcggggtagtggtccgcccatgagactagtagagcctgtgggccgccctagcatacttaaggaggataatttaaaggagttcgaccaattagatcaagaaaatgacgacggctgggctggggctcacgaggaagtcgattataccgaaaaacttaagttcagcgacgaggaagatggccgtgacagcgatgaagagggggccgaggggcaccgagacagtcagagcgcctccggggaagaaagaccccctgaggccgatggcaaaaaggggaatagcccaaactctgaaccaccaactccgaaaaccgcgtgggctgagacctctaggcctccggagactgaaccaggccctccagcccctaagcctcctcttccaccacccggcgattacccagaccggggtggacctccttgtaaaccgccagcccctgaggatgaggacgaagcgtggcgccagcggaggaagcagtcatcatctgagataagtctggctgtggagagggcgcgacggcgcagggaggaagaggagcgccgaatgcaggaagagcgaagggccgcatgtgcagagaagttaaagcgtctggacgagaaatttggggctcctgataagagactgaaagctgagcccgcggcgccgcctgccgcacctagtacccccgccccacccccggcagtgccaaaggaactgcctgctccacctgccccaccgccagcctccgcccccacgcccgaaaaagagcccgaagaacccgcgcaagcgccaccagctcagtctacacccacccccggcgtagccgcagctcccaccctggtctcagggggtggctccacatcttccacaagctctggctcgtttgaggcctctcctgtcgaacctcagctgccaagtaaggaaggccctgagccaccggaggaagttcccccgcccaccacccccccagtccccaaagtggagcctaagggggacggtatcggtcccacccggcagccgcctagtcagggacttggatatccgaaataccaaaagtctcttccaccacgttttcagcgccagcaacaggagcagttgttgaaacagcagcagcagcatcagtggcagcagcatcagcagggctcagccccaccaacacccgtgcccccttcccctccacagccagtcaccctcggtgctgtgcccgccccccaggcaccaccgccaccgccgaaagccctttatccaggggctttgggaaggccccctcctatgccgccaatgaattttgatccacgctggatgatgataccaccctacgtggatccacgactgttgcagggaagaccgccccttgacttctatccccccggcgttcaccccagcgggttggtgccaagagagcgctcagatagcggtggctctagctcggagccattcgatcgacatgctccggctatgctccgtgaacgcgggacgcctcctgtcgatccgaaactggcttgggttggagatgtttttacagcaacccccgcagagcctcgaccactgaccagtccgttgcggcaagctgccgacgaggacgataagggaatgagaagtgaaactcctccggtgccccctccaccgccctatctggcaagttatcccggttttccagaaaatggcgccccaggcccccctatctcccggttcccgctggaggagcctggccctagaccgctgccttggccaccaggttccgacgaagtcgctaaaatccagacccctcctcccaaaaaagaaccacctaaggaggagaccgctcaactcacgggccccgaagctgggcgtaagcccgccagaggcgtcggaagtggtggacagggcccacccccgccccgccgcgaatcccgtaccgagactaggtggggtcctaggcccggatcgtcgaggcgaggcatacccccggaagaaccaggagcccctccccggagagctggacccattaaaaagcctcctccgccaacaaaggtcgaagagctcccccctaaacctttagagcaaggagatgagacaccaaagccgcccaaacctgatccactgaaaataaccaagggcaagctcgggggccccaaagagactcctccaaatgggaacctgagccctgccccacgtttaaggagagattattcatatgaacgggtggggcccaccagctgtcggggaagaggacggggtgagtattttgctagaggccgaggcttcagaggcacatacggcggtcgtggccgcggcgccgcgggcaatagcgccgtaacagagtcctttgaggaaatgatgggagtcgaggtggggcagggggaccagacaaccctgctcctaccagaggcggccctgccagctcgccatggcgcgcgcgtccagtctatgagaaagagcccgagcggagccggcagcggagcccagaagcaggccgcacgacctatgcgcgttatctggctgctgcaaacgcgtaggcttccccatccaagacgcgaacactctcctcggtccaggagccctaccactcgctcacccactttccctgcacctgcaaggtttacacccggggtcggcgaaagctccctccctgaggggatctctcccgggcctcgccgccgcgaacctccccaggtgtgccctggctggtcccccccagctaagtccctagcacccaaaaaaccgccaacagggccactgcccccaagtaaggaacctctaaaggaaaaattaatcccaggaccactatccccagtagccagaggtggatcgaatggtgggtccaatgtcgggatggaggacggtgaacgaccaaggcgaaggagacatgggagggctcagcagcaggataagccaccccggttcaggcgcttgaagcaggaacgagagaatgctgcccgtggctcagaagggaagccatccttaacacttcccgcctccgccccaggacccgaggaagccttaaccactgtaaccgtggcaccagccccaagaagagcagccgccaaatcacccgacctctccaaccagaactctgaccaggccaacgaagagtgggagactgcctcagaatcctccgacttcaccagtgagagacggggagataaagaagcgcccccacccgtgctgcttactcccaaggccgtcgggacgccagggggggggggtggcggggcagttcccggtatcagcgcaatgtcccgcggagatttgagtcaaagggctaaggacctgtctaagaggagcttttcgagtcagaggccaggtatggagcgacagaatcgtagaccgggccctggtggaaaggccggtagcagtggcagcagctccggcggcggtgggggcggacctgggggccgcacaggcccgggtaggggagataaaaggagttggccaagccccaaaaaccgatctcgtccacctgaggagagacctccaggactgcccttgccacctccgcctccttcatcctccgctgttttccgtttggaccaagtaatccactctaatcccgcggggattcagcaggccttagcccagctcagctccagacaaggcagcgttaccgccccaggggggcaccccagacacaaacctggcccgccacaggctcctcagggtcccagtccaagacccccaacccgctatgaaccgcagcgcgtaaattcgggtttgagctcagatccccattttgaagaacctggccccatggtcagaggcgtaggcggcaccccaagggatagtgcaggggttagcccattccctccgaagcggcgggagcgccctccccgcaagccagaactcctccaggaagagtcactcccgccgccccactcgagcggatttctgggctccaagccagagggtcctggacctcaggcagagtcccgagataccggcaccgaggcgctgacgcctcacatatggaaccgtttacacaccgccacaagcaggaagtcataccggcccagcagcatggaaccatggatggagcctctgagtcccttcgaagacgtcgctggcaccgaaatgtcacaaagtgacagcggcgtggatttgagcggagattctcaggtatcttcaggaccttgctcccagagaagttcgcccgatgggggccttaagggcgcagctgaagggcctcccaagcgtcccggaggatcctctccactgaacgctgtgccttgtgaaggccctccaggttcggagcctcctaggaggcctccacccgctccgcacgatggtgacaggaaagaattaccgcgggaacaaccgctccctccaggacctatcggcacagagcggtcgcaacacactgacaggggaactgagcctggacctattcgccctagccaccggcccggccccccagtacagtttgggacgagtgataaggattcagacctgcgcttagtggtgggagactccttgaaggctgaaaaggagctcaccgcatctgtgacagaggccatcccggtctccagggattgggaactgctgccatcagctgcagccagcgccgagccacagagcaaaaacctcgatagcggacattgcgtgccagagcccagctcgtcagggcagcgtttgtatcccgaggtattttacggatcagcagggcctagctcttcccagatcagtgggggtcacggcctgtctgttacatccaagcagtggcggagaccgggaactccaagcttgcacccgtatcggagccaaccactgtatcttcctccggggcctgctccaccctctgccttgctgagcggagttgcgctcaaaggtcagttccttgacttcagcacaatgcaggccacagagctgggcaagttaccggcaggaggggtgctctacccgcccccctcattcctgtactcacctgctttttgtccctctcccctccccgatacaagcctcctgcaagtgcgtcaggatctcccaagcccatcggacttttacagcaccccactgcaaccaggtggccaaagtggctttttgccttccggagcaccagctcagcaaatgttactgccaatggtggactctcagctgcccgtagttaactttgggagcttaccacctgcgcccccccctgcacctcctagcctgagcctcctgcctgtcggccccgctttgcagcctccaagcctggccgtacgccctccaccggccccggccacaagggtgctgccatcccctgcccggccgtttccggcttcccttggccgggccgagctgcacccagtcgagctgaaacccttccaggactatcagaagcttagtagcaatctgggaggtcctggttccagtcggacaccgcccaccggcagatcgttctccggactgaacagccggctgaaggccaccccatccacttattccggtgtatttcggacccagagggtggacctgtaccagcaggcctctccccctgacgctctacggtggatacccaagccgtgggaacggacaggtccaccgcctagagaagggcctagcagaagagcagaagagcccgggtcacgaggggataaggagcccggcctgccccctccacgatag

SEQ ID NO: 200844 - DNA, 6450 bp, Artificial Sequence
  Description of Artificial Sequence: Synthetic coding sequence
atgagcgaccggagcggccccaccgccaagggcaaggacggcaagaaatactcatctctgaacctgttcgacacatataaaggaaaatctctcgaaatccagaaacctgcagtcgcccctcggcacggactccaatctctcggcaaggtagccattgcccgcagaatgccacctccggccaacctgccgtccttaaaagcagaaaacaaaggcaacgacccaaacgttagcctggtacctaaggatggcacaggatgggcatcaaagcaagagcaaagcgacccaaaatctagtgatgcatccactgctcagccccctgaaagccaacccttaccagcgagtcaaaccccggcctcaaatcagcctaaaaggcccccagctgcgcctgaaaacacgccacttgtgccgagtggggtaaagtcctgggcccaggctagcgtgactcacggagcccacggcgatggaggtcgcgcttcttctcttctgtcccgcttttctcgggaggagtttcccacgctgcaggctgccggggaccaggacaaggctgcaaaggaacgtgagtccgccgagcagagttctggacctggtccttcattgcggccccagaacagcaccacatggcgtgatgggggggggcgcggtccagatgagcttgagggcccggattcgaagttgcatcacggacacgatcctcgcggtgggctgcagccttcagggcccccccaatttcccccttatcgaggtatgatgccgccgtttatgtaccccccctaccttccattcccgccgccctacgggccccaggggccatacaggtatccaactccagacggcccatctcgattcccccgcgtcgcgggaccgcgggggtcaggtcctccgatgagattggttgagccagtcggacggccttcgatcttgaaagaagacaatctcaaggaatttgatcagctggaccaggaaaatgatgatggttgggcaggcgctcacgaagaagtggactacaccgagaagcttaagtttagtgatgaagaagacggtcgggactctgacgaggaaggcgctgaaggtcacagagacagtcagagcgcatcaggcgaggagcgtccgcctgaggccgacggaaaaaagggtaattcaccaaatagtgaacctcctactcctaagaccgcctgggccgaaacttctcgccctccagaaaccgagcccgggccacctgctccaaagcctcctcttccaccgcctcatcgcggcccagctgggaactggggcccacccggtgattaccctgatcggggaggaccaccatgcaagcctcccgcacccgaggatgaagatgaggcctggagacagagacgtaagcagagcagttctgagatctcacttgcggtcgagcgggccaggagacgccgagaggaagaggaaagaagaatgcaagaggagagaagagcagcttgtgccgagaagctcaaacggctggatgaaaagttcggcgcacctgataagcgcctgaaggctgaaccggcagcacctcccgctgcgccaagcactcccgccccaccccctgccgtacccaaggaactgccggccccacccgcccctccccctgcctcggccccaaccccagagaaggagcctgaagaacctgctcaggctccccctgctcagagcacccccacaccaggtgtggctgcagccccgacacttgtatcaggtggcgggtccacatcgtcaaccagttccggttccttcgaggcatcccccgtggaacctcagttaccttctaaggagggaccagagccgccagaggaggttccgccccccactacgccaccggtacctaaagtcgaaccaaagggggacgggatcgggccaaccagacagccccccagccaaggcctggggtacccaaagtaccagaaatctctgcctccacggtttcagcgccaacagcaagagcagctactgaaacagcagcagcagcaccagtggcagcaacaccagcaggggtctgcccccccaacccccgtgcccccctccccacctcagcctgtgacactgggagctgtcccagcgccgcaggctccaccccctccccctaaagctctgtacccgggtgcgttgggaagaccaccccctatgccacccatgaatttcgacccaagatggatgatgatccctccatacgtggatccccggctgttgcaaggtcgcccccctttagacttttatccacccggcgtccatccgagcgggctggtgcctcgggaaagatccgatagcggaggcagttcatcagagccttttgatcggcacgcgccagccatgcttcgagagcgtggcaccccgcctgtcgaccccaaacttgcttgggtaggcgacgtgtttactgccaccccagccgaaccgaggcctctcacgtcccctttgcggcaggcggccgatgaggatgataaggggatgagatctgaaacaccgccggtgccccccccccccccataccttgccagctaccctgggttcccagagaatggggctcccggaccacctattagcaggtttcccttagaggagcccgggccgaggcccctgccctggcctccaggatcggatgaagtggcaaaaattcagactccccctcccaagaaagagccccccaaggaagaaactgcacagttaactggacccgaggccggacgaaagccagcacgcggagtgggcagcggtggccagggcccaccgccccctcggagagagtcccgcacagagacacggtggggtccacggccaggttcctcccgtcggggaatcccacctgaagagcccggggccccgccaagacgcgctgggcccataaagaagcccccaccgcctacaaaagtcgaggagctgccacctaagccgttggagcaaggggatgagacccccaaacctccaaaacccgatcccctcaagatcacaaagggaaaactaggcggccctaaagagacaccccccaatggtaacctgtccccagcaccacgcctgagacgcgattactcttacgagcgagttgggcctacatcttgcagaggtcgtggaaggggggagtattttgctcgggggcggggtttccggggtacatatggagggcgtggaagaggggccgctggcaactccgcagtgactgagagcttcgaggagatgatgggtgttgaagtaggccagggagaccagacgacccttctgctaccggaggcggctctgccggcccggcacggggctcgcgttcaatccatgcgcaagtccccatccggcgctgggtccggagcacagaagcaagccgcaaggcccatgagggtaatctggctgctgcagactcggcgactaccacatccgagacgtgagcacagccctcggtcacgatccccaacaactcggagtccgacctttccagccccagctcgattcactcctggggtgggggagagttcactgccagaaggtatcagcccgggtccacggaggagagagcctcctcaggtgtgccccggttggagtcctcctgctaagtcactcgcaccaaagaaaccgccaaccggacccctgcctccaagcaaagaaccactaaaggagaagctgattcctggcccgttgagtcccgtggccagaggaggatccaatggggggagcaatgtaggcatggaggatggggaacgcccacgccgtcggcggcatggaagagcgcagcagcaggacaaacccccaagattcagacggctgaagcaggaacgagaaaacgctgccaggggctccgaaggcaaaccgtcactcacgctccctgctagcgctccaggccccgaagaggctctgacaacagttaccgtggctccagcccctcggagggccgccgcgaaatctcccgatctgagcaatcaaaattccgatcaggctaacgaggagtgggaaactgccagtgaatcctccgacttcacatcagagcgccggggagacaaggaggccccacctccagtactccttacacctaaagccgtgggaacccctggtggaggcggtggcggagccgtgcccggcatctctgccatgagccggggggacctgtcacaaagggccaaggatctgtctaaaaggtcattttcctcacagcgccccggcatggaacggcagaatcggagacccgggcctggcgggaaagcgggttcctctggaagctcttccgggggggggggaggaggcccagggggtcgtaccggtcccggcagaggcgacaaacgcagctggccctcccccaaaaatcgctcgcggcctcctgaggagcgtccccctggcctgcctcttcctccaccacccccgtcatcgtccgccgttttccgtctggaccaggtcattcatagtaatcccgctggcatccagcaagcgctcgcgcagctgtcatcacgacaaggatctgtaactgcgcccggcggtcaccctcggcacaagccagggccccctcaagcccctcaggggccaagcccaaggcctcctactagatatgaacctcaaagggtcaactccgggctgtccagtgatccacatttcgaggagcccggcccgatggtgagaggcgtagggggtactcccagggatagtgccggcgtgagtccctttccacctaagagacgcgagcgccctcctcgaaagcctgagctcctacaggaagaatctctgcctcctccacactcatccggcttcctggggtctaaacctgaggggcccggaccccaggcagaatcacgtgacaccggtactgaggctctcacaccccatatatggaaccggctgcacaccgccacatctcggaagagttatcgcccaagctcaatggagccatggatggagcctttgtctcccttcgaagacgtggcgggaactgaaatgagtcagtcagacagcggagtggatctcagcggagactctcaggtatctagtggaccttgcagtcagagaagttcccccgatggaggcctgaaaggtgccgctgagggaccacctaaaagacccggtggttcaagtccactgaacgctgtaccctgtgagggtcccccaggctcagagccccccagaaggccacctcccgcgccacacgatggtgaccggaaggaacttccaagggaacagcctctgccccctggtccaatagggacggagcgtagtcagcatacagacagaggcacggagccgggaccaataagacccagtcaccgtccagggccccccgtgcagttcgggacaagtgataaagattctgacctcaggttggttgtgggcgattcattgaaggcggaaaaggaactgaccgctagcgtaaccgaagccatcccggtgagccgagactgggagttactgccttcagccgccgcctctgccgaaccacaatcaaaaaacctcgattctggccactgcgtccccgagccgagtagttccgggcagcggctatatcccgaggtcttctacggctccgcagggccctcatcctctcagatcagcgggggtcacggcctcagtgtgacatccaaacaatggcgtcgtcctggcacaccgtctttacacccataccgctcccagccactctacctacctcccggtccggcccctcctagcgccctgctgtccggggtggctctgaagggtcagttcttggacttttccacgatgcaggccacagaactagggaagctgccggccggcggagttctgtacccgccaccctcttttctgtactctcccgcattttgtccttcgcccctgccagacacaagccttttgcaggtgcgccaggatctccccagcccgagcgatttctattctaccccacttcagccagggggacagtccggtttcctgccttccggcgccccagcacagcagatgctgcttcctatggttgactcacagctgcccgtggtgaattttggttcgcttccccctgccccaccgcccgcgcctccttccctgtctttgctcccggtgggacccgcactgcagcctcccagtctggccgtacggcccccgccagctcccgccacaagggtgctgccgtcacccgctcgtccatttccggcaagtctgggaagagccgaattgcatcccgttgaactgaagcccttccaggactatcagaaactctccagcaacctcggtggacccgggagttcccgaaccccaccgactggccggtctttcagcggactgaacagccggctcaaagccaccccttcaacatacagtggcgtcttcagaactcagagggtggacttgtatcaacaggcctcccctccggacgccctacgatggatacctaagccttgggaaagaaccggtcccccaccccgggaaggcccctcccggcgcgccgaggagcccggatcccgaggcgacaaggagcctggtctccccccacccaggtag

SEQ ID NO: 200845 - DNA, 1650 bp, Artificial Sequence
  Description of Artificial Sequence: Synthetic coding sequence
atgagcgaccggagcggccccaccgccaagggcaaggacggcaagaagtatagcagcctaaacctgtttgacacctacaaggggaaatccctggaaatccagaaaccagctgtagcccccagacacgggctgcagtcactgggtaaggtggcaatcgccaggcggatgccccctcccgctaacctgccttctctgaaagctgaaaataagggcaatgatcctaatgttagtttagtccctaaggatggcaccggatgggcttcaaagcaagagcagagcgatcccaagagcagtgacgctagcaccgcacaacccccagaatcccagcccctccccgccagccaaacgcctgcttctaatcagccaaaaaggccccccgccgctccggagaatacgccattagtcccttctggagtcaaatcatgggcccaggcaagcgtcacgcatggggcccacggggacgggggacgggcgagctcattattatctaggtttagtcgtgaggaattccctacactacaagcagctggagaccaagataaggccgcgaaggagagggagagcgccgaacagtcttccggacctggcccctccctgcgcccccagaactccaccacctggagagatgggggcgggcgggggccagacgagctcgagggccccgattctaagctacaccacgggcatgatccgaggggaggactgcagccttccgggccaccgcagttcccaccctacagggggatgatgcccccctttatgtatccaccttacctcccttttccccctccctacggcccacaaggtccatacaggtaccccacccctgacggaccctcccgatttccccgcgtcgcaggaccacggggctcgggcccacccatgaggctggtggagccggtgggccgcccaagcatattaaaagaagacaatctgaaggagtttgatcagcttgaccaggagaacgacgatgggtgggcgggagctcatgaagaggtggactataccgagaagctcaaattcagcgacgaagaggacggtagagacagcgatgaggaaggagcggagggtcaccgcgacagtcagagcgctagtggcgaagagagacctcccgaggccgacggcaagaaaggcaattctcctaattccgagccgccaaccccaaagaccgcctgggcggaaacctccaggcctcctgaaaccgagccagggcctccagcccctaagccaccgttgccacccccgcaccgcggccccgccggcaattggggtccgcccggtgactaccccgaccggggtgggccaccgtgtaaaccacccgcccccgaagatgaagatgaggcctggaggcaaaggcgtaagcaaagtagttccgagatttctcttgcagtcgaaagggccagacggcggcgggaggaggaggagagacggatgcaggaggagcgccgcgcagcgtgtgcagaaaagctgaagagactcgacgagaagtttggggcccctgacaaacgtttgaaggcagaacctgccgctcctccagccgcaccatctacgcccgcccccccacccgcggcctcagaggttccactgatggaagactccaggggccagcagagagaccctccaagagggttggaggctcctcacccatag

SEQ ID NO: 200846 - DNA, 1650 bp, Artificial Sequence
  Description of Artificial Sequence: Synthetic coding sequence
atgagcgaccggagcggccccaccgccaagggcaaggacggcaagaagtacagttccctgaacctgtttgacacttacaaagggaaatctctcgagatccaaaagccagcggttgctcctcggcacggtctgcaatccctgggtaaggtggccatcgcacgacggatgcctccacccgccaacctgcccagtctcaaggccgaaaataaaggtaacgacccaaacgtgagtctggtgcctaaagacggtacggggtgggcatcgaagcaggaacaatcagacccaaagtccagcgacgcaagtacagctcagcctcctgaaagccagcccctgccagcatcacagacacccgcctccaaccagcccaaacggccacctgccgctccagagaatacacccctggttccttctggagtgaagtcgtgggcacaggccagcgtcacacacggggcccacggtgacggcgggagggcatcctcattattgtctagatttagcagggaggaatttcctacacttcaggctgctggagaccaggataaggccgccaaagagcgtgagtctgctgagcagtcatctggaccaggaccatctctgcggccccaaaacagcacaacctggcgagatggaggaggaagggggcccgacgaactggaggggcccgattcgaaacttcatcacggacatgaccccaggggaggactacagccaagcggcccccctcaatttccaccataccgaggcatgatgccaccctttatgtaccccccatatctgccctttcctccgccctacggacctcaaggcccatacaggtaccccactcctgacggacccagcaggtttccccgggtggcaggtccacggggcagtggacctccgatgcgtctggtggaaccagtaggcaggccaagtatcttaaaagaagataatctgaaagaattcgatcagttagaccaagagaatgacgatggctgggcgggtgcacatgaggaggtagattacacagagaagctgaagttctctgacgaggaggacggccgagattccgacgaagaaggcgccgagggccaccgagacagccagagtgcttctggcgaagagcgcccaccagaggctgatggaaagaaaggtaatagtccgaattccgagccccccactccaaaaacagcctgggcggagacctccagaccacctgaaacagaaccagggccaccagcacccaaacctccactcccccccccccacagaggccccgccggcaactgggggccccctggagactatcccgacaggggcggcccaccctgtaagccacccgctccggaggatgaagatgaagcttggagacagcgccggaaacagtcatccagcgaaattagcttggcagtcgaacgggctcggcgccggagggaggaagaagagcgccgcatgcaggaagagaggcgggccgcctgtgcagagaagctgaaacgcttggatgagaaatttggagcccctgataaaaggttgaaagcggagccggcggcaccgcctgcagctccatccacacctgctccaccgcctgctgccagcgaagtccctctcatggaagacagccgggggcagcagcgtgaccccccccggggtttggaggctccacatccgtag

SEQ ID NO: 200847 - DNA, 4149 bp, Artificial Sequence
  Description of Artificial Sequence: Synthetic coding sequence
atgctgcgggagcggggcaccccccccgtggaccccaagctggcctgggtaggggatgtcttcaccgccactcctgcggagccacgacccctaacctctccacttagacaggccgcggacgaagacgacaaaggcatgagaagcgagacccctccggtcccacctcctcccccatatctcgcgtcttacccgggctttcccgaaaacggcgcgcctggcccaccaatttctcggtttccactcgaggagcccggccctaggcccctgccttggccacccggcagcgacgaagtggctaaaattcaaacaccacctccaaaaaaggagccccctaaagaggagacagctcagctgacagggcctgaagcaggacgcaaaccagctcgtggagtggggagcggagggcagggcccacccccccctagacgcgaaagccggacggagacccggtggggcccccggccaggctcaagcagaagggggattcccccagaagagcccggagctccccctcgaagggccgggcccatcaaaaagccaccaccgcctacaaaggtggaagaactcccgccgaagcctctcgagcagggggatgaaacgccaaaacctcccaagccagatccccttaagatcaccaaggggaagctgggggggccaaaagaaactccccccaacggaaatctgtcacctgccccgcgtttgaggagagactatagttacgagagggtcggccctacctcttgcagagggcgcggacgcggcgagtacttcgcccgtgggaggggattccgcgggacatacgggggtcggggccgaggggctcgaagtcgcgagttcaggtcataccgtgaattccggggagatgacggtagaggtggcggtaccggcggacctaaccacccaccagcccctagaggccgaacagcctctgagactagatctgagggttcagagtacgaggaaattcccaagagacggaggcagagaggatcagaaacaggctctgagacacatgagagtgacctggcaccaagcgacaaagaagcacccactcctaaagagggaaccctgacacaagtgccgctggcccctccaccccccggcgcacctccgagccccgcccccgcacgctttaccgctagaggaggaagggttttcacgcctaggggagtgccatcccggcgtggcagaggcgggggcagacctccccctcaggtctgccctgggtggtctcctcccgccaagagcctcgcgcctaagaagcctccaactggccctttaccacccagcaaggagcccctcaaggagaagctgatacccggaccactgagccccgtcgctcgcggcggttctaatggcggatccaatgtaggaatggaggacggcgaaaggccacgtcgtcgccgtcacggacgggctcagcagcaagacaagcctccacggttcaggaggctgaagcaggagagggaaaatgcagcccggggctcggaagggaagccgagccttacgctgcccgcttcagctccgggccccgaagaggctctaaccaccgttactgtggcacccgcccctagacgggccgcagccaagagccctgatctgagcaaccagaattctgatcaggctaatgaggagtgggaaactgcatctgaatctagcgatttcacgtccgagcgccgcggagacaaagaagccccaccacctgtgctactcacaccgaaagcagtgggtacgcctggcggaggcggcggcggggctgtacccggcatcagcgcaatgagtcgcggagatctgtctcaacgggcgaaagacctgagtaagcgctcgttctccagccagcgcccaggcatggaacgccaaaaccggcggcccgggcccggtggcaaggcagggtcaagcggcagttctagtggcggtggcggaggcggaccaggaggcagaactggaccgggccggggggacaagcgatcctggcccagtcccaagaataggagtaggcctccagaggaacgacccccagggctgcctcttcctcctcccccaccctcaagctccgccgttttcaggctggatcaggtcatccattccaatccagctgggatccagcaggcgttggcacagctcagttctcgccagggcagtgtaaccgcaccgggcgggcatccacgccacaaacccggcccccctcaagcaccacagggcccatcccctaggcctcccactcgttatgaacctcagagagtcaactcaggtctgtcctcagaccctcattttgaggagccaggaccaatggtgaggggcgttggtggcaccccgagggactcagcaggcgtctctccatttcctccaaagaggagagagcgaccacctcgtaagccagaactgcttcaggaagagagccttcccccgccgcatagctcaggatttcttggttcaaagcctgagggaccgggaccgcaggcggagagccgcgataccggcactgaagcactgacccctcatatatggaaccgcctgcataccgcaacctctcgaaaatcttataggccatcctctatggagccttggatggagccactcagcccattcgaagacgtggccgggactgagatgagtcagtctgacagtggggtggatctctccggagattctcaggtctcttcaggcccatgtagccagcggtcatcccccgatggcgggctgaagggcgcggctgaaggtccaccaaagcgccctggaggaagctcacccctgaacgccgttccttgtgagggacccccggggtcagagccaccacggcgaccccctccggcgccccatgatggggacagaaaagagctcccccgcgaacaacctctgcccccaggcccaattggcacagagcggtctcagcacacagatcgggggacagagcccggccctatccggcctagccacagaccagggccacctgtgcagtttggtaccagcgataaagatagcgacctgagacttgttgttggagacagtctgaaagccgagaaggaactgacagcttcagtgacagaggccattccagtgtctcgagactgggagttgctgccgagcgccgctgcatctgctgaaccccagagcaaaaacctggacagcggacactgtgttccagagccaagtagctctggtcaacggctctacccggaagtattttacggctccgcgggaccctccagctctcagatctcaggtggagcaatggattcacagctgcaccctaatagcggtgggttcaggccagggacccccagtttacacccctacagatcccagcctttgtacttgcccccaggtcccgcaccgccatccgcactgctgtccggagtagcgctcaaggggcaattcctcgattttagcaccatgcaagccacggaactgggcaagctaccagccggcggagtcctttaccccccgcctagcttcctgtattcacctgctttttgcccttcccccctgccagacactagcctgctccaggtgagacaggatctgccatctcctagtgacttttacagcactcccctgcaaccaggtggacagagcggtttccttccctccggggccccggcccagcaaatgctgcttcctatggtcgattcacagctgccagtggtgaactttggatcactgccgcccgcgcccccacctgcccccccaagtttgagtctactacccgttggaccggccctacaacctccttcccttgcagtcaggccaccgcctgcgccggctacccgagttcttccgtcgcctgcccggccatttccagccagcctaggtagggccgaacttcatccagtggagttaaagcctttccaggattatcagaagttatctagcaatctggggggcccaggaagctctcggacacctcctacgggacggtctttcagcggtttgaactctcgcctgaaggctacaccctctacatactccggggtgtttaggactcagagagttgacctttaccagcaggccagcccaccagatgccctgaggtggattcccaagccatgggaaagaacaggtccccctcctagagaggggccaagtcgccgcgccgaggagcccggcagccgcggagataaggagcctggtctgcctcccccccggtag

SEQ ID NO: 200848 - DNA, 6417 bp, Artificial Sequence
  Description of Artificial Sequence: Synthetic coding sequence
atgagcgaccggagcggccccaccgccaagggcaaggacggcaagaagtattccagcctgaatctgtttgacacctataagggcaagtccctcgagatccagaagcctgcagtagcgccaagacacggattgcagagcctcggcaaggtcgctattgcaagaagaatgccccctccagccaacctccctagtttgaaggccgaaaacaagggcaacgaccctaatgtctctttagtgcccaaagacgggacaggatgggcatccaaacaggagcaaagcgatcccaaatcaagcgacgcgtccaccgcccagccactggagtcccagccgctgcctgccagccaaacgccagctagcaatcagccaaaacggcctcccgctgctccggagaacactcccctcgtgccgtccggagtgaagtcctgggcccaggcgagtgtgacacatggggcccacggtgatggcggcagggccagtagtttgctgagtagatttagtcgtgaggaattcccaaccctccaggcggccggcgaccaggataaggctgccaaagaacgagagtccgcggagcagtcatcaggcccaggaccttcacttaggccccagaacagtacaacctggcgagacggcggcggtagaggtcctgatgaactggaaggccccgactcaaagctccaccacggacatgatccaagaggtggccttcagcccagcgggcctccacagttccccccataccgaggaatgatgccccctttcatgtacccaccataccttcccttccctccgccctacgggccccagggcccctatcgataccccactcccgacggaccctctcgctttccacgcgtggcaggaccaagaggttccgggccacctatgaggctggtggaacccgtcggacgcccctctatactcaaagaggacaacctcaaggagttcgaccaactggaccaggaaaatgacgatggttgggctggagctcatgaagaggtcgactatactgagaagcttaagttcagcgatgaagaagacggaagggattccgatgaagagggagccgaggggcatagagatagtcagtcagccagtggcgaggagcggcctcctgaagctgacggaaagaagggcaattcacctaactctgagccaccaacccccaagacggcttgggctgagacaagccgacctcctgaaacagagccggggccgccagctcccaaacccccccttccacctccaggcgattacccagatcgtggtggcccgccttgcaaaccgcccgcccccgaggacgaagatgaggcctggagacagagacggaagcagtcttccagtgagatctccctggccgttgagagagccagaaggagacgggaggaggaagagcggaggatgcaggaggagaggcgagccgcctgcgccgaaaaactgaagagattagacgaaaagtttggggcccccgacaaaagactgaaagcagagcctgctgccccccctgcagcacccagcacccccgccccaccaccggcagtgcctaaggaactgcccgccccccccgcgccgcccccggcctcggcccctacgcctgagaaggaaccagaagagcccgctcaggcgccccctgcacagtctacccccacccccggtgttgccgcagcgccaaccctggtctctggtggaggtagtacttcctccaccagctctggttcatttgaagccagtcccgtagaaccgcagctgccgagcaaagagggacctgagccgcctgaagaagtgcctccacctactactccgcctgttcccaaggtcgagcccaaaggagatggcatcggccccacccgacagcccccttcacagggtctgggctatcccaaatatcagaagtcactgcctccccgcttccagaggcagcagcaggaacagcttctgaagcagcagcagcagcaccaatggcagcagcaccaacagggttccgcgcccccgactcccgtgcctccttcaccgcctcagcctgtgacactcggggctgttcctgccccccaagcccctccacctcctcccaaggcactgtaccctggtgctttgggccgtcccccacctatgccacccatgaacttcgaccctcggtggatgatgattccaccatatgttgatccccgcttgctgcagggtcggccacccctagacttttacccacctggagttcacccctctggattagtgccacgcgagagatccgatagcggcggcagttcaagtgagcctttcgataggcatgcgccggcaatgctccgcgaacgcggaactccacctgtggatcctaaattggcgtgggtgggggatgtattcacagctactccagccgagccacggcccttgacatcacctttgaggcaggcagccgatgaggatgacaaggggatgaggtctgaaacccccccagttcctcctcctccgccttacctagctagctaccctggatttccagaaaacggagcacccggtcctccaatctctcgattccccctagaggagcctggcccccggccattgccttggcctcctggctctgatgaagtagctaagatccagacacccccccctaaaaaggaaccccctaaagaagagacggcacagctgacgggcccagaagcaggccgcaaaccagcgagaggcgtgggatctggtggccaaggcccacccccgccaaggagagagtcccggaccgagaccaggtggggtcccagaccaggcagttccaggcgggggattccgcccgaagagcccggagctccgcccagacgggcagggcccattaagaagccccctccccccaccaaagtggaggaactgccccctaagcccctcgagcagggggatgagactcctaaacccccaaagccggatccactaaaaattacaaaaggtaaactaggcgggcctaaggagaccccgcccaatggaaacctgtccccagctcctcgactccgccgagactactcttatgaaagggtgggacctacctcatgtcggggacgcggacgtggcgagtacttcgcccgtgggagaggcttccgcggcacttatggaggaagaggacgtggcgcggccggaaactccgccgtcactgaatcctttgaggagatgatgggtgtggaggtcggacagggagatcagaccactctcttgctgccggaggccgctttgcctgcacgccatggtgcgagggtgcagtccatgcgaaaaagcccaagcggggccggatcgggcgcacagaagcaagcagcacgccctatgcgcgtaatctggctgttacagaccaggaggctccctcaccccaggcgggaacactcccccagatcaaggtcccccacgactcgaagtcccacctttcctgctcctgcgagatttacccctggtgtcggagaaagtagcctgcctgagggaatcagtcctgggccaaggaggagagagccaccgcaggtgtgtccagggtggagcccgccagctaagagcctggccccgaagaaacccccaacgggcccattgccgccaagtaaagagcctctgaaggaaaaactgataccaggacctctttctcctgtggccagaggggggagtaatggtgggagcaatgtcggaatggaagatggagaaaggcctaggagacgccgccatggacgggctcagcagcaagataaaccccctagattcagacgcctgaaacaggaaagggagaatgcagctaggggcagcgagggtaagccaagcttgaccctgccggctagcgcccccgggccggaggaggcactcacaactgtgaccgtcgctcctgcacctcggcgcgcggcggccaaaagcccggatctgtcaaatcagaactcagaccaggcgaacgaagagtgggaaaccgcgtccgaatcgtctgattttactagcgaaagacgcggggacaaggaggcaccgcccccagtactgctaacacctaaggccgtgggcaccccaggaggcggcggaggcggggctgtgcctggaattagtgccatgagtcggggcgatttatctcaaagggccaaggatctcagcaagcgctccttcagctcacagagacccggaatggagcgccagaacaggaggcccggccctggaggaaaagcaggttcatctggcagctcgtcaggggggggtggcggggggcctgggggacggaccgggccagggagaggtgacaagagatcttggccttccccaaagaatcggagtcgcccacctgaggagcgaccacccggtctccccctacctcccccgccaccatcttcttccgccgtatttcgtctggatcaggtcattcatagcaatcctgccggaattcagcaggccctcgcccagttgagcagccgccaagggtctgtgaccgcacccgggggccatcctaggcacaagcctggaccccctcaagcccctcaaggcccaagcccaagacctccaactcggtacgagccgcaaagagtgaattccgggcttagctcagacccccacttcgaagagcccgggcccatggtgcgtggagtcggaggaactcctagggatagcgctggtgtgtcacccttcccacccaagcgccgtgaacggccaccccggaagcctgaactgctgcaagaagagagtttgcctccacctcattcttctggctttctcggctctaaaccagaaggacccgggccccaagcagagtcccgcgataccggaacagaagctttaacaccccacatttggaataggctccataccgcaacgagccggaagagttaccgcccctcctccatggaaccctggatggaacctctcagtcctttcgaagacgtggccggcacagaaatgtcccaaagcgacagcggagtggatctgagcggcgattcacaagtctcgagcggaccttgttcccagcgaagctctccagatggggggctcaaaggagcagccgaaggcccacccaaacggccgggaggttcttctccccttaacgcagtgccgtgtgagggcccccctggtagtgagccaccgaggagaccaccccctgccccccacgacggagatcgcaaggagcttcctcgcgaacaacccctgccaccaggcccaatcggcaccgagaggtcacagagaactgaccgcggcacagaacctgggcctatccgaccctctcataggcctgggccacctgtgcagtttggaaccagcgacaaagactcggacctccgcttagttgtgggggactccctaaaggcagaaaaggaattgacagccagtgtgaccgaggccatccctgtgtcgagggactgggaactgcttccctcagcagcggcgtctgctgaacctcagagtaaaaacttagactccggccactgtgtaccagaaccctcgtcctccgggcagagactctatcccgaggtattctacgggtccgccgggccctcctcttcccagatcagcggcggccacgggctgagtatcacttcaaagcagtggcgtcggcccggtacgccgtcactgcacccatataggtcccaaccactgtatcttccccctggtcctgctccaccaagcgccctattaagcggcgtggccctcaaagggcagttcttggatttcagcactatgcaggccaccgagttggggaagttgcccgcaggcggcgtgttatatcctcccccctctttcctctactcccctgccttctgccctagtcctttgccagatacatccctgctccaggtaagacaagatctgcccagtccaagtgacttttattctaccccccttcagccggggggtcagagcggatttttgccttccggcgcaccagctcagcagatgcttctgccgatggtcgactctcagctgccagtcgtgaactttggctctctgccacccgctcccccacctgctcctccgcctctgagcctgctgccagtggggccggccctccagcctcccagtcttgctgtgagaccccctccagcccctgctaccagagtgttaccgtcaccagctaggccctttcctgcttccctgggtagggcagaactgcatccggttgaactgaagccctttcaggactaccagaagctgagctccaacctcggcggccccggatctagcagaaccccgcctacaggcagaagtttcagcgggctgaacagccgcctcaaagctaccccctccacctactccggagtgttccgaacgcagagagtggatttgtaccagcaagcttccccccccgacgctttgcggtggatccccaaaccctgggagagaacaggccctccccctcgagaggggccttccaggagggccgaagaacccggatctcgcggagataaggaacccggcctcccaccccccaggtag

SEQ ID NO: 200849 - DNA, 6417 bp, Artificial Sequence
  Description of Artificial Sequence: Synthetic coding sequence
atgagcgaccggagcggccccaccgccaagggcaaggacggcaagaaatatagctccctgaacttgttcgatacgtacaaaggcaaatctctggagattcaaaaaccggctgtggctcctaggcacggcctgcaaagcttgggtaaagtcgcgatagcccgtcgaatgcccccccccgccaacttgcctagcttgaaggccgagaataagggcaatgaccccaacgtgtcactagtgccaaaggatggcaccggctgggcgtccaagcaggagcaatccgaccctaaatctagtgacgcatccacagcccagccacccgagagtcagcccctccctgcctcacaaacccccgcgtctaaccagcctaaaaggccacccgcagctcccgagaacacccccctggtcccttccggggtgaagtcatgggcccaagcttcagtgactcacggagcacacggcgatggaggccgagcctcttcactgttgtcccgcttctcccgcgaggaattcccaacactccaggctgctggtgatcaggataaagccgccaaagaacgcgagagtgctgagcagtcctccggccccgggccttccctgcgtccccagaattcaacaacttggcgggacggaggcggaaggggtcccgatgaacttgaaggtcccgattccaaattacatcatggacacgaccccaggggcggactgcagccgagtggaccccctcaattcccaccctacaggggtatgatgccgccattcatgtatccgccctatctgccctttcccccaccctacggacctcagggcccatacaggtatcccacacccgatggacctagccgctttcctcgggtggccggtcccagaggtagtggaccccctatgaggctggtggaacctgtgggcaggccaagtatcttaaaagaggataacctgaaggaattcgaccaacttgaccaagaaaacgacgatggctgggcaggtgcacacgaagaagtggactacacagaaaaattgaaattcagcgacgaagaggacggccgggatagcgacgaagagggcgccgaagggcaccgggactctcaaagcgccagtggcgaagagcgtcctccagaagcagacggaaagaaaggaaactcccctaactccgaaccacccacccctaaaacagcctgggccgaaactagtagacctcctgagactgaacccggtccccctgctccaaagccaccactgccccctccaggagattacccggataggggaggccctccctgtaaacctcctgccccagaggacgaagacgaggcctggcgccagagaagaaaacagtctagctcagagattagcctggcagtcgagcgcgcccggcgtagacgcgaggaagaggagcggcggatgcaggaggaacggcgcgcagcttgcgccgagaaacttaagaggttggatgagaaattcggagccccagacaaacggctcaaagcagagccagctgcccccccggccgcaccaagcactccggcccctccccctgccgtgccgaaagaactacctgcgccacctgccccacctccagcttctgccccgaccccggagaaggagcccgaggagcctgctcaggctccacctgctcagtctacccccaccccaggggtggccgcagcgcctacgttggtctcggggggaggtagcacttccagcacatccagcggctcatttgaagcctccccggtggagccacaactgcccagtaaggaaggtcccgagccgccagaggaagtgcccccacctacgacacctccggttccaaaggtcgagccaaagggtgatgggattgggcccactcggcagccaccctcccaaggtctaggatatcccaagtatcaaaagagcttgccccctaggttccaacgtcagcaacaagaacagctcctgaagcagcagcagcagcaccaatggcagcagcaccagcagggcagcgcaccaccgactcccgtgcccccttctcccccccaacctgtaaccctcggcgctgtgcccgctccacaggctccacccccaccccctaaagccttatatcctggcgctttagggagacccccccccatgccgccaatgaatttcgaccctagatggatgatgattcctccgtacgttgacccgagattgctccaggggcggccccccctggatttctacccccccggtgtacacccttccggcctggtaccccgggagcggtcagacagcggagggtccagcagtgagccttttgacagacacgccccagctatgctccgcgaaagaggaaccccacccgtcgaccccaaactggcgtgggttggagacgttttcacagccactccagcagagcctcgcccattgacaagccccctgagacaggcagccgacgaggatgacaaaggcatgcgttctgaaacaccgcccgtgcccccccccccaccttatctcgcctcttaccctggattcccagagaacggcgcccccggcccccctatctcccggtttcctctggaagagcctggccccaggcccctgccatggccaccaggctcagacgaggttgccaagattcaaacacctccacccaagaaggagcctccaaaggaggaaaccgctcagctgacaggccccgaggccggtcgtaagcccgctcggggcgtcggatcgggggggcagggcccaccaccgccaaggcgtgaaagtcgcaccgagacccggtggggccctagacccgggtcgtcaaggcgtgggatccccccggaggagcctggcgcgccccctaggagggctgggcctattaaaaagccccccccacccacgaaagttgaggagcttccaccaaagcctctcgagcaaggggacgaaacacccaaacccccaaagcctgacccattgaagattactaaggggaagttagggggaccaaaggaaacgccaccgaatggcaacttatcaccagcacctcgactgaggagggactacagctacgagcgagtgggcccaacgtcctgccggggccggggtagaggcgaatactttgcgcggggaaggggctttcgtgggacctatggagggagggggagaggggcagctggcaattcggctgtaaccgagtctttcgaggaaatgatgggcgtggaagtgggccagggcgaccagaccacactgttgctgcccgaggccgcattacctgccaggcacggtgcgcgagtgcaaagcatgaggaagtctccgagcggtgccggctccggggctcagaagcaagctgcacgcccgatgcgcgtaatctggctactgcaaacgcggcgtcttccccacccaagaagggaacactcgcccaggagccgcagtcccactaccaggagcccgacttttcctgccccagcccgttttactcctggtgtgggagagtccagtctccctgagggtatttctccagggccaaggaggagagagccacctcaggtgtgccccggctggagcccccctgcaaaatcactcgctcccaagaagccaccaacaggacccttgccgcccagcaaagagcctctgaaggagaagcttattcccggcccactctcacccgttgctaggggcggcagcaatggggggtccaatgtcggcatggaagacggtgagaggcccagaaggcggcgccacggcagggctcaacagcaggataaaccaccgagatttagacgattaaagcaggaacgggagaacgccgctaggggttcagagggtaagccaagcctgaccctaccagcctctgctcccggccctgaggaagcattgaccactgttaccgtcgcccccgccccccgcagagccgccgcgaaatccccggacctgtccaatcagaattccgatcaggcaaatgaagagtgggaaaccgcctccgagtcaagtgactttacgtcggagagacggggcgacaaggaggcaccaccaccggtcctactgacccctaaggcagtgggaacccccggcggcggaggcggaggagcggtgcctggaatctctgctatgtcgagaggcgacctgtcccagcgtgcgaaagacctatccaagagaagctttagtagtcagaggccaggtatggaaaggcagaaccgccgacctggccccggcggtaaagcaggcagcagtggctcctcctcaggcggaggtggcggaggtcccgggggccgcacgggaccaggcaggggcgacaaacggtcctggccctccccaaaaaacaggtcgcgccctcccgaagaacgccctcccgggctgcctctgccaccaccacctccatcatcctcggctgtattccgtcttgaccaggtaatccactcaaacccagccgggatccagcaggccctggcccagctctcgagtaggcagggtagcgtcaccgcccccggcggacacccaagacacaagccgggacctccacaggcaccccagggtccatctccaagacctccaacccgatatgaaccgcagcgcgttaatagcggcctctctagcgacccacactttgaggagccaggccctatggtacggggcgtcggcggcacaccgagggatagcgccggtgtctcacccttccctccaaagagacgcgagcgcccacctagaaaaccagagctcttgcaggaggaaagcctccccccaccccatagcagcggattcctgggatcaaagccagaagggcccggcccacaggctgagtcccgtgacacaggcaccgaagctcttacaccacacatttggaatcgcctgcacaccgccacttcccgcaagtcatacaggccaagtagcatggaaccctggatggagccactcagcccttttgaagacgtagctgggactgaaatgagtcagagcgatagtggagtggatttgtccggcgacagccaggtttcgtctggtccctgttctcagcggagttctccagatgggggattaaaaggggcagcagagggccctcccaagcgcccaggtggctcctcacccttgaatgctgtcccgtgtgaagggcctcccgggtctgagcctcctcgccgaccaccacctgccccgcacgatggggacagaaaagagcttcctcgggagcaacctctgccccccggacccatcggaacagagaggtctcaacacaccgataggggcacggagccagggcccattcgcccatcccacaggccgggtcctcctgtgcagttcgggactagtgataaagactctgacttgaggttggtggtcggggacagtctcaaggctgagaaagagttaactgcctctgtaacagaagcgatccccgtgtcacgcgattgggagcttctgccctcagccgcagccagcgcagaaccacagagcaaaaatctagactcaggtcactgcgttcccgagccatcttcaagcggccagaggctgtatccagaagtgttttacggcagcgccgggcccagcagtagtcagatcagcggcggccacggtctgtcagttacatctaaacagtggaggcggcctgggacaccttcattacatccataccggtcccaaccactttacttgcccccaggaccggcacctcctagcgctttactgtcgggtgtcgccttgaagggccaatttcttgatttttctacaatgcaggctaccgaactcggcaagctgccagcgggaggggtcctttaccctcccccatcctttctgtactcacccgccttctgtccaagcccacttcccgatacaagtctgctccaagtacgacaggatttaccttctccgtccgatttctattctacaccccttcagcccggtggccagtcagggtttctcccttcaggtgcccctgcgcagcaaatgcttctgccgatggtcgatagtcagctccctgtggtcaatttcggctctcttccccctgctccaccacctgctcccccctctctgtcccttttacccgtgggacctgcgctccagccacctagccttgccgtccgtcccccacccgcaccagctacccgtgtgctcccctctcctgccagacccttccctgctagtctgggtcgggctgagttacacccggttgaattgaaaccatttcaggattaccaaaaattaagctctaatctgggagggcctgggtcgtcaagaactccgcccaccggacggagtttttcagggcttaatagtcggctcaaggctaccccttcaacatacagcggcgttttcaggacccagcgagtggacctataccagcaggcttcaccccctgacgcacttcgttggattcccaagccctgggagcgaacgggtccaccacccagagagggacccagtcggcgggccgaagaaccaggcagccgcggagacaaagagccaggcctgccacctccccgctag

SEQ ID NO: 200850 - DNA, 6417 bp, Artificial Sequence
  Description of Artificial Sequence: Synthetic coding sequence
atgagcgaccggagcggccccaccgccaagggcaaggacggcaagaaatattcttcattaaacctgttcgacacctacaaggggaaaagccttgagatccagaaaccagccgttgctccaaggcacggacttcaatcactgggcaaggttgctattgcgaggcgcatgcccccacctgctaacctgcccagccttaaagcggagaataagggcaatgacccaaacgtgagcttagtccctaaggacggtaccggatgggcttctaaacaagaacagagcgatcctaagtctagcgacgcctccactgcgcaaccaccggagtcacagccactgcccgcgtcccaaacacccgcctcaaaccaacccaaaaggccaccagcagccccagaaaataccccactggtgcccagtggggtgaagtcgtgggcccaagcaagcgtgacacatggcgcacatggggatggcgggagggccagttctcttttgtccaggttttcacgagaagaatttccaactctccaggccgcaggtgaccaggacaaagccgccaaagagcgtgaaagcgcagagcaatcgagtggaccagggccctccctacgtccacagaactccaccacatggagagacggcggcgggagaggccccgatgagttggaaggacccgacagcaaacttcaccatggtcacgacccgagggggggcttgcagccctccgggccgccacagtttccgccctatcggggcatgatgcctccttttatgtacccgccttatctgccattcccaccaccgtacggaccccagggaccataccgatatcctactcccgacggcccaagccggtttcccagggtagctgggcctcgtgggtccgggcccccaatgagactcgttgaaccagttggccggccaagcattctaaaagaggacaaccttaaggaatttgaccagttagaccaagagaatgacgatggctgggccggtgctcatgaggaggttgattacacggagaagttgaagttctcggacgaggaggatgggcgggactcagacgaagagggggccgaaggacatagagactcgcagtctgcctccggcgaagaacggccaccagaggcagacggaaagaaaggaaactcacctaactctgagcctccaaccccaaagacagcctgggctgagacatcaaggccccccgagactgagccggggcctcccgcccctaagccaccattaccaccccctggcgactatcccgacagaggcggacccccctgcaagcctccggccccggaggacgaggacgaggcttggcgacagcggaggaagcagagcagctcggagatctctttggctgtagagagagcccggaggagaagagaagaggaagaacgacggatgcaggaagagaggcgcgctgcttgtgctgagaagctgaagcgattggatgaaaaatttggcgcacccgataaaagattgaaagctgagcccgctgctccccctgcagcaccttccacccccgcccccccgcccgccgtgcccaaggaacttccagcccccccagctcctccaccagcctccgcaccaacgcctgagactgagcccgaggagccagcccaggccccaccggcgcagtccacgccaacacccggagtcgcagccgctcccacccttgttagcgggggcggttcgacaagttctacgagtagtggctcctttgaggcgagccctgttgaaccccagttaccgagcaaggagggacccgagccaccagaagaggtacccccacctacaacacctcctgtcccaaaagtggagcctaagggcgacggcatcggacccacaaggcagcccccttctcagggcttggggtaccctaaatatcagaagtctctgcctcccagatttcagcgtcagcagcaggaacagctccttaaacaacagcaacagcatcagtggcagcaacatcagcagggttcagctcccccgactcccgtgcctcccagtcctcctcagcccgtcacactgggtgccgtacccgcaccccaggccccacccccccctccgaaagccctataccccggcgcgctggggagacctccaccgatgccaccgatgaatttcgatccccggtggatgatgatccctccctacgtggaccctcggctgctgcaggggcggccacccctcgatttctatccacctggggtgcacccatccggtctagtgccccgtgaaagaagtgacagtggagggtctagcagtgaaccctttgatcgccacgctcccgctatgctccgcgaacgcgggactccgcctgttgatcctaaattagcttgggtgggagatgtgtttaccgccacccccgcagagcccagacctctcacctcccctcttagacaagcggccgacgaagacgacaagggcatgagatcagagacgcctccggtgcctcctccgcccccatatctggcctcgtatcccgggtttcccgagaacggcgcccccggtccgccaatatcccggtttcctctggaggagcctgggccacgccctctcccgtggccacccggtagtgatgaggtcgccaagatccagacacctcctcctaagaaggaaccacccaaagaggaaactgcccagcttacaggcccggaggccgggaggaaaccggcgcggggggtgggttctgggggccaagggccccctcccccaagacgggagtccagaacagagactaggtggggtccaaggcctggatcaagcagacggggaatccctccggaagaacctggagccccaccaagaagagccgggccgatcaaaaaaccaccgcctccaacaaaggtggaagaattacctcccaaaccactggaacagggcgacgagactcccaagccaccgaaacccgaccccctgaaaattaccaaaggaaagctaggcggccccaaagaaactccccctaacgggaacctcagccctgctccccggttgagacgcgattacagctacgagcgcgtgggcccaacttcctgtcgggggcgcggcaggggagaatacttcgccagaggacgcgggttccgcggtacctatgggggacggggccgcggggccgcagggaacagcgctgtgacagagtcgtttgaagagatgatgggggttgaggtcggacaaggcgatcagacaacactactactgcctgaagcggcattacccgcccggcatggcgcacgggttcagtctatgagaaagagcccctctggggctggaagcggggcccagaaacaggcagctcgacccatgcgcgtcatttggctgctccagacccgccgactgccacaccctaggcgggagcattcaccccgcagccggtctccaacaactagaagcccgacttttcccgcgcccgccaggttcacaccgggcgtgggcgaatcttctctcccggagggtattagtcccggaccaagacgacgtgaaccaccacaggtgtgcccaggttggagccccccagccaaaagccttgcccccaaaaaacctcccaccgggccccttccccctagcaaggaaccccttaaagagaaattgatccctggaccccttagcccagttgcccggggcggatcaaacggcggatctaacgttggaatggaggacggtgaaagacccaggcggagaaggcatggacgggctcagcagcaggataagccacctcgcttccggaggctgaaacaggagagggagaacgcggcccgcggctctgaaggcaagcccagcctgaccctgcccgccagtgcaccaggtccggaagaggctctcaccaccgtgacagttgctccagcgccaaggagagccgctgccaagtccccggatctgagcaaccaaaatagcgaccaggccaatgaggaatgggaaacagcatctgagagctcagattttacgtccgagcgtcggggggacaaagaagcccccccgcctgtgctcctgacaccgaaagctgtgggcactcctggaggagggggaggcggcgccgtccccgggatctcagctatgtcccggggtgacctgagccagcgcgccaaagacctgagcaaacggtcgtttagctcccaacggcccggtatggagaggcagaaccggcggcctggaccaggtggaaaggcaggcagcagtggttccagcagtggtggggggggtggtggccccgggggacggaccggcccgggaagaggggacaagaggtcttggccgtccccgaagaatcgctcaagaccgcctgaagaaaggccgccaggattaccactccctcctcctcccccctcatcgtctgctgtgtttcgccttgatcaggtgatccactccaaccccgccggcatacagcaggccctcgctcagctgtcttcacggcagggctccgtgaccgcgccaggagggcaccctcgccacaaacccggtttaccccaagcgccgcagggcccatctcctcgacctccgacccgctatgaaccgcagcgcgtgaattcgggccttagcagcgaccctcactttgaagagcccggtcctatggtgcgtggtgtcggaggtacaccacgagattcagctggagtgtccccttttccgccgaaacggcgggagcgtccgcctcgtaaacccgaactcctgcaggaggagtctctcccgcccccgcactcatctgggtttcttgggtcaaagcccgagggaccagggccccaggcggagagtcgtgacacggggactgaggcgctgacccctcatatatggaaccggcttcacaccgctactagccgcaaatcctatcgaccatcttcaatggaaccctggatggaacctctctccccctttgaagatgtggcgggaaccgaaatgtctcagtccgactctggcgtcgatctgtcgggagatagccaggtgtccagcggcccttgcagccagcgatccagccctgatggaggcctcaagggcgctgccgagggaccacccaagcggcctgggggaagtagtcctctgaatgccgtgccctgtgaggggcctccgggctccgagcctccccgcaggcctccacccgctccacacgacggagaccgtaaggagctgcctcgggaacaaccgctgccccctgggccaattgggacagagaggtcccagcgcacggacagaggtaccgaaccaggccccattagaccaagccaccgccccggcccaccggttcagttcgggacttctgacaaggattctgatttgagactcgtggtcggggattccctgaaggccgagaaggagctgaccgcctccgtgaccgaggccatccctgttagccgagactgggagctgctgccctcggccgctgcttcggctgaaccccagagcaaaaacctggattcaggccattgcgtgccagaacctagctccagcggtcagcggctgtaccctgaagtgttctatgggagcgcggggccttcaagcagccagatcagcggtggtcatggactctctattacctctaaacagtggcgtcgacctgggaccccatctctgcatccgtatcggtcccagccattgtacctgccccccgggcctgcacccccttctgctctgctcagtggtgtggcgctgaagggccagtttctggatttctcaaccatgcaagccacagagttgggaaaactgcccgccggcggggtgttatacccccccccatcttttctttatagcccagcgttctgtccttcccccttgcctgatacttcactcctgcaggtgaggcaggacttaccaagtccatccgatttttacagtaccccattgcagcctggtggccagtccggatttctccctagcggcgcaccggcacagcaaatgcttcttcccatggtagatagccagctgccagtcgtgaactttggttcactgccccccgctccaccacccgcccctcctcccctgtccctgctcccggtcggacccgcattacagccccccagcttagccgtccggccacctcccgcccccgcgacacgagtccttcccagccccgcacggccattcccggcctcactggggagagctgagctccaccctgttgaactcaaacccttccaagattatcagaaactgagttcgaatttaggcgggcccggttcgtcccgaacgccccccaccggtcggagcttttctggattaaactccaggcttaaggccacaccaagcacctattccggggtattccggacccagcgagtggatctgtaccagcaagcctcaccgcctgacgcccttcgctggattccaaagccatgggaaagaacagggccgcccccacgagaaggcccatctcgccgggcggaggaaccggggagcagaggagacaaggagcctggccttccacctccaagatag

SEQ ID NO: 200851 - DNA, 6417 bp, Artificial Sequence
  Description of Artificial Sequence: Synthetic coding sequence
atgagcgaccggagcggccccaccgccaagggcaaggacggcaagaagtacagcagcctgaacctctttgacacatataaaggaaaaagcctcgagatacagaagccagccgtagcccccaggcatggcttgcaatctctcgggaaggtggcaatcgctcgtagaatgcccccacccgccaacctcccatccctgaaggcagagaacaaaggaaacgacccaaatgtctctctcgtgcccaaagatggcaccggctgggcctccaaacaggagcagagtgaccctaagagctccgatgcctcaactgcccagccgcctgaaagccagcctttgccagcaagccagacaccagcatctaaccaacctaaaagacctcctgctgccccagaaaacactccactcgtccctagcggagtcaaatcatgggcgcaagcttctgtgacccacggcgcccacggagatggcgggcgcgccagtagcttgctttccaggttttcaagggaggaatttcctaccttgcaggctgcaggcgaccaggacaaggcggcgaaggagcgggagtcggccgagcagtcctccgggcccgggccctctctcaggccacagaacagcaccacatggagggacggcggcgggcgaggtccagacgaactcgaggggccagactcaaaactccatcatgggcatgacccccggggggggctgcagccttcaggccccccccagttcccgccataccgcggcatgatgcccccgttcatgtacccgccgtacttacccttcccccccccctatggtccccagggaccatatcggtatcccactccagatggcccaagtaggtttccgagagttgccggcccgagagggagtgggcctcccatgaggctggtcgagcccgttggaaggccttcaatattgaaagaggataatctgaaagagtttgaccagttggatcaggagaacgacgatgggtgggcaggtgcccacgaggaagtagattacacggaaaaattaaagttcagcgatgaagaggatggtagagattccgacgaggagggtgcagaagggcacagggacagccaatctgcaagtggcgaagaaagacctccggaagccgatggcaagaaggggaactcaccaaattccgaaccccccacccccaagaccgcttgggcagagaccagcagacctccagagaccgagccaggccctcctgcccccaaaccacctctcccaccacccggtgattaccctgaccgcggtggaccaccctgcaaaccccccgcccccgaggacgaggacgaagcttggaggcagagacggaagcaatccagctccgaaattagcctcgcagttgaacgcgccagaaggaggagagaggaggaggaacggagaatgcaggaagagcggcgggcggcatgtgctgagaaactcaagcgtctggacgagaaattcggtgctccagacaaacgcctcaaggccgagccagctgcaccgccggcagcaccatccacgccggctcccccccccgccgtgcctaaggagctgcccgctccacccgctccacctcccgcttccgcaccaaccccagaaaaggaaccggaggaacccgcacaggctcctcctgcccagagcactccgacgcccggagtggccgccgccccaaccctcgtctcaggaggggggagcaccagcagcacctcctccggttcatttgaggcctcccccgtggaaccccagctgcctagcaaagagggacctgagccacctgaggaggttcccccacctactaccccgcctgtcccaaaggtagagccgaagggcgatggaattggaccaaccaggcagccccccagtcaggggctcgggtaccctaaataccagaagtcactgccacccagattccagagacaacagcaggagcagttgctaaagcagcagcaacagcatcaatggcagcaacatcaacaaggtagcgccccgccgacacctgtcccaccctcccccccacagcctgtgacactgggcgctgttcccgctccacaagctcctcctccacccccaaaagccctgtaccccggtgcccttggcagacctcctcccatgccccctatgaatttcgatccccgctggatgatgatccctccttacgttgacccaaggctccttcaagggcgccctccccttgacttctatccacctggagtgcacccgagtggcttggtgcctcgggagagatccgattcgggtggatccagctccgagccctttgatcgacacgctccagcaatgctgagggagcggggtactcctccagtggaccccaaactggcctgggttggcgacgtgttcaccgcgactcctgctgaacctcgcccactcacatcacctctgaggcaggccgccgacgaagacgataagggcatgcgctccgagacccctcccgttcccccaccacccccttatctggcttcctatccaggatttccagaaaatggagctccaggcccacctatttcgcgatttccactggaagagcccggccctagaccgttaccgtggccccccggaagtgatgaggtcgctaagatccaaacgccccccccaaagaaggagccaccaaaagaagaaacggcacaacttaccggccccgaggccggcagaaagcccgccaggggagttggatccggcggtcaaggcccccctcccccaagacgggagtcacgcacagagaccagatgggggcccaggccaggatcctcccgaagaggtattccgcctgaagagccgggggctcccccccgcagagccggcccaatcaagaaaccaccaccgcccacaaaagtcgaagagctcccccctaaacccctcgagcagggcgatgagacgccaaaaccacctaagccagatccgctgaaaatcacaaagggcaaactgggaggccctaaagagacaccgcccaacggtaacctgagtccagccccccgcctacgacgggattattcatatgaaagggtcggacccacatcttgccgaggcaggggccggggtgaatatttcgctagaggcagggggtttagaggcacctatgggggtcgaggccgcggcgccgcaggaaactcagccgttacggaatcattcgaggagatgatgggagtggaggtgggacagggcgaccagaccactttgctgttgccggaagcagcccttccagccaggcatggcgcccgggtccagtccatgaggaagagtcccagcggagcagggtccggtgcacaaaagcaggcagcccggcctatgcgtgtcatttggcttttacagaccagacgcctcccccaccctaggcgggagcactcaccgaggtcgagaagccccacaactaggagcccaacctttcctgctccagctaggttcacacccggtgtgggcgagtcgtctctccccgagggaatctcgcccggaccaaggagacgggaaccccctcaggtctgtcccgggtggtctcccccggctaagtctcttgcccccaaaaaaccaccgactgggcccctgcctccaagcaaggagcccttgaaggaaaagctgattccaggaccactctctcctgtcgctcgtggcggtagtaatggcggatccaacgtaggaatggaagacggcgagcgccctcggaggaggaggcacggtagagcacaacaacaagataaaccgcccagattcaggcgtctcaaacaggagcgcgagaacgccgcccgagggagcgagggcaagccctctctcacgcttcctgcgagcgctccggggccggaggaagctcttaccactgtgaccgtcgcacccgcaccccgccgcgctgcagccaaatctcccgacctcagcaaccagaactcagaccaagccaacgaagagtgggagaccgcctctgaatcttccgatttcactagcgaacgtaggggagacaaagaagccccccctcccgtgcttttgaccccaaaagccgtaggtacaccaggtggcggaggcggcggggctgtgccgggcatctctgccatgagcaggggtgacctaagtcaaagggcaaaggacctgtccaaaaggagctttagctctcagcgccctggtatggagaggcagaatcgcaggcccggccctggaggcaaggccggcagtagcggttcctctagcggtggcgggggagggggccctggcggacggaccggacccggcaggggcgataaaaggagctggccctctccaaagaatcgctcccgaccccctgaggagcgtcctcccggactaccgctgcctcctccacccccatcttctagcgctgtgttccgccttgaccaggtgatacactctaacccagccgggattcagcaagctctggcccaactttctagcagacagggaagtgttacagcccccggaggccatccacgccataagccgggtccaccgcaagcccctcaaggtccatcaccgcgcccccctacaaggtacgagccacagcgggtcaactccggactgtccagcgatccgcacttcgaagaacccggacctatggttcggggcgtcgggggaacccctcgggactccgcgggagtgtcacccttccctccaaaacggagagaacgaccaccacggaagcccgaattgctccaggaggaatccctacctcctccacatagctcaggatttctgggctccaagccagaaggcccgggcccacaagcagagagcagggataccggaactgaagctctgacaccacacatctggaaccggcttcacacagccacgagccggaaaagttaccgtccttcgtccatggaaccatggatggagcccctctcccctttcgaagacgtcgccgggactgagatgtcccagagcgattccggagttgatttatctggcgatagtcaagtcagtagcggtccttgcagccagcggtctagtccagacggaggcttgaagggagcagctgagggacctcccaagcgacctggtggcagctcacccctcaacgccgttccatgtgagggaccacctggatccgagcctcctcgacggcctcccccagccccccatgacggcgatcggaaggagctaccacgagagcaacccctcccccccggacccattggaactgagcgatctcagcatactgatagagggaccgaaccgggacctattagacccagccaccggcccgggcctcctgtgcaattcggcacaagcgataaggattcggatctgaggctggttgtcggtgactccttgaaggcagagaaagaactgactgctagcgtaaccgaggcgatcccagtaagccgtgattgggagctgctaccctcggctgcagcctctgccgagcctcagagcaagaacctcgattcaggacattgcgttccagaacctagttcttcggggcaacggctgtaccccgaagtcttctacggctcggctggcccaagtagtagccagatctccggtggacacggcctttccgttacatcaaaacagtggagacggcctggaacccctagcctccatccataccggtcccagccactgtacctgccgccagggccagcacctccctctgcgctgctgtcaggggtcgctctaaagggtcagtttctggacttctccacaatgcaggcaaccgaactcggaaaactcccagccggcggcgttttgtatccacctccctccttcctctactcacctgctttctgtcctagcccgctcccggacacctctcttttacaggtgcggcaggacctgccctcaccgagcgacttttacagtacccccctgcagcccgggggtcaatccggctttctccctagtggggcgcccgctcaacagatgctgttgccaatggttgattcgcagctgccggtggtgaatttcggctcactgccaccagcaccccctccagctcctccatcactgtctctattaccggtgggccccgcactacagccgccgtccttggctgttcggccccctcccgcaccagctaccagggtgctaccttccccagcccgcccatttcctgcctcacttggtcgagctgaacttcaccccgtggagctaaagccctttcaggattatcaaaaactgtctagtaacctgggaggccctggcagcagccgaacccctcccacagggaggagcttttcaggactcaattctagactcaaagccacaccaagtacctactccggagtgttccgaacacagagggtggatctctaccagcaggcgtcacctcccgatgcattgagatggatccctaagccttgggagcgaacaggcccaccaccacgcgaaggccctagccgccgggccgaggagccgggtagtagaggtgacaaggaacctggcttaccccctccaaggtag

SEQ ID NO: 200852 - DNA, 6417 bp, Artificial Sequence
  Description of Artificial Sequence: Synthetic coding sequence
atgagcgaccggagcggccccaccgccaagggcaaggacggcaagaaatattccagcttgaatctattcgatacctacaaaggaaaatccttagagatccagaaacccgctgtggccccacggcacggcttgcagtcgctgggcaaggtggctatcgcgcgaaggatgcctccgccagctaatctcccctccttgaaagcagagaacaaaggtaacgaccctaacgtgtccttggtccccaaggacggtactgggtgggcctccaagcaggagcaaagcgacccaaaatcctcagatgcatcaactgcccagccacctgagagtcagccacttcccgctagtcaaacacctgcatctaatcaaccgaaacgcccccctgccgcaccggaaaacacgcctctcgtgccttccggggtgaagtcctgggcgcaagcttccgtgacccacggtgcccacggcgacggtggcagggcctcatcgctgctgtcacggttttcaagggaggagtttcctaccctgcaggcagccggcgatcaggataaggctgccaaagagagagagagtgctgaacagtcttcggggccgggccccagccttcgtccacaaaattctaccacttggagagacggtggaggtcgcggcccggacgaattagagggaccagatagcaagctgcaccatggacacgatccaaggggcggactacagccatcaggaccgccgcaatttcccccctatagagggatgatgccacccttcatgtacccaccctatctacctttcccacccccctacgggccccagggaccttaccgataccccacgcccgacggcccatcacggttcccccgagtggccggacctagaggtagtggtccacccatgcggctcgtagaacccgtcggaagaccgagcatccttaaggaggataacctgaaggagtttgaccagctcgaccaggaaaatgatgacggctgggctggggcccacgaggaagtggattacaccgagaaattaaagtttagcgacgaggaggatggccgtgatagtgacgaggagggagctgaggggcatagagattcacagagcgcctccggcgaagagagacccccagaagccgacgggaagaagggaaacagcccaaatagtgagcctcccaccccgaagacagcttgggctgagaccagtcggcctccggagaccgagcctgggcccccagctcccaagccgccgctgcctccaccgggggattatcctgatagggggggaccaccttgtaaacctcccgcacctgaagacgaagacgaagcttggcgacagaggagaaaacagtcttcatccgaaatttcgctcgcggtggaaagagcaaggcgcagaagggaggaggaggagagaaggatgcaggaagagagacgtgcagcctgcgccgaaaagctgaaacgtcttgacgagaaattcggagcacccgataaacgtctcaaggcagaacccgccgcccccccagccgctcctagcactcctgcgcccccaccagctgtccccaaagaactccctgctcctccagccccacccccggcatccgcaccaactcccgaaaaggagcctgaggaacctgcccaggctccccccgctcaatccacacccactcctggagtggcagccgctcccactctcgtttcaggcggaggatccactagctcaactagttcaggaagtttcgaagcgtcaccggttgaaccacagctacctagtaaagaaggcccagagccgccagaggaagtgcccccgcccaccacacctcccgtcccaaaagtggagccaaagggtgatgggattggccctacccggcagccaccatctcagggcttaggctacccaaagtaccagaagagcctgccacctaggttccagcggcagcagcaagagcagctactcaagcagcagcaacagcatcagtggcagcaacaccagcagggatccgcccctcctactccagtacccccgtcacctccacaacctgtgaccttgggagctgtacctgccccacaggctcccccacctccacctaaagcactttatccgggcgccttaggtcgcccacctcccatgccgcctatgaatttcgatcctagatggatgatgatacctccctacgttgatcctcggctgttgcaagggagaccccccctggacttttacccccctggcgttcacccatccggcctggtgcctcgagaaaggtctgactcaggaggtagcagcagtgaaccctttgatcgccacgccccagctatgctcagagagcggggtactccgcctgtcgatccaaagctcgcatgggtgggtgatgtgttcaccgccacaccggctgagccaaggccactcacatctcccctgaggcaagccgctgatgaagacgataaagggatgaggtcagaaacgcctcccgtgccaccaccgcccccttacctcgcctcctaccctggattccccgagaatggggcgcctggcccccccatctcgcggtttccccttgaggagcctgggcccaggcccctcccatggccgcctggatcagacgaggtggcaaaaattcagactccccctcccaaaaaagaacccccaaaagaggaaacagcccagctcacagggccggaggccggtcgtaaaccagcgaggggagtcggcagcggcggacagggacccccgccaccgaggcgggaatcgcgcacggaaactcggtggggtcctaggccggggtcctcaagaagaggtatcccacctgaagaacctggcgcccccccgcgacgcgcaggtcccattaagaagccaccacctcctacaaaagtcgaagaactaccccccaagcccctggagcagggagacgagacacccaagcctcccaagcccgatcctctgaaaatcacgaaaggcaagctgggcggccctaaggaaactcctccaaacggcaacctctctccagctcctagactgagaagagattattcctacgagagagtggggcccacatcttgccggggcagagggcggggcgagtattttgccaggggacgtggcttcagggggacgtacgggggcagggggcgcggggccgccggcaattctgcagtgactgagagctttgaagagatgatgggcgtggaggttgggcagggtgatcagactactctcctcctccctgaggctgccctgccagccagacatggggcaagagttcagtcaatgcgcaagagccctagcggggctggcagcggagcacaaaaacaggcagccaggcctatgcgagtgatctggctactgcagacacgcagattgccgcacccaaggcgcgaacattcccctcgaagcagatctcccactacacggtcgcccacctttcctgcgccggctcgcttcacaccgggcgtgggcgaaagctccctgccagagggaatatcgcctgggccgagacgaagggagccaccccaagtgtgccccgggtggtctccaccggccaagagtctcgccccaaagaagccacccacagggccactcccccccagcaaggaaccactgaaagagaagctcattcccggcccattgagcccagtggctcgcggtggtagcaatggggggtccaatgtcgggatggaagatggagagcggccacggcgccggaggcacggccgggcccagcagcaggacaagcccccccgttttaggcggctgaaacaagagcgagagaacgctgctcgcgggtctgaaggcaagccctcactgaccctccccgcctcagctcctgggccagaagaggctctcaccaccgtgaccgtggcacccgcaccccgacgtgcagccgcaaagagccctgatctgagcaaccagaactctgatcaagccaacgaagagtgggagaccgcatccgaatctagcgacttcacctcagagcgacgcggcgacaaagaagccccaccccctgtcttgctgactccgaaagcagtcggaacccccggcggcggagggggaggcgcagtcccgggtattagtgcgatgagtcggggagatctatctcagcgagccaaagatctgagcaaacgttcgttctcttcacaaagacccggaatggagcggcagaataggagacccggtcccggtggaaaagccggtagctcaggctctagtagcggagggggtggtgggggaccaggtggcagaacaggacctgggcggggtgacaaacgatcatggccctcacccaaaaaccggtcccggccgccggaggaaaggccgccaggtctgccactgccccccccgccgccttctagcagtgcagtctttaggctagatcaagttatccactctaacccagctggcatccagcaggcactggctcagctgagttcaaggcagggcagcgttactgcccccggcggtcacccccgccacaagccgggtccacctcaagcaccccagggaccaagcccgcgtccccctactcgctacgagccacagcgcgttaattccggactgagttctgatcctcattttgaagaacctgggcctatggtgcgcggcgttggcggtacccccagagactccgccggcgtgagtcccttccccccaaagcggagagagagacccccgaggaaacccgagttactgcaggaggaatccctccctcctccgcactcttccggttttctggggtccaagccagagggccctgggccacaagcagagtcccgggacacaggcaccgaggcgctcactcctcatatctggaataggctacatactgccactagcaggaagagctaccgaccatcctcgatggaaccttggatggagccgctgtctcccttcgaggacgtcgctggtacagaaatgtcccagagtgactccggcgtggatttgtcaggagattcccaggttagcagtggcccatgttctcagcgcagctcacccgatggaggcctcaagggcgccgcagaggggcccccaaagcgaccaggaggcagctcccccctgaacgcagtgccctgcgaggggccacccggctccgagccgccaagacggcctccgcccgcgcctcatgatggcgatcgcaaggagctcccaagggagcagccactcccaccaggccccatcgggactgagcggagccaacggacagatcggggaacagagcccgggccgattaggccctcacaccgtcccggtcctcccgtgcagtttggtactagcgataaggatagtgatttaagactcgtggtaggtgactcgttgaaggccgagaaggaactcacggcttccgttacagaagccattcccgtatcacgtgattgggaactgttacctagcgccgccgcttcggccgagccccagtctaagaacttagattcaggacactgcgtccctgagcccagctcatctgggcaacgcctgtatccagaagtcttctatggcagcgctgggccctcttcatcacagatatcaggcggccatggcctgagtattacctccaagcagtggcgccggccaggcacaccatctctgcacccgtataggagccagcctttgtatctgccaccaggccccgccccaccttccgccctactcagcggagtggccctgaagggacagttcctggatttctctaccatgcaggctaccgagctgggcaaactccccgctggtggcgtgttgtatccacccccttcatttctctacagtcccgctttctgtccatcacctctccccgacacctccttacttcaggtgcggcaggatctcccctcgccctccgacttctacagcaccccattgcaaccgggcggccagtctggatttctgccgagtggagcccccgcacagcagatgctgctgcccatggtcgactctcagctcccagtggtgaattttggtagtctgccgccagcgcccccaccagccccccccccacttagtctgctgccagtgggacccgccttacagccgccttctctagcagttcggccccccccagcccccgccacccgtgtgctccccagccccgcgcgaccctttcccgcttctttaggtcgagcagagcttcatccagtggaactgaagcccttccaggattatcagaagcttagttctaatctgggggggcccggaagcagccggacccccccaacaggaaggagcttttccggcctcaattcaagattgaaagccacacccagcacatactcaggagtgttcagaacccagcgggtcgacttataccaacaggcttccccccctgacgcattgagatggatacccaaaccgtgggagaggactggaccgccacctcgggaagggccgtctcgcagagctgaggagcccggatctcggggggacaaggaaccaggtctaccacccccgcgatag

SEQ ID NO: 200853 - DNA, 4149 bp, Artificial Sequence
  Description of Artificial Sequence: Synthetic coding sequence
atgctgcgggagcggggcaccccccccgtggaccccaagctggcctgggttggtgatgtgtttaccgcaaccccagccgagccacgccctctgacgtctccattgcggcaggcagcagatgaagatgataaaggtatgcgcagcgaaacacccccggtgcctccaccacccccttaccttgcctcttaccccgggttccccgagaacggggctccaggtccccctatcagccgctttccccttgaagagcccggaccacggccgttgccctggcccccagggagtgacgaagtggcaaagatacaaaccccaccccctaagaaggagcctccaaaagaagagaccgcacagctgacagggcccgaggccggacgtaagccagcacgcggcgtgggctcaggcggccagggaccccctccaccaaggcgtgagagtcggaccgagacccgatggggtcctagacctggctcctctcgcaggggcatcccgccagaagagccaggggcaccccccagaagagcgggaccgataaagaagcccccccctcctacaaaagtggaggagctgcctccaaagcccctggagcaaggagacgaaacgccaaaaccaccgaaacctgacccccttaagattaccaagggtaagctcggtgggccaaaggagacgccacccaacggcaaccttagcccggctccacgactccggcgcgattattcctatgagcgcgtgggccctacctcttgtagggggcggggaagaggcgagtattttgccaggggaagggggttcaggggaacttatggtggacggggccgcggcgcgcgctcccgcgaattccggtcgtatcgcgaatttaggggagatgacggacgggggggcggcacggggggacccaatcatccacccgcgcctcgaggccggactgcctctgagactcgaagtgagggctccgaatatgaggagatccccaaacggaggaggcagcggggctccgagacagggtccgagactcacgaatctgacctggccccttcagataaggaagctccaacgcccaaggaggggactttgacccaggtaccactcgctccaccacccccaggcgccccacccagccctgcaccagcaaggtttacagctagaggcggaagggtattcaccccacgaggggtcccatctaggcggggcagggggggcggccgcccccccccacaggtgtgcccagggtggagcccgccagccaaatctctagcccctaaaaaaccaccaactggacctctacccccgagcaaagagcctctcaaggaaaagctcatcccaggccccttaagccctgtggccagaggtggaagcaatggtggatctaatgtggggatggaggatggcgagcgcccccgaagaagacgccacggccgagcacagcagcaagataagccccccagattcagacgcctgaaacaggagcgcgagaatgcagcacggggctcggagggaaagcctagcctgactctcccggcttcagcgcccggccccgaggaagcactgaccaccgtcacagtggcccccgccccgaggagggccgccgctaagtcccccgatctgtcaaatcagaacagcgatcaggcaaatgaggaatgggaaaccgccagcgagtctagcgactttactagcgagagacgtggggacaaggaagccccgcctcctgttctgctaacacctaaggccgtcggcactccgggtggtgggggcggcggagctgtccctggcattagcgccatgtctaggggcgacttgtcacagagggctaaagatctgtccaaacggtcgttttctagccagcgacctgggatggaaagacagaaccgtcgccccgggcccggtggcaaagctggtagcagcgggtcaagttcaggaggagggggaggcgggcctggcggtaggacagggccagggcgaggtgacaaacgtagctggccaagtcccaaaaacaggtcccggccccccgaagagcgtccacctggactgcctcttccccctccacccccctcatcgagcgccgtttttcggctagaccaggtgattcacagcaatcctgcaggcatccagcaggccctggctcagctttcgagccgccaaggatctgtgaccgctccaggtggccaccctagacacaaaccaggccttcctcaggctccgcaggggccaagccctcgacctccaacgagatatgagcctcagcgcgtcaattctggcctgtctagtgatcctcacttcgaagaacctggtccgatggtgcggggggtcggcgggacaccgcgcgactccgccggagtctccccattcccccccaagaggcgagaacggccaccacggaaacctgagttgctccaagaggagtctctgccccctccccactccagtggattcctgggcagtaaaccagaaggacctggcccacaagcagagtctcgtgatactggcacagaagctttaactcctcacatatggaaccggctccacaccgctaccagtcgcaaaagctacagaccctcctctatggaaccttggatggagcccctatccccattcgaggacgttgctggcaccgagatgtcgcagtctgacagtggagtggatttaagcggggactctcaggtttcttctgggccttgtagccagcgctcaagtcctgacggaggattgaagggggctgctgagggtccacccaagaggccgggaggatctagccccctgaacgctgttccctgcgagggcccgcccgggagcgaaccacctcgtcggccccctccggcaccccacgatggggacaggaaagagctcccaagagagcagcccctgcctcccggcccaatcggaacggagaggtcacagaggactgacaggggcacagaaccaggcccaatcaggcctagtcacaggccgggtccaccggtgcagtttgggacctccgataaggactccgacctgcggctcgttgtgggcgatagtttgaaggctgaaaaggaactgactgcctccgtaacagaagctatccccgtcagtcgcgactgggaactgttgccatccgctgcagctagcgccgagccacagtctaaaaatttggattctggccactgcgtaccagaaccatccagttctggccagaggctctaccccgaagtgttttacggctcggcaggaccctcttcttctcagatctcagggggcgccatggactctcagctgcatcctaatagcggcgggtttaggccgggcacaccaagcctccacccatacagatcacagcctctctacctgcccccgggtcctgccccgccctcagctctgctgagtggggttgcgctgaaaggccagttcctagattttagcaccatgcaggcaacggaactgggcaaattgcctgcaggtggcgtactgtacccaccaccctcattcctctactcgcccgcattctgcccatctccactgcccgatactagccttttgcaggtgcgacaggacttgccctcaccgagcgacttctacagcacacctctacagccaggaggccaaagcggattcctgccgtcaggtgcacctgcacagcagatgctgcttccaatggttgatagtcagctcccagtggtgaactttggcagtctaccccctgcacctcctccagcaccgccgcctttgtcattactccctgtgggcccagctctccagcccccatctcttgccgtgaggccccctcctgccccagcgacccgagttcttccgtctccggccagacccttcccggccagtctcggcagggctgagctccatcctgtggagttgaaaccattccaggattatcagaaactctcatctaatctcggtggtcctgggagctctaggaccccgcccacagggcggtctttcagcggccttaacagcagactcaaagccactccttcaacctattccggtgtcttccgtacccagcgagttgacctgtaccagcaagcctcaccacctgacgcccttcggtggattcctaagccatgggaaagaactggcccccctcctagagaggggccaagtagaagggccgaggaaccagggagcaggggtgacaaagagcctggcctccctccccctagatag

SEQ ID NO: 200854 - DNA, 6450 bp, Artificial Sequence
  Description of Artificial Sequence: Synthetic coding sequence
atgagcgaccggagcggccccaccgccaagggcaaggacggcaagaaatactctagcctaaatctttttgacacatacaaggggaagtccttggaaatccagaaacctgctgtcgccccccgtcacggtctgcaatcactgggcaaagttgccatcgcccgacggatgccaccgcctgccaacctgccttccctgaaggcggagaacaagggaaacgatcccaatgtttcccttgtccctaaggacggcaccggatgggcaagcaagcaggagcaaagcgacccgaagtcttccgatgcctccaccgcgcagcctccagaatcccaaccactgccggcttctcagacacccgccagcaatcagccaaagcgtccccccgccgctcccgagaacacaccgctcgtgccgagtggggtgaaatcatgggcacaggctagcgttactcacggggcacatggggacggcggcagagcgtcctctcttctgtcccggttcagccgtgaagagttccccaccctccaggctgctggtgatcaggataaagctgcgaaggaacgcgagtccgctgagcagtcaagtggcccggggccctctctccggcctcagaattctaccacctggagagatggtggcggtcgggggcctgacgaactggagggccctgattcaaagctgcatcatggccatgacccccgtgggggccttcagccgtcaggtccaccccagtttcctccgtacagaggcatgatgccccccttcatgtaccctccctatctgccattcccacctccctatgggccgcaaggcccctaccggtatccgactcctgacggcccatcccggtttccacgcgttgcagggcctcgcggctcaggcccacctatgcgcctggtcgagccagttggtcggccttccattctcaaagaagacaatctgaaggaatttgaccagcttgaccaagagaatgatgacgggtgggctggggcacatgaggaagtggattacacagaaaaattgaagttcagcgatgaagaagatggacgcgactctgacgaggaaggcgctgaggggcacagagatagtcaatctgctagtggcgaggaacgaccacctgaagcggacgggaagaagggcaacagcccaaatagtgagcccccaacacccaaaactgcatgggcagagactagccgaccaccagaaaccgagcccggccctccggcccctaaaccccccctcccacctcctcaccgaggtcctgctggaaactggggtccacccggagactaccccgaccggggggggcctccatgcaagccacccgctcccgaagatgaggatgaagcatggcggcagcggcgcaaacaaagcagtagtgaaatatcactcgcagttgagcgagcccggcgcaggagagaggaggaggaacgccgcatgcaggaggagcgcagagctgcctgcgccgagaagctgaaacgcctggatgagaagttcggtgccccagacaagagattaaaggccgagccagcagctcctcccgcagccccaagtaccccggctccccctcctgctgtgccaaaggaattgcctgccccaccagcacctccacccgccagtgcccccacgccagagaaagagccagaggaaccagcccaagctcccccggcccagagtacgccgaccccaggtgtggctgccgctccgactctggtctccggtggcgggtccacctcctctaccagctctgggtcatttgaggctagtcccgttgaaccccagctgccttccaaggagggtcccgaacccccagaggaagtgcctcctcccaccacgccaccggttcctaaggtagagcctaagggggacggtatcggcccaacccgccagccgccatcccaaggcttagggtaccctaagtatcagaaatcgttgcctcctcgattccagaggcaacagcaggaacaactcctcaaacagcagcaacagcatcagtggcagcaacaccaacagggttctgccccgcccactcctgtcccaccatctccgccacagcccgtcacgttgggtgcggtgccagccccccaggctcccccaccacctcccaaagcactgtacccaggggcactgggaaggcctccaccaatgcccccaatgaacttcgatccacgttggatgatgattcccccctacgttgatccacggctgctccaaggccgaccacctctggatttttatcctccaggtgtacacccttcaggtctcgtcccaagagagcggtccgacagcggcgggtcctcgagcgagccttttgatagacacgctcccgcgatgttgcgagagagaggcactcctccagtggaccctaagctcgcctgggtgggcgatgtctttaccgcaacccccgcagaacctaggcccctgactagtccgctcagacaggctgctgacgaggacgacaagggcatgaggtcggagaccccacctgtgccccctcctccaccataccttgcctcgtaccctgggttcccagagaacggcgctccaggaccacccatcagtagatttccccttgaagaacccggaccccgtccactgccttggcctccaggctcagatgaagtagctaagattcagacaccaccccctaagaaggagccccccaaggaggaaactgcccagctcacaggcccagaggctgggcgaaagccagcccgcggggtcggcagtggaggtcaaggaccaccacctccccggcgcgaaagccgaaccgagacccggtggggccctagacccggttcatccaggcgtggcatccctcctgaagaacctggcgcaccgccaaggcgagcgggacccatcaagaagccccccccccctacaaaagtggaggagctgcctcctaaacccctggaacagggggatgagactcctaaaccccctaaaccagaccctctgaaaattacgaagggtaaattgggcggacctaaagagacaccccccaacggcaacctcagcccggccccaagactccgacgagactattcatacgagcgcgtcgggcctacatcctgcaggggaagagggagaggcgagtactttgctaggggtcgcgggtttagaggtacctacggaggcaggggcagaggcgccgcaggcaacagcgccgtaaccgaaagctttgaggaaatgatgggcgttgaagtggggcagggggaccagacaaccctgctcctccctgaggccgccctacctgcacgccatggggcacgtgtgcagagcatgcgtaaatccccatctggggcaggaagcggcgctcagaagcaggccgctaggcccatgcgggttatttggctcctccagactcgccgtctgccacacccacgcagagaacacagcccgcgatcacggagcccgacgactagaagtcctaccttccccgctcctgcacggttcactcccggggttggagagagtagtctgccagaagggatttcaccaggacctagacgccgggaacctccccaggtctgtccgggctggtcgcccccagccaaatcgttggcacccaagaaacccccaactggcccattgcctcccagcaaggagcccctgaaggaaaagctcattccaggccctctgagtcctgtcgcccgagggggatccaacggcggctccaatgttgggatggaggacggggaacgtcccaggaggcgccgccatggtagagctcagcagcaggacaagccaccccgttttagacggctgaaacaggagcgtgaaaatgccgcgcgaggatcagagggaaagccgtccctcacccttcccgcgagcgcgccaggaccggaagaagccctgacaacagtgacggttgctccagcacccagacgcgcagcggccaagagtccagacctgagcaaccagaactcggatcaagcgaatgaagaatgggaaacagccagtgagagctcggactttacgtcggagagaagaggggataaagaagctcctcctcccgtactgttgacgcccaaagccgtgggcacaccaggcggcggaggcgggggagccgtccctggaatcagtgcgatgagccgaggcgatctatcccagcgggccaaggacttgtctaagagatccttttcgtcacagcgtcccggcatggaacggcagaatcgccggcctggccctggggggaaggccggctcgtcaggctccagctctggcggagggggcggggggcccgggggccgcactggccccggcagaggagataaaagaagctggcccagtccaaaaaatcggagcagaccacctgaggagcggccccccggtctccctctgccccctcctcccccatcttcaagcgccgtatttagacttgatcaggtgatccactccaatccggcgggcatacagcaagccctagcccagttatcctccaggcagggctccgtgacagcccccgggggccatccgagacacaaaccagggccaccccaggcccctcagggaccatcaccccggccccctacacgatacgagccacagagagtcaactccggtctgagtagcgatcctcactttgaagaaccggggcccatggtgcgcggtgtgggaggtacccctcgcgatagtgccggggtcagtccttttcccccgaagagacgggagcggccgccacggaagcctgagctgttacaggaggagtctctgcccccaccccatagcagcggcttccttgggagtaagccagaaggccccggcccgcaagccgaaagccgagacactggcacagaggcccttacgccgcacatttggaaccgtctccataccgccactagccggaaatcgtatcgcccttctagcatggaaccatggatggaacccctgagtccttttgaggatgtggctgggacagaaatgagtcaaagcgatagcggggtggacctgagcggcgattctcaggtgagttcagggccttgttcgcagcggagcagtcctgatggcggtctcaagggtgccgccgagggtcccccgaaacggccaggtgggagcagcccgctgaacgcagtcccatgcgagggaccacctggatcagaaccgccgagaaggcccccccccgcaccccacgatggggaccgcaaagagctgccaagagagcagccactgccaccggggccaattggaacggaacggagtcagcggacagaccgggggacggaacccggacctattagacctagtcacaggcctggtcctccagtgcagtttgggacttccgataaggacagcgatttacgactcgtcgtgggcgatagtttaaaagccgaaaaggagttgacagcctccgttacagaagcaattccagtgtcccgggactgggagcttcttccttctgctgcagccagtgcagagccccagtctaaaaacctcgatagtggccactgcgtaccagaaccttccagctcggggcaacggctgtacccagaggtcttttatgggagtgctggaccaagttccagtcagatctcgggcgggcacggcctgtcgatcaccagtaaacagtggaggcgacccgggactccctccctgcacccctatcgcagtcagcctctgtacttgcctccaggaccagctccgccatccgccttattaagcggtgtcgcactcaaaggacagttcctggattttagcacaatgcaggctaccgaactgggaaaactgccagctggtggtgtgctgtatccgccgccctcattcctgtactcccccgctttttgcccttcacctttgcccgacacttctctccttcaggtacgccaggatttgccaagccctagtgatttctacagcacccccctccagccgggagggcagtcaggattcctgccttccggggcccctgcccaacaaatgctgctacccatggtcgactcacaattgccagtggtaaattttggttctctgcccccggcccctccccctgccccaccacccctgtctctgctacccgtgggtcctgccctccagccgccttctctcgccgtgagaccccctccggccccagccaccagagttttgccctcccccgctcggccgtttccagcttctctgggcagagccgaactacatccggttgagcttaagccctttcaggattaccagaagctgtccagcaatcttggcggtccaggatcctcccggactccccctactggacgatcgttctctggactgaattctcgactgaaggccacgccatccacatattctggcgtgttccgaactcagagagttgatctttatcagcaggcatctcccccagatgcactccgctggatccccaagccttgggaacgcacaggtcctccaccacgcgaagggcctagtcggcgggcagaagaacctggatctaggggcgacaaggaacctggtttgccccccccccggtag

SEQ ID NO: 200855 - DNA, 6450 bp, Artificial Sequence
  Description of Artificial Sequence: Synthetic coding sequence
atgagcgaccggagcggccccaccgccaagggcaaggacggcaagaagtatagttctctgaatttgtttgatacatacaaagggaaatctctggagattcagaagcctgccgtagcccctcgccacggattgcagtcccttggcaaggtcgcaattgcacgccggatgcccccacctgcaaatctgccttccctaaaagcagagaacaaaggcaatgaccccaatgttagcctggtcccgaaggacggcacggggtgggctagcaagcaagaacagagcgaccccaaatctagcgacgctagcacagcacagccacttgagtcccaacctctgccagccagccaaactccagcgtcaaaccagcctaagcgcccccctgctgcacctgagaacacacctctcgtgccgagcggcgttaagtcctgggctcaagccagcgttactcacggagctcacggcgacgggggtcgggcttcctccctcctctcacggttcagccgcgaggaatttcccacattgcaagccgccggggatcaggataaagcagccaaggagcgtgaatctgctgaacaaagtagcggcccaggtccgagcctcagacctcagaacagcaccacctggcgagacggcggtgggcgcggaccggatgagctggagggcccagactcaaagctgcatcacggccatgatccccgcggcggattgcagccctcagggccccctcagtttccaccctatagaggtatgatgcctcctttcatgtatccaccgtacttgccttttccaccaccctacggtcctcagggaccataccgataccccacgcccgatggtccttcgaggtttccaagagtcgcagggccgcgagggtccgggccaccaatgcgcctggtggagccagtgggacgtccctcgatcctgaaggaggacaacttgaaagagtttgaccagcttgaccaggaaaacgacgacggttgggctggagcgcatgaagaagtagactacactgaaaagctgaaattctccgatgaggaagacggaagggactccgatgaagagggcgccgagggtcacagggacagtcagagcgccagtggagaggagaggccacctgaggctgatgggaaaaaagggaactcaccaaatagcgagccccctactccaaagacagcctgggccgaaaccagtcgcccacctgaaactgaacccggcccacctgctcctaagccacccctgcccccgcctcatcgcgggcccgctggaaattgggggccacctggcgactatcctgatagaggagggcccccctgtaaaccacctgcccctgaggacgaagacgaggcctggcgccaacgccggaagcagtcaagttccgaaattagcttggcagttgaaagagcccgccgaagaagggaggaagaggagcgacgcatgcaggaggaacgcagggccgcttgtgccgaaaagctaaagagacttgacgaaaaattcggagctccagataaacgattaaaagcagagcctgccgctccccctgccgctcctagcacccccgccccgcctccagccgttcccaaggagctccccgcaccacccgcccccccgcccgcaagcgcacccacccccgagaaggaacctgaagagcctgcacaggctcccccagctcaaagcacacccactccaggggtagccgccgcacctaccctggtctccgggggcggatcaactagttctactagttcaggcagttttgaggccagccccgtggagccacagctgcccagtaaggaagggcccgagccccctgaggaggtcccaccgcccacaacaccaccggtaccgaaagttgaaccaaaaggggatggcatagggcctacccgccagccgccgtctcagggcctcggttatccaaaataccagaagagcctgccccccaggttccagcgccaacagcaggagcagctgcttaagcagcagcagcagcaccaatggcagcagcaccagcaggggagcgcaccccccacgcccgttcccccaagtccacctcaaccagtgacccttggcgctgttcctgctcctcaagcaccccccccacctcctaaggccctgtaccccggggctctgggaaggccccccccaatgccacctatgaatttcgatccacgctggatgatgattcctccgtatgtcgatccaaggctgctgcagggcaggccccctctggacttctacccacccggagtgcaccccagcggtctggtgccgagggaacgctctgatagcggaggcagttcgtccgagccatttgataggcacgcgcctgcgatgctgagggaaagaggaactcctcctgtcgaccccaagctggcatgggtgggcgatgtgttcacagctacgcctgctgaaccccggcccctcacctcccctctgcgacaggccgccgacgaggacgacaagggcatgagaagcgagaccccacccgtgccacctccccctccatatctcgccagttatcctggcttccctgagaatggcgcgcccggaccgccgataagccgcttcccactggaggaacccggcccaaggccactcccctggcctcctgggtccgatgaggttgcgaagattcagactccaccgccaaagaaagaaccccccaaagaggagactgcccaattgaccgggcccgaagccggacggaagcccgccagaggggtcggctcgggtggacaagggcctccgccacctcgcagggagtctcgaaccgagactaggtggggaccccggcccggcagttccaggcgaggcatcccacccgaagaaccaggagccccaccgagacgggcaggccccattaagaagccaccaccgcccactaaggtggaagagctgcctcctaaacctctcgaacaaggggatgagaccccaaaacctcctaaaccagatcctttgaaaatcactaagggcaaactcgggggccccaaagagaccccgcccaacggcaacctgtctcctgcgcccagactgaggagggattattcctatgaacgagtaggccctacgagctgcaggggcaggggccggggtgagtacttcgccaggggccgggggttccggggaacgtacggcggtcgcggcagaggcgctgcggggaacagcgctgttaccgagagcttcgaagagatgatgggcgttgaagtgggacaaggcgaccagactactctcttgctcccagaggccgcactgcctgctaggcatggcgcccgggtgcaaagtatgcgcaagagcccctcaggagctgggagtggcgctcagaagcaggccgccagacccatgagggtgatctggttgctccagacccgacgactccctcacccccgtagggaacacagccctcggtcgcgcagccccacaacgcggtcacctaccttccctgcccctgcacgcttcacccctggtgttggagagagctcgcttcctgaaggcatctcacccggccctaggaggcgggaaccaccgcaggtgtgcccgggctggagtccgcccgcaaagtcactggccccaaagaagccaccgaccgggcctctgccgccctcaaaagagcctctgaaggagaagttgattccaggacccctgtcacccgttgcacgcgggggcagcaatggagggtctaacgtgggaatggaggacggcgaacgccctcgacgacgccgtcatgggagagcccagcagcaagataagcctccgcgcttccggagattaaagcaggagagggagaacgccgccaggggcagcgagggtaagccttccctcacgttgcctgcttccgcccctggccctgaggaggccctcacaacggtgacagtggctcctgctccgagaagggccgctgctaaatcccctgatctgtcaaatcaaaatagcgatcaggcaaacgaagagtgggaaactgcttccgaatcaagcgacttcacaagcgagcgaaggggcgacaaagaggccccacctccagtcctccttacacctaaggccgtcgggacccccggaggtgggggtggaggcgccgtgccaggcatctcagctatgagtaggggagaccttagtcagcgagcgaaagatctgtccaaacgcagtttctctagtcaaagacccggaatggagagacagaatcgcaggccaggcccgggaggaaaggcaggctcctcaggctcctcttccggtggcggcggcgggggacctggtgggcgaaccgggcctggccggggcgacaaacggagctggccgagtccaaaaaatcggtcaagacctcctgaagagaggccacctggcctgcctctcccacctcccccgccaagtagttctgccgtgttccggctggaccaggtgatccacagtaatcctgccggcatccagcaggccttggctcagctctcttcaaggcaggggtcagtcacagcacctgggggtcacccgaggcataagccgggccctccccaggctccgcagggccccagcccacggccccccaccagatacgagccacagcgggtgaattccggtctttcaagcgacccccacttcgaggagcctgggcccatggtgaggggcgtggggggaacaccaagagacagtgccggggtctcacccttccctccaaaaagaagggaaaggcccccacgaaagcctgaattgctgcaggaggaatctttaccgcctccccacagttctggtttcctgggaagtaagccggaggggccgggcccccaggcagagtcccgggatacgggcactgaggcacttacgccgcacatttggaaccgcctgcacactgccacatctaggaaatcctatcgtccttcgagcatggaaccatggatggagcctctttccccttttgaagacgttgccgggaccgagatgagtcagtctgatagcggcgttgatctgagcggtgacagtcaggtctctagcggcccgtgtagtcaaaggagcagccccgatggcgggcttaagggggctgccgagggcccaccgaagagaccgggcggctcttcacctttgaatgctgtgccctgtgaagggccaccaggaagtgaaccacctaggcgccctccccccgccccgcacgatggagatcggaaggagctcccgcgggagcagccactgccgcccggcccaattggcacggagcgttcgcagagaactgatcggggcactgaaccaggacccatccggcctagccaccggcctggtcctcccgtccagtttggaacttctgacaaggattctgacctcaggctcgtcgttggtgacagcctcaaggcagaaaaagagttaacagcaagtgtgacagaggctattcctgtgtctcgggactgggagctgctgccctcggccgccgcgtctgctgagccacaatcaaagaaccttgattcaggtcactgtgtgcctgaaccttcctcctccgggcagaggctgtaccctgaagtgttttatgggtccgccggaccatccagctcccagatttctggaggacacggactctcaatcaccagtaagcagtggaggcgcccggggaccccctccttgcacccatatcggtcgcagcctctctatcttccacctggccctgcgcccccaagcgcactgctgtctggcgtcgcactgaagggacagtttctcgatttctctactatgcaggctacagaattaggaaaacttcccgctggcggcgtactttatcctccccccagtttcctgtattcacccgctttttgcccaagcccactgcccgacacatctcttcttcaggtgcgtcaggatcttccctctccatcagatttctattctaccccactccaaccaggaggacaatcaggatttttaccaagcggtgctccggcccagcagatgctgctgcctatggtggattctcagctgcccgtcgttaacttcgggagtctccctcctgcacccccacctgctcctccccccctgtctttactacctgtgggaccagccctgcaaccccccagtctagctgtgagaccaccaccagcccccgcaacccgtgtgttaccgtcccctgcacgaccattccctgcaagtttaggccgagctgagctacaccccgtcgaactcaagccctttcaggactatcaaaagcttagctctaatctgggggggccaggctcctctcgcacgccccctacaggaagatcgttctcaggactgaactcccgcctcaaagccaccccatccacctactctggagtcttccgaacacagcgagttgatttgtaccagcaagcgtccccacccgatgctctccgctggatcccaaaaccatgggaacgcacggggccaccccctagagagggacccagtagacgggcagaggaacctggttcgaggggagacaaggaacctggcctgcctccaccacgatag

SEQ ID NO: 200856 - DNA, 4149 bp, Artificial Sequence
  Description of Artificial Sequence: Synthetic coding sequence
atgctgcgggagcggggcaccccccccgtggaccccaagctggcctgggtgggcgatgttttcacagccacaccagcagagccccgaccattgacttcccctctcagacaggccgctgacgaagatgacaaagggatgagatcagaaactccaccggtcccacccccaccgccttacctcgccagttacccaggcttccccgagaatggcgctcctggacctcccattagtcgtttcccattagaggagccaggaccccgacccctcccatggccacccgggtctgatgaagtggcgaagatccagacgcctcctcctaagaaggagccaccaaaagaggaaaccgcccagttgactggccctgaggcagggagaaagcccgccaggggagtgggatctggcggacagggccctccccccccccggagagagtccagaaccgaaactcgctggggtcccagaccaggtagctctcggagaggaatacctcctgaggagcctggcgcccctcccaggagagccggccccatcaaaaaaccgcctccccccacaaaggtcgaagagttgcccccaaaaccccttgagcagggagacgagacacctaagcccccaaaacccgatcctctgaaaattaccaagggtaagttgggaggtcctaaagagaccccacctaatggcaatctatctcctgcgccacggcttagacgagattattcctacgaacgagttggacctacttcctgtagggggagaggcagaggtgagtacttcgctcgtggacgcgggttccgtggcacttatggcgggcgtgggcgaggcgccagatccagggaattcaggtcctaccgggaattccggggcgacgacggccggggcggcgggacaggtggccccaaccatccacctgctccacgggggcgaaccgcttcggagacccgatcagaggggtctgaatatgaagaaatcccaaaacgacgcagacagaggggttccgaaaccggaagcgagactcacgagtctgatctcgcaccttctgacaaggaagctccaacacccaaagagggcactctgacacaagtgccactggcacctcctccccccggagcaccaccgagtcctgcacccgctcgctttaccgcgagaggtggtcgtgtgtttacaccccgaggcgtgccctcacggcgcggaagaggaggaggcagacctcccccccaggtgtgtcccggctggagcccgccagctaagagtttggctcctaaaaaacctcccacaggccctctacccccatccaaggagccgctcaaggaaaaactcattcccggccccttaagccccgttgcgcgcggcggaagtaacggtggcagtaacgttgggatggaggacggagagagacccagacggagaagacacggcagagcgcaacagcaggacaagccaccccgctttcggcggctgaagcaggaacgggagaatgctgcacgtggatcagagggtaagccctctctgactctaccagccagcgccccagggcctgaggaagctctgaccaccgtaacagtggccccagccccccgccgagctgctgccaaatctcctgacttgtctaaccaaaactccgaccaggcaaatgaagagtgggaaaccgcatctgagtcctccgacttcactagtgaacgacgaggagataaagaagccccccctcccgttctcctgactcccaaggcagtcggaacaccggggggtgggggaggaggtgcagtgccagggatctcagccatgtctcgcggcgacttgagtcagcgagccaaagatcttagcaaacgatcattcagcagtcagcggcccgggatggaacggcagaaccggcggcccgggcccggcggaaaagcagggagttccggctccagtagcggcggcggcggcgggggaccagggggccgcaccggccctggcaggggcgacaaaaggagctggccctcccctaagaaccgcagtagaccgcctgaggaaagacccccgggattgcctctccctccaccgccaccaagctcctctgctgtgttcaggttagatcaggttattcatagcaatccagccggaattcagcaggccttggcacagctgagctctcgccagggatccgtgaccgccccagggggacacccccgtcataagccaggacctcctcaagcacctcaggggccttctccaaggccgccaactcggtatgaaccacagagggtgaatagtgggctgtctagcgacccccacttcgaagagcctggtcctatggtccggggtgtcggcggtacccccagggacagcgctggggttagtccctttccacctaagcgtcgcgagaggcctccacgaaagcctgaactcctacaggaggagagcctgcctcctccacactcctccgggttcctagggtctaagccagaaggaccaggaccccaagccgagagccgggacacaggcaccgaggccctaaccccacatatttggaacaggctgcatacagcaacgtcaaggaagtcatacaggcctagctctatggaaccatggatggagccactaagcccctttgaggacgtggctggaacggaaatgtcccagagcgatagtggggtggatctgagcggagatagtcaagtgagcagcggtccctgtagtcagcggagctctcccgacggaggactgaagggtgctgccgagggccccccgaagcgacctggcggaagtagtcccctgaacgcagtgccatgcgagggaccccctggcagcgagcctcctcgaaggcccccacccgcacctcacgacggagaccgcaaggagctcccaagggaacaacccctacctcccggcccgattggcacagagaggagccagcggaccgaccgcggaaccgagcccggcccgataaggccctcacatagacctggcccccctgtgcaatttggcacaagtgataaggactccgatctcagattggtcgttggcgacagcctgaaggctgagaaagagctgacagcatctgtgacagaagcgatccctgtctctcgggactgggagctccttccctctgccgcggcaagcgccgagccgcagtctaaaaatctcgactccgggcactgtgtcccagaaccctcctcctccggacagcgcctgtatccagaagtgttttacgggtccgctggcccaagtagcagccagatctctggaggtgcgatggactctcagttgcatcctaattcaggtggattccgccctgggacccctagccttcatccgtatagaagccagcccctgtacctgccccctgggcctgcccctccgtcagctctactcagtggcgtggccttaaagggccagttccttgactttagcacaatgcaggccacggagttggggaagctgccggcgggcggtgtgctgtacccgcctccatcatttctgtattctcccgctttttgcccatcacctcttccagacactagtctcctacaggtcagacaggacctgccttctccgtcagacttttactctacaccattgcagcctggcgggcaatccggatttcttccatccggtgctcctgcccagcaaatgctgctgccaatggtggacagccagcttccagtcgtgaactttggatccctgccccctgcgccccccccagctccaccacccctgtccctgctcccagttggtcccgccctgcagcctccttctttggccgtccggcctccccccgctcccgccaccagggttttgcctagtcccgcccgcccttttccagcaagtcttgggagagccgagttacatcctgtggagctgaaaccatttcaagattatcagaagctctcatccaacctcggagggcctggctcctccagaacacccccaacgggtaggtcgttcagcggactgaactccaggttgaaggccaccccatcgacatattcgggggtcttccgcacacaaagggtggacttgtatcaacaagcatcccccccagatgccctccggtggattcccaagccatgggagaggactggcccgccccctagagagggacctagtaggcgggccgaggaaccgggctctcggggcgataaagaacccggtttacctccgcctcgatag

SEQ ID NO: 200857 - DNA, 4149 bp, Artificial Sequence
  Description of Artificial Sequence: Synthetic coding sequence
atgctgcgggagcggggcaccccccccgtggaccccaagctggcctgggtgggggacgtgttcacagccacccctgccgagcccaggcctctgacctcccctcttcggcaggccgccgatgaagatgataaaggcatgaggtcagaaaccccacccgtgcctccccctccaccttatctcgcgagttaccctggcttccctgaaaacggagctcctggccccccaatctcccgatttccactcgaggagcccggccccagacctctgccatggcctccagggtcagacgaggtggccaaaattcagaccccacctcccaagaaagagccccctaaggaagagactgcccagttgactggtcccgaagccggtcgtaaaccggccagaggtgtggggtcaggaggtcaggggccccctccaccccgaagggaatctcgaaccgagacaagatggggcccccggcctggctccagtcgacgtggaattccacctgaggagccaggagcacctccgcggagggccgggcccataaaaaaacctcctcctccaacaaaagtagaggagctcccccctaagcccctcgaacagggcgacgagacacccaaaccgcccaaacctgatccactcaaaatcaccaaagggaagttaggcggacctaaggagacacctcccaacggcaacctgtcccccgctccccgtctacggagagattactcttacgaacgggtgggcccgacaagttgtcgcggtagggggcggggtgagtatttcgcccgtgggcgtgggttcagaggcacatacggtggacggggacgtggggctcgtagccgcgaatttcggtcttatcgcgaatttcgtggagacgatggacgtggagggggaacaggcgggcctaatcatccccctgctccacgaggcaggacagccagtgagacacggtccgaaggtagcgaatacgaggaaattcccaagaggcgaaggcagcgggggtccgagacgggctcagagacgcacgaatcagacctggctccatctgacaaggaagctccaacaccaaaggagggaactttaactcaagtgcctctggctccaccgcctccaggcgcccccccgtctccagctcccgctcgcttcaccgcccgaggtggaagagtgttcaccccgcgaggcgttcccagtcgtcgaggccgaggcggtggacgtccccctcctcaggtgtgccccggttggagcccacccgcgaaatccctcgctccaaagaagccacccaccgggcccctcccccccagtaaggagcccctgaaggagaaacttattcctggtccactgtctcctgtggcccgtgggggatctaatgggggatcgaacgtcgggatggaagacggagaaaggcctcggcgcaggagacatgggcgcgcccagcagcaagacaagccacctcgcttcagacggttgaagcaagagagggaaaacgcggcgagggggtccgaagggaaaccatccctgacccttcccgccagcgctccgggtcccgaggaggcccttactactgtgactgtggctccagcgccgcgcagagcagcagctaagtctccagacctgagcaatcagaacagtgatcaggcaaacgaggaatgggaaaccgctagtgagagttctgatttcacaagtgagagacggggagataaggaagctccgccgcccgtcttactcacaccaaaggcggtcgggactcctggtggcggtggaggaggagcagtgccagggatcagtgctatgagtaggggcgatctgtctcagagggctaaagacctttccaagcggtcattttcatcccagcgcccaggcatggaacggcagaatagacgccctggtcctggaggcaaagccggatcctctggcagttcatctggggggggaggggggggacctggaggcagaactggtccaggacggggcgataaaaggtcgtggccaagtcccaagaaccggagcaggcctcccgaggagagacctcccggactcccattaccgcctcccccaccgtctagctccgcggtctttagattggaccaagttattcactcgaacccagctggcatccagcaggccctcgcccagctttccagccggcagggatccgttacagcacctggtgggcacccacgacataaacccggcccgccacaggccccacagggccctagtcccagaccccccactcgatacgaaccgcaaagagtgaactccgggctctcctctgaccctcactttgaggaaccaggccccatggtccggggtgtagggggaactccccgtgatagtgccggagtcagccctttcccacccaagagaagagaacgtcccccacgaaaacctgagctgctccaggaggagtcactgcctccaccccattcctccggttttcttggaagcaagcctgaggggccaggaccccaggccgaatcacgggacactggaactgaagccttgactccccatatatggaaccgcctgcataccgcgacttcccgcaagagctaccgcccaagctccatggagccttggatggaacctctgagcccattcgaggatgtagccggcacggagatgtctcagtctgattcgggtgtagacttgtccggagactcacaggtgagttccggaccatgctcacagagatcttcacctgacggtggactgaaaggagctgcagagggccccccaaaacgcccaggtggctcatccccgctcaacgcagtgccctgcgaagggccaccaggatccgaacccccaagacgtccacccccggcacctcacgacggcgaccgaaaagagcttccaagagaacagcccttaccccccggcccaatcggtactgagagatcacagcggaccgaccggggtacagaacccggcccaattcgtccttcccaccgtccaggtcctcccgtgcagttcggcacaagcgataaggactctgatctacggctagtggtgggtgattcccttaaggctgagaaggagcttactgcctctgtaaccgaggccatccctgtttcaagggattgggaactgctgcccagtgccgcagcaagtgcagaacctcagtcaaaaaacctggattccggacactgcgtccccgagcccagtagttctggacagcgattgtacccagaggtcttttacggtagcgcgggcccaagttcctctcagatctctggcggggcaatggacagccaattgcaccctaactctggcgggtttagacccggcactccttccttacacccataccggtcccagcctttgtacctcccacctggccctgcccctccaagcgcgctcctttcgggcgtggcgttgaaaggtcagtttctggactttagcacaatgcaggctactgaattgggtaagctccctgccggcggggttttatatccaccaccctcctttctgtactcgcctgccttctgtcctagtcctctccctgatacctcgctactgcaggtgcggcaggacctgcccagccctagcgacttttacagtactcctctgcaaccgggtgggcagtccggctttctgccgtcgggagcaccagcacagcagatgttacttccaatggtggatagtcagctgccagtagtgaacttcggctctctcccacctgcacccccgccggcccctccgccactctctctcttgccggtgggtccggccctgcagccaccatcactggccgtgcgacccccccccgctccagctacgagggtgctgccaagcccggctaggcccttccctgctagtttgggccgtgctgaactacaccccgttgaactcaagcctttccaggattaccagaaactgtcttcgaacctaggcggccctggatcttctagaactccaccgactggacggtcattctcggggctgaactcacgtctgaaagcgacaccaagcacatacagtggagtcttccggacccaacgggtggacctctaccagcaggcttccccccctgatgcgcttaggtggattcccaagccatgggaacggaccggaccacccccgagggaaggcccttccaggcgcgccgaagagccggggagccgaggcgataaggagccaggacttccccctcctcgctag

SEQ ID NO: 200858 - DNA, 6450 bp, Artificial Sequence
  Description of Artificial Sequence: Synthetic coding sequence
atgagcgaccggagcggccccaccgccaagggcaaggacggcaagaagtactccagccttaacctctttgatacctacaaaggaaagtcgctcgagattcaaaaacctgcagtggctcctaggcacggactccaaagtcttggaaaagtcgccatagcccgcagaatgcctcctcccgcaaacctgccatccctgaaggcggagaataaagggaacgatccgaacgtgtccttggtaccgaaggacggaactggctgggcatccaaacaggagcagagtgacccaaaaagttctgatgcctccacagctcagccacctgaaagccagcctctacctgcatctcagacgcctgcttccaaccaaccaaagcggcctcccgcagcgccagaaaatacacctttggtgccttcaggggtaaagtcctgggcacaagcgtctgtcacccacggtgcacacggagacggcggacgcgcctcctcattgctaagtcggttttcgcgggaggagtttcccaccttgcaggccgctggcgatcaggacaaggccgccaaagagcgcgaaagcgcagagcagagcagcggacctggccccagtttgcgacctcagaatagcacaacttggagagatggggggggccggggaccagatgagctggagggtcccgacagcaaacttcatcatgggcacgatccacgagggggtcttcagccctctggaccaccgcagttccccccatacagaggcatgatgccacccttcatgtaccctccgtacttgccatttccccctccctatggaccacaagggccttatcgatatcccacacccgatggccctagtcgcttcccgagggttgccgggccccgtggctccggcccccccatgcggcttgtcgagcctgtggggaggccttctatcctgaaggaagacaatctgaaagaattcgatcaactggaccaagagaatgatgacggctgggctggagctcacgaagaggtcgactacaccgagaagctgaagttttccgacgaagaggacggccgcgatagcgatgaagaaggggccgagggccatcgcgacagccagtccgcttcaggtgaagaaagaccacccgaagccgatggcaaaaagggaaactctcccaacagcgagccacccactcccaagacagcctgggctgagacaagcagacctccggagacagaaccgggcccacctgctccaaagcctcccctaccccccccacatcggggtccagctggaaattggggtccgccgggggactatcctgatcgggggggacctccctgcaagccccccgcacccgaagatgaagacgaagcatggagacaaagaagaaaacagtcttccagcgaaatctcactcgctgttgagcgggctcggcgaagaagagaagaggaggagcgtagaatgcaagaggaacgccgggccgcgtgcgctgagaaactgaagcgtttagatgagaagtttggcgctcccgacaagagactgaaggctgagccagccgcccccccggccgccccatccacaccagctccaccacccgcagttcctaaagagctccctgctcccccagccccacctcccgcctcggctccgacaccagagaaggaacccgaagagcctgcacaagccccgccagctcaatctacccctacccctggggtcgccgcggcccccactctggtgtcaggaggtggatcaacttcttcaacctcatctgggtcattcgaagcctcacccgttgagccccaactccctagcaaagaagggcctgagccccccgaggaagtgcctcctccaacaacaccacctgtgccaaaggtggaacctaaaggtgatggtataggccccacaaggcagccaccctcccaggggctgggttatccaaagtaccagaagtcactacccccccggttccagaggcagcagcaggagcaacttctgaagcagcagcaacagcaccagtggcagcaacatcagcagggctctgccccacctacccccgttcccccgagtcccccccaacccgtaacgctgggggccgttcccgcccctcaggcccccccccctccacctaaagcgttgtaccccggcgcgctgggccgccctccaccaatgccgcccatgaactttgatccgaggtggatgatgatcccgccttatgtcgacccacggctgttgcaggggcggccaccacttgatttctaccccccgggcgtgcatccatccggactggtccctcgggaaagaagcgattcaggcgggtccagctcggaaccttttgaccggcacgcacccgcaatgctgcgggagaggggaacgccacctgtggatcccaagctggcatgggtcggtgacgtctttacagccacccccgctgaacccaggccactcacctcccctttacgccaagcagctgacgaggatgacaaaggcatgagaagcgaaacccctcctgtccctcccccaccaccctatctggcttcttacccagggttccctgagaatggtgccccaggcccacccatctccagattccccttggaagagccaggacctagacccctgccttggccacctggaagtgatgaggtggcaaagatccagacccccccacccaagaaagagcctcctaaggaggaaacagcccaactgacaggccccgaggccgggagaaagcctgcacgaggcgtcggttccggtggtcagggacctcccccacctcggagggaatcaagaactgagactagatggggaccgcgacccggctcttcgcggcgcgggatccctcccgaagagcccggtgcccctccacggagggcaggccccataaagaagccaccaccccctaccaaagtggaagagctcccgccaaagccgctagagcagggtgatgagactcctaagcccccaaagcccgatccgttgaagatcacaaaaggcaaacttgggggacccaaggagacaccgccgaacgggaatcttagcccagcgcctagactgcgccgagattatagttacgaacgggtcggacctaccagctgccgcggaaggggaaggggggagtattttgcgcgcggaagaggcttccgtgggacctacggagggagaggacggggcgcagctggtaattctgcagttacagagtcgttcgaggagatgatgggagtggaagtagggcagggagaccagaccacccttctcctgcccgaggcagctctacctgcacgccatggcgctcgggtacaatcaatgcgtaagagtccatctggcgccggtagcggcgcccagaagcaagctgcccggccaatgagagtcatttggctcttgcagaccaggcgtcttccgcacccccgaagggaacatagcccccgttctcgtagcccaacaacacgcagtcccacctttcccgcgcccgcgagatttacccccggagtgggcgagagttctctccccgaggggattagtcctggcccaagaaggcgcgagccccctcaggtttgtcccggctggtccccccccgccaagagtttagcaccaaaaaagccacccaccggccccctgccaccatcaaaggaacccctaaaagaaaaactgatccctggcccgctgtcacccgttgcaaggggagggtcaaacgggggcagcaatgtgggcatggaggacggagagcgtccacgtagacgtcgacacggtcgggcacagcagcaggataagccgcctagattcagaagattgaagcaggaaagggagaatgctgctagagggtctgaaggtaagccgagcctcaccttgccagcaagtgctccagggccggaagaagccctgacaacagtcaccgtcgcccccgccccaaggagggcagctgctaaatctcctgatctctccaaccagaacagtgaccaagctaacgaagaatgggaaaccgcctccgagagctcagattttacctctgaacgccggggcgacaaagaagcgcctcccccagtccttctgaccccaaaggctgttggaacccctggcggcggcggaggcggcgctgttcccggcattagcgcaatgtcgaggggcgacctgagccagcgcgccaaggacctgtccaagaggtcttttagttctcagagacctggtatggagcgccaaaatcggcggcccggacccggaggaaaagccggtagctccggtagttcttcaggagggggaggggggggccccgggggaaggacgggacctggaagaggggataagagatcttggccatcccccaaaaatcgaagcagacccccagaggaacggccaccgggtctgcccctgccgcccccccctccatcttcctccgccgtctttcggctggatcaggtcatccactcaaacccagccggaattcagcaggccctcgctcagttgtcttctaggcagggtagcgtcactgcacccggagggcacccccgccacaaaccaggtccaccccaagcgcctcaggggccttcgcctagaccaccaacccgctacgagccgcaacgggtcaattcaggccttagcagcgatccgcattttgaggaaccagggcctatggttcgcggcgtcggtggaacgcccagggatagcgccggagtaagcccctttccgcctaaaaggcgtgaacgtccaccccgcaagccagagctcctgcaggaagagagtttacctccaccgcactcaagtgggtttctcggatcaaaacctgagggcccagggccacaggctgagtcaagagacactgggaccgaggctctaaccccacacatctggaatagactgcacaccgccacctcacgaaagagctataggccatcaagtatggagccatggatggaaccgctttcacctttcgaggacgtagccggtactgagatgagtcagtccgacagcggcgtagatctgtccggggactcccaggtgtccagtggaccctgcagccagagatcttcgcccgatggtggtctgaagggggccgcagaggggcctcctaagcgaccagggggttccagcccattaaacgcggtgccatgtgaggggccaccagggtctgagccccctagacgcccaccgcctgcacctcacgatggcgatcggaaggaattgccgagggagcaaccactcccgcctggtccaatcgggactgaacggtcccaacacaccgaccgaggcaccgagcccgggcccatccggccctcacacagacctggcccaccagtccagttcggaacctctgacaaagacagtgacctccgactcgtcgttggtgatagcctgaaagccgaaaaggaactcactgcctctgtgacagaggcaatccccgtaagcagagattgggagctgctacccagtgccgccgcttccgctgagcctcagtccaaaaacttggattccggacactgtgtgcccgaacctagctcaagcggacaacgactttatcccgaagttttttacggaagcgcggggccgagctcttctcagatctcaggtgggcacggattgtctgtaacttctaagcaatggcggcgcccagggaccccatcccttcatccctataggagccagcctttatatctgccgcctgggcctgcaccaccctccgccctgctgagtggggtggccctgaagggccagttccttgatttttccaccatgcaagctaccgagctcggcaagctgcccgcaggaggtgtcttataccctccacctagcttcctgtattcccctgcattctgtcccagcccactacctgacacgagcctgttgcaggtcaggcaagaccttccttctccaagtgacttctattccaccccactccaacctggggggcagtctggtttcttgcccagcggagctcctgcacagcagatgctacttccaatggtagatagccagctccctgtagtgaactttggctccctccctcccgcacctccacctgcacctccaagtctgtcgctgctgcccgtggggcccgcccttcaacccccctccctggccgtgaggccaccccctgcgccagccacacgggttctgccatctccggccaggccattccccgcatccctgggccgcgccgagcttcatccggtcgagcttaagcccttccaggattatcagaaattgtcaagcaacctggggggtcccgggagttctaggacgccgcctaccggccggagcttttcaggccttaacagcagacttaaggcaaccccttcaacatatagtggagtcttcagaactcagcgggtggatctgtaccagcaagccagtccacctgacgcgctccgttggatccctaaaccttgggaacgaacggggccacccccccgagaggggccttcacgcagagcagaagagccaggctctcgcggggacaaggaaccgggcctcccccctcctagatag

SEQ ID NO: 200859 - DNA, 4149 bp, Artificial Sequence
  Description of Artificial Sequence: Synthetic coding sequence
atgctgcgggagcggggcaccccccccgtggaccccaagctggcctgggtgggagacgtgttcaccgcaacccccgccgaaccacggcctctgaccagccctctcagacaggccgccgatgaagacgacaaaggaatgagaagcgagaccccaccagtacccccccctccgccctacctggcttcttatccaggatttccagagaatggcgcccctggccctccaataagcagatttcctctcgaggagccaggcccacgcccactgccctggccacctgggagcgacgaggtcgccaaaatccagacccctccgcctaagaaggaaccaccgaaagaggaaaccgcgcagctgacaggacccgaggccgggcggaagccagctagaggcgtcggctccgggggtcaaggccctccacccccccgacgggagagtaggacggaaacacggtggggccccagacctggctcctcaaggagggggatacctccggaagaacccggggctcccccaagacgcgctgggccaataaagaaaccacctccaccaacaaaagttgaagagcttcctcctaaaccactggagcagggggacgagacacccaagcctcccaaacccgaccctttgaagatcaccaagggaaagctcggcggccctaaggagacacccccgaatggtaatttaagccccgctccaaggctccgccgggactatagctacgaaagagtcggccctactagctgccgtgggagaggtcgcggcgaatactttgccagggggcggggctttagagggacatacggaggaaggggtagaggcgcacgctctcgcgaatttcgttcttacagggagttccgcggcgacgatggacggggcggcggtactggcggtccaaaccatcccccagctccccgggggaggacagccagcgaaacccggtccgagggttctgaatatgaggagattcctaaacgccgtcgtcagcgaggtagcgaaactggcagcgagacacacgagagcgacctcgccccctccgataaagaagcgccgactccaaaggagggtacactgacgcaggtgcccttagcacccccacctcccggcgctccaccatcacccgcccccgctcgattcacagctcgcggtggcagagtcttcacaccccgaggagtcccaagccgacgaggtaggggtggagggcgaccccctccccaggtttgcccagggtggtcaccacccgccaagtctttagccccgaagaagccaccaactgggccactgcctccaagtaaagagcctttgaaggagaaattgatcccggggcccctttcccccgtggcccgcggcggctcgaatggaggctccaacgttggtatggaagacggagaacgccctcggcgacgacgacatggtcgcgcacagcagcaggataagcccccgcgtttccgtcgcttgaagcaggagcgggaaaatgccgctagaggcagcgagggcaagccttccctgacattgccagcctcggctccaggaccagaggaagccttgaccactgtgactgtggcccccgcccctcgacgggcggccgccaaaagcccggatctgtccaatcagaacagcgaccaagccaatgaagaatgggaaacagccagtgagtcatcagattttacaagcgaacggcgtggggacaaggaggctcccccccctgtcctgctgacaccaaaggccgtggggacgcccggagggggtggaggcggtgcagtacccggaatcagcgctatgagccgtggcgatctgagtcagcgggctaaggaccttagtaaaagatccttcagctcgcagcgaccaggaatggagcgtcagaatcgacgtcccggacccggagggaaagctgggtcttctggctcaagtagtggagggggaggaggcgggcccgggggtcgcaccggccccggaagaggggataagcgaagttggccatctcctaagaacaggtctcgccctccagaagaacgccccccaggcctgccattgccaccacctcccccttctagtagcgccgtgttccgacttgaccaagtgatacactctaatccagctgggattcagcaggcccttgcccagttgtcctctcgccagggctctgtgactgcacccgggggccatcctagacacaaacctgggcctcctcaggctccccagggacctagtccaagacctccaacaagatacgaaccccagagagtgaattctggactctcctctgacccgcactttgaagaaccagggccgatggtaaggggagtaggcggcactcctcgggatagcgccggcgtgtcccctttcccgcctaagcggagagagagacctcctcgtaagcctgagcttttgcaggaggagtccctgccaccacctcacagtagcggcttcctcggcagtaaaccagagggaccaggccctcaggcggagagtagggatacggggacggaggctcttaccccacacatttggaaccggctgcatactgcaaccagcaggaagtcctatcgtccctcatctatggaaccatggatggagccactgtccccctttgaggatgtggccggaaccgaaatgtcacaaagcgactctggggtggacctgtctggcgatagccaggtgagcagtggcccctgtagtcaacgcagttcacccgacgggggtttaaaaggagccgctgaaggaccccctaagcgcccagggggtagttctccgctgaacgccgtcccttgtgagggcccccctggctctgaacccccccgcagaccaccgccagccccacacgacggcgataggaaagagctgccaagggagcaacctctgcccccaggtccgatcggcaccgaaaggtcccagcacaccgaccgcggcactgagcctggacctattcggccctcacacaggcccggccctccagtgcagtttggcacttccgacaaagattcagaccttaggctggttgtcggcgatagcctgaaagctgaaaaagaactgacagccagtgtgaccgaggccatccccgttagccgtgattgggagctgttgccttctgccgccgcctctgccgagcctcagtctaagaacttggacagcgggcattgcgtgccagagccctcatcaagcggccagcggttgtatcccgaggtcttctacggatccgcaggaccaagtagctcccagatctccggcggggccatggattcccagctgcacccaaattccggcggctttcgccccggcactccctcccttcacccgtataggtcccagcccctgtatctcccccccggtccggcgccacccagcgccctgctatccggagtggccctgaaaggacaattcctcgacttcagtacgatgcaggcgacggaactcggcaagctgccagccggaggggttctctatcctcccccttccttcctctatagcccagcgttttgcccttcacctctacctgataccagtctcttacaggtcagacaagatctcccctcgcccagtgacttctactcaactccacttcagcctggcggacagagtggctttttaccttctggagcacccgcgcagcagatgttgctgccaatggtcgactctcagctgcccgtggtgaacttcgggtccttacctcctgcccctcccccagctcccccgtccttatcactcctgccggtaggacccgccctgcagcctccatccttagcagtccgcccgccccccgcccctgccacccgggttctgccatcacccgctagaccattcccagcttctctggggagagccgaactgcatcccgtcgaactgaagcccttccaggactaccagaagctgtcttcaaatcttggcggcccaggctcgtctcgcaccccacctaccggtcgtagctttagtggcctcaatagtagattaaaggccacaccatctacctattctggcgtttttcggacgcagcgcgtcgacctgtaccagcaagccagcccacccgacgccctgcgctggatccctaagccgtgggagagaacaggccctcccccacgcgagggcccttcccgacgcgcagaagagccggggagcagaggcgacaaggagcccggccttccacccccaagatag

SEQ ID NO: 200860 - DNA, 6450 bp, Artificial Sequence
  Description of Artificial Sequence: Synthetic coding sequence
atgagcgaccggagcggccccaccgccaagggcaaggacggcaagaagtactcatcgcttaatctctttgacacttacaagggtaaaagtctggagattcagaagccagctgtagctccccgccatggcttgcagagcctgggcaaagtcgccatcgctcgtcggatgccacctccggcaaacttacccagtctgaaagccgagaacaaaggtaatgatcctaatgtgtcacttgtgcctaaagatggcacgggttgggcaagcaagcaggagcagtctgacccaaaatcctccgacgccagtaccgctcaacctcctgagtcccaacccctgcctgctagccaaaccccagcaagtaatcaacctaaaagacctccagcagcacccgaaaataccccattggtgcctagcggagtgaagagttgggctcaggcaagcgtcacgcacggggcccacggggatggggggcgggcatccagcctgctatcacgattcagtcgcgaggagttccctaccctccaggcagcaggcgatcaggacaaagctgccaaagagcgcgaatccgctgaacaatctagtggaccgggcccttctttacggccacagaactctacaacctggagagatggcggtggacgcgggccagacgaactggaggggccagacagtaaacttcaccatggccacgacccccgaggggggcttcagccatcaggccctccgcagtttccaccctaccgcggaatgatgcccccattcatgtatccgccctacctgccgtttcctcctccatatgggccccagggaccctaccggtacccgaccccagatggaccttcacgcttcccgagggtggccggtccccgcggatcagggcccccgatgcgacttgtggaaccagtcggaagacctagcatcctcaaagaggataatctcaaagagtttgatcagttggaccaggagaatgatgacgggtgggccggcgcgcacgaagaggtcgattacacagaaaagcttaagttttcagatgaggaggacgggagggactctgacgaagagggcgccgagggacatagggacagccagtccgcctcgggagaagagagaccacccgaagcggatggcaagaagggcaactctccaaactccgaacctcccactccaaagacagcttgggcagaaaccagcagacctccagagacagagccggggcccccagctcctaagccccctctgcccccccctcatagaggtccggccggcaactggggaccacccggggattaccccgatcgcggcggacctccttgtaaacctccagcaccagaagatgaagatgaagcttggcgccaacggcgtaagcagagcagctctgaaatctccctcgccgtggaaagagcccgcaggagaagggaggaagaggagagaagaatgcaggaagaacgtagagctgcctgtgctgagaagttaaaacggctggacgaaaaattcggtgccccagacaagagattaaaagctgagcctgccgccccacccgccgccccttccacacccgctcctcccccggctgtgccaaaggagctgccagcacctccagcccctccacccgcgtctgctcctacaccggagaaggaacccgaggagcctgctcaagccccccctgcacagtctacacccacacctggagtggcagctgctccgactctggttagcgggggaggctctacttcctccactagctctggaagtttcgaggcctctcccgttgagccacagttaccatcaaaagagggtcccgagcctcccgaagaggtcccaccacctactacaccacctgtgccaaaagttgagcctaaaggcgatgggattggacccactcggcagccaccatcccagggcctgggctatccaaagtatcagaagtcattgccccccaggttccagaggcagcagcaggagcagctcctcaagcagcaacagcagcaccagtggcagcagcatcagcaggggtcagccccccccactccagtacccccatcgccaccccagcctgtcacacttggcgccgtgccggccccccaagccccgccgcctccccctaaggcgctttatcctggcgctctgggcaggccaccccccatgcctccgatgaacttcgaccctcgctggatgatgatcccaccttacgtggatccccgcctgctacaaggccgcccgccactggacttctaccctccaggagtacatccatcaggccttgttcccagagagaggtccgacagcgggggctcaagcagtgagccctttgacagacatgcccctgccatgcttcgcgagcgggggacacctccagtcgatcctaaactggcatgggtgggcgacgtgtttaccgcaactccggccgaaccgagacccttgaccagccctttgcgccaggcagctgatgaagatgataagggaatgaggtctgagacaccacccgtgcccccaccaccaccctacctcgccagttaccctggctttcccgaaaatggggcccctggtccgcctatcagccgcttccctttagaggaaccggggccgcgcccattgccttggccgcctggctccgacgaagttgccaagattcaaacgccaccgccaaagaaagaaccccccaaggaggagaccgctcagttgaccgggcccgaagccggtaggaagccagcgaggggcgtggggtcaggcggccaggggccgcccccacctcgcagagagtctagaaccgagacgaggtggggccctcgccccgggtcttcgcgccggggcatccctcccgaagagcctggagcccccccacgccgagccggcccgattaaaaagccacctccgcccacaaaagtggaagagctgccacctaagccactagaacaaggagatgagacaccaaaaccaccaaagccagatcccctgaaaatcactaaaggcaaactaggtggtcctaaggagacacctcccaacgggaatctgtcccccgccccgcggctgagacgggactactcctacgaacgtgtgggacctacgagctgccgcggacgtggccgtggggagtacttcgcgcgcggtcgaggtttccgggggacctatggtggccgcggaaggggggctgcaggaaactccgccgtaaccgaatcctttgaagaaatgatgggtgttgaggtgggccagggcgaccagaccaccctgctgctcccagaagctgcgctgccagcgaggcacggggctcgggtacagagcatgcgcaagtcgccaagcggcgcaggtagtggggcccagaagcaagccgccagaccgatgagggtgatctggctacttcagactcgccggcttcctcatccaagacgagagcactctccgaggagcagaagtccgacaactagaagcccaaccttcccagccccagctcgtttcacccccggggttggcgaatcctcccttcctgagggaatttctcctggccccaggcggagagagccgccgcaggtctgccccggctggtcacctcctgccaagtcattagctcccaaaaagccccccactggccccttgccgcccagtaaagagccactaaaagagaaactgatacctgggcccctctctcctgtggcccgaggcggcagcaatggggggagcaacgtgggaatggaggatggggagagaccaaggaggcggagacacggtcgagcccaacagcaggacaagccaccacggtttcgccgcctgaagcaggagagagagaacgcagctcgaggaagcgagggcaaacccagcctgacgctgccagcctcagcgcctggtcctgaggaggcccttacaacggtcaccgtcgcccccgctcctcgccgagctgccgccaagtctcctgatctttctaatcaaaactctgaccaggccaacgaagaatgggaaacagcatccgaatcttcagacttcacaagtgagcgtcgaggcgacaaggaggccccgcccccggtgttgttgaccccaaaggctgtggggactccggggggcggcggaggaggcgccgtcccgggaatttccgccatgagccgcggggatctgtctcagagagcgaaagacctgtcaaagagatcattttcatctcagcggccgggcatggaaaggcagaacaggcgccccgggccaggaggcaaagcaggatccagtggatcctctagcggggggggtggcggcggcccggggggtagaacgggcccaggcaggggtgacaagcggtcttggccctctcctaagaatcgctcaagaccccccgaggagagaccaccaggcttgcctctgcctccccctcctccaagctcttctgccgtgttccgccttgaccaggtgattcatagcaatcccgctggtatacagcaggctcttgcacaactgtcctcaaggcaagggtcggttactgctcccggcggtcaccctcgccacaaacctgggcccccacaagcccctcagggtccatcccccagaccacctactcgttatgagccacagcgtgtgaactccggcctctctagcgatccacatttcgaggagcccggacccatggtgagaggtgtggggggtacccctagagactctgccggcgtcagtccgttccctcccaagcgcagggaaaggccccctcggaagcccgagctgctgcaggaggaatcccttccacccccgcactcttccggattcttgggtagcaagccagagggacctggtccacaggctgagagtagggacacaggcacagaggcactcactcctcacatatggaatcgtctgcacaccgccacgagccgcaagtcgtaccgcccttcaagcatggagccttggatggagcccctgagtccattcgaagatgtggccgggacagaaatgtcccagagcgactctggtgtggatcttagcggagactcccaggtatccagcgggccatgctcacagagatcctcacctgacggcgggttgaaaggcgcagctgagggacctcccaagaggccaggaggctcctcccctctgaacgctgtgccttgtgagggacctcccggtagcgagcctcctcgcagaccacctcccgctccccatgatggggatagaaaggaacttcctagagaacaacctcttccacccggcccaattggtaccgagcggagtcaacatactgaccgcgggaccgagccagggcccatacgccccagtcataggccgggcccaccggttcaatttggcacttctgacaaggactccgatttgcggctcgtggtgggtgattccctcaaagcagagaaagaattaactgcatctgtaaccgaggcgataccagtgtcacgagactgggagttgctgcccagtgctgcggcctctgccgagccccagagtaaaaatcttgattctggacattgtgtcccagaaccctcctcctctggccaaagactgtacccagaggtgttttacggttcggctggtccatcctcctcgcagataagcggggggcatggattgagcgtgaccagcaaacagtggaggcggcccggtaccccatcactgcacccataccgaagccaaccattatacctgccccctgggcccgccccacccagcgccctgttgagcggcgttgcgttgaaggggcagttcttggacttcagcaccatgcaagctacagagttgggcaaactgcccgcgggcggcgtgctctacccgcctccttcttttctctattcacctgccttctgtccatctcctctgcctgacacatccttacttcaggtccgccaagacctgcctagcccaagcgacttttattccacccccctgcagcccggaggccaaagcggcttcttgcctagcggtgcaccagcacagcagatgctgctgcccatggtcgactcgcagctgccggtagtgaactttggttccctgccaccagccccacccccggcccctccgagtctatcattactgcccgtcggccccgcgcttcagccgccctccctggctgtgcgccccccaccggccccggcaaccagggtgcttcctagccccgcccgaccatttccggcctccttggggcgagcagaactgcaccccgttgaactgaaacctttccaagactatcagaagctttcttctaatctgggaggccccgggtcatcgcggactcctcccactggccgatcgttcagcggattaaattctagactcaaagctactccaagcacctattccggcgtattccggacacaaagagtggacctgtaccaacaggctagcccacccgacgcactcagatggatccctaaaccatgggagaggaccggacccccaccgcgggaagggccatctcggcgggcagaagagccaggaagtaggggagacaaagagcctggactccccccccctaggtag

SEQ ID NO: 200861 - DNA, 1650 bp, Artificial Sequence
  Description of Artificial Sequence: Synthetic coding sequence
atgagcgaccggagcggccccaccgccaagggcaaggacggcaagaaatacagttcactgaatctgttcgatacctacaaaggcaagtctcttgagatccaaaagcctgctgtggctcctaggcacggcctgcaatccctgggcaaagtggcaatcgccaggagaatgccccctccagccaacctcccttccctgaaagctgaaaacaagggcaacgatcctaacgtttccctggttcctaaagacggaacagggtgggctagcaagcaggaacagtctgatccaaaaagttcagacgcctccactgcccagcccccggaatctcagcctttgcccgcaagccagacgcccgcatccaatcaacctaagcgccctcctgcagcacctgaaaatacaccactggtcccgagcggtgttaagtcatgggcgcaggcctcggtgacacatggtgcccatggagatggcggaagagctagctctctgctatcccggttctcacgcgaagaatttccaaccctgcaggcggcaggagatcaagacaaggccgcaaaggagcgtgaatccgccgaacaaagcagtggaccaggcccttcactccgaccacagaactcaacaacatggcgcgacggaggtgggcgcggtcctgacgaactggagggtcctgatagtaaactccaccacggccatgacccaagaggcggcctgcagccatcggggccgccacagttcccaccatacagggggatgatgccaccattcatgtatccaccttatcttcctttcccaccaccctatggaccacagggaccctatcggtatccgaccccagatggacctagcagatttcctcgcgtcgctggtccacggggttccggcccacccatgcggctggttgagcctgttggacggcctagcatcttgaaagaggataatctcaaagagttcgatcagttggatcaggaaaacgacgacggctgggccggggctcacgaggaggtcgattacacagaaaaactgaaattcagcgacgaggaagatggaagggacagtgacgaggaaggcgctgaagggcatcgggactcccagtctgcatcgggagaggagcgaccccccgaggccgacggaaaaaaggggaacagcccaaactccgaaccaccaactcccaaaaccgcttgggcagagacgagtagacctccggaaacagaaccagggccccctgccccgaagcctccacttccacccccacatcggggtccagctggcaactggggtcccccgggcgactatcccgaccgaggcggtcccccttgtaaaccgcctgcacccgaagatgaagacgaggcgtggcgccagaggcggaaacagtccagttcagaaatcagcctcgccgtagagagagcaagacgccggcgcgaagaagaggagcggcggatgcaggaagagcgtcgtgctgcatgcgctgagaaactgaaacgactggacgagaagtttggcgccccggataagcgtctaaaagctgaacctgctgctcccccggcagccccttcaactcccgcccctcctcccgccgcctcggaagtgcctctcatggaggactcccggggccagcagcgtgacccgcctagaggacttgaggcgccccacccatag

SEQ ID NO: 200862 - DNA, 1650 bp, Artificial Sequence
  Description of Artificial Sequence: Synthetic coding sequence
atgagcgaccggagcggccccaccgccaagggcaaggacggcaagaaatatagttccctgaatctcttcgatacttataagggtaaatccttggaaattcagaagcccgccgtggctccgcgacacgggctgcagtccttgggcaaagtggccatagcccgtagaatgccgccgccggcaaatctgccgtctctcaaggcagagaacaagggaaacgaccccaatgtatccctggtgccaaaggatggaacgggttgggccagtaaacaggaacagtcagatccaaaatcttcggacgcctccacagcgcaaccacctgagagtcagcctttgccggcctctcagacacccgcgtcgaaccaaccaaaacgcccacccgctgctccagaaaatacaccattggtgccttctggtgtaaaaagttgggcgcaggcctcagtcactcatggcgcccacggggacggaggacgtgctagtagcttattgtccaggttttcccgtgaggagtttcccactctgcaggctgccggagaccaggacaaagctgccaaggagagggagtctgccgagcaatctagtggaccaggcccatccctccgcccccagaattccaccacttggcgtgatgggggcggccgggggccagatgaactggagggccccgatagtaaactgcatcatggacacgacccaaggggtggtctgcagccctcgggacccccacagtttccgccataccgcggcatgatgccgccgttcatgtatccaccataccttcccttcccacctccatatggtccacagggcccttacagatatccgacacctgacggcccaagtaggtttccacgggtagccggcccgaggggttccggcccccccatgcgtcttgttgagcctgttggccggccgagcatactcaaggaagacaacctgaaggagttcgaccagttggatcaggagaacgacgacggttgggccggtgctcacgaagaggttgactatactgagaagctgaagttcagtgacgaggaggacggcagagacagcgatgaggagggggccgagggccaccgcgattctcagtccgctagtggggaagagcggccgcccgaagctgatggcaaaaaaggtaatagtcccaacagtgagccacccacgcctaaaaccgcatgggccgaaacgagtcgacctcctgagactgagcccggtcctcccgcaccgaaaccaccattgcctcccccacataggggtccagccggcaattgggggcctccaggtgactaccctgacagaggcggccccccctgcaagcctcctgcccccgaggacgaggatgaggcctggcgacagcgacggaaacaatcatcatctgagatttccctggccgtggagcgcgctcggcggaggcgcgaagaggaagagaggcgtatgcaggaagagagaagggccgcctgcgcagagaagctcaaaagattggatgagaagttcggggcgcctgacaaacggctaaaggctgagcccgcagctccccctgcagcccctagtacccccgcacccccccctgccgcctcagaagttcctttgatggaagattcccggggtcaacaaagggatcccccacggggattagaggctccccatccttag

SEQ ID NO: 200863 - DNA, 4149 bp, Artificial Sequence
  Description of Artificial Sequence: Synthetic coding sequence
atgctgcgggagcggggcaccccccccgtggaccccaagctggcctgggtcggagatgttttcacggccactccagccgaaccgagaccactcaccagcccactcagacaggcagcggacgaagatgataagggtatgagatctgaaacccctccagtcccacctcctcccccatatctggccagctaccccgggttccctgaaaacggcgcccctggaccacctattagccgcttccctctggaggagcctggaccacgcccgctgccttggccaccaggctccgatgaagtcgcaaaaatccaaacacctccacccaagaaagaaccccccaaggaggagaccgcccagctaaccggaccagaggccggcagaaaaccagcaaggggcgtcgggtcaggaggacagggtccaccccccccgagacgagaatcacgaaccgagactagatgggggcctcgcccagggtcctctcgccggggcatccctcccgaggagcctggggctcccccacggcgcgccggaccgattaagaagcctcctccccccacaaaggtggaggaattgccgccaaagccgctggagcaaggggatgagacacctaaaccgccgaaacctgatccgttgaagattactaaaggtaaactggggggccctaaggagacaccgccgaatggaaacctgtctccagccccacgacttcggagggactattcatatgagagagtaggccctacatcctgtaggggtagggggcggggagagtactttgcaaggggaagaggcttccgtgggacatatggcggacgcggtaggggtgccaggagcagggagttcaggtcttatcgggagtttcgcggcgatgacgggagaggcggcggcactggaggacccaaccatccccctgcacctcgaggtcgaacagcctctgaaaccagaagcgagggcagcgaatacgaagagataccaaagcgacggaggcaaagggggtccgagaccggatctgaaacccatgaaagtgacttggccccatctgacaaggaggcgccaacacccaaggagggcactctaacacaggtgcctctcgcgcctccaccgccaggtgctcccccctctccggcccctgctcgattcactgccagaggaggtcgggtgttcacacctcgaggcgtgccctcccgcaggggccgtggcggcggccgcccgccacctcaggtgtgccccggctggagcccaccggccaagagcctggctcccaaaaaaccacctacaggcccgctccctccgtcaaaggagcccctcaaagaaaagctgatccccggcccattgtcgcctgtggccagaggtggatctaacggcggtagcaatgtggggatggaggacggagagcgccctaggcgcagaaggcatgggagggcacaacagcaggacaaaccacctcgctttcgtaggctgaaacaagagcgagaaaacgcagctcggggatccgaagggaagccttccttgaccctccccgcaagtgcacctggcccggaagaggcccttacaacagttaccgtagctccagctccccggcgggcagcggcgaagtcccctgacctcagcaatcaaaattccgaccaagccaacgaggaatgggaaacagcatcagaatcctccgatttcacttcagagcggcggggggacaaagaagcccccccaccagtcttgcttaccccaaaagccgttggcaccccgggagggggaggcggtggtgctgtgccaggaatctccgccatgtcgcggggggatctctcccagcgcgctaaagaccttagtaagcgctcattttccagccagcgcccaggcatggaacgccaaaaccgtagaccagggccaggagggaaggccggatcatcgggcagtagctccggcggcgggggaggcggcccaggaggaaggacaggccccgggcggggcgataagaggtcgtggcccagtccaaaaaaccggagcagaccaccagaggaacggcctcctgggctccctctgccccccccacccccaagctcttcagctgtgttccgactggaccaagtaatacacagtaacccagcaggcattcagcaagccctcgcacaactgtcaagcagacagggatcggttacagcaccaggaggacaccctaggcataaacctggacctccccaggccccgcaggggccatctccgcggccccccacaaggtatgagcctcagagagtaaactccgggctgtctagtgacccccatttcgaggagcccgggcctatggtacgtggggtgggcggcaccccaagagattcagcaggcgtgagcccttttccccccaaaaggcgagaacgcccacctaggaagccagagctgttgcaggaggaatcccttcctccaccccacagttctgggtttctcggctcaaaacccgaagggccgggcccccaggccgaatcccgcgatactggaactgaagcgcttacaccccacatctggaatagattgcatactgccacaagcaggaagagttaccgcccttctagcatggagccctggatggagcccctcagccctttcgaggatgtggctgggactgaaatgtctcaaagcgactctggcgtggacctatccggcgacagtcaggtgagtagtggcccctgttcccagaggtcttcaccagatggagggctaaagggcgcagcggagggtccacctaagcgacctggggggtcttcccctctcaatgccgttccttgtgagggacccccaggttcagagccacccagaaggccacctcctgccccccatgacggggaccgtaaggagttgcccagagaacagcctttacctccgggccccatcggcaccgaacggtcccagcataccgatcgcggtactgagccgggacctatcagaccatcacaccggcccggcccaccagttcagtttggtacatctgacaaggactctgacttaaggttggtagttggcgactccttgaaggcagaaaaagaactcacagcctctgtcacagaggccatacccgtttcccgagattgggaactcctgccaagcgcagcagcctccgccgagccccagagcaagaatctcgatagcggtcactgcgtccctgagccatctagctcgggtcagaggctgtacccagaagttttctatggctccgccgggccctcatcatcacagatctccgggggcgcaatggacagtcagctccatcccaattccggaggttttcgtccggggaccccttccctccatccatacaggagccaaccactctacctgcctccagggcctgccccaccttccgcccttctcagtggggtggcgctgaaggggcagttccttgacttcagtaccatgcaggctaccgagttgggcaagctgcccgctggcggagtgctgtacccaccccctagcttcttgtattcacccgctttttgtcctagccccctaccagacactagcctcctgcaagtgagacaggatttgcccagcccatcggatttctattccacaccccttcagccaggtggccagtccggtttcctgccatccggtgcacccgctcagcagatgctgctgcccatggttgacagccaactgccagtggtcaatttcgggagtttgcctcccgccccgccccctgcccccccgtccctctccctgctccctgttgggccagccctccaaccacctagcctggccgttcgccctccaccagcccccgctactcgagtgcttccgtccccggccaggccattcccggcatccctaggtcgcgcagaacttcatcctgtggaactgaagccgttccaagattaccaaaaactgagcagcaatttaggtgggcccgggtcctcacgaacacccccaactgggcggagtttctctggcctgaattccagactgaaggctactccaagcacttactcaggagtctttcggactcagagggtcgacctttatcagcaggcaagtcctcctgacgcactgaggtggattccaaagccttgggaaaggaccgggccacctccacgggagggaccttcacggcgagcggaggaacccgggtcacgtggcgataaagaacctggactccccccaccaagatag

SEQ ID NO: 200864 - DNA, 984 bp, Artificial Sequence
  Description of Artificial Sequence: Synthetic coding sequence
atgaccgtggtgagcgtgccccagcgggagcccctggtgctgggcggccgcctcgcaccgctcggtttcagctctagaggttactttggtgcgctgcctatggtgacaacagcgccacccccattgccgaggatccctgaccccagggcacttccacccactttattccttccgcacttcttagggggcgacggcccgtgcctgaccccccagccacgtgcgcccgctgcccttcctaacagatccctcgccgttgcaggtggcacccctcgcgccgcgccgaaaaaacggagaaaaaaaaaagttagagcctcccctgccgggcaacttccttctcgatttcatcaataccagcagcaccgcccttccctggaagggggtcggagtcctgctacaggcccgagcggagcccaggaggtgccaggcccagccgccgcgttagcaccatcccctgccgccgccgccggcactgagggggcatcacctgacctagcacctcttaggccggccgccccaggacagactcctcttcgaaaggaagtattgaaaagcaagatggggaaatccgaaaagatcgccttgcctcacggccagctcgtgcacgggatccacctttatgagcagcccaaaattaacagacaaaaatctaaatacaacctccccttgacgaagatcacctcagctaaaagaaacgagaacaacttttggcaagacagcgtctcaagcgaccggatacagaaacaggagaagaagccctttaagaacactgagaacatcaaaaactcacatcttaagaaatccgcattcctcaccgaagtcagtcaaaaagagaattatgctggcgcaaagttcagcgatccccctagtccaagcgtcctgccaaagccaccctcccactggatgggcagcaccgtggaaaatagcaatcaaaatagagaactgatggctgttcacctcaagacattgttgaaggtgcagacctag

SEQ ID NO: 200865 - DNA, 429 bp, Artificial Sequence
  Description of Artificial Sequence: Synthetic coding sequence
atgggcaagagcgagaagatcgccctgccccacggccagctggtgcatgggatccatctttacgaacagcccaaaattaaccgacagaaaagcaagtataacctcccactaacgaaaatcacaagcgcaaaacggaacgagaacaacttctggcaggatagtgtgtctagcgaccggatccagaagcaggagaaaaagccattcaagaataccgagaacattaagaatagccacctgaaaaagtcggctttcctgactgaggtcagccaaaaggagaattacgccggcgccaagttcagcgacccgccatcccctagcgtgctcccaaaaccaccatcccattggatgggctcgacagttgagaactctaaccagaatagagagttgatggccgtgcatttaaagaccttgttgaaggtccagacctag

SEQ ID NO: 200866 - DNA, 429 bp, Artificial Sequence
  Description of Artificial Sequence: Synthetic coding sequence
atgggcaagagcgagaagatcgccctgccccacggccagctggtgcatgggatccatctgtacgagcaacctaagattaaccgtcaaaaatcaaaatacaacctccccctcactaaaattacctcagccaagagaaatgagaataacttttggcaggattcagtgtcttccgacaggatacaaaaacaggaaaagaagcccttcaagaataccgagaacataaagaactcccacctcaagaaaagtgctttcctgaccgaagtgtcacagaaggagaactacgcgggcgcaaagttctccgatccaccatcaccgtcggttctgcctaaacctccctcccactggatggggagcactgtcgaaaactctaaccagaatcgcgagctgatggccgtccacttgaagacccttctaaaggttcaaacctag

SEQ ID NO: 200867 - DNA, 420 bp, Artificial Sequence
  Description of Artificial Sequence: Synthetic coding sequence
atgggcggcggcgagcggtacaacatccccgccccccagagccggaatgtcagcaagaaccagcagcaactgaaccgccaaaaaaccaaggaacagaattcacagatgaaaatcgtccacaaaaagaaagagcggggtcacggctacaactcgtctgcagcagcctggcaggccatgcagaatggaggcaagaacaaaaactttccaaataatcaatcctggaattcctctctttcaggacccagattgctgttcaagtctcaggccaaccagaactacgccggtgccaagttctcagagccccctagtccaagcgtcttgcctaaacctccaagccactgggtcccggtgtcattcaatccgtccgataaggaaatcatgacatttcagctgaaaacccttctaaaggttcaagtgtag

SEQ ID NO: 200868 - DNA, 420 bp, Artificial Sequence
  Description of Artificial Sequence: Synthetic coding sequence
atgggcggcggcgagcggtacaacatccccgccccccagagccggaacgtgagtaaaaatcagcagcaactcaatcggcagaagacaaaggagcagaactcccagatgaagatcgttcacaagaagaaggagcgaggccacgggtataactccagcgccgccgcctggcaggcaatgcagaatggcggcaaaaacaagaatttccccaacaaccagagctggaattcatctctgagcgggcctcgactcctgttcaagtctcaggcaaaccagaactacgccggagctaagttctctgagcccccatccccaagcgtcctgccaaaacccccaagtcactgggttcccgtcagttttaatccttccgataaggagatcatgacgtttcagctgaaaactcttctgaaggttcaagtgtag

SEQ ID NO: 200869 - DNA, 597 bp, Artificial Sequence
  Description of Artificial Sequence: Synthetic coding sequence
atgctgctgatcctgctgagcgtggccctgctggccctgagcagcgctcaaaacctgaatgaagacgtgtcacaggaggagagccctagtctcattgccggtaatccacagggtccctccccgcaggggggcaataaaccgcaaggtccccctcctcccccaggcaagccccagggcccgccgcctcaggggggtaacaaaccccaggggcccccccctcctggtaagccccagggtccccctccgcaaggggataaatcccggtccccccgcagtcccccgggcaaaccgcagggcccacctcctcaggggggcaagccccaaggccctcctccacagggcggcaacaagcctcaggggccacctccaccaggtaagcctcaaggccccccagcacagggtggctctaaatcacagagtgctcgctcgccacctggaaaaccgcagggccccccacaacaggagggaaacaaccctcagggccccccccctccggcaggaggaaacccccagcagcctcaggccccccctgctggccaacctcaggggcccccacgcccaccacagggcgggcggcctagtaggccacctcaatag

SEQ ID NO: 200870 - DNA, 537 bp, Artificial Sequence
  Description of Artificial Sequence: Synthetic coding sequence
atgctgctgatcctgctgagcgtggccctgctggccctgagcagcgcgcagaatctgaacgaagatgtctcccaagaagaaagtccctcgttaatcgcaggcaatccacagggcccgagcccccagggaggcaacaaaccccagggaccacctcctccacctgggaagccacaaggcccaccaccccaaggcggaaataagccacagggacctccacccccgggcaaacctcagggtcccccccctcaaggggacaagagcagaagtcccagatctcctccagggaagccacaaggccctccacctcagggcggcaagcctcagggccctcctgcacagggagggagtaaaagccagtctgctcgcagcccccctgggaaaccacagggaccaccacagcaggaaggcaataacccccagggacccccccccccagcaggaggcaatccacagcagccgcaggctcctccagctggtcagccacaagggccgccccgccccccgcagggaggtcgaccgagcagacctccacagtag

SEQ ID NO: 200871 - DNA, 597 bp, Artificial Sequence
  Description of Artificial Sequence: Synthetic coding sequence
atgctgctgatcctgctgagcgtggccctgctggccctgagcagcgcccagaaccttaacgaagatgtcagtcaggaagaaagtccgagcctgatcgctggaaacccacaaggcccctcgcctcaggggggtaataagcctcagggcccgccccctcctcctgggaagccgcagggtcctcctccccaggggggaaacaagccacaggggccgcctccccctggaaaacctcagggacctcccccacaaggcgacaaaagtaggagccccagatcaccgcccggtaagccccagggcccgccgccacagggggggaagccacagggtcctcccccacagggaggaaacaagcctcaggggcctccaccccctggcaagccccagggtcccccagcgcaggggggctcgaagagccagagtgcgcgttccccccccggcaagccgcagggcccccctcagcaggagggaaataacccgcagggcccccccccaccagccggcgggaatccacaacagccacaagccccacccgcaggccagccgcagggcccacccagacctccccagggagggagaccttcgaggcccccacaatag

SEQ ID NO: 200872 - DNA, 1251 bp, Artificial Sequence
  Description of Artificial Sequence: Synthetic coding sequence
atgctgctgatcctgctgagcgtggccctgctggccctgagcagcgcccagaacctgaatgaagacgtgtcgcaggaggagtcgccttccctcatcgccggaaatcctcagggggcaccaccccagggtggtaataagccccagggccctccatcaccaccaggtaaaccccagggacctccgccacaaggcggtaaccagcctcaaggtcctccaccaccccccggcaaaccccaggggccaccaccccaaggcggcaacaaaccacaggggccacccccaccgggcaaacctcagggccctccgccacagggtgataagtctcgcagccctaggtcccctcccggcaaaccgcagggccccccgccgcagggcggaaaccaaccccaaggtccccccccccctccaggcaagccacagggaccgccaccccaaggagggaataaaccccaggggccccccccaccaggtaaacctcaaggccctcccccccaaggcgacaacaaatcaagatcctcgagatcccctcccggaaagccccagggaccacctccgcagggagggaaccagccccaaggtccgccacccccgcctggaaagccgcagggccccccaccacaaggaggcaataagccacaaggacctcctcctcctgggaagcctcagggccctccaccccaaggagacaacaaatcgcagtcggctcgatccccgcctgggaaaccacagggaccaccgccacagggtgggaatcagcctcaagggcctcctccacctcccggcaagccacaaggaccgcctccgcagggcgggaacaaacctcagggcccgcccccaccaggaaagcctcaaggccccccccctcagggtggcagtaagtctcgctctagtcggagccctcccgggaagccccagggcccacccccgcagggagggaatcaaccccaaggcccaccaccacccccaggaaagccccaaggcccgccaccacaaggggggaataaaccccaggggccccctccacccggtaagccacaggggccccctccccagggcggctctaagagcaggtcagcgcggtcaccacccggaaagccccaaggcccccctcagcaggagggaaacaatcctcaagggcccccacccccggccgggggtaatccccagcagccccaggccccccctgccggacaaccccagggaccacctaggccacctcaggggggcagacctagccgccccccccagtag

SEQ ID NO: 200873 - DNA, 744 bp, Artificial Sequence
  Description of Artificial Sequence: Synthetic coding sequence
atgctgctgatcctgctgagcgtggccctgctggccctgagcagcgccgaaagttctagtgaggatgtaagccaagaggagagcctgtttcttatcagcggcaagcccgagggtaggcggccccagggcgggaaccaaccacagagaccaccaccaccaccagggaaaccccagggaccacccccccagggaggcaaccaatctcagggacccccacctccacccggaaagcctgagggacggccccctcaagggggcaatcagagtcaaggtccgccaccacatcccggaaagcccgagaggccgcccccgcagggcggaaatcagagccagggtaccccccctccccccgggaaacccgagagaccccctcctcagggaggcaatcaaagccatcgcccaccaccccccccgggaaagcccgagcggccaccaccccaggggggcaaccagagccaggggccccccccccaccccggaaagcctgaaggcccccccccacaagagggcaataaaagtcggagtgcccgttcccccccgggcaagccccagggcccacctcaacaagaagggaataaaccacagggcccccctccgcccgggaaacctcagggccctccaccagcaggaggaaatccacagcagcctcaggctccacccgctgggaaaccgcagggtcctccaccccctcctcagggaggccgtccaccccgtcccgcgcaggggcaacagccccctcaatag

SEQ ID NO: 200874 - DNA, 744 bp, Artificial Sequence
  Description of Artificial Sequence: Synthetic coding sequence
atgctgctgatcctgctgagcgtggccctgctggccctgagcagcgcggagtcaagctcagaggatgtcagccaagaggagtcccttttcttgatctctggaaaaccagaaggcaggcgcccccagggagggaaccagcctcaacggccacctcctccccctggaaagccacagggtcccccaccccagggaggtaaccagtctcagggtccacctcctcccccaggaaaaccggaaggccgccccccccaaggcggtaaccagtcacaggggccgcctccccatccagggaagccagaacgcccacctccccagggtggtaaccagagccagggaactccaccacctcccgggaaacccgaacgaccgcccccccagggaggcaaccagtctcatcggcccccaccgccccctggcaaacccgaacgacctcctcctcagggtggcaatcaaagtcagggccctccgccgcacccggggaagccggaagggccaccaccccaggagggtaacaaatcacgaagcgcgcgcagtccgccaggcaagccacaagggcctccgcagcaggaaggtaataaaccccagggtccccctccccccggaaagccacaggggcccccccccgcaggtggcaaccctcagcagcctcaggccccccctgccgggaaaccccaggggccccctcctcctcctcagggcggacggccgcctaggccggcccagggccaacagcctccacagtag

SEQ ID NO: 200875 - DNA, 537 bp, Artificial Sequence
  Description of Artificial Sequence: Synthetic coding sequence
atgctgctgatcctgctgagcgtggccctgctggccctgagcagcgccgagagctccagcgaagacgtttcccaggaggagtccctgttcctgatctctggaaaacctgaaggccgacggccacaaggtgggaatcagcctcaaagacctccccccccaccaggtaagccgcagggaccccccccgcagggtggcaatcagagccagggaccccctccccctccagggaagccagagggcagacctccccagggcgggaaccagagccaaggcccccccccccaccctgggaagccagagcggccacccccgcagggtggaaaccaatcacagggcaaaccccaaggaccccctcagcaagaaggaaacaagccccagggcccccccccccccggtaagccccagggtcctccccctgctggcggcaacccccagcaaccccaagcaccccctgcaggcaagccgcagggaccccctcctcctccccagggcgggaggccaccccgtcctgctcaggggcaacagccccctcagtag

SEQ ID NO: 200876 - DNA, 501 bp, Artificial Sequence
  Description of Artificial Sequence: Synthetic coding sequence
atgctgctgatcctgctgagcgtggccctgctggccttcagcagcgcccaggacctgaacgaggacgtttcccaggaagacgtgcctcttgtgatcagtgacggcggtgacagcgagcagttcctcgacgaagagcgacagggtcctcctctggggggacaacagagtcagccctcagccggggacggaaatcaggatgacggaccacaacaaggtcccccacaacagggaggtcagcaacaacagggccctcctccacctcaggggaagccccaaggccccccacagcaagggggtcatcccccaccacctcagggaagaccccaggggcctcctcagcaggggggccatccacgtccgcccaggggaagacctcagggtccaccccagcaaggcgggcaccaacaaggtcccccccccccacctcctggtaaaccacagggacctcccccgcagggcggacgaccccaggggcctccacagggccaatccccccagtag

SEQ ID NO: 200877 - DNA, 291 bp, Artificial Sequence
  Description of Artificial Sequence: Synthetic coding sequence
atgctgctgatcctgctgagcgtggccctgctggccttcagcagcgcccaagatcttgacgaggacgtatctcaagaggacgttccccttgtcatcagcgacggcggcgacagcgaacagttcatcgatgaggaagggcacaaagaccacccaaatcgcgaagccatttctaaggtcttgcctcatcttctgctggaatcaccacgggaccatttgcctaagggcgccgcgcacaaagatctgcacaggggtagtctgttatccaacttaggatttaacgacagaaagtag

SEQ ID NO: 200878 - DNA, 501 bp, Artificial Sequence
  Description of Artificial Sequence: Synthetic coding sequence
atgctgctgatcctgctgagcgtggccctgctggccttcagcagcgcccaggatctcgacgaggatgtctctcaggaagatgtccccttggtgatttccgatggcggggacagtgaacagttcatcgatgaggagcggcagggacctccgctgggcggtcagcaaagccaaccttctgccggggacggcaaccagaatgacgggccgcaacagggacccccacaacagggaggacagcaacaacaaggtccgcctcctcctcaaggcaaacctcaaggtcccccacagcagggggggcaccctcccccaccccaggggcggccacagggccctccgcagcagggagggcaccctaggccaccacgaggtcgccctcagggaccacctcagcaaggtgggcaccaacagggcccaccaccccccccacccggcaaaccacagggcccgccccctcagggagggcgtccccagggcccacctcaggggcagagccctcagtag

SEQ ID NO: 200879 - DNA, 501 bp, Artificial Sequence
  Description of Artificial Sequence: Synthetic coding sequence
atgctgctgatcctgctgagcgtggccctgctggccttcagcagcgcacaggacctggatgaggacgtttcccaagaagacgtacctttagttatatccgacggcggcgatagcgagcagtttatagatgaagagcggcagggcccccccctgggaggccagcagagccagcctagtgctggcgacggtaaccagaacgacggtccgcagcaggggccacctcaacaggggggccagcagcaacagggtcctcctcccccccagggaaagccgcaagggcccccccagcaaggaggccaccctccaccgccacagggcagaccacagggtccaccacaacagggcggccacccccggccgccaaggggccggccgcagggacctcctcagcagggcggacaccagcagggcccccccccgccaccccctggtaaacctcagggcccgccgccacagggcgggaggcctcagggcccccctcagggacagtcaccacagtag

SEQ ID NO: 200880 - DNA, 900 bp, Artificial Sequence
  Description of Artificial Sequence: Synthetic coding sequence
atggccgccagcagcagcgagatcagcgagatgaagggcgtggaggagagcccaaaggtgccaggagagggccctgggcatagcgaggccgagactggaccacctcaagtgttggctggggtgcccgaccaacccgaagccccgcagcccgggccaaatacaacagccgccccagtcgatagtggccctaaggccggtctggcccctgagacaacggaaacacccgccggggcatcagagacagcacaagctaccgacctgtctctgtccccaggaggcgaatctaaggccaactgctcccccgaggatccgtgtcaggagactgtgagcaagcccgaagtcagtaaagaggctacagcagatcaagggtccagactggagtccgccgcccccccagagccggcgcctgaacccgctccccagccagaccccaggcctgattctcagccgactccaaaacctgccctgcagccggagctgcccacccaagaggatccaaccccagaaattttatccgagtctgtgggcgaaaaacaggagaacggggcggtggtccctttgcaggccggagatggcgaggaggggccagcccccgagcctcactcccccccctccaagaagtcccctccggctaatggcgcaccccctcgagtcttgcagcaactggtggaagaagatcgcatgcgcagggcccattccggccaccctggctctcctcggggcagcctgtcccgacatccttctagccagctggcagggcctggagtggaggggggtgaaggtactcagaagccaagagactacataatcctggcaatattgtcatgtttctgccctatgtggccagtcaacatcgtagcatttgcgtacgccgttatggtttcacccatgggaccatag

SEQ ID NO: 200881 - DNA, 1023 bp, Artificial Sequence
  Description of Artificial Sequence: Synthetic coding sequence
atggccgccagcagcagcgagatcagcgagatgaagggcgtggaggaatcgcccaaagttcccggcgaaggacccggtcacagtgaggccgaaaccgggcctccccaggtactggctggtgtgcccgaccagccagaggccccgcagcccgggcccaacacgacagccgcacccgtggatagcgggcctaaggcaggcctcgcacccgaaactacagagacccctgcaggcgcaagtgagacagcccaggcaaccgacttgagtctctctcctggaggtgagtccaaagcaaactgcagccccgaagacccctgtcaggagactgtgtctaaacctgaagtgagtaaagaggccaccgcggatcagggtagccggctggagtccgcggccccacctgaaccagccccggagccagcaccacagccggacccgagacccgactcccagcccaccccgaaacccgccctacagcctgaactgccaacacaggaggatcccactccagagattctctcggagtctgtcggagagaaacaggaaaacggcgcagtcgtccctcttcaggctggtgacggggaagagggtccagcccctgagcctcactctccaccttcaaagaaatcaccaccagcaaatggggcaccaccacgagtcctgcaacagctcgtggaagaggatcgtatgaggagagcccactcaggccacccaggttcaccacggggaagcctatccagacatccgtcttcccagctcgctggacctggcgttgaaggcggggagggaactcagaaaccacgcgactatatcatactggccattctctcttgtttctgccccatgtggcctgtcaacattgttgcctttgcgtatgccgttatgtcccgcaattctctccagcagggagacgtggatggggctcaacgcctcggccgagtggcaaagctcctgtccattgtggccttggtcggcggcgtgctgatcattatagcctcctgcgtgatcaacttgggggtatacaagtag

SEQ ID NO: 200882 - DNA, 1191 bp, Artificial Sequence
  Description of Artificial Sequence: Synthetic coding sequence
atgccccagctgcagttcaaggacgccttctggtgccgggacttcactgcccatactggttacgaggtcttactgcaacgactattggacggcagaaaaatgtgcaaagatatggaggagcttcttaggcagagggcccaggccgaagagaggtacggcaaagagctggtgcagatcgcgcggaaggctggcgggcagacagagatcaatagccttcgagccagcttcgattcacttaaacagcaaatggaaaacgtggggagcagccatattcagttggcgcttactctgcgagaagagctgagatctctggaggaatttagggagcggcagaaagaacaacggaaaaaatatgaagcagtgatggaccgggtccagaagtccaagctctcgctttacaagaaagccatggaatctaagaagacttacgaacagaagtgccgtgacgccgatgatgccgagcaggctttcgaaagaataagcgcaaacggacaccagaaacaagtggagaaatcccagaacaaggccaggcagtgtaaggatagcgctactgaggccgagagagtctacagacagtctattgctcaattagaaaaagtgagagccgagtgggagcaggagcacaggaccacctgcgaggcctttcagctacaggaatttgatcgccttacgatactacgcaatgctctgtgggttcactcaaaccaattgagtatgcagtgcgtcaaagatgacgagctgtacgaggaggtgcggctgaccttggagggctgttccatagatgctgatatagactccttcatccaggccaaatctaccggtacagagccacccggcgaggtcaggctcgctgactcagcggctagccgcttcagcggccttctccacggaagtcctaaaactacgtccctggctgccagcgccgcttctacagaaacactgactccaacccccgagcgcaacgagggcgtctatacagccattgcagttcaagaaatccagggcaaccccgcttctcctgctcaagaatacagggctctatatgattacaccgcccagaacccagatgagctggacttgtccgctggtgacatcctggaagtgattctggaaggggaggatggttggtggaccgttgaaaggaacggacagagggggttcgtgccaggcagttacctggaaaaactctag

SEQ ID NO: 200883 - DNA, 1251 bp, Artificial Sequence
  Description of Artificial Sequence: Synthetic coding sequence
atgatgccccagctgcagttcaaggacgccttctggtgccgggacttcactgctcatacaggctatgaagtcctcctgcaaaggctccttgatggccgcaaaatgtgcaaggacatggaggagctccttaggcagcgcgcccaggctgaggagagatacggtaaagagctggtgcaaattgctaggaaggccggcggccaaaccgagatcaacagcttaagggcatcgtttgacagcctgaaacaacaaatggagaatgtcggcagctcgcacatccagctagcacttactcttcgcgaggagttgagatccctggaagagtttagggaacgccagaaggagcaacgcaaaaagtatgaggcggtgatggaccgcgtgcagaagtccaaactgtcactgtataaaaaggccatggagtctaagaagacctacgaacagaagtgcagagatgccgatgacgcagaacaggctttcgagagaatatcggccaacggacaccagaagcaggttgaaaaaagtcaaaataaagcccgacagtgtaaggactctgctacagaggcggaacgtgtgtaccgacagtccattgcacagttggaaaaagttagagcagaatgggagcaagaacatcgcacaacttgtgaagccttccagctacaggaatttgatcgcttgaccattctaagaaatgctctctgggtgcactctaaccaactgagcatgcagtgcgtcaaggacgacgaattgtacgaggaggtgcggttgactctcgaaggatgtagcattgacgcagatatcgacagttttatacaggccaagagcactgggaccgagcctccagctccggtaccgtaccagaattactacgaccgcgaggtgacgccactaactagctcccccggcattcaaccttcgtgtgggatgattaagcggttttcgggactcctgcatgggtctccaaaaactacctcgttagccgcgagtgcggcaagtacagaaacactgactcccaccccagaacgaaacgagggggtgtatacagccattgctgtgcaggaaatccaggggaatccagctagcccggctcaggagtacagggctctctatgattataccgcacaaaatccagatgagcttgatctcagtgcgggggacatcctcgaagtgattctggagggcgaagatggctggtggacagtcgagaggaacgggcagcgcggcttcgtccccgggtcctatctagaaaaactttag

SEQ ID NO: 200884 - DNA, 1605 bp, Artificial Sequence
  Description of Artificial Sequence: Synthetic coding sequence
atgatctggtacatcctgatcatcggcatcctgctgccccagagcctggcccatcccgggttcttcacgtctatcgggcaaatgactgatctgatacacacagagaaggatcttgtgacctccctaaaggattatattaaggccgaagaggacaaactggagcaaatcaaaaaatgggctgaaaaactggaccgtctcacgtccactgccacgaaagatcctgaaggttttgtgggtcatccagtgaacgccttcaaattaatgaagcgccttaacaccgaatggtcagaactggagaatctggtgttgaaagatatgtctgacggcttcatcagcaacttgacaatacaacgtcagtactttcccaacgatgaggatcaggttggtgccgcaaaggccctgctccggcttcaggacacttataatctggacactgacacaattagcaaaggtaatctgcccggtgtcaagcacaagagctttttgaccgctgaggactgtttcgagctaggcaaggtggcttatacggaggccgattactatcatacggaactttggatggagcaagcactgagacaactggatgaaggagaaatctctactatcgacaaagtgtctgtgctggactatctctcttacgccgtttatcagcagggggacttggataaggccctgttactgaccaaaaagttgctcgagctagatccagagcaccaacgggccaatggtaacctaaaatattttgaatatatcatggccaaggagaaggatgtaaacaaatccgctagtgatgaccagagcgaccagaagacgacccctaagaagaagggcgtggctgtggactaccttccagagcggcagaaatatgagatgctgtgccgcggagaaggaataaagatgactcctcgccgccagaaaaagctgttttgtagataccacgacgggaatagaaaccctaaatttatcctggcgcctgctaagcaagaggacgaatgggacaagcctaggattatccgctttcatgacattatctctgatgccgagatcgagattgtgaaggatctggctaagcccaggctgtccagagccacggtgcatgacccagagactggcaagctgactacagcacagtaccgcgtgagtaagagcgcctggctctcgggatatgaaaacccagtcgtgtcccgcataaatatgcgaattcaagatctcacaggcctggatgtaagtacagctgaggagttgcaagtggccaactatggcgtgggcgggcaatatgagcctcactttgacttcgcccgtaaagacgagcctgatgctttcaaagagttgggaacgggcaatcgcatcgcaacttggctgttctacatgtccgacgtctccgctgggggcgctacggtgtttcccgaagtgggtgcgtccgtttggcccaagaagggaaccgcagtgttttggtacaacctgttcgccagtggggagggagactattctacacggcatgctgcatgcccagtgctggttggaaacaagtgggtctccaataagtggttgcacgagcgagggcaggagtttcggcgcccctgtaccttatcagagctggaatag

SEQ ID NO: 200885 - DNA, 1605 bp, Artificial Sequence
  Description of Artificial Sequence: Synthetic coding sequence
atgatctggtacatcctgatcatcggcatcctgctgccccagagcctggctcatcccggcttttttaccagtattgggcagatgaccgatctcatccatacggagaaggacctggtgacttccctcaaagattacattaaggccgaggaggataagctggaacagattaagaagtgggcggagaagcttgaccgtctcacatcgacagccaccaaggaccccgaggggttcgtgggtcaccccgtgaacgcattcaagctgatgaagagactgaacacagagtggtcagagctcgaaaatttggtgctgaaagacatgtcagacgggtttattagtaacttgacaatccaaagacaatattttcccaatgacgaagaccaagtgggcgccgcgaaggccctgctgcgcctgcaggacacatataaccttgacaccgacaccataagtaagggaaatctccccggtgtgaaacataagagcttcctaaccgctgaggattgcttcgaacttgggaaggtggcatacacagaagctgactactatcacacagaactctggatggaacaggctcttcgccagctggacgaaggcgaaatctcaacaatcgataaggtgagtgtgctcgattacctatcttacgcagtgtaccagcaaggagatctggataaagccctccttctgaccaaaaagttgcttgagctggaccccgaacatcagcgggcaaacggcaatctcaaatactttgagtatatcatggctaaggagaaagacgttaacaaatccgcctccgatgaccagtccgatcagaaaacaactccgaagaagaagggagtggcggtagattatctccctgagagacagaagtatgaaatgctttgccggggagagggaattaaaatgacgcccagacggcagaaaaagcttttctgtcgttatcacgacggcaacaggaatccaaagttcatcctcgcacctgccaaacaggaagacgagtgggacaagccccgaatcatccggttccatgacatcattagtgacgccgagatcgaaattgtcaaggatttggccaagcctcggctgcgccgcgctacaatttcaaaccccatcactggagacctcgagaccgtgcactaccggatttcaaagagcgcatggctttccggctacgagaacccggtggttagtcgcattaacatgagaatccaggacttgacaggcctagatgtaagtacagccgaagagctccaggtggccaactacggggtgggcgggcagtatgaaccacactttgactttgcccgcaaagatgagcctgatgcctttaaagaactcggtactggaaatcgaattgcaacttggcttttctacatgtccgacgtgtcagcaggtggggcaactgtgtttccagaagttggggccagtgtttggccgaaaaaagggacagccgttttttggtacaacttattcgctagcggagaaggcgactatagtaccagacatgcagcctgcccagtgctggttggaaataagtgggtcagcaacaaatggctacacgaaaggggtcaggagtttaggcgcccatgtaccctttcagaactggagtag

SEQ ID NO: 200886 - DNA, 1605 bp, Artificial Sequence
  Description of Artificial Sequence: Synthetic coding sequence
atgatctggtacatcctgatcatcggcatcctgctgccccagagcctcgcacaccccggcttttttacgagtatcgggcaaatgactgatctgatccataccgaaaaagatcttgtcacttctctgaaggactatatcaaggccgaagaagacaaactagagcagattaaaaagtgggctgaaaagctcgaccgcctgacaagtaccgccaccaaagatcctgagggctttgtgggccaccccgtcaatgcctttaaactgatgaagagactgaatacagaatggtccgagcttgagaatctggtactgaaggatatgtctgatggcttcatttcgaacctaactattcaacgacagtactttcccaatgatgaagaccaggtaggcgccgcaaaggcgctgctaagactccaggatacttacaatctggacacagacaccatatctaaggggaatttaccaggcgttaagcataagtcttttctgactgccgaggactgttttgaactcggtaaagtagcttataccgaagctgactactaccacaccgagttgtggatggagcaagccctgcgtcagctggatgaaggggagatctccaccattgacaaagtgagcgtcctggactacctctcgtatgccgtttaccagcagggagacctcgacaaggccttgctcctgacaaaaaagttgctggagctcgacccagagcaccagcgagctaacggcaatctgaagtacttcgaatatattatggcaaaagagaaagatgtaaataagagcgcaagtgacgatcaatcggaccagaagactacacctaaaaagaagggagtggctgtggactatctgccagagaggcagaaatatgagatgttatgccggggtgagggaatcaagatgacgcccaggcgccagaagaagcttttttgtcgctaccatgacggcaaccggaacccaaaattcattctcgcaccagccaaacaggaggacgagtgggataagccacgcattatcagatttcacgatattatttcggatgcagaaatagaaattgtgaaagaccttgctaagcctagactttcaagggccaccgtgcacgaccccgagacagggaaattaactaccgcccagtatagggtgagtaagagcgcatggctgtccggctacgaaaatccggtcgtgtcccggataaacatgcgtatccaggacctgaccggccttgacgtgtccacagctgaggagctccaggttgcgaactacggagtgggcggacagtatgaacctcactttgattttgccagaaaggatgagcctgacgcttttaaggaactggggactggaaacagaatcgcaacctggttgttttacatgagcgatgtttcagcaggtggggctactgtgtttcccgaggtcggagcatccgtatggcccaagaaagggacggccgtgttctggtataatctgttcgccagtggggaaggcgattatagtacccggcacgcggcctgtcctgtgcttgtgggcaacaaatgggtgtctaataagtggttgcatgagagaggccaggagtttaggaggccgtgcacattatcagagctcgagtag

SEQ ID NO: 200887 - DNA, 1605 bp, Artificial Sequence
  Description of Artificial Sequence: Synthetic coding sequence
atgatctggtacatcctgatcatcggcatcctgctgccccagagcctggctcacccaggtttctttactagcattggacaaatgacagacctcattcatactgaaaaggatctggtcactagtctcaaagactacataaaagccgaggaagataaattggagcagataaaaaaatgggctgagaaactcgaccgtctgacaagcacggcaaccaaagatcccgaaggctttgtcgggcaccctgttaacgcctttaaactgatgaagaggctaaacaccgaatggtctgagctagaaaatctggtcctaaaagatatgtcagacggtttcatctctaatcttacaatccagcgccaatattttccaaacgacgaggatcaagtgggagcggcaaaggccctgttaagactacaggacacatataacctagatacggacaccattagcaagggcaatctcccaggggtaaagcacaagagctttttgacagctgaggactgctttgagctcgggaaagtggcctatactgaggccgactactaccacaccgaactgtggatggagcaggccctccgccagctcgacgaaggcgaaattagcactatcgataaggtgtccgtgctggactatctttcctacgctgtgtatcagcagggggatctcgataaggctttgctactgacaaagaaactccttgagctggacccagagcaccaaagggcgaacggaaacttaaagtattttgagtatatcatggccaaggaaaaagatgtgaacaaatccgctagtgatgatcaatctgaccagaagactacccctaaaaaaaaaggggtcgccgtagactatctcccggagcggcagaagtatgaaatgctctgtcgtggagagggaataaaaatgacgcccagaaggcagaagaagctgttctgcagatatcatgacggcaacagaaaccccaaattcattcttgcccctgcaaaacaggaggacgaatgggataagcctcgtatcatacgctttcatgacatcatttctgacgccgaaattgaaatcgtaaaggatctggccaaacccaggctgcgccgggctacgatctctaaccccatcaccggggacctggaaaccgtgcattacagaatctctaagagtgcatggctgtcaggctatgaaaatccggtagtgtctcgtataaatatgcggattcaagatctcaccggactcgatgtgtctaccgccgaggagctgcaggttgcaaattacggtgtcggaggccaatacgagcctcatttcgacttcgccaggaaggatgagccagacgcgttcaaagagcttggcaccggtaatagaattgcaacttggctgttctatatgtccgatgtgtccgcaggcggagctacagtgtttcctgaagtgggagcctcagtatggcctaagaaagggactgctgtcttttggtacaacttgtttgcatctggggaaggcgactactcaacacggcacgccgcgtgccctgttctggtaggcaataagtgggtctcaaataaatggctccacgagcgcgggcaggagttcaggcggccatgtacactgagcgagttggagtag

SEQ ID NO: 200888 - DNA, 1605 bp, Artificial Sequence
  Description of Artificial Sequence: Synthetic coding sequence
atgatctggtacatcctgatcatcggcatcctgctgccccagagcctggcccaccctggattttttacctccattggacaaatgaccgacctcatccacacagagaaggacctggtaacgagtctgaaagattacatcaaagcagaggaggataagcttgaacagattaaaaagtgggcagagaagctggatcggctgacttccacagctacaaaagatcctgagggttttgtagggcaccctgtgaatgcttttaaactgatgaaacgtttaaacaccgagtggtccgagcttgaaaatctcgttttgaaggatatgagtgatggtttcatttctaatttaactatccaacggcagtattttccgaacgacgaagatcaggtcggcgccgccaaggccctgctgagactccaggacacatataacctcgataccgacactattagcaaaggcaatctgcccggcgtgaagcacaaatcatttctgactgccgaagactgctttgagctcgggaaagtggcctacacagaggcagattattatcacacagaactgtggatggagcaagcactgcggcagttagatgaaggtgaaatctcgactatagacaaggtctctgtcttggattacctgagttatgcagtttaccagcagggtgacctcgacaaggccctcctgctgactaaaaagctactggaactggaccccgagcatcagagggctaatggtaatctgaagtacttcgagtatattatggctaaggagaaagacgtgaataagtcagcctcagacgaccagtccgaccaaaagactaccccaaaaaaaaagggggtagcggtggattacctgccagagaggcaaaaatacgagatgctttgcagaggagaaggaatcaagatgaccccacgccgtcagaagaaacttttctgtcggtaccacgacggcaatagaaacccaaaattcattcttgcccctgcaaagcaagaggacgagtgggacaagcctaggattattcggttccacgacattatatccgatgctgagattgaaatagtgaaagacctggccaagccccgtctccgccgggcaaccatcagtaatcccattacaggcgatctagaaactgtccattatagaatatctaagtcagcctggctgtctggctacgagaatcctgtggtttctagaattaatatgaggattcaggatctgaccggactggacgtttccaccgccgaggagcttcaggtagcaaattacggcgtaggtggacagtatgagccacatttcgactttgccagaaaagatgagcccgatgccttcaaagagctgggcacaggaaatagaattgctacttggctgttctacatgagcgacgtcagtgctgggggcgctactgtgttccccgaggtaggtgcttccgtgtggccaaagaaagggaccgccgtcttctggtacaatctgtttgcatctggagagggtgattactctacgaggcatgcggcatgccccgtcctcgtcggaaataagtgggtgtccaataagtggctccacgaaagaggacaagaatttcgcaggccctgcacccttagcgagttggaatag

SEQ ID NO: 200889 - DNA, 1551 bp, Artificial Sequence
  Description of Artificial Sequence: Synthetic coding sequence
atgatctggtacatcctgatcatcggcatcctgctgccccagagcctcgctcaccccggatttttcacttccataggccagatgacagaccttatccatacggaaaaggatttagtcacctctttgaaggattacatcaaagccgaggaagacaagctcgaacaaatcaaaaaatgggctgagaaattggaccggctgacatccaccgccaccaaggatcccgaggggtttgtgggccacccggtgaacgccttcaaattaatgaaaagactcaacacggaatggagcgagctcgaaaatcttgttcttaaggacatgtcggatgggttcatcagcaacctgacaatccagagacagtactttcctaacgacgaggatcaagtaggagccgctaaagccctgctgaggctgcaagacacatacaacctcgacacagacaccatctccaaagggaatctccccggggtgaaacataagagtttccttactgcagaagactgcttcgagctcgggaaggtggcctatacggaggccgactactaccatactgaactctggatggaacaggccctgagacagctggacgaaggggagatatcaacaatcgacaaggtgtctgttctcgactatctgagctacgctgtctaccagcaaggagatctggataaggctctgttgttaaccaaaaaactattggagctcgatcccgaacaccagagagccaacggcaatctgaagtactttgaatatatcatggcgaaagagaaagacgtgaataagtctgcctctgatgatcagagcgatcaaaagaccactcccaagaagaaaggcgtggctgtcgactatctgccggaacggcagaaatacgagatgctttgccggggagagggtatcaagatgaccccccggaggcaaaaaaaactcttttgtagataccatgatggcaatagaaatccaaagtttattctcgcccctgctaaacaggaagatgaatgggataaaccccgtatcattagatttcacgatatcatttcggatgcagagatcgagatcgtgaaagacctggctaagccccgcctcagcagggctactgttcacgaccccgagacgggcaagcttaccactgctcagtacagagtttcgaagtccgcctggctatcaggttacgagaatccggtcgtgtctagaatcaatatgcgaatccaagatcttacgggcctggatgtctctactgccgaagaactgcagaaggatgaacccgatgcctttaaggaactggggacagggaataggattgccacttggcttttctatatgtcagacgttagtgccgggggagctaccgtgtttcccgaagtaggggctagcgtctggcctaagaaggggacggccgtgttctggtacaacctgtttgcctccggcgagggcgattactccacacggcatgccgcctgccccgttcttgtgggaaataagtgggtgagtaataaatggcttcacgaaagaggccaggaattccggcgaccatgcactttaagcgagttggagtag

SEQ ID NO: 200890 - DNA, 1608 bp, Artificial Sequence
  Description of Artificial Sequence: Synthetic coding sequence
atgaagctgtgggtgagcgccctgctgatggcctggttcggcgtgctttcctgcgtgcaggccgagttcttcacctccataggtcatatgaccgatttgatttatgccgagaaagaacttgtgcagtcccttaaggagtacattctggtcgaggaagccaaactctccaagatcaaatcatgggcaaataagatggaggccctcaccagcaagtctgcggccgacgcagaaggctacctggctcacccagtgaacgcctacaagctggtgaagcgcctcaatactgactggccagccctggaggacctcgttctgcaggacagtgctgcaggtttcattgctaatctgagtgtccagcgacagtttttcccgactgatgaggacgaaattggggccgccaaggccttgatgcgcctgcaggacacatatcgcctagacccaggaactatctcacggggggagctgcccgggactaagtatcaggccatgctgtccgtggacgactgttttggcatgggccgctcagcatacaacgagggggactattaccataccgtgttatggatggagcaggtgttgaagcagcttgacgctggtgaggaggcaacaaccaccaaaagccaggtcctggactaccttagctacgccgtgttccagctgggggacctgcacagggctttggaactcaccaggagattgctgtccctggacccttctcatgagcgggcaggcgggaacctgcggtactttgaacagttactcgaagaggagagagaaaagaccctgaccaaccagaccgaggccgaactggctacgccagagggcatatatgaaagaccggttgactatcttccggaacgagatgtctatgagtcactctgtagaggcgagggggtgaagctgaccccacgccgccagaaaagactgttctgtcgctatcatcacgggaaccgcgcgccccagttactgatagcccctttcaaggaagaggacgaatgggattcgccacacatcgttcggtattacgatgtcatgtctgacgaagagatagaaaggataaaggagatcgcgaaacccaaattggcacgggccacggtgcgcgatcctaagacaggtgtgcttacagtggcctcctacagagtgagcaagtcttcgtggctggaagaggacgacgatcctgttgtagcccgtgtcaatagacggatgcagcacattaccggtcttactgtcaaaacagccgagctgctccaggtcgccaactacggtgttggcggacagtatgagccacacttcgacttttccagaaacgatgagcgggatacatttaagcacctgggaaccggaaacagggtcgctacatttttgaactatatgagtgacgttgaagcagggggggcaacagtgttccctgatcttggggcagcaatttggcctaaaaagggaaccgccgtcttttggtacaatctactgcggagcggcgagggtgattaccgcactcgccatgcagcttgtccggtgctggtaggctgtaagtgggtgagcaataagtggtttcacgagaggggtcaagagtttctgaggccatgcggatctaccgaagtcgactag

SEQ ID NO: 200891 - DNA, 1602 bp, Artificial Sequence
  Description of Artificial Sequence: Synthetic coding sequence
atgaagctgtgggtgagcgccctgctgatggcctggttcggcgtgctcagctgcgtgcaggcggaattctttaccagtattggacacatgaccgacttgatatacgcagagaaagaattggtgcaaagtctgaaagaatatattttggtagaggaggcaaagctctccaaaattaagagttgggcaaataagatggaggcacttaccagtaaaagcgcggccgatgccgagggctacctcgcccaccccgtaaacgcgtacaaactggtaaagcgcctgaatactgactggccagccctggaggacctggtgcttcaagacagcgccgctggatttattgcaaacctgtccgtgcaacggcaattctttcccaccgacgaggacgagatcggcgccgctaaggctctgatgaggttacaagacacttacaggttagacccgggcactatttccagaggcgagctgcctgggacgaaatatcaggctatgctttccgtcgacgattgctttggcatgggtaggagcgcctataatgaaggtgattattaccacaccgtgctgtggatggaacaggtgctgaaacagctggatgcgggggaggaggctacaaccaccaaatctcaagttctggattacttatcctacgctgtttttcagctgggcgatcttcacagagcattggaactgacccgcaggctgctctctcttgacccctcacacgaacgcgccgggggaaacctgcgttattttgaacagttactggaggaggagcgggaaaagacactcaccaatcagaccgaggctgaacttgcgacacccgaaggaatctacgagcgacccgtcgactatctgccggagcgggatgtctacgaaagcctttgcagaggagagggagtgaaactcacccctcgccggcagaagcgactgttctgtaggtaccatcacggaaatcgagccccccagttgctgatcgctccgttcaaagaggaagacgaatgggattctccacatatcgttaggtattatgatgtgatgagtgacgaagagatcgaacgaatcaaagagatagcaaaacctaagcttgcgcgggcaactgtgcgcgaccccaagacgggagtacttacggttgcgtcatatcgggtgagcaagagtagctggctggaagaagatgacgatcccgttgtggctagggtgaacagaagaatgcagcacatcacaggtctgacggttaaaactgccgagctgctccaagtcgccaattatggggtgggtggtcaatatgagccacacttcgacttctctcggaggcccttcgacagcgggctgaagactgaggggaatagattagccacctttcttaactacatgtctgacgtggaggccggtggcgctactgtatttccggacttaggcgcagccatctggccgaaaaaaggcaccgctgtcttctggtacaacctgcttagatctggcgagggggactaccggaccagacacgccgcatgccccgtccttgtcgggtgtaaatgggtgagcaacaagtggttccacgagaggggtcaggaattcctcaggccatgtggttctactgaggtcgactag

SEQ ID NO: 200892 - DNA, 1602 bp, Artificial Sequence
  Description of Artificial Sequence: Synthetic coding sequence
atgaagctgtgggtgagcgccctgctgatggcctggttcggcgtgctgagctgtgtgcaggcagagtttttcacgagtattgggcacatgactgacctgatctatgccgaaaaggaactggttcaatctttgaaagaatacatcttggtggaagaggccaaactctcaaagattaagagctgggctaacaagatggaggccctgaccagcaagagcgcggccgatgcagaaggatatctagctcaccctgtcaatgcttacaaattggtaaaacgtctcaacacagactggccagccctcgaagacctggtgctgcaggactcagccgcaggattcatcgcaaatcttagcgttcagagacagttcttccctacagacgaggacgagataggggcagctaaggcgctgatgcgcctgcaagacacatatcgactggatcccggcaccatctcccgcggggagttgcccggcacgaagtatcaggccatgctttctgtcgacgactgcttcggcatggggcggtccgcctataacgagggagattattaccataccgtgctgtggatggagcaggtcttgaaacaacttgatgccggcgaggaggccacaacaacaaaatcacaggtgcttgattacttaagttatgcagtgttccagttaggcgatttacatagagcgcttgaattgacccgccgcctgctgtctcttgatcctagccacgagagggccggagggaatcttcgatacttcgaacagttattggaggaggaaagggaaaagactctcactaaccagacagaagctgagttggctacccccgagggtatttacgaacggcccgtggactacctgcccgagagggacgtgtacgagagcttgtgtaggggcgagggggtgaaattgactcccaggcggcagaagcgtctcttctgccgttaccatcatggtaaccgtgcgccacagctcttgattgcaccatttaaggaggaagatgagtgggatagcccacacatcgtgcggtattacgatgtcatgtcagacgaggaaatagagcgcatcaaggagattgctaaaccaaaacttgctagggccacagtgcgggacccaaagacaggcgtgctgaccgtagcttcctacagagtgagtaagtcaagctggcttgaagaagacgatgatccagtcgtggccagggtgaatcgtagaatgcagcacatcacagggctgacagtgaaaaccgcagagctgctgcaggtggctaattatggcgtgggagggcagtacgagcctcacttcgattttagcagacggccgtttgactccggcctcaagacggagggaaacaggctggctacttttttgaattatatgtcagacgtggaggctggcggagctaccgtcttcccagacctcggcgccgctatatggccaaaaaaagggactgccgtcttctggtacaacctgcttagatccggggaaggtgattaccggacaaggcacgcagcatgtcctgttttagtcggatgtaagtgggtgtcaaacaagtggttccacgaaaggggccaggagttcctccgaccttgtggaagtaccgaagtagactag

SEQ ID NO: 200893 - DNA, 1602 bp, Artificial Sequence
  Description of Artificial Sequence: Synthetic coding sequence
atgaagctgtgggtgagcgccctgctgatggcctggttcggcgtgctctcatgtgtgcaggcagagtttttcacctcaatcggacacatgacggaccttatctatgcggagaaagagctcgtccagtccttgaaggagtacatactggtggaggaggcaaaacttagtaagataaagtcgtgggctaataaaatggaggccttaacaagtaagtccgcagccgatgctgagggctacctggctcacccagtcaacgcgtataaactggtgaagaggttaaatacggactggccagctcttgaggatctggtccttcaggatagcgccgctgggttcattgctaatctctccgtgcaaagacagttctttcccacagacgaggatgaaatcggcgcagcaaaagccctgatgcggcttcaagatacctataggcttgacccaggtacgattagcaggggggagctgccaggaaccaaataccaggccatgctgtccgtagatgattgttttggaatggggcgttccgcctacaacgagggggattactatcatacggtcctctggatggaacaagtgcttaaacaactggacgctggcgaagaggccacgactaccaaatctcaagtgctggactacctgagctacgcggttttccagctgggggatcttcatcgggctctggaattaacccggcgtctgctgtctttagatccctcgcatgagcgcgccggaggaaacctgcgctacttcgagcagcttctggaagaggaacgggagaagaccttgacaaatcagaccgaggccgagctggctacccctgaagggatctacgaacggcctgtggattacctgccggagcgtgatgtctacgagtcactgtgtaggggcgaaggagttaagctcacaccacgccgtcagaaacggcttttctgccgctaccatcacgggaacagagcccctcaactgctgatagctccctttaaagaggaggacgaatgggattctccccatatcgtacggtactatgacgtgatgtccgatgaggaaatcgaaaggatcaaagaaatcgccaaaccgaagctggccagggcgactgttcgggatccaaaaactggggtgctaaccgtggccagctacagagtttcgaaaagctcttggctggaggaggacgacgacccagtcgtggcccgcgtcaacaggaggatgcagcacataacagggttaactgtcaagaccgcagaattgcttcaggttgcgaattacggtgtcggcggccagtacgaaccccattttgatttcagcaggcggccttttgatagtgggctgaagacagaaggcaacaggctggctacattcctcaactacatgtctgatgttgaggccgggggggcaaccgtgtttccagatctcggagccgctatttggcccaaaaagggaacagcagtcttttggtacaatttattacgcagcggggagggcgactatcggactcgccacgctgcctgccccgtgctggtgggatgtaagtgggtctctaataaatggtttcacgagagaggtcaggagttcctgaggccttgcggcagcaccgaggtggattag

SEQ ID NO: 200894 - DNA, 1608 bp, Artificial Sequence
  Description of Artificial Sequence: Synthetic coding sequence
atgaagctgtgggtgagcgccctgctgatggcctggttcggcgtgctgtcgtgtgttcaggctgaattcttcactagtataggccatatgactgacctgatctacgcagagaaggaacttgtacagtccctgaaggagtatatcctggtcgaagaggccaaactatccaagatcaagagctgggccaacaaaatggaggccctgacctcgaaatcagccgctgatgctgaagggtatttagctcaccccgtcaacgcctacaaattggtgaagcgcctgaacactgattggcctgccctggaagacctggtgttgcaggactccgccgcggggttcattgccaatctctccgttcaacgccagtttttccccacagatgaggatgaaatcggcgctgctaaggccctgatgcgcctgcaggatacctacaggttagatcccggtaccatttcccgcggagaactgccaggcacgaagtatcaggcaatgctgtctgtggacgactgctttgggatgggaaggtctgcctataatgagggggattattatcatacggtgctgtggatggaacaggtgcttaagcagctggatgcaggcgaggaagccactactacaaagagtcaggtcctcgattacctgtcctacgccgtgttccagttgggtgacctacaccgggctctggagctgacccgacggctcttgtctttagacccttcacacgagagagcaggaggcaatctcagatatttcgagcagctgctggaagaggagagagaaaagaccttgacgaatcagacggaggctgaactggcaacaccagagggcatttatgagcgccctgtagattatctccccgaacgtgatgtgtacgagtctctgtgcaggggagagggggtgaagcttaccccccggagacagaagaggctgttttgtagatatcatcacggcaaccgcgcccctcagctgctcatcgcgcccttcaaggaggaggatgaatgggattctccccatatcgtcagatactacgatgttatgagtgacgaagaaatcgagagaatcaaagaaattgccaaacccaagctggcaagagcaaccgtccgggatcctaagacaggtgtgttaacagtggcctcatatagggtctcgaaaagtagttggctggaagaggacgacgatcctgttgttgctcgggtcaaccgcagaatgcagcacatcacgggacttacagtcaagactgccgagttgcttcaagtggcaaactacggggttggggggcagtacgagcctcattttgattttagcaggaatgacgagcgtgatactttcaagcatctcggcactgggaatcgagtcgccaccttcctgaattacatgtcggatgtggaggcgggaggcgcaaccgtgtttcctgatctgggcgctgctatttggccaaagaagggcactgcggtattttggtacaatctcttgcgcagcggagagggagactacagaaccagacacgcagcatgtcccgttttggtaggttgcaagtgggtttcaaacaagtggtttcatgagcgtggccaggagtttttgagaccgtgtggttctaccgaggtggattag

SEQ ID NO: 200895 - DNA, 504 bp, Artificial Sequence
  Description of Artificial Sequence: Synthetic coding sequence
atgaagctgtgggtgagcgccctgctgatggcctggttcggcgtgctcagctgcgtgcaggccgagtttttcacctccatcggccatatgacagatcttatttatgctgaaaaggagttggttcagagcctgaaggagtacatcctcgtggaagaagcgaagctctctaaaataaagagctgggcaaacaaaatggaagccctcacttccaaaagcgcagccgatgctgaaggctacctcgctcacccggttaatgcgtacaagctggtgaagaggctgaatacggactggcctgccctggaagacctggtgctgcaggactcggctgcaggcttcatcgctaacctcagcgtccaacgtcagttttttccaacagatgaggacgagattggggctgccaaagctctgatgcgccttcaagatacgtacagacttgatccaggcactatcagcaggggggagctccctgggacaaagtatcaggctatgctgtctgttgattag

SEQ ID NO: 200896 - DNA, 1608 bp, Artificial Sequence
  Description of Artificial Sequence: Synthetic coding sequence
atgaagctgtgggtgagcgccctgctgatggcctggttcggcgtgctttcatgtgtgcaagccgagtttttcacctctattgggcacatgacagatctgatttacgccgaaaaagaacttgtgcagtctctgaaagaatatatcctggttgaggaggctaaactgtcaaaaatcaagagctgggccaacaagatggaagcactaacttctaaatcagccgccgatgcagaaggctacctcgcgcaccctgtgaatgcatacaaattggtgaaaagattaaatacagattggccagccctggaggaccttgtgcttcaggattctgccgctggttttattgccaatttgagcgtacagaggcaatttttcccgacggacgaggacgagattggagccgcaaaggccctaatgcggcttcaagacacctacagattagacccaggcacgatctctcggggggaattgcccggcacaaaataccaggcaatgctttccgtggatgactgctttggtatgggccgtagtgcttacaacgagggcgactactatcatacagttctgtggatggaacaagtccttaaacagctggacgcgggtgaggaagccactactaccaagagccaggtgctggactatctaagttatgccgtttttcagctcggcgacttacatcgggctctggaactgactcgcagacttctgtctctggacccgtctcatgagcgcgcaggcggcaatcttcggtatttcgagcagctgttggaagaagaacgggaaaaaactctgacaaaccagactgaggctgagctggccactcctgaaggcatctacgagaggcctgtggactatctcccagaacgggatgtctatgaatccttatgtcgcggagagggcgtcaaactcaccccacggcgtcagaagcgcttattttgtaggtaccaccatggcaatcgcgctcctcagctgctgatagcaccttttaaagaagaggacgagtgggatagtccccatattgttaggtactacgacgttatgtcggacgaagaaatcgagcgtattaaggaaatcgcgaagcctaagctcgctcgggccaccgtccgggatccgaaaaccggtgtgctcacagtggcttcctatagggtgagtaagagcagctggctggaagaggatgatgatccggtggtggcacgagtcaacagacgcatgcagcatataacaggtctcacagtcaagacagccgaacttctccaggtggccaattacggcgtgggtggtcaatacgagccccacttcgatttctcacgcaacgatgaacgggacacttttaaacacctcgggaccggaaatagagttgccacattcctgaattacatgagcgacgtagaggccgggggcgccactgtctttcccgacctcggggctgccatctggcccaaaaagggcactgcagtattctggtataacctgcttagaagcggggagggcgattaccgtacccgtcatgctgcctgcccggttctggtgggctgtaaatgggtgtctaacaagtggttccatgaaaggggccaggagtttctgcgcccatgtggaagtactgaagtggactag

SEQ ID NO: 200897 - DNA, 306 bp, Artificial Sequence
  Description of Artificial Sequence: Synthetic coding sequence
atgaagctgtgggtgagcgccctgctgatggcctggttcggcgtgctgagctgcgtacaggcagagttctttactagcataggacatatgaccgatctgatctacgccgagaaggagcttgtgcagtcactcaaggagtacatcctggtggaagaggctaaattgtcaaagattaagtcatgggcaaacaagatggaggcgttgacttcgaagtccgccgcagacgccgagggctacttggcacacccagtgaatgcctataaactcgtcaagcgattgaatacagattggccagccctagagtag

SEQ ID NO: 200898 - DNA, 615 bp, Artificial Sequence
  Description of Artificial Sequence: Synthetic coding sequence
atgaagctgtgggtgagcgccctgctgatggcctggttcggcgtgctgtcttgcgtgcaggccgagtttttcacctctatcggacatatgacggatctcatatacgccgagaaagagttggttcagtcattgaaggaatatattctggtggaggaagcgaagttatccaagattaaatcctgggcgaataagatggaggctttaaccagcaagtccgctgccgacgcggaaggctacctggcacaccccgtgaatgcttacaaactcgtgaaaagacttaacacagattggcccgccctggaggacctggtcctccaagattcagcggccgggtttattgcgaacctgagcgtacagagacagttctttcccactgatgaagatgagattggggccgctaaagcactgatgaggctgcaggacacctacagactggatcccggcacaatctcccggggtgagttaccgggcacgaaatatcaggcaatgctttctgtagacgattgctttggtatgggcaggtccgcttataatgaaggagactattaccataccgtgctttggatggaacaagtgctgaaacagctagacgcaggcgaggaggctacaacctag

SEQ ID NO: 200899 - DNA, 345 bp, Artificial Sequence
  Description of Artificial Sequence: Synthetic coding sequence
atgaagctgtgggtgagcgccctgctgatggcctggttcggcgtgttgtcctgcgtccaggccgagtttttcacgagcatcggacacatgaccgatctgatctacgctgagaaggagctggtgcagagcctcaaggagtacatacttgttgaggaggccaagctgtcaaagattaagagctgggccaacaaaatggaagctctgacatctaaatctgcggctgacgccgaagggtatctcgcacaccctgtgaacgcatataaactcgtcaagcgactgaatacggactggcccgccctggaagacctggtcctccaagacagtgccgcgggatttatcgcctag

SEQ ID NO: 200900 - DNA, 444 bp, Artificial Sequence
  Description of Artificial Sequence: Synthetic coding sequence
atgaagctgtgggtgagcgccctgctgatggcctggttcggcgtgcttagttgcgtccaagccgaattcttcacttctattggacacatgaccgatctgatctatgctgagaaagaactcgtacagagcctcaaagagtatatactggttgaggaagcaaagctgagcaagatcaagtcttgggccaacaagatggaggctctaacgtcgaaatctgccgctgatgctgaggggtatctggcccatcccgtgaatgcttacaagctggtgaagagactgaatacagactggcccgccctagaggacctcgtcctccaggatagtgccgcgggatttatagctaaccttagtgtgcaacgtcagttttttccaaccgatgaagatgagatcggggctgccaaggccctgatgcgcctgcaggacacatacaggcttgatccctag

SEQ ID NO: 200901 - DNA, 153 bp, Artificial Sequence
  Description of Artificial Sequence: Synthetic coding sequence
atgaagctgtgggtgagcgccctgctgatggcctggttcggcgtgctaagctgtgtccaggctgaattctttacttcaattggacatatgacagatttgatctacgccgagaaggagctggtgcagtccctaaaagagtacattctggtgtag

SEQ ID NO: 200902 - DNA, 555 bp, Artificial Sequence
  Description of Artificial Sequence: Synthetic coding sequence
atgaagctgtgggtgagcgccctgctgatggcctggttcggcgtgctgagctgtgttcaggcagagttcttcacttccatcggtcatatgacagatctcatctacgcggagaaggagctggtccagtccttgaaggagtatattctggtggaggaagctaagctgagtaagatcaaatcgtgggctaacaagatggaggcactaacatcgaaatccgcggccgacgctgaaggatatctcgcccaccctgtgaacgcatacaagttggtaaaaaggcttaataccgactggcctgccctggaagaccttgtgctccaggattctgccgcgggcttcatcgccaacctgtcggtccagagacaattctttcctactgacgaggacgaaatcggcgctgccaaagccctaatgcggttacaagatacttaccggctggaccccggtactatatcaagaggcgagctgccaggtaccaaatatcaggccatgctctccgtcgacgactgttttggtatgggccgatctgcttacaatgagggggattactatcactag

SEQ ID NO: 200903 - DNA, 462 bp, Artificial Sequence
  Description of Artificial Sequence: Synthetic coding sequence
atgaagctgtgggtgagcgccctgctgatggcctggttcggcgtgctctcctgtgtgcaggctgaatttttcaccagcattggccacatgaccgacctcatttatgcagaaaaagagctggtccagtctctcaaggaatatatcttggtcgaggaggcaaagttatctaagattaagtcttgggcgaacaaaatggaagcactgacctctaaatctgcggcggacgccgagggataccttgcccaccccgttaatgcctataagctggttaaaagactgaacaccgactggccggctcttgaggatctcgtcctgcaagactctgccgcaggttttattgctaatctgagcgtgcagaggcagtttttccccaccgatgaagatgaaatcggagccgccaaggcccttatgcgcctccaggatacttaccgactcgatccgggtacgatttccaggggttag

SEQ ID NO: 200904 - DNA, 1635 bp, Artificial Sequence
  Description of Artificial Sequence: Synthetic coding sequence
atgggccccggcgcccggctggccgccctgctggccgtgctggccctaggcacaggcgatccggaacgcgcggccgctagaggggataccttctcagcacttacctccgtggcacgggctttggccccagaacgccggctgcttgggctgttgagacgctatctaaggggagaggaagcacgcctacgcgacctgactcgattctacgacaaggttctcagcctccacgaagatagcacaacccccgtcgctaatcccttattggcctttacactgattaaaagattacagtctgattggcgcaacgtggtccattccttagaagccagcgagaatattcgtgctctgaaagacggttatgagaaagtcgagcaggatctgcccgctttcgaggacctcgaaggtgctgccagggcacttatgcggctgcaggatgtgtacatgctaaatgtgaagggcctggcccgcggtgtgttccagagagtaacaggcagcgctatcactgatttgtatagtccgaagcggttgttctctctgacaggcgatgattgttttcaggtgggcaaggtagcttacgatatgggggactactatcatgccatcccatggctcgaggaggcagtcagcctgtttcgggggtcctatggggaatggaagacagaggacgaagcgagccttgaagacgcactcgaccacctggccttcgcctactttagggcgggcaacgtatcttgcgccctgagcttgtccagggaatttctgctatacagtcccgataacaaacgaatggcgaggaatgtcttgaaatacgagagactgctggccgaatctcccaatcacgtcgtcgcagaggccgtaatccaaagacccaacataccgcacctccaaactcgcgacacatacgagggactttgccagactctgggctcacaacccaccttgtatcagattccctcgttatattgcagctacgagaccaattctaatgcatacctacttctgcagcctattcgaaaagaggttattcatcttgagccctacatcgctctttatcacgactttgttagcgattctgaggcgcagaaaattagggagttagccgagccctggttgcagagatctgtggtggcttcaggagaaaagcaacttcaggtcgagtatagaattagcaaaagcgcctggctcaaagatacggttgatcctaaactggtcactctcaaccaccgcattgccgctctgacaggcctagacgtgaggccaccctatgccgaatacctccaggtcgtaaactatggcatcggtgggcattacgagccccattttgatcacgctacttcccccagctcacccttatatcgaatgaaaagcgggaatagggttgctactttcatgatatatctgagctccgtggaggccggaggcgcgacggcctttatatacgctaacctttcagtgcccgtggtgcggaatgcggcattgttctggtggaatctgcacaggtcgggcgaaggggacagtgacacgctgcacgcaggctgccctgttttggttggcgataaatgggtagccaataaatggatccatgagtatggccaggaattccggcggccttgttcatctagtccagaagattag

SEQ ID NO: 200905 - DNA, 1815 bp, Artificial Sequence
  Description of Artificial Sequence: Synthetic coding sequence
atgggccccggcgcccggctggccgccctgctggccgtgctggcccttggcacaggtgaccccgagcgagccgccgcccgaggggacaccttttccgcccttacctccgtggccagagccctggcgcccgaaaggagactcctgggcctgcttaggcggtatctccgcggagaagaggcccgtctgcgcgacttgacacgattctacgacaaggtgctgtctctccacgaggacagcaccactcctgttgctaatccgttgttagcatttaccctgatcaaacgcttgcagagcgactggcgcaacgtcgtgcactccctggaggcctctgaaaatatccgtgctctgaaggatggatatgagaaggtggagcaagacctgcccgcctttgaggacctggaaggtgccgccagagcactaatgagactgcaggatgtttatatgttaaatgttaaaggactggcccgaggcgtgtttcagagggtcaccgggtcagctatcacagacttatattcgcccaaacggctgttttcactgacaggagatgactgctttcaggtgggaaaggttgcatatgatatgggagactactaccacgcgatcccttggctggaggaggcggtaagtctctttcggggcagttatggagagtggaaaacagaggatgaagcaagtttggaggacgcccttgatcacctagcgttcgcatattttcgagccggaaacgttagttgtgccttgtccctctcacgtgagttcctgctgtactcacctgacaataaacgcatggcccgtaatgtactgaaatacgaaaggttgctggcagagtccccgaatcacgtggtggcggaagcagtcatccagcgacctaatataccccacctgcagacaagggacacttatgaaggactctgccagactttgggctcacagcctaccctgtaccagattccaagcctgtattgctcatacgagactaatagcaatgcttacctcctgcttcaacccataagaaaggaagttattcacctggaaccctatatcgcgctgtaccacgatttcgtgagcgactcagaggctcagaaaattagggaactggcagagccatggctgcagagatctgtcgttgcttccggggagaaacagctacaggtcgaatacaggattagcaagagtgcttggctgaaagatactgtcgatcctaaactggttactctgaaccaccggattgctgccttaactggacttgacgtacgccccccgtacgcagagtacttacaggttgtcaactatggtatcggtgggcactacgagccacacttcgaccatgcaactagtccaagctcgcccttgtatagaatgaaatctggcaaccgcgtggcgacctttatgatttacctgtcgtccgttgaggccgggggggctactgcctttatttacgctaatctcagtgtccctgtcgtgcgccattgctttggaggaacttgcactggcgtcgtcaaaggaacagtcacacacttcatgcttgccgtcctatcctggtgggagatttctggctggcccacatctggctatatgtctatggaccggaactccgcagacccagccgcgcccgccctaaagactgaattactggctgagcggagttggtggagccccgttgcctttcagcggagtcaggaacctaaggctggagtgggtgaggagaaggccgaacaacccccgggcaggagaccttgtcaactttgcctctgtctcgccaatcaaagacaggggagaggctgttatcagggaacactgaggatgtatatttag

SEQ ID NO: 200906 - DNA, 1527 bp, Artificial Sequence
  Description of Artificial Sequence: Synthetic coding sequence
atgctgcggcgggccctgctgtgcctggccgtggccgccctggtgcgggcagatgctccagaggaagaagaccacgttttggtgttgagaaaaagtaatttcgcagaggcacttgccgctcataagtatctgctcgtggaattctatgccccgtggtgtgggcattgtaaagctctggctcccgaatatgccaaggccgcggggaagttgaaagcagagggaagcgagattaggctagcaaaggtagatgccacagaggagtccgacttagcccaacagtacggcgtgcgcggatatcccacaatcaaatttttcagaaatggagataccgctagccccaaggagtatacagccggcagggaggccgacgatattgtgaactggctcaagaaacgcacggggcctgcagccactactcttcccgacggagccgcagccgagagcctggtcgaatcttctgaggtcgcagtcatcggcttcttcaaagacgtcgagagcgactccgctaaacagttcctgcaggccgctgaagctatagatgatatcccatttggcatcacctcaaatagcgatgtgttcagtaaataccagctggacaaggacggggtggtactgtttaagaagtttgacgagggcagaaataattttgagggagaggttaccaaggaaaatcttttggatttcatcaagcacaatcagttaccattagtcattgaattcactgaacagactgcgccaaaaatcttcggtggtgagattaagacccatatccttctgtttctgcccaaatccgtctctgattacgatgggaaacttagtaatttcaagacggccgccgagtcgttcaaaggcaagatcctgttcattttcatcgatagcgatcatacagataaccagaggattctggaattttttgggctgaaaaaggaagaatgccctgccgtgcgcctaattactctagaagaggaaatgactaagtacaagcctgaaagcgaggaattaaccgccgaacggattacagagttttgccaccggttcctggaagggaaaataaaaccacatctgatgagccaagaactgccagaagactgggataaacagccagttaaggtcctagtgggcaagaatttcgaggacgtggctttcgatgaaaagaaaaatgtgttcgtggagttttatgccccctggtgcggccattgtaagcagctggcaccaatatgggataagctcggcgaaacatataaggatcacgagaatatcgtgatcgccaaaatggactccacagcaaacgaggtcgaggccgtgaaggtgcacagcttcccaacgctgaagttttttcccgcgtcagctgaccgtacagtcattgactacaatggcgagcgcaccttggatggattcaaaaaatttctggaaagcggtgggcaggacggagcgggcgatgacgacgacttggaggacctggaggaggccgaggaaccagatatggaagaggatgatgaccagaaagccgtaaaggatgagctgtag

SEQ ID NO: 200907 - DNA, 1479 bp, Artificial Sequence
  Description of Artificial Sequence: Synthetic coding sequence
atgctgcggcgggccctgctgtgcctggccgtggccgccctggtgcgtgccgatgccccggaggaggaagatcacaagtacctgttggttgagttctacgcaccatggtgtggccactgtaaggcgctggcccctgaatacgcaaaggccgcaggtaaactaaaagccgaaggttcagaaatccggcttgccaaggtcgatgctacagaggagagtgatctggcccagcagtacggagtgcgtgggtacccaacaatcaaattcttcagaaatggcgacactgctagccctaaggaatacaccgctggcagggaggctgatgacatcgtcaactggctgaagaagcgcaccggccctgcagccaccactctgccggacggggccgcagccgaatctctggttgagagctctgaggtggctgttatcggcttcttcaaggacgttgagtcggactctgctaagcagtttttgcaggcagctgaggctattgatgacattccattcggcatcaccagtaatagcgatgttttcagcaagtatcagctggataaagatggggttgtattgtttaagaaatttgacgagggtagaaataattttgagggagaagtgacaaaagagaacctgcttgattttattaaacacaatcagcttcccctcgtgatcgagtttactgagcaaactgcccctaagatctttggcggggagatcaaaacccacatcctgctcttcttgccaaagtccgtgagtgactacgatggcaagttgagtaatttcaagaccgctgccgaatctttcaaggggaagatcttatttatatttatagactccgatcataccgacaatcagaggatccttgagttttttgggctgaaaaaagaagaatgcccagccgtgagacttattaccctcgaagaggaaatgactaagtataagcctgaaagcgaggagcttaccgcggagcgtattaccgagttttgccacagattcctagaaggtaaaattaagcctcacctgatgtctcaggagctccccgaggactgggacaaacagccggtgaaagtcttggtgggcaaaaatttcgaggatgtggcttttgatgagaagaagaacgtgtttgtggagttttatgctccctggtgcggccactgtaaacagctagcaccaatatgggataaactcggtgaaacctacaaagatcacgaaaatatcgtcattgcaaagatggattcaactgctaatgaggtcgaggctgttaaggtgcactctttcccaactctgaaattctttcctgcgagtgccgatcggactgtcattgactacaatggggaaaggacactggatggcttcaagaaattcctggagtccggcggacaagacggcgcaggcgatgacgatgatctcgaagatcttgaggaggcagaagagcctgacatggaggaggacgatgaccagaaagctgttaaagatgaactgtag

SEQ ID NO: 200908 - DNA, 1356 bp, Artificial Sequence
  Description of Artificial Sequence: Synthetic coding sequence
atgctgcggcgggccctgctgtgcctggccgtggccgccctggtgagagccgatgctccggaggaagaagatcatgtcctcgtactacgaaagtcaaacttcgccgaggccttggcagcacacaagtatctgcttgtcgaattctatgccccatggtgcggacattgcaaggccctggcccctgagtatgctaaggcagctgggaagttgaaggcggaggggagcgagataaggctggccaaggtggacgccactgaggagtccgacttggcccagcagtatggggtgagaggctaccctacgattaagttcttcaggaatggcgacacggccagtcccaaggagtataccgcagggcgggaggctgacgacatcccgtttggcattacttcaaatagtgacgtgtttagcaagtaccaattggacaaagatggagtggtgcttttcaagaaattcgacgagggtcggaataattttgagggggaagttactaaagaaaacctattggactttatcaagcacaatcaactgccacttgtgatcgagtttaccgagcagaccgcacctaagatttttggcggcgaaattaagactcacatattgttgtttctgccaaagtctgtgagcgactatgatgggaagttgagtaattttaagaccgccgctgagtccttcaagggaaagattctgtttatcttcatcgactccgaccacaccgacaatcaacgaatcctggagttttttggacttaaaaaggaggaatgtcccgcggtgcgcctgatcacgctggaggaggaaatgaccaagtacaagccggaaagcgaggaacttacggcagaaagaatcactgaattttgtcatcggtttctggaagggaagatcaagccacacctcatgagccaggaactgcccgaagattgggataaacagcctgtgaaggttctcgtgggtaagaatttcgaggacgtcgcctttgatgaaaaaaagaacgtcttcgtagagttctatgcaccctggtgtggccactgcaagcagctcgcccctatctgggacaaactcggcgaaacctataaggaccatgagaatattgtgatcgcaaagatggattcaaccgcgaatgaggtggaagccgtcaaagttcacagcttccccacactgaagttcttccccgcatcagctgatcgcacagtcatcgattacaacggcgagcgcacacttgatgggttcaagaagttcctggagtccggcggccaggatggggctggagatgatgacgacctcgaagacttagaggaggccgaagagccagatatggaggaagatgatgaccagaaggccgtgaaagacgaattgtag

SEQ ID NO: 200909 - DNA, 2133 bp, Artificial Sequence
  Description of Artificial Sequence: Synthetic coding sequence
atgctgagcctgcagtaccccgacgtgtaccgggacgagaccgccgtgcaagactaccatggccacaaaatctgcgacccatacgcgtggctggaagatcccgactctgaacagaccaaggccttcgttgaggcccaaaataaaataacggtaccattcttggagcagtgccctattaggggtctgtataaggagaggatgacagaactgtacgactatccaaaatacagttgtcacttcaagaagggcaagaggtacttttacttctataatacaggtttgcagaatcagcgggtgttatatgtacaagattcactagagggcgaagccagggtattcctcgacccaaatatacttagcgatgatggtaccgtcgctcttagaggttatgcattttccgaggatggagagtacttcgcgtatgggcttagcgcttctggaagcgattgggtgacgattaaatttatgaaggtggacggagcgaaagagctgccagacgtgcttgagagagtaaagttcagttgcatggcatggactcatgacggcaagggaatgttttacaatagctacccccagcaggatggcaagtcggacggcaccgagacaagtaccaatctacatcagaagctgtactaccatgtgcttggaaccgatcagtccgaggacatcttgtgcgctgagtttcccgatgagcccaagtggatggggggggctgagctgtcagacgacggaagatatgtactgctgtctattagagagggttgtgatcccgtaaatcggctttggtactgtgatctgcagcaggaaagctcaggcattgccggcatcctgaagtgggtgaagctaatcgataatttcgaaggcgaatatgactatgtaaccaatgaagggacagtgtttacctttaaaactaaccggcaaagtcccaattatcgagtgattaatatagatttcagagatcccgaggagagcaagtggaaggttttggtccccgaacatgaaaaggatgttctcgagtggattgcgtgtgttcgatccaattttcttgtgctgtgctatctgcatgatgtgaagaacatcctgcagctgcacgacctgaccactggggctcttttgaaaaccttccccctggatgttggaagcatcgtcggatactccggccagaagaaggacacggaaatcttctaccagtttacaagtttcctgagccctggaattatctaccactgtgatctgacgaaagaagagttggagccacgagtctttcgcgaagtaacggtcaaaggaattgacgcttcggactatcagacagtgcagatcttttaccccagcaaggacgggactaagatccctatgttcattgttcataaaaaagggattaagctagacggcagccatcctgcttttttgtatggctacggtggtttcaatatatccattactcctaactattcggtcagccggctaatcttcgttagacacatggggggcattctcgctgtcgcaaatattcggggcggcggagagtatggagaaacctggcacaagggcggcatactagcaaacaagcagaattgcttcgacgacttccagtgtgcagccgagtatctcatcaaggaagggtacacgagccctaaacgcctaactatcaacggaggaagcaatggcggactgttggtggctgcgtgtgcaaatcagcggccagatctgtttggatgcgtgatagcccaggtgggcgtcatggacatgctcaagtttcacaaatacacaataggtcatgcatggaccaccgactatggatgttccgattctaagcagcactttgagtggcttgttaagtattctccactccataatgtcaaactgcccgaggcagatgatatccaatatccaagcatgttgttgctgacggctgatcatgacgatcgcgttgtgccactccatagcctaaaattcattgccacgctacagtacatcgtggggaggtcaagaaagcagtccaacccgctgctgatccatgtggacacgaaagctggacacggagccggcaagccgacagcaaaagtcatcgaagaggtctccgatatgtttgcgttcatcgctcgttgtctgaacgtggactggataccatag

SEQ ID NO: 200910 - DNA, 138 bp, Artificial Sequence
  Description of Artificial Sequence: Synthetic coding sequence
tgaatcatctaccactgcgacctgaccaaggaggagctggagccccgagtgtttagggaagtcactgtgaagggcattgacgcatcagactatcagaccgttcaattacctaagggcaccgaaagttcgcgcaattag

SEQ ID NO: 200911 - DNA, 135 bp, Artificial Sequence
  Description of Artificial Sequence: Synthetic coding sequence
atcatctaccactgcgacctgaccaaggaggagctggagccccgggttttccgggaggtgaccgtgaagggcattgatgcgagcgactatcagactgtgcagctacccaagggtacggaatcttccagaaattag

SEQ ID NO: 200912 - DNA, 2184 bp, Artificial Sequence
  Description of Artificial Sequence: Synthetic coding sequence
atgcagcagaagaccaagctgttcctgcaggccctgaagtacagcatcccacacttagggaaatgcatgcaaaaacagcatttgaatcattacaatttcgccgatcattgctacaataggattaaactgaagaagtaccatctgacaaagtgcctgcagaataagcctaagatttccgaacttgcgcgcaacattccaagcaggagcttttcatgcaaggacctgcagcctgttaagcaggaaaatgagaagcccttaccagaaaatatggatgcattcgagaaggtccgtacaaaactagaaacgcagccccaggaggaatacgagatcatcaatgtggaggttaagcacggcgggtttgtatactaccaggagggatgttgtttagtccggtccaaagacgaggaggccgataatgacaattacgaggtgctgtttaacctggaagagttgaagctggaccaacctttcatcgactgcattcgggtggcacccgacgaaaagtacgtcgctgccaagataagaacagaagattccgaggccagcacgtgtgtcattattaaactgtccgaccagcctgttatggaagcgtcattcccaaacgtgtcatcgttcgagtgggtgaaagatgaagaggacgaagacgtactgttctacacctttcagcgaaatctgcgttgccacgacgtgtatcgggctaccttcggagataataagcgcaatgagcggttctacacagagaaggacccaagctattttgtattcctatatcttaccaaggacagccggttcctgaccattaacataatgaacaagacaacgagcgaagtctggctcatcgatggactgtccccttgggatccccccgtcttgatccagaaaaggatacacggggtactgtactacgtggaacaccgtgacgacgagctgtatatcttgaccaatgtgggggagcccacggaatttaaactgatgcgaaccgcagctgatacgccggcaataatgaactgggacctcttttttactatgaagagaaacaccaaagtcattgatctggatatgtttaaagaccattgcgtgctgttcctgaagcactcaaacctgctctatgtcaacgtgatcggactggccgatgactccgtaaggagcttgaaacttccgccatgggcctgcgggtttattatggacacgaacagtgatccaaagaactgtccattccagctctgttcacctatccgaccacctaagtattacacctataagtttgccgagggcaagctctttgaggagaccggacacgaggaccccataaccaagacatctcgcgtgttaagactagaagccaaatccaaagacggaaaactggttccaatgactgtgttccataaaaccgatagcgaagatctgcagaagaaaccactcctcgtccatgtctacggcgcatacggcatggaccttaaaatgaactttagacccgagcgcagggtgctagtagacgatggctggattctggcctattgtcacgttagaggaggaggcgaattaggactacaatggcacgccgacggcagactcaccaagaaattgaacgggctcgcagacctcgaggcctgcattaaaacactgcatggccaaggcttttcacaaccctcattaaccactctgacagccttttctgcagggggtgtactcgcaggggcactctgcaactccaatcccgaactcgtgcgcgccgtgacactggaagcaccttttctggatgttctgaatacaatgatggatacaacattgcccctgaccctggaggaattggaagagtggggcaacccctcctctgacgagaaacataaaaactacattaaacggtattgtccgtatcagaacatcaagccgcagcactacccatcaatccacattaccgcttatgaaaacgatgagagagtgcctctgaagggcatcgtcagctataccgagaagctcaaggaagcgatcgctgagcacgctaaagatacaggcgaaggataccagacacctaatatcattctcgacatacagcccgggggtaatcatgtgatcgaggactcccacaagaaaattacagctcagattaagttcctgtacgaggagcttgggcttgacagtacctccgtgtttgaggacctcaaaaagtacctgaaattctag

SEQ ID NO: 200913 - DNA, 1998 bp, Artificial Sequence
  Description of Artificial Sequence: Synthetic coding sequence
atgcagcagaagaccaagctgttcctgcaggccctgaagtacagcatcccccatctgggaaagtgcatgcagaaacagcacctgaaccactataacttcgcggatcactgctataataggatcaaactcaagaagtatcacctcaccaaatgtcttcagaataaacccaaaatttccgagctggccaggaacatcccctcacggagcttcagttgtaaagacctgcagcccgtgaaacaggaaaatgagaagcctctcccagagaatatggacgccttcgagaaagtacgcacgaaattagagacgcaaccgcaggaagagtatgagatcatcaatgtggaggttaaacacggaggctttgtctactaccaagagggctgctgcctggttaggtccaaggacgaagaggcagacaacgacaactacgaggtcttatttaatttggaggagctgaaacttgaccaaccattcattgattgcattcgcgtggcacctgatgagaaatacgttgctgccaagattaggacagaagattcagaggcttccacctgcgtgatcatcaagctatccgatcagcctgtgatggaggcatcatttccgaacgtctcgagcttcgagtgggtcaaggacgaggaggacgaagatgtgctgttttacacgttccagcgcaatttgcgctgccacgacgtgtatagggctacgtttggggataacaaacgcaatgagcgattctacacagaaaaggacccctcatacttcgtatttctctatctgactaaagattctcgctttctcaccatcaatatcatgaacaagactacctctgaagtctggctaattgacgggttgtcaccatgggacccgcctgtactcattcagaaacgaattcacggggtcctttactacgtcgaacaccgtgacgacgaattatatatcctcactaacgtaggtgagcccacagaattcaaactgcctccatgggcatgtggctttatcatggatacaaatagtgaccccaaaaactgtccatttcaactttgcagtccaatacgacctcccaagtattatacatataagttcgcggaaggcaaactctttgaagaaaccgggcacgaggatccaatcactaaaactagtagggtgttaagactcgaagccaaatccaaagatggcaaacttgtgccaatgaccgtttttcacaagactgacagcgaggatctccagaagaagcctcttctcgtgcacgtttatggggcctacggtatggatttgaaaatgaacttccgtcccgaacgccgcgtactggtagacgatggctggatactggcctattgtcacgtgagaggcggtggcgagctgggattgcagtggcacgcagatggtaggctaaccaagaaacttaacggcctcgcagacctggaggcctgcataaagacactccatggccaggggtttagccagccttccctcaccacgctcacagcctttagtgccggaggggtgctggccggcgctctttgcaatagcaaccctgagttagtgagggccgtgactctcgaggcgccatttcttgatgttcttaacaccatgatggataccacattgccactgacccttgaggagctggaggagtgggggaaccctagttccgacgagaagcataagaattatatcaaaaggtattgcccttatcagaatatcaagccccagcactatccttctatccatatcaccgcctatgaaaacgatgagagggtgccactaaagggcattgtctcttacaccgaaaaacttaaggaggccatcgccgagcacgccaaagacactggggagggttaccaaacaccaaatatcatacttgacatccagcctggcggaaaccatgttatagaggatagccacaagaagatcaccgcccagatcaaattcctctatgaggagctcggcctcgattctactagtgtcttcgaagacctcaagaaatatctgaaattttag

SEQ ID NO: 200914 - DNA, 1986 bp, Artificial Sequence
  Description of Artificial Sequence: Synthetic coding sequence
atgcagcagaagaccaagctgttcctgcaggccctgaagtacagcattccacatttggggaaatgtatgcagaagcaacatctcaatcattacaattttgccgaccactgctacaatcgaattaagttaaagaaatatcacctgacaaaatgccttcagaacaaaccaaagattagcgaattggccagaaatatcccatcccgttcattctcctgcaaggacctccaacctgtgaagcaggagaacgagaaacccctgcctgagaatatggacgcttttgaaaaagtgagaactaagctcgagactcagcctcaagaagaatacgagatcattaatgtagaagtgaaacacggcggttttgtgtattatcaagaagggtgttgcctcgtgcgctccaaggatgaggaagccgacaacgacaattatgaggttctttttaacctggaggaactgaagctcgaccagccttttatcgactgtatcagagtggctcccgacgaaaaatatgtcgctgccaagattagaacagaggactcggaagcctccacgtgtgtcatcataaaactgagcgatcagccagtgatggaagcctcctttccaaacgtttctagtttcgaatgggtgaaagatgaagaggatgaggatgttttgttctatacctttcagcgcaacttgcggtgtcatgacgtgtacagggctactttcggggacaacaaacgtaatgagcgattttatactgagaaagatccaagttactttgtgttcttatatctcaccaaggatagccggtttttgaccatcaacatcatgaataagaccacctcggaggtgtggctcatcgacggtctgagcccatgggatccccccgtgctcatccagaagcgaatccatggcgtactgtactacgtggaacatcgggacgatgagctttatattctaaccaacgttggagagcctacagagtttaagctcatgcgcacagccgctgacacaccagcgattatgaattgggacctgttctttactatgaaaagaaacacaaaggtaatcgaccttgatatgtttaaggatcactgtgtgctgttcctcaagcattccaatctgttgtatgtcaacgtcatcggactagcggatgatagcgtgcgtagtcttaaggacggcaagctcgtccccatgaccgtcttccacaagacagatagcgaagatctgcagaagaagccactccttgttcatgtctatggcgcttacggcatggatctcaagatgaatttcaggcccgagagacgagtgctcgtcgatgacggttggatcctggcctactgccatgtccggggcgggggggagttgggtctgcaatggcacgcagatgggcggctgacaaaaaagctgaacggtcttgcggacctggaggcatgcattaaaacactacatggtcaaggtttttcacaaccctccctaacgaccctcaccgctttctcagccggcggcgtcctggccggagctctctgtaacagcaatcccgagctcgtgcgcgctgtaacattggaggcaccttttctggatgttctgaacacgatgatggacactactttgcccctgaccttagaggagctggaagagtggggtaatcccagctctgacgaaaagcacaaaaactacatcaaaaggtattgtccctaccaaaacataaagccccaacattatccatccattcacattaccgcgtacgagaatgatgaacgggtgcccctgaaaggaatcgtgagctatactgagaagctgaaagaagccattgcagaacatgctaaggataccggagaaggataccaaacgcctaacattatcctggatatccagccaggcggaaatcacgtgatcgaggacagtcacaaaaagatcaccgcccagatcaaattcctgtacgaagagctgggcctcgattctacctcagtgttcgaggacctgaaaaagtaccttaagttttag

SEQ ID NO: 200915 - DNA, 2184 bp, Artificial Sequence
  Description of Artificial Sequence: Synthetic coding sequence
atgcagcagaagaccaagctgttcctgcaggccctgaagtacagcatacctcatctgggtaagtgtatgcagaagcaacacctcaaccactataactttgccgaccattgctataatcgcataaagctgaaaaaataccacctgacaaagtgcctgcagaataagccaaaaatcagcgaactagcccgaaatattccgtctcggagcttcagctgcaaggatctccagcccgtgaagcaggaaaacgagaagccactcccggagaacatggacgcctttgaaaaggtgcgcacgaaactggagacccaaccacaggaggagtacgaaataattaacgtagaagtcaaacatggggggttcgtgtattatcaggaagggtgttgcctcgtcagatcaaaggatgaggaggctgataacgacaactacgaggttctgttcaacctcgaagaactcaagctggaccagccatttattgactgcatccgcgttgccccggatgagaaatatgtcgcagcaaagatccggacagaggatagcgaagcctcaacatgtgtgattatcaagctctccgatcagcccgtgatggaggccagctttccgaacgtttcttccttcgaatgggtaaaagacgaggaggacgaggacgtactcttctatacattccagagaaatctccggtgtcatgatgtgtacagggctacattcggtgataataagcggaacgagaggttttacactgagaaagatccctcatacttcgtgttcctgtatctcaccaaggactctcgctttcttactatcaacatcatgaacaagacaacttcagaggtgtggcttattgatggcctcagcccctgggatccgcccgtgttgattcagaaacgaattcacggagtgctgtactacgtcgaacaccgagacgatgagttgtacatcttgaccaatgtgggcgagcccacagaattcaagttaatgcgtactgccgctgacactccggcgatcatgaactgggatctcttcttcacaatgaaacgcaatacaaaagtcatcgatctcgatatgttcaaagatcattgcgtgctgtttttgaagcactctaacctgctgtatgtcaatgtgatcggtcttgctgatgatagcgtaagatctctcaaactgccaccctgggcttgcgggtttatcatggacactaatagtgacccaaaaaactgcccgttccaactgtgttctcctatccgcccaccaaagtactacacttataaattcgctgaggggaagctttttgaggagaccggacacgaggacccaataactaagacaagtagagtgctacgcctggaagccaaaagcaaggacgggaaattggtgcccatgactgtgttccataagactgactctgaagacctccagaaaaaaccactcctagtgcacgtgtacggcgcctacgggatggacctcaaaatgaactttaggcccgaaaggagggtgttggttgatgatggatggattctcgcttactgccacgttagaggggggggcgaactgggtttgcagtggcatgcagacggtcgcttaacaaaaaaactgaacggtctggcggacctggaggcatgtattaaaacactacacggccaggggttttcgcagccttccttgacaaccctcactgcattctctgctggaggggttctggccggcgcactctgcaattccaatcctgagctcgttagagccgtgacactggaggccccctttctggacgtgcttaacaccatgatggacactacattacctctcacactggaagaactggaagagtgggggaacccatcgtcagacgagaagcacaaaaattatatcaagcgttactgtccttatcagaatattaagccacagcattatccaagtatccatatcactgcatacgaaaatgatgaacgggtgcctctgaagggtatcgtgtcatataccgagaaacttaaggaagctatcgccgaacacgccaaagatactggggagggataccaaacacctaacatcatcctggatatccagcctggcggcaaccatgtgatcgaggattcacataaaaaaattaccgcccaaatcaagtttttatacgaagaactggggctcgatagtacaagcgtgttcgaggacctcaagaagtatctaaagttttag

SEQ ID NO: 200916 - DNA, 2184 bp, Artificial Sequence
  Description of Artificial Sequence: Synthetic coding sequence
atgcagcagaagaccaagctgttcctgcaggccctgaagtacagcataccacaccttggcaagtgtatgcagaaacagcacctcaaccactataattttgccgatcattgttataaccggattaagctgaaaaaataccacttgaccaaatgcctccagaataaacctaaaatatccgagctcgctcgaaatatcccgagcagatctttttcatgcaaggacctccaacctgtaaaacaggagaacgaaaaacctctccccgagaatatggacgccttcgagaaagtgcggaccaaactagagactcagcctcaagaagagtatgagattatcaacgtcgaagtgaaacatggaggctttgtgtactaccaggagggttgttgtctggtgagatctaaggacgaagaggcagacaatgacaattacgaagttctgttcaatctggaagagctcaaactggaccagcccttcatcgattgtattcgcgttgcaccggacgaaaaatacgttgcagcaaaaatcagaaccgaggacagtgaggcatctacttgtgtgatcattaagctctctgatcaacctgttatggaagcaagctttcctaacgtgtcctctttcgagtgggtaaaggacgaagaagacgaggacgtcttattttataccttccagcgtaaccttcgttgccacgacgtttacagagccacattcggtgataacaagcggaatgagcggttttatacagagaaggacccctcctacttcgtctttctgtacctcaccaaggactcacgctttctcactattaatattatgaataagactacttctgaggtgtggttgattgatggcctgtctccatgggaccctcctgtcctcatccagaagcgcattcatggtgtcttatattacgtggagcatcgtgacgacgagttatacattctgaccaacgtgggcgagccgacggagttcaaattgatgcggactgccgcagacactcccgcaataatgaactgggatttattcttcacgatgaagagaaatactaaggtgatagatcttgacatgtttaaagaccattgcgtcttgtttctaaagcacagcaacctgctttatgtgaacgtgatcgggctggccgatgactctgtgcggtccctcaagctgccaccttgggcttgcggcttcattatggataccaacagcgatccaaagaattgccccttccagctgtgttctcctatacggccccctaagtattacacttataagttcgccgagggtaagctgtttgaggaaacagggcatgaggaccctatcacgaagaccagccgcgtcctgcgcctagaagccaaatccaaggacggtaaattggtacctatgaccgtctttcataaaactgattcagaagacttgcagaaaaaacctctcttagtccacgtatatggagcttatggaatggacctgaagatgaattttcggccggaaagacgcgtgctcgttgacgatggatggattttagcttactgccatgtgaggggaggaggggagctcggcctccagtggcatgccgacggtagattaacaaaaaaactgaatggcctggcagaccttgaagcttgtatcaaaactctgcacggccagggcttctcccagccctcattaactacccttacagcttttagcgcaggtggagtactggcaggcgccttgtgcaattccaacccagaactggtgcgagcagtgacactcgaagctcccttcctagacgtgctcaacaccatgatggataccactctgcccctaaccctagaggagctggaagagtggggaaacccttcgtccgacgagaaacacaaaaactacatcaagcgttattgtccgtatcagaacattaagccacaacactatccttccatacatattacagcatatgaaaacgacgaacgagtaccgctgaaaggaatagtgtcatatactgagaaattgaaggaagccattgccgaacacgccaaagatacaggagaaggataccagactccaaatatcattctggatatacagccaggcggtaaccatgtgatcgaagattctcacaaaaagatcaccgcacagattaaatttctgtatgaggaactcggcctggatagcacatccgtttttgaagacctcaagaaatacctcaaattttag

SEQ ID NO: 200917 - DNA, 2184 bp, Artificial Sequence
  Description of Artificial Sequence: Synthetic coding sequence
atgcagcagaagaccaagctgttcctgcaggccctgaagtacagcatacctcacctcggaaagtgcatgcagaaacaacacctgaatcattacaattttgctgaccactgctataaccgcattaagcttaaaaagtaccacctcaccaagtgcttgcagaataaaccgaagatttccgagctggccagaaatattccatctcgctctttcagttgtaaggacctccaacccgttaagcaagaaaacgagaaacccttaccggagaatatggacgcctttgagaaggtgagaaccaaattagagacgcagcctcaggaggaatacgagatcatcaatgtagaagtcaagcatggcggcttcgtttattaccaagaaggatgttgcctcgtcaggagtaaagacgaagaggccgacaatgacaactacgaggttctatttaacctggaggagctcaagttagaccagccgttcattgattgcatcagggtcgctccggatgagaagtacgtggccgctaagatcagaaccgaagattctgaggccagcacatgcgttattattaaactcagcgaccaacctgtgatggaagcttccttccctaacgtcagctcgtttgagtgggttaaggatgaagaggacgaggacgtgctattttacactttccagaggaacctcagatgtcacgacgtgtacagagctacctttggagacaacaagaggaatgagcggttttacacggagaaagaccctagctacttcgtatttctttacctgactaaggattccagattcctgaccatcaacatcatgaacaaaaccacatccgaggtctggttaatcgatggactgtcaccttgggatcctccagttctgatccagaagcgaattcacggggtgctgtattatgtcgagcacagagatgatgagctctatatcttaactaatgtgggggagcccacagaatttaagctgatgcgaactgctgcggatacccccgccattatgaactgggatttgttcttcacaatgaagagaaacacgaaggtgatcgatctggacatgttcaaggaccactgtgtgctttttctgaaacattctaatcttctatacgtgaatgtgatcggcctggcagacgacagcgtacgttctctgaaattgcctccttgggcctgtggctttatcatggacacaaactctgaccccaaaaattgtcctttccagttgtgcagccctatacgccctccgaagtattatacctataagtttgcagagggcaagttgttcgaggaaacaggtcatgaagatcctataaccaagactagccgcgtcctcagactggaggccaagagcaaggatggcaaactagtgcccatgacagtgttccataaaaccgactcagaggatctgcagaagaagcctctcctagtccacgtatacggggcttatggaatggacctgaagatgaacttcaggcctgaaagacgggtcttggtagacgacggatggattttagcttactgtcacgtccgtggggggggggagttagggcttcaatggcacgccgacggcagactgactaaaaaattaaacggcctagctgacttagaggcctgtatcaagacactgcacggccagggcttttcccagccatccctgacaaccttgacagcatttagcgcgggtggcgtgctggctggtgccctgtgcaactcaaatcccgaattagtaagagcagtgacgttagaggcaccttttctcgacgtcctgaacacaatgatggatacaactttacccctgaccctcgaggagctggaggagtggggcaatccatccagcgatgagaagcacaagaattatatcaagcgttattgcccataccagaatatcaaaccgcaacattatccatccatacacatcacagcatacgagaacgatgaaagagtgccactgaaaggcatcgtgtcctacaccgagaaactgaaagaagcaatagctgagcatgctaaggataccggagaaggatatcagactcctaatattattcttgacatccagccaggcgggaatcacgtgatcgaggattctcataagaagataaccgcacagatcaaattcctgtacgaggagctaggcctggacagtacctcagtgttcgaggatttgaaaaagtacctgaagttttag

SEQ ID NO: 200918 - DNA, 2184 bp, Artificial Sequence
  Description of Artificial Sequence: Synthetic coding sequence
atgcagcagaagaccaagctgttcctgcaggccctgaagtacagcattccacaccttgggaaatgtatgcaaaagcagcacctgaaccattataactttgctgatcactgttataaccgcatcaagctgaaaaagtaccatttgacaaagtgcctgcagaataagcccaaaatcagcgagcttgcaaggaacatcccatctcggagtttttcgtgcaaggatctgcagccagttaagcaggagaatgagaagcccctgcctgaaaatatggacgcttttgagaaggtgcgaactaagctggaaactcagccccaggaggaatatgagatcatcaacgtggaagtgaagcacgggggattcgtatactaccaggagggttgctgtttggtcaggtccaaagatgaggaggcagacaacgacaactacgaggttctgtttaatctggaagagctcaaactggaccagcccttcattgattgcatacgtgtggcaccagacgaaaaatatgtagcggcaaaaatcagaaccgaagactccgaggcatctacctgtgtcattattaaactgtctgaccagcctgtgatggaggcctcttttcccaacgtatctagtttcgagtgggtgaaggatgaagaggacgaagacgttctgttctacactttccaaagaaacctccgatgtcacgacgtgtatagagcaaccttcggagataacaagagaaatgaacgcttctatacggaaaaagatccaagttactttgttttcctttacctgacaaaagactcccgctttctgaccattaacattatgaacaaaacaacctcagaagtttggttaattgatggactatccccttgggacccgcctgtgcttattcagaagaggattcacggagtgctgtattatgtggagcatcgagatgacgagttatatatcctgacgaacgtgggagagccaactgagttcaagctgatgagaaccgcagcggatacccctgctattatgaattgggatttgttttttacaatgaagaggaatacaaaggtcatcgacctcgacatgttcaaggaccattgtgttctgttcttgaaacattccaaccttttgtacgtcaacgtaatcggcttggctgatgacagtgttagatcactgaagctgccaccgtgggcttgcggtttcatcatggacactaattccgacccgaaaaattgccccttccagctctgttcgcctattagaccaccaaaatattacacttacaaattcgcagaagggaagctttttgaggagactggccacgaggaccctatcacaaagactagcagagtgctccggctcgaggcaaagtcaaaagacggaaagctagtgcccatgactgtgtttcataaaactgattccgaggacctgcagaagaagccattgctcgtgcatgtgtacggcgcatacgggatggatttaaagatgaacttccgcccggagaggcgggtgctcgtggatgacggatggatcctcgcctactgccacgtccgcggtggcggcgagcttggactccagtggcacgcggatggcagactgactaaaaagcttaatggcctggcagatctggaggcctgcatcaagactctgcacggacagggattttcgcagcctagcctgaccactctcactgccttcagcgctggaggtgtcctagccggtgcactgtgcaacagtaacccggaactggtgagagcggtaacgctggaagccccctttttggatgtgctaaataccatgatggacacaactctgcctcttaccctggaagaactggaggagtggggtaacccatcttccgacgaaaaacacaagaattatattaaaaggtactgcccgtaccaaaatataaaaccccagcactacccctccatccatatcaccgcttacgagaacgacgaacgggtaccactcaagggcatcgtttcttataccgagaagcttaaagaggcgattgcggagcacgccaaggatacgggcgaaggctatcagacccccaatataattctcgatatccaacctggggggaatcatgtcattgaagacagccacaaaaaaatcacagctcagattaagttcctgtacgaagaactggggttagacagtacttccgttttcgaggatctcaagaagtacctgaaattctag

SEQ ID NO: 200919 - DNA, 2184 bp, Artificial Sequence
  Description of Artificial Sequence: Synthetic coding sequence
atgcagcagaagaccaagctgttcctgcaggccctgaagtacagcatccctcacttaggcaagtgcatgcagaagcagcatttgaaccactacaatttcgctgatcattgttataatagaatcaagctcaagaagtaccacttaaccaaatgtctgcagaacaaacctaagatttcagaattggcaagaaatattcccagcaggagcttcagttgcaaggacctccagcccgtgaaacaggagaacgagaaaccgctccccgagaacatggatgcttttgaaaaggtaaggaccaagcttgagacccagccgcaggaagaatatgaaatcataaatgttgaggtgaaacacggagggttcgtctattaccaggagggttgttgcctggtgaggagtaaagacgaagaggccgataatgataactacgaagttctgtttaatctcgaggaactgaaactggatcaacccttcatagactgcattcgggtggcaccagatgaaaagtatgttgcagcaaagatcaggactgaagacagcgaggccagtacttgcgtgattatcaagctcagcgaccagccagtgatggaagcttcttttcccaatgtatcctcttttgaatgggttaaggatgaggaagacgaagacgtgctgttctacacctttcaaagaaacttaagatgtcatgatgtgtaccgagctactttcggggataataagagaaatgagcggttctacacagagaaggaccctagttacttcgtgttcctgtatctaactaaagacagccggttcctcaccattaatatcatgaataagaccacatcggaggtttggctgattgacgggctgagtccctgggacccccctgtcctgatccagaaaaggattcacggggtgctctattatgtggagcatcgtgacgatgagctgtatattttaactaacgtgggggaacctaccgagttcaaacttatgcgaacagccgccgatactccggctattatgaactgggaccttttcttcactatgaagcgaaatacaaaggtgatcgaccttgacatgtttaaggaccattgtgtgctgtttctgaaacacagcaatctgttatatgtaaacgtcatcggactagctgacgactctgtgagaagccttaagctgccaccgtgggcctgcggcttcatcatggacacaaactccgatcccaaaaactgcccttttcagctctgttcaccgatccgaccccctaaatactacacctacaagttcgctgaaggcaagctatttgaggagaccggtcacgaggaccctattaccaagaccagtcgcgtactgcgcctggaggctaagtcgaaggatgggaaattagtgccaatgacagttttccataagaccgactctgaagatctgcagaagaagccactcttggtccatgtctatggagcctatgggatggatctgaaaatgaattttagacctgaacgcagagtgctcgtagacgacggatggattctggcctattgtcacgtgcgggggggcggcgagctggggttgcagtggcatgcagacgggcgacttacaaagaagctgaatggccttgccgatctagaagcttgcatcaagacactccatgggcagggattttcacagcccagcctgactacactcaccgctttcagcgccggaggcgttctggccggggctttgtgcaacagcaaccccgaactggtacgagctgtcaccctggaagctccctttctagatgtgctgaacaccatgatggacacaactctgccgctcactctggaggagctagaggagtggggcaatcctagctctgacgagaagcacaagaattacattaaacgctattgcccttatcagaacataaaaccacagcattacccctctatccatatcaccgcatatgaaaacgacgagcgggttccattgaagggcatagtgtcttacactgaaaagctgaaggaagctatcgcggaacacgccaaggataccggggaaggatatcagactccaaacataatcttagacatccagcctgggggaaaccacgtgatcgaggactcgcataagaaaattacagcgcagatcaaatttctatacgaagaactgggactcgactccacctctgtgtttgaggatcttaagaagtacctgaagttctag

SEQ ID NO: 200920 - DNA, 456 bp, Artificial Sequence
  Description of Artificial Sequence: Synthetic coding sequence
atgcagcagaagaccaagctgttcctgcaggccctgaagtacagcattccacatcttgggaaatgtatgcagaaacagcatctgaaccattataattttgctgaccattgctataaccgcataaagctgaagaagtaccatcttaccaaatgtctgcagaacaaaccaaagatttcagaactggcacggaatattccgtccaggagcttctcatgcaaggatcttcagccggtgaagcaggaaaacgagaagccactgcccgaaaacatggatgcattcgaaaaggtgcgtactaagctagagacgcagccccaagaggaatacgaaatcataaatgtggaggtgaaacacggcggcttcgtgtactatcaggagggatgctgtcttgtgagatctaaggatgaagaggcagacaacgacaactacgaggtcctttttaacctggaagagctgtag

SEQ ID NO: 200921 - DNA, 1917 bp, Artificial Sequence
  Description of Artificial Sequence: Synthetic coding sequence
atggacgccttcgagaaggtgcggaccaagctggagacccagccccaggaggagtacgagatcattaatgtggaggtcaaacacggagggtttgtctactaccaggaaggctgttgccttgtaaggagtaaggatgaggaggctgataatgataactatgaggtactctttaatttagaagagttgaagttagaccaaccattcatagactgcatcagggtggcccccgatgagaagtacgtggctgcgaaaattcgaaccgaagactctgaagctagtacatgtgtgatcattaaactatccgatcagcctgtcatggaagcttctttccccaacgtgtcttccttcgagtgggtcaaagatgaagaggatgaggacgtgttgttttatacttttcagcgcaatctacgatgtcatgacgtttatagggccaccttcggcgacaataaaaggaacgaacggttctatacagagaaagatccaagctactttgtgttcctgtatctgacaaaggacagcagattcttgaccatcaatattatgaataaaactacttccgaagtatggctgatcgatgggctgtccccttgggaccctcccgtgctgattcagaaaagaatccatggtgtcttgtactacgttgagcaccgggacgatgagctctatattctgaccaacgtcggtgaacctacagaattcaagctcatgcggacggcagccgacacccctgcaattatgaactgggacttgtttttcacgatgaaaagaaatactaaggtcattgacttggatatgttcaaagaccactgtgtgctatttctcaaacactcaaatcttctctacgtcaacgtaattgggctggccgacgactctgtccgctctctcaaactgcctccttgggcctgtggtttcataatggatactaatagtgacccaaaaaattgcccctttcagttgtgctctcccattcggcctccaaaatattatacctacaagttcgccgaaggcaagttatttgaggagaccggacacgaggatccaatcaccaagacgtcacgagtcctaagactggaagcaaagagcaaggacgggaagctggtgcctatgaccgtctttcacaaaactgactccgaagacctacagaaaaagccactgctcgtccacgtttatggagcatacgggatggatttgaaaatgaactttcgcccggaaagaagggtactcgttgacgatgggtggattttggcctattgccacgtgagggggggcggagaactcggtctgcagtggcacgctgacggcagactaaccaaaaaattaaatgggcttgccgatctcgaggcctgcattaaaacgctgcacgggcaggggtttagccagccttcactcaccactctgacggccttctccgccggcggtgttttagctggggctctgtgcaattctaatcccgagctcgtgagagctgtgacactggaggcaccatttctggatgttttaaatacaatgatggataccaccctgccactgacacttgaagagctggaagaatggggcaacccgtcatctgatgagaaacacaaaaattacatcaagcggtactgcccctatcagaatatcaaacctcagcattacccgagtattcatataaccgcctacgaaaatgacgagagagtccctctgaaggggatcgtctcatacacagaaaagttaaaagaagcaatcgctgagcatgctaaggacaccggcgaagggtatcagacccccaatattattctggacattcagccaggaggtaaccacgttattgaggattcacataagaaaatcaccgctcagatcaagtttctgtacgaggagctgggcctcgactctacttcggtctttgaggatctgaagaaataccttaagttctag

SEQ ID NO: 200922 - DNA, 1491 bp, Artificial Sequence
  Description of Artificial Sequence: Synthetic coding sequence
atgggccggcgggccctgctgctgctgctgctgagcttcctggccccctgggctacaattgccctgcgacctgctctgcgcgcacttggatccctgcacctgccaacaaacccgacctcactgcccgcagttgctaaaaactactccgttctttacttccagcaaaaagtcgaccactttggattcaataccgtaaagaccttcaaccagagatacctagtggctgataaatactggaagaagaatgggggcagcatactgttttacaccggcaacgagggggatattatctggttctgtaataataccgggttcatgtgggatgtggccgaagagctgaaggccatgctggtgtttgcagagcatcgttattatggggagagtctcccttttggggataattcattcaaggattctagacacctgaatttcttaactagcgaacaggccctcgcagactttgctgagctgatcaagcacttgaaaaggacgataccaggagccgagaaccagccagtgattgcaatcggaggaagctacggggggatgttagcagcctggttccgcatgaagtacccgcacatggtagtaggagcgctggccgcgtccgccccaatctggcagttcgaagacctggtaccttgtggcgtgtttatgaagatcgtgaccacggatttcagaaagtccgggccccactgttctgagtctatacaccgctcctgggatgctattaacagactaagcaatactggatcagggttgcaatggctgaccggtgcattacatctctgtagcccattgaccagccaggacatacagcatctgaaagactggatctcggaaacatgggtgaatttagctatggtggattacccatatgcctcgaacttcctgcagccattaccggcttggcccattaaggtggtttgtcagtacctaaagaaccctaacgtctctgattccctactccttcagaatatattccaggcactgaacgtttattataattactccggacaggtgaagtgcctcaatatttctgaaaccgcaacgagctctctgggaacactgggctggagctatcaagcgtgtacagaggtggtcatgcccttctgcaccaatggtgtcgatgacatgttcgagccccactcttggaacctgaaggagttaagcgacgattgttttcagcaatggggcgtaagaccacgaccatcatggatcaccactatgtacggtgggaagaacatttcttctcacaccaatattgttttttcaaatggggaactggatccgtggagcggaggtggggtaaccaaagacataactgatacccttgttgccgtcaccattagtgaaggggcgcaccatctcgacctcagaaccaaaaacgcactagatcccatgagcgttctgttggctcgctctcttgaggtgcggcacatgaagaattggatccgagacttctatgactctgccggcaaacagcactag

SEQ ID NO: 200923 - DNA, 1554 bp, Artificial Sequence
  Description of Artificial Sequence: Synthetic coding sequence
atgggccggcgggccctgctgctgctgctgctgagcttcctggccccctgggcaacgattgcattgcgtcccgccttgagggcattaggttctctacatctgcctactaatcccaccagcctgccggctgttgccaaaaattattctgtgctgtactttcagcagaaagcactggctgcgggacagctgcatatttgtattattcagctgaaccactacaaaacaccactcgtcgatcatttcgggttcaatacagttaaaacgtttaaccaacgttatttggtggccgataagtactggaaaaaaaacggaggttctatcctgttttacactggaaacgagggagatatcatttggttttgtaacaacaccggctttatgtgggatgtcgccgaggaattgaaggctatgctagttttcgctgagcacaggtactatggagagtccttgccgttcggggataactcgttcaaagactcgcgtcacctcaattttctgacttccgagcaggctctggccgacttcgcagagctcattaaacatcttaagagaacaatcccaggagccgagaatcagccagtgattgccattggcggttcatatggcggaatgctcgctgcttggttcaggatgaagtacccccatatggtcgtcggagcactggcagcttctgcaccaatatggcaattcgaggatctggttccctgtggcgtgttcatgaaaattgtgaccaccgactttcgaaaaagtggaccacattgcagtgagtctattcaccgaagttgggatgcaatcaaccgactgtctaatactggctcaggactccagtggttgacgggggcacttcacctgtgcagccccctcaccagccaagatatacagcacctgaaagattggatctctgagacttgggtgaaccttgcaatggtcgactacccttatgcctcaaacttcctccagcctctccccgcttggcctattaaagtggtctgtcagtacctgaaaaacccgaacgtgtccgactctctgctgctgcagaacatatttcaggcactgaacgtttactacaactattcaggacaagttaaatgcctgaacatttctgagactgccacctcctccctgggaacactgggctggagctaccaagcctgtaccgaggtcgtcatgccgttctgtactaacggcgtcgacgacatgttcgagcctcattcttggaatctgaaagaactttccgacgactgctttcagcagtggggagtgcggcctcgaccgagttggatcaccaccatgtatggagggaagaatatctcaagtcacacaaacatcgtttttagcaatggggaactggacccatggtctggagggggcgttaccaaggacatcaccgatacattagtggcagtgacgatcagcgaaggagcccaccatctcgacctgcgcaccaagaacgctcttgatcctatgagcgtcttactagcacgatcactagaagtccgacacatgaaaaactggatccgcgacttttacgattcagccggtaaacagcattag

SEQ ID NO: 200924 - DNA, 1176 bp, Artificial Sequence
  Description of Artificial Sequence: Synthetic coding sequence
atgtgggacgtggccgaggagctgaaggccatgctggtgttcgccgagcataggtattacggagaatctctccccttcggcgataactccttcaaagactctcgccacctgaattttcttacctccgaacaggcgctggccgattttgctgagttgataaaacatttgaagcgaaccatcccaggcgccgagaatcaaccagtcatagctattggaggaagttatggaggtatgctggctgcctggttcaggatgaaatatccacatatggtcgttggcgccttggccgcatccgcccccatctggcagttcgaggacctagtgccttgtggcgtgtttatgaagattgtgacaacagatttccgcaaatcgggcccccactgtagcgagtccatccatagatcttgggacgcaatcaatcgactctctaacaccgggtctggcttacagtggctaacgggtgccctgcatctttgtagccccctgacttctcaagacatccagcaccttaaggattggatcagtgaaacttgggtcaacttagctatggtcgattacccatacgcgagtaacttcctccaacccctaccagcctggccgatcaaggtggtctgccagtatcttaagaatcccaacgttagtgattccttgctgcttcagaacatttttcaggctctgaatgtgtactacaactatagcggacaagtaaaatgtctcaatataagcgaaacggccacatctagccttggaacgctgggctggtcttatcaagcctgtacggaagtggtaatgccattctgcaccaacggcgtggacgacatgtttgagccacactcgtggaatcttaaggaactgagtgatgattgctttcagcagtggggcgttcggcctcgccctagttggatcacgactatgtacggcgggaaaaatatatcaagtcacacgaacatcgtattttcaaacggtgagctggacccttggtccggaggaggtgtcactaaagatataacagacaccctagtggcggtgaccatctccgaaggtgcacaccacctggatctgcggacaaagaacgctctggaccccatgagcgtactcctggcacgctccctggaagttcgccatatgaagaattggataagggatttctacgactcagccggcaaacagcattag

SEQ ID NO: 200925 - DNA, 1428 bp, Artificial Sequence
  Description of Artificial Sequence: Synthetic coding sequence
atggagggcctgctgacccggtgccgggccctgcccgccctggccacttgtagcagacaactgagtggatatgtgccatgcaggtttcatcactgtgctcctagacggggcagacgcttgctgctgagccgggtattccagccccagaacctcagggaagaccgagtgctgagcctgcaggacaagtctgacgacctgacctgcaagagtcagagattgatgctgcaggttggcctcatatatcccgctagccccggatgttatcatctgctgccctatacagtccgggctatggagaaactggtgcgcgtcatcgatcaggagatgcaagctatcggaggtcagaaggtgaatatgccctccttatcacccgccgagctgtggcaggcaacaaacaggtgggatctaatgggcaaggaactgctgagactccgagatagacatgggaaagagtactgtctggggccaacccacgaagaagccattaccgcactcatcgcttctcagaagaagctgagctataaacagttgcctttcctgttataccaggtgacgcgcaagtttagggacgaacctcgccccagatttgggctattgagaggtagagaattctacatgaaggatatgtacacattcgactcgtcacccgaggcggcccagcagacatactccttagtgtgcgacgcctattgttccctcttcaataaactgggactgccttttgttaaggtacaggccgatgtcggcaccattggcgggaccgttagccacgagtttcaactgcccgttgatattggggaggacagacttgctatatgtcctcgctgtagtttctctgccaatatggagacattagatctttcccagatgaattgtccagcgtgccaaggccctctgaccaaaacaaagggcatcgaagtaggccatacattttacctgggcacaaagtacagctcaattttcaatgctcagtttacgaatgtgtgtggaaaacctactcttgcagaaatgggctgctatggcctgggagtcacgaggatactcgcagccgccattgaagtactatccaccgaagactgtgtcaggtggccctcactgctggctccttaccaggcatgcctcatcccccccaagaaaggtagcaaagagcaggcagccagcgaattgatcggccaattatatgaccatattaccgaagcggtaccacagctgcacggggaggttctgctcgatgatcggactcacctgacaatcggaaataggctcaaagacgcgaataagtttgggtaccctttcgttataattgccggaaagagagcgttggaggatccagcacactttgaagtctggtgtcagaatacaggcgaagtggccttcttgactaaggatggggtaatggacttactgacaccagtacagacagtgtag

SEQ ID NO: 200926 - DNA, 498 bp, Artificial Sequence
  Description of Artificial Sequence: Synthetic coding sequence
atggccaagatgaacctgagcagctacatcctgatcctgaccttcagcctattcagccagggtattcttcttagcgcctcgaagtctatacggaacctggatgatgatatggtctttaatacctttcgactaggaaaggggtttcagaaggaagataccgcagagaaatctgtgatcgctcctagcctggagcagtataaaaacgacgagtcatcattcatgaatgaagaggaaaacaaggtgtccaagaacacaggctctaagcataattttctgaatcatggtctccccttgaacctggctattaagccttacctcgcccttaaaggttcggtggccttcccagccgaaaacggggtgcagaacacagaaagcacccaggagaagcgtgagatcggcgacgaggagaactccgcaaaattccctatcggtcggagggactttgacatgctgcgctgtatgcttggtagggtgtatagaccctgctggcaagtttag

SEQ ID NO: 200927 - DNA, 2598 bp, Artificial Sequence
  Description of Artificial Sequence: Synthetic coding sequence
atggccctggtgctgggcagcctgctgctgctgggcctgtgcggcaattcattttcgggcggtcagcccagtagcactgatgcccctaaggcttggaactacgaattaccagccactaattacgagacacaggatagccacaaggcagggccaataggaattctcttcgaacttgtgcacatatttctgtacgtggttcagcctagggatttcccagaggacaccctgagaaagttcctgcagaaggcctacgaaagcaagatcgactatgacaagcccgagacagtgattttggggctgaagattgtctactatgaagccggaatcattctgtgctgtgtgctggggttattatttatcatcctgatgccactcgtaggctacttcttttgcatgtgccgctgctgtaataagtgcggaggtgaaatgcatcagcgtcaaaaggaaaatggcccatttctgcggaaatgttttgcaatctcactgctggtgatatgtatcattatctcaatcgggatattctacggttttgtggcaaaccaccaagttcgcacgagaattaagagaagccgcaagctggccgattcgaattttaaagacttgagaaccctcctgaacgagacccccgaacaaattaaatacattctagcccagtacaacaccacaaaggataaggctttcacagatctcaatagcattaactctgtgcttggcggcggaattctggatagactgagacccaacatcatccccgtcctggacgaaatcaagtccatggcaactgctattaaggaaacgaaggaagcccttgagaacatgaattctactctcaaatcactccatcagcagagcacacaactctcctcgtctctgacctcagtgaagacgagtctgaggtcctctctgaatgaccccctgtgcctggttcacccatcttctgagacttgtaatagcattagactgagcctgagtcagctaaattccaaccctgagctgcggcaactaccacccgttgatgccgagctcgacaatgtcaacaacgtgttacggaccgatcttgacgggcttgtgcaacaagggtaccagtctcttaacgatattcccgaccgggtgcaaagacaaacaacaacagtagtcgcggggatcaagcgtgttctgaattccatcgggagtgacatcgataatgtgacccagcgactgcccatccaggacatactgagcgccttctcggtgtacgttaataacactgaatcgtacattcacaggaacctgcccaccctggaggaatacgatagctattggtggttgggagggctcgtcatttgttccctgcttactctgatcgtcatcttctactatttaggacttctgtgtggcgtgtgtgggtatgacagacatgcaacacccacaacccgtggatgtgtgagcaacacagggggagtttttctcatggtgggggtcgggcttagctttttgttctgctggatcctaatgatcatagtggttctaacatttgtctttggggcaaatgtcgaaaaacttatctgcgaaccctatacgagcaaggaactgttccgggtgctggatactccctatctgctcaacgaagactgggagtactacctctcgggaaagctgttcaataaaagcaaaatgaagctgacgttcgaacaagtgtattccgattgcaagaaaaatcgtgggacttacggaacactgcaccttcagaacagcttcaatataagcgagcatctgaatattaatgagcacactggctcgatctcatctgaactagaaagcctgaaggtgaatctgaatatattcctgcttggggccgccgggcgtaagaacctgcaggactttgccgcctgtggaatcgatcggatgaactacgattcttacctggcacaaaccggcaagtcaccagcaggcgtaaaccttctcagttttgcatatgatctcgaggccaaggccaactcccttccgccagggaacttgaggaacagtctcaagcgagacgctcaaacaatcaagactatacaccagcagagggtgctgccaatcgaacagagccttagcacgctgtaccaatctgtgaaaatattgcagcgcaccggcaatggcctgctggagcgcgttacacgcatcttggcgtcacttgatttcgcgcaaaattttattactaataacacgtcgagcgtaattatcgaggagaccaagaagtatgggaggacaattatcgggtatttcgagcattacctgcaatggattgaatttagtatttcagagaaggtcgcgagttgcaagccagtggcaacagcactggacacggcggtggatgtgtttctgtgttcctacatcatcgacccattgaacctcttctggtttgggattggtaaggccacagtgttcctcctcccagcacttatctttgcagtcaagctcgctaagtattacagaagaatggattctgaagacgtgtacgatgatgtcgagacaattcctatgaaaaatatggagaatggtaataacgggtaccataaagatcacgtctatggtattcataacccagttatgacttccccctcacagcattag

SEQ ID NO: 200928 - DNA, 2571 bp, Artificial Sequence
  Description of Artificial Sequence: Synthetic coding sequence
atggccctggtgctgggcagcctgctgctgctgggcctgtgcggcaatagtttctccggcggccagccctcaagtacggacgccccaaaggcatggaactacgaattgcccgccactaactacgagacccaagattctcacaaagcaggacctatcggtattctctttgagcttgtgcatatttttctatacgtggtccagcccagagacttccccgaagacacgcttcgtaaattcctgcagaaggcctatgaaagcaagatcgactacgataaaatagtgtattatgaggctggtatcattctgtgctgcgttttggggctgcttttcattatcctgatgcctctagtgggctacttcttctgtatgtgtcgctgctgtaataaatgtggcggggagatgcaccagcggcagaaggaaaatggcccattcctccgcaaatgcttcgccatctctctgctggtcatttgcatcattatttcgattggcattttctacgggttcgttgccaaccaccaggtgagaactcgaattaaaaggtcccgaaagctcgccgattccaacttcaaggacctccgcaccctgctgaacgagacaccagaacagatcaaatatattctggcccagtacaataccaccaaagacaaggcttttaccgacctgaactcaattaacagcgtcctgggcgggggtatattggatcgattacgtcctaacatcatacccgtgctggatgaaattaagtcaatggcaaccgcaatcaaagaaaccaaggaagcattggagaacatgaattccaccctgaaaagcctgcatcagcagagcacccaactgtcttcctcactaacttctgttaagaccagcctcagatcctctctaaacgaccctctatgcctggttcatccctctagcgagacctgcaactctatacgcctgagtttatctcaacttaacagcaaccccgaattgaggcagctcccccccgtcgatgcagagctcgacaatgtcaacaacgtcctaaggaccgatcttgatggactagtccagcagggctatcaatctcttaacgacatacccgatcgcgttcaacggcaaaccaccacagttgtggccggcatcaagcgcgtgctcaactccatcggcagcgatatagataacgtcactcagcgactgccaattcaagacatcctctctgcgttttcagtgtacgtcaacaacacggagtcctacattcacagaaacctgcccacactagaggagtatgatagctattggtggctaggcggccttgtaatctgttcattactaaccctcattgtaattttctattatctgggacttttgtgcggcgtttgtggatacgatcgtcatgcgacgccaaccacacgaggttgcgtctcaaacacgggcggtgtgtttctgatggtgggagtgggtttgtccttcctcttctgctggatcctcatgatcattgttgtgctgacctttgtgtttggagccaatgtcgagaagctgatctgcgaaccctacacaagcaaagagctttttagagttttggatacaccatacctgctgaatgaggattgggagtactatctcagcggcaaactcttcaataagagcaagatgaaactcaccttcgagcaagtatactcagattgtaagaaaaaccgcgggacatatggtactcttcacctgcagaacagttttaatatctccgagcacctgaatatcaatgagcacacaggctcaatcagttccgagctagagtcccttaaggtgaaccttaacatattcctcttgggtgcagcaggacggaaaaatctccaagacttcgctgcctgtggtatcgacagaatgaattatgatagttatttggctcagaccgggaaaagccccgccggggtgaacctcctttcatttgcctacgacctcgaggcaaaagctaatagtctgccgcctgggaacctccgcaactccctaaagagggatgctcagactataaaaactattcatcagcaacgggttctgcccatcgaacaaagcctgagtacactctaccagagcgttaagatcctgcagcggacgggtaacggtctgcttgaacgggtaaccagaatactcgcatcactggacttcgcccagaactttataaccaataacaccagctctgttattattgaagagaccaagaaatatggcaggaccataattggttacttcgaacactatctccagtggatcgaattttctataagtgagaaggtcgcctcgtgtaaaccagtagccaccgcactggacaccgcagtagatgtctttctctgcagttacatcattgaccccctgaatctgttctggtttgggattggcaaagcaacggtgtttctgctgcccgcacttatctttgccgtgaaacttgctaaatactacaggcggatggatagcgaagacgtctatgatgatgtggaaactatccctatgaaaaatatggaaaatgggaataacggctaccacaaagatcacgtgtacggaattcacaatcccgtgatgacctccccaagccagcactag

SEQ ID NO: 200929 - DNA, 2571 bp, Artificial Sequence
  Description of Artificial Sequence: Synthetic coding sequence
atggccctggtgctgggcagcctgctgctgctgggcctgtgcggcaattctttttccggcgggcagccatcttctaccgacgcccccaaagcctggaattacgagctgcccgcgactaattatgaaacacaagattcgcataaggctgggcctataggcatcttgttcgaattggtgcacatcttcctatacgttgttcaacctagggacttcccggaggataccttacggaagttcttacagaaggcctacgaaagcaaaattgactacgacaagattgtctattacgaggcaggcataatactctgctgtgttctgggactgctattcatcatcctgatgcccctggttgggtatttcttctgcatgtgtagatgttgtaacaaatgcggaggagagatgcatcagcgacaaaaggagaatggcccatttctgaggaagtgcttcgccatcagcctgcttgtcatttgcatcattatctctatcgggatattttacgggtttgtggcaaaccaccaggttcggactagaataaagagatctcgtaagctcgccgactcaaacttcaaagatctgaggaccctcttgaacgaaacacctgaacagatcaagtacatcctggcccagtacaacaccaccaaagacaaagcgtttaccgacctcaattcgattaattctgttttaggaggcggtatcctggatcgccttcggcctaatattattcctgtgcttgacgagatcaaatccatggcgacagccattaaggaaacaaaggaagctctggagaatatgaatagcaccttaaaatctcttcatcaacagagtacccagctgagttcttctctcacaagtgtaaagactagcctgcgcagctctctcaacgaccccttatgtctagtgcatccttcctcagaaacttgcaattccatcaggctcagtctttctcagctgaatagtaatcctgagcttaggcagctaccaccagttgatgctgagcttgataacgtgaataatgtcctgaggactgacctggacggattggtacagcaaggctaccaatcgcttaatgatatccccgatagagtacagcgacagaccaccacagtcgtagcagggattaagcgcgtgttgaattccattggttcagatatcgacaacgttacacaaagattgccaattcaggacatcctgtcggctttctcggtttatgtgaacaatacagagagctatatccaccggaacctcccgacgctggaagagtacgattcgtattggtggctcggcgggctggttatttgctccctactgacactgatcgtgattttctattacttggggctattgtgcggggtgtgtggctatgatcggcatgccactccgaccacccggggttgtgtgtctaatactggcggggtgtttctgatggtgggcgtcgggcttagctttctcttctgttggattctcatgattatcgtggtgctgaccttcgtttttggtgcgaatgtggaaaagctgatatgcgaaccctatacatctaaggagctgtttcgagtccttgatacaccctatctcttaaatgaggactgggaatactatctgagtggcaagctgttcaataaaagtaaaatgaagctgaccttcgagcaggtgtattcagattgtaaaaagaatagaggtacttacggcactctgcatctgcaaaatagctttaacatctctgaacacttaaacatcaacgagcacaccggttcaatcagcagcgagctggagagcctgaaagtaaatctgaatatctttctgttaggagccgctggccggaaaaatttacaggacttcgccgcctgcggaatcgataggatgaattacgattcttatctcgcccagacggggaaaagccccgcaggggtgaacctgctgtcattcgcctacgatctggaggccaaagcaaactccctgcctcctggaaatctaaggaacagccttaagagagacgcccagactataaagactatccatcagcagagggtcctcccgatagaacaaagcctttccaccctctaccaatccgtaaaaatcctccagaggaccggcaacggcctgttagaacgcgtcactcggatcctcgccagtcttgacttcgctcagaacttcattacgaataacacctcgagcgttatcatagaagaaacgaagaagtatggcaggaccattattgggtactttgagcactacctacagtggatcgaattttcaatctcagaaaaggtcgcatcatgtaaaccagttgcaacagccctggacaccgcagtagacgtgtttctgtgtagctacatcatcgatcccctgaacctgttttggttcggaattggaaaagctacagtcttcctgctgcccgccttgatatttgctgttaagctcgccaaatattacaggcgcatggattccgaagacgtgtatgacgacgtggaaaccatcccaatgaagaacatggaaaatggaaataatggataccacaaagaccacgtctatggcattcacaaccctgttatgaccagccccagtcagcattag

SEQ ID NO: 200930 - DNA, 177 bp, Artificial Sequence
  Description of Artificial Sequence: Synthetic coding sequence
atggccctggtgctgggcagcctgctgctgctgggcctgtgcggcaactcattctccggcgggcagccatcatccaccgacgcacctaaagcctggaattacgagctgccagcaactaattacgagactcaggattctcataaggctgggccaatcggcattctctttgagttatag

SEQ ID NO: 200931 - DNA, 123 bp, Artificial Sequence
  Description of Artificial Sequence: Synthetic coding sequence
atggccctggtgctgggcagcctgctgctgctgggcctgtgcggcaattcatttagtggcggacagcccagcagtactgacgcaccaaaagcatggaactacgaattgccagctacaaactag

SEQ ID NO: 200932 - DNA, 2598 bp, Artificial Sequence
  Description of Artificial Sequence: Synthetic coding sequence
atggccctggtgctgggcagcctgctgctgctgggcctgtgcggcaattccttcagtggtggacaaccttcatccaccgatgcgcctaaagcctggaattatgaactgcccgcgacaaactatgagactcaggatagccataaagccggaccaattggcattttattcgaacttgtacatatcttcctctatgtcgtccaaccgcgagattttccagaagatactcttcggaaatttctgcagaaagcatacgaatccaaaatcgactatgataagcctgaaacagtaatccttgggctgaagattgtatattatgaagcggggattattctctgctgcgttctcggactgctctttattattttgatgccgctcgtgggatatttcttctgcatgtgtcggtgctgtaataaatgcggaggggagatgcaccagagacagaaagaaaacggccccttcctaaggaagtgttttgctatctctctgttagtgatatgcattatcatcagcatcggcattttttacggatttgtcgctaaccaccaggtgagaacccgcattaaacggagcaggaaattggccgactccaacttcaaagatctgagaaccctgttgaacgaaacgcctgagcagattaagtatatcctagcgcagtacaataccacaaaagataaagcgttcactgatttgaactccatcaatagcgtgctcgggggtggaattctcgataggctgcgtcccaacattatcccagtgctggatgagataaagagcatggctaccgccattaaggaaacaaaggaagcccttgagaacatgaacagtaccttgaagtctctgcaccagcagtccactcaactgagctcaagtctcacttccgtgaagaccagcctgcgatcctcccttaacgatccactttgtctagtgcatccttcttctgaaacttgtaatagcattcggttgtctttgtcccagctcaattccaatccggaactaaggcagctgcccccggtcgatgcggaactggataacgtaaataacgtgctcagaaccgacctggatggactggtgcaacagggttatcagtcgctgaacgacattccggaccgggtgcagcgccagacaacaaccgtggtcgccggcataaagagggtgcttaacagcattgggagcgacatagataacgtgactcagcgcctgcctatccaggacattctatctgccttcagcgtgtacgtgaataataccgaatcctatatccacaggaatcttcctacactggaagaatacgatagctactggtggctcgggggcctggtaatttgcagtttacttaccctgattgtgattttttactacctcgggctactttgcggagtttgcgggtatgatcgccacgcgacaccgacaaccaggggttgcgtcagcaacaccggaggtgtcttccttatggtgggcgtgggcttgtccttcctgttttgctggattctaatgatcatcgtggttcttacctttgtttttggtgcaaacgtcgagaaactgatttgcgagccctatacgtcgaaggagctgttccgggtcctggatactccttacctgcttaacgaagattgggagtattacctgagcggaaaactgttcaacaagtctaaaatgaaactgacctttgagcaggtttacagcgattgtaagaaaaacagagggacttacggaaccttacatctacagaattcctttaacatatctgagcacctcaatattaatgaacatacgggctcaattagcagtgaactggagtccctcaaggttaacctcaacatatttttattgggcgccgccggccggaaaaacctgcaggacttcgctgcatgtgggattgaccgcatgaactatgattcataccttgcacaaacagggaagagccccgcaggggtgaacctgctctcgttcgcctacgatctagaagccaaggccaactccctcccgcctgggaatcttaggaacagtctcaagcgggatgcacagacaattaagaccattcaccaacaacgggtcctgccaatcgagcaatcactatccacactttatcagtcagttaaaatcctccaacgcacaggcaatgggctgctagaacgagttactaggatcctcgcttcccttgatttcgctcagaatttcatcacaaataacaccagttccgtgattatcgaggaaaccaagaagtacgggagaaccatcataggttatttcgaacattacctccagtggatcgagttttctatttccgagaaagtcgcatcttgcaagcccgtggcaaccgcactggacactgcggtggatgttttcctctgcagctacatcatagatccactcaatcttttctggtttggcatcggtaaggccaccgttttcctgctgcccgcactcatattcgcggtgaagctcgcaaaatactaccgacgtatggatagcgaggacgtgtacgatgacgtggaaactatcccaatgaaaaacatggagaacggtaacaacggctaccacaaggatcacgtgtacggcattcacaatccagtaatgacctctcctagccagcattag

SEQ ID NO: 200933 - DNA, 45 bp, Artificial Sequence; identical to SEQ ID NO: 94739
  Description of Artificial Sequence: Synthetic coding sequence

SEQ ID NO: 200934 - DNA, 2505 bp, Artificial Sequence
  Description of Artificial Sequence: Synthetic coding sequence
atggccctggtgctgggcagcctgctgctgctgggcctgtgcggcaattcattctcaggtgggcagcctagcagtacagatgcaccaaaagcgtggaactacgagcttccagccaccaactatgaaacccaggactcgcataaggccggcccaatcggtatcctgttcgagctcgtacacatcttcttgtacgtcgtccagcccagggactttcccgaggacacactgcgaaaattcctgcagaaggcttatgagtctaaaattgactatgacaagcctgagacagtcatcctgggcctcaagatagtctattacgaagccgggatcatactttgctgtgttctggggttgttattcataatattaatgccactcgtgggctacttcttctgcatgtgtagatgctgtaacaaatgtggcggagagatgcatcagcgtcaaaaagagaacggtcccttcctgcgtaagtgttttgcaatctccttactcgttatctgcatcattatttccattggcatcttctatggattcgtggctaatcatcaagtgcgcacgcggatcaagcgctccagaaaacttgctgactctaatttcaaggacttgagaacactcttaaacgagacccccgagcaaatcaagtacattttagcacagtacaacacaacgaaggataaagcttttaccgacctcaattccatcaacagtgtgctcggggggggtatcctagacaggctgcgacccaatatcatcccagtgctggacgagatcaaaagcatggccacagccatcaaggaaacaaaggaagccctggaaaacatgaactcaactttgaagagcctacaccagcagagtacacagctgtcctcgtccctgacgagcgttaagaccagcctcaggtcgtccctgaatgatccgctctgcttggtccatccctctagcgaaacgtgcaatagtattagactgagcctgagtcaactgaattccaacccagaacttagacagcttccccctgtggacgctgaacttgacaacgtcaacaacgtgttgcgcacagatttagacgggttagtgcagcagggttaccagagcctaaacgacatcccagacagggtgcagcgccaaacaacaactgtggtggccggcatcaagagggtgctcaactctattggaagcgacatagataacgtcacgcagcgcctgccaatccaggacatactctcagcattcagtgtgtatgtgaacaatacggagagctatattcatcggaatctgcccacactggaggagtatgattcttattggtggctgggcggacttgtcatttgtagccttctcactctgatcgtgatcttctattatctgggcctgctctgtggagtctgtggttacgacaggcacgccacaccaactaccaggggttgcgtatccaataccggcggcgtgtttctcatggtcggagtgggcctgtcctttctcttctgttggatattgatgatcatcgtcgtgctcactttcgttttcggcgccaacgtagagaaattgatctgcgagccctacacaagtaaagaactgtttcgggtgttggacacaccctatctccttaatgaggactgggagtactatctgagcggtaagctctttaacaagagcaagatgaagctaacatttgagcaggtgtacagcgattgtaaaaaaaatcgcggaacctacggtactctgcatcttcagaatagctttaacatatctgaacacctgaatatcaacgagcacaccgggagtatcagcagcgagctggaatccctgaaagtcaaccttaacatttttcttctgggcgccgctggaagaaagaaccttcaggattttgctgcttgcggtattgatcgcatgaactacgactcctatctggcccagaccggcaagagtcccgctggagtgaacctgttgtctttcgcatacgatttagaagccaaagcaaatagtctccctccggggaatttacggaactctctaaaacgcgacgcccagacaattaaaacaatccaccagcaaagagtactccccatcgaacagtccctttcaacattataccagtcggtgaagatcctgcagcgtactggcaatggtctgctggagagagtgacaagaattttagcgtctctggactttgcccagaactttataactaacaacactagctccgtgatcatagaggagaccaagaaatacgggcggaccattattggatatttcgagcattatctccagtggatcgaatttagcatttctgagaaagtcgcaagctgcaagcccgtggccacggccttggacaccgccgttgatgtgttcctctgttcatacatcattgaccctctcaacctgttctggtttggaattgggaaagccacggtcttcctcctgcctgcactcatcttcgccgtaaagttggccaaatattaccgtaggatggactccgaagatgtgtacgacgacccaagccaacactag

SEQ ID NO: 200935 - DNA, 2529 bp, Artificial Sequence
  Description of Artificial Sequence: Synthetic coding sequence
atggccctggtgctgggcagcctgctgctgctgggcctgtgcggcaactcattctccggtggccaacctagtagcacagatgcgcctaaggcatggaactacgaattacccgccacaaattatgagacccaggacagtcataaagctgggccaataggcattctcttcgagttggtccacatctttctttacgtggtccaacctcgcgacttccccgaagatactttgcgaaaattcctgcagaaagcatatgaatcaaaaatagattacgataagcccgagaccgtaattttgggcctgaagattgtctactacgaagcaggaatcatcctgtgctgcgtattaggcctcttattcattatcctgatgccactggtgggatatttcttctgtatgtgccggtgctgtaataagtgtggaggagaaatgcaccaacgacaaaaggagaacggaccattcttaaggaaatgctttgctatcagcttactggtaatttgtattattatcagtatcggcatcttctatgggttcgtcgccaaccatcaggtgcgcacacggattaagaggtctcgcaagcttgcagattctaacttcaaagatctgcgaaccctgctgaacgaaaccccagagcagatcaagtatattctggctcagtataatacaacaaaggacaaggcattcacagatctaaattccatcaacagtgttcttggcggcggcattctcgataggctgagacccaacataatcccggtgttagacgagatcaaatctatggcgaccgctataaaagagaccaaagaagctttagaaaatatgaacagcactctgaaatcactgcaccagcagagtacgcagctgagtagcagcttgacctctgtgaagacctccttacggtctagcttgaatgaccctctctgcctggtgcacccgagctctgaaacttgtaactctataaggctgtcactctcacagctaaactcgaaccctgaactgaggcagctgccacccgttgatgccgagctggataatgtgaataatgtcctgagaactgatctcgacggactggtgcagcaagggtatcagtccctgaacgatatccccgaccgggttcaaagacagacaacaaccgtggttgcggggattaaaagggtgctcaatagcatcggcagtgatatcgataacgtgacccagagattgccaatccaagacatactgtcagctttttctgtgtatgttaataacacggagtcttacattcatcgcaatttgccaacgctcgaggagtacgacagctattggtggttaggaggcctggtcatatgtagcctcctgaccctgattgtaattttctattacctcggcttgctgtgcggagtctgtggctatgatcggcatgccactcccaccaccagggggtgtgtgtcaaataccggaggagtttttctaatggtcggcgtcggtctgagttttctcttctgttggatactgatgattatcgtggtcctcaccttcgtgttcggcgctaatgtagaaaagctgatctgtgagccctacacttccaaggagcttttccgcgtcctggacaccccgtacctcctaaacgaggactgggaatactatctctcggggaaattgtttaataaatcgaagatgaagcttactttcgaacaggtgtatagcgattgcaaaaagaatcgtggaacatatggcacacttcacttgcagaatagctttaacatctccgaacatctgaacattaacgagcacaccgggtccataagcagcgagctcgagtcgctcaaggtgaatcttaacatatttttgctgggagccgccggcaggaagaatctgcaagactttgcagcttgcggcatagatcggatgaattacgactcatacctcgcccagacgggtaagtccccggccggtgtcaatctgctttcctttgcatacgacctggaggccaaagccaatagcctaccccccggaaatctccggaacagcctgaagcgtgatgcccaaacaatcaagacgattcatcagcagagggtcctcccgatcgagcagagcctgagtaccctgtaccaatctgtcaagattcttcagagaactggcaatggcctcttggaacgggtcactagaatactcgccagcctcgactttgcccagaacttcatcacaaataacacaagcagtgtgataatagaggagacgaaaaagtacggcagaacgatcatcggctacttcgagcactacctgcagtggattgaattcagcatctctgaaaaggttgcatcttgcaaacccgtggcaactgccttggatacagcggtcgacgtctttctttgctcctacataattgatcctctgaacctgttttggtttggtatagggaaggccaccgtcttccttctgcccgccctgatttttgctgtcaaacttgctaagtactatcggcggatggactccgaagatgtgtatgatgatgtcgaaactatcccaatgaagaatccctcacaacactag

SEQ ID NO: 200936 - DNA, 2493 bp, Artificial Sequence
  Description of Artificial Sequence: Synthetic coding sequence
atggccctggtgctgggcagcctgctgctgctgggcctgtgcggcaattcgttttccggcgggcagccatcgagcaccgatgccccgaaagcttggaactatgagttgcctgccaccaactacgagacgcaagactctcataaagctggtcccatcgggatcctctttgagctggtacacatctttctgtatgtggtccagccccgggactttcccgaagacaccctgaggaagtttctacagaaggcctatgagagcaaaatcgactacgataaaattgtctactacgaggccggcattattctgtgctgtgtgctcggactcctcttcattattctgatgccattggtgggatattttttttgtatgtgcaggtgctgcaataagtgcgggggagagatgcatcagcgacagaaagaaaacggtccttttctccgcaagtgtttcgctatcagcttgctggtgatctgcatcattatttcaatcggtattttctatggattcgtggcgaaccatcaggtgaggactcgaattaaacgcagccgcaaactcgccgattcaaactttaaggacctgagaacactgctgaacgagacccctgaacagatcaaatacatactggcacagtacaacaccaccaaggacaaagcatttactgatttgaactctattaacagcgtcctggggggcggcattctggatagattacgaccaaacataattccagtgctggacgaaatcaaaagcatggcaaccgccataaaagagaccaaagaagcccttgagaacatgaacagcaccctgaagagcctgcatcaacagtccacgcagctctccagcagtttaacatctgtaaagaccagccttaggtcatccttgaatgacccactttgcctcgtgcatccctcgtctgagacctgcaattctattaggctgtccctcagccagctcaactcgaatcccgagttgcgacagctgcctcccgtagatgccgagttggacaacgtgaacaacgtcctgcggacagatttggacggcctcgtccagcagggctaccagagccttaatgatatccccgatcgggtgcagcgtcagacgactacagtcgtggccggtataaagagagtcctgaatagcatcggttcagatattgacaatgtcacacagagactcccaatccaagatattctgagcgccttcagtgtctatgtcaacaatactgaaagctatatccaccgtaacttgccaactctggaggagtacgatagctattggtggctggggggattggtgatttgcagcctcctcaccctgatagtaattttctattacctgggattgctgtgcggagtttgcgggtatgacagacacgccacgccaaccacaagaggatgtgtgtcaaataccggcggagtatttctgatggtgggcgttggcctgagcttcttgttctgctggattctcatgattatcgtggtgctgacctttgtgttcggagcaaatgtggaaaagcttatctgcgaaccatatacgtccaaagaactgttcagagtcctcgataccccctatcttctcaacgaggactgggaatattatttaagcgggaagctgtttaataagtcgaagatgaaactcacttttgaacaagtgtattcagattgcaaaaaaaataggggcacgtacggaactcttcacctgcagaattcattcaacataagtgaacatctcaatattaacgaacataccggctcgatttcttcagaactcgaaagtctaaaggtgaacttaaatatttttctgctcggtgcagctgggagaaagaatctccaggactttgctgcctgtggcatagataggatgaactatgacagctatctcgcgcagaccgggaaaagtccagcgggagttaatctactgtcattcgcgtatgacctggaggcaaaagccaattccttgccaccggggaatttgcgtaatagcctcaaacgggacgctcagaccattaagaccattcatcagcaaagagttctgcctatcgaacagtccctgtctacgctgtaccagagtgttaagatcttacagaggaccggtaacggcctgttggaaagagttacacgaatacttgcaagtttagacttcgcgcagaatttcatcaccaataatacaagttcagtcatcatagaagagactaaaaagtacggcagaaccattatcggatacttcgaacactatctccagtggatagaattcagcatttctgagaaggtagctagttgcaaacccgtggcaaccgcattagatacagctgtggacgtgttcctctgtagttacatcatagatcctctgaacctgttttggtttgggattggcaaggcgacagtgtttctcctaccggctctgatatttgccgtgaagctcgcaaagtactacagacgcatggactccgaagacgtgtacgatgacagctcttgggtaacctcagttcaatgctag

SEQ ID NO: 200937 - DNA, 681 bp, Artificial Sequence
  Description of Artificial Sequence: Synthetic coding sequence
atggaggccgagcggcggcggcaggccgagaagcccaagaagggcagggtgggttccaatctgcttcccgaaagacatccggccaccggaacacctactactaccgttgactctagcgcgcccccctgcagaaggcttcctggagcaggaggcgggcggtctagattcagtccacagggtggccagcgggggaggccgcacagccgcaggcgacatcggacaaccttctctcctgtgcaactcgaacagctggaatcagctttcggccgtaaccagtacccggatatctgggcacgcgagtcattggcacgcgacactgggctgtctgaggctcgcatccaggtctggttccagaacagaagagccaagcagcggaagcaggagcggtcccttcttcagccattggctcatctgtctcccgccgcctttagctcattcctgcctgagagtaccgcttgcccgtacagctacgctgcccctccaccccccgtgacctgtttcccccacccatacagccatgccctcccgtcacagccatcgaccggaggcgcgtttgcattatcccatcaatccgaagattggtacccaacactgcaccctgctcctgccggccatcttccctgccctcccccgcctcccatgctccctttgagcctggagccttctaaatcatggaattag

SEQ ID NO: 200938 - DNA, 417 bp, Artificial Sequence
  Description of Artificial Sequence: Synthetic coding sequence
aacatcagcctgtgccccgagatctgcttccagaagatcgagagccaggtctactttgtcagggtggatagtgggatccagcctggctctgacatcagtatttactatgacccaatgatctcgaaactgatcacttatggcagtgacaggacggaggcgctcaaacggatggcggatgctctcgataactacgtgattcggggtgtgacccacaacattgcccttctgagagaagtgatcattaacagtcggttcgtcaagggcgatatctcaactaagttcctatccgacgtgtatcccgacggctttaaggggcatatgctgaccaagagcgaaaagaatcagttactggccatcgccagctcactctttgtcgccttccagctacgggctcagcatttccaagagaattcttag

SEQ ID NO: 200939 - DNA, 363 bp, Artificial Sequence
  Description of Artificial Sequence: Synthetic coding sequence
atgagcatccagttcctgggcaccgtgtacaaggtgaacatcctgacgaggctcgcagctgagctgaataagttcatgctagaaaaggttactgaggacacctccagcgtcctgcggtccccgatgcctggagttgttgtggcggtctccgtgaaaccgggtgacgctgctacctcgagcctgagtgtcgagatatgcttgttttggacctttcaagtggctgagggacaggaaatttgtgtgatcgaggcaatgaaaatgcagaactccatgactgccggtaagaccgggactgtgaagtccgtgcactgccaggccggcgatactgtaggggaaggagaccttctggtggaattggagtag

SEQ ID NO: 200940 - DNA, 2046 bp, Artificial Sequence
  Description of Artificial Sequence: Synthetic coding sequence
atggccggcttctgggtgggcaccgcccccctggtggccgccggccgcagaggccgatggccccctcagcagctcatgctctcagccgctcttcggaccctaaaacacgtcctctactattccagacagtgtctgatggtctcgaggaacctgggttcagtgggctacgaccctaatgagaagaccttcgacaagatcctggtggctaaccgtggagagatcgcatgccgtgtgatccgcacctgtaagaaaatgggcataaaaaccgtggccatacattcagatgtggacgcatcctctgtgcacgtgaagatggcagatgaggcggtgtgcgtcggcccagcacccacgtctaagagctacctgaatatggatgccatcatggaggctattaagaagacaagggcccaagcagtgcacccaggatacggcttcctgtcagagaataaagagtttgcgaggtgccttgctgctgaggatgtagtgtttattggacctgatacacacgccattcaggctatgggtgacaaaatcgaaagcaagttgctggccaagaaggctgaggttaacaccataccgggcttcgatggcgtagtgaaggatgcggaggaggctgttcgtattgctagggaaatcgggtacccggtgatgattaaagcctctgccgggggcggtggtaaagggatgagaatcgcctgggatgacgaggagacgagagacgggttccgactgagctctcaggaggctgcctcatcattcggcgacgacaggctgttaattgagaaattcatagacaacccccgccacatcgaaatccaagtgctgggtgataagcatgggaacgccctgtggctgaatgaacgtgagtgctccatccaacggaggaatcagaaagtggtcgaggaggctccaagcatcttcctcgatgctgaaacaagaagagctatgggggaacaggccgtggcacttgcccgcgccgtgaagtacagttccgccggaacagtagaattcctggtagattctaagaaaaacttctatttcctggagatgaatacccgattgcaggtcgagcatcctgtgactgaatgtattacgggtctcgatcttgttcaagagatgattagggtagccaaaggatatcctctccggcataaacaggccgatatacggatcaatggctgggccgtcgaatgccgggtttacgccgaggatccttacaagtccttcgggctgccctccattggacgcctgagtcagtatcaggaaccactgcacctgcccggggtgagagttgacagcgggattcagcccgggtctgatattagcatttattacgacccaatgattagcaagctgatcacctatggcagtgaccggacggaggcactcaaaaggatggcagacgccttggacaactatgtgatccggggggttacgcataacattgccttgctaagggaggtaattatcaactcccgatttgtgaaaggcgacatcagcacaaaatttctgagcgatgtgtacccggatggatttaaaggacacatgctcaccaaaagtgagaagaaccagctgcttgccattgcatcatctttgtttgtggcctttcagttgcgggctcagcattttcaggagaattcccgcatgccagtgattaaacccgatatcgcgaattgggagcttagcgtcaagctccacgataaagtccatacagttgtggcgtcgaacaacggttctgtgtttagcgtggaagttgatgggtcaaaactcaatgtaacctctacctggaatctggcttcccccctgcttagtgtaagtgtggatggaactcaaagaaccgtccagtgtctttctcgtgaggcaggaggcaatatgtctattcagttcttgggtactgtcgtagcagagggccaggagatttgtgtgatagaagcaatgaagatgcagaatagcatgacagccgggaaaactggaactgttaagagcgttcactgccaagctggggatactgtcggcgaaggggatctgctcgtcgagttggaatag

SEQ ID NO: 200941 - DNA, 2187 bp, Artificial Sequence
  Description of Artificial Sequence: Synthetic coding sequence
atggccggcttctgggtgggcaccgcccccctggtggccgccggccggcgtggccggtggccaccacagcagcttatgctgtccgcagcactgagaactttaaagcacgtgctgtattacagtcgccaatgcctcatggtgtcacgcaacctggggtccgttggctatgatcctaacgagaagacatttgacaagatcctggtggcaaatcgtggagagatcgcatgccgggtgattcgtacatgcaagaaaatgggcattaaaaccgtggcaatccactctgacgttgatgctagcagcgtgcacgtgaagatggctgatgaagccgtttgtgtgggccctgcccccactagcaagagctatctcaacatggacgctatcatggaggcgattaaaaagactagggcccaggccgtgcaccccggttacggattcctgtcagagaacaaggagtttgcccgatgtctggcggccgaagacgtcgtgttcatcggaccggacactcatgccattcaagctatgggtgacaagatcgagagtaaacttctggcaaagaaagccgaagtcaatactatccccggcttcgatggcgtggtaaaagacgctgaagaggcagtgcggatcgctagagagatcggctatccggtgatgattaaagcatctgccggtggcgggggtaaggggatgcgaattgcctgggacgatgaggaaacccgagacggttttcggctcagtagtcaagaggctgcatcatccttcggggacgacaggctgctaatagagaagtttattgataacccacgtcacatagaaatccaggttctcggcgataagcatggcaatgccctgtggctgaatgagagagaatgtagcatacagaggcggaaccagaaggtggtcgaagaagcgccctctatcttcctggacgccgaaacacgccgcgccatgggcgaacaagctgtggccctggcgcgtgctgtaaaatacagctccgcggggacagtggaatttctagtagacagcaaaaagaacttttatttcctggaaatgaataccagactgcaggtggaacaccccgtaacagagtgcataaccggcttggacctggtgcaggaaatgatccgcgtggcaaagggttatcccctgcgccacaaacaagccgatattaggataaacggctgggcagtcgagtgccgagtttacgccgaagacccctacaagagctttgggcttccttcaattggccggttgtcacagtaccaagagcccttacacctgcctggcgttcgcgtggatagtggaattcaacccggttccgacatcagcatctattacgacccaatgatctctaaactgataacgtacggatcggataggactgaggcactgaagcggatggccgatgccttggataattatgttatacgcggagtgacacataatattgccctgctcagagaagtgattatcaacagcagattcgtgaaaggcgatatctccaccaagtttttatccgacgtgtaccccgacggttttaagggccatatgcttacaaaatctgagaagaatcaattactcgccattgcatccagtctctttgtagctttccagttgcgtgctcagcacttccaggaaaactcccgaatgcccgtgatcaaaccagacatcgctaattgggagctctccgtcaagctgcacgacaaggtgcataccgtggtcgccagcaataacggaagcgtcttttccgttgaagttgatgggagtaagttgaacgtgacgagtacgtggaatcttgctagtccattgctctccgtatccgtggatggcacccagaggacagtgcagtgcctttccagagaagcggggggtaatatgagcatccaatttctgggcaccgtgtacaaagtgaatattctaaccaggctcgccgccgagctcaataaattcatgctggaaaaggtaacagaggatacatctagcgtgctcaggtcacccatgcctggagttgtggtggcagtctccgtaaagccgggcgacgcggtagccgaaggacaggagatatgcgttatagaggctatgaaaatgcagaactccatgaccgctggcaaaaccggcacggttaagtctgtgcattgtcaagccggagacacagtgggagaaggagatctgcttgtggaactagagtag

SEQ ID NO: 200942 - DNA, 2109 bp, Artificial Sequence
  Description of Artificial Sequence: Synthetic coding sequence
atggccggcttctgggtgggcaccgcccccctggtggccgccggccggcggggccgctggcctcctcagcagttgatgctgagcgctgcgctgcgaaccctgaaaacctttgataagattttggtggcaaacagaggggagatcgcctgcagagtgattcggacttgcaaaaagatgggcataaaaaccgttgctattcatagcgacgttgatgcttcttcagtgcacgtcaaaatggctgatgaagccgtttgcgtcgggccagcacccacctctaagagctacttgaacatggacgccattatggaggcaatcaagaaaactagggcccaagctgtgcacccagggtatgggtttctgtccgaaaacaaggaattcgctaggtgcctcgctgcagaggatgtggtcttcattggaccagacacgcacgctatccaggccatgggggataagatcgagtctaagctgctggcaaaaaaagctgaggtgaataccatccccggattcgacggcgtcgttaaagacgccgaggaggccgtacgcatcgctagggagatcggctacccagtgatgatcaaggcttctgcaggcggaggtggaaagggcatgcgcatcgcatgggatgatgaagagacccgtgatggattccgtctctcatctcaggaggccgcatcatcattcggggacgaccgtctgctgatcgaaaagtttattgataacccccggcatattgagatccaggtactcggggacaagcacggtaatgccttgtggttaaatgagcgtgagtgttcgatccagcgacgcaatcaaaaggtggtagaggaagccccttctatattcctagatgccgaaactcggcgtgccatgggggagcaggcggtcgctctagccagagccgtgaaatactcttccgccggcactgttgaattcctcgtggactcaaaaaaaaacttctattttctcgaaatgaataccaggctgcaggtagagcaccctgtgacggagtgtattaccggccttgacctagtgcaggaaatgatcagagtagcaaaaggataccctctccgccacaagcaggcagacatcaggataaatggctgggccgtcgagtgtcgcgtgtacgcggaggatccgtataagtcctttggcttgccttcaataggacgcctaagccagtatcaggaacctctgcatctaccaggtgtgcgagtcgattctggcattcaaccaggaagtgacattagcatctactacgaccctatgattagtaagcttattacgtatgggagtgatcgcacagaggcgttgaagcgtatggctgatgccctagacaactacgttatccggggtgtgacccacaatatcgccctactcagagaagttataattaacagtcgcttcgtgaaaggggatatctctacaaaattcctgagcgacgtgtatccagatggctttaaaggacacatgctcaccaagtcggaaaaaaaccaattgctggccatagccagtagcctctttgtagcattccagcttagagcccagcactttcaagaaaatagtcggatgccggtcattaagcccgatatcgctaattgggaacttagcgtgaaactgcacgacaaggtgcacactgtagtcgcgagtaataatgggagtgttttcagcgtagaggtggacgggtctaaattgaatgtcacatcaacctggaatctcgcatcccctctgttatcagtgagcgtggacggtacccagcgtacggttcagtgtctgtcccgggaggccggcggcaacatgtccatacagtttctcggtactgtgtataaggtgaatattctgacaagactggccgcagagctcaacaaatttatgctagagaaagtcaccgaggatacctcttctgttctgcggagtcccatgccaggtgtagtggtggcggtgtctgtgaagcccggggacgcggttgcggagggccaggagatttgcgtgatcgaagccatgaaaatgcagaatagtatgacagccggcaagaccgggacagtcaagtccgttcactgccaagccggagacaccgtgggagaaggtgacctattggtggaattggaatag

SEQ ID NO: 200943 - DNA, 255 bp, Artificial Sequence
  Description of Artificial Sequence: Synthetic coding sequence
tgaaactgggagctgagcgtgaagctgcacgacaaggtgcacaccgttgttgcttccaataatggatcagttttctctgttgaggtcgatggctctaagttaaacgtaaccagcacatggaacctcgccagccccctgctgtccgtaagcgtggatggcacccagagaaccgtccagtgtctcagccgtgaggcaggtggtaacatgagtatccagtttctgggtacagtgccctggagaaaattgctggactag

SEQ ID NO: 200944 - DNA, 336 bp, Artificial Sequence
  Description of Artificial Sequence: Synthetic coding sequence
tacaaggtgaacatcctgacccggctggccgccgagctgaacaagttcatgctcgaaaaggtgaccgaggacacctcttcagttctgcgatctcccatgcctggagtggtggttgctgtgtccgtgaagcctggagatgcagctacttcatccctcagcgtagagatctgcctgttctggacattccaggtggccgagggtcaagagatatgcgtgatcgaagccatgaagatgcaaaattccatgacagcgggaaaaactggtaccgtgaagtcagtgcattgtcaagctggagacacggttggggaaggagatctgttggtggaactcgaatag

SEQ ID NO: 200945 - DNA, 405 bp, Artificial Sequence
  Description of Artificial Sequence: Synthetic coding sequence
tgaatgcccgtgatcaagcccgacatcgccaactgggagctgagcgtgaagctccacgacaaagttcataccgttgttgcttcaaacaatggctcagtgttctccgtcgaagtggacggcagcaagttaaacgttacctcaacctggaacctggccagcccactgttgtccgtgtcggttgacggcacccagcgtacagtgcaatgccttagcagggaagcagggggaaacatgtctatacaattcctaggtacagtggttgccgagggccaagaaatttgtgtgattgaagcaatgaagatgcagaactccatgaccgccgggaaaacaggaaccgtgaagagcgtgcactgccaggctggcgacacagtgggcgagggcgatctgctcgtcgaactggagtag

SEQ ID NO: 200946 - DNA, 309 bp, Artificial Sequence
  Description of Artificial Sequence: Synthetic coding sequence
agcgacgtgtaccccgacggcttcaagggccacatgctgaccaagtccgagaagaatcagctgttggccattgcaagctcgttgttcgttgcattccagctcagggcccaacacttccaagagaattctcggatgcctgtgataaagccggatattgccaattgggagctctccgtaaaactgcacgataaagtccatactgtggttgcaagcaataatggaagcgtctttagcgtcgaggttgatggttcaaagcttaatgtcacctccacatggaatctcttcgctctgatcgtatgccaacggtag

SEQ ID NO: 200947 - DNA, 1620 bp, Artificial Sequence
  Description of Artificial Sequence: Synthetic coding sequence
atggccgccgccctgcgggtggccgccgtgggcgcccggctgagcgtcctggcatcaggactgcgcgccgccgtacgttctctctgttcccaggccacttcagttaatgagagaatcgaaaataagagacggactgcgcttctaggaggcggacagaggaggattgatgcccagcacaagcggggaaaactgaccgcccgggagcggatctctctactgttggaccccgggtccttcgtggagtccgacatgtttgttgagcacagatgcgcagacttcgggatggctgccgacaagaacaaatttcccggcgattctgtagtgacaggcagaggtaggattaacggccggctggtgtacgtgttcagtcaggatttcactgtctttggcgggagcctcagcggagcacacgcccagaaaatatgcaagattatggaccaggccattaccgtcggcgcacctgtgattggactgaatgatagcggtggagcccggattcaagaaggggtagagtctcttgcgggctatgctgacatcttcctccggaatgtgaccgcctctggggtcattccacagatctctctgatcatgggaccgtgtgcaggaggagctgtttactccccggcattgaccgatttcacgtttatggtgaaggatacatcatacctgtttatcaccgggcctgatgtggtcaagagcgtaaccaacgaggacgtcactcaggaagagctcgggggtgccaagacgcacacaacgatgtccggagtcgcacaccgggcgtttgagaatgacgtcgacgcattgtgcaacctccgggatttttttaactatctgcccctttctagccaggaccccgctcccgtgagagagtgccatgaccctagcgatcgcctggtgccggagctcgataccatcgtccccctggagtctactaaggcatataatatggtggatattattcactcagtcgttgacgaacgggagttttttgaaattatgcctaactatgctaagaacatcatcgtcggattcgctaggatgaatggacggaccgtggggatagtcgggaaccagcctaaggtggcgagcgggtgtctcgatataaattctagcgtgaaaggggctagattcgtgcgattctgtgacgcctttaacatccccttaatcacatttgtggacgtgcccggcttcctgcctggcactgctcaggaatatgggggaatcatccggcacggggctaagcttctttacgcatttgctgaggcaacagtgcctaaggttaccgttatcaccagaaaagcctatggaggagcctacgacgtcatgtcttctaagcacttgtgcggcgatactaactacgcttggccaactgcagagatcgccgtgatgggagccaagggcgccgtagagatcatttttaagggacatgagaacgtggaggcagcccaggcagagtacatcgagaaattcgccaatccctttcccgcagctgtgcggggcttcgtcgatgatattatccagcctagctcaactcgggctcgcatctgttgcgacctggacgtcctcgcatccaaaaaagttcagcgtccctggagaaaacatgccaacattccactctag

SEQ ID NO: 200948 - DNA, 1680 bp, Artificial Sequence
  Description of Artificial Sequence: Synthetic coding sequence
atggccgccgccctgcgggtggccgccgtgggcgcccggctgagcgtgctcgccagcggactccgcgcagctgtgagatctctgtgttctcaagcaacttctgtgaacgagcgtatagaaaacaagcgcaggactgccctcttgggaggtggtcagcggaggattgacgcccagcacaagcggggtaaacttacagccagggagaggatctcattactactggaccctgggagctttgtagaaagtgacatgtttgttgaacataggtgcgccgatttcggtatggccgctgacaagaataagttccccggggactctgttgtcacaggtaggggcagaataaatggccgcttagtatatgtgtttagccaacagatcatcggttgggcccagtggctgcctctcgtgatctctgccttatgggaagctgaagacttcactgtttttggtgggtctctgagcggcgcccacgcccagaaaatatgcaaaatcatggaccaggctatcacagtcggtgcccccgtcattgggctgaacgattctggcggggcccgcatccaggagggagtggagtcgctcgcaggttatgccgacatttttctacgcaacgtcacagcgagtggggtgatccctcagatttctcttattatgggcccctgcgcagggggcgctgtgtattcacctgctcttaccgactttacatttatggtcaaagatacgtcttacctgttcataactggcccagatgtggtaaagagtgtcaccaatgaagacgtgacacaagaagaactcggcggcgctaagactcatacgacaatgagtggagtcgcacaccgcgcattcgaaaacgatgtcgatgccctctgcaacctccgggactttttcaactacctccctttgagttcccaggacccagcccccgtgcgggaatgccatgatccctctgacaggcttgtgcctgagttggacactattgtaccactggaatccacgaaggcatacaacatggtggatatcattcacagtgtggtggacgaacgagagttcttcgagattatgccgaactacgctaagaacattatcgtcggctttgcgaggatgaacggtagaaccgtgggaatagtgggaaaccaacccaaggtcgcttccgggtgtctggacattaattcttccgtgaaaggtgcaagatttgtaaggttttgcgatgcattcaatataccgctaattactttcgttgacgtccctggatttctgcctgggactgctcaggagtacggcggtattatccggcatggcgctaaactgctatatgcattcgcagaggcaacggtgcccaaggtgactgtgatcactaggaaggcttacggcggcgcctatgatgttatgtcatcgaagcacctttgcggggatacgaactatgcatggccaacagccgaaatcgctgttatgggggccaaaggagcagtggagattattttcaaggggcatgagaacgttgaagccgcacaagccgagtatatagagaaatttgcaaatccattccccgctgccgttaggggcttcgtggacgatataatccagcccagctcaacccgggccaggatttgttgcgatctggacgtgctcgcttctaaaaaagtccaaagaccctggaggaagcacgctaatatacccctctag

SEQ ID NO: 200949 - DNA, 1653 bp, Artificial Sequence
  Description of Artificial Sequence: Synthetic coding sequence
atggccgccgccctgcgggtggccgccgtgggcgcccggctgagcgtgcttgccagcggattaagagccgcggtcaggagtctctgttctcaagccacgagcgtcaacgagaggatcgaaaacaagagacggacagcccttctgggcggcggccaaaggaggattgacgcacagcacaaacgcgggaaattaacggctcgggagcggatctctctcctgctcgacccaggatccttcgttgagagcgacatgtttgtagaacacaggtgcgcggatttcgggatggcagccgataaaaacaagtttccaggagactctgttgttacgggacggggcagaatcaacgggcggctcgtttatgtgttttctcaggatttcacagttttcggtgggtctctctcaggagcccacgcccagaagatctgtaaaatcatggatcaggccatcacagtgggggcccctgtaatcggcttaaacgactcaggtggtgctaggatccaagaaggggtcgaatctttggcaggctacgctgacattttcttacgaaatgtgacagcctcgggcgtcattcctcagatttccctgattatgggcccctgtgcaggtggcgccgtgtacagtcctgctctcaccgacttcacttttatggtgaaagacacttcctacctgttcatcacaggcccagacgtagttaagtcagtcactaacgaggacgtgacacaggaagagctgggcggtgccaagacccatacaaccatgagcggagtagcacatcgcgcttttgaaaatgatgttgatgcattatgtaatctgcgggattttttcaactacttaccactgtccagccaggacccagcacccgtgagagagtgccacgacccctccgacagactggtacctgagctggatacaattgtgccattagagagtacgaaggcttacaacatggtggacattatccactcagtcgtggatgagagagagttcttcgagatcatgcccaactacgccaagaatatcatcgttggatttgccaggatgaacgggcggactgtggggatcgtggggaatcagcccaaggtggcgtcaggttgtctggacattaacagctccgtaaagggagcccggtttgttcggttttgcgacgcgttcaatattccactcatcacgtttgtggacgtccccgggtttttacctgggacagcacaggaatatgggggcattatccggcacggagctaagttgctctacgctttcgcagaggccacagtccccaaagtgaccgtcatcacccgcaaagcctatggcggggcatacgatgtaatgtcttcaaagcacttatgtggagacactaactacgcctggcctacagctgaaatcgccgtcatgggagcaaaaggagccgtggagatcatctttaaaggacatgagaacgtcgaggccgcacaagcagaatacattgagaagttcgctaacccctttcctgccgccgttaggggattcgttgatgacataatacagcccagtagtactagagcacggatttgctgtgatttggacgtactcgcctctaagaaagtgcgtgtgcaggaagtgttccatcaggttgtgcagagcggacaccgggatgggaggggagcagtgcggtggtag

SEQ ID NO: 200950 - DNA, 387 bp, Artificial Sequence
  Description of Artificial Sequence: Synthetic coding sequence
atgagcctgcggctggacaccacccccagctgcaacagcgcccggccactccacgcccttcaggtccttctgctgctctcactccttttaacggcactggcctcttcaaccaaaggacaaacaaaacgtaatctcgccaagggcaaggaagaaagtctcgattccgatttgtacgccgagctgagatgcatgtgtattaaaactacctcggggatccatcctaaaaacatacagagcctggaagtcatcgggaaaggaacccactgtaaccaggtcgaggtgatcgccactttaaaggatggacggaaaatctgcctggaccccgacgcccccaggatcaagaagatcgtgcagaaaaaactggccggagacgagagtgctgactag

SEQ ID NO: 200951 - DNA, 2262 bp, Artificial Sequence
  Description of Artificial Sequence: Synthetic coding sequence
atggagcggcgggcctggagcctgcagtgcaccgccttcgtgctgttttgcgcctggtgcgccctgaatagcgcaaaggcaaagcggcaatttgtgaatgaatgggccgctgaaattcccggtgggccagaggctgcgtcggctattgccgaggagttaggttatgacctgctggggcaaattggatcgctggagaaccactatctttttaagcacaaaaaccaccctcgaaggtctaggcgcagcgctttccatatcacaaagcggctcagcgacgatgatcgcgtgatctgggcggaacagcaatacgaaaaagagcggtccaagcggtctgcgctcagagatagcgcgctgaacctcttcaacgacccgatgtggaaccagcaatggtatctacaggacacccgaatgacggcggccctcccaaagttagaccttcatgttatccccgtatggcagaagggcattactggcaaaggcgtcgttattaccgtattagacgatggactagagtggaaccatacagacatttatgctaactatgatcccgaggccagctatgattttaacgataacgaccacgacccatttccaaggtatgatccaacaaacgaaaataagcacggaactcgctgcgccggggaaatcgcaatgcaggctaataaccacaagtgtggggtgggagtggcctataactctaaagtggggggaattcgtatgctggatggaattgtgacagacgctattgaagcctctagcatcggcttcaatcctggccatgtcgacatatatagcgcaagctgggggcctaacgatgacggaaaaactgttgaaggaccaggacgacttgctcaaaaagcatttgagtacggagtgaaacaaggccgccagggaaagggaagtatttttgtctgggcatcaggaaatggagggcgccagggggataattgtgactgcgatggctacactgacagtatttacacaatcagcatcagctcagccagtcagcaagggctaagcccctggtatgcggagaagtgcagctcaacacttgctacatcctattcttcaggggactacaccgatcagagaattacttcagcggacctccacaacgactgcactgaaacccatactggaacgtctgcgtcagcaccgctcgccgccggtattttcgccctggccttggaagcgaacccaaacctgacttggagggacatgcagcatctggtggtttggaccagcgagtacgaccccttagctaacaacccaggatggaaaaagaacggcgccggcttaatggttaactcacgatttgggtttgggttgctgaacgcaaaagccctcgtagacttggccgatccacgcacttggcgcagtgtgcccgaaaaaaaagagtgcgtggtcaaggacaatgatttcgaaccacgcgcactcaaggctaacggcgaggtgataatcgagatacccacacgggcttgtgagggccaggagaacgcgatcaagtcactggagcacgtacagtttgaggccacgatagagtactcaagaaggggtgatctgcatgttacattgacctcggcagccggaacatctacagtcttactagccgagcgagaacgtgatacctcacccaacgggttcaagaattgggatttcatgagcgttcacacctggggcgagaaccccataggcacttggacacttcggattacggacatgagcggaaggattcaaaatgaggggagaattgtgaactggaagcttatactgcacggcacatcctcccagcccgagcatatgaaacagccaagagtgtacacgagttacaatacggttcagaacgacaggcgtggcgttgagaaaatggttgaccctggcgaggagcaacccactcaggaaaatcctaaggaaaatactttagtctccaagtcaccaagcagttccagtgtgggcggccgcagagacgagctggaggaaggggccccgtcccaggctatgctgcgactgctccagtcagcattttctaaaaactccccgcccaagcagtcccccaaaaagagcccctccgctaaactaaacatcccctatgagaatttctacgaggccttggagaaactcaacaaaccctcccagctcaaagactctgaagactccttgtacaatgactacgtcgatgttttctataacaccaaaccatataagcacagagacgatcgtttactgcaggccttagtggatatactgaacgaagagaattag

SEQ ID NO: 200952 - DNA, 477 bp, Artificial Sequence
  Description of Artificial Sequence: Synthetic coding sequence
atggagcggcgggcctggagcctgcagtgcaccgccttcgtgctgttctgcgcctggtgtgccctgaactccgccaaggcaaagaggcagttcgtgaatgagtgggccgcagagattcctggagggcccgaagctgcctccgccatcgccgaagaattgggctatgatctccttggccagattggttcactcgaaaaccattatctcttcaagcacaagaaccatcctagacgcagtcgaagatctgcctttcacataactaagaggctatcagacgacgacagggtgatctgggccgagcagcagtacgagaaagagaggagcaaacgctccgcattgagggactcagcgctaaacctgttcaacgatcctatgtggaatcaacagtggtacctgcaggacacaagaatgactgcggccctgcctaagctggatctccatgttatacccgtgtggcaaaaggggatcacggggtag

SEQ ID NO: 200953 - DNA, 2121 bp, Artificial Sequence
  Description of Artificial Sequence: Synthetic coding sequence
atgggcaagggcagcatcagcttcctgttcttcagccagatcggctccttggaaaaccactacctttttaagcataagaatcacccccggcgatccagacgcagcgccttccatattacaaagcggttgtccgacgatgaccgcgtgatttgggcagaacagcagtatgagaaggaacgaagcaaacggtccgccctgcgcgattccgccctaaacttgttcaatgatcctatgtggaatcaacagtggtacctgcaggatacgagaatgactgccgcccttcccaaattagacctgcacgtcatacccgtgtggcaaaagggcataacaggaaagggagttgtgattaccgtcctggatgacggactcgagtggaaccatacagatatctacgcaaactatgatccggaagcttcttacgacttcaacgataatgaccatgacccatttccccggtacgatcctacaaatgaaaataagcacgggacccggtgcgctggcgagattgcaatgcaggctaataatcacaaatgtggggtaggggtcgcatacaatagtaaggtggggggaatcaggatgctcgatggcatcgtgacggacgccatcgaagcttcctccatcggtttcaatccaggccacgtggacatttatagtgcaagctggggcccaaacgatgatggaaaaacggtggaagggcccggccgcctcgcacaaaaagcatttgaatatggcgtgaaacagggccgacagggtaaagggtcaattttcgtttgggcctctggaaatggcggacgacagggcgataactgtgattgcgacgggtatacagatagtatctacactattagtatctcttcagctagccagcagggcttaagcccctggtacgcagagaagtgcagttccaccctggctacctcatactcatccggagactacaccgatcaacggattacctccgccgatttgcataatgactgcactgagacacacaccggtacatctgcgagtgctccactggcggccggaatttttgctctcgctctggaagccaatcccaatttgacctggcgcgacatgcagcacctcgtggtatggaccagcgagtatgatccactcgcaaacaatcccgggtggaagaaaaacggtgccggcctgatggtgaacagtcggttcggatttggcctgctgaatgcgaaagcattagtggacctggccgacccgcgtacatggcgcagcgtgcctgaaaaaaaggagtgtgtagtcaaagacaacgatttcgaacccagggccctgaaagccaacggggaggtgataattgaaatacccacgcgcgcatgtgagggccaggaaaacgccatcaagagcttggagcatgtgcaattcgaggctaccatcgaatactccaggagaggtgacctgcacgtgaccctgacttctgcagccggtacaagcaccgtgttgctggccgagagagagagggacacctctcctaacgggttcaaaaactgggacttcatgtctgtccatacatggggcgaaaatccaataggaacctggacactgcgcatcacagacatgtctggtagaatccagaacgaaggtagaattgtgaactggaagctgatcctgcacgggacctccagccagccagaacatatgaaacagcctcgggtgtacacttcttataacacagtgcagaacgacagacgaggggtggaaaaaatggtggatcccggggaagagcagcctacacaggaaaacccgaaggagaacaccctcgtttcaaagtccccttctagtagcagcgtcgggggccgccgggacgagctcgaggaaggcgctcccagccaagctatgcttcggctgcttcagtccgccttttctaagaatagccctccaaagcagtcccccaagaaaagtcctagtgcaaagctaaacattccttacgaaaatttttacgaagccctagagaagcttaataagcctagccagctcaaggactctgaagattctttatataatgattatgtagatgttttttataataccaaaccatataaacaccgtgacgaccgattactgcaggctctggtggatatcctgaacgaagagaattag

SEQ ID NO: 200954 - DNA, 798 bp, Artificial Sequence
  Description of Artificial Sequence: Synthetic coding sequence
atgcccctgcccgtggccctgcagacccggctggccaagcggggcattctgaagcatctcgaacctgagccagaagaggagatcatcgctgaagattacgacgatgacccagtggattacgaagcaacacggctagaagggctgcccccatcctggtacaaggtgtttgacccctcctgtggtctgccgtattactggaatgcggacaccgacttggtcagctggttatcaccgcacgaccctaacagtgtagtgaccaagtctgcaaaaaagctcagaagttctaatgcagacgcggaggaaaaactagataggagccacgacaagagtgataggggccatgataaatcagaccgctcacacgagaagctggatcggggacacgataagtcagatagggggcacgacaaatctgaccgggatcgtgagcggggctacgacaaagtcgaccgcgaacgtgagcgcgacagagaaagggatagggacagggggtatgacaaggctgatcgcgaagaggggaaagaacgtcggcatcatagacgtgaggagctcgctccttatccgaaaagcaaaaaggccgtgtctaggaaggatgaagagcttgatccgatggaccctagctcctacagtgatgcccctagagggacttggtccaccgggcttccaaaacgaaacgaggcaaaaacaggcgccgacacaaccgccgctggtccactgttccaacaacgtccctaccccagccctggtgcagtcctccgagccaacgctgaggcctccaggacaaaacagcaggattag

SEQ ID NO: 200955 - DNA, 1917 bp, Artificial Sequence
  Description of Artificial Sequence: Synthetic coding sequence
atgaagggcggctgcgtgagccagtggaaggccgccgccggcttcctattctgcgtaatggtgtttgcctcggcagagagacccgtgtttaccaaccacttcctcgttgagctccataagggcggagaggataaggccagacaggtcgccgccgaacacggctttggggtcagaaagctgcctttcgccgaaggcctgtatcacttttaccataacggtcttgctaaagcaaagaggaggcggagtctgcatcacaagcagcagttagagcgtgatcctagggtgaagatggcacttcagcaggaaggcttcgacaggaagaagaggggatatcgagacatcaatgagatcgacataaatatgaacgatcctttgttcacaaaacagtggtatctgatcaacacgggacaggccgacggtactcccggattggatctgaacgttgcagaggcttgggagcttgggtatacaggaaagggagtgactatcggcatcatggatgatggcatcgactacctgcatccagatttggctagcaactacaacgctgaagctagctatgatttctccagcaatgatccatatccttatccgcggtataccgacgattggtttaattctcatggcacaagatgtgccggggaagtctccgccgcagctaacaacaacatctgcggcgtgggagtggcctataatagcaaagtggcagggatcagaatgttagatcagcccttcatgacagacatcatcgaagcttctagtatttctcatatgcctcagctgatcgatatatatagtgccagctggggcccaacagacaacggcaaaacagttgacgggcccagagagctgacactacaggccatggcagacggagtgaacaagggccgaggaggaaaaggatccatatatgtgtgggccagcggagatggagggagctatgacgattgcaactgtgatgggtatgcctctagtatgtggaccatttccatcaacagtgcaattaatgatgggaggaccgctctctacgatgaatcgtgcagctccactctcgctagcacctttagcaacgggcggaagcggaatcccgaggctggcgtggccactaccgatctgtacggcaattgcacgctgagacatagcggcacctccgccgcagcgcctgaagctgccggggtgttcgccttggctttggaagcgaacctgggcctcacttggcgcgatatgcaacacctgaccgttctgacatcaaagcggaatcagctgcacgacgaggtccaccagtggcggaggaacggagttggactggaattcaaccacctgtttgggtacggagtattagacgctggcgcaatggtcaagatggctaaggactggaaaacagtgccagagcgatttcattgtgtgggcgggagcgtgcaggatccagagaagattccatcgactggaaaactggttctgacattaacaacagatgcctgtgaaggtaaggaaaattttgtccggtatctcgagcacgtccaggcagtgatcacggttaatgccactcggaggggtgacctgaacatcaatatgactagcccaatgggaaccaagtccatcctgctgtcccgcagacccagagatgatgattcaaaggtaggatttgacaagtggcccttcatgactacccatacctggggcgaagatgcgagaggaacctggaccctcgagttgggcttcgtgggctctgcaccacagaagggagttctcaaagaatggacccttatgctgcacggcactcagtccgctccttatatcgatcaggtggtgagggattaccagagcaagctcgcaatgagcaagaaagaagagctggaagaagagctggatgaggcggtcgaacgctcactcaagtcaatcttgaacaaaaattag

SEQ ID NO: 200956 - DNA, 1860 bp, Artificial Sequence
  Description of Artificial Sequence: Synthetic coding sequence
atggtgttcgccagcgccgagcggcccgtgttcaccaaccacttcctcgttgaactccacaaagggggagaagataaggcccgccaggtagccgccgagcatggcttcggtgttcgtaaactccccttcgccgagggtctctaccacttctatcacaatggtctggcaaaagccaaacgtcgtaggagtctacaccataagcagcagctggagcgcgaccccagagtgaagatggccctccaacaagagggattcgataggaagaaaagaggttatcgagatattaatgagatcgatattaatatgaacgatccgctgttcacaaagcaatggtatctgatcaatactgggcaggccgatggcacgccagggctggatttaaatgtggccgaggcttgggaactgggctatacaggtaagggggttaccatcggaatcatggacgacgggatcgattacctccaccctgatcttgcttcaaactacaatgcggaagcctcgtatgacttcagcagcaacgacccttacccctacccgcgttacacggacgattggtttaacagccatggtacaagatgcgcaggtgaagtctccgcggcagctaataacaacatctgcggcgtaggcgtggcttacaattcaaaggttgccggcatcagaatgctcgatcagccatttatgactgacatcatcgaagcttcttctatttcccacatgccccaactgattgatatctatagtgcttcctggggccccaccgacaatgggaagaccgttgacggccctagggagctgaccttgcaggccatggccgatggcgtgaacaaaggcaggggaggtaagggctctatatatgtatgggcaagtggagatgggggaagctacgatgactgcaattgtgacggctatgccagctccatgtggaccatctccataaactctgccattaatgacgggagaacagccctgtacgacgaaagctgcagcagcacattggctagcacattctctaacggaaggaagaggaatcccgaagccggggtggcaactactgacctctacgggaactgtacacttaggcactcaggcacaagcgccgcagctcccgaggctgcaggcgtgtttgctttggctctagaggccaatctggggctgacatggcgcgacatgcaacatttaactgtattgacctctaagcgcaaccagttacacgatgaagtccaccaatggcggcgtaacggtgtgggactcgagtttaaccatctttttggttatggggttctggacgctggggcgatggtgaagatggccaaagactggaagaccgttccagaacggtttcattgcgtgggtggatcagtgcaggatcctgagaagattccctcaacaggaaaactggtgcttactctgactaccgacgcctgcgagggaaaagagaactttgtgcggtacctggaacatgtgcaggcggtaatcaccgttaacgcgactagaaggggggacctaaatattaacatgactagccctatgggcacaaaaagcatcttgttgtcccggagaccccgtgatgacgactccaaagtagggtttgacaagtggcccttcatgaccactcacacctggggcgaggacgcccgcgggacgtggacactggaattaggctttgtgggctctgctccacaaaaaggagtgctcaaagagtggacactaatgcttcacggcactcagtctgcaccttacattgaccaggtagttcgggattaccaatccaagctggccatgagtaagaaagaagagctggaggaagagcttgatgaagccgtggaaaggagcttgaagagtattctgaacaaaaattag

SEQ ID NO: 200957 - DNA, 1812 bp, Artificial Sequence
  Description of Artificial Sequence: Synthetic coding sequence
atgaagggcggctgcgtgagccagtggaaggccgccgccggcttcctcttttgtgtgatggtctttgccagcgccgagagaccagtttttactaaccatttcttggtcgaactgcacaagggcggggaagataaggcaagacaggtggcagcggaacacggcttcggggtgaggaaagttaagatggcgcttcaacaagaaggttttgataggaagaaacggggctacagggacattaacgagatagacattaatatgaacgacccccttttcactaagcagtggtatttgatcaatacaggacaggccgatggcacacctggtctggatctgaatgtcgccgaggcatgggagcttggctacactggcaagggagttacaattggtataatggatgacggtatagactacctgcaccccgaccttgcgagcaactataacgcagaggctagctacgacttctcctctaacgatccttacccctaccctaggtatacagacgattggtttaatagccacggcaccagatgcgcaggggaggtctctgcagccgccaataataatatttgtggcgtgggcgtggcctataatagcaaggtagccggaatccggatgctcgatcagccttttatgacagatatcatagaagccagctcgatctcgcacatgcctcaattgatcgacatctactccgctagttgggggcccaccgataatggaaagactgtggacggtcctagagagctgacgttgcaagcgatggccgatggggtcaacaagggccgaggaggcaaaggatcaatctacgtgtgggcttccggtgatggcgggtcatatgacgactgtaattgcgatggttacgccagtagcatgtggactattagcatcaatagcgccataaacgacggacggactgcgctgtatgacgagagttgtagctcaacactggcgtctaccttctctaacggccgaaaaagaaatcccgaggctggcgtagccactaccgacctgtacgggaactgcacactcagacatagcgggacaagcgccgccgctccagaagccgccggagtcttcgccctcgcactggaggctaacttgggtctaacatggcgtgacatgcaacatctgaccgtgctcacatctaagaggaatcagttgcacgacgaagtccaccaatggcgccgcaatggcgtgggtctggagttcaaccacctgtttggctatggcgtgcttgacgctggtgccatggtaaagatggccaaggactggaaaaccgtgccggaaaggtttcattgtgtcggagggtcagtgcaggaccctgaaaagattcccagtacaggaaagctggtgttgacgctgacaacagacgcctgtgaaggaaaggaaaattttgtgcgatatctagaacatgtccaggcagtgattaccgtgaatgccactagaagaggagacctcaacattaatatgacaagtccaatgggtacaaagtcgattttgctgagcaggcgacccagggatgatgactcaaaggtaggctttgacaagtggccctttatgacaacccatacttggggcgaagatgctcggggcacgtggactcttgaactcggctttgtggggtcggccccgcaaaagggcgtcttgaaggagtggacgctgatgctgcatggaacacagtcggcaccatatattgaccaggtggttcgggactatcaatctaaactggccatgtcgaaaaaggaggagctggaagaggaactggacgaggcggtagagagaagtcttaaatctatcctgaacaaaaattag

SEQ ID NO: 200958 - DNA, 2268 bp, Artificial Sequence
  Description of Artificial Sequence: Synthetic coding sequence
atgcggcccgcccccatcgccctgtggctgcggctggtgctggccctagctctcgtgcggccccgggccgtcgggtgggcaccagttcgggcgccaatttacgtctcaagctgggcagtccaggtcagtcaaggcaatcgcgaggtggagcgtcttgcccgtaaattcggttttgtgaatcttgggccaattttccccgatggtcaatattttcacctgcgccataggggggtggtacagcagtcgctaactccgcattgggggcacagactgcacctaaagaagaatcctaaggtgcagtggtttcagcagcagacccttcagagacgggtcaagagatccgtagtagtgccaacagatccgtggtttagtaagcaatggtacatgaactccgaggcccagcctgacctgtcaatcctacaggcctggtcgcaggggctatcaggccagggcatcgtggtttctgttttagacgacggtatcgagaaggatcatccagatttgtgggctaactatgatcccttggcctcctacgacttcaacgactacgacccagatccgcagcctaggtataccccctctaaggaaaaccgacacggaacccgttgcgcaggggaggtcgctgctatggcaaataacggcttctgtggcgtcggcgtcgctttcaatgcccgcatcggcggtgttagaatgctggatggaaccatcaccgacgttatagaggcccagagccttagcctgcagcctcagcatattcatatttacagcgctagttgggggcccgaagacgacggcagaaccgttgacggaccaggtattcttactagagaggcctttcgccgaggcgtaactaaaggacgggggggattagggaccctgtttatttgggcttcaggcaatgggggacttcattatgataattgcaattgcgacgggtacacaaacagcattcataccctgtccgtcggatctacaactcagcaaggaagggtcccttggtactctgaggcgtgcgcatccacccttaccacaacctactcctcaggggttgctaccgatccacaaatcgtcaccaccgacctgcaccacggttgtactgaccaacacacaggaactagcgcctctgcacctctggcggcaggcatgatagctctggccctagaagcaaatcctttcctcacatggagagatatgcagcatctcgttgtgcgggctagcaagccggcccaccttcaagccgaggattggaggaccaacggcgtcggacgacaggtgtcacatcactatggctatgggttgctagacgccgggctgctcgtcgatacggctaggacatggctgcctacccaacctcagcgaaagtgcgctgttagagttcagagccggcccaccccgatccttccccttatttatattagggaaaacgttagtgcctgcgccggccttcataattccatacggagcctggagcacgtacaagctcagctcactttatcttactccaggaggggggacctcgaaattagcttgacctcacctatgggtacccgctctacattggtcgccatcagaccgctcgacgtgagcactgagggatataataattgggttttcatgagtacacatttttgggacgagaatccacagggggtttggacccttggcctagaaaacaaaggctactattttaatacgggtaccctctatagatataccctgctgctctatggcacagccgaggatatgactgctcggcccaccggaccccaggtgactagctccgcgtgcgtacagagggatactgagggcttgtgtcaggcctgcgacgggcccgcctacattctgggacaactatgtctggcttattgtccacctaggttttttaaccatacgcgccttgtaactgccggtcccggacataccgcagctcccgctcttcgcgtatgtagctcttgccatgctagctgctatacttgtagaggtggcagcccgcgtgactgtacaagctgtccccccagttcaacactcgaccagcaacaggggagctgcatgggcccgaccacacccgattcacgaccccgcctccgtgccgctgcgtgcccacaccaccggtgcccagcttcagccatggtgttgtctctgctcgccgtcacgctgggggggcctgtactttgtggaatgtccatggatctgcccctttacgcttggttgtcaagagctcgcgcaactcccacaaagcctcaagtgtggctgcccgcaggaacgtag

SEQ ID NO: 200959 - DNA, 1137 bp, Artificial Sequence
  Description of Artificial Sequence: Synthetic coding sequence
atggccagccggcggaccacccggaccagcggccccaccaccaccccgtggccagccatgaccagcatgactacgactcgaacaccctcacccgccactccgcctgcaaaacgtacaggagttagaatgctcgacggaaccatcactgatgtgattgaggcacagagtctcagcctgcaacctcaacacatacacatttattctgctagctggggccccgaagatgatggaaggacagtagacggtcctggcatcctgaccagagaagcctttcgcaggggcgtcacaaaaggccgcggtgggttgggcactctgtttatctgggcttctggcaacggtggactgcactacgataactgcaactgcgatgggtacacgaactctattcataccctgagcgtcggctcaacgactcagcagggcagagtgccttggtacagtgaggcatgtgcatccactctgactaccacatattcatccggagtggccacggatccacaaatcgtcaccacagatctgcatcacggctgtacggaccaacacaccggtacttctgcctctgctcctttagccgctggcatgatcgccctggccttggaagcaaatcccttcctgacctggagggacatgcagcatctggtggtgcgggcatctaagcccgcccacttacaggccgaagactggaggacaaatggcgtcggcaggcaagtgagtcatcactacggatacgggttactggacgctggcctgttagtggacaccgcacgaacttggctgcctactcagccacaaaggaaatgtgcagtaagggtgcagagccgccccacgcctattttgcccctcatttacatccgggaaaacgtgtccgcctgtgccggcctccacaattcaattcggtctttagaacatgtgcaagcccagctaaccctgtcttactcacggcgcggtgatcttgagattagcctcacctccccaatggggacgaggtcaacactggttgctattcgcgatgtcgtccctctgcacgcggccgcgttgtgggacggcagaggccacgacagtgcggcatacagaccccctggcgatcagcagcgggtgtgcgccgccggtcataggggtgctgtgcctggcgtgtag

SEQ ID NO: 200960 - DNA, 2742 bp, Artificial Sequence
  Description of Artificial Sequence: Synthetic coding sequence
atgggctggggcagccggtgctgctgccccggccggctggacctgctgtgtgttcttgcactattggggggctgcttactcccggtatgtaggacccgggtatacaccaaccactgggcggtcaaaatagctgggggatttccggaggctaatcgaatcgcttcgaagtacggcttcattaacatcggccagataggcgccctgaaagattattaccacttctaccacagccggacaattaagagatcggtgataagctctcggggcacgcatagctttattagcatggaaccaaaagtcgaatggattcaacagcaggtggttaagaagaggactaaaagagattacgatttcagcagagcacagagtacttattttaacgatcccaaatggccgagtatgtggtatatgcactgtagcgataatacacacccatgtcagtccgacatgaatatcgaaggagcttggaagcgcggatatacaggcaaaaatatcgttgtgaccatcctggatgacggtatcgagcgaactcacccagatttgatgcagaattatgatgctctcgccagctgtgacgttaacggcaacgacttggatcctatgcctagatacgacgcgagtaacgaaaataagcacggaacccgatgcgctggcgaggtcgccgctgcagcaaacaacagtcattgcaccgtaggcattgctttcaacgctaagatcggaggtgtgaggatgcttgatggcgatgtcaccgatatggtggaagctaagtctgtgtcgtttaatccccaacacgttcacatttatagtgcttcttggggacccgacgatgatggaaagacagtcgatggccccgctccactgaccagacaggcctttgagaacggcgtgcggatggggagaaggggattgggatccgtattcgtttgggcttctggaaatggaggtagatccaaggaccactgttcatgcgacggctataccaattccatttatacaatttccatatcctcaaccgcggagagtggcaagaagccttggtatttggaggagtgctcttctacactagccaccacatactcctccggcgagtcgtatgataagaaaattatcacaacagatctgcgccaacgctgtacagataaccacaccggcacatccgcttcagcccccatggccgctggtattatcgcgctcgctttagaagcaaaccccttcttgacttggcgtgatgtgcagcacgtgattgtacgaacctcacgggcagggcatttgaacgcaaacgactggaagacaaacgccgccggtttcaaagtatcacacctatacggattcgggctcatggatgccgaagccatggtgatggaggccgagaagtggaccacagtgcccagacagcacgtctgtgtcgagagtaccgaccgacagatcaagacaatccggccaaacagtgccgttcggtctatctataaagcaagcggctgctcagataatcctaaccgccatgtgaactatctggagcatgtggtagtcagaatcactattacccatcccaggaggggagatcttgccatatatctgacctccccttctggtaccagatctcagcttctcgcgaatcgactgtttgatcactccatggagggctttaagaactgggaatttatgaccattcattgttggggtgagcgggccgccggcgactgggttctcgaagtttatgatacaccgagccagctcagaaattttaagacaccaggcaagcttaaagaatggtcactggttttgtacggcaccagcgtgcagccatactcccctaccaacgaattccccaaagtggaacgctttcgctactcacgcgtggaagacccaactgacgattacggaacggaggactatgctgggccgtgtgacccagaatgcagcgaggtggggtgtgacggcccggggcccgaccattgcaatgattgcctgcattactactataagcttaaaaataacacccggatttgtgttagtagctgtccacctgggcactaccacgccgacaagaagcgctgtcgcaaatgcgccccaaattgtgagtcttgcttcggatcccacggggaccagtgtatgtcttgcaaatatggttattttctgaacgaagaaacaaacagttgcgttacacattgccctgacgggagctatcaggatacaaagaagaacctgtgcagaaaatgttcggagaactgcaagacctgtactgagtttcacaattgcacagaatgcagggacgggctctccctccagggcagtcggtgtagcgtaagttgtgaagatgggcggtatttcaatggtcaggattgccaaccttgtcatcgattttgcgccacatgcgcgggcgctggagctgatggctgcattaactgcaccgaggggtacttcatggaagacggtagatgtgtgcagtcatgctctatctcgtactatttcgatcatagttctgaaaatggctacaaatcctgcaagaagtgcgatatctcatgcctgacgtgcaatgggccgggcttcaaaaactgcaccagttgcccctctggttatttgctggatctggggatgtgccagatgggtgcgatctgtaaggacgccactgaagaaagctgggccgaaggcggattttgtatgctggtaaagaaaaataacctctgccagcggaaagtcctccagcaactttgctgcaaaacttgcacctttcaaggttag

SEQ ID NO: 200961 - DNA, 4773 bp, Artificial Sequence
  Description of Artificial Sequence: Synthetic coding sequence
atgggccggcggggcctgggcagcgtgttcgtgtgggccagcggcaacggcgggcggagtaaggatcattgcagctgcgacggatacaccaactctatctataccatcagcatctcctctacagcagaaagcggaaagaagccctggtacctggaggaatgttcttcaacattagccacgacttattcatctggagagtcttatgataagaaaatcataactactgatcttagacagcggtgcacagacaaccacacggggacttccgcttccgcacctatggccgctggcataattgcacttgccctcgaggccaacccattcctgacgtggcgcgacgttcagcacgtgatagtgagaaccagtcgggctggacaccttaacgcaaacgattggaaaaccaacgccgccggcttcaaggtgagccacctgtacgggtttgggttaatggacgccgaggcaatggttatggaggccgagaagtggaccacggtgcctagacagcatgtgtgcgtggagagtactgaccgacagatcaagacaatccgccccaatagcgcagtaaggtcaatctacaaggcctccggatgcagcgataatcctaacagacacgtaaattacctggaacacgtggtggtcaggattaccatcacccaccccagacgaggcgacctggctatctacctgacaagcccttcgggcaccaggtctcaactcctagcaaatcgcctttttgaccactccatggagggcttcaagaattgggagtttatgacaatccattgctggggggaacgggcagcaggggattgggtgcttgaggtttatgacaccccatcccagctccggaacttcaagacccctggtaagctcaaggagtggtccctggtgctttacggcacttccgtgcaaccttatagcccaactaacgagtttcctaaggtcgaaaggttccggtattcgcgcgtggaagaccccacagacgactacggcactgaggattacgctggaccgtgcgatcctgagtgcagtgaggttggttgtgacggccccggcccagaccattgtaacgactgcctgcactactattacaagctgaagaataacacaaggatctgcgtatcaagctgtcccccggggcactatcatgcagataagaaaagatgtcgaaaatgcgcacccaattgtgagtcgtgtttcggctcccacggagaccaatgcatgagttgtaagtatggatatttccttaacgaagagactaattcctgtgtgacccactgcccggacggctcttatcaggacaccaagaagaacctttgtcggaagtgttccgagaattgcaagacttgtaccgaattccacaattgtaccgagtgtcgcgacggactctctctccaaggatccaggtgctcagtcagctgtgaggacggccggtacttcaatggccaggattgccaaccttgtcatagattctgtgctacatgcgccggagctggcgcggatggctgcattaactgcactgagggctactttatggaagatggtcgatgtgtgcaatcatgctccatcagctattacttcgatcatagctctgaaaacggctacaaatcatgtaagaagtgcgacatttcgtgcctgacttgtaacggacctgggttcaaaaattgtaccagctgcccttcagggtaccttctggatttaggtatgtgccagatgggcgctatttgcaaggacggggaatacgttgacgagcatggccattgccagacctgcgaagcctcttgtgctaagtgccagggcccaacccaggaggattgcacaacttgcccaatgacaaggatcttcgacgacgggcgatgtgtgtctaattgccctagctggaagtttgagtttgaaaaccagtgtcatccttgccatcacacctgccagagatgccagggatcgggccccacccattgtactagctgcggcgccgataattatgggcgcgaacatttcctgtaccagggtgaatgtggcgactcctgccccgaaggccattatgctactgaggggaatacatgccttccctgtcctgataactgtgagctttgtcactccgtccatgtttgtacacggtgcatgaaagggtactttatcgcccccacaaaccacacctgtcaaaagctggaatgcggccaaggggaggtgcaggaccccgattatgaggaatgcgtgccgtgcgaggaaggttgtctcggttgcagcctagacgacccaggcacatgcacctcctgcgccatgggatattacagatttgatcatcactgttacaagacgtgtcctgaaaaaacttatagtgaagaagtggagtgcaaggcctgcgactctaattgcggtagctgtgatcagaatggttgctactggtgcgaagaggggttttttctcctgggtggcagttgcgtcagaaaatgcggcccggggttctacggcgatcaggaaatgggagaatgtgaaagttgccacagggcttgtgagacatgcacaggaccaggccacgatgaatgttcctcctgccaggaaggattgcagctcctgcgggggatgtgcgtgcatgctaccaagacccaggaggaagggaagttctggaacgaggccgtctccactgctaacttaagtgttgtgaaaagccttctccaagagcgaaggcgttggaaggttcagattaagagggatattctacgcaagctgcagccttgccacagcagctgtaagacttgcaatggctcagccaccctctgtacttcgtgtcccaagggggcttacctgcttgcacaggcgtgtgtctccagctgcccacagggaacctggccatccgtacgcagcggatcctgcgagaactgcactgaggcttgcgctatctgctctggggcagacctctgtaaaaaatgccagatgcaaccaggacatccactgttcctgcatgaagggcggtgttatagcaagtgtcccgagggtagttacgctgaggatgggatatgtgagcgctgttcctcaccttgtagaacctgcgaaggtaatgctactaattgccattcttgcgaagggggtcatgtgctgcaccacggtgtttgccaggaaaattgccctgagcggcatgtcgccgtgaagggcgtctgcaaacactgccccgagatgtgccaggactgtattcatgagaaaacatgtaaggaatgcacaccggaatttttcctccatgatgatatgtgtcaccagagctgcccacgcgggttctatgccgacagccggcactgcgttccatgccataaagattgtttggagtgctccggcccgaaggctgatgattgtgaactgtgtttggagagtagttgggtactctatgacggactgtgtttggaggaatgccctgcgggaacatactatgaaaaggaaacaaaggagtgcagggattgtcacaagagttgcctcacctgttccagcagtggtacttgcacaacatgccagaagggacttatcatgaatccaagagggtcttgcatggctaatgaaaagtgcagccctagcgaatactgggacgaagatgcaccgggttgtaaaccctgtcacgtgaagtgcttccactgcatgggcccagccgaagaccagtgccagacctgccccatgaattcgttgctactgaacacaacatgtgttaaagattgtcctgaagggtactacgccgatgaagatagcaacaggtgcgcacactgtcatagctcttgccgaacatgtgagggcagacatagtcgtcaatgtcatagttgcaggccaggctggtttcagcttgggaaagagtgtcttcttcagtgtcgcgaaggatactacgctgataattccacaggtcggtgcgagcgatgcaacaggtcgtgcaaaggatgtcaaggccctaggcccaccgactgcctctcatgcgatcgcttcttcttcctccttagatcaaagggcgaatgtcacagatcttgtcccgatcattattacgtggagcaaagcacacagacctgcgaacgctgtcacccaacttgcgaccagtgcaaaggcaagggtgccctaaactgtctttcttgcgtctggtcatatcacctcatgggcggaatctgtacctctgattgccttgtgggggagtatcgggtaggagagggtgagaagttcaactgtgagaaatgtcacgagtcttgtatggagtgtaagggacctggagctaagaattgtactctgtgtccagccaacctagtgcttcacatggacgattctcattgtcttcattgttgcaatacctcggacccccctagtgcccaggaatgctgcgactgccaggataccactgacgagtgcattctgaggacttcaaaggtacgccccgccacagagcacttcaagaccgccctgttcatcacctcttctatgatgctagtgctactgctgggggcagcggtagtggtgtggaagaagagtaggggcagagtgcaaccagcagctaaggccggttacgagaagctcgctgacccaaataagtcttattcatcctacaaaagcagttacagagaatctactagtttcgaagaggatcaagtcattgaatatcgcgatagagactatgacgaagacgatgacgacgacattgtatacatgggacaggatggaacagtgtataggaaatttaagtacggtctccttgacgatgacgacatcgatgagctggaatatgacgatgagagttacagttattatcagtag

SEQ ID NO: 200962 - DNA, 2073 bp, Artificial Sequence
  Description of Artificial Sequence: Synthetic coding sequence
atgggctggggcagccggtgctgctgccccggccggctggacctgttatgtgtgttggccctccttgggggctgcttgctgcctgtgtgtcgcacccgggtctacaccaatcactgggctgtgaagatcgccggagggttccccgaagccaataggatagcttccaagtatggcttcattaatataggccagattggggcgctcaaggactattatcacttctatcattcccgcactattaagcggtcagtgatctcctctagaggaacccacagttttatctccatggaaccgaaggtggaatggatccaacaacaggtcgtgaaaaagagaacaaagcgggattacgatttctcaagggcgcagagtacctacttcaacgatcccaagtggccatcaatgtggtacatgcattgcagcgataacacccacccttgtcagtcagatatgaacatcgaaggcgcatggaagaggggctatacaggaaagaatattgtcgtaacaatactcgacgatgggattgaaaggactcaccctgatctgatgcagaactacgacgccctggcatcatgtgatgtgaatggaaacgatctcgaccccatgccaagatacgatgccagcaatgaaaacaagcacgggacccgatgtgccggggaggtggccgcagccgcgaacaactcacattgcacagtaggcattgcctttaacgcaaaaatcgggggggtgcggatgttggacggcgatgtgacggatatggtcgaggccaagtccgtgagtttcaacccgcagcatgtccatatctactctgcctcatggggtccggatgatgatggtaagacggttgacgggcctgcccctctgacgaggcaggcttttgaaaacggcgttcgtatgggaaggcggggacttgggtctgtgtttgtgtgggcttccgggaacggaggcagaagcaaggatcattgttcctgcgacggttataccaattctatctataccattagcatcagttctactgccgagtccgggaaaaaaccatggtacctggaggagtgtagcagtacactcgccacgacctattcaagcggcgagtcctacgataagaagatcataaccactgatctgcggcagcgatgtacagacaaccacacggggacgagcgcttcagcccccatggccgctggcatcatcgcacttgcactggaggccaacccattccttacctggagggacgtgcaacatgtaattgtgcgcacctcccgcgccggccatcttaatgccaatgactggaagaccaatgcagccggctttaaggtatcgcacctgtacggatttggactgatggacgcagaagcgatggtcatggaagccgagaaatggacaactgtgccccgccaacacgtgtgcgttgaaagcaccgatcggcagataaagacaattcggcctaacagtgctgtgcggagcatttacaaggcctccgggtgcagtgataacccaaaccgacacgtgaactaccttgagcacgtggtcgtgagaattacaattacccacccccgtaggggggatctggcgatctacctcacatccccgtccggaacacgctcacagttactggccaacagactgttcgatcacagcatggaaggttttaagaactgggaatttatgacaatccactgctggggggaaagagcagctggcgattgggttctagaagtttatgatactccatctcaactcagaaacttcaagacaccaggtaagctgaaggaatggtcattggtgctttacggaacaagtgtccagccgtactctcctacaaacgagtttcctaaagtggagagattccggtatagccgcgttgaggatcccaccgatgactacgggacagaggactacgccggtgagctggcgagtagcggaacacaggctaaaaagagacagctcatgcatcatcccacaacatgggagaaccggatggaatggaatgggatgaagtggaatggtatgaagtggaacgggatggaatggaatgggatggaatggaataggattgaatctaaccgtattgaatag

SEQ ID NO: 200963 - DNA, 2073 bp, Artificial Sequence
  Description of Artificial Sequence: Synthetic coding sequence
atgggctggggcagccggtgctgctgccccggccggctggacctgctgtgcgtactggccctactgggaggctgcctcctgcctgtctgtcgtactcgggtgtataccaaccactgggccgtaaaaattgccggcggcttcccggaagctaaccggattgccagtaagtacggatttattaacatcggtcaaattggtgccctcaaggattattaccacttttatcactcccggaccattaagcgctccgtcatcagttcgagaggcactcactccttcatttccatggagcctaaggtggaatggatccaacagcaggtagtgaaaaagcgcaccaaaagagactacgactttagcagggcacagtcgacctattttaatgatcccaagtggcctagcatgtggtatatgcactgttccgataatacgcacccctgccaatctgacatgaacatcgaaggggcctggaaaagaggctataccgggaagaatattgtggtcactattctcgatgatggcatcgagaggacccaccccgacctaatgcagaactatgatgctctggcatcttgcgatgttaatggcaacgaccttgatccaatgccacgatatgatgcgtccaatgagaataagcatggaacaaggtgcgccggcgaggtggccgcagctgcgaataactcccactgtacagtgggtatagcattcaatgccaaaatcggcggtgttaggatgttggacggcgacgtgaccgatatggtggaagcaaaatcggtgagcttcaatcctcagcatgtgcatatctactccgcttcctgggggcctgatgacgacgggaagaccgtggatggacctgcacctttaacccgtcaggcctttgagaacggcgtgcggatgggaagaagggggcttggcagtgtgttcgtgtgggcatcaggcaatggcggacggagcaaggaccattgtagctgtgacggatatactaatagtatttataccatttctatcagtagcacagccgagagtggaaaaaagccatggtatctcgaagaatgctcgtccactctagcaaccacatatagttccggggagagttacgataaaaaaataatcactaccgatctgcgacagaggtgcacagacaatcacaccggaacaagtgcaagcgccccaatggccgccggcattattgcactcgcgctcgaggccaacccatttctcacttggagagatgtacaacacgttattgtgaggactagcagagcggggcaccttaacgccaatgattggaaaacaaatgcagctggttttaaggtatctcacctatatggatttggactcatggacgccgaagccatggtcatggaagctgaaaaatggactaccgtccccagacagcacgtgtgcgtggagagtacagatcgccagattaagacaatacgacccaactcggccgtccgctccatatataaagcatctggctgctctgacaacccaaaccgccacgtcaactaccttgagcacgtcgtagtgcggatcactatcacccaccctcgacgaggtgacctggccatttatttgactagtccatcaggtacccgatcccagcttcttgccaacaggctcttcgaccacagcatggagggatttaaaaactgggaattcatgactatccattgttggggggagcgcgcagctggagattgggtactggaggtttatgatacaccaagccaactgcgcaactttaaaacccccggcaagcttaaagagtggtccctagttctgtatggcacatccgtgcagccgtactcccccactaacgagtttcctaaggtagagagattcaggtacagcagggtcgaagaccctacagatgactatggtactgaggactacgccggagagctggcatccagcgggactcaggcaaaaaagagacagctcatgcatcaccctactacatgggagaaccgcatggagtggaacggaatgaagtggaatggcatggaatggaatggcatggaatggaacggaatggagagtaacaggattgaatctaatcgtatagagtag

SEQ ID NO: 200964 - DNA, 4683 bp, Artificial Sequence
  Description of Artificial Sequence: Synthetic coding sequence
aacagcatctacaccatcagcatcagcagcaccgccgagagcggcaagaagccctggtacttagaggagtgttcttctacactagctaccacctactctagcggcgaatcttatgataaaaagatcatcacgaccgacctcagacagcgatgcacggataatcatacaggtaccagcgctagcgctccaatggctgcagggattatagcattagcactggaagctaatccatttcttacttggagagacgttcagcacgtcattgtccgtacttctcgggccggacatcttaatgccaatgattggaaaaccaacgcggcaggctttaaggtaagccacctgtatggctttggcctgatggacgctgaggccatggtgatggaagctgagaagtggacaaccgtgcccagacagcatgtctgcgttgaatcgacggacagacagatcaagacaataagaccaaacagcgcggtgcggtccatttacaaggccagcgggtgcagcgacaatccaaacagacacgtcaattatttggaacatgtggtcgtgagaattacaatcacccaccccagacgcggtgatcttgctatctatcttacaagcccctccggaacaagatcacagcttcttgcaaaccgcttgtttgatcacagcatggagggattcaaaaactgggagttcatgacaattcattgctggggcgagcgtgcggccggggattgggtgctggaggtgtatgacactccaagccaactccgtaattttaagactcctggaaagctaaaggaatggtctctggtgctgtatggaacctctgttcaaccatacagccctacaaatgaattccccaaagtcgaacggtttagatactcacgggtagaggatccaactgacgattacggtactgaggactacgcaggcccatgcgatcctgagtgtagcgaggtgggatgcgatggcccgggtcccgaccactgcaacgattgtctccattattattacaaactgaagaataacacccgtatatgcgtctccagctgtccccccggccactatcacgccgacaagaagcggtgtagaaagtgtgccccaaactgtgaaagctgcttcggaagccacggcgatcaatgcatgagttgtaaatatggttatttcctaaatgaggaaaccaatagctgcgtgacccactgccctgacggcagctatcaagacaccaagaagaacctgtgtcgaaaatgtagcgaaaactgtaagacttgcaccgagttccacaactgtacagaatgcagggatggattatctctgcagggatcacgatgtagcgtcagctgcgaggacggcagatactttaacgggcaggactgtcaaccttgccaccggttctgtgctacctgtgcaggcgcaggggccgacggatgcatcaactgcacagaaggatacttcatggaagacgggaggtgcgtgcagtcatgctccatctcatactatttcgaccacagtagtgagaacgggtacaaaagttgtaaaaaatgtgacatctcgtgtctcacttgtaatgggcctgggtttaagaactgcacgagttgcccgtcgggttatttgttggacctgggcatgtgccagatgggcgccatctgtaaagacggggagtacgtggacgagcacggccattgccagacctgtgaggcatcttgcgcaaagtgtcaggggccaacacaggaggactgtaccacttgtccaatgacacggatctttgacgacggacgttgtgtgagcaactgtcctagttggaagtttgagttcgaaaatcaatgccacccatgccatcacacttgtcagaggtgtcaggggtctggacctacacactgcaccagctgcggtgccgacaactacgggcgcgaacattttctttaccagggcgaatgcggagacagttgtccagaaggccattatgccaccgagggcaatacgtgcttaccgtgtcccgataattgtgaactgtgccactctgtccacgtctgcacccggtgcatgaaggggtacttcatcgctccaaccaaccacacctgtcagaagttagagtgcggccagggcgaggtccaggaccccgactatgaggaatgcgttccatgcgaggaaggatgcctgggatgtagtctggatgacccaggaacctgtaccagctgcgcaatgggttattatcgctttgatcaccactgctacaagacctgtccagagaagacttattccgaggaggtggagtgcaaagcctgcgacagcaattgtggaagctgtgaccagaatggatgttactggtgtgaagagggatttttcctcctcggtggctcttgcgtgcggaagtgcgggcccggcttctatggtgaccaagagatgggggagtgtgagagctgccacagagcatgtgagacttgcaccggccctggccacgatgagtgttcctcctgtcaggaaggcctgcagctactgcgggggatgtgcgttcacgctacaaaaacacaagaggaggggaagttttggaacgaagcggtgtcaaccgccaacttatctgtggtcaaaagcctgttacaagaacggcggagatggaaggtgcagattaagcgggatatcctaaggaaactgcagccctgccactccagctgtaagacgtgtaacggctccgctactctgtgcacctcatgcccaaaaggggcttacctcctggctcaggcgtgtgtatcatcctgccctcaagggacatggccttctgtacgcagtggatcatgcgagaattgcacagaggcttgcgcaatttgctcaggggcagacctttgcaagaagtgccagatgcagcctggacaccctctgtttctgcacgaaggtcgttgctacagcaaatgcccagaggggagctatgccgaggacgggatttgcgagagatgttcttcaccatgccgcacctgtgagggaaacgccactaattgccactcttgtgaaggtggtcatgtgctgcaccatggagtgtgtcaggaaaattgtccggagcgccacgtggctgtcaaaggagtgtgcaagcactgtcctgaaatgtgtcaggattgcatccatgaaaagacctgtaaagagtgcacaccggaatttttcttgcacgacgacatgtgtcatcagtcttgccctagaggattctatgccgacagtaggcactgcgtgccatgtcacaaggactgtctcgaatgttcgggtcccaaggctgatgactgtgaactctgtcttgaaagctcctgggtcctgtatgacggcctatgcttggaggagtgccctgcaggaacttactacgagaaggagaccaaggaatgtcgggactgtcataaatcctgcctaacctgctcatcctctggcacctgcacaacatgtcaaaaaggactaattatgaatcctaggggctcgtgcatggcaaacgagaaatgtagccctagcgaatattgggacgaggatgcccctggatgcaaaccatgtcacgttaaatgcttccattgtatgggaccagctgaagaccagtgtcagacatgtccaatgaactctctgttgctaaataccacttgcgtaaaggactgccccgaagggtattatgccgatgaggattcgaaccgctgtgctcactgccactcttcgtgtcgaacatgcgaggggagacactcgaggcagtgtcattcttgtcgcccaggatggttccagctcggcaaagagtgtcttctgcaatgtcgggaggggtactacgccgacaatagcaccgggaggtgcgaacgctgcaaccggtcctgtaaaggctgccagggaccacgcccgactgactgtttatcttgcgaccggtttttcttccttctgagatccaagggcgagtgtcaccggagctgccctgatcattactacgtggagcagtccacccagacttgtgaacgatgccaccccacctgtgaccagtgtaagggtaagggggctttaaattgcttatcttgtgtgtggagttatcaccttatgggcgggatctgcacctcagattgcctggtgggggaatacagggtgggggaaggcgagaaatttaactgcgaaaaatgccacgagtcgtgcatggagtgtaagggacctggggccaagaattgcactctctgtcccgcgaatctcgtactgcacatggacgatagccactgtctgcattgttgcaatacgtcggacccccccagcgcgcaggaatgttgtgattgccaggatactacggacgagtgcatccttcgcacttctaaggttaggccagctacggagcattttaagactgcattgtttatcaccagctcaatgatgcttgtgctcctactgggagcagcggtggtcgtgtggaagaaaagtcgcggaagggttcagccagcggccaaggccggctacgaaaagctagctgatcctaataaatcatatagcagttataaatctagctatcgtgaatccacctcattcgaagaagatcaagttattgagtatcgagaccgcgactatgatgaggatgacgatgacgatatagtctatatgggccaggatggtaccgtgtatcgaaagttcaagtatgggcttctggatgacgacgatatagacgagctggagtacgatgacgagtcctattcttattatcaatag

SEQ ID NO: 200965 - DNA, 306 bp, Artificial Sequence
  Description of Artificial Sequence: Synthetic coding sequence
tgccagccctgccaccggttctgcgccacctgcgccggcgccggcgccgatggctgcatcaactgtaccgaaggctactttatggaggacgggagatgtgtgcagtcctgttcaatctcctactacttcgatcatagttcagagaatggctataagtcgtgcaaaaagtgtgatataagctgtctgacatgcaacgggcctggtttcaaaaattgcacatcttgcccttcaggctatttactcgacctgggaatgtgccagatgggggctatatgtaaggatgtatcattgtttcgtggcgcctag

SEQ ID NO: 200966 - DNA, 5583 bp, Artificial Sequence
  Description of Artificial Sequence: Synthetic coding sequence
atgggctggggcagccggtgctgctgccccggccggctggacctgctgtgtgtcttagctctcttggggggctgcttgctgcctgtatgtcgcacacgtgtatatacgaaccactgggcagtgaagatcgcagggggcttcccagaagccaaccgaatcgcttctaaatacgggttcattaacatcgggcaaataggcgctttaaaagattactaccatttttatcatagtcggaccattaagagaagcgtcatcagcagcaggggaacgcactccttcatctcaatggagcctaaagtagagtggattcagcaacaggtggtgaagaaacggactaaacgcgactacgacttcagtagggcacaatctacctacttcaatgatcctaaatggcccagtatgtggtacatgcattgtagtgataacactcatccctgtcagtccgatatgaatattgaaggtgcttggaaaagaggctacacgggcaagaacatcgtggtgaccatccttgacgacggcattgaaaggacacacccggatctgatgcagaattacgacgctttggcctcttgcgatgttaacggcaacgatctggacccaatgcctaggtacgatgccagtaatgagaataaacacggcacacggtgtgccggagaggttgcagcagctgcgaataactcacattgcactgtggggattgccttcaatgctaaaattggaggtgtgaggatgctggatggggatgttacagatatggtcgaggcaaaatctgtctcctttaatccccaacacgtccacatttactccgcatcttggggccctgacgacgatggtaagactgtggacggtcccgcccccctgaccagacaggccttcgaaaatggggtcagaatggggagacgaggtcttggcagtgtgttcgtttgggctagcggcaatggcggacgctccaaagaccattgttcctgcgatggctatacgaattcaatatacacgattagtatttccagtacagcagaatctggcaagaagccttggtacctggaagagtgctcatccaccctcgccaccacctacagcagcggcgaaagctatgataagaaaataattacaaccgacctgcggcaacgttgcaccgataaccatacaggtacctctgcaagcgcccctatggcggccgggattatcgcactggccttggaggcgaatcctttcctgacgtggagagatgttcaacacgtgattgtgcgcactagccgtgccgggcacctgaacgccaatgattggaaaacaaacgcggcaggcttcaaggtgagccacctgtacggtttcggtctgatggacgcagaggccatggttatggaagctgaaaagtggacgacagtgccacgtcagcacgtgtgtgttgaatcaaccgacaggcagatcaagaccataaggcccaacagtgctgtacggagtatctataaagcctctggatgctctgacaaccccaatagacatgtgaactacctggagcatgttgtagtcagaatcactatcacccatccacgccgcggagacctggctatttacctcacttccccctctggcacacggtctcagctgttggctaatagattgttcgaccactccatggagggtttcaaaaactgggagtttatgaccattcattgctggggggagcgtgctgcaggtgattgggtgcttgaggtctatgatactccatcacagctgcggaatttcaaaacccccgggaagctgaaggaatggtcgctggtgctgtatgggacttcagtgcagccatacagccccacgaatgagtttcccaaggttgaacgctttagatattccagagtggaggaccctacagatgattatgggaccgaggactacgccggtccttgtgatccagagtgcagcgaagtcggctgcgacggcccaggccccgatcattgcaacgactgcctacattattactacaaactgaagaacaatactcggatatgcgtgagctcttgtcctcctgggcattaccatgccgacaagaagcgctgtcgtaagtgcgctcctaactgtgagtcctgctttgggtctcacggcgaccagtgcatgagttgcaagtacggatatttcctaaatgaagagacaaactcatgtgtgactcactgtcctgacgggtcttaccaggacaccaagaaaaatctgtgtcgaaagtgctccgaaaactgtaaaacatgtacagagttccacaactgcacagagtgccgcgacggtttatcactccagggaagtaggtgctctgttagttgtgaagatggacgttacttcaacggacaggattgccagccatgtcataggttttgcgctacttgtgctggagccggagctgacggctgcattaattgcacggaggggtactttatggaagatggccggtgcgtccaatcttgctcaatttcatattactttgatcactcaagcgagaatgggtacaaaagttgtaagaagtgtgatattagctgcctgacatgtaacggaccggggttcaaaaactgtacctcctgcccctccgggtacctccttgacctcggaatgtgtcagatgggtgcgatttgtaaggatggagagtacgtggacgagcatggtcactgtcagacttgtgaggccagttgcgcaaaatgtcagggcccaacccaggaggactgtaccacctgccctatgactagaatcttcgacgacgggcggtgtgtgagcaattgcccatcctggaaattcgaattcgaaaaccagtgtcacccttgtcaccatacgtgccagcgatgtcaggggtccggaccgactcattgcacatcttgcggcgccgataactacggacgggagcattttctgtaccagggcgagtgtggagattcctgtccggaggggcattacgcaacagaggggaatacctgcctgccttgtccagataattgcgaactctgccattccgttcacgtgtgcacacggtgcatgaaaggttatttcattgcacctactaatcacacctgccagaaactggagtgtgggcaaggtgaggtgcaggatcctgactacgaggaatgcgtgccctgcgaagaaggctgtttaggctgcagtcttgatgacccagggacctgtacctcttgtgccatggggtattaccgctttgaccaccactgctacaaaacgtgccccgagaaaacatacagtgaggaggtcgaatgcaaagcctgtgactctaactgtggcagctgcgatcagaatggatgctactggtgcgaagaaggctttttccttctgggaggtagctgcgtgcgcaagtgtggaccgggtttttacggcgaccaggagatgggtgaatgcgaaagctgtcatagagcttgtgaaacgtgtaccggtcccggccacgacgagtgcagtagctgccaggaggggctgcaactccttcggggcatgtgcgttcatgccactaaaacccaggaggaagggaaattctggaacgacattttgcggaagctacaaccctgccatagtagctgcaagacctgcaacgggagcgccactctgtgcacgtcttgtcccaagggtgcttatctgctggctcaggcttgcgtatcgagctgcccacagggcacttggcctagtgtgaggtccggatcctgcgagaactgcacagaagcttgtgccatctgtagcggtgctgatctatgtaaaaagtgccagatgcagcctggacacccgctgtttctccacgagggtagatgttacagtaaatgtcctgagggctcctacgccgaagacggcatttgcgagcgttgcagttctccctgcagaacttgcgaagggaatgcgaccaattgccacagctgcgagggtggccatgtgctgcatcacggcgtctgtcaggagaactgccctgagagacacgttgcagttaagggagtgtgtaaacactgccccgaaatgtgccaagactgcatccacgaaaaaacttgtaaggagtgtactcccgaatttttcttgcacgatgatatgtgtcatcagagttgtccccgggggttctatgccgacagcagacactgcgtgccatgtcataaagattgtctggagtgtagcggcccgaaagctgacgactgtgagctgtgtctcgagagctcctgggtcctctacgatgggctctgcctggaagaatgccctgccgggacctactacgagaaagagacaaaggagtgccgggattgtcataagagctgcctcacatgttccagcagcgggacatgcactacgtgccagaagggcttgataatgaatcctagaggcagttgcatggccaatgaaaaatgttctccgagcgagtactgggacgaggacgcccctggctgcaagccctgccatgttaaatgttttcattgtatggggcctgcagaagatcagtgccagacctgcccaatgaactcactgttgttaaataccacatgtgtcaaggactgtccagaggggtactatgccgacgaagactccaaccgctgcgctcactgccactcctcatgtcgaacctgcgaaggaaggcactcgcgccagtgccattcctgcaggccaggatggtttcagttgggcaaggagtgcctgttgcaatgtcgtgagggctattatgcggataacagcactggacggtgcgagagatgtaatcgttcttgtaaggggtgccaaggcccgcgccccaccgattgcctttcatgcgaccgattcttcttcctgttgcgctccaaaggagaatgccataggagctgccccgatcactattacgtggagcagagtacccaaacgtgtgaacggtgccaccctacatgtgatcagtgcaagggaaaaggagccttgaactgcctttcgtgcgtgtggtcatatcacttaatgggcggaatttgcacaagcgactgtttggtgggggaatatcgggtgggcgaaggtgaaaaattcaactgcgagaagtgccatgagtcatgtatggagtgtaaggggcccggtgccaagaattgtacactctgtccagcaaacctcgtgttgcatatggacgattcacactgtcttcactgttgtaacacctcagaccctccatcagctcaggagtgttgcgattgtcaggacacaaccgacgaatgcatcttgaggactagcaaagtgaggcctgcaacagaacatttcaagaccgcccttttcatcacttctagtatgatgctagtgcttctattgggggccgcggtcgtggtgtggaaaaagtcccgcggtcgtgtgcaaccagccgcaaaggcaggctatgagaagctggcagatcctaacaagtcgtattcaagctataagtcttcatatcgcgaatctactagcttcgaggaggaccaggtgatcgaatacagggaccgagattacgacgaggacgacgacgatgacatcgtgtacatgggacaagacggcaccgtatatcgcaagtttaagtatggccttcttgacgatgacgacatcgacgagctggaatacgatgacgagtcctatagctactatcagtag

SEQ ID NO: 200967 - DNA, 1497 bp, Artificial Sequence
  Description of Artificial Sequence: Synthetic coding sequence
atctggaacgtgcaccactgcggcgacaagaacagccggtgccggagcgagatgaatgtccaagccgcctggaagagaggctacactggtaaaaatgtggtggttacaatcctggatgatggaattgagcgaaatcacccagatcttgctccaaactatgattcctatgccagctatgatgtgaacggcaacgattacgacccatcccctcgatatgatgcatctaacgagaacaaacacggcaccaggtgtgccggagaggtcgcggcttctgcaaataatagttactgtatcgtgggcattgcatacaatgccaaaattggggggatcaggatgttagatggcgacgtgacagatgtggtcgaggctaaatcccttggaatccgtccaaattacatcgacatctatagtgcatcttggggccccgatgacgacggcaagaccgtggacgggcctgggcgcctggctaagcaggcctttgagtacggaatcaagaagggcaggcagggcttggggtctatattcgtgtgggccagcggcaacggggggcgggagggggactactgcagctgcgatgggtacaccaattccatatacaccatctctgtgagctctgctaccgagaatggttacaaaccatggtacctggaagaatgcgcgtccacgctcgctaccacatactcaagtggtgccttttatgagaggaaaattgtgactaccgacttgcgacaaagatgtacggatggtcacaccggaacatccgtgagcgcgccaatggtcgcaggtattatcgccctggctttggaggctaactcccagctgacatggcgcgatgtgcaacacctactggtgaagacatcgcgaccagcccatctgaaagcctctgattggaaagtcaacggtgcaggccataaggtctcccacttctatggctttggccttgttgacgctgaggccctggtggtagaggccaaaaagtggacagcagttccgtcccagcatatgtgcgtggcagcctctgacaagagaccgcggagcattcccctcgtgcaggtgctgcgaacaactgctcttacttcagcctgcgccgagcacagcgatcaacgggttgtttatcttgagcatgtggtggtgagaaccagcatttctcatccccggcgcggcgacctgcagatctacttggtgtctccgagtggcacaaaatctcagctcttggccaagcggctgctggatctgagcaatgaggggtttaccaactgggagttcatgactgtgcactgttggggagaaaaagccgagggccagtggactctcgagattcaggacctgcctagccaggttagaaaccccgagaagcagggcgatcttgagactcctgttgcaaaccagctgaccacagaagaaagatttgtgagtaccctgtctatcctttttcactggtccgtgtacctgtcttggagccagtaccacatcgttcttattactgtggccctgtag

SEQ ID NO: 200968 - DNA, 1956 bp, Artificial Sequence
  Description of Artificial Sequence: Synthetic coding sequence
atgcccccccgggccccccccgcccccggcccccggcccccccccagggctgccgcggcgactgacactgccgcgggcgccgggggggcaggcggagccggcggtgctggaggccctggatttcgcccactggcccctagaccttggcggtggctgctgctgttggcactaccagccgcatgcagtcccccaccccgaccggtttacacgaatcattgggcggtgcaggttctcgggggaccggcagaagcagaccgcgtcgccgcagcccatggctacctgaacctgggacagatcggaaatctagaggattattaccacttctatcactccaaaacatttaaacgctccactcttagctcacgcggccctcataccttcctccgcatggatccacaagtgaagtggttgcagcagcaagaggtaaagagaagggtaaagagacaggtcagatcagatcctcaggctttgtactttaacgatcccatatggtccaatatgtggtacttgcactgcggggacaagaatagccgctgccgctccgaaatgaacgtccaagctgcctggaaaaggggctacacagggaagaacgtggtggttaccatcctagacgatgggattgaaaggaatcatccagatctcgctccgaactacgacagctatgcgagctacgacgtaaacggaaacgactatgatccaagcccgcgctacgacgccagcaacgaaaataagcacgggacacggtgcgccggggaagtcgcagcttcagccaacaattcatactgtattgtcggcatcgcatacaacgcaaagattgggggcatccggatgctggacggcgacgtgaccgacgttgtggaggccaagagtcttgggatcagacctaactacattgacatctacagtgcctcctggggccccgatgatgacggcaagacagtcgacgggcccggccgactcgccaaacaggcttttgaatatggaatcaaaaagggacggcagggactcgggtcgatttttgtttgggcatcagggaatgggggccgagaaggagattactgtagttgtgacggctacactaattccatctatacaatttcagtctcctccgctacggaaaacggctataaaccttggtatctcgaagagtgtgcgagcacgctggcaaccacatattcatcaggagcattttacgaaaggaaaatcgtgacgacagacctgcggcagaggtgtaccgacggtcacactggaactagtgtttccgcaccgatggtggctggcatcattgccctggcattggaagcaaattcgcagctgacctggcgcgatgttcagcacttactagtgaagactagcaggcctgcccatttaaaggcaagcgactggaaagtcaatggagctggacacaaggtgtcacatttttacggtttcgggcttgtagatgcagaagcactggtggtggaggctaaaaagtggaccgcagttccctcacagcacatgtgcgtggcagctagcgataagcgcccacggtccatcccgctcgtgcaagtcctccgcactacagcactgaccagcgcatgcgccgagcattctgatcagcgggtcgtgtacctggaacatgtcgtggtgaggacctcaatctcacatcctcgccgaggggacctgcaaatttacctggtgtccccatcagggactaagagccagttactcgccaagagactgctggacttgagtaacgagggttttactaattgggagttcatgacggttcactgttggggcgaaaaggctgaaggacagtggacactggagatccaggacttaccgagtcaggtcagaaatccagagaagcagggtgacctggaaaccccagttgctaatcaactaacaacagaagaaagggaacccggcctcaagcacgtgtttcgatggcagatagaacaggagctctggtag

SEQ ID NO: 200969 - DNA, 2907 bp, Artificial Sequence
  Description of Artificial Sequence: Synthetic coding sequence
atgcccccccgggccccccccgcccccggcccccggcccccccccagggccgccgccgccacagacacagcggccggcgctggtggagccggaggggcaggcggcgctgggggcccaggctttaggccgctggcccccaggccatggcgctggcttcttcttctcgcactccctgccgcctgctcgccaccaccacggccggtttatactaatcactgggctgtgcaggtgctgggcggccctgctgaggcagaccgggtcgcagcagctcatgggtatcttaatctgggacagatagggaacctcgaggattactaccatttctatcatagcaaaaccttcaagcgctccactctgtcttccagggggccccacacattcttaagaatggacccacaagtgaagtggctgcagcaacaggaggtcaaacgtcgagtgaaaagacaggtgcggtctgacccacaggccctctattttaatgaccccatctggagcaatatgtggtacctgcattgtggcgataaaaattcccggtgtagaagcgagatgaacgtgcaggccgcttggaagaggggttacaccggaaagaacgtggtagtgaccattctagatgatggcatcgagaggaaccatcccgatctggcccccaattatgacagctacgcaagttacgacgtcaatggcaacgattacgaccctagcccccgttatgatgcatctaacgagaacaagcatggtactagatgtgcaggtgaagtggcggctagcgctaacaactcctactgtattgtcgggatcgcatacaacgccaagatcggagggatcaggatgctggacggcgatgtgacagacgtcgtcgaagctaagtccctgggaatacgacccaactatattgacatttattccgcctcatggggacctgacgacgatggtaagacagttgatggaccaggtaggctggccaaacaggcatttgaatacgggattaaaaaggggaggcaggggttggggagcattttcgtttgggcctcgggtaatgggggtcgagagggcgactactgtagttgcgacgggtatacgaactctatttacactatttctgtgagctctgccacggaaaacgggtataaaccctggtatcttgaagagtgtgctagcacccttgctactacctactcaagcggggcattctatgagcgaaagatcgtaactaccgatctccgacagagatgcacggatgggcataccggcacaagcgtgagtgcaccaatggtggctggtatcatcgcactggctcttgaagcaaatagtcaactgacgtggagagacgtgcaacacctgttggtcaagacttctcggcccgcacacctaaaggcgagtgactggaaagtcaacggcgcaggacacaaggtatcacacttttatggtttcgggctggtggatgcagaggcgctggttgtcgaggcgaagaaatggacagccgtaccatcgcagcatatgtgtgttgccgcctcagataaacgcccccggtcaatcccactggtacaagtgctgcgaaccaccgctcttacctccgcgtgcgcggaacactctgatcagagagtcgtgtaccttgagcacgtcgtagtgagaactagtattagccaccctcgtagaggagatctgcaaatctacctcgtatccccaagtggcaccaaatcccaactgctggcgaagagactccttgacctctccaatgagggatttaccaattgggaatttatgacagtacattgctggggcgagaaagccgaaggccagtggaccctggaaatccaggacttaccctcacaggtcaggaacccggaaaagcaggggaagcttaaagaatggagccttatcttatatggcactgccgaacatccctatcatacctttagcgcccaccagagccggtcacggatgctggaactctcagcacctgaattggaaccccctaaagccgccctgagcccttcccaggtggaagtgccagaagacgaagaggattacaccgctcagagtaccccaggttcggcaaacatcctgcagacgtcggtgtgtcaccccgaatgtggtgacaagggatgtgatggtcctaacgctgatcaatgtctcaactgtgtacactttagtttaggctctgtaaaaacaagtcgcaagtgcgtgagcgtgtgtcctctggggtattttggtgatacggccgcccggaggtgccgccggtgccacaagggctgtgagacatgttcgtcaagggccgcaacacagtgcttgtcttgcaggcgggggttctaccatcatcaggaaatgaatacatgcgtgacactgtgtcctgccgggttctatgccgacgaatcacaaaaaaattgtcttaaatgccacccatcatgcaaaaaatgcgtcgacgagcctgagaagtgcactgtgtgcaaggaaggcttctctctcgccagagggagttgtattcctgactgcgagccaggcacttacttcgacagcgagttgattaggtgcggtgaatgtcaccacacctgtggaacctgtgtaggccccggcagggaggaatgtattcactgtgccaagaattttcacttccatgattggaaatgcgtgcctgcctgtggtgagggcttttaccccgaagagatgccaggccttccccacaaagtttgccgcagatgcgatgagaattgtctctcctgtgccggctcctcccgcaactgtagcaggtgtaaaacaggttttactcagctaggaacgtcatgcatcactaaccatacctgtagtaatgcggatgagaccttctgcgaaatggtcaagtcaaatagactgtgtgaacggaagttgtttatacaattctgctgccgcacatgtctcttggccgggtag

SEQ ID NO: 200970 - DNA, 2868 bp, Artificial Sequence
  Description of Artificial Sequence: Synthetic coding sequence
atgcccccccgggccccccccgcccccggcccccggccccccccccgggcagccgctgctacggacacagcggcaggggctgggggcgccgggggtgcaggcggcgccggcgggcctggctttaggccactggccccacgcccctggaggtggctcctactgcttgcccttcctgctgcctgcagtccaccaccaagacctgtgtacacaaaccactgggccgttcaggtgctgggcgggcctgcggaggctgatcgtgtggctgccgctcacggatacctgaatctggggcagattgggaacctggaagactactaccatttttatcactcgaagacattcaagcgttcgaccctctcctcgcgcggaccccacacctttctgcgcatggacccccaagtcaagtggctgcagcaacaggaggtgaagcgccgggttaagaggcaagtgcggagcgatccacaggccctttatttcaatgaccccatatggagcaatatgtggtacctacactgcggagacaagaactctcgctgcagatccgagatgaacgtgcaggcggcttggaaaagaggctacaccgggaagaatgttgtggtaaccatcctggacgacggaatcgaaaggaaccacccggatctagctcctaactatgactcctatgccagctatgatgtaaacggcaacgactatgatccgtcgccaaggtacgatgcatcaaacgaaaataagcatgggaccaggtgcgcaggggaagtggccgcatcggccaacaacagctactgcattgttgggattgcgtacaatgcaaaaattggggggattaggatgctggacggcgacgttactgacgtggtcgaggcgaagtccctgggaatccgacccaactatattgacatctattctgccagttggggcccagatgatgacgggaagactgtggatggaccaggtcgactcgcgaagcaggcttttgagtatggcatcaagaagggccgccaggggctgggaagcatatttgtgtgggcttcgggaaatggtggtcgcgaaggagattattgttcctgcgacggctatacgaactcaatttatacgatctctgtaagttctgcgacggaaaatggctacaaaccttggtatctagaggaatgcgcctctacacttgcaaccacatacagttccggcgctttttacgagcgcaagatcgtcaccacagacttgagacagaggtgcaccgatggtcacactggcacaagcgtctcagcccccatggtggccggcatcatcgcgttggcattagaggcgaacagtcagctcacctggcgagatgtgcagcatctgttggtgaagacctcacggccggcacacctgaaggcatctgactggaaagtgaacggagcagggcacaaagtgtcccacttttacgggttcggtctggttgacgcagaggctttggtggtggaagccaaaaagtggacggcagtgcccagccagcatatgtgtgttgcggcatccgacaaacgtcctaggtccatccccctcgtacaagtgctccgcactaccgcccttactagtgcatgcgctgaacactccgatcaacgggtagtctaccttgaacacgtcgttgttcgcacttctatttctcatccaagacgaggagacctccagatctatctggtctcacccagcgggacaaaatcccagttgctagctaagcggctgctggacctctctaacgagggattcacaaactgggagtttatgactgttcactgttggggcgaaaaggccgaaggccaatggacattagaaattcaggacttacctagtcaggtccggaacccagaaaagcagggcaaactgaaggaatggtccctgattctgtatggaacagcagagcatccatatcatactttttccgctcaccagtccagaagccgaatgctggaattaagtgcaccagaactcgagccgcccaaggctgccctgtcccctagtcaggtggaggtcccagaagacgaggaggactataccggagtgtgccaccccgaatgtggagacaagggctgtgacggtcccaatgccgaccagtgcttgaactgtgttcacttttctcttgggtcagtcaagacgtcacgaaagtgtgtttccgtgtgtcccttggggtacttcggggataccgccgcccgcaggtgcaggcgatgccacaagggatgcgagacttgcagcagccgcgccgctacacaatgcctaagttgccggcgcggattttatcatcatcaggaaatgaatacttgcgttactctgtgtcccgcagggttctatgcggatgagtcccagaagaactgcctgaaatgtcacccgtcttgtaagaaatgcgttgatgaacccgaaaaatgcacagtatgtaaagagggtttctctctggcaagggggtcctgtatccccgattgtgaacctgggacgtacttcgattcagagctgatccgctgcggcgagtgtcatcacacttgtgggacatgcgtgggacccggcagggaagaatgtatccattgcgccaagaacttccatttccatgactggaagtgcgtcccagcatgcggtgagggcttctatcccgaagagatgccaggcctccctcacaaagtgtgccgccgatgcgatgaaaactgcctgagctgcgcgggctcctctcgtaattgttcccgttgcaaaaccggttttacacagcttggcacatcttgtattacaaatcatacttgtagcaatgccgacgagacattttgcgagatggtaaaaagcaatcgtctctgcgagcgtaaactattcatccagttctgttgtagaacctgcttattagcgggatag

SEQ ID NO: 200971 - DNA, 1869 bp, Artificial Sequence
  Description of Artificial Sequence: Synthetic coding sequence
atgcccccccgggccccccccgcccccggcccccggcccccccccagggcggccgccgcaacagacacggctgccggggctggaggcgctggaggggcgggtggagctggaggcccaggttttaggccactcgctccacgcccgtggcgctggcttctgctcttggcacttcctgcagcttgtagcgccccaccaaggcccgtgtacaccaaccactgggccgtgcaagtcctcggcggccccgccgaggccgacagagttgccgccgctcacggctatctgaacctcggccaaattggaaatctggaagattactaccacttctaccacagtaaaacctttaagcgctctacgctgagcagcagaggcccgcatacctttctgagaatggatccgcaggtcaagtggctgcaacagcaggaggtcaagaggcgcgtgaagagacaggtgcgcagcgatccccaggcactgtatttcaatgacccgatctggtcaaatatgtggtatctgcactgcggtgataagaactctcgttgtcgctccgaaatgaacgttcaggcggcgtggaaacgcgggtacaccggtaagaacgtagtggtaacgattcttgacgacggaatagaaaggaaccatcccgaccttgcaccgaattacgactcctacgccagttacgatgtgaacggtaatgactatgacccatcgccccgttacgatgcctctaacgaaaataagcatggcacacgatgtgctggagaagtagcggcctcggcaaacaattcctattgcattgtcgggattgcttataacgccaagatcgggggcattcggatgttggacggagacgtgacggacgtagtggaagcaaaaagcctaggaatccggcccaactatattgatatctactctgcgagttggggccctgatgacgacgggaagaccgtggacgggcctgggaggcttgccaagcaagcattcgaatacggcattaagaagggtcgtcagggcctaggatccatttttgtttgggcttccggcaacggcggtcgcgagggcgactattgctcatgtgacgggtataccaacagcatctacaccatctccgtgagcagcgccaccgagaatggctacaagccctggtacctggaggagtgcgcttcaacgctcgccaccacatacagctccggcgcattttatgagagaaaaattgtgacaactgatttgcggcaaagatgcactgacggccacaccgggacaagtgtctctgcacccatggtggctggaataatcgccctggctctggaggcaaatagccagctgacatggcgggatgttcagcacttacttgtgaagacatcaaggccagcccatctgaaggcaagtgattggaaagtgaacggcgccggccacaaagttagtcatttttatggcttcggccttgtcgatgcagaggccctggtagtggaagcgaaaaagtggaccgctgtaccctctcaacatatgtgcgtcgccgcatccgataagcgtcctaggtctatacctttggtgcaggtactgcgcaccacagcgctcacctccgcatgtgccgagcactctgatcagcgggtcgtgtatctggagcacgtcgttgtccgaacatccattagccacccccgacgtggggacctccagatctacctggtctcaccttctggcaccaaaagccaattattagcaaagcgattgctcgacctgagtaatgagggatttaccaactgggaattcatgaccgtgcactgttggggagagaaggccgaggggcagtggaccctggagatccaggatttaccaagtcaggtgaggaacccagagaaacagggcaaccttgattag

SEQ ID NO: 200972 - DNA, 1584 bp, Artificial Sequence
  Description of Artificial Sequence: Synthetic coding sequence
atgtacgccctgttcctgctggccagcctgctgggcgccgccctggccgggcctgtccttggcttaaaggagtgtacgcggggcagcgccgtgtggtgccagaatgtgaagacagcttctgactgtggagccgttaaacactgccttcaaaccgtgtggaataaacccactgtcaagtcactgccttgtgatatctgcaaggatgtggtgaccgctgctggggacatgctcaaagataacgctacggaagaggagattttggtgtacctagagaagacctgcgattggctgcctaagcctaatatgtctgcctcttgtaaggaaattgtcgacagttacctgccagtgatcctcgacatcataaagggagagatgtctaggcccggcgaagtctgcagcgcccttaatttgtgcgagagcctgcagaaacacctggctgaactgaatcaccagaagcaactggaaagtaacaaaatccctgagcttgatatgaccgaggtggtggccccatttatggccaatatacctctgcttttgtaccctcaagacgggccacgtagcaaaccacagccgaaggataatggtgatgtgtgccaggactgcatccaaatggtgacagacatccagaccgcagtgcgaaccaattcaacatttgtgcaggcccttgtggagcacgtaaaagaagaatgtgatcggctcggccccggaatggccgacatatgtaaaaattatatcagccagtacagcgaaattgccatccagatgatgatgcacatgtccgccgaacagccgaaggaaatctgtgctctggtgggcttctgcgacgaggtcaaagagatgcccatgcagacactggtgccggcaaaggttgcctccaagaatgttattcctgccctcgagctcgtcgagcccatcaagaagcatgaggtgcccgccaaatctgatgtctattgtgaggtttgtgagttcctcgtgaaggaggtgactaaactgattgataataataaaacagagaaggagattctagacgccttcgacaagatgtgctcaaagttgccaaaaagtctatccgaagaatgtcaggaggtggtggacacatatggtagctctatactgagcatcctgcttgaggaagtgtcgccggagttagtgtgcagtatgctccacctctgctctgggacacgccttccggcacttactgttcatgtaactcagcctaaagacggaggtttttgcgaggtctgcaagaaactggtaggttacctcgaccgcaatctggaaaagaactctaccaagcaggaaatccttgccgctctggagaagggatgctccttcttgcccgacccctaccaaaaacaatgcgaccagtttgtcgctgaatatgagccagtcctcatcgagattctggtggaagtgatggaccccagttttgtatgccttaaaattggagcatgcccctcagcgcataaacctctcctgggtacagagaagtgcatttggggtccgtcctactggtgccaaaacacagagacagccgctcagtgtaatgcagtggaacattgtaagaggcatgtgtggaactag

SEQ ID NO: 200973 - DNA, 1680 bp, Artificial Sequence
  Description of Artificial Sequence: Synthetic coding sequence
atgtacgccctgttcctgctggccagcctgctgggcgccgccctggccggaccggtgcttgggctgaaggaatgcactagggggagtgctgtatggtgccagaacgtaaaaactgcctccgactgcggcgccgtgaagcactgcctgcagacggtgtggaacaaaccaaccgtcaaatctcttccatgcgatatctgtaaggacgtcgtcacagccgctggggacatgctgaaagacaatgccacagaggaagaaattctggtttacctcgagaagacatgcgactggttaccaaagcccaatatgtccgcgagctgtaaggagatagtagatagctacttgcctgttattctggacatcatcaaaggcgaaatgtctcgacccggggaggtctgttctgctcttaacctgtgtgagtctttgcagaagcatttggctgagctgaatcaccagaagcagcttgagtctaacaagatccctgagttagacatgacagaagtcgtcgccccatttatggcaaacatccccctgttactgtacccgcaagacggtcctaggtcaaagccccagcccaaggataatggcgatgtctgtcaggactgtattcagatggtgaccgatatacagaccgccgtgcggaccaattcaacattcgtgcaggctctagtagaacacgtgaaggaagaatgcgatagacttggccctggtatggcggacatttgcaaaaattacatctctcagtattctgagattgctatccagatgatgatgcatatgcagcctaaggagatatgtgcgctggttgggttctgcgacgaggtgaaagagatgcccatgcagaccttggtgcccgctaaagtcgcttctaagaacgtgataccagcattagaactagtagagcctataaagaagcacgaggtgccagcaaagtcagacgtctactgcgaggtttgcgaatttcttgtcaaggaagtcaccaaactcatcgacaataacaagaccgaaaaagagattctggacgcatttgataagatgtgctcaaaattacctaaatctctctcagaggagtgccaagaggtagtggacacttacggctccagcatcttgagcattctgttagaagaggtctctccagagctcgtgtgttcgatgctccacttatgcagcgggacaaggctgcccgccttgaccgtccacgtaacgcagcctaaggacggaggcttctgtgaagtgtgtaagaagctggtaggctatctagaccgcaatctagaaaaaaactcaaccaagcaggagatcctggccgccctggagaaaggctgttcatttctgcctgatccataccagaaacaatgcgatcaatttgtggctgagtacgaaccggtgctgattgagattctggtggaggtgatggatcccagcttcgtatgtctgaagattggagcctgtccctcagctcacaaacccctgctcggaacggaaaaatgtatctgggggccttcctactggtgccaaaacaccgaaactgccgcccagtgtaatgctgtggaacactgcaagagacacgtgtggattggatgttggggagtaggggtgggcagttgtctttggcctacatgggctcccactctcctctctaccagcgggtgtcaggagactgcatcaaaggcatcccgaacttag

SEQ ID NO: 200974 - DNA, 723 bp, Artificial Sequence
  Description of Artificial Sequence: Synthetic coding sequence
atgtacgccctgttcctgctggccagcctgctgggcgccgccctggccggaccagtacttggcctgaaagagtgtacacgaggaagcgccgtgtggtgtcaaaacgtaaagacagccagcgactgtggtgccgtgaagcactgcctccagactgtgtggaacaagccaaccgtcaagtctttgccctgcgatatctgcaaggatgtagtcacagcagccggcgatatgctcaaagataatgctaccgaagaagaaatccttgtgtatttggaggtgagcccggagctggtgtgctccatgctccacctgtgttccggtactcggttacccgcgctgactgtgcatgtgacacaaccgaaagacggtggattttgcgaggtatgtaagaagctggtcggatatctggacaggaatttggagaagaacagtactaagcaggagattctcgccgctctggaaaagggatgcagctttctgccagatccctaccagaagcagtgtgatcagttcgtggctgagtacgagcctgtgctgatagaaatcctggtcgaggtgatggacccgtctttcgtatgtctgaagattggtgcatgcccaagcgcccacaagccgcttctcggcactgagaagtgcatttggggacccagttactggtgtcagaatacagaaaccgcggctcaatgcaatgctgtggaacactgtaaacggcatgtgtggaattag

SEQ ID NO: 200975 - DNA, 1581 bp, Artificial Sequence
  Description of Artificial Sequence: Synthetic coding sequence
atgtacgccctgttcctgctggccagcctgctgggcgccgccctggccggaccagtgctcgggctgaaagagtgtaccaggggctctgcggtctggtgccaaaatgtaaagacagcaagcgattgtggagctgtgaaacattgcctgcagacggtctggaataaacctaccgtcaagtctttaccttgcgatatttgtaaggatgtggtgaccgctgccggcgacatgttaaaggataatgccaccgaagaggagatcctggtgtaccttgaaaaaacatgcgactggctgcctaaaccaaacatgagcgcctcctgcaaggaaattgtggatagctatctacccgtaatccttgacattatcaagggggaaatgtcccgcccgggcgaagtttgcagcgcgctgaacttgtgtgagtctctgcagaaacacctcgcggaactgaaccaccagaaacaactggaaagcaacaaaattcctgagctagatatgactgaggtggttgcacccttcatggcaaacattcctctgctactctacccccaagatggcccacgcagcaaaccacaacctaaggacaatggggatgtgtgtcaggattgtatacagatggttaccgacatccagaccgccgtgcgtactaactccactttcgtacaggcactcgttgagcacgttaaagaggagtgcgatcgccttggaccaggcatggcggacatctgtaagaattacatttcgcagtacagcgaaatcgccatccagatgatgatgcacatgctgcaacagcccaaagagatctgtgccttggtgggcttctgcgatgaggtcaaggagatgccgatgcagactcttgtgccagccaaggtggccagcaaaaacgtgattcccgcacttgagctggtggaacctatcaaaaaacacgaagtgcctgccaagagcgacgtctactgtgaggtctgtgaatttctggttaaggaggtgacaaaactcatcgacaataataagacagaaaaggagatactggacgcctttgataagatgtgcagcaaactccccaagagtctgagcgaagaatgccaggaagtcgtggatacgtacggctcctccatcctatcgatcctgctcgaagaggtctcccccgaacttgtctgttccatgttacatctttgcagcgggacacgcctgccagccctcactgttcacgttacacagcccaaggacggaggcttttgcgaggtgtgtaaaaagctggtgggatacttggacagaaatctggagaaaaactccaccaagcaggagattctcgcagcactcgagaaagggtgttcatttctcccggatccttaccaaaagcagtgcgaccaattcgtcgctgaatacgagccagtgctgattgagattctggtggaggtcatggatcccagtttcgtgtgcttaaaaatcggcgcatgcccttcagctcacaagcctctgctgggcaccgaaaagtgtatatggggcccgtcctactggtgccagaacactgagacagctgcacaatgtaacgccgtcgagcactgtaaacggcatgtttggaattag

SEQ ID NO: 200976 - DNA, 1575 bp, Artificial Sequence
  Description of Artificial Sequence: Synthetic coding sequence
atgtacgccctgttcctgctggccagcctgctgggcgccgccctggctgggcccgtgctgggtctcaaagagtgtacaagagggtccgccgtgtggtgccagaatgtgaagaccgcctcagactgtggcgccgtcaagcattgcctgcaaaccgtttggaacaagcccaccgttaagtccctaccgtgtgacatttgcaaagacgtggttacggctgcaggcgacatgctgaaagacaacgctacggaggaggaaatactagtgtaccttgaaaagacctgtgattggctcccaaaacccaacatgtcagcttcatgtaaggaaatcgttgatagctacctccctgttatcctggacataataaaaggggaaatgtcccggcctggtgaggtatgctcagctctgaatttgtgtgagagtctgcagaaacacctggctgaattaaatcatcagaagcagctcgagagcaacaaaataccggaactggatatgacagaggtcgtggcaccatttatggccaacatcccactcctgctgtatcctcaggatggcccccggagcaagccgcagccaaaagataatggtgacgtgtgccaagattgcatccagatggtgaccgacatacagaccgccgtcaggaccaattctactttcgtacaggctctggtagaacacgttaaggaggagtgcgacaggctgggccctggaatggctgacatctgcaagaactatatttcccagtattctgagattgcaattcagatgatgatgcacatgcagcccaaagagatctgcgcgttagttggtttctgtgacgaagtgaaagagatgcctatgcagaccctggttccggccaaagtggcttctaaaaacgtgattccagccctggagctggttgaacctataaagaaacatgaggttcccgcaaaaagcgatgtgtattgtgaggtgtgcgagttccttgtcaaggaggtaaccaaacttattgacaataataaaacggaaaaagagatacttgatgcgtttgataaaatgtgttccaagcttccgaaaagtctgtctgaggaatgccaggaagtggtggacacttacggctcctcgatattgagtatactgctcgaagaagttagtcctgagctggtttgttcgatgcttcacctttgctcaggaacgcgtttacccgctctcaccgtgcatgttacccagccgaaagacggtggattctgcgaagtctgtaagaagctcgttggttatttggacagaaaccttgagaaaaatagcactaaacaggagatcctggcagccttggagaaaggatgctcattcctgcctgatccgtaccagaagcagtgcgaccaatttgttgccgaatacgagcctgtgctgatcgaaatcttggtcgaggtaatggacccttcctttgtgtgcttgaagattggagcctgtccaagcgcccataagcctctgcttgggacagagaaatgcatatggggccctagttactggtgccagaacacagagacggctgcccaatgcaacgccgtggagcattgtaaacgccacgtttggaattag

SEQ ID NO: 200977 - DNA, 1353 bp, Artificial Sequence
  Description of Artificial Sequence: Synthetic coding sequence
atgctgaaggacaacgccaccgaggaggagatcctggtgtacctggagaagacctgtgattggctcccaaagcccaatatgagcgctagttgcaaggagattgtagatagttacctccctgtaatactagacatcatcaagggtgaaatgtccaggccaggggaagtatgctctgcgttgaatctctgtgaaagcctgcagaagcatttagctgaattgaatcaccagaagcagctagagagtaacaagattcctgagttagatatgacggaagtcgtcgccccattcatggcaaacattcctctgctcctctaccctcaagacggccccaggtccaaaccccagccaaaagacaacggcgatgtttgtcaggactgtatccagatggtcaccgacattcagacggccgtcaggactaattcaacttttgtgcaagctcttgtagaacatgtgaaggaagagtgcgaccgactcgggcctggaatggctgatatctgcaagaattatattagtcagtacagtgagattgctattcagatgatgatgcacatgcagcagcccaaggagatttgtgccctagtaggcttctgcgacgaggtaaaagagatgccaatgcagaccctagtaccagctaaagttgccagtaagaacgtcatccccgctttggagctcgtcgaacctattaaaaaacacgaagttccagccaaaagcgatgtttactgcgaggtctgcgaattcctcgtgaaggaagtgaccaaactgatagacaacaacaaaaccgagaaagagatcctggatgctttcgacaaaatgtgcagtaagcttccaaagtccctgtcagaagagtgtcaagaggtggttgacacttacggctcaagcattttaagcatcctgttagaagaggtaagtcccgagttggtttgttccatgctacacctctgctcaggcacacgcttacctgccctaacagttcacgtcacccagccaaaggatgggggattctgtgaagtgtgcaagaagctggtgggatacctggaccgcaacctggagaagaattccacaaagcaggaaatcctcgcagctttggagaagggctgttccttcctccctgacccttatcagaaacagtgcgatcagtttgtggctgagtatgagcccgtactgatcgaaatcctggtggaggtgatggatcccagttttgtgtgccttaaaatcggggcatgccccagcgctcacaagccacttctcggcactgagaagtgtatctgggggcccagttattggtgccagaatacagaaactgctgcccagtgtaatgccgtcgaacactgtaagcgacatgtctggaattag

SEQ ID NO: 200978 - DNA, 1593 bp, Artificial Sequence
  Description of Artificial Sequence: Synthetic coding sequence
gacggcgccatgtacgccctgttcctgctggccagcctgctgggcgccgctttagctggacctgtactgggtcttaaggagtgcacccgtggtagtgccgtgtggtgtcagaatgtgaagactgcctccgactgcggggccgttaaacactgcctccagaccgtctggaataaacccactgtgaagagtttgccatgcgacatctgtaaagacgttgtgaccgccgcaggggacatgctgaaggacaacgcgacagaggaggaaattctagtatatctggagaagacctgtgactggctccccaagcctaatatgtctgctagctgcaaagaaatcgtggatagctatttgccggtgatcttggacatcatcaagggagagatgtcccggcctggggaggtgtgttcagccttaaatctctgtgagagtctccaaaagcatcttgcagagcttaaccaccaaaagcagttggagagcaacaaaattccggaactggatatgactgaggtggtcgccccgtttatggccaatattcccctgctgctctacccacaggatggaccaagatctaaaccacagcccaaggataacggggacgtgtgtcaagactgcattcaaatggtcaccgacattcagactgccgtccggacaaatagcaccttcgtccaagccctggtggagcacgttaaagaagaatgcgatcggctaggacccggcatggcagatatctgcaaaaactacatcagtcagtactctgagatcgccattcagatgatgatgcatatgtctgcagaacagccaaaggaaatttgcgctctggtcgggttttgcgacgaggtgaaagagatgccaatgcagaccctcgtgccagccaaagtcgcttcaaagaacgtaatcccagccctggagctggtcgagccaataaaaaagcacgaggttccagctaagagcgacgtttattgtgaggtgtgtgagttcctggttaaggaggtgacaaagctgattgacaataataagactgagaaagagatcctggacgccttcgataagatgtgctccaaattacccaaaagcctgtctgaagagtgccaggaagtggtggacacatacggttcaagcatactgagtattctgcttgaggaggtgtccccggaactcgtctgttctatgctccatctttgcagcggaaccagacttcccgctcttacagtgcacgttacccagcccaaagatggcggcttttgtgaagtgtgcaagaaactcgttggctacctggaccgcaatctcgagaaaaacagcacaaaacaagaaattctggcggctcttgagaaaggctgctcatttctgccagatccttaccagaagcaatgcgaccagttcgtagccgaatacgagccagtcttaatagagatcctcgtggaggtgatggacccaagctttgtgtgtctaaaaataggagcctgtcccagcgctcacaaaccattactggggaccgagaagtgtatctggggaccatcgtattggtgtcagaatacagagaccgccgctcagtgcaacgccgttgaacattgcaagagacacgtgtggaactag

SEQ ID NO: 200979 - DNA, 2214 bp, Artificial Sequence
  Description of Artificial Sequence: Synthetic coding sequence
atgcccgaccacgacagcaccgccctgctgagccggcagaccaagcggcggcgagtggacatcggtgtgaaaaggacagtcggaacagcctcggccttcttcgccaaagcccgggcgacatttttctcagcaatgaacccccagggatccgagcaggatgtagaatactccgttgtacagcacgccgatggcgagaagtctaacgtacttcggaagttgcttaaaagagctaactcctacgaggatgcaatgatgccatttccaggagcaactatcatcagccagttgttaaagaataatatgaacaagaacggaggaacagagccatccttccaggcctcagggctaagcagcaccggaagcgaagtgcaccaggaggacatatgtagcaacagctccagggactctccaccagagtgtctgagtcctttcggacggccaactatgagccagtttgatatggaccggttatgcgatgagcatcttcgtgcaaaacgcgcacgagtagaaaatattatccgcgggatgagtcactccccatcagtggccctgagggggaatgagaatgaacgcgagatggctccccaatccgtcagtcctcgagagtcttacagagagaataaacggaaacagaaactacctcagcagcaacaacagtcctttcagcagttggtttccgcgcggaaagagcagaaacgtgaggagcgtcgccagttgaagcagcagctagaagacatgcaaaaacaactaaggcagctccaggaaaagttttatcagatttacgactccacagacagcgaaaatgatgaggacgggaatttatcagaagactctatgcggtcagagattctggatgcccgagcccaggacagcgtgggcaggtccgataacgaaatgtgcgagttggacccagggcagtttatcgatcgggcccgtgccctaatccgggagcaggaaatggctgaaaataaacccaagagggaaggaaataataaagaacgggaccatggcccaaactccctgcagccagagggaaagcatcttgctgagaccctgaagcaagaattaaacacggccatgtctcaggtggtggacactgtggtgaaggtattttcagcgaagccatctcggcaggttccccaggtgttccctcccctgcagattccccaagcgcgcttcgccgtgaacggtgaaaatcataacttccataccgccaaccaacgtctgcagtgtttcggtgacgtcatcatacctaatccgctcgacaccttcggaaacgtgcagatggccagctcaaccgatcagacagaggctctgcccttagtcgtgaggaagaatagtagcgaccagtctgctagcggcccggctgcaggggggcaccatcagcctcttcaccagtctcctctgtctgcaaccacaggttttacaacaagcacatttaggcatccatttccgctgccactgatggcatatcccttccagtctcccctcggagccccttccggctcattcagcggaaaagaccgtgcatcccctgagagtctggacttaacacgagataccacatcactgagaaccaagatgtctagccatcacctgtctcaccatccctgttcacccgcacacccacccagcacagctgaaggactgtctctaagcctcataaagtccgagtgtggtgacctacaggatatgagcgaaatttcaccttattcgggcagcgcaatgcaggagggactgagtccaaaccacttgaaaaaagcaaaactgatgtttttttatacgcgctacccctctagcaacatgctgaagacatatttcagtgacgtcaaattcaatcgctgcatcacatcccagctgatcaaatggtttagtaacttccgtgaattttattatatccagatggagaagtacgcccgccaggccatcaatgacggggtgactagcactgaggaactgtctatcacaagggactgcgaactctatcgcgccctgaatatgcactacaacaaagcgaatgattttgaagtcccagagcgctttcttgaggttgctcagattaccctgagggaattcttcaacgcgatcattgcgggaaaggatgtggatccatcctggaagaaagcaatctacaaagtcatttgtaaactggattctgaagtgcccgagatattcaagagccctaactgtctgcaggagcttctgcatgagtag

SEQ ID NO: 200980 - DNA, 2031 bp, Artificial Sequence
  Description of Artificial Sequence: Synthetic coding sequence
atgcccgaccacgacagcaccgccctgctgagccggcagaccaagcggagacgggtcgatatcggagttaagcgcacagtcggaaccgctagcgccttttttgcaaaagcaagggctacctttttcagtgccatgaatccacaggggtctgagcaggacgtggagtacagcgtggtccaacatgccgacggcgaaaagtccaatgtactgagaaagctgctcaaacgggctaactcatacgaggatgcaatgatgcctttccccggggcaactatcattagtcagctcctgaagaataacatgaataagaacggaggaaccgagcccagttttcaggcgtctggcctctctagcacaggatccgaagtccatcaggaggacatctgttccaattcctctagggattctcctccagagtgcttaagtcctttcgggagaccaacaatgagtcagttcgatatggataggctgtgcgatgagcatctacgagccaagcgggcacgcgtcgagaacatcataagggggatgtctcacagcccttctgttgctctaagaggcaatgaaaacgagagagagatggccccacaatccgtgagtccccgggagtcctaccgcgagaataaacgtaagcagaaactgccccagcagcagcaacagagttttcagcagctggtttccgccaggaaggagcagaaacgcgaggaaaggaggcagctgaagcagcagctggaggacatgcagaagcagcttcgacaactccaggaaaagttctatcagatttacgactctactgactctgaaaacgatgaagacggcaatctgagcgaagatagtatgaggtcggaaattttggacgccagggcgcaagacagtgtgggcaggtcggataacgagatgtgtgagctagatcctggacagttcattgatagagccagggctctgattagagagcaggaaatggctgagaacaaacctaagcgggaaggaaacaacaaagagcgggaccacggcccgaacagcctgcagcccgaggggaaacatttagctgagacgcttaagcaggagttgaacaccgcaatgtcccaggtggtggatacagtggtcaaagtattctcggctaaaccttcacggcaggtcccacaggtgtttcctcctctccaaattcctcaggcgaggtttgcagtgaacggagaaaatcacaattttcacaccgccaaccagaggttgcaatgcttcggggacgtgattatccccaaccctctggacacttttggtaatgtccagatggcgtccagcactgatcaaactgaggcacttccattagtagtccgtaagaacagcagcgatcagtccgcttctggacctgcggcaggaggtcaccaccagccgcttcatcaatcccctctgtctgccaccacagggttcaccacatcgacgttccgtcatccatttcccctgcctcttatggcctatccgttccagtctcctttaggagccccctctggctcattcagtggcaaggatagagcgtcccctgagagtttggatttgactcgagacacaacctcactgaggactaagatgtctagccaccatttgagccaccacccctgttctcccgcacatccaccttctaccgcagaagggctcagcctgtctcttatcaaatcagaatgtggggacctacaggacatgtccgaaattagcccatattcagggtccgcgatgcaggagggcctgagccccaaccaccttaaaaaggcaaagttaatgtttttttatacccggtacccaagttccaatatgctgaagacctattttagcgatgtgaaatttaatagatgcataaccagccagctgatcaagtggtttagcaacttccgggaattctattatatccaaatggagaagtatgcccgccaagcgatcaacgatggggtgacaagcactgaagaactctcaattacacgcgattgtgagctctaccgggccctaaatatgcactacaataaagcaaacgacttcgagtag

SEQ ID NO: 200981 - DNA, 2214 bp, Artificial Sequence
  Description of Artificial Sequence: Synthetic coding sequence
atgcccgaccacgacagcaccgccctgctgagccggcagaccaagcgtaggagagtggacatcggtgtgaaaaggactgtcggtaccgccagtgcgttttttgctaaggccagggctacgttcttctctgctatgaaccctcagggaagtgagcaggatgttgaatactctgtggttcagcacgcagacggagaaaagtcaaacgtgttacgcaaactgctgaaaagggccaatagctacgaagatgctatgatgcctttccctggtgctaccatcatctcccagctgctgaagaacaacatgaataagaatggagggaccgagcccagtttccaagctagtggcctgtcatcaaccgggtcagaggtgcatcaagaggacatttgttccaatagttcacgcgactctcctcccgagtgtctgtcacctttcgggcggcctacaatgtctcaatttgacatggacagattatgtgatgagcatctccgcgctaaacgtgccagggttgagaatattattagaggaatgagtcattctccatcggtggccctgaggggaaacgaaaatgaaagggagatggctcctcagagtgtttccccacgggagagttaccgggaaaataagcgcaaacagaaactgccacaacagcagcaacagtcttttcaacagttggtttcggctaggaaagagcaaaagcgagaagagagacgacaactgaaacagcagctggaagatatgcagaagcagctgcgccagctccaagagaaattctatcaaatttatgattccacagattccgagaacgatgaagacggcaatctgagcgaagactctatgcgctccgagatactggacgctagagcgcaggacagtgttgggcgctccgacaatgagatgtgcgagctcgaccccggacagtttatcgacagagcacgagccttaatcagggagcaggagatggctgagaataagccaaagagagagggcaataataaagagcgcgaccacggaccaaactccttgcaacctgaaggcaagcatttggctgagacactcaaacaggaactgaataccgccatgagccaggtggtcgacaccgtcgtaaaggtgttttctgctaagcccagccgacaggtgcctcaggtcttcccccccttgcaaatccctcaggcccgatttgccgtcaatggcgaaaaccacaacttccacaccgctaaccagaggctccagtgtttcggcgatgtcatcatccccaacccactcgataccttcgggaatgttcagatggcttccagtactgatcagaccgaggccctgccgctagtggtgcggaaaaacagctccgatcagtcagcttcgggccccgcagcgggagggcatcaccaaccactgcatcagagtcctctaagtgcaacaaccgggttcacaacctctaccttcagacatcccttccccctgccattgatggcttatccttttcagtcaccccttggggcaccttcagggtccttctccggtaaagacagggctagtccagagtccctggatctgacaagagataccacgtcccttcgcacaaaaatgtcttcacaccacctgtcacaccacccctgtagcccagcgcacccaccttcgaccgctgagggcctaagtctttcccttatcaaatctgagtgcggcgacctgcaggatatgtctgagatctccccctactccggctctgctatgcaggagggcctatctcctaatcatttgaaaaaagccaagctgatgttcttttataccaggtacccatcatccaacatgctgaagacctatttctcagacgtaaagttcaacagatgcatcacgtcgcaactgattaagtggttcagtaacttccgggagttttactacatacaaatggaaaagtacgctaggcaggcgattaatgacggcgtgacatctaccgaagagttgtctattactcgggactgcgagctttatcgggctctgaacatgcactacaacaaggccaatgattttgaggtccccgagcgctttctggaggtcgctcaaattacactccgggagttcttcaatgccattatcgctggaaaggatgtggatccttcatggaaaaaagccatatataaagttatatgtaagctcgactctgaagtgcccgagatttttaaatctcctaattgtcttcaggaattactgcacgagtag

SEQ ID NO: 200982 - DNA, 693 bp, Artificial Sequence
  Description of Artificial Sequence: Synthetic coding sequence
atgcccgaccacgacagcaccgccctgctgagccggcagaccaagcgtaggagagtggacatcggcgttaaacgaacagtaggcacggcctctgcattctttgccaaggcaagggctacttttttttccgccatgaatccccagggctctgagcaggacgtcgaatatagtgtggttcagcacgcggatggtgagaagtcaaacgtgctccgtaagcttctgaagagggcaaactcctatgaggatgctatgatgccgtttcctggggccaccatcatctctcagctgctgaagaataacatgaacaagaacgggggaaccgaaccaagttttcaggcatccggactctcctcaaccgggtccgaggtgcaccaggaagacatttgctccaacagtagccgtgacagccccccagaatgcctgagccccttcggacgacccactatgagccaatttgatatggatagactctgtgatgagcacctgagagccaaaagggcacgcgtggagaatatcattcgcggcatgtctcactccccatcggtggctctgcgtggtaatgaaaacgagcgtgagatggccccccaatcagtgagccctcgtgaaagttatcgggaaaacaagaggaagcagaaattaccacagcaacagcagcaatcattccagcaactagtgtccgcacggaaggaatag

SEQ ID NO: 200983 - DNA, 2214 bp, Artificial Sequence
  Description of Artificial Sequence: Synthetic coding sequence
atgcccgaccacgacagcaccgccctgctgagccggcagaccaagcggagacgagtggatattggcgtaaagagaacagtgggtacagcttccgcctttttcgcaaaggcccgggccacctttttctccgccatgaatccgcaggggagtgaacaggacgtcgaatattctgtggtacaacacgccgacggggagaaatcaaacgtgctaagaaaactgctcaagcgggccaacagctacgaggacgccatgatgccgtttcccggtgctactattataagccagctcctgaagaataatatgaataaaaacggagggaccgagccatccttccaagcctcggggttgtcaagtacaggctccgaggtacaccaggaagacatctgcagcaactcttcccgcgactcccctccagaatgcctgtcaccgtttggccgtcctaccatgagccagtttgatatggacagactgtgcgatgagcatctgagagctaaacgcgcccgggttgaaaatattattcgggggatgtcccactcacccagcgtggcactacgcggtaacgaaaacgaaagagagatggctccccagagcgtcagtcctcgggaatcttaccgagagaataagaggaagcagaaactgccccagcagcagcagcagtcattccagcagctggtgtccgcccgcaaagagcaaaagagagaggagaggagacagcttaagcagcagctggaagatatgcagaagcagctgcggcagcttcaggaaaaattctaccaaatttatgattccactgattccgaaaacgatgaggacggaaacctatctgaggacagcatgcgcagtgaaattctcgatgctagagcgcaggattccgtggggcggagtgacaacgaaatgtgtgaactcgaccctggccagtttatcgaccgggcccgggccctgataagagaacaggaaatggctgagaataagccgaaacgagaaggaaacaacaaggagcgggaccacggccctaactcgctccaacccgaagggaagcacctggctgagactctgaagcaggagctaaacaccgctatgtcccaggtcgtggacaccgtggtcaaagtgttctcggccaagccatcccggcaggtaccccaggtgttcccaccattgcagatcccacaagcacgctttgccgtgaatggcgaaaatcacaacttccacacggccaaccagcgtctgcagtgcttcggcgacgtgattatccccaaccccctggacaccttcgggaacgtgcagatggcctcctctacggaccagacggaagcacttcccctggtggtgaggaagaatagtagtgatcaaagcgcttctgggcctgctgcaggtggccatcaccagcccttacaccagtcaccactgtccgccacaactgggttcaccacatcgacttttcgacacccattccccctgccactgatggcttacccattccagtctcctttgggcgcacccagcggcagtttctcgggaaaggatcgcgcgtcacctgagtctctcgacttaacgagggatactacaagcctcagaaccaagatgtccagccatcaccttagccatcatccctgctcccccgcccatccaccctcaactgccgaagggctttctctctcactgatcaagtcagaatgcggtgatctccaggacatgtcagagattagcccttattctggaagcgccatgcaagagggtctcagtccgaaccacttgaaaaaagcaaagctgatgttcttctacacacgctacccaagctctaatatgctcaagacatatttttccgatgttaagttcaaccgatgtataactagccagctgattaagtggttctctaattttcgagagttctactacatccagatggagaaatacgcaaggcaagctatcaacgatggagtgacttctacagaggaactgagcataactcgcgactgtgagctgtatagggctctgaacatgcactacaataaagctaatgattttgaagtacctgagcgtttcctagaggttgcccaaatcacacttagagagttctttaacgccattatagccggaaaggatgtcgacccatcttggaaaaaagcaatttacaaagtgatttgtaagctggactctgaggtgccagagatctttaagtcccctaattgtctgcaggagctgctccatgagtag

SEQ ID NO: 200984 - DNA, 930 bp, Artificial Sequence
  Description of Artificial Sequence: Synthetic coding sequence
atggccagcagcaccgaccagaccgaggccctgcccctggtggtgcggaaaaattcaagcgaccagtctgcgtccggccctgccgccggtggtcaccatcagcccctgcatcagtcccccctttcagccaccacaggcttcactacgtccacatttaggcatcccttccccctgcccctcatggcatatccatttcagagtcctttgggggcaccaagtggatcttttagcggtaaggatcgagcttctcccgagtccctggacctgacccgcgatactactagcctgcggactaagatgtcatctcatcatctgtcccatcatccctgcagcccagcccaccctccatcaactgccgagggattaagcctgagcctcattaagtccgagtgtggcgatctccaagatatgtctgagatctccccgtatagcggaagtgctatgcaggagggtctgtctcccaatcatctgaaaaaggccaagttgatgttcttctacacccgttatccgtcaagtaacatgcttaagacctacttctctgacgtaaaatttaaccgctgcatcacgtctcagttaattaaatggttttcaaacttccgtgaattctactacatacagatggaaaaatatgcaagacaggcgatcaacgacggcgttacttccaccgaggaattgagcatcacacgggactgtgaattgtacagagccctcaacatgcactacaacaaggccaatgatttcgaggtgccagaacggtttctagaggtggcccagataactctgagggagttcttcaacgccattatcgcagggaaggatgttgacccttcctggaagaaggccatctacaaagtgatatgcaaactggacagtgaagtgcctgagatattcaagtcccccaactgtctccaggaactgttgcacgaatag

SEQ ID NO: 200985 - DNA, 1080 bp, Artificial Sequence
  Description of Artificial Sequence: Synthetic coding sequence
atgaagagccccttctaccggtgccagaacaccaccagcgtggagaaaggcaatagcgccgtgatgggcggcgtattatttagcaccggccttctggggaacctgctagccctggggctgctcgcacgttcagggcttggatggtgtagcaggcgtcctctaagaccactccccagcgttttctatatgttggtgtgcgggctcactgtgacggatttgcttggaaagtgcctcttaagccctgtggtgctagctgcctacgctcaaaacaggtcactacgagtactggcaccagctctggataattctctgtgtcaagcctttgctttctttatgagtttttttggactgagttccacattgcaattgctggccatggccctggaatgctggcttagcctgggccatcctttcttttaccgcagacatatcacattgcgcctcggggctctggtcgcccccgtagtatctgcgttcagtctggcattctgcgccctgccatttatggggtttgggaagttcgtccagtactgtcccgggacctggtgctttattcaaatggtacacgaggagggatctttatctgtgttagggtatagcgttctctactcatcactgatggctctgctcgtgctggcaactgttttatgcaacctgggagctatgcgcaacctatatgcgatgcatcgtaggcttcaaaggcatccacgctcttgcactcgggactgtgctgagccacgggccgacggacgtgaagcatcaccacaaccactggaggaactggaccacctgctcctgttggccctcatgactgtgctgttcactatgtgcagcttgccagtaatctatagagcatactacggcgcgtttaaggatgtgaaagagaaaaaccggaccagcgaagaggcggaagacctccgcgccctcaggttcctgagcgtgatttctatcgtcgacccttggatctttatcatcttccgaagccctgtgtttcggatcttctttcacaagatattcattaggcccctgagatatcgatcccggtgctcaaattcaacaaacatggagtcctcattatag

SEQ ID NO: 200986 - DNA, 8034 bp, Artificial Sequence
  Description of Artificial Sequence: Synthetic coding sequence
atgagcacctgctgctggtgcacccccggcggcgccagcaccatcgactttctcaaacggtacgcctcaaatactccaagcggcgagttccaaactgcagatgaggatctttgttattgcttagagtgcgtggcagagtaccataaggcccgagatgagttacctttcctgcacgaagtgctttgggagctcgaaactctgcggctgatcaatcattttgagaagagcatgaaagccgaaattggggatgacgatgaattgtacatcgtggataacaacggggaaatgcctctctttgatatcacgggccaagacttcgagaataagctccgggtccctctcctcgagatcctcaagtacccataccttcttcttcacgagagggtgaatgagctctgtgtggaagccctatgtcggatggaacaagcaaattgtagcttccaggtgttcgataaacaccccgggatttacctgttcctggtacaccccaatgaaatggtacgtcggtgggccattctcaccgctagaaaccttggaaaagttgacagagacgactactacgaccttcaggaagtgttactctgccttttcaaagtgatcgagctgggccttttggagagccctgacatatatacctcctctgtgctggagaagggaaagttaatcctcctgccatctcacatgtacgatacaacgaactacaagagctattggttagggatttgtatgttgctgactattttggaagaacaggcgatggattctttgctgctaggaagtgacaaacaaaacgacttcatgcagagcatcctgcatacaatggagcgtgaggccgacgatgactccgttgaccccttctggcctgcactgcactgctttatggtcattttggatcgcctggggtcaaaggtctgggggcagctgatggaccccattgtggcttttcagactattatcaataacgcctcttataaccgtgagatcaggcatattcgaaattctagcgtgcgcactaagctggagcccgagagctatctcgacgacatggttacctgctcccaaatagtgtataactataatccggagaaaacaaagaaagactctggctggaggaccgccatttgtccggactactgccctaatatgtatgaggagatggaaacactcgcatctgttctgcagagcgacataggccaggatatgagggtccacaatagtacattcttgtggtttattcctttcgtgcagtcgcttatggacttaaaggatcttggcgttgcgtatattgcacaggtggtcaatcacctgtacagcgaagtaaaggaggtgctaaatcagactgatgctgtgtgcgataaagttactgaattttttttactcattctcgtttcggtgatcgagctgcaccggaacaaaaaatgcctacaccttttgtgggtgtcaagccagcagtgggtagaagctgttgtaaaatgtgctaagctaccgaccaccgcctttaccaggtcctcagagaagtccagcggcaattgctcaaagggcactgctatgatctcttccttaagtttacattctatgccgagcaacagtgttcagctggcgtatgtccagcttattaggagtcttctgaaggaaggctaccagctgggccagcaatccctatgtaaaaggttttgggacaaattaaacttgtttctgagggggaatttgagtctggggtggcagctgacatctcaagagacacatgaattgcagtcttgtctgaagcagattattcggaacatcaagtttaaggctcctccttgtaacacattcgtggacctcacctcagcctgtaagatctccccagcctcatacaataaggaagaatctgaacagatgggtaagacctctaggaaggacatgcactgtctggaggcttctagccctactttctccaaggaacctatgaaagtacaggactccgtgttaattaaggctgataataccatcgagggggacaacaacgagcaaaactatatcaaagacgtcaaattagaggaccaccttctggcaggttcttgcctgaagcaaagtagcaaaaatatcttcacagaacgagccgaggatcaaattaagatatcaacgcgaaagcaaaagtccgtaaaagagatcagctcatacacacccaaggattgtacaagtcggaatggacccgagcggggctgcgaccggggaatcattgtcagtactaggctgctcacagattcgtccactgacgctctcgaaaaagtaagcaccagtaacgaggacttctccctcaaagatgatgccctcgccaagactagcaagcgcaagacgaaagttcaaaaggacgagatttgtgccaagctgtctcacgtcattaagaaacaacataggaagtccacgctagtggacaacactatcaacctggatgagaacctgacagttagtaacattgagtcattctatagccgaaaggatactggcgttcagaagggggatggattcatccacaatctgagcctggacccttctggcgtgctggatgacaagaatggtgagcaaaaaagccaaaacaatgttctgcctaaagagaagcagttgaagaatgaggaattggtgatattttcatttcacgaaaataactgcaagatccaggagttccacgtggatgggaaagagttgattccgtttactgagatgacgaacgcttcggagaagaagagcagcccgtttaaagacctgatgaccgttccagaatcacgcgacgaggaaatgtcgaacagtacctccgtgatctactcaaaccttactagggaacaggctccagacatttcaccaaagtccgacactttgaccgattcccaaattgacagagacctccacaagctcagcttgctcgcccaggctagcgtgatcaccttcccttcagacagcccccagaacagttcccagctgcaaagaaaagtgaaggaagataagaggtgtttcaccgccaaccagaataatgtcggagatacctcacggggccaagtaatcatcatctccgactcagacgatgatgatgatgagcgtattctaagcctggagaagctcaccaagcaggacaagatttgcctggaaagggaacaccccgagcaacacgtatcaactgtaaattcaaaagaggaaaaaaatcctgtgaaagaggagaagacagagaccctgtttcagttcgaggagagcgattcccagtgctttgaatttgagtcatccagtgaggttttcagcgtttggcaagaccatcctgatgacaacaactccgtacaagatggagaaaagaaatgcctggcacccatagctaatactacaaatggccagggatgcactgactatgtgtccgaggtcgtcaagaaaggagccgaggggatagaggaacacaccagacccagaagtatttcagtcgaggagttttgcgaaattgaggtgaaaaaacccaagagaaaaagaagtgagaaaccaatggccgaggatcctgtgaggcccagcagttccgtgagaaatgaaggacagtccgacactaataaacgggatctggtgggcaacgatttcaagagcatagaccggcggacatccacccctaacagcaggatacagagggctacgactgtgagtcagaagaaaagcagcaagctctgtacttgcacagagcccattcgtaaggtgcccgtaagcaagacccccaagaagacccacagtgatgccaagaaagggcagaaccgctctagcaattacctgagttgccgaaccactcctgcaatagtccctccaaaaaagttccggcagtgtcccgagccaacgtctacagccgagaaattgggcctgaagaagggtccaagaaaggcttacgaactttcccaacgctctctggattacgttgcacagctcagagaccacgggaaaacagtcggggttgtggatacacgaaaaaagactaagctcatttctcctcagaaccttagcgtgcggaacaacaaaaagctactgacttcccaggaactacaaatgcagcgccagatcagacctaagtctcaaaagaatcgtcgccggttatctgattgcgagtctacggacgttaaaagggcaggcagtcacaccgcccaaaattccgatatattcgtgcctgaaagcgatcggtctgattacaactgcaccggcggcacagaagtgctggccaattcaaataggaagcagctgataaagtgcatgcctagcgaacccgaaacaatcaaggccaaacacggtagcccagccaccgacgatgcatgcccacttaatcaatgtgactccgtggtgctgaacggtactgttccaaccaatgaagttatcgttagcacgagcgaggaccccctggggggcggggacccaacagcccgccacatagagatggcggccttgaaggagggtgaaccggattcctcctccgatgccgaagaggataatctgttcctgacacagaatgatcccgaagatatggatctgtgtagccagatggaaaacgataactataaattgatagagcttattcatggcaaggatactgtcgaagtggaagaagattctgttagccgtcctcagttggagagcctgagcggaactaagtgtaaatacaaggactgtctggagacaacgaagaaccagggagaatactgccccaaacattctgaagtgaaagctgcagacgaagatgttttccggaagccggggctcccaccacctgccagcaaaccactgcgaccgactaccaagatcttcagcagcaagagtacatcccgaatcgccgggctttcaaagagtttagagaccagcagcgccctttcgccgtctcttaagaacaagtccaagggaatccagagcattttgaaggtgcctcagcccgttccgctcatcgctcaaaaaccggtaggggaaatgaagaactcctgcaatgtgttgcatccacagagtccgaacaatagtaaccgccagggatgtaaagtcccttttggcgagtcaaaatactttccttcttcatctcccgtgaatatccttctgagctcccaatcagtgagcgatactttcgtcaaggaggtattgaagtggaagtacgagatgtttttaaactttggccagtgcggaccaccagcgagcttgtgtcagtccatcagtagaccggttcctgtgcggtttcacaactacggagactactttaacgtcttcttccctctgatggtgctcaatacattcgaaactgtggcacaggaatggctgaacagccctaatcgtgaaaacttttaccagttgcaggtaagaaaattccccgcagattatattaaatattgggagtttgcagtatacctggaggaatgtgaattagcaaagcagctgtatccaaaggagaatgacctggtattcctggccccagagaggattaatgaagaaaaaaaggataccgagcggaacgatatccaagacctgcacgaataccactccggatatgtgcataagtttcgtagaacaagcgtgatgagaaatggcaaaacagaatgttatctgagcattcagactcaggagaactttcccgcgaacctgaacgaactcgttaattgtatcgtcattagctccttggtaactacccaaaggaagctgaaggctatgtccctgctggggagtagaaatcaactggctcgggcggtcctgaacccaaatccaatggacttttgcacaaaggacctgctaactaccacaagtgagagaataatcgcctatctgcgcgactttaacgaggaccagaagaaggctatcgagacagcttacgcaatggtgaaacactcaccctctgtcgctaaaatttgtctcatccacggtcctcccggcacgggaaagagtaagactatcgtagggctcctctaccgcctgttgaccgaaaaccagcgcaaaggacacagtgacgaaaacagtaacgccaagataaaacagaatagagtcctggtgtgcgcaccatccaacgctgccgtagacgaattaatgaaaaaaatcattctcgagtttaaagaaaagtgcaaggataagaagaaccctctgggaaactgcggcgacattaacctggtccggctcggaccagagaagagtatcaacagtgaagtcctgaagtttagcttggacagtcaagtgaaccacaggatgaaaaaggagcttccatctcacgtgcaggccatgcataagagaaaggagtttttagactaccagctcgatgagctctcccgtcagagagccctgtgcaggggcgggagggagattcagcggcaagagctggatgagaatatatccaaagtctctaaggagaggcaggaattggcttccaaaatcaaggaggtacaaggtcgaccacagaaaacccagtccataattatcttggaaagtcacattatctgctgcaccctcagcacttctgggggactcctgctggagtccgctttcagaggccagggaggtgtcccattctcttgcgtgattgtggatgaagcgggccagtcctgcgaaatcgagactctgacccctttaatccaccggtgcaataagctcatcctggtcggagatccaaaacagttaccccctaccgtcatttctatgaaagctcaagagtacggctacgatcagagtatgatggccagattttgtcgccttctcgaagagaacgtcgagcacaatatgatatctcgcttgcctatcttgcagcttaccgtgcagtaccgcatgcaccccgacatttgtctgtttccttcaaattacgtgtacaaccggaacttgaaaactaaccggcagaccgaggccattcgctgtagttcggattggccctttcagccctatctggtattcgatgtgggtgacggcagtgagcgtcgggacaatgatagctacattaatgtgcaggagatcaaattagtgatggaaattatcaagctgattaaggataagcgaaaggacgtgtcatttcggaacattggcataatcactcattacaaggcccaaaagaccatgatccagaaagacctcgacaaagagttcgatcgaaaggggccagccgaagtcgatacagtagacgccttccagggccgccagaaggattgtgtgatcgtcacttgtgtccgcgcgaactcaattcagggctctattgggtttcttgcctctctgcagcgactaaacgtcaccataactagggcaaagtatagcctcttcatcctgggacacctgcgtacgctgatggagaaccaacactggaaccaacttatacaagatgctcagaagaggggggccattataaaaacctgtgacaaaaattacagacacgacgccgtgaagatcttaaaactgaagcccgttcttcaaagatccttgacacacccacccaccattgctcccgagggaagccgaccccagggcgggctaccctcgtccaagttagattctggctttgccaaaacatctgtcgccgccagcctgtaccatacaccttctgacagcaaggaaatcaccctgacggtgacctccaaagatcccgaacgaccgcccgtccacgatcagctacaggaccctaggctgcttaaaaggatggggatcgaggtgaagggcggaattttcctttgggacccacaaccatcatctccacagcatccgggtgccacaccccccacaggcgaacctggctttccagttgtccaccaggacctgagccacatacagcagcccgcagccgttgtagcagctttgtcctctcacaaacctcccgtgagaggcgagccacccgccgctagtccagaggctagcacctgtcaatctaaatgtgatgacccagaggaagaactatgccaccgcagagaggctcgtgctttctctgaaggtgaacaggagaaatgtggctccgagacacaccacaccagaaggaattccagatgggataaaaggaccctggagcaggaggattccagctcgaagaagcgaaagctgctgtag

SEQ ID NO: 200987 - DNA, 483 bp, Artificial Sequence
  Description of Artificial Sequence: Synthetic coding sequence
atggccacccaccacaccctgtggatgggcctggccctgctgggcgtcttgggggacctgcaggctgccccagaggcgcaggtgagcgtccagccaaattttcaacaggacaaatttctcggccggtggtttagcgccggactggcatccaacagttcctggctcagagaaaagaaggcagcactgtccatgtgtaagagcgttgtcgcaccagccaccgacggcggactgaacttaacgtccacattcctgcgcaagaaccagtgtgagacaaggaccatgctcctccagcccgccggcagcttgggttcctactcatatcggtctcctagggaatgggggctccaccgcccacctggcccttctcttggagccaccttagcaggtactacactgggccagccacctgctgccgagatccacggcgttggaggcgatggttgccccacaagcgtgcgcgggaagggacaagcctgggcctag

SEQ ID NO: 200988 - DNA, 573 bp, Artificial Sequence
  Description of Artificial Sequence: Synthetic coding sequence
atggccacccaccacaccctgtggatgggcctggccctgctgggcgtgttaggagatctgcaggccgcccctgaagcccaggtctccgtgcaacctaacttccagcaagacaaattcctgggtcgttggttctccgcgggcctggccagcaattcttcctggctgcgtgagaagaaagccgccctttcaatgtgtaagtcagtagtcgctcctgccactgatggtggtctcaatctcacaagcaccttccttcgcaaaaaccagtgcgagacccgaacaatgttactccagccagctggtagtttgggcagctactcctatcgcagtcctcattggggatcaacatactcagtttcagttgtggaaacagattacgaccagtatgccctgctgtactcacaaggctcaaagggaccaggtgaggacttccggatggcaaccttatattctaggacccagacacctcgcgctgagttgaaagaaaagtttacagcattctgcaaggctcagggtttcaccgaggataccatcgtgttcctgccacaaactgacaagtgtatgaccgagcagtag

SEQ ID NO: 200989 - DNA, 189 bp, Artificial Sequence
  Description of Artificial Sequence: Synthetic coding sequence
tgaggctaccactgcctgcccgcccccaaccgggcccagggcgaggtcggcggcgatggtggttcagtccaattcggcggtagtgtaaaaacgagtagcgcacttcgggaagagcaagaggcccagtgggaaaactggcctaaatctggtgttctcactacggcaccaggctttttcctgggacgctag

SEQ ID NO: 200990 - DNA, 642 bp, Artificial Sequence
  Description of Artificial Sequence: Synthetic coding sequence
tgactgcggggcggcggccagttcctgggccggggcgtgcggggcgtcgccgcgcgcggtatcggacgcggaggaggtgccggactggaaactggaggtgtggatggaagaggtgctcccgcaggacgacgaaggtgggtaaggcgcgtgcttgcagatgccggaggcggcagaagtccccaattcctcggccgctggttctcagccgggttagcgagcaattcttcatggctgagagagaaaaaggccgccttgtccatgtgcaagagcgtggtggccccagctaccgacggaggcctcaacctcaccagtacctttctgcggaaaaaccagtgcgagacccggaccatgctgctccagcctgcagggagccttggctcctacagttacagatctcctcactggggatccacttactccgtaagtgtggtcgagactgattacgatcagtacgccttgctttattctcaaggcagcaagggaccaggtgaggactttagaatggcaaccctttactccagaactcagactcctcgagccgagctgaaggagaagttcactgcattttgcaaggcgcaagggttcacggaagacacaattgttttcctaccccagacagacaaatgtatgaccgagcaatag

SEQ ID NO: 200991 - DNA, 588 bp, Artificial Sequence
  Description of Artificial Sequence: Synthetic coding sequence
atggccacccaccacaccctgtggatgggcctggccctgctgggcgtgctcggggacctccaggccgcccccgaagctcaggtgtccgtacagccgaattttcagcaggataagttcctgggacgctggttttccgccggcctggcctccaactcctcctggcttagggagaagaaagctgcactctcaatgtgtaagtcagtagtcgcccctgcgaccgacgggggcttgaatctgacttctaccttcctgaggaaaaaccaatgcgagactcggacgatgctgctacagcctgcaggaagcctgggaagttactcttatcggtcacctcgggagtgggggcttcacaggccccctggtccatcccttggagccactctggccggcactacccttggacagccccctgccgccgaaatccatggcgtgggagattggggaagcacatattctgtttctgttgtcgaaacagactacgatcagtacgctctgctgtactctcagggttcaaaaggacccggcgaggactttcgtatggccactctttacagtcgaacccagacccccagggccgaacttaaggaatag

SEQ ID NO: 200992 - DNA, 573 bp, Artificial Sequence
  Description of Artificial Sequence: Synthetic coding sequence
atggccacccaccacaccctgtggatgggcctggccctgctgggcgttcttggagacctacaagccgctcccgaggcccaggtaagtgttcagccaaacttccagcaagataaattcctgggcagatggttcagcgccggacttgcctctaactctagttggcttagagagaagaaggcggccctgagcatgtgcaaatcagtcgtcgctcctgctactgacggcgggttgaacttaacatctaccttcctgagaaagaaccagtgtgaaacacggactatgctgctccagccagccgggagcctgggcagctactcgtatcgcagtccccactggggctcaacttactcagtctccgtggttgagaccgactatgaccagtatgccctactgtatagccaagggagcaaaggtcccggggaagacttccgaatggccaccttgtactcacgcacacagacccctagggccgagctcaaggagaagttcactgctttctgtaaagcacagggatttactgaggacactattgtattcctgcctcagaccgacaagtgtatgacagaacagtag

SEQ ID NO: 200993 - DNA, 1209 bp, Artificial Sequence
  Description of Artificial Sequence: Synthetic coding sequence
atgagcccctgcggccccctgaacctgagcctggccggcgaggccaccacctgtgccgccccctgggtaccaaatacctcagccgtgcctcccagtggagcttcacctgcgttgcctatcttctccatgacccttggcgccgtttccaaccttctggcattagcgcttctggcccaggccgcaggacgcctcaggaggcgcaggtcagccgccacattcctcttatttgtggcttccttattggccaccgatctcgccggccatgtgattcccggagcactggtgctgcgactgtacacagctgggcgcgcacctgcaggtggcgcatgccactttcttggtggttgtatggtcttctttgggctttgcccccttcttctgggatgcggaatggctgtggaacggtgtgtgggtgtaacacgtccactcctgcacgctgctagagtttccgtagctcgggctagactcgcactagccgccgtagccgccgtcgcccttgcagtagccctcctgcctctggcccgcgtaggacggtatgagctgcagtatcctggtacctggtgttttattggtcttggaccacccggcggatggcggcaggctctgctagcaggtctattcgcctcactaggcctggtggccctgctggctgctctcgtgtgtaacaccctcagcggactggccctgttgagggccagatggcgccgccggagcagaagaccaccacccgccagtggcccagacagtaggcggagatggggagcgcacggccctcgttccgcttctgctagcagtgctagttccatcgcttcggccagcacatttttcgggggctcccgctcgtctggctcggccagacgagccagagcccacgatgtggagatggtgggccaactcgtggggatcatggtagtctcctgtatttgctggagccctatgctagtgctcgtggcgttggctgttggagggtggagctcaacgtctcttcagcggcctcttttcctggccgtccggctcgcctcttggaatcagattctcgatccctgggtatacattctcctgagacaagctgtgctcagacagctgctgaggctgctgcctccccgcgctggcgctaaagggggaccagccgggctgggtctgaccccctcggcctgggaggctagcagcctgaggtctagtcgtcacagtggtctgtcacatttttag

SEQ ID NO: 200994 - DNA, 1077 bp, Artificial Sequence
  Description of Artificial Sequence: Synthetic coding sequence
atgggcaacgccagcaacgacagccagagcgaggactgcgagaccaggcagtggcttcctcctggggagtcccccgctattagctccgttatgttttccgctggcgtgttgggaaacctgatcgccctcgccctccttgcacggcgatggaggggtgacgtcggctgctccgccgggcgtcggtctagccttagcctatttcacgtgctcgttactgagctcgtatttacggatctcttgggcacttgccttatttctccagtggtgctggcatcctacgccaggaatcaaaccttggtcgccctcgctcctgaatcccgagcatgcacatactttgcattcgccatgacctttttctccctggcgactatgctgatgctatttgccatggcgcttgagcgatatcttagtattggccatccttacttctatcagcggcgagtgtcacgctcaggcggactcgccgtcctgccagtaatatatgcagtcagcctcctcttttgttcactcccactgttggattatggacagtacgtccaatattgtccgggcacctggtgttttatcaggcacgggcggactgcatacctgcagctgtacgccactctcctactactgctgatagtctcagtgctcgcctgcaatttttccgtgattctgaatctgattcggatgcaccgaaggagtcgacgaagcaggtgcggaccatccctcggctctggccgcggagggcccggtgctaggcgaaggggggaacgggtttccatggctgaggagaccgatcacctgattctccttgctatcatgacaattaccttcgcggtgtgtagtctgcccttcaccattttcgcctacatgaatgaaactagtagcaggaaagagaagtgggacttacaggctctgaggtttctgagtatcaactcaataattgacccctgggtgttcgcaatcttgcgtccaccagttctgcggttgatgcgcagcgtgctgtgctgtcgaatcagcttgcgaacacaggacgcaactcagacatcgtgctccactcagagcgatgcttccaagcaggccgatctctag

SEQ ID NO: 200995 - DNA, 1173 bp, Artificial Sequence
  Description of Artificial Sequence: Synthetic coding sequence
atgaaggagacccggggctacggcggcgacgcccccttctgcacccgtctgaatcacagttacaccggcatgtgggctcccgagcgttcagctgaggctcgcggtaacctgaccagaccacccggctctggtgaagactgcgggagcgtgtctgtggcattccctattactatgcttctcaccggttttgtcggaaacgctttagccatgctgttggtgtcccgttcttacagacgaagagagtcaaagcgcaagaaatcattcttactatgcatcggatggttggcactgacggacctggtcggacagctactgactactcccgtagtcatagtggtgtatctgtcaaaacagcggtgggaacacattgatcccagcgggcgcttatgtaccttctttgggctgactatgaccgtctttgggttgagctcactgttcatagctagtgccatggccgtagaaagggccctcgctatcagggccccacattggtacgcgagtcatatgaagaccagggcaactagggctgtgctgcttggcgtgtggctggccgtcctggcatttgctttactgccagttcttggggtcggacaatacacagtccagtggcccggtacctggtgcttcatatcaactgggaggggggggaatggtacaagcagttctcacaactggggcaatctctttttcgcctcagctttcgcgttcctgggactactcgctctgaccgttactttttcctgtaacctggccactattaaagcgctggttagccgctgtcgcgccaaggccacagctagccaatcttctgcccagtggggccggattactactgagactgcaatccagctcatggggatcatgtgcgtgttgtccgtgtgttggtctcctctgctcatcatgatgctgaaaatgatattcaaccagaccagtgtcgaacattgtaagactcacaccgagaaacagaaagagtgtaatttttttctgattgcggtacgacttgccagcctgaatcaaattttggacccttgggtgtaccttctgctcaggaagatcctactgcgcaaattttgtcagatcagataccatactaataattatgctagctcttccacgtcactgccctgtcagtgttcatccacacttatgtggtctgaccacctggaacgttag

SEQ ID NO: 200996 - DNA, 1260 bp, Artificial Sequence
  Description of Artificial Sequence: Synthetic coding sequence
atgaaggagacccggggctacggcggcgacgcccccttctgcaccaggcttaatcattcctatacaggaatgtgggcccctgaacgatccgcagaagcccggggaaacctgacccggcctcctggctccggcgaggactgtgggagtgtcagtgtcgcatttccaatcaccatgctgcttactgggtttgtcggaaacgctctcgccatgctgctagtttcccgaagctaccggcgcagggagtctaagcggaaaaaaagcttcctgttgtgcatcggatggctggccctcaccgatctggtgggacagttgctaaccactcccgttgttattgtggtgtacctcagtaaacagcgttgggagcacatcgacccctccggacgcctgtgcacattctttggattgaccatgacagtgttcggtttatccagcctcttcattgcctcagccatggctgtcgaaagggctttagccatcagagcaccccattggtatgccagtcatatgaagactagggccactagggctgtgcttttaggcgtctggttagctgtgctggcattcgcactcctgcccgttctaggagtcggccagtatacggttcagtggccagggacgtggtgttttatcagcaccgggagagggggaaacggaacttccagctcacacaattggggcaaccttttctttgcaagcgctttcgcgttcctggggctgttagctttgaccgtgacctttagctgtaacttggccaccatcaaggcccttgtgtcccgctgcagagccaaggccaccgccagccagagcagcgcccagtggggccgaatcaccacagaaaccgcaatccagcttatggggataatgtgcgtgctgagtgtgtgttggtcccctctcctgatcatgatgctgaaaatgatctttaaccagaccagtgtggagcattgtaagacgcacacggaaaaacagaaggagtgcaacttcttcttgattgcagttcgcttggcctcactcaaccaaattttggatccctgggtttatttgctcctgcggaaaattcttctgcgtaaattctgccaggtcgctaacgccgtcagcagctgcagtaacgatggtcagaagggtcagcctattagcttgagtaacgagatcattcagacagaggccatccgctatcacaccaataactatgccagcagcagcactagccttccatgtcagtgctcctccaccctgatgtggtccgaccacctggagcgctag

SEQ ID NO: 200997 - DNA, 1290 bp, Artificial Sequence
  Description of Artificial Sequence: Synthetic coding sequence
atgaaggagacccggggctacggcggcgacgcccccttctgcacccgcctgaaccattcttacacggggatgtgggcaccagaacgatcagctgaagcaagagggaatttgaccagacctcccggctctggcgaagactgtgggagtgtgtcagtggcttttcctataacaatgcttctgactgggttcgtcggcaacgcccttgccatgttgctagtctctcgctcctataggagacgcgagtccaagcggaaaaaatccttccttctgtgcattgggtggctggccctgacagacctggtcggacagctgcttactacccctgtggtgattgttgtgtacttgtcaaagcaacgctgggagcatattgacccatctggtaggctgtgtactttctttggtctgaccatgacagtgttcggcctttcaagcctgttcattgcgtcggcgatggccgttgagagggccctggctattcgcgccccccattggtatgcatctcacatgaaaacccgcgctacccgcgcggtgctcctgggtgtgtggctggctgtgttggccttcgctctccttcccgtcctgggagtgggccaatataccgtgcagtggcccggtacttggtgcttcatttctaccgggcgtggaggcaatggaacttcgagtagtcataattggggtaatctgtttttcgcaagcgcatttgcctttctgggattgctggccttgaccgtaacattcagctgtaacctggccaccatcaaggctcttgtgagccgatgcagggccaaagcaaccgcttcacagtcatcagcgcaatggggtcgcatcactaccgagacagctattcagctcatgggtattatgtgtgtgctgtctgtgtgctggagccccctcctgatcatgatgctgaagatgatctttaaccagacaagtgttgagcactgcaaaacacatacggaaaaacagaaggagtgtaacttcttcctgatagcggtgcggttggcaagtctgaatcaaatccttgacccctgggtgtacttgctgctccgcaagatcctcctgagaaagttttgccagatgcgcaagagaagattgcgagaacagttttggcggcctgcttcttctgggtcaggatgccagcagataagatgtctaatggagtcttgttcactgacacagaccggcgtgcagtggagcgacttccgatctttacagcccagcccacctcctctgaccgccatattcgcgtcatgggtgcaggtaatccttctaccacagcctccaaaatag

SEQ ID NO: 200998 - DNA, 1257 bp, Artificial Sequence
  Description of Artificial Sequence: Synthetic coding sequence
atgaaggagacccggggctacggcggcgacgcccccttctgcacccgcctgaatcacagttacactggaatgtgggcacctgagcggtcagcagaggctaggggtaatctgacacggcccccaggctctggggaggattgcggaagtgtctccgtggcattccccatcaccatgcttctgaccggtttcgtagggaatgctctcgctatgttgctagtttctaggtcttatagacggcgggagtccaagcgaaaaaagagtttcttgctctgcatcgggtggctggcactaactgatctcgttgggcaactcctaaccaccccagtggtgattgtagtgtacctatccaagcagcgctgggagcacatagatcccagcggcaggctctgcaccttctttggccttaccatgacagtgtttgggttgtcgagtctttttattgcgagcgctatggcggttgagagagccctggccatccgggctccgcactggtatgcttcccacatgaagactagagcaactcgcgctgtactcctgggagtctggctcgccgtcctagcctttgccctgctgcccgtgctcggcgtcggccagtacaccgtgcagtggcctgggacttggtgctttatcagcaccggccgcggcggcaacgggaccagctcttcacacaactggggcaacttgtttttcgcatctgcgttcgcttttctgggcctgctggcattgactgtcacgttcagttgcaatctggcgacaataaaagccttagtgtcacggtgtcgtgcgaaggcaacagctagccagagcagtgcccaatggggccgcatcacgactgagacggccatccaactgatggggatcatgtgtgtgttgtccgtgtgctggagtcctcttctgatcatgatgctgaagatgattttcaaccagacttcagtggaacactgcaagacacacaccgagaaacaaaaggaatgcaactttttccttattgcggtgcggctggcctcactgaaccagatccttgatccctgggtgtatctgttgctgcgcaaaattcttttaaggaagttttgccaaatgcggaagcgaagacttcgcgagcagttaatttgctctcttcagaattcacaaattcagcgagcaaccgctcattgtggccaggtgcagacatacagggtactgaatcgagaggagatggaagttctagtctctagcattaatgtctatacccgcatcagtacagtgaagaccgagtag

SEQ ID NO: 200999 - DNA, 1209 bp, Artificial Sequence
  Description of Artificial Sequence: Synthetic coding sequence
atgaaggagacccggggctacggcggcgacgcccccttctgcacccgcctgaatcattcatacacagggatgtgggccccggagcggtccgccgaagcaagaggcaacctgaccagaccccccggctccggagaggactgcgggagtgttagcgtggcatttcctattaccatgttgcttaccggttttgttgggaacgccctcgccatgctgctggtgtcacgcagctataggcgtcgggaaagcaagcggaaaaagtcattcttgctgtgcatcggctggttggcactcactgatctcgttggccaattgctcactacaccggttgtcattgtcgtctacctgagcaagcagcgctgggagcacatcgatccttcaggcaggctttgcacattcttcgggctcaccatgaccgtcttcgggctatccagtctgttcatcgcctccgccatggcagtagagcgggcacttgccattcgtgcgcctcactggtatgcttcccatatgaagacaagggccacccgtgccgtattgctcggggtctggttagctgtccttgcgtttgccttgctccctgtgttaggcgtcggacagtacaccgtgcaatggcctggcacgtggtgtttcatctcaacaggccgtggcggcaacggcacctccagcagtcataattgggggaacctgttctttgcgtcagcctttgctttcctggggctgttagcccttacggtgacattttcatgcaatctcgctacgattaaagcgctggtgtccagatgccgtgcgaaagcgactgcctcacagtccagtgcacagtggggacggatcacgaccgagaccgctattcagctgatgggcatcatgtgcgtcctgtctgtttgctggtcacctttgttgattatgatgcttaagatgattttcaatcagacgtctgtggaacactgcaagactcatacagagaagcaaaaggagtgcaatttcttcttgattgcggttaggctggcatcactgaaccagatcctggacccctgggtttatttattactgcgcaagatactgctgcgcaaattttgccagatgagaaaacgccggctcagggagcaggagatgggacctgacggacgctgcttttgccatgcctggcgccaagtcccccgcacttggtgtagctcacacgaccgagagccttgctctgtgcaactctcttag

SEQ ID NO: 201000 - DNA, 1167 bp, Artificial Sequence
  Description of Artificial Sequence: Synthetic coding sequence
atgaaggagacccggggctacggcggcgacgcccccttctgcaccagactgaaccatagttatactggtatgtgggcccctgagcgctcagccgaggcccggggtaacctgacccgaccccctggtagcggtgaagactgcggttctgtatcagtggcctttcctatcactatgctgctcacgggattcgtgggaaatgctctggctatgctcctcgtcagtaggtcttacaggcggcgcgagtctaaaaggaagaagtcattcctactgtgcatcggctggctcgcactgaccgatcttgtcggccagctgctcactactcccgtagtaatcgtggtgtacttatccaagcaaaggtgggagcatattgaccccagcgggcggctctgtacattttttggactaactatgacagtgttcggcctatcctctctgtttattgccagtgctatggccgtggagcgagctttggccatcagagcgccacactggtatgcctctcatatgaaaactagggccactcgggctgtccttcttggggtctggctggctgtgctggccttcgcgctcctccccgtgttaggagtaggccagtatactgtgcagtggcccggtacctggtgctttatcagcactggaaggggcggcaatggtacctccagctctcacaattggggaaatttatttttcgcaagcgcattcgctttcctggggctcctcgcactaaccgtgactttcagctgcaatctggcgaccatcaaagcgttggtctctaggtgtagggctaaggctaccgctagccaaagtagcgcacagtggggtcgaattacaacggagaccgcaatccagctaatggggatcatgtgcgtactgtccgtctgttggagtcctctgctgatcatgatgttaaagatgatatttaatcagacatcagtggagcattgcaaaacccacacagagaagcagaaagaatgcaatttctttcttattgccgtcagactggcttccttaaatcagatcttggatccttgggtctatctgctgctgcggaagatcctgctccggaagttctgtcaagtggctaatgctgtcagtagttgctccaatgacgggcagaaaggacaacccatctccctgagtaacgaaatcatccagaccgaagcatag

SEQ ID NO: 201001 - DNA, 1173 bp, Artificial Sequence
  Description of Artificial Sequence: Synthetic coding sequence
atgaaggagacccggggctacggcggcgacgcccccttctgcaccagactgaatcactcatacacaggcatgtgggcccccgagaggtccgctgaggcacgaggtaacctgacaaggccaccgggcagcggcgaagattgtggctcggtttctgtggcgtttccaatcacaatgctcttaaccggcttcgtcggtaacgccctggccatgctgctggtgtccagaagctaccggcggcgggagtccaagcgtaaaaaatcttttcttctctgtataggatggctagccttgaccgatctcgttggacagctgctgacaacccctgtggtgattgtagtttacctgagtaagcaacgttgggaacacattgatccgagcggaaggctgtgtacttttttcgggcttactatgacagtttttggcctcagttccctgttcattgcttccgctatggctgtggagagagccttagctatacgcgctcctcactggtatgccagtcatatgaagacacgggccacacgtgccgtcctcctgggggtgtggctggcggtcttagcatttgcgctgctccctgttctgggagtgggacagtacaccgtgcaatggccaggcacctggtgctttatttccacaggcagaggtggaaacggcacctcgtcttcccacaactgggggaatctgttcttcgcaagcgcgtttgcctttctgggactacttgcgcttaccgtaactttctcatgcaatctagcgaccattaaggctcttgtgagccgctgtcgcgctaaagctacagcgtctcagagcagtgcccagtggggacggataactacagagactgcaattcagctgatggggatcatgtgtgtcctctccgtgtgttggtctccactgctgattatgatgctaaagatgatctttaaccagacatctgttgaacattgcaaaacccatactgagaaacagaaggaatgcaacttttttctgattgccgtgcgtctggctagccttaaccagatcctggacccatgggtttacttgcttctgcgaaagatattgctgaggaaattttgccaaatccgctaccacacgaacaactatgcctcttcctctactagcttgccgtgccagtgttccagcaccctgatgtggtccgatcacctggaacggtag

SEQ ID NO: 201002 - DNA, 1098 bp, Artificial Sequence
  Description of Artificial Sequence: Synthetic coding sequence
atgaaggagacccggggctacggcggcgacgcccccttctgcacccggttaaaccattcgtatacaggtatgtgggctccggagcgctctgcagaggcgcgcggcaacctgacaaggccccccggctccggcgaggactgtggctccgttagcgtggcgtttccaattaccatgctgttgactggtttcgtggggaatgctttagcaatgctgctggtaagcagaagttacaggaggcgcgagtccaagcgcaagaaatccttcctgctctgtatcgggtggcttgccctgactgatttagtcggccagttactcactactccggtggtcattgtcgtgtacctgtccaagcagagatgggagcacatcgatccaagcggtcggctgtgtaccttcttcggcctcacaatgacagtgttcggactgtcatccctcttcattgcgagtgccatggcagtggaaagagcgctggctatcagagcccctcactggtacgctagccacatgaaaacaagggcaacaagggccgtcctcctgggggtgtggttggcggtgctggcgttcgccttgcttcccgttcttggcgtcggccaatataccgttcagtggcccggcacctggtgctttatctccacagggcgcggtgggaatggtacttctagtagtcacaattggggcaatctctttttcgctagtgcctttgcctttttaggcctcctcgccctgaccgtgacctttagttgcaacctagccacaatcaaggctttagtgtcccgatgtcgggccaaggccaccgcgtcccaatcctcagcccagtggggacgcataactacagaaacagcaatccagctcatggggattatgtgtgtgctgtccgtctgctggagccccttactgatcatgatgctgaaaatgatcttcaaccagacgagcgttgagcattgcaagacccacacagagaaacagaaggagtgcaattttttcctgatcgctgtcagactggcatcgcttaaccaaatattagatccttgggtttatcttttactgaggaagatcctgttacgtaagttctgtcaagaggagttttggggaaactag

SEQ ID NO: 201003 - DNA, 1365 bp, Artificial Sequence
  Description of Artificial Sequence: Synthetic coding sequence
atgaaggagacccggggctacggcggcgacgcccccttctgcacccgtctgaatcactcctacaccgggatgtgggccccagagagatcggccgaggcaagaggtaacctgacccgccctccaggctctggagaagattgcgggtctgtgtcggtcgctttccctattacgatgctgctgaccggattcgtaggtaatgcactggcaatgctcctggtctcgagatcatacagacgaagagaatcaaaacgcaaaaagtcctttcttctgtgcattggctggctggcgctgaccgacctggtggggcagcttctcacaactcctgtggtgattgtggtgtacctgtccaagcagcgttgggagcacatcgaccctagtggaagactatgcactttctttgggctgactatgaccgtatttgggctgtcctccctgttcatcgcaagtgcaatggcggtggagagggctctggcgatcagagcccctcattggtacgcctcgcatatgaaaacaagagccactcgtgccgtgctgcttggggtgtggcttgccgttcttgcctttgccttgttgcccgtcttgggcgtcggacagtacacagttcagtggccaggcacctggtgtttcatttcaacgggccgcggcgggaatggaaccagcagcagccacaattggggaaacctgttctttgcgtccgcttttgcctttctcggattgctggccttgactgttaccttttcatgcaaccttgccaccattaaggccctcgtcagcagatgtcgggcaaaggccaccgcttctcagagttctgcccagtggggcagaataacaacagaaacagcaatccagctcatggggattatgtgcgtgctgtcagtgtgctggagccccttgttgataatgatgctgaaaatgatattcaaccagacatccgtcgagcattgtaagacgcacaccgagaagcagaaggaatgcaactttttcctgatcgcagttaggctagcttctttaaatcaaatcctggacccctgggtgtacttgctgcttcgtaaaatactgctacggaaattctgtcaggttgccaacgcggtgtctagttgctcaaatgacggacagaaggggcagccaatttccctgagcaacgagatcatccagactgaagcaatgcgcaagcgacgacttagagagcaggcccctttgctgccaacaagcaccgttatcgatccatctcggttttgcgcacagcctttcagatggtttctggatctgagttttccagcgatgtcaagttcccaccctcagctgccactgaccctcgctagctttaaattactgcgagaaccgtgctccgttcagttgtcctag

SEQ ID NO: 201004 - DNA, 1173 bp, Artificial Sequence
  Description of Artificial Sequence: Synthetic coding sequence
atgaaggagacccggggctacggcggcgacgcccccttctgcaccaggttgaatcattcctacaccgggatgtgggctcccgagcgctcagccgaagccagggggaatctgaccaggcccccgggttcgggagaggactgtggaagcgtttccgtggcctttcccatcaccatgcttctgactggatttgtgggtaacgctcttgctatgctcctggtaagccgcagctatcgccggcgtgagtccaagcggaaaaagtcctttctgttgtgcataggatggttggctctcaccgatctagtggggcagctgctaaccacccccgtggtgatcgtggtatacctgtctaaacagcggtgggaacacattgacccatccggccgtctgtgcacattctttggtctcacgatgaccgtgttcggtctcagctcattatttatcgccagtgcaatggctgtggaacgagcactggccatccgtgccccacactggtatgccagccatatgaaaactcgtgcaactagagccgtgttgctgggcgtgtggctggctgtcctagctttcgccctgctaccggtgctcggggtcggacagtacactgttcaatggccaggcacgtggtgtttcatttctaccgggaggggtggtaatggcaccagctcatcacacaattggggaaacctcttctttgctagcgcctttgcgtttctggggctcctagcactcactgtaaccttcagctgcaatttggctaccattaaagccctcgtgtcgaggtgccgggccaaggccacggctagtcagtcgtcagcccagtgggggcggattacgacagagacggctatccagcttatgggtatcatgtgcgtgctgtccgtgtgctggtcccctctcctgataatgatgctgaagatgatatttaaccagactagtgtggaacattgtaaaactcacaccgaaaagcagaaagaatgtaactttttccttatcgcggtgcggctggcctccctgaatcagatcctggatccctgggtctacctgttactgcgaaaaatactgcttcgcaagttttgccagatccggtaccacactaataactacgcctctagcagcacttcattgccgtgtcagtgctcatctacgcttatgtggtccgaccatctagaaaggtag

SEQ ID NO: 201005 - DNA, 1125 bp, Artificial Sequence
  Description of Artificial Sequence: Synthetic coding sequence
atgaaggagacccggggctacggcggcgacgcccccttctgcacccgcctcaaccacagctataccggcatgtgggcacctgaaagatcagccgaagcgcgcggcaatttgacaagaccacctggctccggagaggattgtggatccgttagcgtcgcctttcctattaccatgctgctgaccggtttcgtaggcaacgctcttgccatgctgctcgtgtcccgatcatataggcgccgcgagagcaagcggaagaaatcgttcctcctttgtattgggtggcttgctttgacggacctggtggggcagctgctcacaacaccggtggtgatcgtggtctacttgtcaaagcagcggtgggagcacattgatccatccggccgcctgtgcactttcttcgggctgacaatgacagtgttcggtctgtcaagcctctttatcgcatccgccatggccgtcgagcgtgcactcgcaattcgggcccctcactggtacgcttctcacatgaaaaccagagccactagagccgtccttctgggcgtatggctggcagttctcgcatttgccctgctgccagtgttgggggtaggccagtacactgtgcagtggccgggaacatggtgcttcatcagcactgggagaggtggtaatggcacaagctcttcacacaactgggggaacctgttctttgcaagtgcattcgcattcctggggcttctggccctcacagtgacattctcatgcaacctcgccactatcaaagctctggtgagccggtgccgagcaaaggctaccgcgagccagtcctccgcacaatggggtcggattacgaccgagactgcaatccagcttatgggcattatgtgcgtgctcagtgtgtgctggagtcccctattaattatgatgcttaaaatgatattcaaccagacttctgtggaacactgcaaaacccacaccgaaaaacagaaagagtgtaactttttcctgatcgccgtcaggctggccagcctgaatcagattctggatccttgggtctacctccttctccgcaagattctactgcgcaaattttgccaaatgcggaaacggcggcttcgcgagcaggaggaattttgggggaattag

SEQ ID NO: 201006 - DNA, 1467 bp, Artificial Sequence
  Description of Artificial Sequence: Synthetic coding sequence
atgagcacccccggcgtgaacagcagcgccagcctgagccccgaccgccttaactctccagtcaccatccccgcagttatgttcatctttggcgtagtcgggaatttagtagccatcgtagtgttatgcaagtctcgaaaagaacagaaggagacaaccttctacactctcgtgtgcggtctggccgttactgatcttctgggaaccctactcgtgtctccagtcacaatcgctacatacatgaaggggcagtggccaggaggacagccactgtgtgaatacagcacattcattctgcttttcttttccctgtccggtttgagtatcatctgcgctatgagtgttgagagataccttgctatcaatcacgcctacttctattctcactacgtggacaaaagattagcaggacttaccctattcgccgtctacgcaagtaatgtgctgttttgtgcccttcccaatatgggcctgggcagctctaggctccagtaccctgacacttggtgttttatcgactggaccaccaacgtgaccgcgcacgcagcatattcttacatgtatgctggattctcctcattcttgatcctagctactgtgctgtgcaacgtcctggtgtgcggtgctttgttgcggatgcaccggcagtttatgagacggacatcattgggaaccgagcagcatcatgcagcggccgcagcatcagtcgccagcagaggacatccagccgcgtctcctgctctgcctcggctttcagactttagacgtaggcgctcttttcgcaggatagccggggctgagatccaaatggtgattctcctgatcgcaacttctcttgtggtcctcatatgttccatccccttggttgtcagggtgttcgtgaaccagctgtaccagcccagcctagagcgcgaagtatccaaaaatcctgatctgcaggcaatcaggatagcgtctgtcaaccccatcctggatccatggatttacatcttgctcagaaagaccgtactgagtaaggctatcgagaagatcaaatgcctcttctgccggatcgggggctcccgcagagaaagaagtgggcaacattgcagcgattcccagcggacctcttctgctatgtctggtcattcaaggagctttatatccagagaactgaaagaaatttcctcaacgtctcagaccctcctgcccgatctaagtctgccagacctctctgagaatggactcggcgggaggaatctgttacccggagtgcccggcatgggactagctcaggaagatactacaagtttgcgaacattacggatctctgaaactagcgactctagtcagggacaggactcagaaagtgtcctcctcgtggacgaagcaggtggctcggggcgagctggaccagcccctaagggatcaagtctacaagtcacttttccctcagagactctgaacctgtctgagaagtgcatctag

SEQ ID NO: 201007 - DNA, 459 bp, Artificial Sequence
  Description of Artificial Sequence: Synthetic coding sequence
atgcccgcccacagcctggtgatgagcagccccgccctgcccgccttcctgctctgttcaactctcctcgtcattaaaatgtacgtcgtggctattatcacggggcaagtgaggctgagaaaaaaggcatttgctaatcccgaagatgccttgagacatggaggcccacagtactgcaggtctgaccccgacgtagagcgttgcctgcgcgcgcacaggaatgatatggaaaccatttaccccttcctcttcctgggatttgtatacagttttttgggtcctaatcctttcgttgcctggatgcacttcctcgtgtttctggtgggaagggtcgcgcacaccgtagcttacctgggcaaactgcgagcaccaattagatcagttacatacacactggctcagcttccatgtgctagcatggccctccaaattttatgggaggccgctcgacacctctag

SEQ ID NO: 201008 - DNA, 561 bp, Artificial Sequence
  Description of Artificial Sequence: Synthetic coding sequence
atgaaggccgtgaacgagcagggcaaggaggtgaccgagttcggcaataagtactggctgatgttaaatgagaaagaggctcagcaagtatatgggggaaaggaggctagaaccgaggaaatgaagtggcgacagtgggccgatgactggctggtccatctgattagtcctaatgtgtatcggaccccaacagaggctctggcttctttcgattacatcgtgcgggaaggcaaatttggagccgtggagggcgctgtcgcgaagtatatgggggccgccgccatgtacttgatcagtaaaaggctcaagtctagacatcgcttgcaagacaatgtgagggaggatctgtatgaggctgctgacaagtgggtggctgctgtaggtaaggatcgtcctttcatgggcggacaaaaacctaacctggcagatctagcggtgtacggtgtattgcgtgtgatggaagggcttgacgccttcgatgacttaatgcagcacacccatatccagccatggtatcttcgggtcgagcgggcaattaccgaggctagtcctgcccattag

SEQ ID NO: 201009 - DNA, 1134 bp, Artificial Sequence
  Description of Artificial Sequence: Synthetic coding sequence
atggaccccgccgcccgggtggtgcgggccctgtggcccggcggctgcgcacttgcatggcgcctcggggggcgtcctcagcccctgctgcccacacaatcccgagctggatttgccggcgcggccggtggtcccagcccagtcgcagctgcccgaaagggcagcccaagattgctcggagctgctgccctcgctctggggggagccctgggactgtatcatactgctcgatggcatttacgcgcccaggatctgcacgctgagagatcggctgcccaacttagtctatcttcacggctacagctcactctttatcagtacaagacgtgtccattttgctctaaagtgcgtgcatttctcgacttccacgcactcccttaccaggtggtagaagtcaacccagtgcgaagagcagaaatcaagttcagcagctatcgcaaggtgcctatactggtcgcccaggagggcgagtcgtctcagcaattgaatgacagttctgtgatcattagcgccttaaagacctatttggtgtcagggcagcccctggaagagataattacatattacccagcgatgaaggctgtcaatgagcaaggaaaagaagttacagaattcgggaataagtattggttaatgctgaatgagaaagaagcgcagcaggtgtacggcggcaaggaggcacgcacggaggaaatgaagtggcggcagtgggccgacgattggctggtacatctgatatctcccaatgtttataggactcccacagaagctctggcgtcatttgactacatcgtgcgcgaaggaaagttcggtgccgtcgagggtgccgtggctaagtacatgggcgcagctgcaatgtacctgatcagtaaacgcctgaaaagcaggcaccggcttcaggataacgtgcgcgaagatctgtatgaggcggcggataaatgggtggcagcagtcggaaaagaccgtccttttatgggaggacaaaaaccaaatctcgctgacttggctgtctacggtgtcttgagggttatggagggactagatgcgttcgatgacctgatgcagcatactcacatccaaccatggtatcttagagttgagagagccattacagaggcatcccctgcccactag

SEQ ID NO: 201010 - DNA, 894 bp, Artificial Sequence
  Description of Artificial Sequence: Synthetic coding sequence
atgagcatgaacaacagcaagcagctggtgagccccgccgccgccttgctgtcaaataccacctgccagactgaaaatcgcctgtcggtgttcttctctgtaattttcatgactgttgggatactctccaatagtttggctatcgcaattcttatgaaggcctatcaacggttcagacagaaatctaaagctagtttccttctgctcgccagcgggctggtaattaccgatttcttcggccatctgataaatggagccatcgccgtcttcgtgtatgcatcagacaaggaatggattcgctttgaccagtccaatgtcctctgtagtatctttggcatttgtatggttttctcagggctctgtcccctgctcctcgggagtgtcatggcaattgagcgctgcattggagtcactaaaccgatttttcattcgactaaaatcacctccaagcatgttaagatgatgctttccggagtgtgcctgttcgccgtgtttatagcactgctccccatccttgggcaccgcgattataaaatccaggcctctaggacctggtgtttttacaacactgaagacattaaagattgggaggaccgattttatctgttactgttctcctttctgggcttgctggcgttgggggtgagtttactgtgtaacgcaatcacgggcataactttgctcagggtcaagttcaagagccagcagcaccgccagggacgctcccatcacctagaaatggtgatccaattattagcaattatgtgtgtaagttgtatatgctggtcgccctttttaggttatagaatcatcctcaatggcaaggaaaagtacaaggtgtatgaagaacagtctgactttctccaccgtctgcagtggcctacgcttgagtag

SEQ ID NO: 201011 - DNA, 1080 bp, Artificial Sequence
  Description of Artificial Sequence: Synthetic coding sequence
atgagcatgaacaacagcaagcagctggtgagccccgccgccgccctcttatccaacaccacctgtcagaccgagaatcggctgagcgtgttcttttctgtgatcttcatgactgtcggaattctcagtaactctcttgcgatcgcgatcctcatgaaggcctaccaacgattcagacagaaatccaaagcctcgtttctgctgctagctagcggcctggtgatcactgatttctttggacatcttattaatggggccatcgctgttttcgtgtacgccagcgacaaagaatggatcaggtttgaccaatcgaacgttctgtgctccattttcggcatctgtatggtcttttctggcctctgccccctattgttaggtagcgtgatggctatcgaaaggtgtatcggggtaacgaagcctattttccacagtaccaaaattacaagcaagcacgtgaaaatgatgctgagtggcgtatgccttttcgcagtctttattgcccttttacccatcctgggccaccgagactacaagatccaggcctcccgcacctggtgcttttataataccgaagatatcaaggactgggaggatagattctatctgttactgttcagcttccttggactccttgccctgggggtgagcctgctgtgtaatgccatcacaggcatcacccttctcagggtgaaatttaaaagtcagcaacaccgccaaggccgatcccaccacctggaaatggtcatccagctgctggccatcatgtgtgtcagctgcatctgctggtcgccatttttagttacaatggcaaatattgggattaatggaaaccattcactggagacctgcgagaccaccctattcgcgttacggatggccacttggaaccagatcctggatccatgggtctacattttgctgaggaaagccgtgctgaaaaacctctacaagctcgctagccagtgttgcggcgtccatgtgatctccctgcacatatgggagttatcttccatcaagaattctttgaaggtggcggccatctccgaatctccggtagcagagaagagcgcctctacctag

SEQ ID NO: 201012 - DNA, 1080 bp, Artificial Sequence
  Description of Artificial Sequence: Synthetic coding sequence
atgagcatgaacaacagcaagcagctggtgagccccgccgccgccctactgtctaataccacctgccaaaccgagaacagactgtccgttttcttctcagtcatcttcatgactgtcggtattctgtccaactccctcgccattgccatcttaatgaaggcataccagaggtttcgccagaagtcaaaggcctcatttctgttgctggcctctggactcgtcataaccgacttcttcggccacctaataaatggtgccatcgctgttttcgtgtacgccagcgataaagaatggatcaggttcgatcagtccaacgtgctgtgcagcattttcggcatatgcatggtgtttagcggcctgtgcccactccttcttggcagtgtaatggccatcgaaagatgcataggagttaccaaacctattttccattctacaaaaatcactagcaagcatgtgaaaatgatgctgtctggcgtatgtctgttcgccgtctttatcgccctgctgcccatcctgggacaccgcgactacaaaatccaagccagcaggacatggtgcttctataatacagaggatatcaaggattgggaggatcgcttttatctcttgctgtttagcttcctgggattgcttgcgctgggcgttagccttctctgcaatgccattactggaatcactttactcagggtgaagttcaagtcccaacagcatcggcagggacgaagccaccacctcgaaatggtgattcagttgctggctatcatgtgcgtgtcctgtatctgctggtccccattcctggtgacgatggccaacatcggaattaatgggaatcattcattggaaacttgcgagacgaccttgttcgcactacgtatggctacatggaaccaaatactggatccttgggtctatattctgttacgtaaggcagtgctcaaaaacctgtataaacttgccagtcagtgttgcggggtgcacgtcatctctttacatatttgggagctctctagtataaagaactccttaaaggtggccgcaatttcagagtcccctgtcgcagaaaaatccgcttcaacctag

SEQ ID NO: 201013 - DNA, 2640 bp, Artificial Sequence
  Description of Artificial Sequence: Synthetic coding sequence
atgggccggctggccagccggcccctgctgctggccctgctgagcttggctttgtgtcgaggcagggtagtgagagttccaaccgcgacgctggtacgagtggtgggcacagagctagtgatcccgtgcaacgtttccgattatgacggcccctctgagcagaactttgattggagcttctcatccttaggctcttcctttgttgagcttgcgtcgacttgggaagtcggtttccccgctcaactctaccaggagaggctacaacgaggcgaaatcctgctccggcggactgcaaacgatgcagttgagctgcatatcaagaatgtgcagccatctgatcagggccactataagtgtagcacgccttctaccgatgcaactgtccaaggcaattacgaagacaccgtgcaggtgaaggtactggcagactcccttcacgtcgggcccagtgcaagaccacccccatcgctgagcctcagagaaggggaacccttcgagctcagatgtacggcagccagtgcctccccgctgcatacacaccttgctctgctctgggaggttcaccgcggacccgctcgacgctcagtcctggctcttactcacgaggggaggttccacccaggcctgggctatgagcagagatatcattccggggacgtcagactcgacactgtgggcagcgatgcctaccggctgtccgtctcacgcgctttaagtgccgatcagggcagttatcggtgtatcgttagtgagtggattgcagagcaagggaactggcaagagatacaggaaaaggcagtggaagtcgcaaccgtggttatacagccgtccgtcctgcgggctgccgtgcccaagaatgtgagcgtggccgagggtaaagaattggacctgacttgcaacattacgacggacagagccgatgacgtgaggccagaagtgacgtggtcattctctcggatgcccgattccacactccccgggagccgcgtgctcgctagactggatagagattctttagtgcactcctccccccacgtggccctgtcccatgtggacgccaggtcataccatttgctcgttcgggatgtttctaaagaaaactctggctattattattgccatgtgagtctgtgggccccaggccacaacagatcctggcataaggtggccgaggcggtttcttcacctgccggggttggcgtcacctggttggagcctgattatcaggtctatctcaacgcctctaaagtacccggtttcgccgatgaccctacggagcttgcctgcagggttgtagatactaaaagtggagaggccaacgttaggttcaccgtcagttggtattatcggatgaacaggcggagcgataacgtggtcacaagcgagctacttgctgttatggacggcgattggacattaaaatacggggagcgctccaagcagcgcgctcaagacggagacttcatcttttccaaggagcacacagacactttcaattttcgcatccagagaacaacggaggaggatagagggaactactactgcgtggtctcggcatggacgaaacagcggaacaattcttgggtgaagagtaaggacgtgttctccaaacccgtgaacatcttttgggcactcgaggactcagttttagttgtaaaagctcggcagcctaagccctttttcgctgctggcaatacctttgaaatgacctgcaaagtgtcatccaagaatattaaaagcccccggtacagcgtcttgatcatggcagagaagccagtgggcgatctcagctccccaaacgaaactaaatatatcatatcactggatcaggattccgtagtcaagctggaaaattggacagatgcatctagagtcgacggggtagtattagagaaggttcaagaagacgagttccggtatagaatgtatcaaacgcaggtctccgatgcgggactgtaccgctgtatggtaacagcttggagccccgtgaggggtagcctgtggcgcgaggcggcaacatctcttagtaatcctatagaaatcgattttcagacatcgggacccatcttcaacgcctcagtgcattcagataccccctctgtgattcggggagaccttataaaactgttttgcattatcaccgtcgaaggcgccgccctggaccccgacgacatggcctttgatgtttcttggttcgctgttcattcctttggcctggacaaagctccagtcctgctgtcttctctagatagaaagggcatcgtaaccactagccgaagggactggaagtctgacctctctctcgaaagggtttccgtgcttgagtttctgttgcaagtacacggaagcgaggatcaggactttgggaattattactgttcagtcacaccatgggtgaaaagtccaaccggcagctggcagaaggaggccgaaatacacagtaagcccgtgtttattacggtgaaaatggatgtcctgaatgcttttaagtatccactgttaatcggagttggactctctacagtcataggcctgttaagctgtctcattggctactgttcgtcgcattggtgctgtaagaaggaggtgcaagagacaaggcgggagcgtagaaggctgatgtccatggagatggactag

SEQ ID NO: 201014 - DNA, 2217 bp, Artificial Sequence
  Description of Artificial Sequence: Synthetic coding sequence
agcggcgccgccggcgccggccggggcggcggcggcgaggccgccggcaaagaggaagagggcgaaccctttgagctacgctgcactgcggccagtgcctcgcccctgcacacacacctcgcactgctatgggaggttcaccggggccctgctaggcgctccgtccttgccctgacccacgagggaaggtttcatccaggcctcggttacgagcaacggtaccattcgggggacgttagactggataccgtgggcagcgatgcttacaggctatccgtctctagggcactgagtgcagatcagggaagctataggtgcatagtatccgaatggattgcagaacaaggaaattggcaggagatccaggaaaaggccgtggaggtggctaccgtggttattcagccaagcgtcctgcgcgcagctgtgccaaaaaatgtgtctgtcgcagagggtaaggaacttgatttgacatgtaacattaccactgaccgtgcagatgacgtaagacccgaggtgacttggagcttcagcagaatgcccgacagcaccctccccgggagccgggtgctggcaaggctcgatcgagattctctcgtgcattcatcacctcacgtcgcattatctcacgtggacgcccggtcatatcacttgcttgtcagagatgtgtccaaggaaaacagcgggtactattactgtcacgtctcattgtgggccccagggcataatagatcctggcataaagttgcagaagctgtatcatcaccagctggagtgggggtaacatggctggaaccggactatcaagtatatctcaacgccagcaaggtgccagggttcgcagacgacccaaccgagctggcatgccgggtcgtagataccaaatctggtgaagctaacgtgcgctttacggtgtcttggtattacaggatgaatcggcggagtgataatgtggttacgagtgagctgctggcggtgatggatggtgactggacactgaagtatggagagagatccaaacaacgcgctcaggatggagattttatattcagtaaggagcacactgataccttcaattttaggatccagaggacgaccgaagaggaccgcgggaactattactgtgtcgtctcagcctggacaaagcaacgcaataactcatgggtcaagtccaaagacgtgtttagcaagcctgtgaatatcttctgggctctggaagacagcgtgctcgtggtgaaggcgcggcagcctaagcctttcttcgccgccggaaacaccttcgaaatgacatgtaaagtctccagcaaaaacattaagtctccgcgttactcagtgttgattatggctgagaagcctgtcggagacctgtctagcccaaatgaaaccaaatacattatcagcctggaccaggactccgtggtgaagcttgaaaactggactgacgcttcacgggtggatggggtcgtgttggaaaaggtgcaggaagatgagtttcgctaccgcatgtaccagacacaggttagcgatgcaggcctttataggtgcatggtgactgcctggagcccagtgcggggctccctgtggcgagaagctgcaacttcgctatccaatccgattgaaatcgatttccagacatccggaccgatatttaatgctagcgtccactccgataccccgtccgtgatcaggggcgacctgatcaaactattctgtatcatcacagttgagggcgccgccctcgacccagacgacatggcattcgacgtatcatggttcgccgtacattcattcggcctggataaggcccctgtgttgctctctagtctcgatagaaaagggattgtgacgacttcacggcgagactggaaatctgatctctcactggaaagggtttcggtcctagaattcctcctgcaggttcatgggtcagaggatcaagatttcggcaactactattgcagtgtgacgccttgggtgaagagcccgacaggatcttggcaaaaagaggcggaaattcactcgaaaccagtattcattactgttaaaatggatgtccttaacgctttcaagtacccactgctgataggggtaggtctgagtaccgtgattggcctgctgagttgcttgatcggttactgcagctcacactggtgttgtaaaaaagaggtgcaggaaacacgaagagaacgacgaaggctcatgtccatggagatggactag

SEQ ID NO: 201015 - DNA, 1161 bp, Artificial Sequence
  Description of Artificial Sequence: Synthetic coding sequence
atggccgacagctgccggaacctgacctacgtgcggggcagcgtggggccggccacctccaccctgatgtttgtagcaggcgtcgtagggaatggattagctttgggcatcctgtccgccagaagacccgctagaccttccgctttcgccgtgctggttaccgggctggccgcaaccgatctcctgggtacaagcttcttatccccggcagttttcgtagcttacgcaaggaacagttctctcctaggtctcgcgcgtggaggccctgctctgtgcgacgccttcgctttcgcgatgacctttttcggcctcgcatccatgctgatcctgttcgctatggctgtggagaggtgtctcgcgctgtcacatccttacttgtacgcccagctggacggccctaggtgtgcacgcctcgccttacctgccatctatgctttctgcgtcttattttgcgcgcttcccttgctcggactgggccagcatcagcagtactgtccaggaagttggtgctttctgcggatgcgatgggcccagccgggcggcgccgctttttcactcgcttatgctggtctggtggccctattggttgcggccatattcctatgcaatggatctgtcactctttcactgtgtaggatgtatcggcagcagaagcgccatcagggcagccttggcccacgaccacggacaggggaggatgaggtggaccacttaattctgctggcccttatgacagtggttatggcggtctgtagcctgcccttgacaattcgatgctttacacaggccgtcgccccggacagcagtagtgaaatgggagacttgttggcttttagattttatgcctttaatccaattctcgatccatgggtgtttattctcttcaggaaagctgtttttcaaaggctgaagctatgggtttgttgcctgtgcttgggcccagctcacggggactctcagacgcccctgtcccagctagcctctggaaggcgggacccccgagcaccctctgcgcccgtcggaaaggaaggatcctgtgtgcctctgtcagcctggggcgaaggacaggtagaaccattacctccaacacaacagagctctggtagcgccgtcggaaccagctcaaaggctgaggcctctgtggcttgttccctctgttag

SEQ ID NO: 201016 - DNA, 1503 bp, Artificial Sequence
  Description of Artificial Sequence: Synthetic coding sequence
atggcctgggccgccctgctgggcctgctggccgccctgctgctgctcctgctattgtccaggagacggacaagacgacccggggaacctcctcttgacctggggagcataccttggttagggtacgctcttgactttgggaaagatgctgcaagctttctcaccagaatgaaggagaaacatggcgacatttttaccattctcgtgggtggtcggtatgtgacggtactgcttgatccacatagctacgacgccgtagtatgggaaccccgcacccggcttgactttcatgcctatgcaatatttctgatggaacggatcttcgacgtccagcttccccactacagccctagcgatgaaaaggccaggatgaagctgaccctgctgcacagggagctgcaggccctaaccgaagcaatgtacaccaatcttcacgccgtactactgggggatgcaaccgaagccggaagcgggtggcatgagatgggtctgctcgacttttcctatagttttctgcttcgtgctggatatctcacgctgtacggaattgaggcccttcctcggactcatgagagccaggcacaggacagagtgcactccgccgacgtctttcatacgttccgtcaattagaccgactgctcccaaagctggcacgggggagtctgagtgttggtgacaaagatcacatgtgctcagtgaaatcgagactttggaaactgcttagtccagcacgtcttgcaaggcgtgcacacaggagcaaatggttggaatcttacctcctccatttggaggagatgggcgtatccgaagaaatgcaggctagagcactggtcctgcagctctgggctacgcagggaaacatggggcccgccgcattctggttgctgctttttttgttaaagaacccagaagcgctggctgcagtgcgcggagagttagagtctatcttgtggcaggctgagcagcctgtgtcccagactacgactctgccacaaaaggtgcttgacagtacaccagtcctggatagcgtgctgtccgagtctttgcggttgactgcagcaccgtttattacccgcgaagtggtagtggacctggctatgcctatggccgacggcagggaattcaacctacgacgcggggacagactgctgctgttcccctttttgtcaccccagagagaccccgagatctacactgaccctgaagttttcaagtataatcggtttttaaatccggatggaagtgagaaaaaagatttttacaaggacggcaagaggctgaaaaactataacatgccatggggagccggtcataaccactgcttaggcaggtcatatgccgtgaactccatcaagcaatttgtcttcctggtgcttgttcacctcgatctcgagctcataaatgccgatgtggaaattcccgagtttgatctttcacgctatgggtttgggctgatgcaaccagagcatgatgtgccagttaggtacaggattcggccatag

SEQ ID NO: 201017 - DNA, 408 bp, Artificial Sequence
  Description of Artificial Sequence: Synthetic coding sequence
atgcgggccttcctgcggaaccagaagtacgaggacatgcacaacattattcacatactgcagatcaggaaattgcgccaccgcctgagtaacttccctcggctgccaggcatcctggcgcctgaaaccgttttactgccattctgttacaaggttttccgcaaaaaggagaaggtgaagcgcagccagaaggcaacggagttcatcgactatagcattgagcagagccatcatgccatccttacacctctacagacccacttaactatgaagggctcatccatgaagtgttctagcctttctagcgaggccattttgtttacattgacactgcagcttacacagactctgggacttgagtgttgtctcctctatctatctaagaccattcaccctcagatcatctag

SEQ ID NO: 201018 - DNA, 345 bp, Artificial Sequence
  Description of Artificial Sequence: Synthetic coding sequence
atggccggcctggccctgcagcccggcaccgccctgctgtgctactcctgcaaggcgcaggtgagtaacgaggattgcctccaagttgagaactgtacgcagctgggagaacaatgctggacagcacgcatcagagctgtcggcctgctaacggtgatctcaaagggatgcagcctgaactgcgtggacgatagccaggattactacgtaggaaaaaaaaatatcacctgctgcgacaccgatctttgtaatgcctctggggcccacgccctgcagcccgccgccgccatccttgccctgctgcccgcccttggtctcctgctctgggggccaggacagctgtag

SEQ ID NO: 201019 - DNA, 714 bp, Artificial Sequence
  Description of Artificial Sequence: Synthetic coding sequence
atgatggtgatggtggtggtgatcacctgcctgctgagccactacaaactctccgctagaagctttatatcccgccacagtcagggccgtcgtagagaggacgccctcagctcagagggctgtctgtggccatcagagagtacagtgagtggtaatggaatcccagagccccaggtctatgctcctccgagacccactgacagactcgctgttcctcccttcgcccagcgcgagagattccataggttccagcccacctacccctatctccaacacgagattgacttgccaccaacgatcagcctgtcagatggggaagaacctcctccgtaccagggcccgtgcacactgcagcttagagaccccgaacagcagctcgaactcaatcgggagtctgtcagagcaccacctaaccgcacaatattcgactctgacttaatggacagtgctcgcctcggagggccttgtccaccctcgtctaattctggaatcagcgctacttgttacggttccggcggacggatggaggggcctccaccaacgtatagcgaggtaattgggcactatcctggctctagttttcagcaccaacagagtagcggcccccccagcctcctggagggaactcggctgcaccatacccatattgcccccctcgagtctgccgcaatctggtcaaaggagaaggataagcagaaaggccaccccttatag

SEQ ID NO: 201020 - DNA, 864 bp, Artificial Sequence
  Description of Artificial Sequence: Synthetic coding sequence
atgcaccggctgatgggcgtgaacagcaccgccgccgccgccgccggccagcctaacgtctcgtgcacttgcaattgcaagcgcagcctcttccagtcaatggaaatcaccgagttggagtttgtgcagataatcatcattgttgttgttatgatggtgatggtggttgtcattacgtgtttgctgagccactataagctgtccgcaagatctttcatctcaaggcactcccaggggcgccggagggaagatgccctgagctccgaaggctgcctgtggcccagcgagagcactgtgagcgggaatggcatccccgaacctcaggtatacgcgccaccccgcccgactgatcgacttgcggtgcctcccttcgcacagcgcgagcggtttcataggttccaacccacatatccgtaccttcagcacgagattgatctcccacctaccatttccctcagcgatggagaggagccacctccgtaccagggcccctgtacgcttcaactgcgagatcccgagcagcaactcgaactcaatagggagagtgtgagagcccctccaaacaggacgatcttcgactcagaccttatggattccgctcgacttggcggaccatgtccaccctcaagcaatagcggcataagcgctacttgttacggcagcggaggacgaatggaaggcccaccccctacctattcagaagttatcggccactaccccggtagttcatttcagcaccaacaaagtagtggcccaccaagtctactcgagggcacacgactgcaccatacccacatcgcgcctttggaaagcgcagccatttggtccaaagaaaaggataaacagaaaggccacccgctgtag

SEQ ID NO: 201021 - DNA, 759 bp, Artificial Sequence
  Description of Artificial Sequence: Synthetic coding sequence
atggccgagctggagttcgtgcagatcatcatcatcgtggtggtgatgatggtgatggtggttgtgattacatgcctccttagtcactacaagctatccgctcggtccttcatcagccgccacagccaggggcggaggcgggaggatgccctgtcaagtgagggctgcctgtggccctcagaatcaactgtgagcgggaacggcatccccgagccacaggtttacgcgccacctaggccaactgacagactggccgtgcccccctttgctcagagggaaagattccatcgttttcagcctacctacccctacttacagcacgagattgacctaccgccaactatcagtctgagcgatggggaggaaccgcctccttatcagggaccctgtaccttacagttgagggaccccgaacagcagctggaactgaacagggaatccgtgcgagccccacccaatagaaccatcttcgactctgaccttatggactcagccaggctcggaggaccatgtccacccagttcaaacagcggtatctctgctacctgttatggcagcggaggaaggatggaggggccgccacccacatacagtgaagtgatcggccactatcctggcagcagctttcagcatcagcagagtagcggccctccttctctgctggagggtacacgactgcatcacacccatattgccccccttgagtctgcagccatttggagcaaggaaaaggataaacaaaagggacacccgttatag

SEQ ID NO: 201022 - DNA, 714 bp, Artificial Sequence
  Description of Artificial Sequence: Synthetic coding sequence
atgatggtgatggtggtggtgatcacctgcctgctgagccactacaaactgagtgctagaagcttcatttcccgccacagccaagggcgccgcagggaggatgccctgtcctctgaaggctgtttgtggcctagcgaaagtacagtgtcagggaatggaattccagagccacaagtctatgcgcctcctcgacccaccgaccgcctggctgtcccacccttcgcacagcgcgagcggtttcatagattccagcccacgtatccttacctccagcatgagattgatctgcccccgacgatcagcctatccgatggtgaagaaccacccccctatcagggtccttgtactctgcagctgcgggatcccgagcaacagcttgaattgaacagggaatcagttagggccccccccaatcggaccatcttcgatagtgatcttatggatagcgcacggctgggcggaccttgcccaccctcatccaattctgggatctctgctacttgttacggatctggcggccggatggagggcccaccccccacctactccgaggttatcggtcattatcccggctctagcttccaacatcagcagagctccgggcctccctcattgctcgaagggacgcgacttcatcatacacatattgcgcctctggagagtgcagcgatttggtcaaaggagaaagacaagcagaagggacaccccctttag

SEQ ID NO: 201023 - DNA, 714 bp, Artificial Sequence
  Description of Artificial Sequence: Synthetic coding sequence
atgatggtgatggtggtggtgatcacctgcctgctgagccactacaagttgagtgcacgcagcttcatctctcgccattcacagggaagacggagagaagatgctctgtcctccgagggctgtttatggccttcagaaagcactgtgtctggtaacggcattcctgagccgcaggtgtatgcacccccaagacctactgataggctcgctgtgccacctttcgcgcagcgcgagcgctttcacaggtttcagcctacatatccctacctgcagcatgagatcgatcttccccctactatttcactgtctgatggagaagagcccccgccgtaccaggggccatgcacactgcaactgagggatcctgaacagcagttggagttgaatcgtgagtcggtccgagctcctccaaatagaacaattttcgatagcgatctgatggactccgcgaggctgggcggaccctgtcctccttcttcgaattccggcatctcagctacatgctatggctccggggggagaatggaaggcccgccgccaacctactcggaagtcatcggtcactacccaggatcctcttttcagcatcaacagtcgtccggacccccaagcctgctggaggggacccgcctgcatcacacccacattgccccccttgagtccgccgccatctggagtaaagaaaaggacaaacaaaagggccacccactgtag

SEQ ID NO: 201024 - DNA, 684 bp, Artificial Sequence
  Description of Artificial Sequence: Synthetic coding sequence
atgcaccggctgatgggcgtgaacagcaccgccgccgccgccgccggccagcctaatgtgagctgtacatgcaattgtaaacgatccctgtttcagtccatggagattagctgtcatggtttcccagtttgtaagtctcaccaacatcaggaatggaagtccctgtgttggagtctcaggagtccaggcggtgcaagtagtattaccgggttcgggtcaatgaaagtaaccaatcctgccatgaacctcccggaatgtcagtggcttcgcattcagaaagctgaactcgagtttgtccaaataattatcatcgtggtggtgatgatggtaatggtggtcgtgatcacttgcctcctgtctcattataagctgtctgctcgctccttcatcagcagacacagtcagggtagacgacgagaagacgccctcagtagtgaagggtgcctgtggcccagtgagtcaacagtatcgggcaacgggattcccgagcctcaagtgtacgctcccccaaggcctacagatagactggctgtaccccccttcgcacagcgggaacgctttcatcgatttcagcccacttacccgtacctgcagcacgagattgatctgccacctaccattagcttgagtgacggggaagaacctcctccatatcagggtccctgtaccttgcagctgcgatag

SEQ ID NO: 201025 - DNA, 627 bp, Artificial Sequence
  Description of Artificial Sequence: Synthetic coding sequence
atgcccgccatccccgcccacggcgccgagctggagttcgtgcagatcatcatcatagtcgttgtgatgatggtgatggtggtcgtgataacatgcctgctgagtcactataagctgtcagcccgcagcttcatctcgaggcacagtcagggtaggcggagagaggatgccttgtcatccgaaggttgtctatggccttctgagagcactgtcagcgggaatggaatcccggaaccccaagtgtatgcccctccaaggcccacggacaggcttgccgttcctccctttgcccaaagggagcggttccacagatttcagcctacttatccctatttgcagcacgaaattgacctgcctcccacgatctcactgagcgatggggaggagccccccccttatcagggcccctgtactctccaattacgggatcctgaacagcagctcgaacttaatcgcgagtcagtccgcgcccccccgaaccgcaccattttcgacagtgatttgatggattctgcccgcttgggaggtccatgccctccatcttcaaattctggcatctcagccacatgttatgggagtggcggacgaatggagggcccaccccccacctattctgaggtgatttag

SEQ ID NO: 201026 - DNA, 156 bp, Artificial Sequence
  Description of Artificial Sequence: Synthetic coding sequence
atggcccggtaccggtgctgccggagccagagccggagccggtactataggcaaaggcaacgatcaaggcgtaggcggagaaggagctgtcaaacccgcagacgcgctatgaggtgctgccgccctagataccgaccccggtgtcgcaggcattag

SEQ ID NO: 201027 - DNA, 309 bp, Artificial Sequence
  Description of Artificial Sequence: Synthetic coding sequence
atggtgcggtaccgggtgcggagcctgagcgagcggagccacgaggtataccgacagcagcttcatgggcaggaacagggccaccacgggcaggaggagcaagggctgagccctgaacacgtggaagtgtacgaacggactcacgggcaatctcattatcggcgtaggcattgctctagaaggaggctgcaccgtattcatcgacgccagcaccgctcctgcaggcgtcggaaaaggcgcagctgtcggcatagaaggagacacagacggggatgccggactaggaaacgcacatgccggcgccattag

SEQ ID NO: 201028 - DNA, 423 bp, Artificial Sequence
  Description of Artificial Sequence: Synthetic coding sequence
atggtgcggtaccgggtgcggagcctgagcgagcggagccacgaggtctaccggcagcagctccacgggcaggagcaagggcatcatggccaggaggagcagggcctgagccctgaacacgtggaggtgtatgaaagaacccatggccagtcccattaccggcgccgccattgttcccggaggcgtttacatcgtattcatcggcgccaacaccggtcgtgtcgtcgaagaaagaggcggtcctgccggcaccgccgccgtcaccggcgggaatccctcggagatccgcttaatcagaattttctgagccagaaagccgctgagcctggacgcgagcatgctgaaggaaccaaattgcccgggcctcttacccccagctggaaactaagaaagagcaggcctaaacatcaggttcgaccgtag

SEQ ID NO: 201029 - DNA, 657 bp, Artificial Sequence
  Description of Artificial Sequence: Synthetic coding sequence
tgactggccctgctgctggcccgggccggcctgcggaagcccgagtcacaggaggctgcaccattgtctggaccatgtgggaggagggtgattacctcaaggatcgtaggtggagaggatgcggagttaggacgctggccatggcagggctctctccggttgtgggattcccacgtttgcggagtcagcctactgagtcatagatgggccttaactgccgcgcactgtttcgagactgatctttcagacccttccggttggatggtgcaattcggacagctgacctctatgccttccttttggtctttgcaggcctactacacacggtacttcgtatccaacatttacttgtcaccacgctatctagggaactcaccctacgacatcgctctggtgaaactctcggctcccgtaacatatactaagcatatccagccaatctgcttacaagcatctacattcgagtttgagaaccggacagattgttgggtgaccgggtggggctacatcaaggaagacgaaggcagctccggacgccatcacaagcagctttatgtacaaccacccctgccccaagtgcagtttcctcaaggccatttgtggcggcacggactttgctggcagtgccctcgtcgggaagggtgtttgctgcgatag

SEQ ID NO: 201030 - DNA, 744 bp, Artificial Sequence
  Description of Artificial Sequence: Synthetic coding sequence
atgaaccccctgctgatcctgaccttcgtggccgccgccctggccgctccattcgacgacgacgacaagatagttggcggctataattgtgaagaaaactccgtgccttaccaggtttcattgaactcgggctaccatttctgcgggggtagcctgatcaacgagcagtgggtggtgagcgctggtcattgctataaaagcagaatccaggtgcgcctcggcgaacacaatatcgaggttctggagggaaatgagcagtttatcaatgctgctaaaattataaggcacccacaatacgaccgtaaaacactgaacaatgatatcatgctgatcaaactgtcgtcacgggccgtgatcaatgctagagtttccacaatctccctgcccaccgctccccccgcaaccgggacaaaatgcctgatttccggttggggtaatacagctagctctggcgcagattatccggacgagctacagtgtctggacgcccccgtgctgtctcaggcaaaatgcgaagcctcgtacccgggaaagatcaccagtaacatgttttgtgtaggcttcctagaggggggaaaggacagctgtcagggcgattcaggaggacctgtagtgtgcaatggacagcttcagggcgttgtgtcttggggggacgggtgcgctcagaagaacaaacctggcgtatatacgaaggtctataattatgtgaagtggattaagaatactattgccgctaattcttag

SEQ ID NO: 201031 - DNA, 714 bp, Artificial Sequence
  Description of Artificial Sequence: Synthetic coding sequence
atgaaccccctgctgatcctgaccttcgtggccgccgccctggccgcaccatttgatgatgatgataagatcgtaggcgggtacaactgcgaggagaattccgtaccataccaggtgagcctgaattctggctatcatttttgtggtgggtccttgatcaacgaacagtgggttgtcagcgccgggcactgctacaaatctagaattcaggtgcgtttaggcgagcacaacattaatgcggcaaagatcattagacaccctcaatacgacaggaagaccctgaataatgacatcatgctgataaagctgtctagcagagcagttattaacgctcgggtgagcactatctcccttcccaccgctccacctgccactggaacaaaatgcttaatcagcggctggggaaatactgccagctccggggccgactatccggatgagttacagtgtctcgacgctcccgttctcagccaggccaagtgtgaagcatcctaccctggaaagattaccagtaacatgttctgtgtcggcttcttggagggaggtaaagattcctgtcagggggactctggtggcccagttgtatgcaatggacagctgcagggtgttgtgagctggggtgacggatgtgcccagaagaacaaaccaggggtttatactaaggtgtacaattatgttaaatggattaagaacaccatcgccgccaattcatag

SEQ ID NO: 201032 - DNA, 2628 bp, Artificial Sequence
  Description of Artificial Sequence: Synthetic coding sequence
atgaccctggcccggttcgtgctggccctgatgctgggcgccctgcctgaagtggtggggttcgacagtgtcctgaacgacagtttgcatcattctcatagacactccccccctgctggccctcattatccttactatttaccaactcagcagcgccctccgcgaacccggccgccccctccactacccagattccctcggccaccccgtgccctgccagcccagaggccgcacgcgcttcaagccggacacactccccgcccgcacccatggggatgccccgctggtgagccatgggtatctgtcacagacttcggagcaccctgcttgcgatgggctgaggtgcctccattcctcgagcggtctccccccgcctcctgggcgcagttgaggggacagaggcataacttttgcaggagcccagacggtgccggacggccttggtgtttctatggcgatgcccgaggaaaagtcgactgggggtattgtgattgtagacatggctccgtacggttgcggggtggaaagaacgagtttgaaggcacagtagaggtctacgcaagcggagtgtggggtaccgtctgttcctctcactgggatgacagcgacgcctcagtgatctgccaccaactgcagctgggggggaagggcatagcaaaacagacaccattttcaggcttggggctgatccccatttactggagcaatgtgcggtgcagaggggatgaggagaatattctcctgtgtgagaaggacatctggcaggggggcgtttgccctcagaagatggccgctgcagttacctgtagcttcagccacgggcccacttttccgataatcaggctggctggaggctcctcagtccacgaaggcagggttgaactgtaccacgctggacaatggggcaccgtgtgcgatgatcagtgggacgacgctgacgcagaagttatctgccgtcagctgggactgtctgggatcgccaaagcatggcatcaggcatactttggggaggggagcgggcccgtgatgctggatgaggttaggtgcacaggaaacgagctgtcaatcgagcagtgtcccaagagcagttggggagaacataactgcgggcataaagaggatgctggagtcagttgtaccccccttaccgatggagtaatcagactcgctggtggaaaaggatctcacgaagggcgcttggaggtttactacagaggccaatgggggactgtgtgtgacgacgggtggacggaactcaatacttatgtggtgtgccgccagttgggcttcaagtacgggaagcaagcctcggccaaccacttcgaggaatccactggccccatttggcttgacgacgtgtcctgctccggcaaagaaacccgcttccttcagtgttcacggcgacaatggggaaggcatgattgtagtcaccgcgaggatgtttcaatcgcttgttacccgggcggagagggtcataggctcagcttagggtttcccgtgcgtctaatggatggggaaaataaaaaagaaggccgcgtggaggtgtttattaacggccagtggggcacaatctgcgacgacgggtggactgacaaagacgcagccgtgatttgcaggcagctcggttacaaaggcccggcccgagcccgaacaatggcgtacttcggcgaagggaaaggacccatacatgtggacaatgtgaaatgtacaggaaacgaaaggagccttgccgactgtatcaagcaggatatcggcaggcataactgtcgccatagtgaagatgccggagtgatctgtgattacttcggcaagaaggcgtctgggaattccaataaagagagcctttccagcgtttgtggcctcaggttgctgcaccggcgacaaaagcgtatcatcggtggcaaaaattccttacgggggggttggccttggcaagtgtccttgaggctgaagtcatcccatggcgacggaaggctgctatgtggcgcaacactgctgtccagctgttgggtgctgacagccgcccactgctttaagagatatggaaacagtactcgttcatatgccgtgcgcgtcggtgattatcatacgctcgtgcctgaggagttcgaggaggaaattggggtgcagcagattgtcatacaccgcgagtaccggcctgaccggtctgattacgatatcgcccttgtgagacttcagggccctgaggagcagtgcgccagattttcatctcacgttttgcctgcctgtctgccattgtggagggagcgtccacagaaaacagctagcaattgttatattacagggtggggggacacaggacgtgcctacagtcgcacattgcagcaggctgccatcccgttactgcccaaaagattttgcgaggagcgctacaagggccggttcaccggtaggatgttatgtgccggaaacctgcatgagcacaagcgggtggacagttgccagggagattcggggggtcccctaatgtgcgaacgccccggggaaagttgggtggtgtacggtgtcacatcctgggggtacggctgtggagtaaaagattccccaggtgtgtatacaaaggtaagtgcatttgtgccctggatcaaatccgtgactaaactctag

SEQ ID NO: 201033 - DNA, 489 bp, Artificial Sequence
  Description of Artificial Sequence: Synthetic coding sequence
atgaagggcttcaccgccaccctgttcctgtggaccctgatcttcccttcttgcagtggcggcggcgggggaaaggcctggcccacccacgtggtctgcagcgatagcggactggaagtgctgtaccagagctgcgatcctttacaggacttcggtttttccgttgaaaagtgtagtaagcagctgaagtctaacatcaatatccggttcggtatcatcctgagggaggacattaaggaactgtttcttgacctggctctcatgagccagggcagtagcgtgttgaacttttcctatccaatttgcgaagctgcattgcctaaatttagtttctgcggaaggcgcaagggagaacaaatctactacgctggaccagtaaataaccccgaatttacaatcccccagggagaataccaggtgttgttggaactgtatactgaaaagagatccactgtcgcgtgcgccaatgccactatcatgtgcagttag

SEQ ID NO: 201034 - DNA, 822 bp, Artificial Sequence
  Description of Artificial Sequence: Synthetic coding sequence
atggccgtgtggctggcccagtggctgggccccctgctgctggtgagtctgtggggactgcttgcgcccgctagtctactgagacgactgggggagcacattcaacagtttcaggaatccagtgcccagggcttaggattgagcttgggccccggggctgctgccctaccaaaagtggggtggttggaacagcttctggatcctttcaatgtgtctgatagaaggtcgttcttacagaggtattgggtaaacgatcagcattgggtgggacaggatggtcctatcttcctccatctgggcggcgaagggtccttggggcccggatccgtcatgcgcgggcatccggctgcgcttgcacccgcctggggtgctctggtcatctctctggaacaccgcttctatgggctcagcatccccgctgggggtctcgaaatggctcaactgaggttcctcagtagtaggctggccttggcagacgtggtgtcggcccggctggcactgtcacgtttatttaacatcagtagttcctccccctggatctgcttcggcggctcctatgcaggctcactcgctgcatgggcccgcctcaagttccctcatctcatctttgcctccgtagccagttctgcccctgtccgtgccgtgctggattttagtgaatataacgatatagtgcttcattcattgggccagaagtgtctcagttttagccgagctgaaacggtcgcccagttgaggtccaccgagccccagttatccggggtgggcgatcgccagtggctctatcagacttgtacagaattcggattttacatcacctag

SEQ ID NO: 201035 - DNA, 501 bp, Artificial Sequence
  Description of Artificial Sequence: Synthetic coding sequence
atggccgtgtggctggcccagtggctgggccccctgctgctggtgagtctgtggggtctgctggctcctgctagcttgttaaggaggctaggcgaacacatccagcagttccaggaaagttcggcccaggggctcggactatccttagggcccggcgctgctgccttgccaaaggttggatggctggagcagctccttgacccctttaatgtctcagatagacgatcttttctgcagaggtactgggtaaatgaccagcactgggtgggccaagacggccccatttttctgcacttgggcggcgagggaagcctgggacctggatcagtgatgcgaggacatcctgcagcactggcacccgcttggggggcgttggtgattagtttagagcatagattttacggcttgtccattcctgcagggggactcgagatggcccagttgcgcttcttgtcaagtcgactggcgctctcctgtaccgcctgggcaaggtcggtgtag

SEQ ID NO: 201036 - DNA, 498 bp, Artificial Sequence
  Description of Artificial Sequence: Synthetic coding sequence
tgagtgatgcggggccaccccgccgccctggcccccgcctggggcgccctggtgatatccttagagcatcggttctacggccttagtattccggcaggcgggcttgaaatggctcagttaagatttctgtccagccgcttggcgctggcagatgtagtgtccgccaggctggccctgagtagacttttcaacatctcaagcagttccccatggatttgtttcggaggttcctatgcagggtccttggctgcatgggccagactcaagttccctcacctgatttttgcctctgtagcttcgagcgctcccgtgagagcagttttggattttagcgagtataacgacattgtgcttcactccttgggtcaaaagtgcctgagtttttcccgagccgaaacagttgcccagctgcgctccaccgaacctcagctctctggggtaggagatcgccaatggctgtaccagacctgcaccgagttcggattttacgtcacctag

SEQ ID NO: 201037 - DNA, 945 bp, Artificial Sequence
  Description of Artificial Sequence: Synthetic coding sequence
atgggcgcccggggcgccctgctgctggccctgctgctggcccgggcaggcctgcggaagcccgaaagccaggaggcggcaccattgagtggcccttgcggccgcagagtcatcaccagtagaattgtggggggcgaagacgccgaactggggcggtggccctggcagggttctttgaggctgtgggactctcatgtgtgtggagtgagcctgttgagtcaccggtgggctttaacagcggctcattgtttcgagacgtatagcgacctgtcagaccccagtggttggatggttcagtttggccagctgacatctatgccctccttttggagcttgcaggcatattatacacggtacttcgtgtcgaacatttatctcagtcccaggtatttgggaaactccccttatgacatcgccctggtcaagctcagcgcgcctgtgacatataccaaacatattcagcccatctgtctccaagctagcacctttgagtttgaaaaccgtacggattgttgggtgactggctgggggtacatcaaagaggacgaagccctgccctccccccacacgcttcaagaagtccaagtggcaattattaacaactccatgtgcaaccatctgttcttgaagtattccttcaggaaggatattttcggcgatatggtgtgcgctgggaatgcccaggggggcaaggacgcatgctttggggactccggcggtcctctggcctgcaataagaatggactgtggtatcagataggagtcgtttcctggggcgtggggtgcggccggccgaatcgccccggcgtctatactaacataagccatcacttcgaatggatccaaaagcttatggcacagtcagggatgtctcagcctgacccctcctggccacttctctttttccccctgttatgggcactccctctattggggcctgtgtag

SEQ ID NO: 201038 - DNA, 903 bp, Artificial Sequence
  Description of Artificial Sequence: Synthetic coding sequence
atgggcgcccggggcgccctgctgctggccctgctgctggcccgggctgggctccgaaagcctgaatcacaagaggctgcgccattatctggtccttgtggtcgtcgggtcattacttcacggatcgttggaggggaggatgccgaattaggtcggtggccttggcaaggcagccttcgtctgtgggacagtcatgtttgcggcgtcagtcttctgtcccatcgctgggcacttaccgccgcacattgtttcgagacctactctgacttgtctgacccctctgggtggatggtacagttcggacaacttacaagtatgccatcattttggtccttgcaggcctattatacccgctactttgtcagtaatatctatctgtcgccccggtatctgggcaactccccttacgacattgccttagtgaaactaagtgctcctgtaacctacaccaagcatatccagcctatatgcctgcaggcatccacattcgagtttgaaaatcgcacagattgctgggttactgggtgggggtatatcaaagaagacgaagcactcccctccccccacactctacaggaagtgcaggtggcgattattaataattccatgtgcaaccacctctttctgaagtattcctttcgaaaggacatttttggtgacatgggagactcgggcggaccactcgcttgcaacaaaaacggcttgtggtaccaaatcggtgttgtgtcatggggcgttggatgtggccgacctaacagaccaggagtgtatacaaacatttcacaccatttcgagtggattcagaaactgatggctcagagcggcatgagtcaacccgatccttcctggccactgcttttttttccattgctgtgggccctacctctgttaggtcctgtgtag

SEQ ID NO: 201039 - DNA, 939 bp, Artificial Sequence
  Description of Artificial Sequence: Synthetic coding sequence
atgggcgcccggggcgccctgctgctggccctgctgctggcccgggcaggcttgcggaaacctgagtcccaagaagcagcccctttaagcgggccctgcggtcggcgagtcattacaagtcgtatcgtgggtggcgaagacgcggagctaggtcggtggccttggcaggggagcttgcggctctgggacagtcacgtctgcggcgtatccctcctttcccaccgctgggccctgactgctgctcactgcttcgagactgacctgagcgatccctcagggtggatggtgcagtttgggcagcttacttctatgcccagtttctggagcctccaggcgtattacacacggtactttgtcagcaatatatacttatccccaaggtacctcggcaattcaccttacgatatcgctttggttaaactatccgcacctgtcacctacaccaagcacatacagcccatctgtctgcaggcaagtacgtttgagtttgaaaataggaccgattgctgggtgacaggctggggttatataaaggaagacgaagcattacccagccctcatactctgcaggaggtccaggtagcaataattaacaatagcatgtgcaaccatttatttctgaaatactcatttcgtaaagacatcttcggcgacatggtttgcgctggaaatgctcagggcggcaaagatgcctgttttggagactccggcggccctctggcctgcaataagaatggcctgtggtaccaaatcggagtggtttcgtggggggtggggtgcgggcgccccaataggccaggcgtttataccaatatctcccaccatttcgagtggatacaaaagttgatggcccagagcggcatgagtcagcctgatccatcctggccattgctgttcttcccattgttatgggccctccccctcctggggccagtctag

SEQ ID NO: 201040 - DNA, 954 bp, Artificial Sequence
  Description of Artificial Sequence: Synthetic coding sequence
atggtggtgagcggcgccccccccgccctgggcggcggctgcctggggacctttactagcctgctgctgctagcaagtacagcaatactcaacgcagcacgcattcctgtcccccctgcttgtggcaagcctcaacagctgaatcgcgtggtcggaggcgaagactctacagatagcgagtggccttggattgtgtccatccagaagaatgggacacaccactgcgcagggagccttctgacaagccgctgggttatcacagcggcccactgcttcaaggataatcttaataaaccatacttgttctctgtgctcctgggcgcatggcaattgggaaatcctggttcacgctcccagaaagtcggcgtagcttgggttgaaccgcatcctgtgtacagctggaaggagggagcttgcgcagatattgcattagtccggctggagagatctattcagttctccgaaagagtgttgccgatttgtctgcctgatgcaagtatacacctcccgcctaacactcactgctggatttctggctggggttctatccaggatggtgtgccactcccccatccccagaccctgcaaaagctgaaggtcccaatcattgacagcgaagtctgttcacatctctattggcgcggtgcggggcagggccctataactgaggatatgttgtgtgccggctacctggagggcgaaagagacgcctgcctgggggacagcggcggaccactgatgtgccaagtcgatggcgcttggctcttggcgggaattatttcatggggcgaggggtgtgctgagaggaaccgtccaggagtgtatatctcattgtctgcacataggagctgggttgagaaaatcgtgcagggtgttcagctgcgcgggagagcccaggggggcggcgctttgcgagctccatcgcaggggtctggcgcagccgcacggtcgtag

SEQ ID NO: 201041 - DNA, 786 bp, Artificial Sequence
  Description of Artificial Sequence: Synthetic coding sequence
atgcacatgcgggagaccagcggcttcaccctgaagaagggccggagcgcccctctggttttccatccccctgatgccctcatcgctgtgccattcgatgatgatgataaaatcgtgggcgggtacacatgcgaagagaacagtctgccttaccaggttagcctgaattccggttcgcacttctgtggcggatctttaattagtgagcaatgggtcgtcagtgccgcgcactgctataaaactaggatacaagtgcggttaggcgaacacaacataaaggtcctcgagggaaatgagcagtttataaatgcagccaagatcatacgccaccccaagtacaaccgtgacactcttgataacgacattatgctgataaaattatccagcccagccgtcataaacgcgcgggtatctacgattagcctgcccactactccccctgcagctggcacggaatgtctgatcagtggctggggaaataccctaagtttcggagcagattacccggacgagctcaaatgtcttgatgcccctgtgctgactcaggcagaatgtaaggcctcctaccctggcaaaatcactaactcgatgttctgtgtaggtttcctggagggggggaaagacagctgtcagcgcgactctgggggccccgtggtctgcaacggtcagctgcaaggtgttgtcagctggggacacggctgcgcttggaaaaacagacctggcgtatacaccaaggtgtataattacgtcgattggattaaggacaccatcgccgctaattcctag

SEQ ID NO: 201042 - DNA, 915 bp, Artificial Sequence
  Description of Artificial Sequence: Synthetic coding sequence
atgtgcggccccgacgaccggtgccccgcccggtggcccggccccggtcgcgctgtgaagtgtggaaagggcctcgcagctgcaagacccggtcgcgtggaacgtggcggagcacagagagggggggcagggctggagttgcaccctctcctaggaggccgcacgtggagagcggcccgggatgcagatgggtgtgaggccttggggaccgttgccgtgccttttgatgacgacgataaaatcgtgggagggtacacatgcgaggaaaattctctgccgtaccaggtgtctcttaatagcgggtcccacttctgtggtggatctctgatctcggaacagtgggtcgtctcggccgcccactgctataaaaccagaatccaagtccgcctgggagagcacaacatcaaggtgctcgaaggcaacgaacaattcattaacgccgccaaaatcatcagacaccccaaatataatagggataccctcgataacgacattatgcttattaagctctcgtctcccgccgtcattaacgctagagtttccactatttctctgccaaccacccctcctgctgctggaaccgagtgtttgatctctgggtgggggaacactctcagcttcggagccgactaccccgatgaactgaagtgcctcgatgctccagtgttaactcaggcagagtgcaaggcaagctacccagggaagatcactaatagcatgttttgtgtgggtttcttggaggggggaaaagatagctgtcagcgcgactccgggggccccgtggtatgtaacggccaactgcagggcgtggtgtcctggggacatggatgcgcctggaagaaccgtcccggggtttataccaaagtctataactatgtggactggattaaagatactatagcagccaacagctag

SEQ ID NO: 201043 - DNA, 744 bp, Artificial Sequence
  Description of Artificial Sequence: Synthetic coding sequence
atgaaccccttcctgatcctggccttcgtgggcgccgccgtggccgtcccttttgacgacgatgacaagatcgtagggggctatacttgcgaagagaactctttgccatatcaggtgagcctgaactctggatcccacttctgtgggggctcgctgatatcggagcagtgggtggtgagcgctgcccactgctacaagactaggatacaggtgagactcggggaacataacatcaaagtgctggaagggaacgagcagtttatcaatgccgctaaaattattcgccatccaaagtacaatcgggacacccttgataatgatatcatgttaatcaaattaagctcgccagccgtaataaacgctagggttagcacaatttctttgcctactactcccccagctgcgggtacagaatgcctcatttctggctggggtaacacgctcagcttcggtgccgattacccagacgaacttaaatgtctagacgcccccgtactgacacaggccgagtgcaaggcgagctatccaggcaagattaccaactccatgttctgtgttggttttctcgaaggaggtaaggatagctgtcagagggactctggagggccagttgtgtgcaacgggcagttgcaaggggttgttagctggggccatgggtgtgcttggaagaatcggcctggtgtgtatacaaaagtctataactacgtagactggatcaaggacaccatcgctgctaactcttag

SEQ ID NO: 201044 - DNA, 723 bp, Artificial Sequence
  Description of Artificial Sequence: Synthetic coding sequence
atgggccccgccggcgaggtggccgtgcccttcgacgacgacgacaaaatagttgggggttacacttgcgaggagaactcccttccctaccaagtatcacttaattcagggtcacacttttgcggcgggtctttgatatccgagcagtgggtggtaagcgccgcccactgttacaagacccgtattcaggtgcggctgggggaacataatatcaaagtcctggagggcaacgagcagttcatcaatgcagcaaagatcattagacacccaaaatataatagagatactctggacaacgatatcatgcttatcaagttgtcctcgccagctgttattaacgcaagggtgtcaaccatcagtctcccaacaacgccaccagccgcaggtaccgagtgcctaataagtggttggggcaatacactttcatttggcgccgactacccagacgaactgaagtgtctcgatgccccggtactgacgcaggccgagtgcaaagcgtcctaccctggaaagattactaactctatgttctgtgtgggctttctggaagggggaaaggattcgtgccagagagattctggagggcctgttgtgtgcaatgggcagctccaaggcgtggtctcttggggccacggctgtgcctggaaaaatagaccaggggtgtatactaaggtgtacaactacgtcgactggatcaaggacacaatcgccgccaactcctag

SEQ ID NO: 201045 - DNA, 537 bp, Artificial Sequence
  Description of Artificial Sequence: Synthetic coding sequence
atgcgggagaccagcggcttcaccctgaagaagggccggagcgcccctctcgttttccatccacccgacgcgttaatcgccgtacccttcgacgatgatgataaaatcgtggggggatacacctgcgaggagaacagcctgccatatcaagtcagcctcaattcaggatcacacttttgtggcggatccttgatatctgaacagtgggtagtgtcggccgcccattgttataaaacgaggattcaagtccggttaggagagcataacatcaaagtgttggagggaaacgagcaatttatcaatgccgccaaaatcattaggcacccaaaatataaccgcgataccctggataatgatataatgttgatcaaactgagcagccccgcagtcattaacgcccgtgtgtctactatctctctgccaactactcctccagctgcgggcacagaatgccttatttcgggatggggaaacacgctgagtttcggggcggattacccagacgagctgaaatgcctggatgccccagtgctgtag

SEQ ID NO: 201046 - DNA, 843 bp, Artificial Sequence
  Description of Artificial Sequence: Synthetic coding sequence
atgcggggcgtgagctgcctgcaggtgctgctgctgctggtgctgggcgctgccggaacccagggtcggaaatccgcggcatgtggccagccccgtatgtcttctcgtatagtgggcggtagggacgggcgggacggcgagtggccatggcaagcttcaatacagcatcgtggagcccatgtatgtgggggcagtctcattgctccacaatgggtgctgaccgctgcccactgtttcccacgcagagctcttcccgctgaatatagagtgcggctcggtgctctcaggttgggaagcacaagcccacgcacactctcagtgcccgtgagaagagttctccttcctccggattactcggaggacggagctaggggagatttagcccttctccagctgcggagaccagtccctctgtccgcccgcgttcagcccgtatgcctccccgtgccaggagcacgacccccacccgggacgccatgccgggtcaccggatggggcagcttgagacctggcgtcccccttcctgagtggcgccctctgcaaggggtgagagtgcccctgctggacagtcgtacttgcgacggattgtatcatgtaggcgcagacgttcctcaagctgaacgcattgttctcccaggtagtctgtgcgcgggctacccccaaggacacaaggacgcatgccaaggcgactcaggtggccctttgacatgtttgcagtccggtagttgggtcctcgtcggagtcgtgtcctggggcaaaggttgcgcacttccaaacagacccggagtttatacttcggtggccacctacagcccatggatccaagctagggtcagcttttag

SEQ ID NO: 201047 - DNA, 1032 bp, Artificial Sequence
  Description of Artificial Sequence: Synthetic coding sequence
atggcccagaagggcgtgctgggccccggccagctgggcgccgtggcaatcctgctgtacctcgggcttctgcgctccggaaccggcgccgaaggagccgaggccccttgcggagtggctcctcaggctaggatcaccggcggcagttctgctgtggctggccagtggccatggcaggtgagtatcacctatgaaggcgtgcacgtctgcggaggctctcttgttagcgagcagtgggtgttgagcgccgcccactgctttccgagcgaacatcacaaggaggcatacgaagtcaaactgggcgcccaccaacttgactcttatagcgaggatgccaaagtgtctactctgaaggacataattccccatccaagctaccttcaagaggggtctcaaggagacattgcactgctgcagctttcccggcctatcacgttctcgagatatattagaccaatttgtcttcctgctgccaatgcaagctttcccaacgggcttcactgtacggtgactggctggggacatgtagcgccatctgtgagtctcttgacaccaaaacctctacagcagcttgaggtcccactaatcagtagagaaacctgcaactgcttatataacattgacgccaaacctgaagagcctcacttcgtgcaggaggacatggtatgtgccggatatgtggaaggcggtaaagacgcctgtcagggggattccggcggtccactctcctgcccggtcgagggcctctggtatctgacaggaatagtgtcttggggtgatgcttgtggcgccaggaaccgccccggtgtgtacaccctggctagttcgtacgctagctggattcagagcaaagtgactgagcttcagccccgcgtcgtcccccagactcaagagtcccagcccgatagcaacctgtgcggctctcatttggccttcagcagtgctcctgcccaggggttactccgtcctatcttgttcctgcctctcggtttggcacttggactcctgtcaccttggctctccgagcactag

SEQ ID NO: 201048 - DNA, 504 bp, Artificial Sequence
  Description of Artificial Sequence: Synthetic coding sequence
atggcccagaagggcgtgctgggccccggccagctgggcgccgtggccatcctcctttacctgggcctgctgaggagcggaactggcaaagagggagcagcagctccgtgtggcgtagctccgcaggcaagaataacaggaggatcctccgctgttgccggacagtggccttggcaggtcagtattacattctcgaggtatatacgtccaatttgtctgcctgctgcgaatgcgtcatttcccaacgggttacactgtactgtaacaggatggggacacgttgccccatcggtgtcactgctgacccctaagccactgcagcagcttgaggttccgttgatctcaagagaaacttgcaattgtttgtataatatcgatgcgaaacctgaagagccgcactttgtccaagaagacatggtctgcgctggctacgtggagggcgctttgctgcgggtgaccctgggtgctcactctcctgccctttggcgcgtctcagggacctag

SEQ ID NO: 201049 - DNA, 1197 bp, Artificial Sequence
  Description of Artificial Sequence: Synthetic coding sequence
atggagctggaggagggcaaggccggcagcggcctgcggcagtactatctaagcaaaatcgaggaactccagctcatcgttaacgataaatcacagaaccttcggcgactgcaggctcagaggaacgagcttaatgctaaagtgaggttgctccgcgaggagcttcagctccttcaggaacagggatcctatgtcggcgaagtcgttagagccatggataaaaagaaagtcctggtgaaggtgcatcctgagggaaagtttgttgtcgacgtggacaaaaacattgatattaatgacgtcacacccaattgcagagttgctttgaggaatgactcatataccctacacaaaatcctgccaaataaggttgaccccttggtctcactgatgatggtagaaaaggtccctgactctacctacgagatgatcggcgggctcgataagcaaattaaagagataaaagaggtaattgagctcccagtcaaacacccagaactttttgaggccctaggtatcgcacagccaaaaggcgttctcctttacgggcctcccggcacaggaaaaaccctcctggcacgcgctgtggcccaccacaccgattgtacgtttatacgcgtctcaggcagcgagctggtgcagaagtttatcggggagggggcccggatggtccgagagctgtttgtgatggctcgcgagcacgcaccgtcgattattttcatggacgaaattgacagcataggtagcagcaggttagagggaggctccggcggagatagcgaggtacagcggaccatgttagaactcttaaaccagttggatgggtttgaggccactaagaacattaaagtgatcatggcaaccaaccggattgacattctggacagtgcactgctaaggccaggtcgcatcgacagaaagatcgaattcccacctcccaatgaggaggctcggttggacatcctcaaaattcactctcgaaagatgaacctcacacgagggattaatctacgcaaaattgcggagttgatgcctggagcatcaggcgcagaagtgaagggcgtgtgcacagaagcgggcatgtacgccctgagggaacggagagtccacgtgacacaggaggacttcgagatggcggtcgccaaggtgatgcagaaggacagcgaaaaaaacatgtcgatcaaaaagctatggaaatag

SEQ ID NO: 201050 - DNA, 765 bp, Artificial Sequence
  Description of Artificial Sequence: Synthetic coding sequence
atggccagcctgctgaaggtggaccaggaggtgaagctgaaggtggacagtttccgagaaagaatcacctcggaggctgaagatctcgtggctaatttctttcccaagaaattgctggagttggacagttttttaaaggagcccatcctcaacatacacgacctcacccagattcattcggacatgaatctccccgtccccgatcccatactgctgactaactctcacgacggcctcgacggacctacatataagaagagacgcctcgatgagtgtgaggaagcattccaggggacaaaggtgttcgtcatgccgaatgggatgctaaagtcgaaccagcagttggtggatatcattgaaaaagtcaagcctgaaatcaggctgcttatcgaaaagtgcaatactgtcaagatgtgggtgcaactactgatcccccgtattgaggacggcaacaacttcggagtctccatacaggaggaaacggtcgccgagctgagaaccgttgagtctgaagccgcgtcctaccttgaccaaatcagtcggtactacattactcgagcgaagctggtgagcaaaatcgctaaatacccccacgtcgaggattacaggaggacagtgacagaaatcgatgaaaaggaatacatatctctgcgacttattatcagcgaactacggaaccaatatgtcaccctgcatgatatgatcctgaagaatatcgagaaaatcaagcgccccagaagctccaacgctgagaccctatactag

SEQ ID NO: 201051 - DNA, 1323 bp, Artificial Sequence
  Description of Artificial Sequence: Synthetic coding sequence
atgggccagagccagagcggcggccacggccccggcggcggcaagaaagatgataaagataaaaaaaagaagtacgaaccacccgtgcctactcgcgtgggcaagaagaagaagaagacaaagggtcctgacgccgcctcaaaactccctcttgtgaccccgcatactcagtgtagactcaaactgctgaagctggagcgcataaaagattacctgctgatggaagaagagttcattcggaatcaggaacaaatgaagccattggaagagaagcaggaggaggagcggagcaaggtggacgacctcagggggacacccatgtcagtcgggactctggaagaaatcatagatgataatcatgctattgtgtctaccagcgtgggttcagaacattatgtgtcaatcctgtccttcgtagataaagatctgttagagcctgggtgtagcgtccttctgaaccacaaagtccatgccgttatcggcgtgctcatggatgacaccgaccctttagttactgtcatgaaagtggaaaaagccccccaggagacctacgccgatatcggggggctggataatcagatccaggaaataaaagagtccgtggagttgccgctaacacatcccgaatactacgaagaaatgggaattaaacccccaaagggcgtaattctgtatggacctccaggaactggtaagacactccttgccaaagccgtggctaatcagacctctgcaacttttctgcgagtcgtgggtagcgagctcatacagaaatacctaggtgatggaccaaaactagtgagagagctcttccgagtagccgaagagcacgccccctctatcgtcttcatagatgaaatagacgcaattgggaccaagaggtacgattctaactctggcggcgagcgggaaatccagcgaacaatgctcgaactgttaaaccagttagacgggttcgactctcgcggcgatgttaaagttattatggcgacaaacagaatcgagactctggaccctgccttaattagaccaggtagaatcgaccggaaaatcgagtttcctctgcccgacgaaaaaaccaaaaaaaggatctttcagatccacacaagccgtatgactctagctgacgacgtgaccctagatgacctgatcatggcaaaggatgacctctctggcgccgatatcaaggccatttgtaccgaggcagggctcatggctttacgagagaggcgaatgaaggtaacgaacgaagactttaagaagtcaaaagagaatgtgctatataaaaagcaggagggaaccccagaagggttgtacttgtag

SEQ ID NO: 201052 - DNA, 1104 bp, Artificial Sequence
  Description of Artificial Sequence: Synthetic coding sequence
atggaggaggagttcatccggaaccaggagcagatgaagcccctggaagagaagcaagaagaggaaaggtcgaaggtggacgatctgcgcggtacccctatgtcagtgggcacccttgaagagattatcgatgataatcacgcaatagtgtcgacttcagtaggtagcgaacactatgtgtccatcctgtccttcgtcgataaagacttactcgagcccggatgttccgtgctgttaaatcataaggtccatgctgtgatcggagtgttgatggacgacaccgatcctctagtcaccgtgatgaaggtggagaaagctccacaggagacctatgcagacataggtggcttagacaaccagattcaagagatcaaggagagcgttgaacttcccctaacccacccagagtattatgaggagatggggatcaagccaccaaaaggtgttatcttgtacgggcctcctggaaccggtaagacgctgctcgctaaggccgtggccaatcagacctctgctacatttcttcgtgtggtagggagcgagttaattcagaagtacttgggagatgggcctaagctagtccgggagttgtttcgggtggccgaagagcacgcaccgtccatcgtcttcattgacgagattgatgcaataggaacaaaacgctatgattccaatagtggcggcgagcgggagattcaacggacaatgttggaactccttaatcagttggacggcttcgattcaagaggagatgttaaggtgattatggccactaaccgcatcgaaacactggaccctgccctcattcgacccggacgtatcgaccgaaaaattgaatttccgctgccggacgagaagacgaaaaagcgcattttccagatccacacttcacgaatgaccctggcagatgatgttacgctagatgatctgatcatggctaaagatgacctaagtggagcggatatcaaagccatctgtaccgaggcgggactcatggcattaagagagagaaggatgaaggttacaaacgaagattttaaaaaaagcaaagaaaatgtgctatataagaagcaggaaggaactccagagggcctgtacttgtag

SEQ ID NO: 201053 - DNA, 1302 bp, Artificial Sequence
  Description of Artificial Sequence: Synthetic coding sequence
atgcccgactacctgggcgccgaccagcggaagaccaaggaggacgaaaaagacgataagcctattagagcactggatgaaggggatattgccctcctgaaaacctatgggcagtctacctattcaaggcagataaaacaagtagaggatgacatacagcagctgctcaaaaagatcaatgagctcactggaatcaaggaaagtgacacgggcttggcacctcccgccctctgggacctggccgcggacaaacaaactctccaatctgagcaaccattgcaagtggccaggtgcaccaagattattaatgcggactcagaggacccgaagtacatcatcaacgtgaaacagtttgccaagtttgtggtggacctgtctgaccaggtggcccctacggacatcgaggaggggatgagagtgggtgtggaccgcaataaatatcaaatccacatacccctgcctccgaagatcgacccaaccgtgacaatgatgcaggtggaggagaaacccgatgtaacatattcagatgtgggtgggtgtaaggaacagatcgaaaagctcagagaagtggtggagacaccccttttacaccccgagcgcttcgtgaacctgggcatcgagccacctaaaggtgtacttctgttcggtccaccaggcaccggaaagacactctgtgctcgggccgtcgcaaacagaactgacgcttgtttcatccgcgtgatcggttccgagttagtccagaaatacgttggcgaaggtgctcggatggtcagggagctgtttgaaatggctcgtaccaaaaaggcgtgcctgatcttctttgacgaaatcgacgcaataggcggcgctcgctttgatgatggagccggcggagataatgaagttcagcggactatgctggaattgattaaccaattagacggattcgatcccagaggaaatatcaaagtgcttatggctacaaaccggcccgacaccctcgaccccgccctgatgcgacccgggagacttgataggaaaattgaattctccttgcctgacctcgagggtagaacccatatctttaagatccacgcacgctcgatgtctgtggagcgtgacattagattcgagctcttagccaggttgtgccccaactccactggcgccgaaatccgctcagtgtgcaccgaggccggaatgtttgctatcagagcccgccggaaaatcgctacggaaaaggacttcctggaggcagtgaataaggtgatcaagagctacgctaagtttagtgccacacccagatatatgacatataactag

SEQ ID NO: 201054 - DNA, 393 bp, Artificial Sequence
  Description of Artificial Sequence: Synthetic coding sequence
atgcccgactacctgggcgccgaccagcggaagaccaaggaggacgaaaaggatgacaaaccaataagagccttggatgagggggatatagctctcctgaagacctatggacagagcacttacagccggcagatcaagcaggtggaggatgatattcaacagctgttgaagaagattaacgagttaacagggatcaaagaatccgataccggtctcgccccacctgccctctgggacctggcagcagataaacaaacactccagagtgaacagcctctgcaagtggccagatgcacaaaaatcatcaacgccgacagcgaggaccctaagtatatcattaatgtaaagcagttcgccaaattcgtcgttgacctgtctgaccaggtcgcatag

SEQ ID NO: 201055 - DNA, 1302 bp, Artificial Sequence
  Description of Artificial Sequence: Synthetic coding sequence
atgcccgactacctgggcgccgaccagcggaagaccaaggaggacgagaaagacgacaagcctattagagccttggatgagggtgatattgctctcctgaaaacatatggccagagtacttacagccgtcagattaagcaagtcgaagatgatatccagcagttgttaaaaaaaatcaatgaactgactggcatcaaagaatcagacacggggttggcaccccctgccctgtgggacctggcagccgataaacaaaccctacagtccgagcagcccctgcaggtggctcggtgtacaaagataataaacgctgacagtgaagatcctaagtatatcatcaacgttaagcagtttgcaaagttcgtggtcgatctatcagatcaggttgccccaacagatatcgaagaaggtatgagggtgggggttgatagaaataagtaccagattcacatcccacttccacctaaaatcgatcccacagtcacaatgatgcaggtcgaggagaagccagatgtcacctactccgacgtcggcgggtgcaaagagcaaatagaaaagttgcgcgaagtggtggagactccactccttcatcccgagagattcgtcaatctgggcatagagcctccaaagggcgtgttgttgtttggccctccgggaaccggaaagaccctgtgcgcccgggcagtggccaatcggactgacgcctgcttcatccgcgtaatcggctccgaattagtccagaaatatgtcggagagggtgccaggatggtgcgagagctatttgaaatggcgcgcactaagaaggcatgcctcattttctttgacgagatcgatgccattgggggcgcccggtttgatgatggagcaggcggcgacaacgaagttcagcggacaatgctcgagcttatcaatcagctcgacgggtttgacccccgtgggaacattaaagtgctcatggccacaaatcgtccagacacacttgatcctgcgctcatgagaccagggagactggacagaaaaattgagtttagcttacccgatctggagggaagaacacatattttcaagatccatgcaaggtccatgagtgtggaacgggacattagattcgaattgctggcccggctgtgcccgaatagcactggagccgaaatcagaagcgtctgtaccgaggcaggcatgttcgcaatacgcgccaggagaaagattgccacagagaaagatttccttgaggccgtcaacaaagtgatcaagtcttacgctaagttttccgctactcccagatacatgacatataactag

SEQ ID NO: 201056 - DNA, 393 bp, Artificial Sequence
  Description of Artificial Sequence: Synthetic coding sequence
atgcccgactacctgggcgccgaccagcggaagaccaaggaggacgaaaaggacgacaagcccataagagcattagacgaaggggatattgctctgcttaaaacgtatggtcagtccacttacagcagacagattaaacaagtggaggacgatatccagcagctgctgaaaaagataaatgaactcactggcattaaagaaagcgacacgggtctagcaccccctgccctgtgggatctggccgcagataaacagaccctgcagagcgaacaacccctgcaggttgctcgatgcacaaaaattatcaacgctgacagcgaggatcccaagtacattattaatgtcaagcagttcgccaagttcgtggtcgatctctctgatcaggtggcatag

SEQ ID NO: 201057 - DNA, 891 bp, Artificial Sequence
  Description of Artificial Sequence: Synthetic coding sequence
atgcgggtgggcgtggaccggaacaagtaccagatccacatcccccttcccccaaagattgatcctactgtcacaatgatgcaggtagaagaaaagccagatgtgacttactccgacgtgggcgggtgtaaagagcaaatagaaaaactgcgggaagttgtggagacccccttactgcaccccgagcgctttgtcaatctgggcatagagccccctaagggcgtactcctcttcggacctccaggaactggtaaaactctgtgtgctagagccgtagctaacagaaccgatgcatgctttatcagggtgatcggcagcgaactcgtgcagaaatacgtgggggagggagccaggatggtgagggaactcttcgagatggccagaacaaagaaagcatgtctgatttttttcgatgagattgatgccatcggtggggcgaggtttgatgacggcgctggaggcgacaatgaggtgcaacggaccatgctggagttgatcaaccaactggatggtttcgatcctagaggaaacatcaaagtgttaatggctaccaacaggcccgatacactcgaccccgccctgatgagaccaggtagacttgaccgcaagatcgaattctccctgccagatctcgaaggcagaacacatatctttaagatccatgcccggagcatgtcagttgaacgcgacatccgcttcgaattgctggcgcgcctttgccccaattctacgggggccgagattaggtctgtgtgtaccgaggcggggatgttcgcaatccgggctaggcgtaaaatcgctacagagaaggactttcttgaggcagtcaataaggttatcaaatcttacgcaaagttttctgcaaccccacgttatatgacatataattag

SEQ ID NO: 201058 - DNA, 1320 bp, Artificial Sequence
  Description of Artificial Sequence: Synthetic coding sequence
atgaacctgctgcccaacatcgagagccccgtgacccggcaggagaagatggcaaccgtttgggacgaggccgagcaggacggaataggggaggaggtgctcaagatgtccaccgaggaaataatccagagaacgcgtttgttggattccgaaatcaagatcatgaaaagcgaggttcttcgtgtgacccatgagttacaggccatgaaagacaagatcaaagagaacagcgaaaaaattaaagttaacaagactctcccctatcttgtttctaacgtcatcgagctgttagatgttgatcccaacgatcaggaggaggatggcgcaaacatcgatctcgatagccagcgtaaaggaaaatgcgcagtgatcaaaacatcaaccagacagacttattttctgcccgtgatcggcctagtagatgccgaaaagctgaaacctggcgatctcgttggcgtaaacaaggacagctacctgatcctggaaacactgcccaccgaatacgattccagggtgaaggccatggaggtcgacgagcgacctaccgaacagtattccgatatcggaggactggataagcagatacaggagctcgtggaggccattgtgctgcccatgaaccacaaagagaaattcgagaacttagggatccagcctcctaagggcgtcctcatgtatggaccccccggaaccggcaaaacattgttggcaagggcctgtgctgcacagactaaggccactttcttaaagctagctggtccccagcttgtccagatgtttattggggatggggccaaactggtgagggacgcattcgccctcgcgaaggaaaaggccccatcgatcattttcattgatgagttggacgctattgggaccaagaggttcgacagtgaaaaagcaggcgacagggaggtgcagcgaactatgctggaactgctgaaccaactcgacggctttcagcctaatacccaggtgaaggtgatagcggccacgaatagggtagatatactggacccagctctccttcggtccgggagactggacagaaaaatcgagttcccgatgccaaacgaggaagcccgcgccaggatcatgcaaattcacagcaggaagatgaacgttagcccagacgtgaactatgaggaactggcacgatgcaccgacgacttcaacggcgcacaatgtaaagctgtgtgtgtagaagctggcatgattgcgctaaggcgaggcgccaccgaactaacacatgaggattacatggaggggatactagaggtgcaggccaagaaaaaggcgaaccttcaatattacgcctag

SEQ ID NO: 201059 - DNA, 1257 bp, Artificial Sequence
  Description of Artificial Sequence: Synthetic coding sequence
atggaggagatcggcatcctggtggagaaggcccaggacgagatcccagcactcagtgtatctagacctcagactgggttatcttttctcgggccggagcccgaggaccttgaagacctctattcccggtacaagaaattgcaacaggaactggaattcttggaagtgcaggaagaatatattaaggatgagcagaagaacctcaaaaaagagttcttgcacgctcaggaagaggtaaaaaggatccagtctattcccctcgtgatcgggcagttcctagaggcagttgaccagaacacagccatcgtgggttcaacgaccggctcaaactactacgttcgcatactttccacaattgatcgagaactgctgaaaccaaacgcatcagtggcactccataaacattctaatgccttggtggatgttctcccgccagaggccgattcctctatcatgatgttaacatcagaccagaagcctgatgtgatgtatgctgatattggcggaatggacatacagaaacaggaagtgcgggaagctgtcgagctacccctcacccatttcgaactgtataaacaaataggcattgacccacccaggggcgtgctgatgtacggcccaccagggtgtgggaagaccatgcttgcaaaagctgtggcgcaccatacgacagcggccttcatccgcgtcgtgggaagcgagttcgtgcagaagtacctaggcgaagggccgcgaatggtaagagacgtctttcgcttggccaaggagaatgccccagctatcatttttattgacgaaattgacgcaattgccactaagcgctttgatgcccaaacaggcgccgaccgcgaggttcagcggatcctgctggagctgttaaatcagatggacggcttcgaccagaatgtgaacgtgaaagttataatggctaccaatagggctgatacgttagatcccgccttgctaagaccagggagactggaccgaaaaatagagtttcctcttcccgaccgccggcagaagaggttgattttttcaaccattaccagtaaaatgaacttatcagaagaagttgacttggaggactacgtagcacgtcccgacaagatttcaggggcggatattaatagcatctgtcaggaaagcggcatgctggccgtgcgggaaaatcggtatattgtcctggctaaagacttcgagaaggcgtataagacagtaataaagaaggacgagcaggagcacgagttctataagtag

SEQ ID NO: 201060 - DNA, 1164 bp, Artificial Sequence
  Description of Artificial Sequence: Synthetic coding sequence
atggaggagatcggcatcctggtggagaaggcccaggacgagatccccgccctgtcagtgtctcgccctcagacgggcttgtcctttctcggcccggagccagaagatctggaagacctttacagccgatataaggaagaggtcaaaaggatccagtctatacccctcgtgatcggacaatttcttgaggctgtggaccagaacaccgctattgttggttcaacgactgggtccaattattatgtgcgcattctgtccacaatcgatcgagaactcctcaagccgaatgcttctgttgctctccacaaacattcaaatgcactggtagacgtgctgccacctgaagctgatagttcaatcatgatgcttacctcagaccaaaaaccagatgtgatgtatgcggatattggagggatggacatccagaaacaagaggttcgggaggccgtggaactgcctttaacacacttcgaattgtacaaacagatcgggatagatcctccgaggggtgtcctcatgtacggtcccccagggtgcggcaagaccatgcttgcaaaggccgtggcccatcacacaacagcggcgtttatcagggtggttgggtccgaattcgttcagaagtacctgggcgaggggccaagaatggtgagagatgtgttccggctggcaaaggaaaatgcccccgctattattttcattgacgagatcgacgctatcgccacgaagcgcttcgacgcacagaccggagccgatagggaggtacagaggatattgttggagctgctgaatcaaatggatggctttgaccagaatgttaacgtgaaggtgattatggctaccaaccgggctgacacactcgaccccgccctgctgcgccctgggcgcttagacaggaaaattgagtttccactcccagatagaagacagaaacggctgatttttagtaccatcacttccaaaatgaatctgtcggaggaggttgatctcgaagactatgtcgcccgacccgacaagatttccggcgccgatatcaactccatttgccaggaaagcggtatgctggcagtgcgcgaaaaccgatatattgtgctggcaaaagattttgagaaggcctacaagactgtcatcaagaaggacgagcaggagcatgagttttacaagtag

SEQ ID NO: 201061 - DNA, 1221 bp, Artificial Sequence
  Description of Artificial Sequence: Synthetic coding sequence
atggccctggacggccccgagcagatggagctggaggagggcaaggctggctccggcctcagacagtactacctgtcaaaaatcgaagaactgcaactgatcgtcaacgacaaaagtcagaatctaagacggctgcaagcccagagaaacgagttaaatgctaaggtaagactgttgagagaggaactgcagctgctccaggagcagggaagttatgtaggggaagtggtacgcgcgatggataaaaaaaaggtgctcgttaaagtgcaccctgaagggaagtttgtggttgacgtagataaaaatatcgacatcaacgacgtgacgcccaattgtcgtgtggcattgcggaatgactcctacacactgcacaaaatactccctaacaaagtcgacccccttgtctcccttatgatggtcgagaaggtccccgacagtacctatgagatgatagggggcctggataaacagatcaaagaaattaaggaggtgatcgagcttcccgtcaaacaccccgaactatttgaagctttgggtatagcacagccgaagggtgtactcctttatgggcccccaggcactggaaaaaccctcttggcccgtgccgtcgcccaccatacagactgcacgtttattcgcgtgtcgggatctgaactagttcagaaatttatcggtgaaggggctcggatggtcagggaactcttcgtgatggctcgagaacatgccccttccatcatatttatggatgagattgattccatcggctccagtcggctggaggggggctctggaggagattctgaagtccaacgcaccatgcttgagttactcaatcaactcgatggatttgaggcaaccaaaaatattaaggtgatcatggcaaccaacaggatcgacattctggattcagctctgcttcggcccgggaggatcgatagaaagattgaattcccacctcccaacgaggaggcacgcctggatattctgaagatacactctaggaagatgaatctcacacggggcatcaacctgcggaagatcgctgagttgatgccaggtgcatccggagcagaagttaaaggcgtgtgtaccgaggccgggatgtacgctttgcgggaacggcgggtacatgtcacccaggaagatttcgaaatggctgtggctaaagtcatgcagaaggatagcgagaaaaacatgtccataaagaaactttggaagtag

SEQ ID NO: 201062 - DNA, 1197 bp, Artificial Sequence
  Description of Artificial Sequence: Synthetic coding sequence
atggagctggaggagggcaaggccggcagcggcctgcggcagtactacttgtcaaaaattgaggagctgcagctgatcgtcaacgacaagagccagaacctccggagactacaagcacagaggaacgagcttaatgcgaaagtgcggttgctcagagaagagttgcagctgctgcaggagcagggttcctatgtcggagaggttgttagagcgatggataagaaaaaagtgctggtgaaggttcacccagagggtaagttcgtggtggatgtcgataagaacattgacattaacgacgtgacgcctaactgccgcgttgctctgagaaatgacagctatactctgcataagattctccctaataaagtggacccgctggtgagcctcatgatggtcgagaaggtaccagatagcacgtatgagatgatcggcggcctggacaagcagattaaggaaatcaaggaggtgatcgaattgccagttaagcaccccgagctattcgaagcccttggcatagcacagcctaaaggagtactcctctacgggccgcctggcactggcaaaactctgttggcccgagccgtggcgcatcacaccgactgcaccttcattcgtgtgtccggctctgagctggtacagaaatttattggcgaaggcgctcgcatggttcgcgagctcttcgttatggctagagagcacgctccgtctatcatcttcatggacgagatagactctatcggtagcagccgtctggagggaggaagtgggggcgactctgaagttcaaaggacaatgctcgagctccttaatcaactggacgggtttgaagccacaaagaacattaaagtgataatggccacaaaccgcattgacatcttagactccgccctgctaagacccggtcgcatcgacaggaagatcgaatttccgccacccaacgaggaggcacgcctggatatccttaagatccactctcgtaagatgaacctcacgagggggattaaccttcgaaagattgccgagctgatgccgggtgcgtctggcgctgaagtgaaaggggtctgcacggaggctggaatgtatgcattgcgcgagagacgtgttcacgtaactcaagaggactttgagatggccgtggccaaggtaatgcagaaagattctgaaaagaacatgtccatcaagaagctatggaaatag

SEQ ID NO: 201063 - DNA, 1212 bp, Artificial Sequence
  Description of Artificial Sequence: Synthetic coding sequence
atggccatccccggcatcccctacgagcggcggctgctgatcatggctgatccaagggataaagctttgcaggactatcgtaaaaaactacttgagcataaggaaatagacgggaggctcaaggaactacgcgagcagttaaaagagctgaccaaacagtatgaaaagagtgagaatgatctgaaggccttacaatctgtgggccagattgttggggaagtcctgaaacagctgaccgaagagaaatttatcgttaaggcgacgaacggtcctcggtacgtagttgggtgcagacgacagctggataaaagcaagctgaagcccgggactcgcgtcgcgctcgacatgacgacccttacaattatgaggtacttgcctcgggaagtcgaccctcttgtgtacaacatgtcccatgaagatccggggaacgttagctatagtgaaattggcggcctgtccgagcaaatcagggaactgcgggaagtaattgagctgcctctgacgaacccagaactgtttcaacgggtgggcataatccctccaaaaggctgcctgctttacggtcctcccggaacaggcaaaactcttttagcgagggcagttgcctctcagttagactgcaactttctgaaggtggtcagctcttcgatcgtcgataaatacatcggcgaaagcgccaggctcattcgcgaaatgtttaattatgcccgtgatcaccagccttgtatcatttttatggacgaaatagatgcgatcggtggccgccgcttttctgaaggcacttctgccgaccgagaaatccagaggactctcatggagctcctgaaccagatggacggattcgataccctgcacagggttaagatgatcatggccacaaatagacctgataccctagaccctgctctgttaagaccgggcaggttagacagaaaaatccacattgatttaccgaacgagcaggccaggcttgacattttgaaaatacacgccgggcccatcaccaagcacggcgagatcgactacgaggccattgtgaaactgtcagacggattcaacggtgcggatttgcggaatgtgtgtacagaagccggcatgttcgcaattcgggctgatcacgattttgtggtccaggaggatttcatgaaagcagtcaggaaggttgctgattctaagaagctcgagagcaagctggattacaaaccagtgtag

SEQ ID NO: 201064 - DNA, 933 bp, Artificial Sequence
  Description of Artificial Sequence: Synthetic coding sequence
atggaccggctgctgcggctgggcggcggcatgcccggcctgggccagggtccccctactgacgctcccgcagtcgatactgccgagcaggtgtacatctcatctcttgctcttcttaagatgctgaagcacggcagggccggcgtgccgatggaggttatgggattgatgctcggtgagttcgtggacgattataccgtgagagtgatcgacgtgttcgccatgccgcaaagtggcacaggcgtcagcgtggaggcagtggacccggtatttcaggctaagatgcttgacatgcttaagcagaccggccggcccgaaatggttgtagggtggtatcatagccaccctgggttcggttgctggttgtccggagtggatattaacacccagcagtcattcgaagctctgtcggaaagggccgttgcggtggtggtagaccccatccaatctgttaagggtaaggtcgttattgatgccttccgcctgattaacgctaatatgatggtattagggcatgaacccagacagaccaccagcaacctgggccacctcaataagccttccattcaggccttgatccacggtctcaaccggcactactactcaatcaccattaattacaggaaaaacgagctggagcagaaaatgttgctgaatctgcacaaaaagagctggatggaaggtctcactctgcaggattactcagagcactgtaagcataacgagagtgttgtgaaggagatgcttgagcttgcaaagaattataacaaagctgtcgaagaagaggataagatgacccctgaacaattggccatcaaaaatgtgggcaaacaagaccctaagaggcacctggaagaacacgtggatgtgctgatgacctccaacattgttcagtgtcttgcagccatgctggatacagtcgtgtttaaatag

SEQ ID NO: 201065 - DNA, 255 bp, Artificial Sequence
  Description of Artificial Sequence: Synthetic coding sequence
atggaccggctgctgcggctgggcggcggcatgcccggcctgggccagggccctccaactgatgctccggcagtggatacagcagagcaggtgtacatctccagtttagcgcttctgaagatgcttaaacacgggcgagccggcgttcctatggaggtgatggggctgatgcttggggagtttgtcgatgactacacagtgagggtgattgatgtttttgcaatgccccagtccggaaccggagtctctgtttag

SEQ ID NO: 201066 - DNA, 2727 bp, Artificial Sequence
  Description of Artificial Sequence: Synthetic coding sequence
atggaggagggcggccgggacaaggcccccgtgcagccccagcagagtccagccgccgctcccggcggcaccgatgaaaaacccagcggcaaggaaagaagagacgcaggcgataaggataaagaacaagagttgtctgaggaggacaagcagctccaggacgagcttgaaatgctggtcgaacgattaggcgagaaggacaccagcttgtatcggcctgctctggaggaactaagacggcagattcgctcttccacgacgtcaatgacctcagtaccaaagcccctgaagtttctacgtcctcactatggtaagcttaaagagatttatgagaacatggcgcctggcgagaataagcgatttgctgctgatatcatttctgtgctcgccatgacaatgtccggggagcgcgagtgcctgaagtatcggcttgtggggtcccaggaggaactagcgagctggggacacgagtacgtgaggcatcttgccggagaggttgccaaggaatggcaggaactggacgatgctgagaaagttcagcgggagcccttgctgacactggtcaaggagatagtgccgtacaatatggcccacaacgccgaacatgaggcttgcgatctgctgatggaaattgagcaggtggatatgctggaaaaggatatagacgagaacgcatatgccaaagtatgtctttatctgacatcctgtgtaaattacgtgcccgagcccgagaattccgcgctgcttaggtgtgccttaggagtattccgcaagttcagtagatttcccgaagcattgaggcttgccttaatgctgaacgatatggagctagttgaggacatctttacctcctgcaaagacgtggtggtacaaaaacagatggccttcatgctgggcagacacggagtgttcctagaactgagcgaggacgttgaagagtacgaggacctcacagagattatgagtaacgtgcaactgaattcgaactttcttgccctggcccgcgaattggatattatggagcctaaggtccctgacgacatttataaaacccatcttgagaacaatcggttcggagggagcggatctcaggtcgacagtgcgaggatgaatcttgcatccagctttgtgaacggattcgtgaatgctgcatttggccaagacaagctgctcacagacgacggcaacaaatggctgtataaaaacaaggaccatggcatgttatcagcagccgcctcgctgggtatgattctgctatgggatgttgatggcggcctaactcagattgacaagtacttgtattccagcgaagattacatcaagtcaggtgcactactggcttgtggcatcgtgaactctggtgtgagaaacgagtgtgaccccgcccttgccttgctttcagattacgtcttgcacaattctaataccatgcgcctaggatctatctttggtcttggcctcgcctacgcgggctcaaaccgagaggacgtgctcaccctactgctgcctgttatgggagatagcaaaagttcaatggaagtggccggtgtgaccgctttggcatgcggcatgatagccgtcggcagttgtaatggggacgttacttcgaccatcttgcagaccatcatggagaaatccgaaacggaacttaaagacacttatgcccgctggttacccctggggctgggcctgaaccatttgggaaaaggggaagccatcgaagccattttagccgccctagaagtggtctctgagccgttcagatctttcgccaacacccttgttgatgtatgtgcttacgccgggtccgggaacgtacttaaggtgcaacagttgctccacatctgcagcgagcacttcgattccaaggagaaagaggaagacaaggataagaaggaaaagaaagacaaggataaaaaggaagcgcctgcagatatgggggctcaccaaggtgtagcggtactcgggatagccctgattgcgatgggcgaagaaatcggtgcagagatggcactccgtacatttggtcacctcctgcgctacggagagcctacgctccgcagggctgtgcctctcgccctggctctgattagtgtgtctaacccaaggctgaacatccttgatactctatccaagttttcacacgacgctgaccccgaagtcagctataattcgatattcgcaatgggaatggtgggttcaggcactaataacgctcgcctggccgctatgctccgccaactcgcccagtatcacgctaaggatcctaacaacctgttcatggtgcgactggcacaggggctgacccatctgggcaagggaactctgacgctgtgtccttaccattcagacaggcagttgatgagccaggtggctgtcgctggccttctcaccgtcctggtatctttcctggacgttcgcaacattattcttggcaagtctcactacgtgttatacggtctagtggccgccatgcagccaaggatgctggtgacattcgacgaggaactccgccctcttcctgtttcagtgcgagtggggcaggctgtggacgtggtgggccaagccggcaagccgaagaccatcacaggtttccagactcacactacacctgttttattggcacacggagagcgcgcagaactcgctactgaggagtttttgccagtcacacccatcctagaaggcttcgtcattctcaggaaaaatcccaattacgacctctag

SEQ ID NO: 201067 - DNA, 1743 bp, Artificial Sequence
  Description of Artificial Sequence: Synthetic coding sequence
cagtgcaccgcccagcagcagctgctgggcctgagcagcggcgccggccaccatggggcccagctgatgctgcagaatccccccagggagcaacaagtttggggacagtggctgtcagggggactttgccctcatgagcccggcctgctgttctgtgaatggctgtgcgaatgtagcttttgggataaactgttgaccgacgacgggaacaagtggctatacaagaacaaagaccacggcatgctatctgccgccgcctcactcggaatgatcctactgtgggatgtggatggcgggctgacgcagattgataaatacttgtattctagtgaggactacattaaatctggcgcccttctggcttgcgggattgtaaattccggcgttcgtaatgaatgcgacccagcactggccttgctcagcgactatgtactgcataacagtaatactatgagacttggctccatctttggactggggctagcttacgcaggtagcaatcgcgaggacgtcttaactctcttactccccgtaatgggtgattccaagtcaagcatggaggtggccggcgtcacagccctggcttgtggaatgatcgccgttggctcctgtaatggcgacgtgacttctacaatcctgcagactattatggaaaaatcagagaccgaactgaaagacacttacgctcgatggcttcccctgggcttaggactcaaccacctgggcaaaggtgaggcaatagaagcaatactggcggccctcgaagtagtgagtgagccatttaggagcttcgctaacacattagtagacgtgtgtgcctacgcaggatccgggaacgtccttaaggtgcaacagctactgcacatctgtagcgaacacttcgatagcaaagagaaggaagaagataaagacaaaaaggagaagaaggataaggacaaaaaagaggcaccggcagatatgggcgcccatcagggtgttgccgtcctcggcccgcttttgctgtggggtaggcggctggttcagcgctggcattatgagccatatcaccaacttcgctatggcgaaccaaccttaaggcgggctgtgccgctagctttggccttgatttcagtgtctaatcccagactcaacattctcgatactctgtccaagttttctcacgacgctgacccagaagtgtcatacaattcaatctttgccatgggaatggttggatccggcactaacaacgcacgcctcgcagcaatgctgaggcaactggcacaataccatgctaaggaccccaataacctctttatggttcgccttgctcaaggcttgacacacttaggcaaaggaacactcacactgtgcccttaccattctgatagacagttaatgagccaggtggccgtcgctggcctgctgactgtgctcgtctcatttctagacgtgcggaacatcatcctgggcaagtcgcattatgttctctacgggctcgtggctgcaatgcaacctcggatgctagttaccttcgatgaggaactgcgacctctgcccgtaagtgtgagggtcgggcaggccgtagacgtagtcggtcaagctgggaagcccaaaacgattaccggcttccaaacacacacgacaccagtgttgctggcccatggagagcgcgcagaactggctacagaggaatttctccccgtaactccgatcctggaaggttttgtcttcggtaggacccctatcatgatctcgaagtag

SEQ ID NO: 201068 - DNA, 2703 bp, Artificial Sequence
  Description of Artificial Sequence: Synthetic coding sequence
atggaggagggcggccgggacaaggcccccgtgcagccccagcagagcccggctgcggcaccaggtgggaccgatgagaagccttcaggcaaagacaaggagcaggaactctctgaggaagacaagcaactccaggatgagctagaaatgctcgtcgagaggttgggagagaaggatacatcgttatatcgacccgccctggaggagctgcgacggcagattcgatctagcaccacctccatgacctcggtccccaagcccctgaagttccttagacctcactacggaaaactgaaagaaatttatgagaacatggccccgggggagaacaaaagattcgccgcggatatcatatctgtccttgccatgactatgtcgggggagagagagtgtctgaaatatcgcctggtgggcagtcaagaggagctggccagctgggggcacgagtatgttcggcacctggctggcgaagtggcaaaggaatggcaggaactggacgacgccgaaaaagtccaaagggagcccctgttaacattggtaaaagaaatagtaccgtataacatggcccataacgccgaacacgaagcgtgtgatttgctcatggagattgaacaggtcgatatgctggagaaggatatagatgagaacgcctatgccaaggtgtgcctgtacctgacatcttgtgtgaattacgtgcctgaacccgagaactccgctctcctgcgttgcgccctgggagtgttccgcaagttcagcagattcccagaggccctccgcctggccctgatgcttaatgacatggaactggtggaggatatttttacatcctgtaaggacgtggtagtccagaaacaaatggcttttatgctggggcgccacggagtatttctggagctttcggaggacgtggaagagtacgaggatctgacagaaatcatgtccaacgttcaactaaactccaatttcctggccttagccagagagctggacataatggagcccaaggtgccggacgacatctacaaaacccacctagagaataacagatttggtggctcgggcagccaagttgacagtgctagaatgaacttggcaagctcctttgtgaatgggttcgtgaatgccgcgtttggccaggataagctgcttaccgacgacggcaacaaatggctctacaaaaataaggaccacgggatgctcagcgcagctgcgtccttaggaatgatattgctctgggacgtggatgggggactcacacaaattgataaatatctgtatagcagtgaggattacatcaagagtggagccctgctggcatgcggcatcgtcaactccggggtgaggaatgagtgtgaccccgccctggcccttctgagcgattacgtactacacaactcaaacaccatgcgtctgggcagtatcttcgggctgggtctcgcgtatgccggctctaaccgtgaggatgtgctcacactcttactccccgtaatgggcgacagcaaaagctctatggaggtcgccggcgtaacagcccttgcgtgtggaatgatcgccgtcggctcctgcaatggggatgtgacctcaacaattctccagactatcatggagaaatctgagactgagctaaaagatacctatgcccgctggttacccctggggctgggcctgaaccatctgggtaagggtgaggccattgaggctattctcgccgctctagaagtggtcagcgagccctttcggagcttcgccaacaccctcgtcgacgtgtgtgcctacgcaggcagcggtaacgtccttaaggtgcaacaactgctccacatttgttctgagcactttgacagcaaagagaaggaggaggataaggataagaaggaaaagaaggacaaagacaaaaaggaagcacctgcagatatgggggcgcaccagggtgtggccgttctgggcattgccctgattgccatgggggaggagatcggggccgaaatggcattgagaacctttggccatctgctgcgctatggtgagcccactctgcggcgtgctgtcccgctggcccttgccctgatatccgtgagtaatcccagacttaatatattggataccttgtctaagttttcacatgatgctgatcctgaggttagctataactcaattttcgcgatgggaatggtcggcagtggcaccaataacgcacggctggccgctatgttaagacagctggcacagtatcacgcgaaagacccaaataacttattcatggtgcggcttgcccagggcctgacacacttgggaaaggggactctgaccctgtgcccctatcatagcgacaggcagcttatgtcgcaggtggcagtcgcaggcttgctcactgtgctggtgtccttcctggacgttaggaacattatcctgggaaagtcccattatgtcttgtatggcttggtcgccgccatgcagccgaggatgctggtgactttcgacgaagaacttcgaccactgccagtgtccgtccgcgtggggcaggctgtggatgtggtcgggcaggccggcaaaccaaagacgatcacaggatttcagacacatactacccccgttctgctggcgcacggtgagagagctgagctcgcaaccgaggaattcctccccgttacccctatcctggaggggtttgtaatccttaggaagaacccaaattacgacttgtag

SEQ ID NO: 201069 - DNA, 552 bp, Artificial Sequence
  Description of Artificial Sequence: Synthetic coding sequence
atggacgccagccccagccccttcagcctgcccaagaagctgaacgaactgtctgcgagacggggatctgatgaactgctatcctcagggatcatcaacgggcccttcactatgaatagctcaactccctcaacagctaatgggaacgacagtaaaaagttcaaacgagaccgccccccgtgttccccctctcgcgtgctacaccttcgtaaaataccttgtgacgtgactgaagccgagatcattagtctcggactgccattcggcaaggttacgaatctgctgatgttaaaaggaaagtcccaggcattccttgagatggctagcgaagaggcagccgtaacgatggtaaactactacacccccattacgcctcatctgcgatcccagcctgtctatattcagtatagcaatcatagggagttgaagacagataatctccctaaccaagcaagagcgcaggcagccttacaggccgtctctgccgttcaatccggttctctggcattgtctggcggaccttcaaatgaggggaccgtgctgcccgggtag

SEQ ID NO: 201070 - DNA, 474 bp, Artificial Sequence
  Description of Artificial Sequence: Synthetic coding sequence
atggtgaccagcctggcctacacccaccacggccggcagtacctggcacaagaaggagtcattgatcaaattagtaatatcatcgttggagccgacagcgacccatttagctctttctaccttcctggctttgtgaagttttttgggaatctcgcggtgatggattcgcctcagcaaatttgcgagcggtatcccatattcgtagaaaaggtgtttgaaatgatcgaatcgcaggaccctactatgattggcgtggccgtagacacagttggcatcttgggaagcaatgtggaaggtaagcaagttttacagaagactgggtggtacgatctcgccctgttccgagacattctgatattcgaccgaggcagtatatgtaagttcatctgctggtgggtgaactacatcgtcgaaaccatcctgtgggtcgccgtgctcttaaccatgacactgtattcctgcctgaagatttag

SEQ ID NO: 201071 - DNA, 1386 bp, Artificial Sequence
  Description of Artificial Sequence: Synthetic coding sequence
atggccgcccaggccctggccctgctgcgggaggtggcccggctggaagcccctctagaggagctcagagctctgcacagcgtgttacaggccgtgccgctcaacgaactgcggcagcaggcagccgagttgagactggggccattattctccctattaaacgagaatcatcgtgaaaaaactactctctgcgtgtctattctggaacgtctcctgcaggctatggagcccgtgcacgttgcacgcaatctgcgcgtggatctgcagaggggactgatccatcccgacgacagtgtcaaaattctcacccttagtcaaatcggacgaatagtggaaaactcagacgccgttaccgaaattctcaataatgctgagctcctcaagcagatcgtctattgcatcggcggtgagaacctctcagtcgccaaggcattgatcatagagattagctccgtgagcccagaatctctcaactactgtaccacctcaggacttgtgacacagctgctgcgcgaactgaccggcgaggatgtgctcgtgcgggccacctgcatcgaaatggtgacttctttagcttatacccaccatggtcggcagtatctcgcgcaagaaggggttattgaccagatctccaacataattgttggcgctgacagtgatccgttttcatcgttttacctaccaggtttcgtaaagttctttggcaatcttgccgtgatggattcgccccagcaaatctgtgaacggtatcctatcttcgtcgaaaaggtgtttgagatgatcgagtctcaggacccaaccatgattggcgtcgccgtcgacactgtagggatccttggctcaaatgtggaaggtaaacaggtactccaaaagactggtacccgcttcgaaaggttgctgatgaggatcggtcatcagagcaaaaacgccccagtcgagttaaagatccggtgcttggacgccatatctagcctgctttacctgccgccagagcaacaaactgacgatctcttgagaatgaccgagagttggttttcttccttatcaagggatccattagagctttttcggggcattagctctcagcccttccctgagctgcattgcgccgccttaaaagtgtttactgctattgccaaccaaccatgggcccagaagctgatgttcaattcacctggattcgtggaatacgtggtagaccggagcgtggaacatgacaaagcttccaaggatgcgaaatatgagctagtaaaggcactcgctaattctaagacgattgcagaaattttcgggaatccaaactacctccggctccggacatacctctccgaggggccttactacgtgaagcccgtttctaccaccgcagtggagggtgcagagtag

SEQ ID NO: 201072 - DNA, 294 bp, Artificial Sequence
  Description of Artificial Sequence: Synthetic coding sequence
atgcggatcggccaccagagcaagaacgcccccgtggagctgaagattcggtgcctggacgcaatatctagcctcctctacctgccacccgagcagcagaccgacgatctgctgaggatgactgaaagttggttttcatctctgtctcgcgatccattggagctgtttcgcggcatctcaagtcagccctttcccgaattacattgtgctgctctcaaagttttcaccggacggaagcatctccaccttgaggaactggtgggggggaatcaggtgaaaaataccgtcgagtag

SEQ ID NO: 201073 - DNA, 510 bp, Artificial Sequence
  Description of Artificial Sequence: Synthetic coding sequence
atgatctgcctggtgctgaccatcttcgccaacctgttccccgccgcctgtacaggcgcccacgagcgcacatttttggccgtgaagcctgatggagtgcagcgtcggctggtgggggagatcgtacggcgcttcgaacgaaaaggctttaaacttgttgccctgaagctcgtccaggcaagcgaggagctgttgcgagagcactatgcagagctaagagagcgtcccttttacgggcgtctagtaaaatatatggccagtgggcccgtggtcgccatggtgtggcagggactggatgtggtgcgtacgagtcgcgccctgattggtgccacgaacccggccgacgcgccccctggaaccattcgcggggatttctgcattgaggtgggcaagaatctgatccatgggtcagattccgtagaatccgctcgtagggagatcgccctgtggttcagagctgacgagcttctgtgctgggaggattccgctggccactggctatatgaatag

SEQ ID NO: 201074 - DNA, 744 bp, Artificial Sequence
  Description of Artificial Sequence: Synthetic coding sequence
atgtacggcatgttcaagaaggtgaacgcccgggagcggatcgtgggatggtaccacactggccccaagctccataaaaatgacatcgccatcaatgagcttatgaagagatattgcccaaacagcgttttagtgatcattgacgtgaaaccaaaggacctcgggctccctaccgaagcctatatctccgttgaggaggttcatgatgacggtacacctacttccaagacatttgaacatgtaacatcagaaatcggggccgaggaagccgaagaggttggggttgaacatctgctccgagatattaaggataccactgtgggcactctgagtcagcggattaccaaccaggtccacggtctcaaggggcttaactccaaattactggatatacgctcgtatctggagaaagttgcaaccggcaagctgcctataaatcaccagatcatctaccagttacaggatgtgtttaacctgctgccggacgtctctctccaggaatttgtgaaggctttctacctgaaaactaacgaccagatggtagtggtctacttggcgtcgctcattcgttcagttgttgcgcttcacaacctcattaataacaaaatcgcaaacagagacgctgaaaaaaaggagggtcaggagaaggaagaatctaagaaggatcgcaaggaagataaagaaaaagataaggataaggaaaagtctgatgtgaaaaaagaggagaagaaggagaaaaagtag

SEQ ID NO: 201075 - DNA, 624 bp, Artificial Sequence
  Description of Artificial Sequence: Synthetic coding sequence
atgagcgacgaggaggcccggcagagcggcggcagcagccaggccggcgtggtgacagtgtccgacgtccaggaactgatgcgccgcaaagaagaaatcgaggcacagatcaaagccaattatgacgtcctagagtctcagaagggaattggcatgaatgaaccgcttgtggattgtgagggctaccctcgttccgatgtagacctctatcaggtgagaaccgccagacacaacatcatctgcttgcaaaatgaccataaggccgtaatgaaacaggtcgaggaagccctgcaccaattacatgcaagggataaggagaagcaggccagagatatggcagaagcccacaaagaggccatgagcaggaaattgggtcaatctgaatctcagggaccaccgagggcgttcgccaaagttaactctatctccccaggtagccccgcctcgatagcaggcctccaagtagatgacgaaattgtggagttcggctcagtgaacacccagaattttcagtccctgcataacattggctcagttgtacagcacagcgaaggagcactggcgcccaccatactgctctcagtctctatgaaccttaccacccccggcacatcatcacgatag

SEQ ID NO: 201076 - DNA, 672 bp, Artificial Sequence
  Description of Artificial Sequence: Synthetic coding sequence
atgagcgacgaggaggcccggcagagcggcggcagcagccaggccggggtggtgacagtgtccgacgtgcaagaactcatgaggcgaaaggaagagattgaggctcagataaaggccaactatgacgtgctcgaatcacagaaaggcatcggcatgaatgagcctcttgtcgattgcgagggctaccctcgctcggatgtcgatctgtaccaggtgcgtaccgcaaggcacaacataatttgcctgcagaacgaccataaagcagtgatgaaacaggtagaggaggcccttcaccaactccacgcacgcgataaggagaagcaggctcgcgacatggcggaggcccataaagaggcaatgagtcgcaaactcgggcagagcgaatctcaaggacctcctagagcttttgctaaggttaacagcatctcaccaggtagtcctgcatcaattgccggactgcaggtggatgatgagatcgtggagtttggatctgtgaatacccagaacttccagtccttgcacaacattgggagtgtggtgcagcacagcgaaggcaagccgttgaacgtcaccgttattcgacgtggagagaaacaccagctgcgcctggtgcctacacggtgggcggggaaggggctcctgggctgcaacattatccccctccagcgttag

SEQ ID NO: 201077 - DNA, 411 bp, Artificial Sequence
  Description of Artificial Sequence: Synthetic coding sequence
atgctgctgaagctgaaggagaaggccagcctgaccctggccgtgggcaccctaccttttccatctcagttcaacttcgtgccaccaggtcggatgtgcagggtggctggctggggtcgcaccggtgtcctgaaacctgggtcagacaccctgcaggaagtaaagctgagacttatggatccacaggcgtgctcacactttcgggatttcgatcacaacttacagctgtgcgttgggaatccacgcaagacaaagagcgcttttaaaggagatagtgggggacccctattatgcgcgggtgtcgcccaggggatagtgtcgtacggtcggtctgacgcaaagccccctgcggtgttcaccaggatctctcactaccggccctggattaatcagatactccaggctaactag

SEQ ID NO: 201078 - DNA, 753 bp, Artificial Sequence
  Description of Artificial Sequence: Synthetic coding sequence
atggccatgctgcgggtgcagcccgaggcccaggccaaggtggacgtgttcagggaggacctgtgcaccaagaccgaaaacctgttagggtcttactttcccaagaaaatctctgagctagacgcctttctgaaggaacccgctctcaacgaagcaaatttgtccaatttaaaagctcccctcgatattcctgtgccggaccctgtaaaggaaaaagagaaggaggagcgcaagaagcagcaggaaaaggaggacaaagacgagaaaaaaaaaggcgaagacgaggataaggggccaccatgcggtcctgtcaattgcaacgaaaaaatagtggtgctgctccaacgtctgaagccggagatcaaggatgtcatcgaacagctgaatctcgtaaccacgtggctgcaattgcagataccgaggattgaagacgggaataactttggcgtagctgtgcaagagaaagtgtttgaacttatgacttctctacacaccaaacttgagggctttcatactcaaattagtaaatacttctccgagagaggggacgcagttacaaaggccgcaaaacagccccatgttggcgattatcggcaattggtgcatgagctcgatgaggcagaataccgagatatacgcctcatggtcatggagatacgcaacgcttacgtgcgacggcaggggcagggaagagggggacagcgtcagctctcccaagctacccatagcctcaccctgcaggcgcggggttag

SEQ ID NO: 201079 - DNA, 627 bp, Artificial Sequence
  Description of Artificial Sequence: Synthetic coding sequence
atgggcgaggtggagatcagcgccctggcctacgtgaagatgtgcttacatgccgcccgttaccctcacgctgccgttaacggactgtttctcgctccagcccctagaagtggggagtgtctctgccttaccgactgtgtgccactgttccattcacatcttgccctctctgtgatgctggaggtcgcgctcaatcaggttgatgtatggggcgcccaggctggcttggtggtagcagggtactaccacgcaaacgctgcagttaatgaccagtccccaggaccactcgccctgaagatcgccgggcggatcgcggagttctttcctgacgccgtcctgatcatgctcgacaaccagaagttggtgcctcaaccccgtgttcctccagtaattgtcctcgagaatcaggggctgaggtgggtgccaaaggacaagaacctcgtgatgtggagggattgggaggagagtcgccagatggttggggccctgctggaggatagggctcaccagcacctcgtcgatttcgactgccacctggatgatattaggcaagattggaccaatcagaggcttaatacacagatcacccagtgggtggggcccaccaacgggaacggaaatgcttag

SEQ ID NO: 201080 - DNA, 804 bp, Artificial Sequence
  Description of Artificial Sequence: Synthetic coding sequence
atggccagcctgctgaaggtggaccaggaggtgaagctgaaggtggactcatttcgggagcgcatcacgtcagaagccgaagatctcgtcgctaatttctttcccaaaaagctgctggagttggatagcttcttaaaagagccgatcctgaacattcatgaccttactcaaatccacagcgacatgaatctccctgtgcccgatcccatcctgctgaccaactctcacgatggattggacggtcctacgtacaagaaacgacgactcgacgagtgcgaggaagcttttcaaggtacaaaagtatttgtcatgccaaatgggatgctgaagtctaaccaacaactggtcgatattatcgaaaaggtgaaacccgaaatccgattactcatcgaaaaatgcaacactccttctggtaagggtccccacatctgttttgatctacaagtgaaaatgtgggtccagctgctgattccccggatcgaagacggaaacaactttggcgttagcatccaggaggagactgtcgccgagctgagaactgttgagagcgaggccgcgagttatctggaccagatcagtcggtactacattacgagagccaaactagtctccaaaatcgctaagtatccccacgtagaagattacaggaggacagtgacggagatcgatgaaaaagagtatatcagccttcgcctcatcatttcagagcttcggaaccagtacgttaccctgcacgatatgatactaaagaatatagagaagattaagaggccacggtcctcaaacgcagaaaccctgtattag

SEQ ID NO: 201081 - DNA, 765 bp, Artificial Sequence
  Description of Artificial Sequence: Synthetic coding sequence
atggccagcctgctgaaggtggaccaggaggtgaagctgaaggtggattccttccgggagagaataacgtcagaagctgaggatctggtcgcaaacttcttcccgaagaagttgcttgagctcgactcctttctcaaagagcccatcctcaatatccacgacctgacacagatccactccgatatgaacttaccggtccctgatccgatattgctcaccaatagccacgatggcctcgacggccccacttataaaaagcgccgcctggatgagtgcgaagaggcattccaggggaccaaggtcttcgtgatgccaaacggaatgctgaaaagcaatcaacagctggtggacattatcgagaaggttaagcccgaaatacgcctcctgatcgaaaaatgcaatacagtcaagatgtgggtgcagctgcttatcccccgtatcgaggacggcaataatttcggggtcagcatccaggaagaaaccgtggccgagctcagaacagtggaatcggaagccgcttcatatttggaccaaatctctcgctactatatcaccagggcgaagctggtgagtaaaatagctaaatatccccacgtggaggactataggcgaacagtgacagagattgacgaaaaagagtacatatcccttcggctgataatctctgagctgcgaaaccagtacgtcacccttcacgatatgatcctgaaaaacatagagaagatcaaacgaccccgatctagcaacgcagagactctgtattag

SEQ ID NO: 201082 - DNA, 48 bp, Artificial Sequence; identical to SEQ ID NO: 94888
  Description of Artificial Sequence: Synthetic coding sequence

SEQ ID NO: 201083 - DNA, 393 bp, Artificial Sequence
  Description of Artificial Sequence: Synthetic coding sequence
atggccagcctgctgaaggtggaccaggaggtgaagctgaaggtggacagctttcgcgaaaggattacgagcgaagccgaggatctagtcgccaacttctttcctaagaaactgttggagctcgacagcttcctgaaggaaccaattctcaatattcatgacctgacacagatccattccgacatgaacctgcccgtgcccgatccgatattactgactaattcacatgatggactggatggacctacttataagaagcgcaggctggatgagtgcgaggaagccttccagggtcagaacgttggtacggcacctgatagccaagacagaaggtggaaacagctttggggagtgcatagcggggggaacagttgtagggctaagaactgttag

SEQ ID NO: 201084 - DNA, 582 bp, Artificial Sequence
  Description of Artificial Sequence: Synthetic coding sequence
atgaacctgcccgtgcccgaccccatcctgctgaccaacagccacgacggcctcgacggaccaacctataagaagcggagattggatgaatgcgaggaagcattccaggggaccaaggtattcgtgatgccaaatggaatgcttaaatcaaatcagcaacttgtggacatcattgaaaaagtcaagcccgaaatccggctgctcatagaaaaatgcaataccgtcaagatgtgggtgcaacttctcatccctaggatagaggatggcaacaattttggcgttagcattcaggaggagaccgtggctgagttgcgaacagttgaaagcgaagccgcgtcgtacctcgaccagatttcccggtactacattacaagggccaaactagtgtctaagattgccaaatacccacacgtggaggactatcgaagaaccgtgactgagatcgacgagaaagaatacatctcccttcggctaatcatcagcgaactgagaaatcaatacgtgacactccatgacatgattcttaagaatattgaaaagatcaaacgccccagatctagtaatgcagagacactgtactag

SEQ ID NO: 201085 - DNA, 5532 bp, Artificial Sequence
  Description of Artificial Sequence: Synthetic coding sequence
atggagcccgccgagcgggccggcgtgggcgagccccccgagcccggtggtcgcccagaacctgggcctagggggttcgtccctcaaaaagagatagtgtataacaaactcctcccgtacgccgagaggctggacgcggaaagtgatctgcagcttgcccagatcaaatgcaacctgggacgggccgttcaactacaggagctctggcccggaggcctgttttggacccgtaaactgtcaacttatatccgtctgtacggccgcaagttctctaaggaggaccacgttctatttataaaactgctgtacgaactggtgtctatccctaagttggagattagcatgatgcagggttttgcacgcctgctaataaacctgctgaagaagaaagagctgctgtcaagagctgaccttgagctaccatggcgaccactgtacgatatggtggaacgaattctgtattcaaagactgaacatcttgggttgaactggtttccaaattccgtcgaaaacatactgaagactctcgtgaagtcttgtagaccttatttccccgcggacgcaacagccgaaatgctggaggagtggcgccccctcatgtgcccttttgacgttaccatgcagaaggctatcacatattttgaaatcttccttcctaccagcctcccaccggagctgcatcacaagggattcaaactttggtttgacgaactgataggactttgggtgtcggtgcagaatttacctcagtgggaaggccaactcgtgaatctcttcgcccgcctggccactgacaatatcggttacatcgattgggacccttacgtgcccaagatcttcacacgtatcttgcggagtctcaatctgccagtgggctcctcccaggttctagtacctcgatttctcacgaatgcctacgacattggacacgcagtgatctggattaccgccatgatgggggggccaagcaaactggttcagaaacatctggcaggactgttcaatagtattacctcattttatcacccctctaataacggcaggtggttgaacaaactgatgaaactcctgcagcgactgcccaactccgtcgtccggcgcctccacagagaacgatacaagaagccaagctggcttacgcctgtacctgactcccacaaactgaccgaccaagacgttacagacttcgtacagtgtatcatacaacccgtgctgctggctatgttttccaagactggcagcctcgaagcagcccaggcccttcagaacttggccctaatgcgtcccgagctggtgattcctcctgtgctggagagaacataccccgccctggagacactgaccgaacctcaccagcttaccgcgacgctgtcatgcgttatcggcgttgcccggagcctggtctccggaggcagatggttccccgaaggcccgacacacatgctccctcttctaatgagggccctgcctggggtggatccaaacgatttctccaagtgtatgattacttttcagtttattgctacctttagcacactggtgcctctcgttgattgcagctctgttctgcaggagagaaacgatctaaccgaagtggagagagaactctgtagcgccaccgctgagttcgaagatttcgtgctccaattcatggatcgttgtttcggcttaattgaaagctccactctggaacagacccgcgaggagaccgaaactgagaagatgactcacctagaatccctcgtggagttggggctcagctctacgtttagcaccatcttgactcagtgctccaaggagatattcatggttgcgctacagaaagtctttaattttagcacctcccatatattcgagacgcgggtagccggccggatggtagcggacatgtgcagggcagccgtgaaatgctgcccagaagaaagcctaaaactctttgtaccccactgttgttccgtgattacccagctgaccatgaacgacgacgtgctcaatgacgaagaactggataaggaactactgtggaacttgcagctcttatccgagataactagggtggacggcaggaagctcctgctctaccgagagcagctagtgaagattttgcagcggactttgcacctgacatgtaagcaggggtacactctcagttgcaatctcctgcatcacctcttacgctcgacaacattgatctacccgaccgaatattgcagcgtgccagggggttttgacaaacctccctcagaatacttccctattaaagattggggcaagcccggggatttgtggaacctgggcatccagtggcacgtgcccagcagcgaggaagtgtccttcgcgttctatcttctcgacagtttcctgcagcctgagctcgtaaaactgcagcattgtggcgatgggaaactggagatgagccgcgacgatattctgcagtctttgaccattgtgcataactgcctgattggctcagggaatctgctgccgccactgaaaggggagccggttactaacctcgtgcccagcatggtaagtcttgaagagaccaaactgtataccggcctggagtacgatttgtcacgtgaaaatcaccgggaggttatcgccacagtgattagaaaattgctcaaccacattcttgacaattcggaggacgacacaaaatcactcttcctgatcatcaagattatcggggatctgctccaatttcaggggagccataagcatgagttcgatagccgctggaaatcctttaaccttgttaagaaaagcatggagaaccggctgcacggtaaaaagcaacacattagagcccttctaattgatcgggtaatgttgcaacacgagctcagaactcttacagttgaaggttgcgaatacaaaaagattcatcaggatatgatacgggatctactgagactgagtacatcctcctattcgcaggtgcgaaacaaggcccagcagaccttttttgccgcccttggcgcttacaacttctgctgtcgcgatatcatcccactggtactggaattcctaaggccagatcggcagggcgtgacacaacaacagtttaagggggctctgtattgcctgttgggcaaccattccggggtttgcttagctaacctgcatgactgggattgtattgtccagacatggccagctattgtgagttccggtctaagtcaggcgatgtcgctggaaaagccaagcatcgtgagactgtttgatgatctggccgagaaaattcaccgacagtacgagactattgggctggactttaccatccccaagtcttgcgtggagattgctgagctgttgcagcagtctaaaaacccctccattaatcagatactgctctcgccagaaaaaattaaggagggtatcaaaaggcagcaggagaaaaacgccgacgccctccgcaactacgaaaatctggtggatactctgctggacggcgtggaacaacgcaatcttccttggaagtttgaacacatagggatcggcctcctttctttgttgctgcgcgatgatagggtccttccattgcgcgccatcaggtttttcgtggagaatctcaatcatgatgccattgtggtccgcaaaatggccatctccgctgttgccggaatacttaaacagctcaagagaacacacaaaaaactgacaatcaacccttgcgaaattagtgggtgccccaagcccactcagataattgctggtgataggcctgacaatcattggctgcactacgattccaagacgatccctcggactaagaaggagtgggagtcctcctgctttgtcgaaaaaacgcactggggctattatacatggccaaaaaacatggtggtttacgctggagtggaggaacagcctaagctaggccgaagcagagaagacatgacggaggcagagcagattatctttgatcacttcagcgatcccaagtttgtggagcagctgatcaccttcctctccctggaagacagaaaaggcaaggacaagtttaatccacgcaggttttgcttgtttaaagggatctttaggaattttgacgatgcgttccttcccgtgctcaaacctcacctggaacatctcgtggcagacagccatgagagcacccagcgctgtgtagcagagataatcgcaggacttatcagaggttcaaagcactggacttttgagaaggtagaaaagctgtgggagttactttgccctctgctgaggaccgctctgtctaatatcacagtggagacgtacaatgactggggcgcgtgcatcgctactagctgcgaatcgagggacccgcgcaagttgcactggttgttcgagttgctgttggaatctcctctctcaggtgagggcggttcattcgtggacgcatgtcgcctgtacgtgctgcagggagggctcgcacagcaggagtggcgcgtgcctgagttattacatcgtttgctcaagtatctggagcctaagctgactcaggtgtataagaatgtgcgagagagaattggctctgtccttacttatatctttatgatcgacgtatctttacccaatactaccccaaccatttccccgcatgtgccagagttcacggctagaatcttggagaagctcaaacccttgatggatgttgatgaggaaatccagaaccatgtaatggaggaaaatgggatcggtgaagaggatgagcggacccagggcatcaaattacttaagacaatcctgaagtggctgatggcttccgccggcagaagcttttctaccgcagtgactgagcagctgcagctgttacccctgttttttaagatcgcgcccgtggaaaacgataacagttacgatgagctcaaacgggacgccaagttgtgcctgtcactcatgtcacaggggctgctctatcctcaccaggtgccactcgttctgcaggtattgaaacaaacagcacgctcatcatcctggcacgcaaggtacacggtgctgacatatctgcaaaccatggtattttataacctctttatttttctcaacaacgaagatgccgtcaaagatatccgttggcttgtgatcagtttgctggaggatgagcaactcgaggtcagagagatggccgctaccacactgtccggtcttctccagtgcaacttcctcaccatggactcaccaatgcagattcacttcgaacagctgtgcaaaacaaaacttcccaaaaagcggaagagagaccctggttcagtcggtgataccatccctagcgcagagctggtgaaaagacatgccggggttctcggattaggcgcatgcgtcctgagttccccctacgacgtgcctacatggatgccacaattacttatgaatttgtccgcccacctgaacgacccccaacctatcgagatgactgtgaagaagacactctcaaacttccggcgtacccatcacgacaactggcaagagcacaaacagcagttcaccgatgaccagctcttagtattgactgacttgctggtttccccttgttactatgcatag

SEQ ID NO: 201086 - DNA, 2964 bp, Artificial Sequence
  Description of Artificial Sequence: Synthetic coding sequence
atgggcgagaacctggccaagaagatcatgttcttcctgctgaccatcaaactgatactgaatcacattctcgataactctgaagacgatacaaaaagtctgtttctgattataaagataatcggtgatctgttacagttccagggatcccataaacatgaatttgactctcggtggaagagcttcaatctggtgaagaaatctatggagaaccggctccatggtaaaaagcaacatatacgagccctgctcatcgatcgagtgatgctccagcacgagctgcggacactgacagtggaaggctgcgagtacaaaaaaattcaccaggatatgatccgggatctactgaggttgtctaccagctcctattcgcaggtgaggaataaggcccagcagacttttttcgccgctctgggcgcatataacttttgttgtcgcgatatcattcccctggtcctggagttcttgagacctgaccggcagggcgttacacagcagcaatttaagggggccctgtactgtttactgggcaaccatagtggtgtttgtcttgctaacctacatgactgggattgcattgtgcagacctggcctgccatagtgtcaagcgggctgagccaggccatgtctctggagaaaccctcaatcgtacggctcttcgacgatctggctgaaaaaatccaccggcagtatgagacgattggcctggacttcaccattcctaagagctgtgttgagatcgccgaactcctccagcagagcaagaaccccagtataaatcagattttattaagccctgaaaagatcaaagagggcataaaaaggcagcaagagaaaaacgctgatgctctgcgtaattacgagaatctggttgacacactcttggacggcgtcgagcagcgcaacctgccctggaaatttgaacatattggaatagggctgctgtccttgcttctgcgagacgatagagtgctgcccttgcgggctattcggttcttcgtggagaatcttaatcatgacgcaatagttgttcgtaaaatggcaatctcggccgtggccggtattctgaagcaactcaagagaacccacaaaaagctcaccatcaatccttgcgaaataagcggctgtcccaagccgacccaaatcatcgccggcgaccggcccgacaaccattggttacattatgattccaaaaccatcccgcgcacaaagaaggaatgggagtcctcgtgcttcgttgaaaagactcactggggctactacacatggcctaaaaacatggtcgtctacgccggcgtggaggagcagcctaaacttggccggtccagggaagacatgaccgaggctgaacagattatcttcgaccatttctcagatccaaaattcgtggaacagctcattacatttcttagcctggaggataggaaaggcaaagacaaattcaatcccagacgcttttgtctgttcaaaggaattttcaggaacttcgatgatgcgtttttgcctgtgctgaagccacatttagagcacttagtcgccgactcacatgaaagtacacagcgatgcgtggccgagattatagcaggcctcattcgcggctccaaacactggaccttcgaaaaagtggaaaagttgtgggaactgctgtgtccactgctcaggacagccctgtcgaacatcacagtcgagacctataacgactggggcgcttgcatcgccacttcctgtgagtcgcgggatcctcgaaagttgcattggctgtttgaattgctactcgaatccccccttagcggtgaaggaggatcgttcgtagatgcatgtcgtctgtatgttctgcagggtggactcgcccagcaggaatggcgagtgcctgagcttctccaccgtctgcttaagtacctagagccaaagcttacccaggtgtataagaacgtgagggaacgtatcggttctgtcctgacttatatctttatgatcgatgtttccctacctaataccactcctaccatctcgccccatgttcctgaatttaccgcccggatactcgaaaaactgaagcctcttatggacgtcgacgaagaaatccagaatcacgtaatggaagagaatggaatcggcgaggaggacgagcgtacacagggcataaagctcctgaagacaatccttaagtggttgatggcctctgccggacgtagtttttctactgcagtgaccgaacagcttcagctgcttcctctgtttttcaaaattgcacctgtggaaaacgataactcttacgacgagctgaagcgcgatgcaaaactgtgcctgtcccttatgagccagggattgctgtatccccaccaggtgccactggtgcttcaggtgctgaagcagaccgcacgctcatcctcctggcacgccagatacacagtgctcacatacctgcagactatggtcttctacaacctgtttatcttcctgaataacgaggatgctgtgaaagacatcagatggctcgtgatatcactgttagaggacgagcagctagaggtcagagaaatggcagcgacgacactctccggtctgttgcagtgcaacttccttactatggatagtcccatgcagattcactttgagcagttgtgtaagaccaagctgccaaaaaaacgcaaacgagaccctggtagtgtgggcgacacaattccctctgcagaactggttaaacgtcatgccggagtgctgggtctaggggcatgcgtgttatcttccccttacgacgttccaacatggatgcctcagcttcttatgaatttatcagcccatctcaatgaccctcagcccatcgagatgaccgtaaaaaaaacgctgagcaacttccgacgcacacatcatgataactggcaggaacataagcagcagtttactgacgaccaactgctggtcctgaccgatctgttggtgtcaccatgttactatgcatag

SEQ ID NO: 201087 - DNA, 867 bp, Artificial Sequence
  Description of Artificial Sequence: Synthetic coding sequence
atggccgccaccttcttcggcgaggtggtgaaggccccctgccgggctggaaccgaggacgaagaggaagaggaagaggggaggcgagagacccccgaagaccgcgaggtgagattgcaacttgccagaaagcgagaggttcggctgctcaggagacagaccaagactagcctagaagtgtctcttctcgaaaagtatccatgcagcaagtttataattgcaataggcaacaatgctgtagccttcttgtcatccttcgtaatgaactcaggcgtttgggaagaggtcggttgcgccaaactctggaacgaatggtgtcgcaccaccgatacgacccacctgagcagcaccgaagctttttgtgtgttttatcacctgaagtcaaacccctctgtgttcttatgtcagtgctcctgctacgtggccgaagatcagcagtaccaatggctggagaaggttttcggctcttgcccgcggaagaatatgcagataaccattttgacttgtcgtcatgtgaccgattacaagacttccgagagtaccggatcactgcccagtccattcctgagggccctcaaaactcagaacttcaaggatagcgcctgctgtccgctgttggagcaaccaaacatcgttcacgacttacccgcagccgtcttaagctactgtcaagtttggaaaatacccgccattctttatctctgttatacggacgttatgaaattagacctgatcacagtcgaggcatttaagcctatactgtccacccgaagtttaaagggcctggttaagaatataccgcagtccaccgagatattgaagaaactgatgaccacaaacgagatccaatcaaacatctacacttag

SEQ ID NO: 201088 - DNA, 804 bp, Artificial Sequence
  Description of Artificial Sequence: Synthetic coding sequence
atggccgccaccttcttcggcgaggtggtgaaggccccctgccgggccgggaccgaagacgaggaggaggaggaagagggccgccgggagactccggaggacagggaagttcgcttgcagcttgcccgaaaacgggaagttcggcttctgcgtcgacagaccaagacctctctcgaagtgtcgctgttagaaaagtatccttgcagcaagttcattatcgctatcggtaacaacgccgtggcgtttctgtcaagcttcgtcatgaacagtggcgtgtgggaggaggttggatgcgctaagttgtggaacgagtggtgcagaacaaccgatacgacacatctaagttccaccgaggctttttgtgtattctaccacctcaaaagcaatccttccgtgtttggctcatgcccacgcaagaacatgcagataacgatccttacttgccgacacgtgactgattacaagaccagcgagtcgacggggagcctgccatcccccttcctgcgcgccctgaaaacccaaaattttaaagattcggcctgctgccctctcttagagcagccaaacatagttcacgatctgcccgctgctgtcctatcctattgccaggtctggaagatccctgccattctgtatttgtgctacactgacgtcatgaagttggacctgatcactgttgaagctttcaagcccatacttagcacccggtctctaaaagggctggtgaaaaacatcccgcagtcaaccgagatcttaaaaaaacttatgacaacgaacgaaattcagtccaatatctatacctag

SEQ ID NO: 201089 - DNA, 795 bp, Artificial Sequence
  Description of Artificial Sequence: Synthetic coding sequence
atgttcgtgccctgcggcgagagcgcccccgacctggccggcttcacactgctaatgccagctgtcagcgtgggtaacgtagggcagctggctatggatctgatcatttcaaccctgaacatgagcaaaattggttatttttacactgactgcctggtgcccatggttggtaacaacccctatgctacaactgagggtaattcaaccgaattatctattaacgccgaagtatattcccttcctagccgaaagctcgtggctctccagctacgatctattttcatcaagtacaagagtaagccattctgtgagaagctgctgagttgggtgaaatcatctgggtgcgcgagagtgatcgtgctctcctcatctcattcttaccagcgaaatgatcttcagctgcgctccactcctttcagataccttctgactccgagtatgcaaaaatccgtgcagaataagattaaatctctaaattgggaagagatggagaaaagtcggtgtataccagagattgatgattcggagttttgtattcgcataccaggcggcggaattacaaaaacgttgtacgacgaaagctgttccaaagaaatccagatggctgttctcctgaagtttgtgtctgagggcgataacatccccgacgctctgggcttggtggagtacctgaacgagtggttgcagatacttaagcctctttccgatgacccaacagtgtccgcctcacgctggaaaattcccagctcttggcggttattgttcggtagcggcttaccgccagctctgttctag

SEQ ID NO: 201090 - DNA, 459 bp, Artificial Sequence
  Description of Artificial Sequence: Synthetic coding sequence
atgcccgccgtgagcgtgggcaacgtgggccagctggccatggacctaattatctctactctgaacatgtccaagatcgggtacttttataccgactgtctggtgccaatggtgggcaataacccatacgctaccactgaaggaaattccaccgaactctcgatcaacgcagaggtctacagtctccccagtaggaagctggttgcactgcaacttaggagtatcttcatcaaatacaaaagtaagccgttctgtgagaaacttctaagctgggtgaaatctagcggttgtgctagggtcatcgttctgtcttcatcacacagttaccagcgtaacgacctccaactgagaagtaccccttttcggtatttgcttaccccttcgatgcagaagtctgtgcagaataaaataaaatcgctgaactgggaggagatggaaaaaggggccttcctcaagtag

SEQ ID NO: 201091 - DNA, 792 bp, Artificial Sequence
  Description of Artificial Sequence: Synthetic coding sequence
atgttccggaaccagtacgacaacgacgtgaccgtgtggagcccccaggggcgtatccaccaaatcgaatatgccatggaagctgtgaaacaggggtcagccaccgtcgggctaaaaagcaaaacgcacgccgtgctcgtggccctcaaaagggcccagagcgagttggcagcccaccaaaagaaaatccttcatgtcgataatcatattggaatcagcatcgctgggctgaccgccgacgctcgacttctgtgtaatttcatgagacaggagtgtctcgactctaggtttgtgttcgaccgcccccttcccgtgtctcgtttagtctcattaattggctcgaagactcagatccccacgcagagatatgggagacgtccctacggcgtgggattgctgatagctggatatgacgatatgggccctcacatattccagacatgcccttccgcaaattacttcgattgtcgggctatgagtatcggcgcccgcagccaatccgctcgaacttatttggagaggcacatgtccgagttcatggagtgtaacctgaatgagctggttaagcacggtcttagggctctcagggagaccctacccgcggaacaggacctcaccactaaaaatgttagtatcggtattgtgggcaaagacctagaatttactatatatgacgacgatgatgtcagccctttcctcgagggattggaggagcgacctcagagaaaagcacagccggcccagcccgctgatgaacccgccgagaaagctgatgaacctatggaacattag

SEQ ID NO: 201092 - DNA, 792 bp, Artificial Sequence
  Description of Artificial Sequence: Synthetic coding sequence
atgttccggaaccagtacgacaacgacgtgaccgtgtggagcccccaaggtagaatccaccagatagagtacgccatggaggccgtcaagcagggatctgcgaccgtgggcttgaagtctaaaacgcacgccgtcctggtggctctaaagcgggcacagagtgagcttgctgcacatcaaaaaaagatactgcatgtcgataaccatatcggaatttcaattgcggggcttacagcagacgcccgactgctctgtaactttatgcggcaggagtgcttagattcacggtttgtgtttgacagacctcttcctgtttcaaggctggtgagccttattgggtcaaaaacccagatcccgacacagcgctatgggcgtcgcccttacggcgtgggcctccttatcgctgggtatgatgacatggggccccatatttttcagacctgtcctagcgccaactacttcgattgtcgagccatgtctataggggccaggtcccagtccgctaggacttacctggagcgtcacatgagcgagttcatggaatgtaaccttaatgagttggtcaagcatggtttaagagccctgagagagacactacccgccgagcaggatcttactacaaagaatgtcagcattggaatcgtcggcaaggatctggagttcaccatttatgatgatgacgacgtgagccccttcttggaagggctggaagagaggccccagcgtaaagcccagcctgcacaaccagctgacgagcctgccgagaaggccgatgagcccatggaacactag

SEQ ID NO: 201093 - DNA, 810 bp, Artificial Sequence
  Description of Artificial Sequence: Synthetic coding sequence
atgcagctgagcaaggtgaagttccggaaccagtacgacaacgacgtgactgtgtggtccccccagggacggattcaccagattgaatacgctatggaggccgtcaaacagggatccgctactgttggattaaagtccaaaacccacgctgtactggtggctctgaaacgcgcccagagcgagctggctgctcaccagaagaagattttacacgtggacaaccacattgggatttccatagcagggctgaccgccgatgctaggctcctttgtaattttatgaggcaggagtgcttagacagcagattcgtgttcgatcggcctctacctgtatctcggctggtcagcctaattggcagcaagacccagatcccaacacagcggtatggtaggagaccatacggagtgggcctcttaatagcgggctacgatgacatgggaccccacattttccagacctgcccatctgccaactatttcgactgccgcgccatgagtatcggagcgcgaagtcaaagtgctcgtacatatttagagcgacatatgtcagaatttatggaatgcaacctgaatgaactcgtcaagcatggcctgagagctctgcgggaaaccctgcccgctgaacaggacttgaccacaaagaatgtgtctatcgggatagtcggaaaggatctcgagtttacaatatatgatgatgatgatgtgtctccttttctcgaaggtctcgaagagagacctcagagaaaagcccagcccgcacagccggccgatgaacctgcagaaaaggcagacgagccaatggagcactag

SEQ ID NO: 201094 - DNA, 495 bp, Artificial Sequence
  Description of Artificial Sequence: Synthetic coding sequence
atgttccggaaccagtacgacaacgacgtgaccgtgtggagcccccagggtcgcattcatcagattgagtatgccatggaagctgttaagcagggtagtgcgactgtcggtctcaagagcaagacacatgccgtgctggtggctcttaaaagggcacaaagcgagttagctgctcatcagaaaaagatactccatgtcgacaatcacatagggatttcgatagcagggcttacagcagatgcacgccttctgtgtaacttcatgcggcaggagtgtttagattccaggttcgtattcgaccgccccttaccggtctctagactagttagtcttatcgggtcctccatcctgtttatgatttgggcattaaccttctcaaagcctgtccacctgctgacaatcctcactgcggagccctgtcctttagaaccggtgcctaaccagctggtgctaacatggcgagatatatgtctcaacctatggagcgtgatttag

SEQ ID NO: 201095 - DNA, 1014 bp, Artificial Sequence
  Description of Artificial Sequence: Synthetic coding sequence
atggaccagaacgagcacagccactggggcccccacgccaagggccagtgtgccagccgtagtgagctcaggatcatactggtaggtaaaactggaacaggtaaaagcgccgcggggaattcaattctcagaaagcaggcctttgaaagcaagctaggcagccagacactcacaaaaacttgctctaagtcacagggtagctggggcaatcgggagattgtaattatcgatacacccgacatgtttagctggaaagatcattgtgaagccctttacaaggaggtgcagcgttgttacttgctgtccgcacctggaccgcacgtgctgctgctagttactcagctagggcggtacactagtcaggatcagcaggctgctcaacgggtaaaggaaatttttggggaggacgcaatggggcacaccattgtgctctttacccacaaggaggacctgaacggcgggtctttgatggattatatgcacgattcagacaataaggcattgtctaagcttgtcgccgcttgtggtggccgcatatgtgcctttaacaaccgcgccgagggctccaatcaggatgaccaggtaaaggagctcatggactgcatcgaggaccttttgatggagaaaaatggcgatcactatactaatggtctctactctctgattcaaagatccaagtgtggtcctgtgggctcggacgaacgcgtgaaggagttcaagcagtccctgatcaagtatatggaaactcagaggagttatactgccctagcagaggctaactgcttgaaaggggcattaattaagacacaattatgtgtgctgttctgtattcagctctttttgcgattaatcatcctctggctttgcatactccacagcatgtgtaacctattttgctgtctgctcttctcgatgtgcaatttgttttgctcactgctcttcataatcccgaagaagctgatgatattcctgcgaacggtaattaggctagagcggaagactcccagactctag

SEQ ID NO: 201096 - DNA, 300 bp, Artificial Sequence
  Description of Artificial Sequence: Synthetic coding sequence
atgggccccgactaccgggtgctggtgcaccgggcccggaagctggcccaacagtattatcttgtctaccaggagccgataccaacggctcagctggtgcaacgtgtggccagcgtgatgcaggagtacacacagtctgggggcgtgagaccttttggagtaagcttgttgatttgtggctggaacgaaggccgcccctaccttttccagtcagatcctagcggtgcgtactttgcatggaaagcgactgctatgggtaagaattatgtgaatgggaaaacttttcttgagaaaaggtag

SEQ ID NO: 201097 - DNA, 465 bp, Artificial Sequence
  Description of Artificial Sequence: Synthetic coding sequence
atgctgtactgcgaggccgagagcccccccaccgtggagaaggtgaagccggcgagggagaattcagagacagacctcgagatcgagggcgagcacggccacctaggggccgtgcgagccgcttcaccacaaaagcttgagaaatctggcttccaggagctcagctcccactcattccctgagtcagcgctgcgcatggcctgcggcgggaatgtggcggagagacccgcccgcttttgcttggaatcctcctcaggcttggctggtgagtcttcctgctctttcccccggctcagccccgcctccggcgccgtccccagcagacggctcgtgaaatcgggcattaatacccaaacacggtttagcaatctgctaaacgtgtcaacctggggtatcttatgtaacctctgtaattctccgaggtcctttcctaaaaaagggagcaccgaacgtgaacatctttag

SEQ ID NO: 201098 - DNA, 747 bp, Artificial Sequence
  Description of Artificial Sequence: Synthetic coding sequence
atgagcagcatcggcaccggctacgacctgagcgccagcaccttctcccccgacggacgcgtgtttcaagtggaatatgctatgaaagcagtagagaatagctctaccgccatcggcataagatgcaaggatggggttgtttttggggtggagaaactggtactgtctaagctgtatgaggagggctctaacaagaggctattcaacgttgaccggcatgtgggtatggcggtggccggactgctggcagacgcgcggtcattggcggacatcgcccgggaagaggcttcaaattttcgctccaactttggatataatattccgttgaagcatctggctgacagagttgccatgtacgtgcacgcatacacgctgtactccgcagtgaggcccttcggatgctcagtgaacgatggagctcagttatatatgatcgatcccagcggggtgtcatatgggtactggggctgcgccatagggaaagctaggcaggcagccaagacagagatcgagaagctacagatgaaagagatgacgtgtcgcgacatcgtgaaggaggtcgcaaaaatcatatatatcgttcatgatgaggtgaaagacaaagcgtttgagctcgagctgagctgggtcggtgagctgactaacggccgacacgaaattgtcccaaaggacatccgtgaagaagccgagaaatacgcaaaggaaagtctgaaggaggaggacgagtcggatgatgacaacatgtag

SEQ ID NO: 201099 - DNA, 786 bp, Artificial Sequence
  Description of Artificial Sequence: Synthetic coding sequence
atgagccggcggtacgacagccggaccaccatcttcagccccgaggggcgactgtaccaggtcgagtatgccatggaggcaatcggtcacgctggaacctgcctgggtattctggccaatgacggagtgctgctggccgcagagagaaggaacattcataagctgctcgacgaagtgttcttctcagaaaagatttataaactgaacgaagacatggcctgttcagtggccgggattaccagcgacgccaacgtgctcacgaatgaactcaggctgatcgcacagcggtatctgcttcagtatcaggaacccattccatgtgaacagctggtcactgccctgtgtgacattaagcaggcttacacccagttcggcggaaagcgaccattcggcgtctccctgttgtatatcggctgggacaagcattacggctttcaattgtaccagtctgatccaagtggcaactatgggggatggaaggctacctgcattgggaataacagcgcagcagccgtttccatgctgaaacaggattacaaggaaggcgaaatgacgttaaaaagtgccctggcactggccataaaagttctcaataaaaccatggacgtgtccaaactgtccgcggagaaggtggaaattgctacattgactcgggaaaacggaaagacagtgattcgtgtcctgaaacagaaggaggtcgagcagctgatcaagaagcatgaggaagaggaagctaaggccgagcgggaaaaaaaggagaaagagcagaaagaaaaggacaagtag

SEQ ID NO: 201100 - DNA, 573 bp, Artificial Sequence
  Description of Artificial Sequence: Synthetic coding sequence
atggcctgcagcgtggccggcatcaccagcgacgccaacgtgctgacgaacgagctgaggctgatagcccagaggtacctcctgcagtaccaggagccaattccctgcgagcagctggtgacagccctgtgcgacattaagcaggcctacacccaattcggcggcaagaggccatttggcgtgtctttgctctacattggttgggataagcattatggcttccagttataccagagtgacccaagcggcaattatgggggatggaaggcaacttgtataggaaataattccgccgccgcagtaagtatgctgaagcaggactataaagagggtgagatgaccctgaagtcggctctggcactggcaattaaagtattaaacaagaccatggatgtctccaagctgtccgcagagaaagttgagatagcaacgcttactcgggagaacggtaagactgtgataagagtcctaaaacagaaagaagtcgagcagttgattaaaaagcacgaggaagaagaggcaaaggccgaaagagagaaaaaggaaaaggagcagaaggaaaaggacaaatag

SEQ ID NO: 201101 - DNA, 786 bp, Artificial Sequence
  Description of Artificial Sequence: Synthetic coding sequence
atgagccggcggtacgacagccggaccaccatcttcagccccgagggcaggctatatcaggttgagtatgcgatggaagccatcggacatgccggaacctgtctcgggatcctggcgaatgacggagtcctgctggctgctgagagaaggaatatccacaaattactggacgaggtcttttttagtgagaaaatctataagcttaatgaggacatggcatgtagtgtggccgggatcactagtgacgctaacgttttgacgaatgaactccgactgatagcgcagagatacctgttacagtatcaggagccgattccctgtgagcagctagtgaccgccttatgcgacatcaaacaagcctacacacagtttggaggaaagagaccttttggggtctccctgctgtatattggatgggataagcattacgggttccaactctaccagtctgacccctcaggtaactatggaggatggaaagcgacttgtatcggaaacaactccgctgcggccgttagcatgctcaaacaggattataaggagggagaaatgacactgaaatccgcgctggctctggcgattaaagtgctcaataagaccatggatgtctccaaattgtcagccgaaaaggttgaaatagcaacactgaccagagagaacggtaagacagtcatccgcgtactcaaacagaaggaagtcgagcagttgatcaagaagcatgaggaagaggaggcgaaggcggagcgcgagaagaaggaaaaagaacaaaaggagaaggataagtag

SEQ ID NO: 201102 - DNA, 666 bp, Artificial Sequence
  Description of Artificial Sequence: Synthetic coding sequence
atgagccggcggtacgacagccggaccaccatcttcagccccgagggaaggctgtatcaggttgaatatgctatggaggctatcgggcatgctggtacctgcctcggaatcctagcgaatgacggagttcttttggccgccgaaaggagaaacatccacaagctcctcgatgaggtcttcttctctgaaaagatctataagctcaatgaggatatggcttgttcagtggcaggcatcacaagtgatgcaaacgtgctgaccaacgaattgaggttgatcgcccagaggtatttactgcagtatcaagagcccatcccatgtgagcagctggtgaccgctctttgtgatattaaacaagcttatacccagtttggggggaagcggccatttggggttagcctcctctacattgggtgggataaacactacggattccaactgtatcagtcagaccccagtggtaactatggcggatggaaagccacctgcattggtaataactccgccgcagccgtgtccatgctgaagcaggactacaaggagggcgagatgacattaaagtccgctcttgccttggccattaaggtcctgaacaagactatggacgtatctaaacttagcgctgagaaggtggagattgcgaccctcacaagggagaatggttag

SEQ ID NO: 201103 - DNA, 630 bp, Artificial Sequence
  Description of Artificial Sequence: Synthetic coding sequence
atgagccggcggtacgacagccggaccaccatcttcagccccgagggccgcctataccaagtcgagtatgccatggaagcaattggccatgctgggacatgcttagggatcctcgccaatgacggagtgctgcttgccgctgaacggcgtaacatccacaagctgttggacgaagtgttcttttcggaaaaaatctataagctgaacgaagacatggcttgtagtgtggccggaatcacaagcgatgccaatgtcctgaccaatgaattacgcctcatcgctcaacggtaccttttacagtaccaagagcctatcccttgtgagcagctggtgactgctctgtgtgacatcaagcaagcatacacccagtttgggggtaaacgtccttttggtgtctcattgctgtacatcggatgggataagcactacgggtttcagttataccagtctgatccaagcggcaactacggcggatggaaagccacctgtataggcaacaatagcgctgctgcagtcagtatgctgaagcaagactacaaagagggggaaatgaccttaaagtcagctctggccctagctatcaaagtcctcaacaagacaatggacgtttctaaactgagcgcagagtag

SEQ ID NO: 201104 - DNA, 693 bp, Artificial Sequence
  Description of Artificial Sequence: Synthetic coding sequence
atgagccggcggtacgacagccggaccaccatcttcagccccgaggccgaacgccgcaatattcacaaattactggatgaagtgtttttctcagagaagatttacaaacttaacgaagacatggcatgttcggtggccgggattacctcagatgccaacgttctgacaaatgagctaagattgattgctcagcggtatctgctgcagtatcaggaacccatcccatgcgagcaattggtaaccgccctgtgtgatattaagcaggcttatacacagtttggtggtaagcgcccgttcggtgtttcccttctctatatcgggtgggacaaacattatggcttccaattgtatcaatccgatcctagtgggaactacggaggctggaaagccacctgtatagggaataatagcgccgcagctgtgagtatgctaaagcaagactataaagaaggcgagatgacgttaaaatccgccctggccttggctatcaaggtgctgaacaagaccatggacgtgtcgaagttatcagccgagaaagtggaaatcgcaaccctaacgcgagagaacggcaagactgtcattcgggtcctaaagcagaaggaagtagagcagctgattaagaagcatgaggaggaggaagccaaggcagaacgggagaagaaggagaaagaacagaaagaaaaagacaaatag

SEQ ID NO: 201105 - DNA, 711 bp, Artificial Sequence
  Description of Artificial Sequence: Synthetic coding sequence
atgagccggcggtacgacagccggaccaccatcttcagccccgagggacggttatatcaagtggaatacgccatggaggctatcgggcacgccggcacatgcctcggcatcttggcaaacgatggagttttactcgctgcggaacggagaaacatccacaagcttctagacgaggtgttttttagtgagaagatttataagctgaacgaggacatggcttgtagcgttgccgggatcacctccgatgccaacgtcctgacaaacgagctccgcttgattgctcaacggtatttgctacagtatcaggaaccaatcccgtgcgaacaactagtgacagcgctgtgtgacataaaacaagcttatacgcaattcggcgggaagagaccatttggtgttagcctgttgtatattggctgggataagcattatggatttcaactgtatcagtctgatccctctggcaattacggcggctggaaggctacgtgcataggtaacaacagcgcagccgcagttagcatgcttaagcaggactacaaagaaggggaaatgacactgaagagcgccctggccctcgctatcaaagtgctgaacaaaactatggacgtaagcaagctcagcgccgaaaaggtcgagatcgctaccctgacacgcgaaaacggaaagaccgtgattcgagtgctcaagcaaaaggaggtggaacaactttag

SEQ ID NO: 201106 - DNA, 726 bp, Artificial Sequence
  Description of Artificial Sequence: Synthetic coding sequence
atgttcctgacccggagcgagtacgaccggggcgtgaacaccttcagccccgagggtcggctgttccaggtcgaatatgccatcgaagccattaagctggggagcaccgcgatcgggatacagaccagcgaaggagtgtgccttgccgtcgagaagcgtattacctcgcccctgatggaaccctcttcaatcgaaaagatcgtcgagatcgatgcccatatcgggtgtgcaatgagcggcctcatcgccgatgctaagaccctcatcgataaggccagagttgagacacaaaaccactggtttacatataacgagaccatgactgtggagtccgtgactcaggcagtcagcaatctggccctccagttcggcgaggaggacgctgatcctggcgccatgtcgcgcccgtttggggtggcactgctgttcggcggggtggacgagaaaggccctcagctttttcacatggatcccagcggcacctttgtccagtgcgatgccagagcaattggtagtgccagcgaaggagctcagtcctcacttcaggaagtataccacaaaagtatgaccctcaaagaggcaattaagtcctccttgatcattctaaagcaagtgatggaagagaaattgaatgcgactaacattgagctggctacagtgcagcccgggcagaatttccacatgttcactaaggaggagttggaagaggttatcaaggacatttag

SEQ ID NO: 201107 - DNA, 552 bp, Artificial Sequence
  Description of Artificial Sequence: Synthetic coding sequence
atggagcccagcagcatcgagaagatcgtggagatcgacgcccacataggatgtgccatgagcggactgatcgccgatgccaagacacttatcgacaaggccagagtcgagacacaaaatcactggttcacatataatgagacaatgacggttgagagcgtcacccaagctgtctcaaatctcgccttacagttcggcgaggaagacgctgaccccggggccatgagcaggccgttcggagtggccctgctgttcggaggggtggatgaaaaggggcctcaactgttccatatggatccgagtggtacgtttgtgcagtgtgacgcccgcgcgattggttccgccagcgaaggcgctcagagcagtctgcaagaggtctatcataaaagcatgacactaaaggaagccattaagagctctcttatcatcctaaaacaggtcatggaagagaagctgaacgctactaacatcgagctggcgaccgtgcagccaggccagaattttcatatgttcaccaaagaggagttagaggaggtgataaaggacatctag

SEQ ID NO: 201108 - DNA, 741 bp, Artificial Sequence
  Description of Artificial Sequence: Synthetic coding sequence
atgagccggggcagcagcgccggcttcgaccggcacatcaccatcttttcacccgaggggcgtttatatcaagtggaatacgccttcaaagcaatcaatcaggggggcctcacctcagtagctgtgagaggaaaggattgcgccgttatagttacacagaagaaagtacctgacaaactgcttgatagctcaacagtgacacatctttttaaaatcactgagaatattggctgcgtgatgactggtatgacggccgattcacgcagtcaggtccaaagggcgcgatatgaagccgcaaattggaagtataaatatggctacgagattccagtggatatgttatgcaagcgaattgccgacatcagccaagtgtacacccaaaatgccgagatgcgcccactgggctgctgtatgattctgataggaatcgatgaagaacaaggcccacaggtgtacaaatgcgatcccgctggctactattgtggattcaaagcgactgcagcaggagtgaagcagaccgaaagcactagcttcttagaaaaaaaagttaagaaaaagttcgattggacttttgaacagacggtggaaactgctatcacttgcctgagcaccgttctcagtatagactttaaaccaagcgaaattgaggttggggtggtcacagtggagaacccgaagtttcggattctcaccgaagccgagatcgatgcacatttggtggctctcgcggagagagattag

SEQ ID NO: 201109 - DNA, 684 bp, Artificial Sequence
  Description of Artificial Sequence: Synthetic coding sequence
atggccggcctgcggcgggagtacgccttcaaggccatcaaccagggcggtctcaccagtgtggccgtgagaggcaaggactgtgcggtgatcgtgacacaaaagaaggtccctgataaactactggatagtagcactgtcacacatctgtttaagatcacggagaatattggctgcgtgatgaccggcatgacagccgacagccgtagccaagtgcagcgcgctaggtatgaggcagcaaactggaagtataagtatggctatgagattccagttgatatgttatgcaagagaattgctgacatctcccaggtttacacacaaaacgccgagatgcggcctttggggtgttgcatgatcctgatcggcatagacgaagaacagggcccccaggtatacaaatgcgaccccgctggctattactgcggcttcaaggctactgcggcaggcgtaaaacagactgagagcacttcatttctggagaaaaaagtcaagaagaaattcgattggactttcgagcagacggtggagacagcaatcacgtgcctctccacagtgctgagcatcgacttcaagcctagtgagattgaggtgggtgtcgttaccgtcgagaaccccaaattccgtatcctcaccgaggccgagatcgatgcacatcttgttgccctggctgaacgggactag

SEQ ID NO: 201110 - DNA, 759 bp, Artificial Sequence
  Description of Artificial Sequence: Synthetic coding sequence
atgagccggggcagcagcgccggcttcgaccggcacatcaccatcttttcaccagaaggcaggctgtaccaggtcgagtatgctttcaaagccatcaatcaaggaggcttgacttctgtggcagtgagagggaaggattgcgccgtgatcgtcacacagaagaaagtgcccgacaagctcctggattcttccacggtgacacacctttttaagattaccgagaatatcggttgtgtgatgaccggcatgacagccgactccagaagccaggttcagcgcgcccgctatgaagcagctaattggaagtacaagtatggctacgaaatcccagtggacatgctctgcaagaggatcgctgatatctcccaggtatacacccaaaacgcagagatgagaccactgggatgctggtcgttcctgtttctggggatgattctcataggaattgatgaggaacaaggaccccaggtgtacaagtgtgatccagccggctattattgtggtttcaaggcaactgccgccggagtgaagcagaccgagagtacgagtttcctggagaaaaaagtgaagaagaaattcgactggacctttgagcagacagtcgaaacagctatcacctgtctgtccacggttctgagtatcgatttcaaaccgagtgagatcgaggtgggcgtcgtcacagtggagaatcctaaatttcgaattttgaccgaggctgaaatagatgcacatttggtggcccttgctgaacgcgattag

SEQ ID NO: 201111 - DNA, 324 bp, Artificial Sequence
  Description of Artificial Sequence: Synthetic coding sequence
atgagccggggcagcagcgccggcttcgaccggcacatcaccatctttagtcccgaagggcgactctatcaggtggaatacgcctttaaagccatcaatcagggcgggctaacttctgtggctgtgaggggaaaagactgcgctgtaatagtgacgcagaagaaagtcccagataaactcttagatagctccactgttactcacctcttcaagatcacagaaaatatcggctgtgtgatgactggtatgacagtgtccctttgtcgaccaggatgcagtgccagctgggtgcaggccatcttggtgcctcagccccccaggtag

SEQ ID NO: 201112 - DNA, 447 bp, Artificial Sequence
  Description of Artificial Sequence: Synthetic coding sequence
atgagccggggcagcagcgccggcttcgaccggcacatcaccatcttctcacctgagggccgactttatcaagtggagtatgcttttaaggctatcaaccaaggcggtcttacctctgtggccgtgcgtggcaaggactgtgctgtcatcgtgacccaaaaaaaagttcccgacaagttgctggactcaagtacggtgacccacctgttcaaaatcactgaaaacattggttgtgtcatgactggaatgaccgccgatagtaggtctcaggttcagagggctcggtatgaagcagccaactggaaatataagtacgggtacgagatccctgtggacatgctctgcaagcggatagctgatatctcgcaggtttatacccagaacgccgaaatgcgacctcttggctgttactgcaactacatgccagtctactgctccataaactag

SEQ ID NO: 201113 - DNA, 504 bp, Artificial Sequence
  Description of Artificial Sequence: Synthetic coding sequence
atgaccggcatgaccgccgacagccggagccaggtgcagcgggccagatacgaagcggccaattggaagtacaagtacggttatgaaattccagttgacatgctgtgcaaacggattgctgatatcagtcaagtctacacacagaacgcagagatgagaccccttggttgttgcatgattctgattggaattgatgaggagcaaggcccccaggtgtacaaatgcgatcctgcaggctattattgcgggtttaaggccactgccgccggcgtgaagcaaacggagtccacctccttcctcgaaaaaaaggtgaagaagaagtttgattggacttttgagcagaccgttgaaacagctatcacttgtctgtctactgtgctgtcgattgattttaagccttccgagatagaagtcggcgttgttacagttgagaaccccaaattccgtattctcactgaggctgaaatcgacgctcatctagtggccctggcagaaagagactag

SEQ ID NO: 201114 - DNA, 612 bp, Artificial Sequence
  Description of Artificial Sequence: Synthetic coding sequence
atgagccggggcagcagcgccggcttcgaccggcacatcaccatctttagccccgaaggtaggctttaccaggtcgaatatgccttcaaggctatcaatcagggcggcctgacaagcgtggcggtaaggggcaaggactgcgccgtaatcgtaacacagaaaaaggtccctgacaaactgttagatagttctaccgtgactcatctgttcaaaatcactgaaaatatcggctgcgtcatgacagggatgacggcagatagccggagccaggtgcaaagagccagatatgaggcagcgaattggaaatacaagtacggatacgagatccctgtcgacatgttgtgcaagagaattgcggacatcagccaggtctatacccagaatgcagaaatgcgccccctcggctgctgtatgatcctgattggcatcgatgaagaacagggaccccaggtatacaagtgtgatccagccgggtactattgcggattcaaggccacagcggcaggggtgaagcagactgaaagcacgagcttcctggagaagaaggtaaaaaagaagttcgactggacatttgagcagactgtggaagattcctatagatctagagattag

SEQ ID NO: 201115 - DNA, 450 bp, Artificial Sequence
  Description of Artificial Sequence: Synthetic coding sequence
atgagctacgaccgggccatcaccgtgttcagccccgacggccacctctttcaggttgaatacgcacaggaggccgttaagaaagggagcactgcggtaggtgtgcgcggacgggacatcgtggtcctgggcgtcgagaaaaaatcagttgcaaagttacaggacgagcggaccgtgaggaagatctgcgcgctcgacgataatgtttgtatggccttcgcaggcctgactgccgatgcacgcattgtgatcaatagagccagggtggaatgtcagtctcacaggttgactgtcgaggaccctgtgaccgtcgagtacattacccgctatattgcctcactaaagcaagttggagcatgccctctggcgtgttccccactggcagctgggcaaagtcgcctccgacacggagggagttgccacgtgacaagcggagaatcagaaaattag

SEQ ID NO: 201116 - DNA, 537 bp, Artificial Sequence
  Description of Artificial Sequence: Synthetic coding sequence
atggccttcgccggcctgaccgccgacgcccggatcgtgatcaacagagctcgggtggagtgtcagagccatagactaaccgtagaggacccagtgacagttgagtacattacaagatacatcgctagtctgaaacaaagatacacacagtcgaacggacgccgccccttcggaatttcggccctcatcgtgggcttcgattttgacggcactccgcgtctttaccaaactgacccctccggcacctatcatgcctggaaagcgaacgctatcggccgcggcgccaagtccgtgcgcgaatttctggagaaaaactacacggacgaagctattgagacagacgatctaactattaagttggtcatcaaggcactcctggaggtggttcagtctggtgggaagaatatcgagctggccgtgatgcgaagggatcagtcactcaaaatcttaaaccctgaagaaattgagaagtatgtggccgagatcgaaaaagaaaaagaagagaacgagaaaaaaaagcagaaaaaggcgtcatag

SEQ ID NO: 201117 - DNA, 747 bp, Artificial Sequence
  Description of Artificial Sequence: Synthetic coding sequence
atgagctacgaccgggccatcaccgtgttcagccccgacggccacctttttcaggttgagtatgcccaggaggcggttaagaaaggtagtaccgccgttggggtgagaggtcgggacattgtcgtcctcggcgtcgaaaaaaagagcgtcgccaaactgcaggatgagaggacggttcggaaaatttgcgccctagatgacaacgtgtgtatggcattcgccggcctcactgccgacgcacgcattgtcattaatcgggcacgtgtggagtgtcaaagccaccgcttaacggtagaagatcccgtcacagtggaatacatcacccgatatatagcgagccttaaacaaaggtacacccagtctaacgggaggcgcccatttggcattagtgctctgatagtgggctttgacttcgatggcacaccccgcctgtaccaaaccgatcccagcggaacctatcacgcctggaaagccaatgcaatcggccggggggcaaaatccgtcagagagtttttagagaaaaattacactgatgaggctattgagaccgatgacctcaccattaagctggttatcaaggctcttctggaggtggtgcaatccggcggaaagaatatcgagcttgcggtgatgaggcgtgatcagagtctcaagattctaaatcccgaggaaattgagaaatatgtagccgaaattgagaaagagaaagaggaaaatgagaagaagaagcagaagaaggcctcttag

SEQ ID NO: 201118 - DNA, 564 bp, Artificial Sequence
  Description of Artificial Sequence: Synthetic coding sequence
tgactgaccgccgacgcccggatcgtgatcaaccgggcccgggtggaatgccagtcccatcgtctgactgtagaagatcccgttactgtcgaatacataaccaggtacatagctagtctcaaacagaggtacacacagtcaaacggccgacggccctttggcatttctgctctgattgtgggtttcgatttcgatggtacacccagactgtatcagactgatccttcaggcacttaccacgcatggaaagcaaatgctatcgggaggggcgccaagtctgtgcgtgaatttttggaaaagaactatactgatgaagcaatagaaactgacgaccttacaatcaagctggtcattaaagctttgcttgagggaaaggtggtcaatgcccccgtgttttgcccatttaaggtcgttcagagcggcgggaagaatatagagctcgctgtcatgcgaagagaccagagcctcaagatactgaatccagaggaaatagaaaagtacgtggccgaaattgagaaggaaaaagaagagaacgagaaaaagaagcagaagaaggcaagctag

SEQ ID NO: 201119 - DNA, 726 bp, Artificial Sequence
  Description of Artificial Sequence: Synthetic coding sequence
atgctgagcagcaccgccatgtacagcgcccccggccgggacctgggcatggaaccccacagggcagccggtcccctgcagctcagattctcaccctacgtctttaatggaggcaccattctggcgatcgctggcgaggacttcgcgatcgtcgcatccgacaccagattaagcgagggcttctccattcacacacgcgattcccctaaatgctacaagctcacagataagacagtaatcgggtgctccggctttcacggcgactgcttgaccctgaccaagatcattgaagcccgcctcaaaatgtacaagcattccaacaataaggccatgaccaccggtgccattgctgcaatgctctccaccattctgtattcaaggaggttttttccatactacgtgtacaatatcatagggggacttgatgaggaaggtaaaggcgcagtctactccttcgaccctgtcggttcatatcagagagactctttcaaggccggtggttctgcatctgccatgctgcagccgctgctagacaaccaggtcggattcaaaaacatgcagaacgtggaacacgtgcccctgtctttggaccgggcgatgcgcctagtcaaggatgtcttcatctcagcagctgaaagagacgtttacaccggcgatgctctccgcatatgcatcgtgacgaaggagggcattcgggaggagaccgtaagcctgcgcaaagattag

SEQ ID NO: 201120 - DNA, 591 bp, Artificial Sequence
  Description of Artificial Sequence: Synthetic coding sequence
cggcggagccgggccatgctgagcagcaccgccatgtacagcgccccgggtcgcgacctaggtatggaaccgcacagggccgccggcccgctccagctgagattcagtccctacgttttcaacggtggaacaatactcgcgattgcgggcgaggattttgcaatcgtcgcttcagataccaggttgagcgaggggttttccattcatacacgggattcacctaagtgttataaactaactgacaaaaccgtgatcggctgttccggttttcacggagactgcctcacgctgacaaagatcattgaggctagactgaaaatgtacaagcatagcaataataaggcgatgactactggtgccattgctgccatgttgtctacaattctttatagccggagattcttcccatactacgtgtacaatattatcgggggcctggatgaggagggaaaaggagctgtctattcctttgaccccgtggggagctatcagcgagatagctttaaagcagggggatccgcttcagcaatgttgcagcctctgctggataatcagtacatttcctcgaactcagtttccttatgcgtttag

SEQ ID NO: 201121 - DNA, 822 bp, Artificial Sequence
  Description of Artificial Sequence: Synthetic coding sequence
atgctgaagcccgccctggagccccggggcggcttcagcttcgagaactgccagcgcaatgcgtcgctggagcgagtgctgcctggccttaaggtgccccacgctcgcaagaccggaaccaccattgctggtctagtttttcaggatggggtgattctcggagcggataccagggctacaaacgacagcgtcgtagccgataagtcttgcgaaaagatccattttatcgcccccaaaatctattgttgtggggcgggtgtggctgctgacgcagaaatgacgaccaggatggtggcgagcaagatggagttgcatgctctttcgaccgggcgcgagccaagagttgcaaccgttacaaggattctccgccagactttatttcgttatcagggtcatgtgggggcttcccttatcgtcggaggcgttgatctcacaggccctcaactctacggggtacaccctcatggctcatattctaggttacccttcacagctcttggaagtgggcaggatgcagctctggcagtgctggaggatcgttttcagccaaatatgacactcgaagccgcgcaaggactgctggtggaggccgtgaccgcaggaatccttggggatctggggtctggaggcaatgtggatgcatgcgtgattaccaaaacaggggcaaaactcctgcgcactttgtcttctccaacggagcctgtgaagcggagtggaaggtaccactttgtccctggaaccaccgcggttctcactcaaacggtcaagccactgaccctcgagttggtagaagaaacagtgcaagctatggaggtcgagtag

SEQ ID NO: 201122 - DNA, 903 bp, Artificial Sequence
  Description of Artificial Sequence: Synthetic coding sequence
atggccctgcaggacgtgtgcaagtggcagagccccgacacccagggaccaagtccgcatttgccccgcgccggaggatgggctgtgcctaggggttgtgatccgcagacttttctacagattcatggcccacggttagcccatgggacaacaaccctcgctttccggtttcgccacggagtgattgccgcggctgacacccggagcagctgtggcagctatgtggcatgccccgccagctgtaaggtgattccagtacaccagcacttgcttgggaccacatctggcacgtctgctgactgtgccacctggtatcgtgtgctgcaacgcgagctgcgacttcgggaactacgcgaagggcagctcccaagcgtggcttctgcagccaagctgctgtcagccatgatgtcccagtaccggggcctggatctgtgcgttgcgaccgccctgtgcggctgggatagatctgggcccgagctgttttatgtgtattctgatgggacaagattgcagggggatatcttcagcgttggctccggctctccctacgcgtacggagtgctggaccgtggctatagatatgatatgtccacacaagaggcctatgcccttgcccgctgcgcagtcgcccatgcaacacacagagacgcatacagcggcgggagcgtcgatctattccacgtgagagaatcaggatgggaacacgtgtccagatctgacgcttgcgtcctgtatgtcgagctgcagaagctgctggagcccgagcccgaggaggacgcaagccacgctcaccctgaacctgctacggctcaccgagccgccgaggaccgggagctatcggtgggtcctggcgaagtgactccgggtgacagcagaatgccagcaggcacagagacagtgtag

SEQ ID NO: 201123 - DNA, 606 bp, Artificial Sequence
  Description of Artificial Sequence: Synthetic coding sequence
atggagtacctgatcggcatccagggccccgactacgtgctggtggcaagcgatagagttgctgctagtaacatcgtccagatgaaagacgatcatgataagatgtttaagatgtcagaaaaaatacttctgctttgtgtgggagaagctggggacactgtgcagtttgcggagtacatccagaagaacgtgcaactatacaaaatgcgtaatggctatgagctcagtcccaccgctgcggccaactttaccaggcgtaacctggccgactgtctgaggagccgcacgccataccacgtaaatttattgttagcagggtatgatgagcatgaggggcctgcactgtactatatggattatctcgccgccctggcgaaggcccccttcgcggctcatggctatggcgcctttctcactcttagcattctagaccgctattacaccccaacgatcagcagagagcgagccgttgagctcctgcgcaagtgcttagaagagcttcagaaacgatttatcctgaacctccccacattttccgtgcgcatcatagataaaaatgggatccacgacctagataatattagcttcccaaaacaagggagttag

SEQ ID NO: 201124 - DNA, 468 bp, Artificial Sequence
  Description of Artificial Sequence: Synthetic coding sequence
atggccagcctgaagtgcagcaccgtggtgtgcgtgatctgcctggagaaacccaaataccgctgccctgcctgcagggtgccttattgttctgtggtctgtttccggaagcacaaagagcagtgcaacccggagacccggcccgtggagaagaaaatacgatcggctttgcctacaaagacagtgaaacccgtggagaacaaggacgatgatgactcaatcgcagacttcctgaatagtgacgaggaggaggatagggtgtcgttgcagaacctgaaaaatctgggtgagagtgcgacactgcgctcccttttgctgaatccgcatctgcgccagctgatggtcaatttggaccaaggagaagacaaggcgaaactgatgagggcatatatgcaggagccactttttgtcgaattcgctgattgttgtctcggcattgtagagccaagccaaaacgaagagtcctag

SEQ ID NO: 201125 - DNA, 795 bp, Artificial Sequence
  Description of Artificial Sequence: Synthetic coding sequence
atggaggccttcctgggcagccggagcggcctgtgggccggcggccccgcccccggacagttctatagaattccatccacacctgactcatttatggacccggcctccgccctgtatcgcggccctatcacaaggacacagaacccaatggttacgggcacatccgtcctcggcgtgaagttcgaggggggggtggtgattgccgcagacatgcttggctcctacgggagtctggcccgattcagaaacatctctagaattatgcgagtcaataattccacaatgctgggcgcttctggggattatgccgatttccagtatttgaagcaggttttgggacagatggtgatcgatgaggagctattgggcgacgggcacagttactcaccccgagcgatccattcttggctgacccgagctatgtactcaaggagatcaaagatgaaccccctgtggaatacgatggtcataggagggtatgccgatggcgagagttttctaggctacgttgatatgctgggagtcgcttacgaggctccctctctggccaccgggtacggggcttatctcgcgcagcccttgctccgcgaggtgttagagaaacagcccgtgctgtcacagaccgaagctcgggacctggtcgagcgctgtatgcgggtactgtattatagggacgcaaggagttataataggttccagatcgccacggtcactgaaaagggtgtagagatagagggccccctgagcactgagacaaattgggacatcgctcacatgatctccggtttcgagtag

SEQ ID NO: 201126 - DNA, 792 bp, Artificial Sequence
  Description of Artificial Sequence: Synthetic coding sequence
atggccctggccagcgtgctggagcggcccctgcccgtgaaccagaggggattttttgggctcggcggccgcgccgaccttctagacctgggccccggcagcctgagtgatgggctcagcttagccgcccctggatggggcgttcccgaggagcctgggatagagatgctgcacggtacaactaccctcgcctttaaatttagacacggggtgattgtggccgctgattcaagagcgactgcgggcgcctatatagcctcccagaccgtgaaaaaggttatagagatcaacccgtatctgcttggaactatggcaggcggagccgccgactgctcattctgggaaaggttgctcgctcgacaatgtagaatatacgaactcagaaacaaagagaggattagcgtggcagccgcctctaagctactggcgaatatggtctatcagtataagggcatggggttgagcatggggacaatgatctgtggctgggataagaggggtccagggctctattacgtggattcagaaggaaaccgcatctccggcgcaactttttctgtcggatccggttccgtatatgcttatggggtcatggatagaggctattcatacgacctggaggtggaacaggcttatgacctggctcgaagggccatataccaagcgacatatcgcgacgcttatagtggtggagctgtaaacctgtaccacgtgagggaagatggatggattcgcgtcagctctgacaatgttgctgacttgcacgaaaaatattctggctcgacaccgtag

SEQ ID NO: 201127 - DNA, 483 bp, Artificial Sequence
  Description of Artificial Sequence: Synthetic coding sequence
atggccggcggcgccgccgactgcagcttctgggagcggctgctggctcgccagtgtagaatctatgaattacggaacaaagaacggatttcggtcgccgctgccagcaaactattggccaacatggtttaccagtataagggcatgggactctctatgggaactatgatttgcggatgggataaacgaggaccaggactctactatgtagacagcgagggaaaccgtatcagcggagccacattctccgtggggagcgggtccgtgtacgcatacggagttatggaccgcgggtactcatacgatttagaggtggagcaggcatacgatctcgcaaggcgagcgatctaccaggcgacttaccgcgatgcgtactctggtggcgccgtgaatctctatcacgtaagggaggacggctggatacgtgtttcctccgacaatgttgcagacctgcatgagaagtactcgggctccaccccatag

SEQ ID NO: 201128 - DNA, 612 bp, Artificial Sequence
  Description of Artificial Sequence: Synthetic coding sequence
atggccctggccagcgtgctggagcggcccctgcccgtgaaccagcgagggtttttcgggctgggaggtagagctgatttgctcgacttgggccctggctctctgtcggacggcctctcactggctgcccccggctggggcgtccccgaggagccgggtatcgagatgctgcacgggaccacaactctcgcctttaaatttagacatggtgttatcgtggctgcggactctagggcaactgccggagcctacattgccagccagacggtgaagaaggtcatcgaaatcaatccatatctactgggaacaatggccggtggtgccgcggactgcagcttctgggagcgactgctagctcgccaatgccgcatctacgagttgcggaataaggaacgtatttccgtggctgctgctagtaagctgctggcgaatatggtgtatcaatacaaaggaatgggcctgtctatgggcacaatgatctgcggctgggataagcgcgggcccgtgtcagaggtactttgccttaagcccaagtcgttcggaatgtatctattctgcggttgcgctgagaggatcggaaacatggcacggccactgcttaggggccagtag

SEQ ID NO: 201129 - DNA, 834 bp, Artificial Sequence
  Description of Artificial Sequence: Synthetic coding sequence
atggccgccgtgagcgtgtacgccccccccgtgggcggcttcagctttgacaactgtagacggaacgccgtgctggaggcagacttcgctaaaagaggatacaagttgccgaaggtccgaaaaaccggtacaaccattgcgggggtcgtatataaggacggcattgtactcggcgcagacacaagggccactgaagggatggttgtagcagataagaattgctccaagattcactttatatcacccaatatttattgctgtggtgccggtactgccgcggacactgacatgacaacccagctgatctcatcaaatctggaactccactcgttgagtacagggagactgcctcgcgtcgtcacagccaatagaatgcttaagcagatgctcttcagatatcaagggtacataggagccgccttagtgctgggcggcgttgacgtgacaggacctcacctgtacagtatttatccgcatgggtctaccgataaactgccctatgttactatgggctctgggagcttagccgctatggccgtgttcgaggacaagttccgtcccgacatggaagaggaagaggccaaaaacttagtgtccgaggccatcgccgccgggattttcaacgatctgggatcaggttctaatatcgacctctgtgttataagcaagaataagttagactttctgaggccctacaccgtgccaaataagaaggggacacgcctgggcaggtaccgctgcgaaaagggcactactgcagtgctgacagagaaaatcacgccgctggagattgaggtcctcgaagagacagtacaaaccatggacactagctag

SEQ ID NO: 201130 - DNA, 633 bp, Artificial Sequence
  Description of Artificial Sequence: Synthetic coding sequence
atggccgccgtgagcgtgtacgccccccccgtgggcggcttcagctttgacaattgtcgccgaaacgctgtgcttgaggctgatttcgccaagcggggctacaaactcccgaaagtcaggaaaactggcaccactatagccggggttgtgtataaagacggtatagtcttaggggcagatactcgcgccactgaagggatggtcgtcgctgacaaaaactgttctaagatccattttatcagtcccaatatctactgctgtggcgctggtaccgccgcagatactgacatgactacacaactaatttcctctaatttggagctccacagcctcagtaccggtaggctgccccgggtcgtgactgcaaataggatgcttaaacaaatgctgttccggtatcagggatatattggtgccgccctagtgttaggcggagtcgacgtgaccgggccacacctgtatagcatttatccccatgggtctacggacaagttgccctatgttaccatggtgcactgtgaagaagaactctttactgagaacctgttcttcattcggcaggctgaagtggtgagcgaagaagcctggggccccagcttcgctatatccttagctgtctttctggtggcctag

SEQ ID NO: 201131 - DNA, 429 bp, Artificial Sequence
  Description of Artificial Sequence: Synthetic coding sequence
atggccgccgtgagcgtgtacgccccccccgtgggcggcttcagcttcgataactgcaggcgcaacgctgtgctggaagcggactttgccaagcgcggatacaaactgccaaaagtgagaaagactggcactaccatagctggtgtagtgtataaggacggcattgtattaggcgccgacacccgggcgacagagggtatggttgtggcggacaaaaactgttccaagatccatttcatctcgccaaacatctattgctgcggagccggcactgcagccgacacagatatgactacacagctgatctcttcaaatctcgaattgcattctttaagcacgggccggctaccccgggtcgtgaccgccaatcgtatgctgaaacagatgctgtttagattttggctgctcgggagcaatggctgtatctag

SEQ ID NO: 201132 - DNA, 819 bp, Artificial Sequence
  Description of Artificial Sequence: Synthetic coding sequence
atgctgatcggcacccccaccccccgggacaccacccccagcagctggctgacctctagcctgttggtggaagcagctcctcttgacgataccactttacctacgccagtctctagcggatgtccaggactcgaaccaacggagttctttcagtcattgggtggcgatggggagaggaacgtccagatcgagatggcccacggcaccaccactttggcctttaaattccaacacggcgtcatcgcagctgtggatagtcgagcttccgctgggagctatatatcagcattgcgggtaaataaggtgatcgagattaatccttacctgctgggcaccatgtccgggtgcgccgctgattgccaatactgggaaagactactcgcaaaggagtgtaggctttactatctccggaacggcgaaaggatatcagtcagtgcagcctctaagctgcttagcaatatgatgtgccagtaccgcggcatgggattgagtatgggaagtatgatttgcgggtgggacaagaagggcccggggttgtactatgtggacgagcatgggacccgcctcagcgggaatatgttttcgaccggatctggtaatacatacgcctacggagttatggattcggggtacagaccaaatttatctccagaagaagcctatgacttgggtagacgcgcaatagcttacgctacccatcgcgactcctattcggggggtgtggttaacatgtaccacatgaaggaggatggatgggtgaaagtggaatccacagacgtctcagacttactgcatcagtaccgagaagccaaccaatag

SEQ ID NO: 201133 - DNA, 831 bp, Artificial Sequence
  Description of Artificial Sequence: Synthetic coding sequence
atggccctgctggacgtgtgcggcgccccccggggccagcggcccgaatcagctctgcccgtggcaggatctggtcgaagatcggatccgggtcactacagcttttctatgagaagcccagagctcgctctgccccgcggcatgcagccaacagaattcttccagtctctgggcggagacggagagcgtaatgttcagatagaaatggcacatgggaccaccacactggctttcaagtttcagcacggcgtgattgccgccgtggatagtagagcatctgccgggtcttatatcagtgcactgagagtgaacaaagttatcgaaatcaatccttacctcctggggacgatgagcgggtgcgccgcagactgtcagtattgggagaggctgttggccaaggaatgccggctgtactacctgaggaatggggagcgaatttctgtatccgccgcgagtaaactgctgagtaacatgatgtgccagtataggggcatgggcttaagtatgggtagcatgatctgcggatgggacaagaaaggtcctggcctgtactacgtcgacgaacatggaaccagactcagcgggaacatgtttagtaccggctccgggaacacctacgcttacggggtgatggactccggataccgaccaaacctctcgcctgaggaagcctatgatctggggcgacgggccatcgcttacgccacccatcgcgatagctatagcggcggagtggtcaatatgtatcacatgaaggaagatggctgggttaaagtggaaagtacagacgtatcagatctgctccatcagtatagagaggcaaatcaatag

SEQ ID NO: 201134 - DNA, 831 bp, Artificial Sequence
  Description of Artificial Sequence: Synthetic coding sequence
atggccctgctggacgtgtgcggcgccccccggggccagcggcccgagtccgccctccctgtggcgggatccggtcgccggagcgaccccggtcattactccttttctatgaggtcccccgagctggcactaccccggggcatgcagcctacggagttctttcagagtctgggaggcgatggtgagagaaatgttcaaattgagatggcccatgggacaacaacgttggcatttaaattccagcacggcgtgatcgcagccgtggattcccgggcttccgctggtagttacatctcagccctgcgggtgaataaagttattgagatcaacccgtacctgctcggcacgatgtcaggttgcgctgctgactgccagtactgggaaaggctactggccaaggagtgccggctatactacttgaggaacggagagcgcatctcagtcagtgccgcatccaagcttctgtccaacatgatgtgccagtatagaggtatgggcttgtccatggggagcatgatctgcggttgggataagaaaggacctggcctgtactacgtagacgagcatggcacacgactgtcgggaaacatgtttagtactgggtcaggcaatacctacgcctacggcgtcatggactcgggttacaggccaaatctttccccggaggaagcgtacgacttggggcgaagagccatcgcctacgcaacccacagagatagttactcaggaggggtcgtgaacatgtaccatatgaaagaggacgggtgggtgaaagtagagagtacggatgtgagcgatctgctgcaccagtacagggaagccaatcaatag

SEQ ID NO: 201135 - DNA, 819 bp, Artificial Sequence
  Description of Artificial Sequence: Synthetic coding sequence
atgctgatcggcacccccaccccccgggacaccacccccagcagctggctgaccagtagtctgcttgtggaggctgccccacttgatgacaccacgctccccactccagtgagctctggatgtccggggctggaaccaactgaattctttcagagtctgggtggtgacggcgaacggaatgttcagattgaaatggcacacggtaccaccacattagcttttaaattccagcatggcgttatcgctgctgtcgactctcgggcttctgctggcagttatatatcggctttacgggtgaataaagtgatagaaattaacccttatctcctgggcactatgagtgggtgcgccgccgactgtcagtattgggagcgtctgctagcaaaggaatgtcggctatactacttacggaatggggagaggatcagcgtatccgcggcttcaaaactgctaagtaacatgatgtgtcagtataggggcatgggactgtcaatgggatccatgatctgtgggtgggataaaaaagggccaggcctgtattatgtcgacgaacatggaacccgcctcagcgggaatatgttttccacaggtagtgggaacacatacgcttatggagtgatggatagtgggtaccgccctaatctgagcccagaggaagcgtacgatttagggcgccgggcaatcgcatacgctacacacagagattcatattccggcggagttgtgaacatgtaccatatgaaagaggatggatgggtgaaggtggagtccactgatgtttccgatctgctccaccagtacagggaggctaaccaatag

SEQ ID NO: 201136 - DNA, 759 bp, Artificial Sequence
  Description of Artificial Sequence: Synthetic coding sequence
atggccctgctggacgtgtgcggcgccccccggggccagcggcccgaatcagctctcccagtcgccgggtcaggacgtcgttctgatccggggcattacagtttcagtatgcgcagccccgagctggccctccccaggggtatgcaaccgaccgaatttttccagtcccttggcggcgatggagaaagaaacgtgcagatcgagatggctcatggcactacgaccctggcctttaagttccagcacggagttattgcggctgtcgattctcgagctagcgcaggcagttacatcaactgccagtactgggaaagacttctggcaaaagaatgcaggctgtattacctcaggaacggcgagaggatctccgtttcagccgcatcaaaactgctgagcaacatgatgtgccaatatcggggtatgggtctatctatgggcagcatgatttgcggctgggacaaaaaaggaccagggctatactatgtagatgagcacggaacaaggctgtctggaaacatgttcagcaccggctccggaaacacctacgcttatggagtgatggactcagggtaccggccaaacttaagtccagaggaagcctatgatctcgggcgcagagcaatcgcctacgccacccatcgagactcatacagcggcggggtggtgaacatgtaccatatgaaggaggacggatgggtgaaagttgagagtacggatgtgtccgacctcctgcaccaatacagggaagcaaaccagtag

SEQ ID NO: 201137 - DNA, 759 bp, Artificial Sequence
  Description of Artificial Sequence: Synthetic coding sequence
atggccctgctggacgtgtgcggcgccccccggggccagcggcccgaatccgcacttccggttgcgggtagcggtaggcggtctgatccagggcactattcattttccatgaggtctccggaactcgcacttccgagagggatgcaaccaacagagttttttcaatctctgggaggggatggcgagagaaacgtacaaattgaaatggcccacggcaccaccactctggcattcaagttccagcatggggtgatcgccgccgtggacagtcgcgcttctgctggcagctacatcaattgtcagtactgggagcggctgctggctaaggaatgtcgcttatattatcttaggaatggggaacggattagtgtgagtgcggctagtaagttgttgagtaacatgatgtgtcaatatcgcggcatgggactgagcatggggtccatgatttgcggatgggataaaaaaggtcccggcttgtattacgtggatgaacacggaaccaggctgtccggcaatatgttctcaacaggtagcgggaatacctacgcttacggagtcatggactctgggtatagaccaaacctcagcccagaagaggcgtacgacctcggtcgccgcgcaatcgcatacgctacccacagagactcttactccggcggagtcgtgaatatgtaccacatgaaggaggacggatgggtaaaagttgaaagtaccgatgtgtcagatctgctgcaccagtacagagaagccaaccagtag

SEQ ID NO: 201138 - DNA, 819 bp, Artificial Sequence
  Description of Artificial Sequence: Synthetic coding sequence
atgctgatcggcacccccaccccccgggacaccacccccagcagctggctcactagcagcttactggtcgaagccgccccactagacgacacaacgttgccgactcccgtttcgagtggatgccccggtctagagccaaccgaattcttccagtcactcggcggagacggagagagaaacgtgcagatagaaatggcacacggaacaacaactctcgcctttaagttccagcacggagtaatcgccgcggtggactcacgagcctctgccggttcctacatttcagcactcagagtgaacaaggtcatagagattaatccatacctccttgggaccatgtctggctgtgccgcagactgccagtactgggaacgcttgctcgctaaggagtgcaggctttattacctcagaaatggggaaaggatctcggtgtcagcagcatctaagctgctcagcaatatgatgtgccagtacagaggcatgggacttagcatggggtctatgatttgcggctgggataaaaagggccccggcctgtactatgttgacgagcacggcacgaggctgtcaggtaatatgttctctacgggctctggcaacacctacgcttacggggtgatggatagcggttatcgtcctaatttaagtccagaggaggcctacgacctgggtcgcagagctatcgcttatgcaacacatagggatagctattcgggtggcgtggtgaatatgtatcatatgaaagaagacgggtgggtcaaggtcgagtccactgatgtgagtgacctgctgcatcaatatagggaagccaatcaatag

SEQ ID NO: 201139 - DNA, 819 bp, Artificial Sequence
  Description of Artificial Sequence: Synthetic coding sequence
atgctgatcggcacccccaccccccgggacaccacccccagcagctggctgaccagctccttgctcgtagaggcagcaccactggacgataccacgcttccaacacccgtgagctcgggctgtcccggcctggagcccacggagttctttcagagtctgggtggggatggcgaaagaaacgttcagatcgaaatggcacacggaacaacgactctggcttttaagttccagcacggagtgatcgcagccgtagatagcagggccagcgcgggatcttatatcagcgcactgagagtaaacaaagtgatcgagatcaacccctatctgcttggcacaatgtccggctgcgccgcggactgtcagtactgggagagacttctggcaaaggagtgccgtctgtactacctaaggaacggggaaaggatctccgtgagcgccgcaagtaaattactgtcgaatatgatgtgccagtatcgaggtatgggcttgagcatgggctctatgatctgcggatgggataaaaaggggcccggtttgtattacgtcgatgagcatggcactcgcctctccgggaatatgttctccacaggaagcgggaacacttatgcgtacggcgttatggattctggttaccggcccaacttatcgccagaggaagcgtacgatcttggcagaagggccatagcctatgcgacccaccgcgactcctattctggcggtgttgtcaacatgtaccacatgaaagaagatggctgggtgaaagtggagtccaccgacgtgtccgaccttctacatcagtaccgggaggctaaccagtag

SEQ ID NO: 201140 - DNA, 831 bp, Artificial Sequence
  Description of Artificial Sequence: Synthetic coding sequence
atggccctgctggacgtgtgcggcgccccccggggccagcggcccgaatccgctctgcctgtggccggttcaggtcggagatcggaccctgggcattattcctttagtatgcgctcccctgaactggctctgccacgtggcatgcagcccactgaattctttcagtctctgggaggggatggtgaacgcaacgtgcagattgagatggcccatgggactacaaccctcgccttcaagtttcagcacggcgtgatcgctgctgtagattctagggcatctgcagggtcctatatctccgcattgcgcgtgaacaaggtgatcgagattaatccctatctcctgggcacaatgtccggctgcgctgcagattgccaatactgggaacggcttcttgctaaagagtgccgtctttactacttgcgaaatggtgaacggatctccgtctcggccgctagtaagctcctgtccaacatgatgtgccagtaccgcggtatggggttaagcatgggctcaatgatatgtggctgggataaaaaaggacctgggctgtattatgtggacgaacatggcactcgcctttctgggaacatgttctccactggttcgggcaacacttatgcatacggcgttatggatagtggatataggccaaaccttagcccagaggaagcttatgatctggggaggcgcgccatcgcctacgcaacccaccgagattcctacagtggtggggtcgtgaacatgtaccacatgaaagaagatggttgggtgaaagtggagagcactgatgtgagcgatcttttacaccagtacagggaggctaatcagtag

SEQ ID NO: 201141 - DNA, 759 bp, Artificial Sequence
  Description of Artificial Sequence: Synthetic coding sequence
atggccctgctggacgtgtgcggcgccccccggggccagcggcccgaatctgctctgcccgtcgccggctcggggcggcgctcagaccctggccattactctttctccatgcgctcccccgagctggcattgccccgcggaatgcaacctaccgagtttttccagagtttgggcggggatggcgaacgcaacgttcagattgagatggcccacggcacaactacccttgcctttaaatttcagcacggggtgatcgccgctgtagactcacgggctagtgcaggaagttatatcaactgccagtattgggagcgactgttggcaaaagagtgtaggctttactatctgcgtaacggagaacggatcagcgtgtcagctgcatctaagcttctgagcaatatgatgtgccagtatcgcgggatgggcttgtccatggggtcaatgatttgtggctgggataagaagggcccaggactctattatgttgacgaacatggaacgcgactttctggcaacatgttcagcacaggaagcggaaacacatacgcctacggcgttatggactctgggtacaggccaaatctcagtccagaagaggcctatgatctcggcagaagagccatcgcatatgccacacaccgcgatagctatagcggtggggtagtgaacatgtatcatatgaaagaggacggctgggtgaaagtcgagtcaaccgacgtctcagatctgcttcatcagtatcgggaggctaaccaatag

SEQ ID NO: 201142 - DNA, 759 bp, Artificial Sequence
  Description of Artificial Sequence: Synthetic coding sequence
atggccctgctggacgtgtgcggcgccccccggggccagcggcccgaatccgcgctcccagtggccgggtccggtaggaggagcgatccaggccattatagctttagtatgagatccccagagctggccttgccccgggggatgcagcctaccgaatttttccagagtttaggcggggacggcgagaggaacgtgcagatcgagatggcgcatggcacgaccactcttgccttcaaatttcagcatggtgtgatcgccgcagttgactcgagagcatccgcaggaagctacattaactgccagtattgggagcggctcctagcaaaagagtgccgcttgtattatctacgcaacggcgagcggatctcagtttctgccgcttccaagctgctgtccaacatgatgtgccaatatcggggaatgggtctgtcaatgggatctatgatatgcggctgggacaagaagggccctggcctctactatgtggatgaacatggaacccgcctgtctggtaatatgttctccactgggagcggcaacacatacgcttacggagtgatggatagcggctatcgccccaacttgtcacctgaggaggcttatgacctgggcaggcgagccatagcgtacgccacacacagagattcttactccggtggcgtggtaaatatgtaccacatgaaagaggatggatgggtgaaggttgagagcacagatgtcagcgatcttctgcaccaatatcgtgaggctaatcagtag

SEQ ID NO: 201143 - DNA, 831 bp, Artificial Sequence
  Description of Artificial Sequence: Synthetic coding sequence
atggccctgctggacgtgtgcggcgccccccggggccagcggcccgagagtgcactgccggtcgccggttctggccgcaggtccgaccccggccactatagctttagcatgcggagcccggagttggctctgcccagaggaatgcaacctaccgaattttttcagagcctaggcggtgatggagagaggaacgtacagatagagatggctcacgggaccactacactggcattcaagtttcagcatggggtcattgcggctgttgatagccgggctagtgccggatcctacatttccgctttaagagtgaacaaggttattgagatcaatccatatctgctgggcaccatgtccggctgtgccgccgactgccagtactgggagcggttgctggcaaaggagtgcaggttatactacctcaggaacggagagcggatcagtgtgagcgctgccagcaagctgctgtccaatatgatgtgtcaatacagagggatgggcctcagcatgggatcgatgatctgtgggtgggacaaaaagggtcctggtctgtattacgtggatgagcacggtacgcggctaagtggcaatatgttctctaccggaagcggcaacacatatgcatacggtgttatggattctggatatcgacccaacctcagccccgaagaagcatacgacctgggacgtcgcgctatcgcctatgctacacacagggattcttactccggcggggtggtgaatatgtatcatatgaaggaggacggttgggttaaagtggagagtacagatgtgtcagatctgctacaccagtatagggaagctaaccagtag

SEQ ID NO: 201144 - DNA, 819 bp, Artificial Sequence
  Description of Artificial Sequence: Synthetic coding sequence
atgctgatcggcacccccaccccccgggacaccacccccagcagctggctgacgagctctctgctagtggaagcagcccctctcgatgataccactctgcccacccccgtgtcatcgggatgtcccgggttggaaccaacggaattttttcaaagtctgggcggcgatggggagcggaatgtacaaatagagatggcccacggcactacaacattggcttttaagttccagcatggagtgattgcggcagtggactcacgagcgtctgccgggtcgtacatttccgcccttagagtgaataaggtcatcgagattaacccttatctgcttggtactatgagcgggtgtgccgcagattgccagtactgggagcgactgcttgctaaggaatgccgcttgtattacctgagaaatggggagaggatatcagtgtcagccgcatccaagctgttatccaatatgatgtgtcagtaccgggggatgggcttgtccatggggagcatgatttgcggatgggataagaaaggcccaggtttatattatgtcgacgaacatggcaccaggctgagtggcaatatgttcagcaccggctctggcaatacttatgcttacggggttatggattctggatatcgtcctaacctgtcacccgaagaggcctatgacctggggcgaagggcgatcgcctatgccacccatagagacagttacagtgggggcgtggtgaacatgtaccacatgaaagaagacggctgggtaaaggtagagtctacagacgtgtctgacctcttgcatcagtatagagaggcaaaccagtag

SEQ ID NO: 201145 - DNA, 819 bp, Artificial Sequence
  Description of Artificial Sequence: Synthetic coding sequence
atgctgatcggcacccccaccccccgggacaccacccccagcagctggttgacctccagtttgctggtcgaggcagcccctctcgacgacaccaccttgcccacccccgtgagttccgggtgcccagggttggagccaaccgaattcttccagtctttaggaggagacggggaacgcaacgtgcagattgagatggcacacggaacgacaacactggctttcaagttccagcatggggtgattgcagcagtggactcccgggccagcgcgggaagttacattagcgccttacgagtgaacaaagtgattgagatcaatccttatctcctgggaacaatgtcgggctgcgcagccgattgtcagtattgggagcgcttactggccaaggagtgtcggctttactacttaaggaatggcgagaggatcagcgtatctgccgcgtctaagctgctgagcaacatgatgtgtcagtaccgcgggatgggactgagcatgggatctatgatatgtggctgggataagaaaggtccaggtctctattacgtggatgagcacgggacccgcctctcaggaaacatgttctctacgggttccgggaatacgtacgcctatggagtgatggattctgggtacagaccaaacctgtctcccgaagaggcgtacgatctgggccggagggctattgcctacgccacacacagggactcctactccgggggggtggtcaacatgtatcatatgaaggaggacgggtgggtcaaggtggagtccactgacgtttcggatctactacatcagtatcgtgaggcaaatcagtag

SEQ ID NO: 201146 - DNA, 831 bp, Artificial Sequence
  Description of Artificial Sequence: Synthetic coding sequence
atggccctgctggacgtgtgcggcgccccccggggccagcggcccgagtcagcgcttccagtagctggctcaggacgacgcagtgaccctgggcactatagttttagcatgcggtccccggaactggcgctcccacgagggatgcagccgactgagttcttccagtcgctcgggggtgacggcgagcggaatgtccaaattgaaatggcccatggcactacaacacttgcctttaagttccagcatggggtgatcgcggctgtcgacagcagggcctctgccgggtcttacatcagtgccctgagggtcaataaagttatcgagataaatccctacctcttgggcactatgtcggggtgcgcagctgactgccagtattgggagagattgcttgccaaggagtgtaggctgtactacctccgcaacggggaacgcatttctgtcagtgctgcgagcaaactgttgtccaatatgatgtgccaatacagggggatgggcttgagtatgggaagtatgatctgcggctgggacaaaaaaggtcctggactctactacgtcgatgagcacgggacccgcctgagcggcaatatgttttcgaccgggagcggcaacacctacgcttacggggtgatggacagtgggtacagacctaatctgtctcccgaggaagcatatgatctgggaagacgtgcaatcgcgtatgctactcacagggactcctattcgggaggggtggtgaacatgtatcacatgaaagaggatgggtgggttaaagtggaaagcactgacgtctctgatctgttgcaccaatatagagaggctaatcagtag

SEQ ID NO: 201147 - DNA, 819 bp, Artificial Sequence
  Description of Artificial Sequence: Synthetic coding sequence
atgctgatcggcacccccaccccccgggacaccacccccagcagctggttgacctcttcacttcttgttgaggcggccccattggatgacaccaccctcccgacccccgtttcgtctggctgcccaggactggaaccaactgagttcttccaaagcctggggggcgatggtgagaggaacgtgcagatagaaatggcccatggcaccaccacactggcctttaaatttcagcacggagtgatcgcggcagtcgactcgcgcgcatctgcaggttcatatatttccgcactgcgcgtgaataaagttattgaaataaatccttacctgctaggaacaatgtctggctgcgccgctgactgtcagtattgggagcgcttgctagccaaggagtgtcgcttatactatttaaggaatggcgagagaatctccgttagcgccgcatccaaacttctgtcgaacatgatgtgtcagtataggggcatggggctttctatgggtagtatgatctgcggatgggataagaagggccccggcttgtattacgttgatgagcacgggacccgtctgagtgggaatatgttcagcaccggcagtggcaacacatacgcttatggagtgatggattccggctaccgaccaaacctctcacctgaggaggcgtacgatcttggaagacgagccattgcctacgccacccaccgagactcgtactccggaggagtggtaaatatgtaccacatgaaagaggatgggtgggtgaaggtagaaagcactgacgtgagcgacctactgcatcaatatcgcgaagccaaccagtag

SEQ ID NO: 201148 - DNA, 831 bp, Artificial Sequence
  Description of Artificial Sequence: Synthetic coding sequence
atggccctgctggacgtgtgcggcgccccccggggccagcggcccgagtctgctctgcctgtggcagggtccggtaggcgttccgatcctggacattacagcttctctatgaggtcaccagagctagccctgcctcgcggcatgaagcccactgaattttttcaatccctggggggcgacggagagcggaatgtccaaatcgaaatggcacacgggaccactacccttgctttcaaattccagcatggagtgattgcggctgtggacagcagagcctccgctggctcttatatctccgccctgcgcgtcaacaaagttatagaaataaacccctacctgctggggacgatgagtggctgcgccgccgactgtcagtattgggagagactcttggctaaggagtgtaggctctactaccttcgcaacggcgagaggatttctgtgtccgctgcctcgaagcttctgtctaacatgatgtgccaatatagagggatggggctgtccatggggtctatgatctgtgggtgggacaagaagggtcctgggttgtactatgtggatgagcatggaacccggctgagcgggaatatgttctccaccgggagtgggaatacttacgcatacggggtgatggactccggctatagacctaacctctcgcccgaggaggcttacgacctcggccgcagagcgatcgcttatgctacacacagagattcctacagtggcggagtggtgaacatgtaccatatgaaagaggatggttgggtcaaagttgaatcaaccgacgtgtcagacctgctccaccagtatcgggaagccaaccaatag

SEQ ID NO: 201149 - DNA, 759 bp, Artificial Sequence
  Description of Artificial Sequence: Synthetic coding sequence
atggccctgctggacgtgtgcggcgccccccggggccagcggcccgaaagcgccctgcccgtcgcaggatctgggcgacgaagtgatccagggcactatagcttctctatgaggtcccccgagctggccctgcctagggggatgcagcccactgaattctttcagtcactcggtggagacggcgaacgtaacgtacagatcgaaatggcacatggaaccacaaccttggcgttcaagttccaacacggtgtgatagcggccgtggacagcagggcttccgccggaagctacatcaattgccagtattgggagcggttgttagcgaaagagtgtaggctgtattacctccgaaacggtgaaaggatatcggtgagcgctgccagtaaattgctgagtaacatgatgtgtcaatatcggggcatggggctctcaatgggctcgatgatctgtggatgggacaagaaggggcccgggctctattatgtggatgagcatggcacacgactgtccggaaacatgttttccaccgggtccggaaatacatacgcatacggggtcatggatagtgggtataggcccaacctgagtccggaagaagcgtatgacctggggcgacgggctatcgcttatgccacccaccgagactcatacagcgggggggtagtgaacatgtatcatatgaaggaggatggatgggtgaaagtcgagtctaccgacgtttctgacctcttacaccagtatcgcgaggcaaatcagtag

SEQ ID NO: 201150 - DNA, 759 bp, Artificial Sequence
  Description of Artificial Sequence: Synthetic coding sequence
atggccctgctggacgtgtgcggcgccccccggggccagcggcccgaatctgctctgcctgtggccgggtctggaaggcgctctgatccgggacactattctttcagcatgcgctcccccgagttggctttaccccgcggcatgcagccgaccgagttctttcaatccctcggcggtgatggcgagagaaatgtacaaattgagatggcccatggtacaactacccttgccttcaagtttcaacacggggtaattgcggcagtggactcccgcgcgagcgccggttcctatatcaactgccagtattgggaacggctgctcgctaaagaatgccgcttgtattacctgaggaacggagagcgcattagcgtttctgctgccagtaagcttctttcaaatatgatgtgccagtaccggggcatgggtctgagcatggggtcaatgatctgtggttgggataagaagggaccaggcctctactacgtggacgagcacggtactagattgtccggaaatatgttctctacaggcagcggcaatacctatgcgtatggggtcatggattccggttaccgacccaatctgtcgccagaggaagcctatgatcttggaaggcgcgctatcgcctacgccacccacagagactcctactcgggcggggtggtcaatatgtaccatatgaaggaagatggatgggtgaaagtggaatctactgacgtttccgatctgctgcatcagtatcgagaggctaaccagtag

SEQ ID NO: 201151 - DNA, 759 bp, Artificial Sequence
  Description of Artificial Sequence: Synthetic coding sequence
atggccctgctggacgtgtgcggcgccccccggggccagcggcccgaaagcgcccttcccgtggcgggaagcggtcgaaggagcgaccccgggcattattccttttccatgcggagccccgaactggccctgcctaggggtatgaagccaacagagttcttccaatctctgggcggggacggcgaaagaaatgtgcagatagagatggctcacggtaccacaacacttgcgttcaaattccaacatggggtgatcgccgccgtcgactcccgggctagtgcaggcagttatatcaattgtcagtactgggagcgcctgctcgcgaaagagtgcagactctactaccttagaaatggggaacgtatctcagtgagtgctgccagcaagctgctctctaatatgatgtgccagtaccgaggaatgggtctgagcatgggttctatgatctgtggctgggataagaagggccccggattgtattacgtcgatgaacacgggacccgactctccggaaatatgttttccactggctctggaaatacatatgcatacggtgtgatggactccggataccgcccaaacttgtccccggaggaggcatatgacctgggaaggcgcgcaattgcctacgcaacgcacagggactcttatagcggaggcgtggttaacatgtatcatatgaaagaggatgggtgggttaaagtggagtccaccgatgtgagcgacttgcttcatcagtatcgggaggcgaatcagtag

SEQ ID NO: 201152 - DNA, 819 bp, Artificial Sequence
  Description of Artificial Sequence: Synthetic coding sequence
atgctgatcggcacccccaccccccgggacaccacccccagcagctggctgacctcctctcttcttgtggaggccgctcccctggatgacaccaccttaccgacacctgtctctagcggatgccctggcttggagcctactgagttcttccagtctttggggggtgatggcgagcggaatgtacagatagagatggcacatggtaccacaacactggccttcaagtttcagcacggggtcattgccgccgttgattctcgcgcatcagcagggtcctacatatctgccctccgcgtcaataaggtaattgaaataaacccatacctgcttggcacaatgagtgggtgcgctgctgactgccagtactgggaacggttactggccaaagagtgtaggctttactacctccgaaacggggagcgcatatccgtttctgctgcctccaagctcctgagtaacatgatgtgtcaataccgggggatgggcctgtctatggggagcatgatctgcggatgggataaaaagggccctggtctgtactatgtcgatgagcatggcacccgactatctggcaacatgttctccaccggttctgggaacacatacgcctacggtgtgatggatagtggatatcggcccaatctatccccagaagaagcatacgatctgggtaggagggccatcgcctatgctacgcacagggacagctattccggaggcgtggtgaatatgtatcacatgaaagaggacggctgggtcaaggtggagtccaccgacgtatccgatttattgcatcagtatcgcgaggcaaaccagtag

SEQ ID NO: 201153 - DNA, 831 bp, Artificial Sequence
  Description of Artificial Sequence: Synthetic coding sequence
atggccctgctggacgtgtgcggcgccccccggggccagcggcccgagtcggcattacctgtggccgggtccggacgacggagtgaccctggccattactcatttagtatgaggagccctgagcttgcccttccacgcggaatgcagcccaccgaattcttccaatcgttaggaggagacggcgaacggaatgtccaaatcgaaatggcccacggcacgactacactcgccttcaaattccagcacggcgttatagccgctgtagattcacgagccagcgccggatcttatatttcagccctgagagtaaacaaggtcattgagatcaacccataccttttagggacaatgtctggatgcgcagctgactgccaatactgggagcgcttattagctaaggagtgccggctctactatctgcgcaacggcgagaggatcagcgtaagtgccgcaagcaagctgctgtccaatatgatgtgccagtatcgcgggatgggcctgtcaatgggctctatgatctgtgggtgggacaaaaaggggcctggcctgtattacgtggatgaacacgggacccggttatcagggaacatgttctccaccggctccgggaacacctacgcttacggagtgatggacagtggctataggcccaacctttctcctgaagaggcctatgatctaggtaggagggcaatcgcttatgcgactcacagagatagctactccggcggggtagtgaatatgtaccacatgaaagaggacgggtgggtaaaggtcgaatcaaccgatgtgtccgatctactccaccagtacagagaggctaaccagtag

SEQ ID NO: 201154 - DNA, 831 bp, Artificial Sequence
  Description of Artificial Sequence: Synthetic coding sequence
atggccctgctggacgtgtgcggcgccccccggggccagcggcccgaaagcgctttgcctgtggcaggcagtggtagacgaagcgatcccggccactattcattttcaatgcgaagcccagaactggccctcccacgtgggatgcagcctacagaattcttccaaagcctgggaggggatggcgagcgcaatgtccagattgagatggctcatggaacaacaactctcgctttcaagttccagcacggcgtcattgcagctgtggactctcgcgcttctgcgggaagctatatatccgctctcagggttaacaaagttattgaaatcaacccttacttattaggaacaatgtctggctgcgctgccgactgtcaatattgggagcgcttgcttgctaaggaatgtcgcttatactatctccggaacggcgagcgtattagcgtgtccgcagcatcaaagctgctcagcaacatgatgtgtcagtacagaggaatgggcctttccatgggcagcatgatttgtgggtgggataagaaagggcccgggctgtactatgtagatgagcacgggactcgactctccggcaacatgttttccacaggctccggaaacacctacgcttacggagttatggattcaggctacaggcctaacctatccccagaagaggcttacgacctcgggcggagggcaatcgcatatgccacacaccgcgactcctacagtggaggcgtagttaacatgtaccacatgaaggaggacgggtgggttaaggtggagagtacagacgtgtccgaccttctgcatcaatatcgcgaagccaaccaatag

SEQ ID NO: 201155 - DNA, 759 bp, Artificial Sequence
  Description of Artificial Sequence: Synthetic coding sequence
atggccctgctggacgtgtgcggcgccccccggggccagcggcccgaaagtgccctgcctgtggcggggtcaggaagacgttcagatccaggccactactctttcagcatgaggtcgcctgaacttgctctccctcggggaatgcagcctacagagtttttccagtccctgggaggcgacggtgagcgtaacgtgcaaatcgaaatggctcacggcaccaccactttagcattcaagtttcagcatggcgtgatcgccgctgtggactcccgcgcctccgctggaagctacataaactgtcagtactgggaaaggttgttagccaaggaatgtcgactgtactacctgcgcaacggagaaagaatttcggtgtctgcagcatctaagctgctctcgaacatgatgtgccagtacagaggaatgggcctgagtatgggctccatgatttgtggctgggacaaaaaagggcctggactgtactatgtcgacgagcacggcacaagattgtccggcaacatgttctctacaggctccggcaatacgtatgcctacggcgtcatggattccgggtacagacccaatctgtcccctgaagaggcttatgacctgggccgacgagccattgcctatgccactcatagggactcttacagtgggggtgtggtgaatatgtatcacatgaaagaggacggctgggtgaaagtagagagcacagacgtgagcgatttattgcaccagtatagggaggcaaaccagtag

SEQ ID NO: 201156 - DNA, 831 bp, Artificial Sequence
  Description of Artificial Sequence: Synthetic coding sequence
atggccctgctggacgtgtgcggcgccccccggggccagcggcccgagagcgcccttcctgtcgccggcagcggtcggagatctgaccccggacattattctttctccatgcgttccccagagcttgctctgccacgtggaatgcagcctaccgaattttttcaatccctcggaggtgacggggaaagaaatgtgcagatcgaaatggcccatggaacaacgaccctggccttcaaattccagcacggagttatcgccgcagtggattctagagcgagtgctggaagctacatcagcgccctgagagtcaataaagttattgagatcaatccatatttgctgggcacgatgtcgggatgcgccgcagattgccagtactgggaaaggctgctcgcgaaggagtgcagactctattacttacggaatggcgaacggatcagcgtgtctgcagcaagcaaactgctctcaaatatgatgtgtcagtatcgaggcatgggattgtccatggggagcatgatttgcgggtgggataagaaaggccccggactgtattatgttgacgagcacggcaccagattgtcaggcaatatgtttagtaccggatcaggaaacacgtacgcatatggggtgatggacagcggatacagaccaaacttgtcacccgaagaggcctacgatctcggtagaagggctattgcttatgccactcaccgggactcatattctgggggtgtggtcaacatgtatcacatgaaggaggatgggtgggtaaaagtcgagagtacagatgttagcgacttgctgcatcaatacagggaagcaaatcaatag

SEQ ID NO: 201157 - DNA, 660 bp, Artificial Sequence
  Description of Artificial Sequence: Synthetic coding sequence
atgctgcgggccggcgcccccaccggcgacctgccccgggccggcgaggtgcacacaggaactaccattatggctgtggaattcgacgggggggtagtcatgggctctgactcgagagttagcgcaggggaagccgtcgtcaacagggtttttgataagctcagccccttacatgagcgcatctattgcgctttatctggctcagcagcagacgctcaggctgtagctgacatggccgcctatcagttagaactacacggaattgagctcgaggaaccacccctagtcctagccgccgcaaatgtagtaagaaacatctcttataaataccgggaagatctgtcagctcacctgatggtggcaggctgggaccagagggagggaggacaggtttatggcactctcggtggcatgctcacgaggcagccatttgccattggcggatccggttctaccttcatctacggctatgtggacgcagcttacaagccaggtatgtctccggaggaatgtcgaaggtttacgaccgacgccatcgcactggcaatgtcccgcgacgggtcaagcggcggagtgatatacttggtgacaattaccgctgcaggcgtggaccacagggtgatattgggcaatgagctcccaaagttttacgatgagtag

SEQ ID NO: 201158 - DNA, 660 bp, Artificial Sequence
  Description of Artificial Sequence: Synthetic coding sequence
atgctgcgggccggcgcccccaccggcgacctgccccgggccggcgaagtccatactggcactactattatggcagttgaatttgatgggggcgtcgtaatgggctccgattcccgtgtctctgctggcgaagccgtggtcaacagagtgttcgataagctgagtcctctgcatgagagaatttactgcgccctgtctggtagtgcagctgatgctcaagcggtggccgatatggccgcttaccagctcgaactccatggcatcgaactggaagagcccccactcgtgctggccgccgctaacgtagtcaggaacatatcgtacaagtaccgcgaggatctcagcgcacacttgatggtggcagggtgggaccaacgagagggcgggcaggtgtatggcacgttggggggaatgttgactaggcagccctttgccatcgggggctcagggtcaaccttcatttacggctatgttgacgctgcatacaagcccggcatgagcccagaagagtgtaggcgatttactactgacgccattgcactggctatgagtcgggacggcagtagcgggggggttatctacttggtaacaatcaccgcggccggtgtcgaccatcgggtcatcctgggcaatgaactccccaagttctatgatgagtag

SEQ ID NO: 201159 - DNA, 660 bp, Artificial Sequence
  Description of Artificial Sequence: Synthetic coding sequence
atgctgcgggccggcgcccccaccggcgacctgccccgggccggcgaggtgcacacagggaccactatcatggctgtggagttcgatggaggagtcgtgatggggtcagattccagagtgtctgctggggaggctgtggttaaccgagtatttgacaaacttagcccactgcatgaacgcatatactgtgctctcagtggctctgcggccgatgcacaggcggtggcagacatggcggcctaccagctggaactgcatggtattgagctggaggagccaccactagtgctggccgctgccaacgtggtgaggaacatatcctacaaataccgggaagatctcagcgcccatctgatggtcgccgggtgggaccaacgagagggggggcaggtgtatggaaccttggggggtatgcttaccagacagcccttcgcaattggagggagcggatcaacattcatatatggctatgtggatgctgcctacaagccaggcatgtctccggaagaatgtagacgttttactacagacgccatcgcactcgccatgtcaagagatggctccagtggaggagtaatctacttagtgacgattacagcagcaggggtcgatcaccgtgtgatactgggaaatgaacttcctaaattttacgatgaatag

SEQ ID NO: 201160 - DNA, 591 bp, Artificial Sequence
  Description of Artificial Sequence: Synthetic coding sequence
atggccgtggagttcgacggcggcgtggtgatgggcagcgacagcagagtttcagcaggtgaggccgtggttaatcgggtgttcgataagctcagcccactccatgaacgcatttactgcgccctgagcggttcggctgccgacgcccaggcagtagctgacatggcagcctatcagctggagttacacgggatcgagctggaagaaccgcctttggtgctggccgctgccaacgtggtgcggaatatttcttacaaatatcgagaggatctgtctgctcatctgatggtagcagggtgggatcagagagagggcggacaggtttacggtactctgggtggcatgttaaccaggcagccttttgccataggtggtagtggatccaccttcatttacggttacgtggacgccgcgtacaagcctggaatgtcgcctgaggagtgtagaaggtttaccaccgatgcaattgccctggctatgagcagggatgggtcatctggaggtgtcatctatctggttacaataaccgccgccggagtggaccaccgtgtcattctgggaaatgagcttcctaagttttacgacgagtag

SEQ ID NO: 201161 - DNA, 537 bp, Artificial Sequence
  Description of Artificial Sequence: Synthetic coding sequence
atgctgcgggccggcgcccccaccggcgacctgccccgggccggcgaagttcacaccggaacaacgatcatggcggtggagtttgatggaggcgtagtgatggggtctgactccagagtctctgccgggattgagcttgaagaacccccacttgtattggctgcagcgaacgttgtcagaaacattagctataaataccgggaggatctgagcgcccacctgatggtggccgggtgggatcagcgtgagggagggcaggtgtatggcaccctgggaggtatgctgaccagacagccttttgccatcggcgggagtggatccacctttatttatgggtatgtcgacgccgcttacaaacctggaatgagtcctgaagaatgccggcgctttaccacagacgccacatcaacaaaaaggagagtgtgcggctactttctgcggacccaaaaaagagagaatcagaaccagcgggtccacgaatacatgtgtacaggcgagagaagcctttctagctctcctctgctgagctgctcttag

SEQ ID NO: 201162 - DNA, 591 bp, Artificial Sequence
  Description of Artificial Sequence: Synthetic coding sequence
atggccgtggagttcgacggcggcgtggtgatgggcagcgacagccgcgtaagcgcaggagaggcagtggtaaatagggtctttgacaagttgagcccccttcacgaaagaatatactgtgccttgtcgggatcagccgctgacgctcaggctgtggctgatatggcagcctaccagctggaattgcatggcatcgaattagaggaaccccctctggtattagccgccgccaacgtagtcagaaatatcagttacaagtatcgtgaagacttaagtgcacatcttatggttgccggatgggaccagcgggaagggggccaggtatacggcaccctgggaggaatgctaacgagacagccctttgccatcggcggctccggctccacattcatatacggctacgtggatgccgcctataagccaggcatgtctcccgaagaatgcagacgcttcacgacggacgccatcgcccttgcaatgtcccgagatggatcttcaggaggcgtaatttacttagtgacaatcacggctgccggggtggaccatcgggtcatactgggcaatgagctgcctaagttctatgacgaatag

SEQ ID NO: 201163 - DNA, 537 bp, Artificial Sequence
  Description of Artificial Sequence: Synthetic coding sequence
atgctgcgggccggcgcccccaccggcgacctgccccgggccggcgaagtacataccggaaccaccataatggccgtggagttcgacggtggggtggtgatggggtcggatagtagagtttccgccggaatagaattggaggaaccacccctagtcctggcggccgctaatgttgtccgaaacatcagttataagtatcgggaagatttgagcgctcatctcatggttgctgggtgggaccagcgagagggagggcaggtatacggaaccctgggaggaatgcttactcgacaacccttcgcaatcgggggttccggctcgacgtttatctacggatacgtggacgcagcttacaagccggggatgagcccagaggagtgtcgaagattcacgacagatgccacgagcacaaaaagacgggtgtgtggctacttcctgcgcacccagaaacgcgagaaccagaatcaacgggtgcatgaatacatgtgcacaggggagcgctctctctcttcttcccctctgctcagctgttcctag

SEQ ID NO: 201164 - DNA, 591 bp, Artificial Sequence
  Description of Artificial Sequence: Synthetic coding sequence
atggccgtggagttcgacggcggcgtggtgatgggcagcgacagcagagtttctgcgggtgaagcagtggttaatcgtgtattcgataaactcagtcccctccacgagaggatctactgtgcccttagcgggagtgccgcagacgcgcaggctgtcgcagatatggccgcctaccagcttgagctccacggcatcgagcttgaggaaccccccctggtccttgccgctgccaacgtagtgcgcaacatttcctataagtatagggaggatctgtctgcccacctgatggtggccggatgggaccagcgcgagggcgggcaagtctatggtacactcggaggcatgctcactcggcaacccttcgccatcggggggtcggggtcaacattcatctatggatacgtggatgccgcatacaagcctggcatgagcccagaggaatgcaggaggttcacaaccgacgctattgccttggcaatgagcagagacggtagttccgggggcgtgatctaccttgtgaccatcacagctgctggggtcgatcatcgggtcatcctcggaaatgaactgcccaaattttacgacgagtag

SEQ ID NO: 201165 - DNA, 537 bp, Artificial Sequence
  Description of Artificial Sequence: Synthetic coding sequence
atgctgcgggccggcgcccccaccggcgacctgccccgggccggcgaggttcatactggcaccactattatggctgtggagtttgatggtggcgttgttatgggctccgatagcagggtaagcgcgggcatcgagttggaggagccaccactggtgttggcggccgcaaatgtcgtgcggaacatctcgtataagtacagggaagacctgagtgcacacctgatggtggctggatgggaccaacgggagggtggacaagtctacgggactcttgggggcatgttgacgcgccaaccatttgccatcggaggcagcgggtcaaccttcatttacggttatgtcgacgccgcctacaagcctggaatgtctcctgaagaatgtcgcagatttacaactgatgccacgtctaccaaacgcagggtgtgcggctacttcttgagaacccagaagcgcgaaaaccaaaaccaacgagtgcatgaatatatgtgtaccggagagcgcagtctttccagtagtcccctcttgtcatgctcctag

SEQ ID NO: 201166 - DNA, 396 bp, Artificial Sequence
  Description of Artificial Sequence: Synthetic coding sequence
atggccgtggagttcgacggcggcgtggtgatgggcagcgacagcagggtttcagccggcgaagccgttgtcaatagggtgttcgacaagttgagcccactgcatgagcggatctattgtgccttgagcggatccgcagcagatgcccaggcggttgcagatatggctgcttaccagctggagttacatgggatcgagctcgaggagcctcccctggtgcttgcagcggctaatgtcgttcgtaacatatcttacaaatacagggaagacctatccgcacacctgatggttgcaggctgggaccagcgagagggcggccaggtctatggcactttgggcggtatgcttacccgccagccttttgccatcggcggttcgggtagtacattcatctag

SEQ ID NO: 201167 - DNA, 396 bp, Artificial Sequence
  Description of Artificial Sequence: Synthetic coding sequence
atggccgtggagttcgacggcggcgtggtgatgggcagcgacagcagagtctcagccggtgaggcagtcgttaatcgcgtcttcgacaagttgtcccccttgcacgagaggatttactgcgccctgtctggaagcgccgccgacgcccaggcagtcgctgacatggcagcctatcagctggagttgcacggaattgagcttgaggagccaccactggtcctagctgcagccaacgtggtgaggaatatatcatacaagtatcgcgaggatctttccgctcatctgatggttgccgggtgggatcagagagaaggcgggcaggtgtatggaaccctggggggtatgttaacacggcagccgtttgctattggagggtcaggaagtacatttatctag

SEQ ID NO: 201168 - DNA, 396 bp, Artificial Sequence
  Description of Artificial Sequence: Synthetic coding sequence
atggccgtggagttcgacggcggcgtggtgatgggcagcgacagccgcgttagcgccggagaagcagtggttaatcgggtattcgataaactgagcccactgcacgagaggatttactgtgctctgtctggaagtgcggctgacgcacaagcagtggcagacatggccgcctatcagctggaattgcacggaatagagctggaagaaccgcccctagtgctggccgccgcaaatgttgtcaggaacataagttacaaatacagagaggacctcagtgcccatctgatggtcgcagggtgggaccagcgggagggcggccaggtatacgggactctgggcggcatgctcaccaggcagccctttgcaatcgggggatcaggatctacgttcatttag

SEQ ID NO: 201169 - DNA, 396 bp, Artificial Sequence
  Description of Artificial Sequence: Synthetic coding sequence
atggccgtggagttcgacggcggcgtggtgatgggcagcgacagccgagtttctgctggggaggctgtggtgaatcgggtgtttgataaactgtcaccgctccacgagagaatttactgtgcgctttctggctctgctgccgatgctcaggcagtggccgacatggcagcttaccagctcgagctccacggtatcgaactcgaggagccccccctcgtgttggcggccgctaacgtcgtccggaacatctcatacaaatacagagaggatctctcagcccatctcatggtagctggatgggaccagcgtgaaggaggacaggtctacgggaccctcggcgggatgctcacaaggcaaccattcgctatcggaggctcagggagcacgtttatttag

SEQ ID NO: 201170 - DNA, 537 bp, Artificial Sequence
  Description of Artificial Sequence: Synthetic coding sequence
atgctgcgggccggcgcccccaccggcgacctgccccgggccggcgaggtccacactggaacaacaataatggcggtagagtttgatggaggcgtggtgatggggagcgactcaagggtatcagccgggattgaactggaggagccaccgctagtgctggcggctgccaatgtggtgcggaacataagctacaaatatagagaagacctgtcagcacacctgatggtagctggctgggaccaacgtgagggggggcaggtctatggcacattgggcggtatgcttactaggcagccattcgcaatcggagggtcggggtccacatttatttacgggtatgtggatgctgcgtataaacccggcatgagccctgaggaatgccgcagatttaccaccgatgctacctccacaaagaggcgcgtatgtggatacttcctgagaacacagaagagggagaatcaaaaccaacgcgtgcacgaatatatgtgcacctccgaacggtcactctcatcaagtcctctgctaagctgttcgtag

SEQ ID NO: 201171 - DNA, 396 bp, Artificial Sequence
  Description of Artificial Sequence: Synthetic coding sequence
atggccgtggagttcgacggcggcgtggtgatgggcagcgacagccgtgtctccgccggggaggcggttgtcaatagggtatttgacaagctctcaccgctgcatgagcatatttactgcgccctgtccggtagcgccgccgacgctcaggctgtcgctgacatggctgcctaccagctcgagctgcatgggattgaactggaggagccacccttagtgctggcagctgccaatgtggtgcggaacatcagctataaataccgggaggacttatcggcgcatctcatggtggctgggtgggaccagcgcgagggtggtcaggtttacgggaccctggggggcatgctaacaagacagcctttcgctatcggaggttccggtagcacgttcatctag

SEQ ID NO: 201172 - DNA, 591 bp, Artificial Sequence
  Description of Artificial Sequence: Synthetic coding sequence
atggccgtggagttcgacggcggcgtggtgatgggcagcgacagcagggtgtccgccggcgaggcagtggtcaacagggtatttgacaaactgtcccctttacatgagcgaatttattgcgccctgagcggatcagctgctgacgctcaagctgttgcagatatggctgcctaccagctagagctgcatgggatcgagctagaggagccaccactggtactagctgccgcaaatgtggtgagaaatattagctacaagtacagagaagacctgtcagctcatctgatggttgcagggtgggaccaacgcgaaggaggacaggtgtacgggacactgggtggcatgctgacaagacagccatttgccattggcggctctgggtctactttcatttacggatatgtggacgcggcgtataaaccagggatgtcccctgaggaatgtcggcgattcacaacagacgccattgctctcgccatgagcagggatggctcatctggtggagtgatatacctggttacaataactgccgctggtgtcgaccatagggtcatcctgggcaacgagcttccgaaattctatgacgaatag

SEQ ID NO: 201173 - DNA, 660 bp, Artificial Sequence
  Description of Artificial Sequence: Synthetic coding sequence
atgctgcgggccggcgcccccaccggcgacctgccccgggccggcgaagttcataccggcacaacgattatggcagtggaattcgatggaggcgttgtgatgggtagcgattcaagggtgagtgccggcgaggcggtggtcaacagggtgtttgataagctcagtccactccacgaacgaatctactgcgccctctcaggaagcgcagctgacgcgcaagctgtggctgacatggcagcatatcagctggagctccatggaatagagctagaggagcctcccctggtgctggctgccgcaaacgtagtgaggaatatatcatacaagtatcgagaggatctgtccgctcatttaatggtggctggctgggatcagcgcgagggcggtcaagtgtacgggacccttggaggcatgcttacacgccagccatttgctattgggggttctggttcaaccttcatttacggatacgttgatgccgcatataagccaggaatgtcccccgaagagtgcaggcggtttactacggacgcaatcgcactggccatgtcacgcgatgggtcttccggaggggtcatatatctggtaacaatcaccgctgctggggtcgaccatagagtgattctgggtaatgagctccccaaattctatgacgagtag

SEQ ID NO: 201174 - DNA, 591 bp, Artificial Sequence
  Description of Artificial Sequence: Synthetic coding sequence
atggccgtggagttcgacggcggcgtggtgatgggcagcgacagccgcgtttctgccggagaagcggttgtcaacagggtcttcgataaactgtccccgctgcacgagcacatctactgtgctctctccggaagtgcggcggatgcccaggctgtagcagatatggcagcttaccagcttgagctccacggcatagaacttgaggagcctcccctggttcttgccgcggcaaatgtcgtccgtaatatcagctacaagtaccgggaggatcttagcgcccatcttatggtggccggttgggaccagagggaaggcgggcaggtgtacggaaccctgggcgggatgctaacccgccaacccttcgcaatcggcggcagcggatcaacatttatctacggctatgtcgatgctgcgtacaagccaggaatgagcccggaagaatgccgcaggtttaccactgacgctatcgcccttgctatgagccgagatgggtctagcggaggagtaatttatctcgtgactattacagcagcaggcgtcgatcaccgggtgatcctcggtaatgaattacctaaattttatgatgaatag

SEQ ID NO: 201175 - DNA, 537 bp, Artificial Sequence
  Description of Artificial Sequence: Synthetic coding sequence
atgctgcgggccggcgcccccaccggcgacctgccccgggccggcgaggttcatactggtacaactatcatggcagttgaatttgacggcggtgtagttatgggaagcgactccagagtgtcggccgggattgagcttgaggaacctcctctggtgctggctgcagctaacgtggtccggaatatatcctacaagtaccgagaagacctctccgcacacctgatggttgcagggtgggatcagcgggagggcggacaggtgtacggaactctgggcggcatgctaacaaggcagccctttgccatcggcggaagcggctcaactttcatctacggttacgtggatgcggcttacaaacctggcatgtctcccgaagaatgccggaggtttactacagacgccacatctactaaacggcgagtatgtggatactttctacgcacacagaaacgcgagaatcagaaccagagagtgcacgagtacatgtgtacttctgagcgtagcttgtcctccagtccactgctgagctgctcatag

SEQ ID NO: 201176 - DNA, 537 bp, Artificial Sequence
  Description of Artificial Sequence: Synthetic coding sequence
atgctgcgggccggcgcccccaccggcgacctgccccgggccggcgaggtgcacaccggaacaaccattatggcagtggagttcgacggtggcgtagttatgggatctgacagccgggtgtccgcagggatagaactggaggaaccaccacttgtgcttgccgctgctaacgttgtcaggaatatttcttacaagtatcgggaggatctgtctgcccaccttatggtagcaggctgggatcaaagggaaggaggccaagtgtacggcactctgggagggatgttgacccgacaaccctttgccatcggcggctccggatctacgttcatctatgggtatgttgacgcagcatacaaacctggaatgagtcctgaagagtgccgacggttcaccaccgatgctacctcgaccaaacggagagtgtgtggctatttcctcagaacacagaagcgcgagaaccagaaccagcgggttcacgaatacatgtgtacgtcagagagaagcttgtcatcaagtcctctcctaagttgtagctag

SEQ ID NO: 201177 - DNA, 660 bp, Artificial Sequence
  Description of Artificial Sequence: Synthetic coding sequence
atgctgcgggccggcgcccccaccggcgacctgccccgggccggcgaggtgcacacaggtactactatcatggccgtcgaattcgatggcggggttgtcatgggttcagatagccgcgtcagtgccggggaggccgtggtcaatagggtttttgataagctgagtcccctgcacgagcatatctattgtgccctaagtggatcagcagcagacgctcaggccgtagccgatatggccgcctatcagttagagctgcacggaatagagctcgaggagccgccactggtcctagctgccgccaatgtcgtacgaaatataagctacaaatacagagaggacttgagtgcacacctcatggtggccggttgggaccaacgggaagggggtcaagtctacggcaccctgggaggaatgctgacgagacaaccctttgctatcggtgggtcaggctcaacattcatctacggttacgtggacgcagcttataaaccagggatgtctccggaagagtgtagaaggttcaccacagatgcaatcgcgctggctatgagccgggatggcagctccggtggggtgatttatctcgttacaattaccgcagccggcgtggaccaccgtgtcattctcggcaatgagcttcctaagttctatgatgaatag

SEQ ID NO: 201178 - DNA, 591 bp, Artificial Sequence
  Description of Artificial Sequence: Synthetic coding sequence
atggccgtggagttcgacggcggcgtggtgatgggcagcgacagccgagtgagcgccggcgaggccgtggtgaacagggtgttcgacaaactttcccccctacacgagcacatctactgcgctctctctgggtcggccgcagatgcccaggccgtggctgatatggctgcctaccaacttgagctccatggcatcgagcttgaagagccacctctggtgctcgccgccgccaacgtggtgcggaacattagttacaagtatagagaagatctcagcgcgcaccttatggttgcgggctgggaccaaagggaaggtggacaggtttacggaacgttgggcggaatgctgacccggcaacctttcgcaattggggggtcgggcagcacttttatctatggctacgtggacgctgcctacaagccggggatgagccccgaagagtgcaggcggttcactacagacgccatcgcgttagcgatgtcccgagatggatcgagcgggggagtaatatacctggtgactattactgctgctggagtggaccaccgcgtgatcctcgggaacgagctgcccaaattctatgatgagtag

SEQ ID NO: 201179 - DNA, 660 bp, Artificial Sequence
  Description of Artificial Sequence: Synthetic coding sequence
atgctgcgggccggcgcccccaccggcgacctgccccgggccggcgaggtacacaccggcaccactattatggccgtagagttcgatggtggagtggtgatgggctctgattccagggtgagtgcaggcgaggcggtagtcaatagagttttcgacaagctgtcgccgctccacgagcacatctactgcgccctgagcggcagtgccgcagacgcccaggctgtcgcagacatggccgcatatcaactggaattgcatggcattgaactggaggagccacccctcgtgctcgctgccgccaatgtggtccgaaacatctcttataagtacagagaggatctctcagcacaccttatggtggccgggtgggaccagagagaaggaggtcaggtgtacggaacacttggcggtatgctgaccagacagccctttgccattgggggctcggggtcaacgttcatctacgggtatgttgatgctgcctacaagcccggaatgtccccagaagagtgccgccgcttcactacagacgccatcgccttagccatgtcgcgcgacggttcttctggaggcgtgatctatttggtgacaatcacagctgccggtgtcgatcaccgggttatcctaggaaatgagctgcctaagttttatgacgaatag

SEQ ID NO: 201180 - DNA, 396 bp, Artificial Sequence
  Description of Artificial Sequence: Synthetic coding sequence
atggccgtggagttcgacggcggcgtggtgatgggcagcgacagcagagtctcagccggggaggcggtggtcaacagagtcttcgataagctgagccctctgcacgagcgaatttactgtgctctgtccggtagcgcggccgatgcacaagccgtcgccgacatggctgcctatcagttggagttgcacgggattgagctcgaggaaccacctctggtcctagccgccgcaaatgtcgtgaggaacattagctacaaataccgtgaggatcttagtgcccacctgatggtagcgggctgggaccagcgggaaggggggcaggtttacggcacccttggggggatgttgacccggcagccattcgcaattggagggagcgggagtacctttatatag

SEQ ID NO: 201181 - DNA, 396 bp, Artificial Sequence
  Description of Artificial Sequence: Synthetic coding sequence
atggccgtggagttcgacggcggcgtggtgatgggcagcgacagccgggtgtctgccggtgaggcagtcgtgaatcgggtatttgacaaattgtctccactccacgagcatatatactgcgcactgagcgggtcagctgcagacgcacaggccgtcgctgatatggccgcctaccagcttgagctgcacggtattgagctcgaggagccaccattggttctggctgcagccaatgttgtgaggaatatcagctataagtaccgggaggacttgtccgcccatctcatggttgcgggctgggaccagcgagaaggcggccaggtctacggaactctcggaggtatgctcactcgccagcccttcgccatcggaggatctggttccactttcatttag

SEQ ID NO: 201182 - DNA, 591 bp, Artificial Sequence
  Description of Artificial Sequence: Synthetic coding sequence
atggccgtggagttcgacggcggcgtggtgatgggcagcgacagccgcgtctcagctggagaagccgttgtcaatagggtgtttgataagctgtctcccctacacgagcacatttactgtgccctgagcggctccgccgcagacgcacaggcagtggccgacatggctgcgtaccaactcgagctccacgggatagaactagaagaaccacccttggtgctggctgctgctaacgtggttaggaatatcagctacaagtatcgggaagatctcagtgcacatttgatggtggcaggatgggatcaaagggagggcgggcaggtgtacgggaccctgggaggcatgctgaccagacagccatttgccataggcggcagtggaagcaccttcatctatggatatgtggatgccgcatacaagcccggcatgagcccggaggagtgtaggcgattcaccaccgacgctattgcactggctatgtcgagagatggcagctctggcggcgtcatttatctggtgacgataacagctgcgggggttgatcaccgcgtgatcctcggaaacgagctccctaagttctatgatgaatag

SEQ ID NO: 201183 - DNA, 660 bp, Artificial Sequence
  Description of Artificial Sequence: Synthetic coding sequence
atgctgcgggccggcgcccccaccggcgacctgccccgggccggcgaagtccatacgggaaccaccattatggccgtcgagtttgatggcggggtcgtgatgggctcagactcgagagtctcggcaggggaggctgtggtcaacagggtatttgataagctcagcccactacatgagaggatttactgcgctttgtcaggcagcgccgctgacgcgcaggccgtggctgatatggccgcataccagctggagttgcatggtattgaacttgaggaacctcccctggtgttagcggcagccaatgtggtcaggaacatcagttataagtatcgtgaggatctctccgcccacctgatggtcgcaggatgggatcagcgcgagggcggacaggtatatgggaccctgggcggcatgttaactcggcagcccttcgccataggcgggtctggcagtacctttatttacggctacgtggacgccgcatacaaaccggggatgtcccctgaagagtgtcggcgattcacgacagacgccattgctctggctatgtccagagacggatcatcaggcggagtgatctacttagtgacgatcacagctgccggagttgaccatagagtgattctgggtaatgagttgccgaagttctacgacgagtag

SEQ ID NO: 201184 - DNA, 537 bp, Artificial Sequence
  Description of Artificial Sequence: Synthetic coding sequence
atgctgcgggccggcgcccccaccggcgacctgccccgggccggcgaggtgcatactgggaccaccattatggccgtcgaatttgatggcggtgtcgtgatgggctcggattctagggtgtccgccggtattgagctcgaagaaccccctctggtgcttgctgcggcaaatgtggtgaggaacatttcttacaaatacagggaggatttgtcagcccatctcatggtggctggctgggaccagcgcgagggtgggcaggtctatggaactctcgggggaatgctaacgcggcaaccttttgccattggcgggtcaggtagtacatttatctatggatatgtcgacgctgcttataagcctggtatgagccccgaagagtgcagacgctttactaccgacgctacctcaactaagcggcgagtctgtggttactttctcagaacgcagaagcgagaaaatcagaatcagagagtacacgaatacatgtgtactggcgagagatccctgagctcgtcccccctgctgtcctgttcctag

SEQ ID NO: 201185 - DNA, 537 bp, Artificial Sequence
  Description of Artificial Sequence: Synthetic coding sequence
atgctgcgggccggcgcccccaccggcgacctgccccgggccggcgaggtgcacacaggaacaacgattatggcggtcgagtttgacggtggggtcgttatgggttctgattccagggtgagcgctggaatagaacttgaagagccgcctttagttttagccgcagctaacgttgtgagaaacatcagctataaataccgtgaagatttgtctgcacacctcatggtcgcagggtgggaccagagggagggtggccaggtctacggtacactgggcggcatgctgacacgccagccattcgccattggagggagcgggtcgacttttatctatggttatgtagacgccgcctataagcctggaatgagcccggaagagtgccgcaggttcacaactgatgccactagcaccaagcggcgagtgtgtggttacttcttaaggacccagaaaagggaaaaccagaaccaaagagtgcacgagtatatgtgtaccggcgaaagaagtctttcctcttctcctctgctgtcatgctcatag

SEQ ID NO: 201186 - DNA, 591 bp, Artificial Sequence
  Description of Artificial Sequence: Synthetic coding sequence
atggccgtggagttcgacggcggcgtggtgatgggcagcgacagccgggtttcggccggggaagccgtcgtgaaccgggtgttcgataagctgtcccctttacatgaaagaatctattgcgctctctcaggttccgccgccgacgcacaagcagtggccgatatggccgcttaccaactggagctccatgggatcgaactggaagaacctcctctagtccttgcggctgcgaacgttgtacggaatatctcctataagtacagggaagacctgtccgcccacctgatggttgctggctgggaccagcgagagggtggccaggtgtatgggacgctcggcggcatgctcacgcgacaaccttttgccattggagggagtggtagcacattcatctacggatacgtcgacgctgcgtacaagccaggtatgagtcccgaggaatgtaggcgctttactacagatgctattgccttagcaatgtcccgggatggctcctcgggaggagtgatctacctggtgacgatcactgccgccggagttgaccacagagtgatcctgggaaacgagctacctaagttttatgacgaatag

SEQ ID NO: 201187 - DNA, 660 bp, Artificial Sequence
  Description of Artificial Sequence: Synthetic coding sequence
atgctgcgggccggcgcccccaccggcgacctgccccgggccggcgaggtgcacaccggcaccacaatcatggctgtcgaattcgatggcggagtggtgatgggctcagattcaagggtgagcgccggggaagctgtagtaaatagggttttcgacaaactatctccactgcacgagcacatttactgtgctcttagtgggtcggcagcggacgcacaggcagtcgccgacatggcagcctatcagctggagctccacggcattgaactggaggaacccccgttggtactggccgcagcaaatgtagttagaaacatctcatataaatacagagaggatctatcggcacaccttatggtggctgggtgggatcaaagagagggcggtcaagtttatggaacactcggcggaatgctcacacgccagccattcgccataggaggttcagggtctactttcatttatggatacgtagacgcggcttacaagccggggatgtccccagaagagtgccggcgatttaccacggatgccatcgcattagcaatgtcccgcgacggcagttcaggaggtgttatctatctggtcactattactgctgcaggcgtagaccacagggtgatcctgggtaatgagctgcccaaattctacgacgagtag

SEQ ID NO: 201188 - DNA, 465 bp, Artificial Sequence
  Description of Artificial Sequence: Synthetic coding sequence
atgctgcgggccggcgcccccaccggcgacctgccccgggccggcgaggtacacaccggaaccactattatggcagtcgaatttgacggcggcgtggtgatgggaagtgattccagggtgagcgccggtatcgagctggaggagcctccgcttgtcctggctgctgcaaacgtggttcggaacatctcatacaaataccgagaggatttatctgctcacttaatggtcgctgggtgggatcaaagggaaggaggccaagtctacggaacgctgggcgggatgctgacacgtcagccctttgctatcggtggttccggaagcactttcatctacggatacgtggatgccgcctacaaaccagggatgtccccggaggagtgcagacgcttcaccaccgatgggaaccagccgagcggaagagtgccaggagaggggtttgaaacttgggaagggagtcgcctgtag

SEQ ID NO: 201189 - DNA, 396 bp, Artificial Sequence
  Description of Artificial Sequence: Synthetic coding sequence
atggccgtggagttcgacggcggcgtggtgatgggcagcgacagcagggtaagcgccggcgaagcagtggtgaaccgtgtcttcgacaaactgagcccacttcacgaacatatctactgcgccttgtcaggatctgctgcagatgcccaggctgtggcagacatggctgcctatcagcttgaactgcatggaatcgaactggaggaaccacctctggtgctcgcggcggccaacgtcgtgagaaatatatcctacaagtacagagaagatttgtcagcccatttgatggtggcagggtgggatcagcgagaaggagggcaggtgtatggcacactaggcggtatgttgaccagacagccgttcgctattggagggtctgggtctacattcatttag

SEQ ID NO: 201190 - DNA, 465 bp, Artificial Sequence
  Description of Artificial Sequence: Synthetic coding sequence
atgctgcgggccggcgcccccaccggcgacctgccccgggccggcgaggtccatacaggaacaaccattatggccgtagagttcgatggcggcgtagttatgggctcagacagccgggtgtctgcaggaattgaactcgaggagccacccctcgtgttggccgcagctaatgtggtgaggaacatctcttacaagtaccgtgaggatctgtcggcacacttaatggtggccgggtgggaccagagagagggaggccaagtgtatggtacgctaggcggcatgcttacgagacaacccttcgcgatcggcggtagcggtagcacctttatctacggttacgtggacgccgcctacaagcccggcatgagccctgaggaatgtagacgttttacaaccgacggaaatcaacccagcggaagggttccaggtgaggggttcgagacctgggagggatctaggttgtag

SEQ ID NO: 201191 - DNA, 465 bp, Artificial Sequence
  Description of Artificial Sequence: Synthetic coding sequence
atgctgcgggccggcgcccccaccggcgacctgccccgggccggcgaggtccacacagggacaaccatcatggctgtggagtttgatggcggagtagtgatgggatcagacagccgggtatcagccgggattgaactcgaggaacctccccttgtccttgccgcagctaacgtagttagaaatatttcctataagtaccgagaggacttaagtgcacatttgatggtggcagggtgggatcagcgcgagggcgggcaagtttatgggaccctggggggcatgctgacaaggcagcctttcgcaatcggaggatctggcagcaccttcatctacggttacgttgacgccgcatacaagcccggcatgagtcctgaagaatgcaggcgcttcacaaccgacggcaatcagccatctggtagagtgccaggtgagggctttgaaacatgggagggaagccggctgtag

SEQ ID NO: 201192 - DNA, 465 bp, Artificial Sequence
  Description of Artificial Sequence: Synthetic coding sequence
atgctgcgggccggcgcccccaccggcgacctgccccgggccggcgaagtgcatacaggaactactatcatggctgtagaatttgatggcggagtagttatgggcagcgattctcgagtatccgctggtattgagttggaagaacccccattggttcttgctgccgcgaacgtggtgcgaaatatcagctataaatatagggaagacctctcagcccatctgatggttgccggttgggaccagcgagaaggcggacaggtatacggcactttgggtgggatgctgacccgccagccattcgctatcgggggtagtggcagcacatttatatacggctacgtggacgcagcatacaaacccgggatgtctcccgaagagtgtcggaggttcactacggacggcaaccagccatcagggagggtgcccggagaaggatttgaaacatgggaaggttccagactctag

SEQ ID NO: 201193 - DNA, 465 bp, Artificial Sequence
  Description of Artificial Sequence: Synthetic coding sequence
atgctgcgggccggcgcccccaccggcgacctgccccgggccggcgaggtgcacaccggcactacgataatggctgtcgaattcgatggcggagtagtcatgggatcagacagtcgggtgtccgcaggcattgaactggaagaaccaccgcttgtgctggccgctgcaaacgttgtccgcaacatctcgtacaagtatagggaggacctgagcgctcatttgatggtagcaggttgggatcagcgagagggaggccaggtatatgggaccctgggggggatgctgactaggcaaccgtttgcaataggcggaagcggctcaactttcatttacggttatgtggatgctgcctacaaacccgggatgagtcctgaagaatgccgccggtttaccacggacggcaaccagccaagcggtcgggtgccaggagaaggattcgaaacttgggaaggcagtcggctgtag

SEQ ID NO: 201194 - DNA, 465 bp, Artificial Sequence
  Description of Artificial Sequence: Synthetic coding sequence
atgctgcgggccggcgcccccaccggcgacctgccccgggccggcgaggtgcacaccggcaccactataatggccgtggagtttgatggcggcgtggtcatgggatcggactcgagagtgtcagccggcatagaattggaggagcctcccctcgtacttgctgcagcaaatgtggtgcggaacataagttataaatatcgtgaggacctctctgcccatttaatggtagccgggtgggaccagcgggaagggggccaggtgtatgggactttggggggtatgctgactagacagccattcgcgattggtggaagtggaagcacattcatctacggctacgtggacgccgcctacaagccagggatgagccctgaagaatgtaggcggtttaccaccgatggaaatcagcccagcgggcgggtacccggagagggcttcgagacatgggagggtagccgtctctag

SEQ ID NO: 201195 - DNA, 465 bp, Artificial Sequence
  Description of Artificial Sequence: Synthetic coding sequence
atgctgcgggccggcgcccccaccggcgacctgccccgggccggcgaggtccacactggaaccacaatcatggccgtggaattcgatgggggggtggtgatgggcagtgacagccgggtctccgccggtatcgaactcgaagagccaccactggtcctggccgcagctaacgtcgtaaggaatatctcttacaagtaccgcgaagacctgtccgcgcatttaatggttgcgggttgggaccagcgggaaggcggtcaggtgtatggaaccctgggaggcatgctcacacgccaaccttttgcgattgggggatcgggctcaacgtttatctacggttatgtggatgccgcttataagcccggcatgtccccggaagaatgccgtcggtttactactgacggcaatcagccgtccggccgtgtacccggggagggctttgagacttgggaggggtcccgactgtag

SEQ ID NO: 201196 - DNA, 465 bp, Artificial Sequence
  Description of Artificial Sequence: Synthetic coding sequence
atgctgcgggccggcgcccccaccggcgacctgccccgggccggcgaggtgcacaccgggacgacaattatggccgtggaattcgacggtggggttgtgatgggctccgactcacgcgtgagtgcaggcatcgaactggaagagcccccactggtcctggctgcagccaacgtagttcgaaacatcagctataagtatagagaggatctctcggctcaccttatggtggccggatgggaccagcgagaaggtgggcaggtgtatggcacccttggtggaatgctcactaggcagccttttgcaatcggcggttccggatcaacgtttatttacggctatgtggatgccgcatacaaacccgggatgtccccggaggaatgcagaagatttacgacggatgggaatcagccctccgggagggtccctggcgaaggatttgagacatgggaaggatccagactatag

SEQ ID NO: 201197 - DNA, 426 bp, Artificial Sequence
  Description of Artificial Sequence: Synthetic coding sequence
atgaacgcccggggcctgggcagcgagctgaaggacagcatccccgtgacagaattgtccgcaagtggccccttcgaaagccacgatttgctcagaaaaggcttttcctgcgtgaagaatgagctgctgccctcccatccactggagttgagtgagaaaaattttcagctgaaccaagataagatgaacttctccaccctccgtaacatccaggggttgttcgcccctctcaaactgcagatggaattcaaagctgtacagcaggtccagcgactgccatttctatctagtagcaatttaagcctcgacgtcctgagaggcaatgacgaaaccatcgggtttgaagacattctcaatgacccgtctcagagcgaagttatgggggagccccacctgatggtggaatacaaactcgggcttctctag

SEQ ID NO: 201198 - DNA, 471 bp, Artificial Sequence
  Description of Artificial Sequence: Synthetic coding sequence
atgcccatggccggcctgctgaagggcctggtgcggcagctggagcggttttcagtgcagcagcaagcgtctaaaatgccccctaagggcaaatctgggtctggtaaagcgggcaaagggggagccgctagtggctccgacagcgctgacaagaaggctcagggccctaaaggcggggggaatgctgtcaaggttcgccacatcctttgtgagaaacacggaaagattatggaggctatggaaaaacttaagtctgggatgcgatttaatgaggtagccgcacagtactctgaagacaaagcccgccaaggaggggacttagggtggatgacgcgcgggtccatggttggaccctttcaggaagcagcttttgctctccctgtcagcggcatggataaaccagtttttacagatccacccgttaagacaaaattcggataccacattattatggttgaaggacggaaatag

SEQ ID NO: 201199 - DNA, 402 bp, Artificial Sequence
  Description of Artificial Sequence: Synthetic coding sequence
atgcccatggccggcctgctgaagggcctggtgcggcagctggagcgcttctcagtacagcagcaggcgtctaagatgcctcctaaaggtaagagtggctcaggaaaggcaggcaaaggaggggccgcctcgggcagcgactcggccgataaaaaggcccaggggccaaagggcggaggcaatgctgttaaagtacggcacattctctgcgagaagcacggaaagatcatggaggccatggagaagctcaaaagtggtatgcggttcaacgaggttgccgcccaatatagcgaggacaaagcgcggcaagggattccaagtttgcaacaacatgctggtcaccatcgcgacctccggtccaccctgatttccctcgtatcctacttacagactactccatag

SEQ ID NO: 201200 - DNA, 1062 bp, Artificial Sequence
  Description of Artificial Sequence: Synthetic coding sequence
atggccgccgccgaggccgccaactgcatcatggaggtgagctgcggacaagctgaatccagtgagaagccaaacgcagaggacatgacatcaaaggactattactttgattcctacgctcacttcggtatacatgaggagatgttgaaagatgaggtaaggaccctgacatacaggaactccatgttccataatagacatctcttcaaggacaaggtcgtgctggacgtcggctccggcactggaattctctgtatgtttgcagcgaaggctggagcgcgtaaggtgatcggaatagagtgtagttcaattagtgattacgctgtgaagattgtgaaagcgaacaagctggaccatgttgtaaccattatcaaaggtaaagtagaagaggtggagctccctgttgagaaggtggatatcatcatctccgaatggatgggctattgcctgttctacgagagcatgttgaacaccgtgttatacgctcgggacaagtggctggcacccgatggcctaatcttccccgatcgggcgacgctttatgttacggccatcgaagatcgccagtacaaggactacaagattcactggtgggaaaacgtctatggatttgacatgagctgcataaaggacgtggccattaaggaacccctggtggacgtggtcgatcctaagcagcttgtcacaaatgcttgtctcatcaaagaggtggacatttatacagtgaaggtggaagatctgacctttacctcccctttctgtctgcaggtaaaacggaatgattacgtgcacgcgttggtagcctactttaatattgagttcacccggtgccataagcggacaggattttcaacttccccggagtccccttacacacactggaaacaaacagttttctatatggaggactatcttacagtcaaaactggggaggagatttttggcacaatcggtatgcgccccaacgcaaagaataatagagacctggactttactattgatctagattttaagggacagttgtgcgagctctcatgtagcacagactaccggatgcgttag

SEQ ID NO: 201201 - DNA, 882 bp, Artificial Sequence
  Description of Artificial Sequence: Synthetic coding sequence
atggtgggcgtggccgaggtgagctgcggccaggccgagagcagcgagaaaccgaacgcggaagatatgacttccaaagattactacttcgatagctacgcgcattttggcatccatgaagaaatgttgaaggacgaggttcgcacactgacctacagaaattccatgtttcacaaccgccacctgttcaaggacaaggttgttctggacgtgggttctggcacggggatattatgtatgttcgccgccaaggcgggcgctcggaaagtgatcggcattgaatgtagttctatctccgactacgctgtcaagatagttaaggccaataagttggatcacgtggtgaccatcataaaaggtaaagtagaagaagtggagttgccggtggagaaagtcgatataatcatttccgaatggatggggtactgcctgttttatgaaagcatgctgaacaccgtgctgtacgcaagagacaaatggctggcacctgacgggctgatctttcccgacagagccactttgtatgttaccgccatcgaggacaggcagtataaagattacaaaattcactggtgggagaatgtgtacggctttgacatgtcctgcataaaggacgtggccattaaggaaccactggttgacgttgtggaccccaaacaactggttaccaacgcttgcctcattaaagttcgagggtgggcctggccaggagctccctgggtcgagacaaaagagaggcctagcccagggccgggcatggggctttgggggccagagtgctggccagaagtgagcgaacccgacttaccggctagagggggcgcccgaggcccagggaaaacactccggccactgaacatctttgtaagcgcagccgtgtag

SEQ ID NO: 201202 - DNA, 1116 bp, Artificial Sequence
  Description of Artificial Sequence: Synthetic coding sequence
atggccgccgccgaggccgccaactgcatcatggagaacttcgtggctaccctcgctaatgggatgtcactacaaccgccacttgaggaggtttcttgcggccaggctgagagcagcgagaagccaaatgctgaggacatgacctccaaagattattactttgacagctacgctcactttggaattcacgaggagatgttgaaggatgaggtccgaaccctgacctaccggaactccatgtttcacaatcggcatctattcaaggataaggtggtcctggatgtgggctccggcacgggcatattgtgtatgtttgctgcaaaggcaggagccagaaaggtcatagggatagagtgctcgtctatcagtgattacgcagtgaaaatcgtaaaggccaataagctcgatcacgtggttactattattaaaggtaaagtggaagaagtggagctgcctgtagaaaaggttgacatcatcatatctgagtggatgggttactgccttttttatgaatccatgctgaacacagtgttatatgcccgcgataagtggctcgcgcctgatggcctaatttttccggaccgggctacgctatatgttactgccatagaggatagacagtataaggactacaagatccactggtgggagaacgtttacggatttgatatgagctgcatcaaggatgtggccatcaaagagccactggtcgatgttgtggatcccaaacagttagtcactaacgcatgcctcataaaggaggtggacatctacactgtgaaggtcgaagatctgactttcacaagtccattctgcctgcaggtcaaaagaaacgactacgtgcacgccctcgtggcttattttaacattgagttcactcgctgtcacaagagaactggctttagcacttcaccagagtccccatacacccattggaaacagaccgtcttttatatggaagactatttgacagtcaagaccggggaagagattttcggcaccattggcatgcggccgaacgctaagaataatcgcgatctggactttacaattgatctggacttcaaggggcaattatgtgagctgagctgttcaacggactataggatgcgttag

SEQ ID NO: 201203 - DNA, 483 bp, Artificial Sequence
  Description of Artificial Sequence: Synthetic coding sequence
atgaccagcaaggactactacttcgacagctacgcccacttcggcatacatgaagagatgctaaaggatgaagtccgaacactgacctatcgcaacagcatgtttcataaccgtcatctcttcaaggataaagtcgtcttagacgtagggagtggcaccggaattttatgtatgtttgcagctaaagcaggagcacgaaaggtgatcgggattgaatgtagttcaattagcgactacgcggtgaaaatcgtaaaggctaataaactggaccatgttgtaaccatcataaaaggaaaggttgaagaagtagagctcccagtcgaaaaggtggacatcattatttctgagtggatgggctactgccttttctacgagtctatgctcaataccgtgctgtacgcccgagataagtggttggcccctgatggccttatttttccagaccgggccacactttacgtgactgctatcgaagaccgctag

SEQ ID NO: 201204 - DNA, 618 bp, Artificial Sequence
  Description of Artificial Sequence: Synthetic coding sequence
atgaccagcaaggactactacttcgacagctacgcccacttcggcatccacgaggagatgctgaaggacgaagtccggaccctaacatacaggaattcaatgtttcacaatagacatctttttaaagacaaggtcgtgctagatgtcggttctggaacaggtatcctctgtatgttcgctgcaaaggctggagctaggaaagtgatcgggattgagtgctcctccatatcagactacgcagtgaaaatcgtcaaagccaacaagctggaccacgtcgtgactattatcaagggtaaggtggaggaggtcgaactgcccgtcgagaaggtggacattatcatctcagaatggatgggatactgcttgttctatgagagtatgctaaacactgtcttatacgcccgagacaagtggctggcccctgatggccttatttttccagaccgtgccactctgtatgtgactgctatagaggaccgccagtataaagattacaagattcactggtgggagaacgtttacggctttgacatgagctgcataaaggacgtggcaattaaggagccgctagtcgatgtggttgacccaaagcagcttgtgaccaacgcctgcctgtag

SEQ ID NO: 201205 - DNA, 483 bp, Artificial Sequence
  Description of Artificial Sequence: Synthetic coding sequence
atgaccagcaaggactactacttcgacagctacgcccacttcggcatacatgaggagatgctaaaggatgaggtgaggacattaacatacagaaactcaatgttccacaataggcatctttttaaagacaaggttgtgctggatgtgggaagtggtaccggcatactgtgcatgttcgccgctaaggctggagcacgtaaggtaatcggtatagaatgtagcagcatatctgattacgcggtgaagattgttaaagccaacaaattggatcacgtcgtgaccatcatcaaggggaaggttgaagaggtcgaactgcccgtggagaaggtggatatcataatttccgagtggatgggatactgtttgttttacgagtctatgctcaataccgttttgtatgcacgggataaatggctggcacccgatggacttatttttcctgatcgagctaccctgtatgtgacggcaattgaggacaggtag

SEQ ID NO: 201206 - DNA, 630 bp, Artificial Sequence
  Description of Artificial Sequence: Synthetic coding sequence
atgaccagcaaggactactacttcgacagctacgcccacttcggcatacatgaagaaatgctgaaggatgaagtgcgcactctgacttaccggaattctatgtttcataacaggcatctgtttaaagataaggtggtcttagacgtaggctcgggcacagggatcctgtgcatgttcgccgctaaagcaggggcacgcaaggtcatcggcatcgagtgctcaagtatctccgattacgcggtgaaaatagtgaaagccaataaactcgatcacgtggtgaccatcataaagggtaaggttgaagaggtcgagctgccagtggagaaagtagatattattatctccgagtggatggggtactgtctgttttacgagtccatgttgaacacagtgctgtacgctagggataagtggcttgcacccgatggtctgatcttccctgatcgcgctaccttatacgttaccgccatcgaggaccggcaatacaaagactataaaatccactggtgggagaatgtgtacgggtttgacatgagttgtattaaggacgtggccattaaagagcctctggtggatgtggttgatcctaagcagctcgtgactaatgcttgcctcattaaggttcggtag

SEQ ID NO: 201207 - DNA, 687 bp, Artificial Sequence
  Description of Artificial Sequence: Synthetic coding sequence
atggccaccagcggcgactgcccccggagcgagagccagggcgaggaaccagctgagtgttccgaggctggtctgctgcaggagggcgtgcagccagaggaatttgttgccattgcagattacgcagctaccgacgaaactcagctgtctttcttgcggggcgagaagatcctgatcctgcgacagactactgccgactggtggtggggcgagcgggcgggctgttgcggctacattcccgcaaatcacgtgggtaagcatgtcgacgagtatgatcctgaggatacctggcaggacgaagagtatttcggcagttacggcacactgaagctccatctcgaaatgctggcagatcaaccacggaccacaaagtaccactcggtcatcctccagaataaggagtcactaacggacaaggtaatcctagacgtggggtgcggtacaggcattatctccctcttttgcgcccattatgccagaccccgtgccgtttacgccgtcgaagctagcgagatggcacaacatacgggccagctggtgttgcagaacgggttcgccgacattattacagtttaccagcaaaaagtcgaagatgtggtgttgcctgagaaagtggacgttctggtatccgaatggatgggaacatgcctcttagtgggagagaaggtgttccctatttggagatag

SEQ ID NO: 201208 - DNA, 855 bp, Artificial Sequence
  Description of Artificial Sequence: Synthetic coding sequence
atggccaccagcggcgactgcccccggagcgagagccagggcgaggagcccgccgaatgctccgaggcaggacttctccaggagggcgtgcagccagaggaatttgtggccattgcagactatgcagcaactgacgagacacagctgtcgtttctgagaggtgagaagattctcatcctccgtcaaacaaccgccgattggtggtggggagaaagggccggatgttgcggttacatcccagccaatcacgtcggcaaacatgtggatgagtatgatccagaggacacctggcaagacgaggagtattttggatcttatggcacattaaagttgcatctggagatgttggctgaccaaccccgcactaccaagtaccacagcgttatactgcagaacaaggagagcctcaccgataaagtcatccttgacgttgggtgcggaaccgggatcatcagccttttttgcgcacattatgccaggcctagggccgtctatgctgtggaagctagcgagatggcgcagcacacgggacaactggtgctgcagaacgggttcgccgacatcatcacagtttaccaacagaaagttgaggatgttgtacttcccgaaaaagttgacgtccttgtgagcgagtggatgggcacttgcttgcttgcggcccccctcctctcatgccgtatcttgccgtgcacctgtgcctccggcccactgcacgtgttgctggcttgttgtctgcccctcccttgcacatgtgcaagtgtgccactgcatgtcttgctcgcctgttgtcttcctgttcttagggcaccacagccgtccggcctgcatctgtcctggcccatctttctcctatag

SEQ ID NO: 201209 - DNA, 1302 bp, Artificial Sequence
  Description of Artificial Sequence: Synthetic coding sequence
atggccaccagcggcgactgcccccggagcgagagccagggcgaggaaccagctgagtgtagcgaggccggtcttttgcaggagggagtccagcctgaggagtttgtcgccattgccgactacgctgctacagacgaaactcagctcagctttctaagaggggaaaaaatcctgatcctacgccagactacggccgactggtggtggggcgagcgggcaggctgctgcgggtatatccccgctaatcatgtgggcaaacacgtggatgaatacgatcctgaagatacttggcaggatgaagagtatttcggttcttacggaactctcaagctgcacctggagatgctggccgaccagccgcgcaccactaagtatcactctgtcatcctgcagaacaaggaaagtctcacagataaggtgatcttggatgtggggtgtggaaccggtataatatcactattttgcgcccactatgcacggcctagagccgtgtatgctgtggaagcttccgaaatggctcagcacacgggccagttagtgctacagaatggattcgctgacattataacagtgtaccagcagaaagtcgaagacgttgtgctccctgaaaaagtggatgtactagtctccgagtggatgggcacatgtctgctatttgaattcatgatagagagtattctgtatgccagagatgcctggctgaaggaagacggggttatctggcccactatggccgccctccaccttgtaccgtgctcggcagacaaggattatcggagtaaggtactgttctgggacaacgcttacgagtttaacctgtccgctctgaagagcctggcagttaaagaattttttagtaagcccaaatacaatcacattttaaagcccgaagattgcctgtctgagccatgcacaatcctccaacttgatatgagaacagtccagatcagcgatctcgaaacactgagaggtgagctgcggtttgatatccgcaaggcaggaacgctccatggcttcaccgcatggttttcagtccattttcaaagcctgcaggaagggcagcctccacaggtcttgtccactggccctttccatccaactactcattggaaacagacattgttcatgatggacgatccagttcccgtacataccggagatgttgtaacaggctcagtggtgcttcaaaggaacccggtgtggagacggcacatgagtgtcgcactgtcttgggccgtgacatctcgccaggatccaacctcccagaaagtgggggagaaggtctttcctatatggcgctag

SEQ ID NO: 201210 - DNA, 486 bp, Artificial Sequence
  Description of Artificial Sequence: Synthetic coding sequence
atgctggccgaccagccccggaccaccaagtaccacagcgtgatcctacaaaataaggaatctctgcgcatcaagagctcctggacctgggccgtgggtctgggctccagtgttagttctgtgcacaccatgagggggctcgagagggtgtacgccgtggaggcaagcgagatggcccagcacaccggtcagttggttcttcaaaacggtttcgctgacataattactgtataccagcagaaagtcgaagatgtggttctgccagagaaggtggacgtgctggtgtctgagtggatgggtacctgtcttctattcgagttcatgattgagtccatcctatatgcaagggatgcctggttaaaagagacaggtagctttggtcctccttggttaagatgcactctgtgtcccgccgtgctaattcggattattgttgccagatgttccagcggaactacgcgcaccagcagcaccagcgccctttag

SEQ ID NO: 201211 - DNA, 1302 bp, Artificial Sequence
  Description of Artificial Sequence: Synthetic coding sequence
atggccaccagcggcgactgcccccggagcgagagccagggcgaggaaccagcagaatgttccgaagccggattattacaggaaggggtccagccagaggagttcgtcgctattgctgactatgcagccactgacgagacccaactatcttttctgagaggtgagaaaattctcatcctccgacaaaccacggccgactggtggtggggcgagagggcaggctgctgtggatacattcctgcaaaccatgtcggaaagcacgtagacgaatacgatccagaggacacttggcaggacgaagagtatttcgggtcgtatggaaccctcaagctccacctggaaatgctggcagatcagcccaggactactaagtaccactctgtgatcctgcagaacaaggagtctcttacagataaagtgattctggatgtgggatgtggcaccggcattatctcacttttttgtgcacattatgccagacctcgtgcggtatacgccgtggaagctagtgagatggcccaacacaccgggcagctcgtcctacagaacgggtttgcggatatcatcacagtgtatcaacagaaggtcgaggatgtcgtgctgcctgaaaaggtcgatgtgctggtctctgagtggatgggtacctgccttttatttgaattcatgattgagagtatcttatacgcccgggatgcttggcttaaggaagatggagtgatctggcccactatggctgctcttcacctagtgccatgtagcgctgataaggattataggtcgaaggtcttgttctgggacaatgcctatgagtttaacctgagtgctctgaaatccctcgcggtaaaggagtttttttccaaaccaaagtacaaccacattctaaagccagaagattgcctgagtgaaccgtgcactatcctgcagctcgacatgcgaactgtgcagatttccgatctcgagactctgaggggcgaacttcggtttgacatcagaaaagccggcactctccacggctttaccgcttggttcagcgttcatttccagagtttacaagagggacagcccccacaggttctaagtacaggcccttttcatcccaccacccactggaagcagaccctgtttatgatggatgaccccgtgccggtccatacaggtgacgtggttactggatccgtcgtgttgcagcgaaatccggtgtggaggcgccacatgagtgtggccctctcttgggctgtaacatctcgccaggatcccacaagccagaaggtcggagagaaagtgttccccatatggcgttag

SEQ ID NO: 201212 - DNA, 1302 bp, Artificial Sequence
  Description of Artificial Sequence: Synthetic coding sequence
atggccaccagcggcgactgcccccggagcgagagccagggcgaggagcctgccgaatgctctgaagctgggctattacaggaaggagtgcagcccgaagagtttgttgccatagcggattatgccgctacggatgaaacccaactgagctttctcagaggagaaaaaatacttattctgcggcagaccactgcggactggtggtggggggaacgagccggatgttgtggctatattcctgcgaaccacgtgggaaagcacgtggatgagtacgatcccgaggacacttggcaggatgaagaatactttggctcatacgggacgctcaaactgcacctggagatgctcgccgaccagcctagaaccacaaaataccactccgttatcttacagaacaaagagtctctgaccgataaggtgatccttgacgtcggctgcggaacgggcataatcagtctattctgcgctcattacgccagacctcgtgccgtgtatgccgtagaggcaagtgagatggcgcagcataccggccagcttgtgctgcagaacggctttgccgatatcatcacagtgtaccagcaaaaagttgaggatgtggtcttgccagaaaaggtagatgtgctggtaagcgagtggatgggaacctgccttttatttgagttcatgatcgaatcaatactttacgccagggacgcatggctgaaagaggacggagtgatctggcctacaatggccgcgttacatttggtgccttgttctgccgataaagattaccgctcaaaagtgttgttttgggataatgcttatgagtttaatctgagtgccttgaagagtctggccgtgaaggagttcttctctaagccaaagtataatcacatcctgaagccagaggattgcctttcagagccttgcacaatccttcagcttgatatgaggacagtccagatctctgacctggaaaccctcaggggggaactgaggttcgacatcaggaaagccggcacattgcatggcttcacggcatggttctctgtacattttcaatccctccaggaggggcagcctccccaggtgctgtcgaccgggccattccatccaaccacgcattggaaacaaaccctgttcatgatggacgatccagtgcccgttcacaccggggacgtggtaacaggctccgtcgttttgcagaggaacccagtctggagacgccatatgtccgtggcactgtcatgggctgtcacaagccgccaggatccaacatctcagaaagtgggagagaaggtatttcccatctggcggtag

SEQ ID NO: 201213 - DNA, 996 bp, Artificial Sequence
  Description of Artificial Sequence: Synthetic coding sequence
atggccaccagcggcgactgcccccggagcgagagccagggcgaggaacctgcagaatgctccgaagcaggcttgcttcaagaaggggtacagcccgaggagtttgtcgcaatcgccgactacgctgcaaccgatgagacccagcttagttttctcaggggagagaagatattaatcctgcgacagactaccgcagactggtggtggggagagcgggctggctgctgtggctatatccccgctaatcatgttgggaaacatgttgacgagtacgacccagaagacacttggcaagacgaggagtactttggctcatatggcactctgaagttgcacctggaaatgctggccgaccagccaaggactacaaagtaccattccgtgatcctgcagaacaaggagtctctgaccgacaaggtgatcttggatgtgggatgtggtactggtattataagcctcttctgcgctcactatgccagacctcgtgctgtgtacgccgttgaggcgtcagaaatggcccaacacacaggccagctggtactccagaatggctttgccgatatcatcacggtttaccaacagaaggtcgaagacgtggtgcttcctgaaaaagtggacgtcctggtaagcgaatggatgggcacatgtctgctgacattgaggggcgagctgaggttcgacatcagaaaagctggaactctccacgggtttactgcctggtttagtgttcattttcagtctctgcaagaaggacagccgccacaggttcttagcacaggtcctttccaccccacaacacactggaagcagaccctcttcatgatggatgatcctgtgccagtccataccggtgatgtggtgaccggcagcgtggttctgcaacgtaatcctgtgtggcgtcggcatatgtctgtggccttaagctgggcggtgacaagtcgacaagacccgacatctcagaaagtgggtgagaaggtgttccccatttggcgatag

SEQ ID NO: 201214 - DNA, 870 bp, Artificial Sequence
  Description of Artificial Sequence: Synthetic coding sequence
atggccaccagcggcgactgcccccggagcgagagccagggcgaggagccagcagaatgttccgaggccggactactgcaggagggcgttcagccagaggaattcgtcgccatcgctgactatgcggctaccgatgagactcaactgagctttcttcggggggaaaagatcctcattttgcgtcagacaactgcagactggtggtggggtgagcgggcaggctgctgcggttatatcccagctaatcatgttggcaagcatgtggacgagtatgatcctgaggacacctggcaggacgaagagtacttcggaagttatggaaccttaaagctccacttagagatgttggcggatcagcccaggacgaccaaataccacagcgtgatactgcagaacaaggagtcattaaccgataaggtgatattggacgttgggtgtggcaccggaattatttccctgttctgtgcccattacgcaaggccccgtgccgtgtatgccgtggaagctagcgaaatggctcagcacacgggacaattagtgctgcaaaatgggtttgcggacataatcacggtttatcagcagaaagtcgaggatgtggtcctgcctgagaaggtggatgtcctggtctccgagtggatgggcacgtgtttgttatttgagttcatgatcgagtccattctgtacgctagagatgcctggcttaaggaggacggcgtcatctggcccacgatggctgctcttcatcttgtgccttgtagtgcagacaaagattatcgctccaaggtccttttttgggataacgcatacgagttcaacctgtccgctctcaagcttgagaaaaaatctagcccctccggagacgatagttag

SEQ ID NO: 201215 - DNA, 906 bp, Artificial Sequence
  Description of Artificial Sequence: Synthetic coding sequence
atggccaccagcggcgactgcccccggagcgagagccagggcgaggagccagcagagtgttcggaggccggcctgctccaggaaggggtccagccggaagaatttgttgcaattgctgactatgccgccactgacgagactcagctgagcttccttagaggagaaaagattctgatcctgagacagaccactgccgattggtggtggggcgagcgagcaggttgctgcgggtatatcccggctaaccatgtaggcaaacacgttgacgagtacgatcctgaggatacctggcaggacgaagagtacttcggcagctatggcacactgaaactgcacctagagatgctggccgatcagcctcgtaccaccaagtaccattcggtgatacttcagaacaaggagtcactgacagacaaggtgatcttggacgttggatgcgggaccggcatcattagcctcttctgcgcgcactacgcaagaccccgcgccgtatacgccgtcgaagccagtgagatggcccaacacaccggacagctggtgctacaaaatgggttcgcagatatcatcactgtttatcagcagaaagtggaggatgtcgtgctgcctgaaaaagtggatgtgctggtgtcagaatggatgggcacatgcttgctacatcacacgctggaagctgacgccgtgcatgacggccggccgagcccatgtccctatcgtagaagaggccatggcttttcttgtgtggccgagaaaccaagcgttgaaaaggcacatgtgtgtggatccgagctgggctgtcacttccagaccaggccccacatttccaagtcatggaggaagtctctgcctcatctcgagatgacagtggatgctctgtttggcaagcagtgtgcctacctggagggttag

SEQ ID NO: 201216 - DNA, 951 bp, Artificial Sequence
  Description of Artificial Sequence: Synthetic coding sequence
atgatcgccgaccgggtgcggaccgacgcctaccggctgggcatcttgaggaactgggccgccttgcgtggtaagaccgtgctagacgtcggcgctgggaccggtatcctcagtattttctgcgcccaggcaggggccaggcgcgtttacgccgtggaagcgagcgcaatttggcaacaggcaagagaagtggtgcggttcaacggcctagaagaccgagtccacgtgttaccagggcctgttgagaccgttgaattgcccgaacaggtcgacgctatcgtatccgagtggatgggctatggcctcctgcacgagtccatgctctcatccgtcctccatgccaggacaaagtggctgaaggaagggggcctcctcctgccagcttctgccgaactttttatcgcgcccatcagtgatcagatgctggagtggcggttggggttttggtctcaggtaaaacagcattatggagtagacatgtcttgccttgagggattcgctacccgttgtctcatggggcactccgaaatcgtcgtgcaaggtctgtcaggggaggatgttctcgcccgaccacagcgctttgcacagctcgagctcagtcgggccggactagaacaagaactggaggctggagtgggcggcagattccggtgcagctgttatggaagcgctcccatgcatgggttcgctatctggttccaggttaccttccctggcggtgaaagcgagaaacctctagtcttatcaacttccccattccatccggcaactcattggaaacaggccctcctttacctgaacgaaccagtccaagtggaacaggacaccgacgtctcaggcgaaatcactctgttgccaagcagagacaatcccaggaggctgcgggtgctgttacggtataaggtgggtgatcaggaggaaaagaccaaggattttgccatggaggattag

SEQ ID NO: 201217 - DNA, 1128 bp, Artificial Sequence
  Description of Artificial Sequence: Synthetic coding sequence
atgagccagcccaagaagcggaagctggagagcggcggcggcggcgagggtggagaaggcacggaagaggaagacggcgcagagcgagaggccgccttagagcggccacgaagaacaaaacgcgagcgcgatcagctgtattacgagtgctattcagacgtcagcgtccacgaagagatgatcgcagatcgcgtacgcacggatgcatacagactgggaatcttgcgcaattgggccgctctccgggggaaaacagtcctcgacgtgggcgccggaactggcatccttagtattttttgcgcgcaggcaggcgcaagacgggtctacgctgtagaagccagcgccatctggcaacaggccagggaagtggttaggttcaatggactggaagacagagtccatgtcctgcccggcccggtcgaaaccgtggagctgcctgagcaagtcgacgccatcgtctctgagtggatgggatatggtctcctgcacgaatccatgttgtcctcagtcttacacgcacggaccaaatggctgaaagagggcgggctacttttaccagccagcgctgaactgttcatcgctccgatttctgatcagatgctggagtggcgcttaggattctggtctcaggtgaagcaacactacggcgttgacatgtcgtgccttgaggggtttgcaaccaggtgtctgatggggcattctgagattgtagttcagggtttaagtggagaggacgtgcttgccagaccccagagattcgcccagttagagcttagccgcgcggggcttgagcaggaactcgaggcaggcgtgggcgggagattcagatgttcttgctatgggtcagcacccatgcatggttttgccatttggttccaggtgacattccctgggggcgaatctgaaaaacccctcgtcctgtctactagccctttccatccagctacacattggaaacaggctctcctgtatttaaacgagcctgtacaggttgaacaagacaccgatgtgtcgggagagatcaccttgctcccatccagagataacccaagacgcctgcgggtgctactccgctataaagtgggagatcaggaggagaagaccaaggattttgctatggaggactag

SEQ ID NO: 201218 - DNA, 936 bp, Artificial Sequence
  Description of Artificial Sequence: Synthetic coding sequence
atggcccggagcggccggcggccctggagcgaccccggcggcctgagcggcgccgtgcaaagagccggaggtcccggcgctaggcctgccggtacctctggggattgtcgagtagccggtaccggaggttgccaccgcgaaagagtagatgggctccgtaccccggctagggttcacgcagagttgagacccccgagagccaaccaggtggccgaggggggccggtccagcccggcaggcctgcgtagagcactacacagcccccaccagcggcccgatgctggaatggcccctggactgctggaaccaggcgaggcagctctatggtgtggacacgaactgccaggtggcctccgacatgctcttagccacggaccactaggcgaccgctgtgcgggcatcgtgcgccgcggaagggccggtcccgccgctgccctttgcagcgcccgtgcattgccgaggcggctgggagcaggtgccggcgggcggtctggtagagcactacccctccaattgttgtggctgggtgcgcacgcctggctttgccatctcgtgccaggagacctgccttggcggggtgtgggagagactcccggggccgtgcacctggcgttttcacccggacacagcttggagacgggggcaccgctgcccgaacgagcaggagctagcggtgctcgccacgggaggttccgcagggatcatgccgccgcactgccggggcagcccccttcaccagccagggccgccgctctgcagtccggcaggccgggcggtgaggatcaaagactgtgccacgggggactaagcgtcgcttttagtccttcatacctccccaaacagcctgatctgcggggacgcggggttgcccggtccgagggaaagggtcgcagtcacgttcaggttggaggcatatcccctcctttcccatcctag

SEQ ID NO: 201219 - DNA, 2532 bp, Artificial Sequence
  Description of Artificial Sequence: Synthetic coding sequence
atggccaagcccctgaccgacagcgagaagcggaagcagatcagcgttaggggcttggccggtctaggggatgttgccgaggtcaggaagtcctttaaccgccacctccactttaccctagtaaaagaccgaaatgtcgcaaccccaagagactactttttcgcgttggcacatacagtccgcgatcacctggtagggcgctggattcgcactcagcagcactattacgaaagagatccgaagcggatctattacctgtccctcgagttctatatgggcaggactctccagaacaccatggtcaatttgggattgcagaatgcttgtgacgaagcaatctaccagctaggcttggacctggaggagctggaagagatcgaggaggatgccggcctgggcaacggcggtctgggtaggttggcagcctgctttttagatagcatggccacacttggcttggccgcgtacggttatggaataaggtatgagtttggaatttttaaccagaaaatcgtgaacggatggcaagttgaagaggccgacgactggctgcggtacggtaatccgtgggagaaagcacgccccgagtacatgctgccggtccatttttacgggcgagtggagcacactcctgacggcgtgaagtggctggacacacaagttgtgctggccatgccctacgacacgccagtgccggggtataagaacaacaccgttaataccatgcgcctctggtctgccaaagccccgaatgacttcaaactgcaagatttcaatgtgggggactatatcgaggcagttcttgaccgcaatctggccgagaacatttcacgcgtgctatatccgaatgacaacttcttcgaaggaaaggagttgcgactgaaacaggagtatttcgtcgtggccgcaactttacaagatattatcaggaggttcaagtctagcaagtttgggtgcagggatcctgtgagaacatgcttcgagaccttcccagacaaggtggccatacagttgaatgatacacatcctgcgctgagtatacctgaactgatgcggatcttggttgatgtcgaaaaggtcgattgggacaaagcgtgggagataacgaaaaagacgtgtgcttatacaaatcatacagtactgccggaagccctggagcgctggcctgttagcatgtttgaaaaactgctgccccgccacctcgagattatctacgctattaatcagcgtcatcttgaccatgttgccgcactgtttcctggagacgtggacagacttcgccggatgagcgtgatcgaagaaggtgattgcaaacgtatcaacatggcacatctttgcgtgatcggctctcatgctgtcaacggagttgcacgaatccattcggagatagtcaagcaatccgtgtttaaggatttctacgaactcgaacccgagaagttccaaaacaaaaccaatggcatcacacccagacgatggctgctgttgtgtaatcccggccttgccgacactattgtggaaaaaattggcgaagaatttttaacggatctgtcgcagctcaaaaagctcctccccctggtttccgacgaagtctttatccgtgatgtggccaaagtcaagcaggaaaataagctgaaattcagcgccttcctcgaaaaggagtacaaggtcaagatcaatcctagttccatgttcgatgtccacgtgaagagaatccacgagtataagcgacaactgttgaattgcctacacgtggtgacactttacaatcgcataaaacgtgaccctgccaaagcgtttgtgcccagaactgtgatgataggaggcaaagctgcccccggatatcacatggcaaagctaattataaagcttgtgacctcaattggtgacgtggtcaatcacgatccggtagtgggcgacaggctcaaagtgatttttttagagaactaccgtgtctccttggcagaaaaagtaattcccgcggctgacctcagccagcagatcagtactgctggtacggaggcctcgggtaccggcaacatgaagttcatgctgaatggagctctcacaattgggaccatggacggcgctaacgtagagatggctgaagaagcgggtgcagagaatttattcatcttcggtttgagagtggaggatgtcgaagccctagatagaaaaggctacaacgcccgcgaatattacgatcatctccccgagttaaagcaggctgttgatcagatctcttccggtttcttctcacccaaagagccagattgtttcaaggacatagtaaacatgttgatgcatcacgacaggtttaaggtcttcgccgattatgaggcctatatgcaatgtcaggcacaagtggaccagctgtaccgaaaccctaaagaatggaccaagaaggtaatcagaaatatcgcctgctccggtaaattttcctctgatagaacaatcaccgaatacgcccgcgaaatctggggcgttgagcctagtgacctgcaaataccgccgcccaacattcctagagattag

SEQ ID NO: 201220 - DNA, 717 bp, Artificial Sequence
  Description of Artificial Sequence: Synthetic coding sequence
atgctgaccaccctgctgcccatcctgctgctgagcggctgggccttctgcagtcaggatgccagtgatggcctacagcgcctgcatatgcttcaaatctcctactttagggacccttaccacgtatggtaccagggaaatgcatctctagggggtcatctgacccatgtcctggagggcccggacaccaacaccactattatccagctccagccgctgcaggaacctgaatcttgggcgcgcacgcagagcggattgcagtcctacctgttgcagttccacggccttgtcaggcttgtgcaccaggagaggacactggcctttcctctgaccattagatgtttccttggttgtgagctgccgccagagggctctcgggcgcatgtcttcttcgaggtggcggtgaacggatcttccttcgtctccttccggccagagagagcactgtggcaagccgatactcaggtaacttccggggtcgtaacttttaccctgcagcagctcaacgcatacaatagaacacgttatgagctacgggagtttctggaggacacctgtgtgcagtatgtgcagaaacatatttccgcggaaaataccaagggttcccagacctcccgaagctatacatcactggtgctgggcgtcctagtgggtagctttattatagctggcgtggccgtgggaatctttctatgcaccggcggtaggcgttgctag

SEQ ID NO: 201221 - DNA, 4551 bp, Artificial Sequence
  Description of Artificial Sequence: Synthetic coding sequence
atggacaaccagcaggacaaggccatcgtggccagcgccaacggcgagaacaccctgatcaacggcgtgaaagaaaacgactcagaggaccaggacgtggctatgaagtcatttgcagcccttgaagcagcggccccaatccagcccacaccggtggctcagaaggaaacactcatgtatccacgtggactcctgccgttgccttctaagaaaccttgtatgcagagtccacccagcccgctcgggctgattgaggcccctgagcatgccgccaactccgcctctgtgaatgctatcagcctaacatcggggatcgcaaaggggctgaacacctggagccttcctaacgaatgcgagaaggctccattcgccataatggagcccgctggaatgagtgcgttaaatggggattgtcttatgcagccatcaagaacatgccttggatgcttcatggaatccaaggatgccgtggatccagagcccggcataagcctgaaagttggtgatctgaatagggattatgagacctgtgccgtgtccgacattggcatccagtgcattaatgcgggtgaaaatatgaaatacggggaacaattgttgagcgaccagcttcttggcttccctctgcacaaatcaagagccggcgaccgtcgggagactgagaaacctgatatcgatcttgaagaccccgcccagaagagctattacgaggccctgttactggataaatgtaataccgaggaagccctgctagcaaattccaaccaggactggggttattttgagactttcatcagcgaatcgaaaatcgagcttttagatttgtgtagtaaaaatgaactgagcgtgaacctgttttcagaagaagatgtcgacaactatatgtttgatgacgacgaatctaccctcggatccgatgtttgcagcttaaagatccgatacgagtcatttcaagacaacgtgcgggacaagacgacactgctcatgcaggaagatgctcagtttaatttttttccgagcgtcttcacaacctgcccgaagagagagtccaagtctggggccctgaaacaatcatctgacttctctcagttcaaagtgccagacgtgtccattatttggggggaggaagataagaacttagacaagaaaaagggtaaggaggagggacaggaggataagggggtggagaagaaagacggcaaagataatggcgaaaaacccgctcttaacaaaccctgctcaggtaccgaggtcgagcagctaaagaatcccaaacaagggcatttagccaatagtcttgagaccagtgggagcttcagcgacgattcctcttttatagaaatctcctacgacgccatgggcgagattaaagactgctcgcgctacatggcccgtgatacaaattccggatcaagctcctcacaacagaactacggtctgagggcgaaaagaaaggtgagatactcagaggactacctgtatgatgtggattccctcgaaggggaaaaagtaaatgaaagaaaggagtggttacccgttggaagtaaagaggaggatgacgacgaatggtgtcccaagaagcgacgcaaggtgacgaggaaggaacctccagtgataatcaagtacataattatcaacaggtttaaaggggaaaagaacatgctcgtgaagctggggaaagtggacgcgagcgagaccaccgtgaatctgtcagagaaccagctgaacaaatacgcaaagctggcgccactgaaagggttctggcagaagaagaagaagcaaagaaacaccaataccgatagtatcaaaacccccttctcgcaaaagcagagcttcgaaccaggctccttcgaagtatccttccttccccccgcgcgcaaaaggaaaagtaagctcggcaaccgccaccggatacagaggatcccatccatcgaaatcagcgcatcgtcaaagcagatctctttgtgtaatgaccagcgacatgcctccaaccacaaagaagatgggggtctgaaaggcactctgaaatccgctccccttggggcccctagttgcgccaatggttctcacttgaacgacattactggacctgattcggtgaaagtgaaggcccaggatacagagtttaagggccccgagaggaaggtgctcaacaagataaagttcaagagtgaggctcgactcaaaagtaagaaagttaaggcagccggtcaggagtcgaagcctatcgttcaaatgtctccacttctggaaaatcaaagcagcaaggctaatctcaaaaatgaggtgatccccggtacttctaatagtagtcgactttcagagttccacgaagcaaaagccgcgaaatcctcaacgttcctgccaactacctgttcctctgagatgcccctgtcatcagcaaatgtgacaacaaacatccctgtgatccccggcggttaccttcagaccctgttagacgctagcgatttaagcaacaatacaagtatatcttatttttcccaccattcaccggaacagaatgagggctcactgacacagacagaaaaatcgtttgtgccccttcaacctacacaggactgcgtcctgactagctcatctgactctgagttacagcagagctcccataatttcaagatggaatcctctaactacagaaacgtctggcctaataaggccacctcaggaacccaggagtttatggccgaagtgtcccgagaaattgcacccactcagagcagcgaattcggggcctcccaggtggtcagcatggagaacaacctcaccccaacaacatacaatccaatttgtctgaactctggagggtccaactgtaataaggttttgtacgactccatgcaagacacgcagcttccctccgacgactcctaccagttatgtcactttaacaacggtgagatttgttttccattccagcaaggtcctgttaatatggacgatggccggttgttcagcttcgactccatggccccactgagcgtatcttcgtcaaactactgttccctatccctgaaatcatgcgaaaaggatggggatgatgacatcaccgatgattttctggctcactgctctcccaagctggtgatccaacagagcattgatgagattgcccccctaaaggaaagcacagacctgctggacatcagcaactttacaccggacaaatttcggcacagcagtctgtccgagatgtcgccaccagacacgccctccctgagtcctcagatcaccagatgtgagtctatgaagacgctggggaccctcaagggattccaggaaggggtgcccggccctctcgatagcgttgagaagattaaatgggactgttctactttaagccgacaggttcagatggaagatggcttcactctgaacaatcaccagtttcagtttcacatgttcaacgatgaagattccgttagcttgctccagaaaaatccttgcctgtccaccttcaacgatccctcagggcaaatttctacaaacaacaaggtctccaagtctagaaaaaaatcctcacccagcaaatccggggccatgaaccaatcttcttcgcaaaagaacaccagaaagaagtctttgaaaggcaataataaggggatagagaaaccgcctggaaagaacagtcgacaggtccccaagtccacaaagaagggaaagtacatggcagcaataaatggcgagaagatgcagatcggaattgggcggggaggttcacagaccaatacaatctctagcacggggaaaacactcgccgagtgtattcagcatggcgggccaatggcaagtatgaaaatgccttctcagaaagggctgtccggggactgggccctcgggaaggagtcaagccctggctggtctgatatgtctatgggcacaaacaccaattccctcctggacgatgatcagcgggaatttcaggagccatcatacatcctgtctaatatcgcctcaggcatggccgatgtacagaggttcatgatggcatcgatcgagcccctctgggagccgatggaacaccacggggatcccaacatattctattcaccagaaagcaacagtcttaaattgaagacccttaaaattctagcaggcaccccccaagaatcgaagaaaaaaattaactcaggtagtcagggagcgacgaagaaccacagaagcatcaagggggtgtcaaaatctaacggaaaaacagccatcggcgacccaggtcgcgcgaacatgcccggatataacgaagattcccgaagcactttcttcgataagaaatatagcaacatgtctaccctcggtaacaatgggccaacccataaaaaactataccggcataaaagttcaagtaaggcactgcgggatgagaaatgcaaagggaagcacatggaacgagagcaggtgcacaaagacgaatcaggcactgcgagctttgagaagttgagagacagtgactacaatctcctgaaggcagaaaccacattttgggtcctgcccgtgtttgaggaagaaacgaggatattccagaaggatatttag

SEQ ID NO: 201222 - DNA, 1008 bp, Artificial Sequence
  Description of Artificial Sequence: Synthetic coding sequence
atgtgggccaccctgcccctgctgtgcgccggcgcctggctgctgggagttccagtatgtggggccgcggaactttgtgtgaacagcctggagaaatttcattttaaatcatggatgtccaagcatcggaagacctactctaccgaggaatatcatcaccgcttacagacatttgcatccaattggagaaaaatcaacgcgcacaacaacgggaaccacaccttcaaaatggcacttaatcagttctctgatatgtcttttgcagaaataaaacataagtatctgtggtcagaaccccaaaactgttctgctacaaagtctaattatttacgcggcaccggaccgtatcccccatcagtggattggcgtaaaaagggcaactttgtctctcctgtgaaaaaccagggtgcatgcgggtcttgttggactttcagcactaccggagcactggaatctgctattgctattgccacaggcaaaatgcttagcctcgccgagcaacagttagtagactgtgcccaggattttaacaatcatgggtgccaggggggactgccatcccaggcatttgagtatatcctttataacaaggggattatgggagaagacacatatccgtatcagggcaaagatggctactgtaagttccagcctggcaaggcaattggctttgtgaaggatgtcgcaaatataacaatctacgacgaggaggctatggtggaggcagttgctctttataatccggtcagcttcgccttcgaggttacccaggattttatgatgtatcgcactggcatttattctagcacctcgtgccataaaacccctgataaggttaatcatgcagtgttagcagtaggatacggggagaagaatggaattccctactggatagtaaagaactcttggggaccgcaatggggcatgaacggatatttcctcattgagcggggaaagaatatgtgtggattggctgcatgcgcatcttatccgattccgctggtctag

SEQ ID NO: 201223 - DNA, 5655 bp, Artificial Sequence
  Description of Artificial Sequence: Synthetic coding sequence
atgcactgcaccaaccccgccctgatcttcctgatcgacgagctgtccccggagcaacataatctgtcgctgtactcaatggaactagtgctgaaaaaatcgaccggccattccgcggcccaagtagctctgacagaaaccgctccgggatcccagcatagctctcccctgcacgtgacggcacctccatctgctaccacctttgacacagcgttttttaaccaggggaaacagactaagagcactgccgatccgtccatatttgttgccacctatgtctcggtgaccagtaaggaggtcgccgtcaatgacgacgaaatggacaatttcctgccagacacacattggacgactcctaggatggtatctccaatccagtatataacggtgtcgccacccggcctgccacgcgaagccttggagcccatgctgacgccaagcttgcccatggtgtctctgcaggacgaggaggtgacttcaggctggcagaacaccacccggcagccagctgcctatgccgaatcagcctctcacttccatactttcagaagcgcattccgcacatccgagggaatcgttcctactccagggaggaatctggttctgtatcctactgatgcttattcccatttaagctccaggaccctgccagagattgtggcttctctgaccgaaggagttgagactaccctcttcctttcctcccgaagcctaatgccacagccactgggagacggcataaccatccctctgccgtctctgggggaggtctctcagcctcccgaggaggtgtgggccaccagcgccgatagatacaccgatgtgacaacagtgttgtctcagagtctcgaggaaacaataagcccccgcacgtaccccactgtgaccgctagccatgctgcgttagccttctcccgtacccacagtccactgctgtccactcctctggcatttgctagcagcgcctctccgacggacgtctccagtaatccgttcctccccagtgacagctctaaaacatctgaactccactctaactccgcactccccgggccggtggataacactcacattctctcccccgtttcttcattccggccttacacctggtgtgccgcctgcaccgtaccaagcccacagcaggtcctggctacgtccctcatggaaaaagacgttggctctggagacggagcagagaccctgtgcatgacggtgctggaggaatcatccattagcttgatgtcatcagtggtggccgacttcagcgagtttgaagaagatccacaggtcttcaacaccctgttcccaagcaggcccattgtccccctaagctctaggagcatggaaatcagcgaaacatcagtgggaataagcgccgaagtggacatgtcatccgttacgacaactcaggtccccccagctcacgggaggctgtccgtgcccgcctctcttgatcctacagcagggagtctctctgtggccgagactcaggtaacaccatcaagcgttacaacagccttttttagcgttatcacatcaattttactggactcctccttctctgtgatagctaacaagaacaccccaagcctagccgtaagggacccatctgtgtttactccctactctctggtgccaagcgtggagagttccctcttttccgaccaggagaggtcctccttctctgagcacaagccgaggggagccttagactttgcttcctcatttttctcgacgcccccactagaactgtctgggagcatctcgtccccgtccgaagctcccgcatccttaagcctaatgcctagcgacctgtctccatttactagccagtcattcagccctcttgtagagacatttaccctcttcgacagcagcgacctccagagctcccagttgtctctgccttcctccacaaacctggagttcagtcagctccaaccctccagtgaactccctttgaatacaatcatgctcctcccctcacgatcagaggttagtccttggtcaagctttcccagcgattctttggaattcgtggaagctagcacggtgtccctcactgattcggaagctcatttcactagcgcgttcatcgagactacaagctatctagaaagctcactgatttcccatgaatcagccgtgaccgccctagtgcctccagggtctgagagtttcgacatccttaccgccggaatacaggccaccagcccactcacgacagtgcacacaacacctattcttacagagagctccctcttttccacgctgacgccccctgacgaccagattagtgctctcgatgggcacgtttctgttttggcctctttcagcaaggctatccctacaggcacagtcctaattaccgacgcatatctcccctctggcagcagcttcgtaagtgaggccacacccttccccctccccactgaattaaccgtcgtaggaccatcgctaacgccaacagaggttccacttaatacatctaccgaggtaagtaccaccagcaccggagctgctactggtgggccattggactcgacactcatgggtgatgctgcatcccagagccctcccgaaagtagtgccgcccctccgctgccctctctgcggccggtgactgcatttaccctggaggcaactgtggacactccaacactagccaccgccaagcccccctacgtatgtgacattacagtccctgacgcctatcttatcactacagtgcttgctcgccgggccgtccaggagtacatcatcacggcaatcaaggaagtgctgagaatccactttaaccgcgccgtggaactcaaagtgtatgagctctttaccgatttcacttttctcgtaacgtccggaccatttgtatataccgccatttctgttataaacgtattaattaacagcaaactggttagagatcagacgcccctcattttgagcgtcaaaccttcttttcttgtccccgagagtcgtttccaggttcaaaccgtgctccagtttgtgcctccctcagtagacacaggtttttgtaacttcacacaaaggatcgagaaaggcctcatgacggcactgtttgaggtgcgcaaacaccatcagggcacctataatttgaccgtgcaaatcctgaatataacaatatctagctcccgagtgacaccccggagaggcccagtgaacataatttttgctgtcaaaagtactcaaggtttcttaaacgggagcgaagtgagtgagctgcttcggaacctctctgtagtcgagttctccttttacctgggttatccggttctgcaaattgctgaacctttccagtacccacaactgaatctgagccagctgctgaagtcctcttgggttcgaactgtgctgctgggagtgatggagaagcaacttcagaacgaagtgtttcaagccgaaatggagaggaagttggcccaactcctaagcgaagtgtccacacgacggcgaatgtggcgacgcgcgaccgttgcagccggcaattccgtcgtgcaggtcgttaatgtctcacggcttgagggggacgacaatccagtccaactgatctacttcgtggaggatcaggacggagaaaggttaagtgcagtgaaatcgagtgatctgatcaacaaaatggatctgcagcgcgccgcaatcatattaggatatcggatacagggcgtaatcgctcagcctgtggacagggtaaagaggcctagcccagaatcacaatccaataacctgtgggtgatcgttggcgtggtgatccctgtactcgtggtaatggtcatagtggtgatcctttactggaagctttgccgaacagataaactggacttccaaccagacacagtcgctaacatccaacagcgtcaaaagctccagatcccatcggtgaaaggcttcgactttgccaagcaacacctgggccaacacaataaagatgacatcctgataatccatgaaccggcaccattgcccggtcctctgaaggatcacacaacccctagcgagaacggcgacgtgccatcacctaagtctaagatcccatcaaagaacgtcagacaccgaggcagagttagtcccagtgacgccgatagcactgtgtctgaagaatcatcggagagggatgctggggacaaaactccaggcgccgtaaacgatggtagaagtcatagagcaccacaatccggacctccgctgccctcgtccgggaacgagcagcactccagcgcctccatcttcgagcatgtggatagaatctctagaccacctgaagccagtcgacgcgtaccatcaaaaatacagctgatcgccatgcagccaatccctgctccgcccgttcagagaccatctccagccgatcgcgtggccgagagtaacaagattaataaggagatccagacagccctcagacacaagtccgagatagagcaccataggaacaaaatccgtctgcgggcaaaaagaagggggcattacgaatttcctgtggtcgatgacttgtcctcaggggacaccaaggagcggcatagggtgtacaggagagcccaaatgcagattgataaaattttagaccccactgcttcggtgcccagcgttttcatagagccacggaaaagctcccgcattaagcgcagtcctaaacctcgccgcaagcaccaggtgaatggatgtccggccgatgcagagaaagacaggctgatcactactgacagtgatggtacatacaggcggccccccggtgtccacaacagcgcctacattggctgtccctccgaccccgacctgcccgccgatgtgcagacgccttcttcggtggagttgggcaggtaccccgcattgccatttccagcctcacagtatatccccccccagcctagcatcgaggaagcccgccagactatgcattccctcctcgacgacgcttttgcgttagtcgcaccatcatctcagcccgcctccaccgctggcgtgggcccgggggtgccccctggactgcctgctaactcaactcccagtcaagaagaacgaagggcaacgcaatggggctccttttattccccagcccaaaccgcgaataatccttgtagcaggtacgaggattacggaatgacccccccaaccggtccactgcccagacctggattcggtcccggcctcctgcagagcacggagttggtaccccccgatccccaacaaccacaggcgagcgcagaagcgccttttgccgctaggggtatctactccgaggagatgccatctgtggcccggcctaggcccgtgggaggcactaccggttctcagatccagcatctgacccaggtggggatagccagcaggatcggggctcaacctgtggaaattccaccttccagaggatctcagtatgggggcccaggctggccttcttacggcgaagatgaggcgggccgaagagaggctgtaccaaggacaagtgggcgtgagcctagtgccccttcaggcaacctcccacataggggtctgcagggtcctgggcttggctacccgacaagtagtaccgaagaccttcagcctggacactccagtgcatccctgatcaaagctattagagaggagctgctgcggttgtctcaaaagcagagtacggttcagaactttcattcctag

SEQ ID NO: 201224 - DNA, 1236 bp, Artificial Sequence
  Description of Artificial Sequence: Synthetic coding sequence
atggagacccccgaggtgcccgtgggcagcctgatcgacttcggccctgaggctcccacctccagcccacttgaagcgccgcccccggtgcttcaggacggcgatggcagtttaggcgacggagctagcgaatcagagacaaccgaatccgccgattcagaaaatgatatgggcgaatcgccatcccatccaagctgggatcaagatcgacggagttcatctaacgagagcttttcgagtaatcagtcgaccgagagcactcaagatgaagaaactttagctctgagagactttatgaggggctatgtggaaaaaattttcagtggtggtgaggacctcgaccaagaggagaaggctaaatttggagagtattgtagcagtgagaacgggaaggggagagagtggtttgcccgatatgtgagcgctcaacgatgcaacagtaagtgcgtgtcagaggcaaccttctaccgactggttcagagcttcgcggtagtgctcttcgagtgccaccagatggacgattttggtccagcaaagaacttgatgactatgtgctttacctactaccacattggaaaaccccagctgctgccaccagaaagtcgggaaaagcccgccgggagtattgactcttacctcaagagtgccaactcctggttggcggagaaaaaggacattgctgagcgattgctgaaaaatacaagtgctcgcacggaaaatgtgaaaggcttcttcggtggacttgagacaaaactgaagggccccctggcgcggagaaacgaggaggacgaaaacaagccacaggaaaagcgtccgagagcggtcactgcctacagccccgaagacgagaaaaagggcgagaagatatacctgtacacacatctcaagcagcagccaatctggcacacacttcgcttttggaacgccgccttcttcgatgcagtgcactgtgaacggacgaaaaggagtcctactacgagaggggacgccggggaggaagaggaaaagcgtgagaaatggtgccatatgactcaagaggagagagatgacagccttagattcaatgaaaatatcacattcggccagctgggaactttcacgcacaatatgctggcctttggcttgaataagaaattgtgcaacgactttttgaagaaacaggctgtgatcgggaacttggacgaagagcagtataagctgcttagcgatcatattgagcagatggccactgaatag
